United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 32

SEQ ID NO: 1152738 - RNA, 19 nt, Mycobacterium bovis subsp bovis AF2122/97
gaccugcgcgagguuggcg

SEQ ID NO: 1152739 - RNA, 18 nt, Mycobacterium bovis subsp bovis AF2122/97
gaccugugcggccgacgg

SEQ ID NO: 1152740 - RNA, 18 nt, Mycobacterium bovis subsp bovis AF2122/97
gaccuguagaucagcagc

SEQ ID NO: 1152741 - RNA, 16 nt, Mycobacterium bovis subsp bovis AF2122/97
gaccuguaugccgcgg

SEQ ID NO: 1152742 - RNA, 13 nt, Mycobacterium bovis subsp bovis AF2122/97
gaccuguccggca

SEQ ID NO: 1152743 - RNA, 13 nt, Mycobacterium bovis subsp bovis AF2122/97
gaccuguccggua

SEQ ID NO: 1152744 - RNA, 20 nt, Mycobacterium bovis subsp bovis AF2122/97
gaccugguucccgacgucgg

SEQ ID NO: 1152745 - RNA, 21 nt, Mycobacterium bovis subsp bovis AF2122/97
gaccugguucccgacgucggc

SEQ ID NO: 1152746 - RNA, 16 nt, Mycobacterium bovis subsp bovis AF2122/97
gaccuguccggugauc

SEQ ID NO: 1152747 - RNA, 19 nt, Mycobacterium bovis subsp bovis AF2122/97
gaccgcuaugaugccgccg

SEQ ID NO: 1152748 - RNA, 21 nt, Mycobacterium bovis subsp bovis AF2122/97
gaccgcuaugaugccgccggu

SEQ ID NO: 1152749 - RNA, 16 nt, Mycobacterium bovis subsp bovis AF2122/97
gaccggcgccguagcc

SEQ ID NO: 1152750 - RNA, 20 nt, Mycobacterium bovis subsp bovis AF2122/97
gaccggcgccguagccgauc

SEQ ID NO: 1152751 - RNA, 13 nt, Mycobacterium bovis subsp bovis AF2122/97
aacggcagcacgg

SEQ ID NO: 1152752 - RNA, 23 nt, Mycobacterium bovis subsp bovis AF2122/97
aacggccacaugccacagcggcg

SEQ ID NO: 1152753 - RNA, 14 nt, Mycobacterium bovis subsp bovis AF2122/97
gaccugcaagacgc

SEQ ID NO: 1152754 - RNA, 15 nt, Mycobacterium bovis subsp bovis AF2122/97
gaccugcaagacgcc

SEQ ID NO: 1152755 - RNA, 22 nt, Mycobacterium bovis subsp bovis AF2122/97
aacggccgacuuggugaccccg

SEQ ID NO: 1152756 - RNA, 20 nt, Mycobacterium bovis subsp bovis AF2122/97
gaccugauggcgcugcaccg

SEQ ID NO: 1152757 - RNA, 23 nt, Mycobacterium bovis subsp bovis AF2122/97
gaccugauggcgcugcaccguag

SEQ ID NO: 1152758 - RNA, 17 nt, Mycobacterium bovis subsp bovis AF2122/97
gacgaaggucuccggca

SEQ ID NO: 1152759 - RNA, 20 nt, Mycobacterium bovis subsp bovis AF2122/97
gacgaaggucuccggcaagc

SEQ ID NO: 1152760 - RNA, 22 nt, Mycobacterium bovis subsp bovis AF2122/97
gacgaaggauucgaagccgagc

SEQ ID NO: 1152761 - RNA, 18 nt, Mycobacterium bovis subsp bovis AF2122/97
gacgaaucccgcgcccgg

SEQ ID NO: 1152762 - RNA, 17 nt, Mycobacterium bovis subsp bovis AF2122/97
gacgaaucgccuaccgg

SEQ ID NO: 1152763 - RNA, 17 nt, Mycobacterium bovis subsp bovis AF2122/97
gacgaauugguugcccu

SEQ ID NO: 1152764 - RNA, 16 nt, Mycobacterium bovis subsp bovis AF2122/97
gacgacaaacggcgac

SEQ ID NO: 1152765 - RNA, 14 nt, Mycobacterium bovis subsp bovis AF2122/97
gaccuuggcgucga

SEQ ID NO: 1152766 - RNA, 22 nt, Mycobacterium bovis subsp bovis AF2122/97
gaccuucucgccgccgcuguug

SEQ ID NO: 1152767 - RNA, 15 nt, Mycobacterium bovis subsp bovis AF2122/97
gaccuugcaccggcc

SEQ ID NO: 1152768 - RNA, 19 nt, Mycobacterium bovis subsp bovis AF2122/97
gaccuucgaguagggccau

SEQ ID NO: 1152769 - RNA, 22 nt, Mycobacterium bovis subsp bovis AF2122/97
gaccuucgcuauggcggcuucg

SEQ ID NO: 1152770 - RNA, 23 nt, Mycobacterium bovis subsp bovis AF2122/97
gaccuucgcuauggcggcuucga

SEQ ID NO: 1152771 - RNA, 15 nt, Mycobacterium bovis subsp bovis AF2122/97
gaccuucaugccgga

SEQ ID NO: 1152772 - RNA, 23 nt, Mycobacterium bovis subsp bovis AF2122/97
gaccuucaugccggacugcgauc

SEQ ID NO: 1152773 - RNA, 12 nt, Mycobacterium bovis subsp bovis AF2122/97
gaccugucggua

SEQ ID NO: 1152774 - RNA, 15 nt, Mycobacterium bovis subsp bovis AF2122/97
gaccugucgguaccg

SEQ ID NO: 1152775 - RNA, 19 nt, Mycobacterium bovis subsp bovis AF2122/97
gacgcggggcucaaccccg

SEQ ID NO: 1152776 - RNA, 15 nt, Mycobacterium bovis subsp bovis AF2122/97
gacgcgggucuuggc

SEQ ID NO: 1152777 - RNA, 19 nt, Mycobacterium bovis subsp bovis AF2122/97
gacgcgggcuaucgguuca

SEQ ID NO: 1152778 - RNA, 15 nt, Mycobacterium bovis subsp bovis AF2122/97
gacgcgggccgacca

SEQ ID NO: 1152779 - RNA, 13 nt, Mycobacterium bovis subsp bovis AF2122/97
gacgcgggccgcg

SEQ ID NO: 1152780 - RNA, 15 nt, Mycobacterium bovis subsp bovis AF2122/97
gacgcgggccgcgaa

SEQ ID NO: 1152781 - RNA, 16 nt, Mycobacterium bovis subsp bovis AF2122/97
gacgcgggccgcgaaa

SEQ ID NO: 1152782 - RNA, 14 nt, Mycobacterium bovis subsp bovis AF2122/97
gacgcggucgacga

SEQ ID NO: 1152783 - RNA, 20 nt, Mycobacterium bovis subsp bovis AF2122/97
gacgcgguccucgagccgau

SEQ ID NO: 1152784 - RNA, 14 nt, Mycobacterium bovis subsp bovis AF2122/97
gacgcguccggugc

SEQ ID NO: 1152785 - RNA, 14 nt, Mycobacterium bovis subsp bovis AF2122/97
gacgcgucagcggc

SEQ ID NO: 1152786 - RNA, 18 nt, Mycobacterium bovis subsp bovis AF2122/97
gacgcgucagcggcgagc

SEQ ID NO: 1152787 - RNA, 17 nt, Mycobacterium bovis subsp bovis AF2122/97
gacgcgggccgcgaaac

SEQ ID NO: 1152788 - RNA, 14 nt, Mycobacterium bovis subsp bovis AF2122/97
gacgcuaccgccgg

SEQ ID NO: 1152789 - RNA, 15 nt, Mycobacterium bovis subsp bovis AF2122/97
gacgcuaccgccgga

SEQ ID NO: 1152790 - RNA, 19 nt, Mycobacterium bovis subsp bovis AF2122/97
gacgcgucagcggcgagca

SEQ ID NO: 1152791 - RNA, 17 nt, Mycobacterium bovis subsp bovis AF2122/97
gacgcguugcucgaaac

SEQ ID NO: 1152792 - RNA, 20 nt, Mycobacterium bovis subsp bovis AF2122/97
gacgcguucaacaccgccga

SEQ ID NO: 1152793 - RNA, 16 nt, Mycobacterium bovis subsp bovis AF2122/97
gacgcuaacgucgauc

SEQ ID NO: 1152794 - RNA, 18 nt, Mycobacterium bovis subsp bovis AF2122/97
gacgcuaacgucgaucuc

SEQ ID NO: 1152795 - RNA, 20 nt, Mycobacterium bovis subsp bovis AF2122/97
gacgcuaaagcccccgcacg

SEQ ID NO: 1152796 - RNA, 18 nt, Mycobacterium bovis subsp bovis AF2122/97
gacgcgcggccagcccac

SEQ ID NO: 1152797 - RNA, 22 nt, Mycobacterium bovis subsp bovis AF2122/97
gacgcgcgcuugggguugggcg

SEQ ID NO: 1152798 - RNA, 13 nt, Mycobacterium bovis subsp bovis AF2122/97
gacgcgcggccag

SEQ ID NO: 1152799 - RNA, 14 nt, Mycobacterium bovis subsp bovis AF2122/97
gacgcgcggccagc

SEQ ID NO: 1152800 - RNA, 15 nt, Mycobacterium bovis subsp bovis AF2122/97
gacgcgcggccagcc

SEQ ID NO: 1152801 - RNA, 13 nt, Mycobacterium bovis subsp bovis AF2122/97
gacgcgcucgcgc

SEQ ID NO: 1152802 - RNA, 18 nt, Mycobacterium bovis subsp bovis AF2122/97
gacgcggaaucgcaccgu

SEQ ID NO: 1152803 - RNA, 16 nt, Mycobacterium bovis subsp bovis AF2122/97
gacgcggccagcggca

SEQ ID NO: 1152804 - RNA, 12 nt, Mycobacterium bovis subsp bovis AF2122/97
gacgcggccgag

SEQ ID NO: 1152805 - RNA, 15 nt, Mycobacterium bovis subsp bovis AF2122/97
gacgcggcaggccgg

SEQ ID NO: 1152806 - RNA, 22 nt, Mycobacterium bovis subsp bovis AF2122/97
gacgcggccaaauaacgcggga

SEQ ID NO: 1152807 - RNA, 13 nt, Mycobacterium bovis subsp bovis AF2122/97
gacgcggccgggc

SEQ ID NO: 1152808 - RNA, 16 nt, Mycobacterium bovis subsp bovis AF2122/97
gacgcggcgaccgucg

SEQ ID NO: 1152809 - RNA, 17 nt, Mycobacterium bovis subsp bovis AF2122/97
gacgcggcgaccgucga

SEQ ID NO: 1152810 - RNA, 16 nt, Mycobacterium bovis subsp bovis AF2122/97
gacgcggcgccgccau

SEQ ID NO: 1152811 - RNA, 15 nt, Mycobacterium bovis subsp bovis AF2122/97
gacgcgacucggcgg

SEQ ID NO: 1152812 - RNA, 18 nt, Mycobacterium bovis subsp bovis AF2122/97
gacgcgaucuguccgcga

SEQ ID NO: 1152813 - RNA, 18 nt, Mycobacterium bovis subsp bovis AF2122/97
gacgcgaugaccgcaccg

SEQ ID NO: 1152814 - RNA, 13 nt, Mycobacterium bovis subsp bovis AF2122/97
gacgcgcccgacg

SEQ ID NO: 1152815 - RNA, 20 nt, Mycobacterium bovis subsp bovis AF2122/97
gacgcgccgguucagacggu

SEQ ID NO: 1152816 - RNA, 18 nt, Mycobacterium bovis subsp bovis AF2122/97
gacgcgcauucgccgggc

SEQ ID NO: 1152817 - RNA, 14 nt, Mycobacterium bovis subsp bovis AF2122/97
gacgcucggucgcc

SEQ ID NO: 1152818 - RNA, 16 nt, Mycobacterium bovis subsp bovis AF2122/97
gacgcuccaguggcgc

SEQ ID NO: 1152819 - RNA, 19 nt, Mycobacterium bovis subsp bovis AF2122/97
gacgcucggucgccaccgc

SEQ ID NO: 1152820 - RNA, 23 nt, Mycobacterium bovis subsp bovis AF2122/97
gacgcucggucgccaccgccggc

SEQ ID NO: 1152821 - RNA, 14 nt, Mycobacterium bovis subsp bovis AF2122/97
gacgcugccgguca

SEQ ID NO: 1152822 - RNA, 12 nt, Mycobacterium bovis subsp bovis AF2122/97
gacgcugccgca

SEQ ID NO: 1152823 - RNA, 18 nt, Mycobacterium bovis subsp bovis AF2122/97
gacggagguguggucgag

SEQ ID NO: 1152824 - RNA, 20 nt, Mycobacterium bovis subsp bovis AF2122/97
gacggaccaucuccggugug

SEQ ID NO: 1152825 - RNA, 15 nt, Mycobacterium bovis subsp bovis AF2122/97
gacggaaucgucggc

SEQ ID NO: 1152826 - RNA, 17 nt, Mycobacterium bovis subsp bovis AF2122/97
gacggaaucgucggcgc

SEQ ID NO: 1152827 - RNA, 17 nt, Mycobacterium bovis subsp bovis AF2122/97
gacggaaugucagccgg

SEQ ID NO: 1152828 - RNA, 20 nt, Mycobacterium bovis subsp bovis AF2122/97
gacggaauucgguuggcucg

SEQ ID NO: 1152829 - RNA, 16 nt, Mycobacterium bovis subsp bovis AF2122/97
gacgcuguggcucgac

SEQ ID NO: 1152830 - RNA, 17 nt, Mycobacterium bovis subsp bovis AF2122/97
gacgcuguggcucgacg

SEQ ID NO: 1152831 - RNA, 18 nt, Mycobacterium bovis subsp bovis AF2122/97
gacgcuguggcucgacga

SEQ ID NO: 1152832 - RNA, 22 nt, Mycobacterium bovis subsp bovis AF2122/97
gacgcugugggcuuugccgucg

SEQ ID NO: 1152833 - RNA, 20 nt, Mycobacterium bovis subsp bovis AF2122/97
gacgcuuggguagccugacc

SEQ ID NO: 1152834 - RNA, 20 nt, Mycobacterium bovis subsp bovis AF2122/97
gacgcuuuccgccgcaccgg

SEQ ID NO: 1152835 - RNA, 16 nt, Mycobacterium bovis subsp bovis AF2122/97
gacgcugggcgguagc

SEQ ID NO: 1152836 - RNA, 23 nt, Mycobacterium bovis subsp bovis AF2122/97
gacgcuggcgguguagccgcggu

SEQ ID NO: 1152837 - RNA, 13 nt, Mycobacterium bovis subsp bovis AF2122/97
gacgcuggucggc

SEQ ID NO: 1152838 - RNA, 14 nt, Mycobacterium bovis subsp bovis AF2122/97
gacggcccgccguc

SEQ ID NO: 1152839 - RNA, 15 nt, Mycobacterium bovis subsp bovis AF2122/97
gacggccgcggcguc

SEQ ID NO: 1152840 - RNA, 14 nt, Mycobacterium bovis subsp bovis AF2122/97
gacggccgcucggg

SEQ ID NO: 1152841 - RNA, 19 nt, Mycobacterium bovis subsp bovis AF2122/97
gacggccgcucgggccagc

SEQ ID NO: 1152842 - RNA, 14 nt, Mycobacterium bovis subsp bovis AF2122/97
gacggccgccagca

SEQ ID NO: 1152843 - RNA, 16 nt, Mycobacterium bovis subsp bovis AF2122/97
gacggccgccagcagc

SEQ ID NO: 1152844 - RNA, 17 nt, Mycobacterium bovis subsp bovis AF2122/97
gacggccggcggucggg

SEQ ID NO: 1152845 - RNA, 15 nt, Mycobacterium bovis subsp bovis AF2122/97
gacggccagcccagc

SEQ ID NO: 1152846 - RNA, 17 nt, Mycobacterium bovis subsp bovis AF2122/97
gacggccauggacgcca

SEQ ID NO: 1152847 - RNA, 15 nt, Mycobacterium bovis subsp bovis AF2122/97
gacggccaggugcag

SEQ ID NO: 1152848 - RNA, 22 nt, Mycobacterium bovis subsp bovis AF2122/97
gacggccaguugguagccgccc

SEQ ID NO: 1152849 - RNA, 23 nt, Mycobacterium bovis subsp bovis AF2122/97
gacggccaguugguagccgcccu

SEQ ID NO: 1152850 - RNA, 20 nt, Mycobacterium bovis subsp bovis AF2122/97
gacggcauguaccgaccgcg

SEQ ID NO: 1152851 - RNA, 12 nt, Mycobacterium bovis subsp bovis AF2122/97
gacggccaccgg

SEQ ID NO: 1152852 - RNA, 15 nt, Mycobacterium bovis subsp bovis AF2122/97
gacggccaccggggu

SEQ ID NO: 1152853 - RNA, 18 nt, Mycobacterium bovis subsp bovis AF2122/97
gacggccaccccgucggg

SEQ ID NO: 1152854 - RNA, 18 nt, Mycobacterium bovis subsp bovis AF2122/97
gacggcauuucagcgcgc

SEQ ID NO: 1152855 - RNA, 21 nt, Mycobacterium bovis subsp bovis AF2122/97
gacggcacccgacucgucggc

SEQ ID NO: 1152856 - RNA, 14 nt, Mycobacterium bovis subsp bovis AF2122/97
gacggcagaccaug

SEQ ID NO: 1152857 - RNA, 13 nt, Mycobacterium bovis subsp bovis AF2122/97
gacggcagccagc

SEQ ID NO: 1152858 - RNA, 15 nt, Mycobacterium bovis subsp bovis AF2122/97
gacggcagccgggcg

SEQ ID NO: 1152859 - RNA, 20 nt, Mycobacterium bovis subsp bovis AF2122/97
gacggcagccgggcggcagc

SEQ ID NO: 1152860 - RNA, 14 nt, Mycobacterium bovis subsp bovis AF2122/97
gacggcaggcucgg

SEQ ID NO: 1152861 - RNA, 16 nt, Mycobacterium bovis subsp bovis AF2122/97
gacggcaggcucgggc

SEQ ID NO: 1152862 - RNA, 15 nt, Mycobacterium bovis subsp bovis AF2122/97
gacggcaggcuggcg

SEQ ID NO: 1152863 - RNA, 19 nt, Mycobacterium bovis subsp bovis AF2122/97
gacggcauagcagccagcg

SEQ ID NO: 1152864 - RNA, 22 nt, Mycobacterium bovis subsp bovis AF2122/97
gacggcauagcagccagcgucc

SEQ ID NO: 1152865 - RNA, 20 nt, Mycobacterium bovis subsp bovis AF2122/97
gacggcaaaccaguuggcga

SEQ ID NO: 1152866 - RNA, 20 nt, Mycobacterium bovis subsp bovis AF2122/97
gacggcaaaggauucgcgcg

SEQ ID NO: 1152867 - RNA, 21 nt, Mycobacterium bovis subsp bovis AF2122/97
gacggcaagccauucacgagc

SEQ ID NO: 1152868 - RNA, 12 nt, Mycobacterium bovis subsp bovis AF2122/97
gacggcaccggc

SEQ ID NO: 1152869 - RNA, 15 nt, Mycobacterium bovis subsp bovis AF2122/97
gacggcacccgacuc

SEQ ID NO: 1152870 - RNA, 16 nt, Mycobacterium bovis subsp bovis AF2122/97
gacggcacccgacucg

SEQ ID NO: 1152871 - RNA, 19 nt, Mycobacterium bovis subsp bovis AF2122/97
gacggcaaaccaguuggcg

SEQ ID NO: 1152872 - RNA, 22 nt, Mycobacterium bovis subsp bovis AF2122/97
gacggacucccucgaucacggc

SEQ ID NO: 1152873 - RNA, 15 nt, Mycobacterium bovis subsp bovis AF2122/97
gacggaugaucagcg

SEQ ID NO: 1152874 - RNA, 20 nt, Mycobacterium bovis subsp bovis AF2122/97
gacgggaaccagcggucggc

SEQ ID NO: 1152875 - RNA, 22 nt, Mycobacterium bovis subsp bovis AF2122/97
gacgggacgcaugcgugacccg

SEQ ID NO: 1152876 - RNA, 17 nt, Mycobacterium bovis subsp bovis AF2122/97
gacggcuugagccgcag

SEQ ID NO: 1152877 - RNA, 18 nt, Mycobacterium bovis subsp bovis AF2122/97
gacggcuugagccgcagc

SEQ ID NO: 1152878 - RNA, 19 nt, Mycobacterium bovis subsp bovis AF2122/97
gacggcuugagccgcagca

SEQ ID NO: 1152879 - RNA, 17 nt, Mycobacterium bovis subsp bovis AF2122/97
gacgggaaacuccgcgg

SEQ ID NO: 1152880 - RNA, 19 nt, Mycobacterium bovis subsp bovis AF2122/97
gacgggaaacuccgcggcg

SEQ ID NO: 1152881 - RNA, 21 nt, Mycobacterium bovis subsp bovis AF2122/97
gacgggaaacuccgcggcgcg

SEQ ID NO: 1152882 - RNA, 16 nt, Mycobacterium bovis subsp bovis AF2122/97
gacggcuuccaacucg

SEQ ID NO: 1152883 - RNA, 17 nt, Mycobacterium bovis subsp bovis AF2122/97
gacgggcacgcggcgau

SEQ ID NO: 1152884 - RNA, 21 nt, Mycobacterium bovis subsp bovis AF2122/97
gacgggcacccgagccgcaca

SEQ ID NO: 1152885 - RNA, 13 nt, Mycobacterium bovis subsp bovis AF2122/97
gacgggcgccaac

SEQ ID NO: 1152886 - RNA, 18 nt, Mycobacterium bovis subsp bovis AF2122/97
gacgggcgccaacgggcu

SEQ ID NO: 1152887 - RNA, 16 nt, Mycobacterium bovis subsp bovis AF2122/97
gacgggcgcgucggcg

SEQ ID NO: 1152888 - RNA, 17 nt, Mycobacterium bovis subsp bovis AF2122/97
gacgggcgcgucggcgu

SEQ ID NO: 1152889 - RNA, 17 nt, Mycobacterium bovis subsp bovis AF2122/97
gacgggccgucgccguc

SEQ ID NO: 1152890 - RNA, 15 nt, Mycobacterium bovis subsp bovis AF2122/97
gacgggccacgaugc

SEQ ID NO: 1152891 - RNA, 21 nt, Mycobacterium bovis subsp bovis AF2122/97
gacggggaacguccgcgccga

SEQ ID NO: 1152892 - RNA, 23 nt, Mycobacterium bovis subsp bovis AF2122/97
gacggggaugggggagccgguga

SEQ ID NO: 1152893 - RNA, 20 nt, Mycobacterium bovis subsp bovis AF2122/97
gacggggcgagcaugccguu

SEQ ID NO: 1152894 - RNA, 18 nt, Mycobacterium bovis subsp bovis AF2122/97
gacggggcggucggccgg

SEQ ID NO: 1152895 - RNA, 16 nt, Mycobacterium bovis subsp bovis AF2122/97
gacggggcugaccgcc

SEQ ID NO: 1152896 - RNA, 23 nt, Mycobacterium bovis subsp bovis AF2122/97
gacgggucguaggacaccaccgu

SEQ ID NO: 1152897 - RNA, 21 nt, Mycobacterium bovis subsp bovis AF2122/97
gacgggggucgggcgugucgg

SEQ ID NO: 1152898 - RNA, 22 nt, Mycobacterium bovis subsp bovis AF2122/97
gacgggggucgggcgugucggg

SEQ ID NO: 1152899 - RNA, 20 nt, Mycobacterium bovis subsp bovis AF2122/97
gacgggguugaccgccaccc

SEQ ID NO: 1152900 - RNA, 23 nt, Mycobacterium bovis subsp bovis AF2122/97
gacggguccgggccaaugccguu

SEQ ID NO: 1152901 - RNA, 20 nt, Mycobacterium bovis subsp bovis AF2122/97
gacggggcugaccgccaccc

SEQ ID NO: 1152902 - RNA, 18 nt, Mycobacterium bovis subsp bovis AF2122/97
gacggucacggugguguc

SEQ ID NO: 1152903 - RNA, 12 nt, Mycobacterium bovis subsp bovis AF2122/97
gacggucaacga

SEQ ID NO: 1152904 - RNA, 20 nt, Mycobacterium bovis subsp bovis AF2122/97
gacggucaaggugcgccgcc

SEQ ID NO: 1152905 - RNA, 20 nt, Mycobacterium bovis subsp bovis AF2122/97
gacgguaggcccgcgcgaga

SEQ ID NO: 1152906 - RNA, 13 nt, Mycobacterium bovis subsp bovis AF2122/97
gacgguacgccag

SEQ ID NO: 1152907 - RNA, 19 nt, Mycobacterium bovis subsp bovis AF2122/97
gacgggucggcgccgagca

SEQ ID NO: 1152908 - RNA, 18 nt, Mycobacterium bovis subsp bovis AF2122/97
gacgggugcagcgcaacc

SEQ ID NO: 1152909 - RNA, 12 nt, Mycobacterium bovis subsp bovis AF2122/97
gacgggugcgcg

SEQ ID NO: 1152910 - RNA, 13 nt, Mycobacterium bovis subsp bovis AF2122/97
gacgggugcgcgg

SEQ ID NO: 1152911 - RNA, 18 nt, Mycobacterium bovis subsp bovis AF2122/97
gacgggugcgggccgaac

SEQ ID NO: 1152912 - RNA, 18 nt, Mycobacterium bovis subsp bovis AF2122/97
gacggugaauucacgaug

SEQ ID NO: 1152913 - RNA, 12 nt, Mycobacterium bovis subsp bovis AF2122/97
gacggugaccgg

SEQ ID NO: 1152914 - RNA, 15 nt, Mycobacterium bovis subsp bovis AF2122/97
gacggugaaaccggc

SEQ ID NO: 1152915 - RNA, 16 nt, Mycobacterium bovis subsp bovis AF2122/97
gacggugaaccaccac

SEQ ID NO: 1152916 - RNA, 16 nt, Mycobacterium bovis subsp bovis AF2122/97
gacggugagggcgucg

SEQ ID NO: 1152917 - RNA, 21 nt, Mycobacterium bovis subsp bovis AF2122/97
gacggugagggcgucgucgag

SEQ ID NO: 1152918 - RNA, 13 nt, Mycobacterium bovis subsp bovis AF2122/97
gacggugacgacc

SEQ ID NO: 1152919 - RNA, 14 nt, Mycobacterium bovis subsp bovis AF2122/97
gacggugacgacca

SEQ ID NO: 1152920 - RNA, 23 nt, Mycobacterium bovis subsp bovis AF2122/97
gacggugaugggggagccgguga

SEQ ID NO: 1152921 - RNA, 17 nt, Mycobacterium bovis subsp bovis AF2122/97
gacggugccgguuuucg

SEQ ID NO: 1152922 - RNA, 20 nt, Mycobacterium bovis subsp bovis AF2122/97
gacgguccacgacgucgagc

SEQ ID NO: 1152923 - RNA, 16 nt, Mycobacterium bovis subsp bovis AF2122/97
gacgguacgccagucg

SEQ ID NO: 1152924 - RNA, 15 nt, Mycobacterium bovis subsp bovis AF2122/97
gacggugccgucggu

SEQ ID NO: 1152925 - RNA, 21 nt, Mycobacterium bovis subsp bovis AF2122/97
gacggugccgucggugccgcg

SEQ ID NO: 1152926 - RNA, 23 nt, Mycobacterium bovis subsp bovis AF2122/97
gacggugccgucggugccgcgga

SEQ ID NO: 1152927 - RNA, 16 nt, Mycobacterium bovis subsp bovis AF2122/97
gacgguggcgccgucg

SEQ ID NO: 1152928 - RNA, 17 nt, Mycobacterium bovis subsp bovis AF2122/97
gacgguggggauggcgc

SEQ ID NO: 1152929 - RNA, 18 nt, Mycobacterium bovis subsp bovis AF2122/97
gacgguggggucgccguc

SEQ ID NO: 1152930 - RNA, 17 nt, Mycobacterium bovis subsp bovis AF2122/97
gacgguguagccgccgg

SEQ ID NO: 1152931 - RNA, 18 nt, Mycobacterium bovis subsp bovis AF2122/97
gacgguguggaaaccgcg

SEQ ID NO: 1152932 - RNA, 19 nt, Mycobacterium bovis subsp bovis AF2122/97
gacggugucaugaacgacc

SEQ ID NO: 1152933 - RNA, 22 nt, Mycobacterium bovis subsp bovis AF2122/97
gacggugcgggcuaggcggcgu

SEQ ID NO: 1152934 - RNA, 20 nt, Mycobacterium bovis subsp bovis AF2122/97
gacgguggggucgccgucga

SEQ ID NO: 1152935 - RNA, 12 nt, Mycobacterium bovis subsp bovis AF2122/97
gacgguguuggu

SEQ ID NO: 1152936 - RNA, 15 nt, Mycobacterium bovis subsp bovis AF2122/97
gacgguguugguggc

SEQ ID NO: 1152937 - RNA, 19 nt, Mycobacterium bovis subsp bovis AF2122/97
gacgguguugguggccggg

SEQ ID NO: 1152938 - RNA, 17 nt, Mycobacterium bovis subsp bovis AF2122/97
gacgguguugguggcgg

SEQ ID NO: 1152939 - RNA, 19 nt, Mycobacterium bovis subsp bovis AF2122/97
gacgguuccgccaccggac

SEQ ID NO: 1152940 - RNA, 17 nt, Mycobacterium bovis subsp bovis AF2122/97
gacgguuucgaccacca

SEQ ID NO: 1152941 - RNA, 19 nt, Mycobacterium bovis subsp bovis AF2122/97
gacgguugccccggcgacc

SEQ ID NO: 1152942 - RNA, 17 nt, Mycobacterium bovis subsp bovis AF2122/97
gacggcgcuguggcggg

SEQ ID NO: 1152943 - RNA, 15 nt, Mycobacterium bovis subsp bovis AF2122/97
gacggcggagucgcg

SEQ ID NO: 1152944 - RNA, 16 nt, Mycobacterium bovis subsp bovis AF2122/97
gacggcggagucgcgc

SEQ ID NO: 1152945 - RNA, 19 nt, Mycobacterium bovis subsp bovis AF2122/97
gacggcggauaaccggcau

SEQ ID NO: 1152946 - RNA, 14 nt, Mycobacterium bovis subsp bovis AF2122/97
gacggcggcaacgg

SEQ ID NO: 1152947 - RNA, 15 nt, Mycobacterium bovis subsp bovis AF2122/97
gacggcggcaacggc

SEQ ID NO: 1152948 - RNA, 13 nt, Mycobacterium bovis subsp bovis AF2122/97
gacggcggcaagg

SEQ ID NO: 1152949 - RNA, 18 nt, Mycobacterium bovis subsp bovis AF2122/97
gacggcggcacgggcggc

SEQ ID NO: 1152950 - RNA, 19 nt, Mycobacterium bovis subsp bovis AF2122/97
gacggcggcacgggcggcc

SEQ ID NO: 1152951 - RNA, 21 nt, Mycobacterium bovis subsp bovis AF2122/97
gacggcggcacgggcggccau

SEQ ID NO: 1152952 - RNA, 16 nt, Mycobacterium bovis subsp bovis AF2122/97
gacggcgcucggcgag

SEQ ID NO: 1152953 - RNA, 14 nt, Mycobacterium bovis subsp bovis AF2122/97
gacggcggcaucgg

SEQ ID NO: 1152954 - RNA, 21 nt, Mycobacterium bovis subsp bovis AF2122/97
gacggcggccacguggucggc

SEQ ID NO: 1152955 - RNA, 18 nt, Mycobacterium bovis subsp bovis AF2122/97
gacggcgcucggcgagcu

SEQ ID NO: 1152956 - RNA, 15 nt, Mycobacterium bovis subsp bovis AF2122/97
gacggcggccgccac

SEQ ID NO: 1152957 - RNA, 12 nt, Mycobacterium bovis subsp bovis AF2122/97
gacggcggcgag

SEQ ID NO: 1152958 - RNA, 14 nt, Mycobacterium bovis subsp bovis AF2122/97
gacggcggcgaggc

SEQ ID NO: 1152959 - RNA, 18 nt, Mycobacterium bovis subsp bovis AF2122/97
gacggcggcgaggcgguc

SEQ ID NO: 1152960 - RNA, 23 nt, Mycobacterium bovis subsp bovis AF2122/97
gacggcggcgaggcggucgccga

SEQ ID NO: 1152961 - RNA, 22 nt, Mycobacterium bovis subsp bovis AF2122/97
gacggcgggcgaucuuggcgac

SEQ ID NO: 1152962 - RNA, 12 nt, Mycobacterium bovis subsp bovis AF2122/97
gacggcgucggg

SEQ ID NO: 1152963 - RNA, 17 nt, Mycobacterium bovis subsp bovis AF2122/97
gacggcugccgucagcc

SEQ ID NO: 1152964 - RNA, 18 nt, Mycobacterium bovis subsp bovis AF2122/97
gacggcugccgucagccg

SEQ ID NO: 1152965 - RNA, 18 nt, Mycobacterium bovis subsp bovis AF2122/97
gacggcuucggcagccgc

SEQ ID NO: 1152966 - RNA, 21 nt, Mycobacterium bovis subsp bovis AF2122/97
gacggcugcgccgaacaccac

SEQ ID NO: 1152967 - RNA, 15 nt, Mycobacterium bovis subsp bovis AF2122/97
gacggcguugucgac

SEQ ID NO: 1152968 - RNA, 17 nt, Mycobacterium bovis subsp bovis AF2122/97
gacggcguugucgacga

SEQ ID NO: 1152969 - RNA, 18 nt, Mycobacterium bovis subsp bovis AF2122/97
gacggcguugucgacgaa

SEQ ID NO: 1152970 - RNA, 23 nt, Mycobacterium bovis subsp bovis AF2122/97
gacggcuccuccgguaucggcga

SEQ ID NO: 1152971 - RNA, 16 nt, Mycobacterium bovis subsp bovis AF2122/97
gacggcgucgaccucg

SEQ ID NO: 1152972 - RNA, 17 nt, Mycobacterium bovis subsp bovis AF2122/97
gacggcgucugcggugg

SEQ ID NO: 1152973 - RNA, 23 nt, Mycobacterium bovis subsp bovis AF2122/97
gacggcguugauccgcaccccau

SEQ ID NO: 1152974 - RNA, 15 nt, Mycobacterium bovis subsp bovis AF2122/97
gacggcguugccgga

SEQ ID NO: 1152975 - RNA, 19 nt, Mycobacterium bovis subsp bovis AF2122/97
gacggccugcgagucgcgc

SEQ ID NO: 1152976 - RNA, 22 nt, Mycobacterium bovis subsp bovis AF2122/97
gacggccuggggcagccgggcg

SEQ ID NO: 1152977 - RNA, 15 nt, Mycobacterium bovis subsp bovis AF2122/97
gacggccuuggcgac

SEQ ID NO: 1152978 - RNA, 19 nt, Mycobacterium bovis subsp bovis AF2122/97
gacggccuuggcgacgucg

SEQ ID NO: 1152979 - RNA, 23 nt, Mycobacterium bovis subsp bovis AF2122/97
gacggcgaaaucgacagcagcgc

SEQ ID NO: 1152980 - RNA, 15 nt, Mycobacterium bovis subsp bovis AF2122/97
gacggcgaacccgcc

SEQ ID NO: 1152981 - RNA, 16 nt, Mycobacterium bovis subsp bovis AF2122/97
gacggcgaacccgccg

SEQ ID NO: 1152982 - RNA, 18 nt, Mycobacterium bovis subsp bovis AF2122/97
gacggcgaacccgccgau

SEQ ID NO: 1152983 - RNA, 21 nt, Mycobacterium bovis subsp bovis AF2122/97
gacggcgacgaugucgacucg

SEQ ID NO: 1152984 - RNA, 19 nt, Mycobacterium bovis subsp bovis AF2122/97
gacggcgaccaccgcggcu

SEQ ID NO: 1152985 - RNA, 23 nt, Mycobacterium bovis subsp bovis AF2122/97
gacggccucgucgauguucgccg

SEQ ID NO: 1152986 - RNA, 23 nt, Mycobacterium bovis subsp bovis AF2122/97
aacgucgagauccucgucgaggu

SEQ ID NO: 1152987 - RNA, 20 nt, Mycobacterium bovis subsp bovis AF2122/97
aacguccagccguggcggcg

SEQ ID NO: 1152988 - RNA, 13 nt, Mycobacterium bovis subsp bovis AF2122/97
gacggcgcucggc

SEQ ID NO: 1152989 - RNA, 15 nt, Mycobacterium bovis subsp bovis AF2122/97
gacggcgcucggcga

SEQ ID NO: 1152990 - RNA, 17 nt, Mycobacterium bovis subsp bovis AF2122/97
gacggcgcgagccgcac

SEQ ID NO: 1152991 - RNA, 19 nt, Mycobacterium bovis subsp bovis AF2122/97
gacggcgcgagccgcacga

SEQ ID NO: 1152992 - RNA, 24 nt, Mycobacterium bovis subsp bovis AF2122/97
gacggcgcccgcccgagccgcugc

SEQ ID NO: 1152993 - RNA, 13 nt, Mycobacterium bovis subsp bovis AF2122/97
gacggcgccgccc

SEQ ID NO: 1152994 - RNA, 12 nt, Mycobacterium bovis subsp bovis AF2122/97
gacggcgccguc

SEQ ID NO: 1152995 - RNA, 19 nt, Mycobacterium bovis subsp bovis AF2122/97
gacggcgccauuggcgucc

SEQ ID NO: 1152996 - RNA, 15 nt, Mycobacterium bovis subsp bovis AF2122/97
gacggcgcccauagc

SEQ ID NO: 1152997 - RNA, 17 nt, Mycobacterium bovis subsp bovis AF2122/97
gacggcgauggcgcgca

SEQ ID NO: 1152998 - RNA, 18 nt, Mycobacterium bovis subsp bovis AF2122/97
gacggcgcaacaccucgu

SEQ ID NO: 1152999 - RNA, 17 nt, Mycobacterium bovis subsp bovis AF2122/97
aacgucggcaccgguuu

SEQ ID NO: 1153000 - RNA, 15 nt, Mycobacterium bovis subsp bovis AF2122/97
aacgucgccgcggcg

SEQ ID NO: 1153001 - RNA, 13 nt, Mycobacterium bovis subsp bovis AF2122/97
aacgucgucgcgu

SEQ ID NO: 1153002 - RNA, 15 nt, Mycobacterium bovis subsp bovis AF2122/97
gacggcgauggcgcg

SEQ ID NO: 1153003 - RNA, 23 nt, Mycobacterium bovis subsp bovis AF2122/97
aacgugcgcaacgcgucgucggu

SEQ ID NO: 1153004 - RNA, 20 nt, Mycobacterium bovis subsp bovis AF2122/97
aacgugcgcaacgcgucguc

SEQ ID NO: 1153005 - RNA, 15 nt, Mycobacterium bovis subsp bovis AF2122/97
aacgugacgccggcc

SEQ ID NO: 1153006 - RNA, 16 nt, Mycobacterium bovis subsp bovis AF2122/97
aacgugaugcggucgc

SEQ ID NO: 1153007 - RNA, 15 nt, Mycobacterium bovis subsp bovis AF2122/97
aacgugcaaccacgg

SEQ ID NO: 1153008 - RNA, 20 nt, Mycobacterium bovis subsp bovis AF2122/97
aacgugcaaccacggcggca

SEQ ID NO: 1153009 - RNA, 13 nt, Mycobacterium bovis subsp bovis AF2122/97
gaccgcgccaaca

SEQ ID NO: 1153010 - RNA, 19 nt, Mycobacterium bovis subsp bovis AF2122/97
gaccgcgccaacuccgauc

SEQ ID NO: 1153011 - RNA, 23 nt, Mycobacterium bovis subsp bovis AF2122/97
gaccgcgccagguacucggugca

SEQ ID NO: 1153012 - RNA, 21 nt, Mycobacterium bovis subsp bovis AF2122/97
gaccgcgcccagaccgacccg

SEQ ID NO: 1153013 - RNA, 15 nt, Mycobacterium bovis subsp bovis AF2122/97
gaccgcgcccgcggg

SEQ ID NO: 1153014 - RNA, 21 nt, Mycobacterium bovis subsp bovis AF2122/97
gaccgcgacggcgccggcauc

SEQ ID NO: 1153015 - RNA, 13 nt, Mycobacterium bovis subsp bovis AF2122/97
gaccgcgacggca

SEQ ID NO: 1153016 - RNA, 13 nt, Mycobacterium bovis subsp bovis AF2122/97
gaccgcgccgauc

SEQ ID NO: 1153017 - RNA, 15 nt, Mycobacterium bovis subsp bovis AF2122/97
gaccgcgaucgccga

SEQ ID NO: 1153018 - RNA, 18 nt, Mycobacterium bovis subsp bovis AF2122/97
gaccgcgaucgccgacgc

SEQ ID NO: 1153019 - RNA, 20 nt, Mycobacterium bovis subsp bovis AF2122/97
gaccgcgaugaucgcaucga

SEQ ID NO: 1153020 - RNA, 16 nt, Mycobacterium bovis subsp bovis AF2122/97
gaccgcgccggacagc

SEQ ID NO: 1153021 - RNA, 18 nt, Mycobacterium bovis subsp bovis AF2122/97
gaccgcgccggacagcgc

SEQ ID NO: 1153022 - RNA, 14 nt, Mycobacterium bovis subsp bovis AF2122/97
gaccgcgccgauca

SEQ ID NO: 1153023 - RNA, 13 nt, Mycobacterium bovis subsp bovis AF2122/97
gaccgcgcggcac

SEQ ID NO: 1153024 - RNA, 22 nt, Mycobacterium bovis subsp bovis AF2122/97
gaccgcggcccggacgucggcg

SEQ ID NO: 1153025 - RNA, 22 nt, Mycobacterium bovis subsp bovis AF2122/97
gaccgcgggucgugccagcagc

SEQ ID NO: 1153026 - RNA, 20 nt, Mycobacterium bovis subsp bovis AF2122/97
gaccgcggucauggcgacgg

SEQ ID NO: 1153027 - RNA, 13 nt, Mycobacterium bovis subsp bovis AF2122/97
gaccgcgauggug

SEQ ID NO: 1153028 - RNA, 15 nt, Mycobacterium bovis subsp bovis AF2122/97
gaccgcggccggccg

SEQ ID NO: 1153029 - RNA, 21 nt, Mycobacterium bovis subsp bovis AF2122/97
gaccgcggccggguggcccgg

SEQ ID NO: 1153030 - RNA, 17 nt, Mycobacterium bovis subsp bovis AF2122/97
gaccgcggcgcguccgg

SEQ ID NO: 1153031 - RNA, 19 nt, Mycobacterium bovis subsp bovis AF2122/97
gaccgcggcggccgaaaac

SEQ ID NO: 1153032 - RNA, 17 nt, Mycobacterium bovis subsp bovis AF2122/97
gaccgcguacaggccgg

SEQ ID NO: 1153033 - RNA, 16 nt, Mycobacterium bovis subsp bovis AF2122/97
gaccgcggucugcgcg

SEQ ID NO: 1153034 - RNA, 21 nt, Mycobacterium bovis subsp bovis AF2122/97
gaccgcggucugcgcgucgcg

SEQ ID NO: 1153035 - RNA, 19 nt, Mycobacterium bovis subsp bovis AF2122/97
gaccgcggucuucuucacc

SEQ ID NO: 1153036 - RNA, 18 nt, Mycobacterium bovis subsp bovis AF2122/97
gaccgcgucggcggccag

SEQ ID NO: 1153037 - RNA, 17 nt, Mycobacterium bovis subsp bovis AF2122/97
gaccgcguggucggcga

SEQ ID NO: 1153038 - RNA, 23 nt, Mycobacterium bovis subsp bovis AF2122/97
gaccgcuaccagcugggcgacca

SEQ ID NO: 1153039 - RNA, 18 nt, Mycobacterium bovis subsp bovis AF2122/97
gaccgcuaugaugccgcc

SEQ ID NO: 1153040 - RNA, 23 nt, Mycobacterium bovis subsp bovis AF2122/97
gaccgccgauacuucaucggcac

SEQ ID NO: 1153041 - RNA, 14 nt, Mycobacterium bovis subsp bovis AF2122/97
gaccgccgaugccc

SEQ ID NO: 1153042 - RNA, 15 nt, Mycobacterium bovis subsp bovis AF2122/97
gaccgccgacgccgu

SEQ ID NO: 1153043 - RNA, 21 nt, Mycobacterium bovis subsp bovis AF2122/97
gaccgaugacgaucggcggcg

SEQ ID NO: 1153044 - RNA, 23 nt, Mycobacterium bovis subsp bovis AF2122/97
gaccgcccuagcgagcggcacca

SEQ ID NO: 1153045 - RNA, 14 nt, Mycobacterium bovis subsp bovis AF2122/97
gaccgaugacgauc

SEQ ID NO: 1153046 - RNA, 18 nt, Mycobacterium bovis subsp bovis AF2122/97
gaccgaugacgaucggcg

SEQ ID NO: 1153047 - RNA, 13 nt, Mycobacterium bovis subsp bovis AF2122/97
gaccgaucggcgc

SEQ ID NO: 1153048 - RNA, 20 nt, Mycobacterium bovis subsp bovis AF2122/97
gaccgaucggcgcgucgauc

SEQ ID NO: 1153049 - RNA, 12 nt, Mycobacterium bovis subsp bovis AF2122/97
gaccgccgccgg

SEQ ID NO: 1153050 - RNA, 13 nt, Mycobacterium bovis subsp bovis AF2122/97
gaccgccgccgga

SEQ ID NO: 1153051 - RNA, 23 nt, Mycobacterium bovis subsp bovis AF2122/97
gaccgccgccggaucgccgguga

SEQ ID NO: 1153052 - RNA, 16 nt, Mycobacterium bovis subsp bovis AF2122/97
gaccgccgacgccguu

SEQ ID NO: 1153053 - RNA, 17 nt, Mycobacterium bovis subsp bovis AF2122/97
gaccgccgacgccguug

SEQ ID NO: 1153054 - RNA, 12 nt, Mycobacterium bovis subsp bovis AF2122/97
gaccgccgccga

SEQ ID NO: 1153055 - RNA, 16 nt, Mycobacterium bovis subsp bovis AF2122/97
gaccgccgcgccggca

SEQ ID NO: 1153056 - RNA, 18 nt, Mycobacterium bovis subsp bovis AF2122/97
gaccgccgcgccggcacg

SEQ ID NO: 1153057 - RNA, 13 nt, Mycobacterium bovis subsp bovis AF2122/97
gaccgcgacccgg

SEQ ID NO: 1153058 - RNA, 17 nt, Mycobacterium bovis subsp bovis AF2122/97
aacggcaaggucgcggc

SEQ ID NO: 1153059 - RNA, 16 nt, Mycobacterium bovis subsp bovis AF2122/97
aacggagccgagccga

SEQ ID NO: 1153060 - RNA, 17 nt, Mycobacterium bovis subsp bovis AF2122/97
aacggcaccgcgcccac

SEQ ID NO: 1153061 - RNA, 17 nt, Mycobacterium bovis subsp bovis AF2122/97
gaccgacagcggcaccg

SEQ ID NO: 1153062 - RNA, 18 nt, Mycobacterium bovis subsp bovis AF2122/97
gaccgacagcggcaccgg

SEQ ID NO: 1153063 - RNA, 22 nt, Mycobacterium bovis subsp bovis AF2122/97
gaccgacaggugcucgucaucc

SEQ ID NO: 1153064 - RNA, 22 nt, Mycobacterium bovis subsp bovis AF2122/97
gaccgauaacacccgggccauc

SEQ ID NO: 1153065 - RNA, 17 nt, Mycobacterium bovis subsp bovis AF2122/97
gaccgauaaguucggcu

SEQ ID NO: 1153066 - RNA, 20 nt, Mycobacterium bovis subsp bovis AF2122/97
gaccgagcuuccaaacccgg

SEQ ID NO: 1153067 - RNA, 20 nt, Mycobacterium bovis subsp bovis AF2122/97
gacccgggaaggaaccgggc

SEQ ID NO: 1153068 - RNA, 18 nt, Mycobacterium bovis subsp bovis AF2122/97
gacccgggggcgcccggg

SEQ ID NO: 1153069 - RNA, 15 nt, Mycobacterium bovis subsp bovis AF2122/97
gacccgggucggcac

SEQ ID NO: 1153070 - RNA, 16 nt, Mycobacterium bovis subsp bovis AF2122/97
gacccgggucggcacg

SEQ ID NO: 1153071 - RNA, 20 nt, Mycobacterium bovis subsp bovis AF2122/97
gacccgggucggcacgaccc

SEQ ID NO: 1153072 - RNA, 16 nt, Mycobacterium bovis subsp bovis AF2122/97
gacccgggcggcguug

SEQ ID NO: 1153073 - RNA, 16 nt, Mycobacterium bovis subsp bovis AF2122/97
gacccgggccggucgg

SEQ ID NO: 1153074 - RNA, 20 nt, Mycobacterium bovis subsp bovis AF2122/97
gacccgggcgagcgcggccu

SEQ ID NO: 1153075 - RNA, 16 nt, Mycobacterium bovis subsp bovis AF2122/97
gacccggcgccgucga

SEQ ID NO: 1153076 - RNA, 16 nt, Mycobacterium bovis subsp bovis AF2122/97
gacccggcggugccgu

SEQ ID NO: 1153077 - RNA, 18 nt, Mycobacterium bovis subsp bovis AF2122/97
aacgcgugaccagggccu

SEQ ID NO: 1153078 - RNA, 14 nt, Mycobacterium bovis subsp bovis AF2122/97
gacccggugacccg

SEQ ID NO: 1153079 - RNA, 21 nt, Mycobacterium bovis subsp bovis AF2122/97
gacccggucgacgggucggcg

SEQ ID NO: 1153080 - RNA, 14 nt, Mycobacterium bovis subsp bovis AF2122/97
gacccggucgccgg

SEQ ID NO: 1153081 - RNA, 20 nt, Mycobacterium bovis subsp bovis AF2122/97
aacgcguugaccaucacgcc

SEQ ID NO: 1153082 - RNA, 18 nt, Mycobacterium bovis subsp bovis AF2122/97
aacgcuccaggccuaguc

SEQ ID NO: 1153083 - RNA, 18 nt, Mycobacterium bovis subsp bovis AF2122/97
gacccguucagcgacggc

SEQ ID NO: 1153084 - RNA, 15 nt, Mycobacterium bovis subsp bovis AF2122/97
gacccguuccacgcc

SEQ ID NO: 1153085 - RNA, 18 nt, Mycobacterium bovis subsp bovis AF2122/97
gacccguuccacgccggc

SEQ ID NO: 1153086 - RNA, 19 nt, Mycobacterium bovis subsp bovis AF2122/97
gacccguuccacgccggca

SEQ ID NO: 1153087 - RNA, 23 nt, Mycobacterium bovis subsp bovis AF2122/97
gacccguuccacgccggcaucgu

SEQ ID NO: 1153088 - RNA, 14 nt, Mycobacterium bovis subsp bovis AF2122/97
gacccuggccgucc

SEQ ID NO: 1153089 - RNA, 21 nt, Mycobacterium bovis subsp bovis AF2122/97
gacccugguggugcggauguc

SEQ ID NO: 1153090 - RNA, 15 nt, Mycobacterium bovis subsp bovis AF2122/97
aacggacgaagcacc

SEQ ID NO: 1153091 - RNA, 14 nt, Mycobacterium bovis subsp bovis AF2122/97
aacggaagaccgcg

SEQ ID NO: 1153092 - RNA, 20 nt, Mycobacterium bovis subsp bovis AF2122/97
gacccugcugcagggccugg

SEQ ID NO: 1153093 - RNA, 16 nt, Mycobacterium bovis subsp bovis AF2122/97
gacccugcgccgccac

SEQ ID NO: 1153094 - RNA, 18 nt, Mycobacterium bovis subsp bovis AF2122/97
gacccuccagcacgccgu

SEQ ID NO: 1153095 - RNA, 20 nt, Mycobacterium bovis subsp bovis AF2122/97
gacccuagauaugcacccgc

SEQ ID NO: 1153096 - RNA, 22 nt, Mycobacterium bovis subsp bovis AF2122/97
gacccuagauaugcacccgcac

SEQ ID NO: 1153097 - RNA, 17 nt, Mycobacterium bovis subsp bovis AF2122/97
gacccguucgccgucgg

SEQ ID NO: 1153098 - RNA, 14 nt, Mycobacterium bovis subsp bovis AF2122/97
gacccgcgcgccgg

SEQ ID NO: 1153099 - RNA, 15 nt, Mycobacterium bovis subsp bovis AF2122/97
gacccgcgcgccggc

SEQ ID NO: 1153100 - RNA, 17 nt, Mycobacterium bovis subsp bovis AF2122/97
gacccgcgcgccggcga

SEQ ID NO: 1153101 - RNA, 19 nt, Mycobacterium bovis subsp bovis AF2122/97
gacccgcgcgccggcgacc

SEQ ID NO: 1153102 - RNA, 13 nt, Mycobacterium bovis subsp bovis AF2122/97
gacccgcggaccg

SEQ ID NO: 1153103 - RNA, 20 nt, Mycobacterium bovis subsp bovis AF2122/97
gacccgcgguagcggaccug

SEQ ID NO: 1153104 - RNA, 16 nt, Mycobacterium bovis subsp bovis AF2122/97
gacccgcuacgacggu

SEQ ID NO: 1153105 - RNA, 23 nt, Mycobacterium bovis subsp bovis AF2122/97
gacccgcugccacccaucgcacg

SEQ ID NO: 1153106 - RNA, 19 nt, Mycobacterium bovis subsp bovis AF2122/97
gacccgcuauucggcggca

SEQ ID NO: 1153107 - RNA, 21 nt, Mycobacterium bovis subsp bovis AF2122/97
gacccggauaucgaccaccgg

SEQ ID NO: 1153108 - RNA, 14 nt, Mycobacterium bovis subsp bovis AF2122/97
gacccggaugucgu

SEQ ID NO: 1153109 - RNA, 16 nt, Mycobacterium bovis subsp bovis AF2122/97
gacccggaaucccgag

SEQ ID NO: 1153110 - RNA, 18 nt, Mycobacterium bovis subsp bovis AF2122/97
gacccggaccugggcgac

SEQ ID NO: 1153111 - RNA, 19 nt, Mycobacterium bovis subsp bovis AF2122/97
gacccgcugggccgcaucg

SEQ ID NO: 1153112 - RNA, 16 nt, Mycobacterium bovis subsp bovis AF2122/97
aacgcgcgcguggucg

SEQ ID NO: 1153113 - RNA, 22 nt, Mycobacterium bovis subsp bovis AF2122/97
aacgcgcgcguggucgccccga

SEQ ID NO: 1153114 - RNA, 14 nt, Mycobacterium bovis subsp bovis AF2122/97
gacccggagccgcc

SEQ ID NO: 1153115 - RNA, 14 nt, Mycobacterium bovis subsp bovis AF2122/97
aacgcggcgcgcug

SEQ ID NO: 1153116 - RNA, 19 nt, Mycobacterium bovis subsp bovis AF2122/97
gacccggcagcccggcggc

SEQ ID NO: 1153117 - RNA, 12 nt, Mycobacterium bovis subsp bovis AF2122/97
aacgcggcacca

SEQ ID NO: 1153118 - RNA, 13 nt, Mycobacterium bovis subsp bovis AF2122/97
aacgcggcgucga

SEQ ID NO: 1153119 - RNA, 20 nt, Mycobacterium bovis subsp bovis AF2122/97
aacgcgguaaagccccgcuc

SEQ ID NO: 1153120 - RNA, 20 nt, Mycobacterium bovis subsp bovis AF2122/97
aacgcggaucgggcaccccg

SEQ ID NO: 1153121 - RNA, 19 nt, Mycobacterium bovis subsp bovis AF2122/97
aacgcggacaccgcggcga

SEQ ID NO: 1153122 - RNA, 16 nt, Mycobacterium bovis subsp bovis AF2122/97
gacccggccgauggug

SEQ ID NO: 1153123 - RNA, 22 nt, Mycobacterium bovis subsp bovis AF2122/97
aacgcggccuugcgcacaggcg

SEQ ID NO: 1153124 - RNA, 14 nt, Mycobacterium bovis subsp bovis AF2122/97
gacccgggccgcgg

SEQ ID NO: 1153125 - RNA, 15 nt, Mycobacterium bovis subsp bovis AF2122/97
gacccgggccgcggc

SEQ ID NO: 1153126 - RNA, 16 nt, Mycobacterium bovis subsp bovis AF2122/97
gacccgggccgcggcg

SEQ ID NO: 1153127 - RNA, 19 nt, Mycobacterium bovis subsp bovis AF2122/97
gacccgggccgcggcggcc

SEQ ID NO: 1153128 - RNA, 19 nt, Mycobacterium bovis subsp bovis AF2122/97
gacccggcgaugcagccgg

SEQ ID NO: 1153129 - RNA, 16 nt, Mycobacterium bovis subsp bovis AF2122/97
aacgcguacugggugu

SEQ ID NO: 1153130 - RNA, 14 nt, Mycobacterium bovis subsp bovis AF2122/97
aacgcgucgccgac

SEQ ID NO: 1153131 - RNA, 19 nt, Mycobacterium bovis subsp bovis AF2122/97
aacgcguagagccgaucac

SEQ ID NO: 1153132 - RNA, 13 nt, Mycobacterium bovis subsp bovis AF2122/97
gaccacgccgccg

SEQ ID NO: 1153133 - RNA, 17 nt, Mycobacterium bovis subsp bovis AF2122/97
gaccacgccgccggcgc

SEQ ID NO: 1153134 - RNA, 19 nt, Mycobacterium bovis subsp bovis AF2122/97
gaccacgccgccggcgcug

SEQ ID NO: 1153135 - RNA, 14 nt, Mycobacterium bovis subsp bovis AF2122/97
gaccacgccgacga

SEQ ID NO: 1153136 - RNA, 14 nt, Mycobacterium bovis subsp bovis AF2122/97
gaccacgccgacgu

SEQ ID NO: 1153137 - RNA, 16 nt, Mycobacterium bovis subsp bovis AF2122/97
gaccaccgugaccgag

SEQ ID NO: 1153138 - RNA, 22 nt, Mycobacterium bovis subsp bovis AF2122/97
aacgauagaacguagcgcccac

SEQ ID NO: 1153139 - RNA, 19 nt, Mycobacterium bovis subsp bovis AF2122/97
aacgaucgacaccagggcg

SEQ ID NO: 1153140 - RNA, 17 nt, Mycobacterium bovis subsp bovis AF2122/97
aacgaucgcgcgagcga

SEQ ID NO: 1153141 - RNA, 13 nt, Mycobacterium bovis subsp bovis AF2122/97
gaccaccgggcgc

SEQ ID NO: 1153142 - RNA, 18 nt, Mycobacterium bovis subsp bovis AF2122/97
gaccaccggguagccggc

SEQ ID NO: 1153143 - RNA, 23 nt, Mycobacterium bovis subsp bovis AF2122/97
gaccaccggguagccggcgugca

SEQ ID NO: 1153144 - RNA, 18 nt, Mycobacterium bovis subsp bovis AF2122/97
gaccaccggcagcgcgau

SEQ ID NO: 1153145 - RNA, 16 nt, Mycobacterium bovis subsp bovis AF2122/97
gaccaccgcgucgggc

SEQ ID NO: 1153146 - RNA, 13 nt, Mycobacterium bovis subsp bovis AF2122/97
gaccaccgcugcg

SEQ ID NO: 1153147 - RNA, 20 nt, Mycobacterium bovis subsp bovis AF2122/97
gaccaccggaucgccgucgg

SEQ ID NO: 1153148 - RNA, 21 nt, Mycobacterium bovis subsp bovis AF2122/97
gaccaccggaucgccgucggc

SEQ ID NO: 1153149 - RNA, 16 nt, Mycobacterium bovis subsp bovis AF2122/97
gaccaccgccggcccg

SEQ ID NO: 1153150 - RNA, 20 nt, Mycobacterium bovis subsp bovis AF2122/97
gaccaccgccggcccgcggg

SEQ ID NO: 1153151 - RNA, 13 nt, Mycobacterium bovis subsp bovis AF2122/97
gaccacccggcgc

SEQ ID NO: 1153152 - RNA, 14 nt, Mycobacterium bovis subsp bovis AF2122/97
gaccacccggcgcg

SEQ ID NO: 1153153 - RNA, 14 nt, Mycobacterium bovis subsp bovis AF2122/97
gaccaccgccgaca

SEQ ID NO: 1153154 - RNA, 24 nt, Mycobacterium bovis subsp bovis AF2122/97
gaccaccgaaauacccagcgcagc

SEQ ID NO: 1153155 - RNA, 19 nt, Mycobacterium bovis subsp bovis AF2122/97
gacaugaucugccaccgcg

SEQ ID NO: 1153156 - RNA, 14 nt, Mycobacterium bovis subsp bovis AF2122/97
gacaugagcgccac

SEQ ID NO: 1153157 - RNA, 13 nt, Mycobacterium bovis subsp bovis AF2122/97
gacaucggcggcc

SEQ ID NO: 1153158 - RNA, 19 nt, Mycobacterium bovis subsp bovis AF2122/97
gacaucggcccgaucacca

SEQ ID NO: 1153159 - RNA, 16 nt, Mycobacterium bovis subsp bovis AF2122/97
gacaucgcugcgacug

SEQ ID NO: 1153160 - RNA, 20 nt, Mycobacterium bovis subsp bovis AF2122/97
gacaucgguggcggccuccg

SEQ ID NO: 1153161 - RNA, 14 nt, Mycobacterium bovis subsp bovis AF2122/97
gacaucguaggccg

SEQ ID NO: 1153162 - RNA, 18 nt, Mycobacterium bovis subsp bovis AF2122/97
gacaucguaggccggcau

SEQ ID NO: 1153163 - RNA, 16 nt, Mycobacterium bovis subsp bovis AF2122/97
gacaucgucgccaggg

SEQ ID NO: 1153164 - RNA, 19 nt, Mycobacterium bovis subsp bovis AF2122/97
gacaucggucagcgggcac

SEQ ID NO: 1153165 - RNA, 23 nt, Mycobacterium bovis subsp bovis AF2122/97
gacaucgucgccagggccgccga

SEQ ID NO: 1153166 - RNA, 13 nt, Mycobacterium bovis subsp bovis AF2122/97
aacgccgcccgcu

SEQ ID NO: 1153167 - RNA, 17 nt, Mycobacterium bovis subsp bovis AF2122/97
aacgccgccagcgcggu

SEQ ID NO: 1153168 - RNA, 20 nt, Mycobacterium bovis subsp bovis AF2122/97
gaccacuguuggugccgcca

SEQ ID NO: 1153169 - RNA, 22 nt, Mycobacterium bovis subsp bovis AF2122/97
gaccacuguuggugccgccacc

SEQ ID NO: 1153170 - RNA, 23 nt, Mycobacterium bovis subsp bovis AF2122/97
gaccacuguuggugccgccacca

SEQ ID NO: 1153171 - RNA, 16 nt, Mycobacterium bovis subsp bovis AF2122/97
gaccacuuagcuggcg

SEQ ID NO: 1153172 - RNA, 16 nt, Mycobacterium bovis subsp bovis AF2122/97
gaccacuucgauggcg

SEQ ID NO: 1153173 - RNA, 23 nt, Mycobacterium bovis subsp bovis AF2122/97
gaccacuucgcuuucccgucggc

SEQ ID NO: 1153174 - RNA, 17 nt, Mycobacterium bovis subsp bovis AF2122/97
gaccagaaucucgccgg

SEQ ID NO: 1153175 - RNA, 13 nt, Mycobacterium bovis subsp bovis AF2122/97
aacgccgcgguca

SEQ ID NO: 1153176 - RNA, 12 nt, Mycobacterium bovis subsp bovis AF2122/97
aacgccgcucau

SEQ ID NO: 1153177 - RNA, 16 nt, Mycobacterium bovis subsp bovis AF2122/97
gaccagcacccgcucg

SEQ ID NO: 1153178 - RNA, 18 nt, Mycobacterium bovis subsp bovis AF2122/97
aacgccagugaacgcgcg

SEQ ID NO: 1153179 - RNA, 14 nt, Mycobacterium bovis subsp bovis AF2122/97
aacgccaugccggg

SEQ ID NO: 1153180 - RNA, 16 nt, Mycobacterium bovis subsp bovis AF2122/97
aacgccagucgagcac

SEQ ID NO: 1153181 - RNA, 19 nt, Mycobacterium bovis subsp bovis AF2122/97
aacgcccccauccggucga

SEQ ID NO: 1153182 - RNA, 14 nt, Mycobacterium bovis subsp bovis AF2122/97
aacgccccggcgcg

SEQ ID NO: 1153183 - RNA, 13 nt, Mycobacterium bovis subsp bovis AF2122/97
gaccacucgccgg

SEQ ID NO: 1153184 - RNA, 16 nt, Mycobacterium bovis subsp bovis AF2122/97
gaccacucgccggcgg

SEQ ID NO: 1153185 - RNA, 19 nt, Mycobacterium bovis subsp bovis AF2122/97
gaccacgcgagggcauccg

SEQ ID NO: 1153186 - RNA, 15 nt, Mycobacterium bovis subsp bovis AF2122/97
aacgaugccggcaag

SEQ ID NO: 1153187 - RNA, 22 nt, Mycobacterium bovis subsp bovis AF2122/97
aacgauugaacucuggugacgg

SEQ ID NO: 1153188 - RNA, 14 nt, Mycobacterium bovis subsp bovis AF2122/97
aacgauguccgcgc

SEQ ID NO: 1153189 - RNA, 21 nt, Mycobacterium bovis subsp bovis AF2122/97
aacgaugguggcgaucaucgg

SEQ ID NO: 1153190 - RNA, 19 nt, Mycobacterium bovis subsp bovis AF2122/97
gaccagggcagcggccagg

SEQ ID NO: 1153191 - RNA, 14 nt, Mycobacterium bovis subsp bovis AF2122/97
gaccagggccgccg

SEQ ID NO: 1153192 - RNA, 20 nt, Mycobacterium bovis subsp bovis AF2122/97
gaccaucuuaacgucggcaa

SEQ ID NO: 1153193 - RNA, 15 nt, Mycobacterium bovis subsp bovis AF2122/97
gaccaucugcugugg

SEQ ID NO: 1153194 - RNA, 15 nt, Mycobacterium bovis subsp bovis AF2122/97
gaccaggccggcccg

SEQ ID NO: 1153195 - RNA, 17 nt, Mycobacterium bovis subsp bovis AF2122/97
gaccaggccggcccgca

SEQ ID NO: 1153196 - RNA, 12 nt, Mycobacterium bovis subsp bovis AF2122/97
gaccaggcgcgg

SEQ ID NO: 1153197 - RNA, 15 nt, Mycobacterium bovis subsp bovis AF2122/97
gaccaggcgcggcga

SEQ ID NO: 1153198 - RNA, 23 nt, Mycobacterium bovis subsp bovis AF2122/97
gaccaggcuccggccggccagca

SEQ ID NO: 1153199 - RNA, 17 nt, Mycobacterium bovis subsp bovis AF2122/97
gaccaggcgcggcgaca

SEQ ID NO: 1153200 - RNA, 14 nt, Mycobacterium bovis subsp bovis AF2122/97
gaccagcgcuagcg

SEQ ID NO: 1153201 - RNA, 17 nt, Mycobacterium bovis subsp bovis AF2122/97
gaccagcgccgauacca

SEQ ID NO: 1153202 - RNA, 21 nt, Mycobacterium bovis subsp bovis AF2122/97
gaccagcgccgauaccagcca

SEQ ID NO: 1153203 - RNA, 20 nt, Mycobacterium bovis subsp bovis AF2122/97
gaccagcgaaaauucggucu

SEQ ID NO: 1153204 - RNA, 14 nt, Mycobacterium bovis subsp bovis AF2122/97
gaccagcgccccgg

SEQ ID NO: 1153205 - RNA, 19 nt, Mycobacterium bovis subsp bovis AF2122/97
gaccagcgccccggcgcgu

SEQ ID NO: 1153206 - RNA, 14 nt, Mycobacterium bovis subsp bovis AF2122/97
gaccagcaggccgg

SEQ ID NO: 1153207 - RNA, 23 nt, Mycobacterium bovis subsp bovis AF2122/97
gaccagcaggccgggcgcaagca

SEQ ID NO: 1153208 - RNA, 22 nt, Mycobacterium bovis subsp bovis AF2122/97
gaccagccgaucaucaccggca

SEQ ID NO: 1153209 - RNA, 15 nt, Mycobacterium bovis subsp bovis AF2122/97
aacgccucaggggcg

SEQ ID NO: 1153210 - RNA, 17 nt, Mycobacterium bovis subsp bovis AF2122/97
aacgccucaggggcgcc

SEQ ID NO: 1153211 - RNA, 15 nt, Mycobacterium bovis subsp bovis AF2122/97
aacgccgucgccugc

SEQ ID NO: 1153212 - RNA, 13 nt, Mycobacterium bovis subsp bovis AF2122/97
gacccgccgacgc

SEQ ID NO: 1153213 - RNA, 18 nt, Mycobacterium bovis subsp bovis AF2122/97
gacccgccgacgccgccg

SEQ ID NO: 1153214 - RNA, 22 nt, Mycobacterium bovis subsp bovis AF2122/97
gacccgccgaugaugcggcgca

SEQ ID NO: 1153215 - RNA, 15 nt, Mycobacterium bovis subsp bovis AF2122/97
gacccgccggcgacu

SEQ ID NO: 1153216 - RNA, 12 nt, Mycobacterium bovis subsp bovis AF2122/97
gacccgccgccc

SEQ ID NO: 1153217 - RNA, 14 nt, Mycobacterium bovis subsp bovis AF2122/97
gacccgccgcccca

SEQ ID NO: 1153218 - RNA, 16 nt, Mycobacterium bovis subsp bovis AF2122/97
gacccgccgcgcccgg

SEQ ID NO: 1153219 - RNA, 17 nt, Mycobacterium bovis subsp bovis AF2122/97
gacccgccgcgcccggc

SEQ ID NO: 1153220 - RNA, 21 nt, Mycobacterium bovis subsp bovis AF2122/97
gacccgccgcgcccggcgcaa

SEQ ID NO: 1153221 - RNA, 18 nt, Mycobacterium bovis subsp bovis AF2122/97
gacccgcauccacgucgc

SEQ ID NO: 1153222 - RNA, 15 nt, Mycobacterium bovis subsp bovis AF2122/97
gacccaucaccagcg

SEQ ID NO: 1153223 - RNA, 12 nt, Mycobacterium bovis subsp bovis AF2122/97
gacccgccaggg

SEQ ID NO: 1153224 - RNA, 20 nt, Mycobacterium bovis subsp bovis AF2122/97
gacccgccagggcacguggc

SEQ ID NO: 1153225 - RNA, 22 nt, Mycobacterium bovis subsp bovis AF2122/97
gacccgcccuugccgccgaggg

SEQ ID NO: 1153226 - RNA, 18 nt, Mycobacterium bovis subsp bovis AF2122/97
gacccaucaccagcggcu

SEQ ID NO: 1153227 - RNA, 18 nt, Mycobacterium bovis subsp bovis AF2122/97
gacccagcucgucgacgu

SEQ ID NO: 1153228 - RNA, 16 nt, Mycobacterium bovis subsp bovis AF2122/97
gacccagcgcggcaac

SEQ ID NO: 1153229 - RNA, 20 nt, Mycobacterium bovis subsp bovis AF2122/97
gacccagcucgucgacgucg

SEQ ID NO: 1153230 - RNA, 15 nt, Mycobacterium bovis subsp bovis AF2122/97
gacccauacgaacuc

SEQ ID NO: 1153231 - RNA, 15 nt, Mycobacterium bovis subsp bovis AF2122/97
gacccagcgcggcaa

SEQ ID NO: 1153232 - RNA, 21 nt, Mycobacterium bovis subsp bovis AF2122/97
gacccacccgcaccgccggca

SEQ ID NO: 1153233 - RNA, 15 nt, Mycobacterium bovis subsp bovis AF2122/97
gacccaccgccccgg

SEQ ID NO: 1153234 - RNA, 15 nt, Mycobacterium bovis subsp bovis AF2122/97
gacccagaccggcuc

SEQ ID NO: 1153235 - RNA, 23 nt, Mycobacterium bovis subsp bovis AF2122/97
gacccacauuccguagccggcgg

SEQ ID NO: 1153236 - RNA, 16 nt, Mycobacterium bovis subsp bovis AF2122/97
gacccaccaccgcaac

SEQ ID NO: 1153237 - RNA, 16 nt, Mycobacterium bovis subsp bovis AF2122/97
gacccaagucgccgag

SEQ ID NO: 1153238 - RNA, 22 nt, Mycobacterium bovis subsp bovis AF2122/97
gaccaugagccggcgccgccgu

SEQ ID NO: 1153239 - RNA, 18 nt, Mycobacterium bovis subsp bovis AF2122/97
gaccaugaugccuaccgg

SEQ ID NO: 1153240 - RNA, 11 nt, Mycobacterium bovis subsp bovis AF2122/97
gaccaugccga

SEQ ID NO: 1153241 - RNA, 18 nt, Mycobacterium bovis subsp bovis AF2122/97
gacccaacgaccaccacc

SEQ ID NO: 1153242 - RNA, 18 nt, Mycobacterium bovis subsp bovis AF2122/97
gaauugcguucgccgccc

SEQ ID NO: 1153243 - RNA, 18 nt, Mycobacterium bovis subsp bovis AF2122/97
gaauuucgaugagguggc

SEQ ID NO: 1153244 - RNA, 14 nt, Mycobacterium bovis subsp bovis AF2122/97
gaauuugucggcga

SEQ ID NO: 1153245 - RNA, 17 nt, Mycobacterium bovis subsp bovis AF2122/97
gaauuugucggcgaagc

SEQ ID NO: 1153246 - RNA, 21 nt, Mycobacterium bovis subsp bovis AF2122/97
gacaaagcugcucgucggcgc

SEQ ID NO: 1153247 - RNA, 21 nt, Mycobacterium bovis subsp bovis AF2122/97
gacaaagcggcugcccgagau

SEQ ID NO: 1153248 - RNA, 21 nt, Mycobacterium bovis subsp bovis AF2122/97
gacaaacguguugaccggguc

SEQ ID NO: 1153249 - RNA, 14 nt, Mycobacterium bovis subsp bovis AF2122/97
gacaaagccgucga

SEQ ID NO: 1153250 - RNA, 14 nt, Mycobacterium bovis subsp bovis AF2122/97
gacaaagccgucgc

SEQ ID NO: 1153251 - RNA, 20 nt, Mycobacterium bovis subsp bovis AF2122/97
gacaaagacgccgucggcgc

SEQ ID NO: 1153252 - RNA, 14 nt, Mycobacterium bovis subsp bovis AF2122/97
gacaaagccgaacg

SEQ ID NO: 1153253 - RNA, 18 nt, Mycobacterium bovis subsp bovis AF2122/97
gaaugcgguccucgaucg

SEQ ID NO: 1153254 - RNA, 21 nt, Mycobacterium bovis subsp bovis AF2122/97
gaaugcggugaguccgcugag

SEQ ID NO: 1153255 - RNA, 14 nt, Mycobacterium bovis subsp bovis AF2122/97
gaaugcgccgucgg

SEQ ID NO: 1153256 - RNA, 21 nt, Mycobacterium bovis subsp bovis AF2122/97
gaaugcgccgucggugggugc

SEQ ID NO: 1153257 - RNA, 21 nt, Mycobacterium bovis subsp bovis AF2122/97
gaaugccuggcccgucggcgu

SEQ ID NO: 1153258 - RNA, 18 nt, Mycobacterium bovis subsp bovis AF2122/97
gaauucggccggcgcggc

SEQ ID NO: 1153259 - RNA, 14 nt, Mycobacterium bovis subsp bovis AF2122/97
gaauggaccagcgc

SEQ ID NO: 1153260 - RNA, 22 nt, Mycobacterium bovis subsp bovis AF2122/97
gacaacacgccgucgaccggcg

SEQ ID NO: 1153261 - RNA, 16 nt, Mycobacterium bovis subsp bovis AF2122/97
gacaacaggccgucga

SEQ ID NO: 1153262 - RNA, 20 nt, Mycobacterium bovis subsp bovis AF2122/97
gacaacaccacggugccgac

SEQ ID NO: 1153263 - RNA, 23 nt, Mycobacterium bovis subsp bovis AF2122/97
gacaacaccacggugccgacgau

SEQ ID NO: 1153264 - RNA, 23 nt, Mycobacterium bovis subsp bovis AF2122/97
gacaacacgccgucgaccggcgg

SEQ ID NO: 1153265 - RNA, 20 nt, Mycobacterium bovis subsp bovis AF2122/97
gacaacacggcgaaccggcc

SEQ ID NO: 1153266 - RNA, 19 nt, Mycobacterium bovis subsp bovis AF2122/97
gacaacagagucaccgcgc

SEQ ID NO: 1153267 - RNA, 22 nt, Mycobacterium bovis subsp bovis AF2122/97
gacaacagcaagauuauggcga

SEQ ID NO: 1153268 - RNA, 14 nt, Mycobacterium bovis subsp bovis AF2122/97
gacaacaaacccgg

SEQ ID NO: 1153269 - RNA, 15 nt, Mycobacterium bovis subsp bovis AF2122/97
gacaacaaacccggc

SEQ ID NO: 1153270 - RNA, 19 nt, Mycobacterium bovis subsp bovis AF2122/97
gacaacaaacccggccucg

SEQ ID NO: 1153271 - RNA, 14 nt, Mycobacterium bovis subsp bovis AF2122/97
gacaaaucggcggu

SEQ ID NO: 1153272 - RNA, 23 nt, Mycobacterium bovis subsp bovis AF2122/97
gacaacaaacccggccucgguga

SEQ ID NO: 1153273 - RNA, 22 nt, Mycobacterium bovis subsp bovis AF2122/97
gacaaaucgaugaccgucgcac

SEQ ID NO: 1153274 - RNA, 15 nt, Mycobacterium bovis subsp bovis AF2122/97
gacaaaggugccgac

SEQ ID NO: 1153275 - RNA, 15 nt, Mycobacterium bovis subsp bovis AF2122/97
gacaacgccgucgau

SEQ ID NO: 1153276 - RNA, 14 nt, Mycobacterium bovis subsp bovis AF2122/97
gacaacgccgucga

SEQ ID NO: 1153277 - RNA, 15 nt, Mycobacterium bovis subsp bovis AF2122/97
gacaacgaucgcgcg

SEQ ID NO: 1153278 - RNA, 16 nt, Mycobacterium bovis subsp bovis AF2122/97
gacaacgaucgcgcga

SEQ ID NO: 1153279 - RNA, 20 nt, Mycobacterium bovis subsp bovis AF2122/97
gacaacgaucgcgcgagcga

SEQ ID NO: 1153280 - RNA, 17 nt, Mycobacterium bovis subsp bovis AF2122/97
gacaacgacgucgccga

SEQ ID NO: 1153281 - RNA, 22 nt, Mycobacterium bovis subsp bovis AF2122/97
gacaacgacugcguuccgaucg

SEQ ID NO: 1153282 - RNA, 20 nt, Mycobacterium bovis subsp bovis AF2122/97
gacaacccgcucggcggucg

SEQ ID NO: 1153283 - RNA, 17 nt, Mycobacterium bovis subsp bovis AF2122/97
gacaaggugcgcugggu

SEQ ID NO: 1153284 - RNA, 17 nt, Mycobacterium bovis subsp bovis AF2122/97
gacaacgugccgaacgc

SEQ ID NO: 1153285 - RNA, 17 nt, Mycobacterium bovis subsp bovis AF2122/97
gacaagcacagcgaaca

SEQ ID NO: 1153286 - RNA, 14 nt, Mycobacterium bovis subsp bovis AF2122/97
gacaagaccggcgg

SEQ ID NO: 1153287 - RNA, 15 nt, Mycobacterium bovis subsp bovis AF2122/97
gacaagaccggcggg

SEQ ID NO: 1153288 - RNA, 16 nt, Mycobacterium bovis subsp bovis AF2122/97
gacaacugcccgauga

SEQ ID NO: 1153289 - RNA, 23 nt, Mycobacterium bovis subsp bovis AF2122/97
gacaaucucggcguugccgccgu

SEQ ID NO: 1153290 - RNA, 12 nt, Mycobacterium bovis subsp bovis AF2122/97
gacaaucgcacg

SEQ ID NO: 1153291 - RNA, 16 nt, Mycobacterium bovis subsp bovis AF2122/97
gacaauccgccgccgg

SEQ ID NO: 1153292 - RNA, 18 nt, Mycobacterium bovis subsp bovis AF2122/97
gacaagcugucggcgacc

SEQ ID NO: 1153293 - RNA, 21 nt, Mycobacterium bovis subsp bovis AF2122/97
gacaaggauggucgccugcgg

SEQ ID NO: 1153294 - RNA, 19 nt, Mycobacterium bovis subsp bovis AF2122/97
gacaagucggcgcuggccg

SEQ ID NO: 1153295 - RNA, 15 nt, Mycobacterium bovis subsp bovis AF2122/97
gacaagugccggcgc

SEQ ID NO: 1153296 - RNA, 23 nt, Mycobacterium bovis subsp bovis AF2122/97
gacaaguucgguagcgaucgugc

SEQ ID NO: 1153297 - RNA, 14 nt, Mycobacterium bovis subsp bovis AF2122/97
gacaauacgugcga

SEQ ID NO: 1153298 - RNA, 18 nt, Mycobacterium bovis subsp bovis AF2122/97
gacaagucggcaccggug

SEQ ID NO: 1153299 - RNA, 15 nt, Mycobacterium bovis subsp bovis AF2122/97
gaaucgcaucggcgg

SEQ ID NO: 1153300 - RNA, 19 nt, Mycobacterium bovis subsp bovis AF2122/97
gaaucgcccauuucggcac

SEQ ID NO: 1153301 - RNA, 20 nt, Mycobacterium bovis subsp bovis AF2122/97
gaaucgcccauuucggcacg

SEQ ID NO: 1153302 - RNA, 14 nt, Mycobacterium bovis subsp bovis AF2122/97
gaaugccgucgccg

SEQ ID NO: 1153303 - RNA, 21 nt, Mycobacterium bovis subsp bovis AF2122/97
gaaucgcacgaaaucagcccg

SEQ ID NO: 1153304 - RNA, 16 nt, Mycobacterium bovis subsp bovis AF2122/97
gaaucgagcaccgcaa

SEQ ID NO: 1153305 - RNA, 18 nt, Mycobacterium bovis subsp bovis AF2122/97
gaaucgaagcccggcggc

SEQ ID NO: 1153306 - RNA, 19 nt, Mycobacterium bovis subsp bovis AF2122/97
gaaucgaagcccggcggca

SEQ ID NO: 1153307 - RNA, 15 nt, Mycobacterium bovis subsp bovis AF2122/97
gaaucgaagcggcug

SEQ ID NO: 1153308 - RNA, 20 nt, Mycobacterium bovis subsp bovis AF2122/97
gaauccugccgcacgggccc

SEQ ID NO: 1153309 - RNA, 16 nt, Mycobacterium bovis subsp bovis AF2122/97
gaaucaccccggcggc

SEQ ID NO: 1153310 - RNA, 23 nt, Mycobacterium bovis subsp bovis AF2122/97
gaauccggucgaugaccucguca

SEQ ID NO: 1153311 - RNA, 13 nt, Mycobacterium bovis subsp bovis AF2122/97
gaauccggccaga

SEQ ID NO: 1153312 - RNA, 19 nt, Mycobacterium bovis subsp bovis AF2122/97
gaauauggcggccgggucg

SEQ ID NO: 1153313 - RNA, 22 nt, Mycobacterium bovis subsp bovis AF2122/97
gaauagguccggaagcggcguu

SEQ ID NO: 1153314 - RNA, 16 nt, Mycobacterium bovis subsp bovis AF2122/97
gaacugcucgauccgc

SEQ ID NO: 1153315 - RNA, 22 nt, Mycobacterium bovis subsp bovis AF2122/97
gaacugcgcaacaccgugcacc

SEQ ID NO: 1153316 - RNA, 21 nt, Mycobacterium bovis subsp bovis AF2122/97
gaacuggacaagcuccucgcg

SEQ ID NO: 1153317 - RNA, 23 nt, Mycobacterium bovis subsp bovis AF2122/97
gaacuggcggugcagugccucgg

SEQ ID NO: 1153318 - RNA, 22 nt, Mycobacterium bovis subsp bovis AF2122/97
gaaguggagccccgacugcuga

SEQ ID NO: 1153319 - RNA, 20 nt, Mycobacterium bovis subsp bovis AF2122/97
gaagugcucacauccgguca

SEQ ID NO: 1153320 - RNA, 19 nt, Mycobacterium bovis subsp bovis AF2122/97
gaacuggcugguggcgugc

SEQ ID NO: 1153321 - RNA, 16 nt, Mycobacterium bovis subsp bovis AF2122/97
gaacugggccucagac

SEQ ID NO: 1153322 - RNA, 22 nt, Mycobacterium bovis subsp bovis AF2122/97
gaacugcaugguggcgccgacc

SEQ ID NO: 1153323 - RNA, 16 nt, Mycobacterium bovis subsp bovis AF2122/97
gaacucgaccaccgcc

SEQ ID NO: 1153324 - RNA, 15 nt, Mycobacterium bovis subsp bovis AF2122/97
gaacugaugaaccac

SEQ ID NO: 1153325 - RNA, 18 nt, Mycobacterium bovis subsp bovis AF2122/97
gaagugggcguuggcggc

SEQ ID NO: 1153326 - RNA, 19 nt, Mycobacterium bovis subsp bovis AF2122/97
gaaguggucuccggcaccg

SEQ ID NO: 1153327 - RNA, 17 nt, Mycobacterium bovis subsp bovis AF2122/97
gaaguggcgccuugggu

SEQ ID NO: 1153328 - RNA, 16 nt, Mycobacterium bovis subsp bovis AF2122/97
gaaguucucggugcgc

SEQ ID NO: 1153329 - RNA, 22 nt, Mycobacterium bovis subsp bovis AF2122/97
gaaguucggguagccgggaacg

SEQ ID NO: 1153330 - RNA, 17 nt, Mycobacterium bovis subsp bovis AF2122/97
gacaauuuucgcaccua

SEQ ID NO: 1153331 - RNA, 14 nt, Mycobacterium bovis subsp bovis AF2122/97
gacacacgccgccg

SEQ ID NO: 1153332 - RNA, 15 nt, Mycobacterium bovis subsp bovis AF2122/97
gacacacgccgccgg

SEQ ID NO: 1153333 - RNA, 15 nt, Mycobacterium bovis subsp bovis AF2122/97
gacacaacaccggcg

SEQ ID NO: 1153334 - RNA, 14 nt, Mycobacterium bovis subsp bovis AF2122/97
gacaccaccggcgc

SEQ ID NO: 1153335 - RNA, 16 nt, Mycobacterium bovis subsp bovis AF2122/97
gacaccaccggcgccg

SEQ ID NO: 1153336 - RNA, 17 nt, Mycobacterium bovis subsp bovis AF2122/97
gacaccaccggcgccgc

SEQ ID NO: 1153337 - RNA, 20 nt, Mycobacterium bovis subsp bovis AF2122/97
gacaccaccggcgccgccgu

SEQ ID NO: 1153338 - RNA, 21 nt, Mycobacterium bovis subsp bovis AF2122/97
gacacauaagcccccgccacg

SEQ ID NO: 1153339 - RNA, 16 nt, Mycobacterium bovis subsp bovis AF2122/97
gacaccaacaccggug

SEQ ID NO: 1153340 - RNA, 15 nt, Mycobacterium bovis subsp bovis AF2122/97
gacaccaacccaccc

SEQ ID NO: 1153341 - RNA, 15 nt, Mycobacterium bovis subsp bovis AF2122/97
gacaccgagaugcgc

SEQ ID NO: 1153342 - RNA, 16 nt, Mycobacterium bovis subsp bovis AF2122/97
gacaccgagccacgac

SEQ ID NO: 1153343 - RNA, 20 nt, Mycobacterium bovis subsp bovis AF2122/97
gacaccgagccacgacccag

SEQ ID NO: 1153344 - RNA, 17 nt, Mycobacterium bovis subsp bovis AF2122/97
gacaccgaggucggcca

SEQ ID NO: 1153345 - RNA, 15 nt, Mycobacterium bovis subsp bovis AF2122/97
gacaccgaccggguc

SEQ ID NO: 1153346 - RNA, 17 nt, Mycobacterium bovis subsp bovis AF2122/97
gacaccgauccggccgc

SEQ ID NO: 1153347 - RNA, 21 nt, Mycobacterium bovis subsp bovis AF2122/97
gacaccgauccggccgccgau

SEQ ID NO: 1153348 - RNA, 21 nt, Mycobacterium bovis subsp bovis AF2122/97
gacacccugggugccggcagc

SEQ ID NO: 1153349 - RNA, 22 nt, Mycobacterium bovis subsp bovis AF2122/97
gacacccugggugccggcagcg

SEQ ID NO: 1153350 - RNA, 22 nt, Mycobacterium bovis subsp bovis AF2122/97
gacaccgaaccgccgcugccgc

SEQ ID NO: 1153351 - RNA, 14 nt, Mycobacterium bovis subsp bovis AF2122/97
gacacccucgggca

SEQ ID NO: 1153352 - RNA, 16 nt, Mycobacterium bovis subsp bovis AF2122/97
gacacccucgggcaac

SEQ ID NO: 1153353 - RNA, 12 nt, Mycobacterium bovis subsp bovis AF2122/97
gacacccgggcc

SEQ ID NO: 1153354 - RNA, 22 nt, Mycobacterium bovis subsp bovis AF2122/97
gacacccgggccaccccgagcu

SEQ ID NO: 1153355 - RNA, 23 nt, Mycobacterium bovis subsp bovis AF2122/97
gacacccguugagcauaugacgu

SEQ ID NO: 1153356 - RNA, 19 nt, Mycobacterium bovis subsp bovis AF2122/97
gacacccgagggccugacg

SEQ ID NO: 1153357 - RNA, 21 nt, Mycobacterium bovis subsp bovis AF2122/97
gacacccgcauggcagcggcg

SEQ ID NO: 1153358 - RNA, 21 nt, Mycobacterium bovis subsp bovis AF2122/97
gacacccgccaggccgcgcga

SEQ ID NO: 1153359 - RNA, 22 nt, Mycobacterium bovis subsp bovis AF2122/97
gacacccaucgaccgcccgcca

SEQ ID NO: 1153360 - RNA, 15 nt, Mycobacterium bovis subsp bovis AF2122/97
gacaccccggaaucc

SEQ ID NO: 1153361 - RNA, 21 nt, Mycobacterium bovis subsp bovis AF2122/97
gacaccaccgaggucgagcga

SEQ ID NO: 1153362 - RNA, 14 nt, Mycobacterium bovis subsp bovis AF2122/97
gacaccaccgcccg

SEQ ID NO: 1153363 - RNA, 17 nt, Mycobacterium bovis subsp bovis AF2122/97
gacaccaucuccgccgu

SEQ ID NO: 1153364 - RNA, 18 nt, Mycobacterium bovis subsp bovis AF2122/97
gacaccauaggccgacgg

SEQ ID NO: 1153365 - RNA, 19 nt, Mycobacterium bovis subsp bovis AF2122/97
gacaccauaggccgacggg

SEQ ID NO: 1153366 - RNA, 17 nt, Mycobacterium bovis subsp bovis AF2122/97
gacaaugucggcgaugc

SEQ ID NO: 1153367 - RNA, 18 nt, Mycobacterium bovis subsp bovis AF2122/97
gacaccgcgaucaccacc

SEQ ID NO: 1153368 - RNA, 17 nt, Mycobacterium bovis subsp bovis AF2122/97
gacaccgcggacccgca

SEQ ID NO: 1153369 - RNA, 12 nt, Mycobacterium bovis subsp bovis AF2122/97
gacaccgcccga

SEQ ID NO: 1153370 - RNA, 18 nt, Mycobacterium bovis subsp bovis AF2122/97
gacaccgccccgccgcga

SEQ ID NO: 1153371 - RNA, 18 nt, Mycobacterium bovis subsp bovis AF2122/97
gacaccccggaaucccca

SEQ ID NO: 1153372 - RNA, 22 nt, Mycobacterium bovis subsp bovis AF2122/97
gacaccgccaccacgccgucga

SEQ ID NO: 1153373 - RNA, 14 nt, Mycobacterium bovis subsp bovis AF2122/97
gacaccgcagcggg

SEQ ID NO: 1153374 - RNA, 20 nt, Mycobacterium bovis subsp bovis AF2122/97
gacaccgaucggacgucgug

SEQ ID NO: 1153375 - RNA, 15 nt, Mycobacterium bovis subsp bovis AF2122/97
gacaccgccaccacg

SEQ ID NO: 1153376 - RNA, 16 nt, Mycobacterium bovis subsp bovis AF2122/97
gacaccgccaccacgc

SEQ ID NO: 1153377 - RNA, 19 nt, Mycobacterium bovis subsp bovis AF2122/97
gacaccgccaccacgccgu

SEQ ID NO: 1153378 - RNA, 13 nt, Mycobacterium bovis subsp bovis AF2122/97
gacaccggcacca

SEQ ID NO: 1153379 - RNA, 15 nt, Mycobacterium bovis subsp bovis AF2122/97
gacaccggucggcag

SEQ ID NO: 1153380 - RNA, 14 nt, Mycobacterium bovis subsp bovis AF2122/97
gacaccggucggca

SEQ ID NO: 1153381 - RNA, 17 nt, Mycobacterium bovis subsp bovis AF2122/97
gacaccggccaccagcc

SEQ ID NO: 1153382 - RNA, 16 nt, Mycobacterium bovis subsp bovis AF2122/97
gacaccggccgcgacg

SEQ ID NO: 1153383 - RNA, 13 nt, Mycobacterium bovis subsp bovis AF2122/97
gacaccggcggca

SEQ ID NO: 1153384 - RNA, 18 nt, Mycobacterium bovis subsp bovis AF2122/97
gacaccgcggugccccgg

SEQ ID NO: 1153385 - RNA, 16 nt, Mycobacterium bovis subsp bovis AF2122/97
gacaccguccagcagc

SEQ ID NO: 1153386 - RNA, 19 nt, Mycobacterium bovis subsp bovis AF2122/97
gacaccguggaucggcagc

SEQ ID NO: 1153387 - RNA, 19 nt, Mycobacterium bovis subsp bovis AF2122/97
gacaccgugucgccggcga

SEQ ID NO: 1153388 - RNA, 15 nt, Mycobacterium bovis subsp bovis AF2122/97
gacaccucgggcgcc

SEQ ID NO: 1153389 - RNA, 14 nt, Mycobacterium bovis subsp bovis AF2122/97
gacaccuaccgaga

SEQ ID NO: 1153390 - RNA, 20 nt, Mycobacterium bovis subsp bovis AF2122/97
gacacuaaagcccucgacac

SEQ ID NO: 1153391 - RNA, 17 nt, Mycobacterium bovis subsp bovis AF2122/97
gacacgucgcgccaggc

SEQ ID NO: 1153392 - RNA, 19 nt, Mycobacterium bovis subsp bovis AF2122/97
gacacgucuaucggcgaac

SEQ ID NO: 1153393 - RNA, 13 nt, Mycobacterium bovis subsp bovis AF2122/97
gacacggcucgcc

SEQ ID NO: 1153394 - RNA, 16 nt, Mycobacterium bovis subsp bovis AF2122/97
gacacgcugcaggcgg

SEQ ID NO: 1153395 - RNA, 13 nt, Mycobacterium bovis subsp bovis AF2122/97
gacacggcgcugc

SEQ ID NO: 1153396 - RNA, 12 nt, Mycobacterium bovis subsp bovis AF2122/97
gacacgccgaug

SEQ ID NO: 1153397 - RNA, 15 nt, Mycobacterium bovis subsp bovis AF2122/97
gacacgccgaugccg

SEQ ID NO: 1153398 - RNA, 20 nt, Mycobacterium bovis subsp bovis AF2122/97
gacacgccgugcgugcgggg

SEQ ID NO: 1153399 - RNA, 15 nt, Mycobacterium bovis subsp bovis AF2122/97
gacacgccgauucgc

SEQ ID NO: 1153400 - RNA, 18 nt, Mycobacterium bovis subsp bovis AF2122/97
gacaccuuucuccacacu

SEQ ID NO: 1153401 - RNA, 19 nt, Mycobacterium bovis subsp bovis AF2122/97
gacaccugucguccucgcu

SEQ ID NO: 1153402 - RNA, 17 nt, Mycobacterium bovis subsp bovis AF2122/97
gacaccuccgucagcgc

SEQ ID NO: 1153403 - RNA, 16 nt, Mycobacterium bovis subsp bovis AF2122/97
gacacgccagccgugc

SEQ ID NO: 1153404 - RNA, 23 nt, Mycobacterium bovis subsp bovis AF2122/97
gacacgccaggugaugccgccgu

SEQ ID NO: 1153405 - RNA, 20 nt, Mycobacterium bovis subsp bovis AF2122/97
gacacucaaccugaaccggc

SEQ ID NO: 1153406 - RNA, 20 nt, Mycobacterium bovis subsp bovis AF2122/97
gacacugccuuaaccgagcc

SEQ ID NO: 1153407 - RNA, 22 nt, Mycobacterium bovis subsp bovis AF2122/97
gacacugccuuaaccgagccga

SEQ ID NO: 1153408 - RNA, 18 nt, Mycobacterium bovis subsp bovis AF2122/97
gacacugcugcggcagcg

SEQ ID NO: 1153409 - RNA, 17 nt, Mycobacterium bovis subsp bovis AF2122/97
gacacuggggugcugcg

SEQ ID NO: 1153410 - RNA, 17 nt, Mycobacterium bovis subsp bovis AF2122/97
gacacuggucgcggcgc

SEQ ID NO: 1153411 - RNA, 20 nt, Mycobacterium bovis subsp bovis AF2122/97
gacacuggucgcggcgcugg

SEQ ID NO: 1153412 - RNA, 21 nt, Mycobacterium bovis subsp bovis AF2122/97
gacacuggucgcggcgcuggc

SEQ ID NO: 1153413 - RNA, 20 nt, Mycobacterium bovis subsp bovis AF2122/97
gacagcacccaaugccaccg

SEQ ID NO: 1153414 - RNA, 24 nt, Mycobacterium bovis subsp bovis AF2122/97
gacagcaccgaauuacgcaccgag

SEQ ID NO: 1153415 - RNA, 14 nt, Mycobacterium bovis subsp bovis AF2122/97
gacagcaccgccgg

SEQ ID NO: 1153416 - RNA, 20 nt, Mycobacterium bovis subsp bovis AF2122/97
gacagagcggguucgacguu

SEQ ID NO: 1153417 - RNA, 14 nt, Mycobacterium bovis subsp bovis AF2122/97
gacagaugccgggc

SEQ ID NO: 1153418 - RNA, 22 nt, Mycobacterium bovis subsp bovis AF2122/97
gacagauggucggucgcuucag

SEQ ID NO: 1153419 - RNA, 16 nt, Mycobacterium bovis subsp bovis AF2122/97
gacagaugcauccagc

SEQ ID NO: 1153420 - RNA, 22 nt, Mycobacterium bovis subsp bovis AF2122/97
gacagcuaucccaggggcaccg

SEQ ID NO: 1153421 - RNA, 22 nt, Mycobacterium bovis subsp bovis AF2122/97
gacagcgucucgccgggaaaca

SEQ ID NO: 1153422 - RNA, 16 nt, Mycobacterium bovis subsp bovis AF2122/97
gacagcgugccgaaca

SEQ ID NO: 1153423 - RNA, 13 nt, Mycobacterium bovis subsp bovis AF2122/97
gacagcuuggccg

SEQ ID NO: 1153424 - RNA, 15 nt, Mycobacterium bovis subsp bovis AF2122/97
gacagcagccggcgu

SEQ ID NO: 1153425 - RNA, 18 nt, Mycobacterium bovis subsp bovis AF2122/97
gacagcagccggugccgg

SEQ ID NO: 1153426 - RNA, 21 nt, Mycobacterium bovis subsp bovis AF2122/97
gacagcagccggugccggucg

SEQ ID NO: 1153427 - RNA, 17 nt, Mycobacterium bovis subsp bovis AF2122/97
gacagcagcgccacccg

SEQ ID NO: 1153428 - RNA, 13 nt, Mycobacterium bovis subsp bovis AF2122/97
gacagcagccgcc

SEQ ID NO: 1153429 - RNA, 14 nt, Mycobacterium bovis subsp bovis AF2122/97
gacagcagccgccg

SEQ ID NO: 1153430 - RNA, 13 nt, Mycobacterium bovis subsp bovis AF2122/97
gacagcggcaccg

SEQ ID NO: 1153431 - RNA, 14 nt, Mycobacterium bovis subsp bovis AF2122/97
gacagcggcaccgg

SEQ ID NO: 1153432 - RNA, 20 nt, Mycobacterium bovis subsp bovis AF2122/97
gacagcacccggccaccgga

SEQ ID NO: 1153433 - RNA, 18 nt, Mycobacterium bovis subsp bovis AF2122/97
aacgacgcuuucccgaug

SEQ ID NO: 1153434 - RNA, 13 nt, Mycobacterium bovis subsp bovis AF2122/97
aacgacggcaaca

SEQ ID NO: 1153435 - RNA, 14 nt, Mycobacterium bovis subsp bovis AF2122/97
aacgacggccgaca

SEQ ID NO: 1153436 - RNA, 18 nt, Mycobacterium bovis subsp bovis AF2122/97
aacgacgccaugagcgcg

SEQ ID NO: 1153437 - RNA, 16 nt, Mycobacterium bovis subsp bovis AF2122/97
aacgacgccgcggucg

SEQ ID NO: 1153438 - RNA, 19 nt, Mycobacterium bovis subsp bovis AF2122/97
aacgacggccgucgcccca

SEQ ID NO: 1153439 - RNA, 19 nt, Mycobacterium bovis subsp bovis AF2122/97
aacgacccgccgccccaca

SEQ ID NO: 1153440 - RNA, 16 nt, Mycobacterium bovis subsp bovis AF2122/97
aacgacaugggcaggc

SEQ ID NO: 1153441 - RNA, 15 nt, Mycobacterium bovis subsp bovis AF2122/97
gacaggaacggcccg

SEQ ID NO: 1153442 - RNA, 17 nt, Mycobacterium bovis subsp bovis AF2122/97
gacaggccggccaccag

SEQ ID NO: 1153443 - RNA, 19 nt, Mycobacterium bovis subsp bovis AF2122/97
gacaggccaccgcagacgc

SEQ ID NO: 1153444 - RNA, 18 nt, Mycobacterium bovis subsp bovis AF2122/97
gacaucaccgaacggcga

SEQ ID NO: 1153445 - RNA, 17 nt, Mycobacterium bovis subsp bovis AF2122/97
gacauccuugacgcggc

SEQ ID NO: 1153446 - RNA, 19 nt, Mycobacterium bovis subsp bovis AF2122/97
gacauccuugacgcggcca

SEQ ID NO: 1153447 - RNA, 20 nt, Mycobacterium bovis subsp bovis AF2122/97
gacauccuugacgcggccac

SEQ ID NO: 1153448 - RNA, 21 nt, Mycobacterium bovis subsp bovis AF2122/97
gacaucccugacgaaggucuc

SEQ ID NO: 1153449 - RNA, 15 nt, Mycobacterium bovis subsp bovis AF2122/97
gacauccgcuuacgg

SEQ ID NO: 1153450 - RNA, 20 nt, Mycobacterium bovis subsp bovis AF2122/97
gacaucacgaaggcguucgc

SEQ ID NO: 1153451 - RNA, 22 nt, Mycobacterium bovis subsp bovis AF2122/97
gacaucaccaccgaccuggacg

SEQ ID NO: 1153452 - RNA, 20 nt, Mycobacterium bovis subsp bovis AF2122/97
gacaucaccaccgccggggu

SEQ ID NO: 1153453 - RNA, 17 nt, Mycobacterium bovis subsp bovis AF2122/97
gacauaguuggcgcccg

SEQ ID NO: 1153454 - RNA, 18 nt, Mycobacterium bovis subsp bovis AF2122/97
gacauaguuggcgcccga

SEQ ID NO: 1153455 - RNA, 13 nt, Mycobacterium bovis subsp bovis AF2122/97
cgucgaccucgcg

SEQ ID NO: 1153456 - RNA, 21 nt, Mycobacterium bovis subsp bovis AF2122/97
cgucgaccucgcgggcgaucg

SEQ ID NO: 1153457 - RNA, 23 nt, Mycobacterium bovis subsp bovis AF2122/97
cgucgaccucgcgggcgaucggc

SEQ ID NO: 1153458 - RNA, 14 nt, Mycobacterium bovis subsp bovis AF2122/97
cgucgaccucggca

SEQ ID NO: 1153459 - RNA, 16 nt, Mycobacterium bovis subsp bovis AF2122/97
cgucgaccucggcaac

SEQ ID NO: 1153460 - RNA, 15 nt, Mycobacterium bovis subsp bovis AF2122/97
cgucgaccggaacca

SEQ ID NO: 1153461 - RNA, 19 nt, Mycobacterium bovis subsp bovis AF2122/97
cgucgacgaggucagcggu

SEQ ID NO: 1153462 - RNA, 13 nt, Mycobacterium bovis subsp bovis AF2122/97
cgucgacgucgau

SEQ ID NO: 1153463 - RNA, 17 nt, Mycobacterium bovis subsp bovis AF2122/97
cgucgacgucgauggug

SEQ ID NO: 1153464 - RNA, 14 nt, Mycobacterium bovis subsp bovis AF2122/97
cgucgacgucgacg

SEQ ID NO: 1153465 - RNA, 13 nt, Mycobacterium bovis subsp bovis AF2122/97
cgucgacgaucag

SEQ ID NO: 1153466 - RNA, 20 nt, Mycobacterium bovis subsp bovis AF2122/97
cgucgacugcgugccgcacc

SEQ ID NO: 1153467 - RNA, 22 nt, Mycobacterium bovis subsp bovis AF2122/97
cgucgacugcgugccgcaccgc

SEQ ID NO: 1153468 - RNA, 20 nt, Mycobacterium bovis subsp bovis AF2122/97
cgucgaccgugucaccgccg

SEQ ID NO: 1153469 - RNA, 20 nt, Mycobacterium bovis subsp bovis AF2122/97
cgucgacgucggcaucggcg

SEQ ID NO: 1153470 - RNA, 18 nt, Mycobacterium bovis subsp bovis AF2122/97
cgucgacgucggcgagcu

SEQ ID NO: 1153471 - RNA, 21 nt, Mycobacterium bovis subsp bovis AF2122/97
cgucgacuugcaggcguccca

SEQ ID NO: 1153472 - RNA, 22 nt, Mycobacterium bovis subsp bovis AF2122/97
cgucgacuugcaggcgucccag

SEQ ID NO: 1153473 - RNA, 15 nt, Mycobacterium bovis subsp bovis AF2122/97
cgucgagcaccaccc

SEQ ID NO: 1153474 - RNA, 20 nt, Mycobacterium bovis subsp bovis AF2122/97
cgucgagcaccacccgggcc

SEQ ID NO: 1153475 - RNA, 18 nt, Mycobacterium bovis subsp bovis AF2122/97
cgucgagauagucggccg

SEQ ID NO: 1153476 - RNA, 17 nt, Mycobacterium bovis subsp bovis AF2122/97
cgucgagauccucgucg

SEQ ID NO: 1153477 - RNA, 19 nt, Mycobacterium bovis subsp bovis AF2122/97
cgucgagauccucgucgag

SEQ ID NO: 1153478 - RNA, 21 nt, Mycobacterium bovis subsp bovis AF2122/97
cgucgagauccucgucgaggu

SEQ ID NO: 1153479 - RNA, 22 nt, Mycobacterium bovis subsp bovis AF2122/97
cgucgagcaacgugacccggau

SEQ ID NO: 1153480 - RNA, 14 nt, Mycobacterium bovis subsp bovis AF2122/97
cgucgagcagcgcc

SEQ ID NO: 1153481 - RNA, 15 nt, Mycobacterium bovis subsp bovis AF2122/97
cgucgagcagcgcca

SEQ ID NO: 1153482 - RNA, 14 nt, Mycobacterium bovis subsp bovis AF2122/97
cgucgagcagccga

SEQ ID NO: 1153483 - RNA, 19 nt, Mycobacterium bovis subsp bovis AF2122/97
cgucgagcacggugagccg

SEQ ID NO: 1153484 - RNA, 16 nt, Mycobacterium bovis subsp bovis AF2122/97
cgucgagccgaccgcg

SEQ ID NO: 1153485 - RNA, 17 nt, Mycobacterium bovis subsp bovis AF2122/97
cgucgagccgaccgcgg

SEQ ID NO: 1153486 - RNA, 18 nt, Mycobacterium bovis subsp bovis AF2122/97
cgucgagccgaccgcggg

SEQ ID NO: 1153487 - RNA, 14 nt, Mycobacterium bovis subsp bovis AF2122/97
cgucgagccgaucg

SEQ ID NO: 1153488 - RNA, 19 nt, Mycobacterium bovis subsp bovis AF2122/97
cgucgagccgaucgcccgc

SEQ ID NO: 1153489 - RNA, 15 nt, Mycobacterium bovis subsp bovis AF2122/97
cgucgagccgaccgc

SEQ ID NO: 1153490 - RNA, 14 nt, Mycobacterium bovis subsp bovis AF2122/97
cgucgagccacagc

SEQ ID NO: 1153491 - RNA, 19 nt, Mycobacterium bovis subsp bovis AF2122/97
cgucgagccacagcgucga

SEQ ID NO: 1153492 - RNA, 21 nt, Mycobacterium bovis subsp bovis AF2122/97
cgucgagcagcgccacccgcg

SEQ ID NO: 1153493 - RNA, 14 nt, Mycobacterium bovis subsp bovis AF2122/97
cgucgagccgugcc

SEQ ID NO: 1153494 - RNA, 20 nt, Mycobacterium bovis subsp bovis AF2122/97
cgucgagcgacccccagcgc

SEQ ID NO: 1153495 - RNA, 22 nt, Mycobacterium bovis subsp bovis AF2122/97
cgucgagcgacccccagcgccc

SEQ ID NO: 1153496 - RNA, 13 nt, Mycobacterium bovis subsp bovis AF2122/97
cgucgagcgcgcc

SEQ ID NO: 1153497 - RNA, 14 nt, Mycobacterium bovis subsp bovis AF2122/97
cgucgagcgcgcca

SEQ ID NO: 1153498 - RNA, 17 nt, Mycobacterium bovis subsp bovis AF2122/97
cgucgaucggcuugccu

SEQ ID NO: 1153499 - RNA, 22 nt, Mycobacterium bovis subsp bovis AF2122/97
cgucgaucucgaucgacccggu

SEQ ID NO: 1153500 - RNA, 17 nt, Mycobacterium bovis subsp bovis AF2122/97
cgucgaucucggcgcag

SEQ ID NO: 1153501 - RNA, 15 nt, Mycobacterium bovis subsp bovis AF2122/97
cgucgaucgcggacc

SEQ ID NO: 1153502 - RNA, 18 nt, Mycobacterium bovis subsp bovis AF2122/97
cgucgaucagcggcagca

SEQ ID NO: 1153503 - RNA, 16 nt, Mycobacterium bovis subsp bovis AF2122/97
cgucgaucgacucaca

SEQ ID NO: 1153504 - RNA, 23 nt, Mycobacterium bovis subsp bovis AF2122/97
cgucgagguggcgcacaucgcga

SEQ ID NO: 1153505 - RNA, 14 nt, Mycobacterium bovis subsp bovis AF2122/97
cgucgaucagcggc

SEQ ID NO: 1153506 - RNA, 16 nt, Mycobacterium bovis subsp bovis AF2122/97
cgucgaucagggcccc

SEQ ID NO: 1153507 - RNA, 19 nt, Mycobacterium bovis subsp bovis AF2122/97
cgucgaugucguuggccac

SEQ ID NO: 1153508 - RNA, 18 nt, Mycobacterium bovis subsp bovis AF2122/97
cgucgaugucgacgucgc

SEQ ID NO: 1153509 - RNA, 18 nt, Mycobacterium bovis subsp bovis AF2122/97
cgucgauggucuccggac

SEQ ID NO: 1153510 - RNA, 21 nt, Mycobacterium bovis subsp bovis AF2122/97
cgucgauggucuccggacgca

SEQ ID NO: 1153511 - RNA, 15 nt, Mycobacterium bovis subsp bovis AF2122/97
cgucgauggugcggc

SEQ ID NO: 1153512 - RNA, 17 nt, Mycobacterium bovis subsp bovis AF2122/97
cgucgauguccccggcg

SEQ ID NO: 1153513 - RNA, 19 nt, Mycobacterium bovis subsp bovis AF2122/97
cgucgauguccccggcggc

SEQ ID NO: 1153514 - RNA, 22 nt, Mycobacterium bovis subsp bovis AF2122/97
cgucgauguccccggcggcagc

SEQ ID NO: 1153515 - RNA, 23 nt, Mycobacterium bovis subsp bovis AF2122/97
cgucgauguccccggcggcagca

SEQ ID NO: 1153516 - RNA, 20 nt, Mycobacterium bovis subsp bovis AF2122/97
cgucgaugaccagcacaccg

SEQ ID NO: 1153517 - RNA, 21 nt, Mycobacterium bovis subsp bovis AF2122/97
cgucgaugaccagcacaccgc

SEQ ID NO: 1153518 - RNA, 23 nt, Mycobacterium bovis subsp bovis AF2122/97
cgucgaugaccuugggaccaccg

SEQ ID NO: 1153519 - RNA, 18 nt, Mycobacterium bovis subsp bovis AF2122/97
cgucgaguaguucgucga

SEQ ID NO: 1153520 - RNA, 20 nt, Mycobacterium bovis subsp bovis AF2122/97
cgucgaguaguucgucgacg

SEQ ID NO: 1153521 - RNA, 21 nt, Mycobacterium bovis subsp bovis AF2122/97
cgucgaguaguucgucgacgu

SEQ ID NO: 1153522 - RNA, 15 nt, Mycobacterium bovis subsp bovis AF2122/97
cgucgaguccaggcc

SEQ ID NO: 1153523 - RNA, 17 nt, Mycobacterium bovis subsp bovis AF2122/97
cgucgaggcggcagucg

SEQ ID NO: 1153524 - RNA, 19 nt, Mycobacterium bovis subsp bovis AF2122/97
cgucgaggucagugggcgg

SEQ ID NO: 1153525 - RNA, 16 nt, Mycobacterium bovis subsp bovis AF2122/97
cgucgagguccaccac

SEQ ID NO: 1153526 - RNA, 21 nt, Mycobacterium bovis subsp bovis AF2122/97
cgucgagguccucgucgucga

SEQ ID NO: 1153527 - RNA, 20 nt, Mycobacterium bovis subsp bovis AF2122/97
cgucgagcucguccucgucu

SEQ ID NO: 1153528 - RNA, 22 nt, Mycobacterium bovis subsp bovis AF2122/97
cgucgagcgucugcgaucccga

SEQ ID NO: 1153529 - RNA, 18 nt, Mycobacterium bovis subsp bovis AF2122/97
cgucgagcgugcgcacgg

SEQ ID NO: 1153530 - RNA, 20 nt, Mycobacterium bovis subsp bovis AF2122/97
cgucgagcgugcgcacggcg

SEQ ID NO: 1153531 - RNA, 15 nt, Mycobacterium bovis subsp bovis AF2122/97
cgucgagcgcgucgg

SEQ ID NO: 1153532 - RNA, 21 nt, Mycobacterium bovis subsp bovis AF2122/97
cgucgagcgccuugucgaucu

SEQ ID NO: 1153533 - RNA, 15 nt, Mycobacterium bovis subsp bovis AF2122/97
cgucgagcgcggugc

SEQ ID NO: 1153534 - RNA, 16 nt, Mycobacterium bovis subsp bovis AF2122/97
cgucgccacgaugccg

SEQ ID NO: 1153535 - RNA, 18 nt, Mycobacterium bovis subsp bovis AF2122/97
cgucgccacgaugccggc

SEQ ID NO: 1153536 - RNA, 12 nt, Mycobacterium bovis subsp bovis AF2122/97
cgucgccaggcc

SEQ ID NO: 1153537 - RNA, 23 nt, Mycobacterium bovis subsp bovis AF2122/97
cgucgccauuccaucgcgcaccg

SEQ ID NO: 1153538 - RNA, 22 nt, Mycobacterium bovis subsp bovis AF2122/97
cgucgccagggccgccgaagcu

SEQ ID NO: 1153539 - RNA, 20 nt, Mycobacterium bovis subsp bovis AF2122/97
cgucgccagauagguccgau

SEQ ID NO: 1153540 - RNA, 18 nt, Mycobacterium bovis subsp bovis AF2122/97
cgucgccagggccgccga

SEQ ID NO: 1153541 - RNA, 23 nt, Mycobacterium bovis subsp bovis AF2122/97
cgucgauguucgccgcgcggaac

SEQ ID NO: 1153542 - RNA, 16 nt, Mycobacterium bovis subsp bovis AF2122/97
cgucgauuagcccacc

SEQ ID NO: 1153543 - RNA, 20 nt, Mycobacterium bovis subsp bovis AF2122/97
cgucgauuagcccacccaug

SEQ ID NO: 1153544 - RNA, 22 nt, Mycobacterium bovis subsp bovis AF2122/97
cgucgauugcaggucggcccag

SEQ ID NO: 1153545 - RNA, 18 nt, Mycobacterium bovis subsp bovis AF2122/97
cgucgauugucaacccgu

SEQ ID NO: 1153546 - RNA, 16 nt, Mycobacterium bovis subsp bovis AF2122/97
cgucgauuucgacgac

SEQ ID NO: 1153547 - RNA, 15 nt, Mycobacterium bovis subsp bovis AF2122/97
cgucgauguggcgcu

SEQ ID NO: 1153548 - RNA, 21 nt, Mycobacterium bovis subsp bovis AF2122/97
cgucgauguggcgcuccggcg

SEQ ID NO: 1153549 - RNA, 16 nt, Mycobacterium bovis subsp bovis AF2122/97
cgucgaugugcgccca

SEQ ID NO: 1153550 - RNA, 22 nt, Mycobacterium bovis subsp bovis AF2122/97
cgucgccaccgauggcgguggu

SEQ ID NO: 1153551 - RNA, 14 nt, Mycobacterium bovis subsp bovis AF2122/97
cgucgccaccaucg

SEQ ID NO: 1153552 - RNA, 18 nt, Mycobacterium bovis subsp bovis AF2122/97
cgucgcaaggcccgcacc

SEQ ID NO: 1153553 - RNA, 20 nt, Mycobacterium bovis subsp bovis AF2122/97
cgucgcaaggcccgcaccgc

SEQ ID NO: 1153554 - RNA, 18 nt, Mycobacterium bovis subsp bovis AF2122/97
cgucgcaacgcgaucacc

SEQ ID NO: 1153555 - RNA, 23 nt, Mycobacterium bovis subsp bovis AF2122/97
cgucgcaacggccccccccaggu

SEQ ID NO: 1153556 - RNA, 22 nt, Mycobacterium bovis subsp bovis AF2122/97
cgucgcaaacuucgcgcacgcc

SEQ ID NO: 1153557 - RNA, 18 nt, Mycobacterium bovis subsp bovis AF2122/97
cgucgauuucgacgacca

SEQ ID NO: 1153558 - RNA, 20 nt, Mycobacterium bovis subsp bovis AF2122/97
cgucgauuucgacgaccacc

SEQ ID NO: 1153559 - RNA, 18 nt, Mycobacterium bovis subsp bovis AF2122/97
cgucgauuucggcgaccg

SEQ ID NO: 1153560 - RNA, 23 nt, Mycobacterium bovis subsp bovis AF2122/97
cgucgccggccuugagcacccga

SEQ ID NO: 1153561 - RNA, 13 nt, Mycobacterium bovis subsp bovis AF2122/97
cgucgccggccgu

SEQ ID NO: 1153562 - RNA, 15 nt, Mycobacterium bovis subsp bovis AF2122/97
cgucgccggccccgc

SEQ ID NO: 1153563 - RNA, 15 nt, Mycobacterium bovis subsp bovis AF2122/97
cgucgccggacgaca

SEQ ID NO: 1153564 - RNA, 14 nt, Mycobacterium bovis subsp bovis AF2122/97
cgucgccggcggcg

SEQ ID NO: 1153565 - RNA, 16 nt, Mycobacterium bovis subsp bovis AF2122/97
cgucgccggcuaccgc

SEQ ID NO: 1153566 - RNA, 20 nt, Mycobacterium bovis subsp bovis AF2122/97
cgucgcgauugccgcgguug

SEQ ID NO: 1153567 - RNA, 16 nt, Mycobacterium bovis subsp bovis AF2122/97
cgucgccgccgucacc

SEQ ID NO: 1153568 - RNA, 17 nt, Mycobacterium bovis subsp bovis AF2122/97
cgucgccgccgucaccg

SEQ ID NO: 1153569 - RNA, 14 nt, Mycobacterium bovis subsp bovis AF2122/97
cgucgccgccguua

SEQ ID NO: 1153570 - RNA, 14 nt, Mycobacterium bovis subsp bovis AF2122/97
cgucgccgcgcaga

SEQ ID NO: 1153571 - RNA, 14 nt, Mycobacterium bovis subsp bovis AF2122/97
cgucgccgccguug

SEQ ID NO: 1153572 - RNA, 18 nt, Mycobacterium bovis subsp bovis AF2122/97
cgucgccggagucgauca

SEQ ID NO: 1153573 - RNA, 20 nt, Mycobacterium bovis subsp bovis AF2122/97
cgucgccggagucgaucagc

SEQ ID NO: 1153574 - RNA, 23 nt, Mycobacterium bovis subsp bovis AF2122/97
cgucgccggauagcgcagcucgc

SEQ ID NO: 1153575 - RNA, 16 nt, Mycobacterium bovis subsp bovis AF2122/97
cgucgccggcaccggc

SEQ ID NO: 1153576 - RNA, 11 nt, Mycobacterium bovis subsp bovis AF2122/97
cgucgccgcgg

SEQ ID NO: 1153577 - RNA, 21 nt, Mycobacterium bovis subsp bovis AF2122/97
cgucgccgcggcggcagcggc

SEQ ID NO: 1153578 - RNA, 15 nt, Mycobacterium bovis subsp bovis AF2122/97
cgucgccgcgguaga

SEQ ID NO: 1153579 - RNA, 22 nt, Mycobacterium bovis subsp bovis AF2122/97
cgucgccgcgguagacgccgcc

SEQ ID NO: 1153580 - RNA, 16 nt, Mycobacterium bovis subsp bovis AF2122/97
cgucgcgccgcguggu

SEQ ID NO: 1153581 - RNA, 16 nt, Mycobacterium bovis subsp bovis AF2122/97
cgucgcgccugcccgg

SEQ ID NO: 1153582 - RNA, 17 nt, Mycobacterium bovis subsp bovis AF2122/97
cgucgcgcaucgccucc

SEQ ID NO: 1153583 - RNA, 17 nt, Mycobacterium bovis subsp bovis AF2122/97
cgucgcgccaggcgcga

SEQ ID NO: 1153584 - RNA, 19 nt, Mycobacterium bovis subsp bovis AF2122/97
cgucgcggaucagcccgcg

SEQ ID NO: 1153585 - RNA, 20 nt, Mycobacterium bovis subsp bovis AF2122/97
cgucgcggauugccgcgcgc

SEQ ID NO: 1153586 - RNA, 16 nt, Mycobacterium bovis subsp bovis AF2122/97
cgucgcggcacgccca

SEQ ID NO: 1153587 - RNA, 14 nt, Mycobacterium bovis subsp bovis AF2122/97
cgucgcgcugccgg

SEQ ID NO: 1153588 - RNA, 17 nt, Mycobacterium bovis subsp bovis AF2122/97
cgucgcggccacgguca

SEQ ID NO: 1153589 - RNA, 21 nt, Mycobacterium bovis subsp bovis AF2122/97
cgucgcggccggcggccgccc

SEQ ID NO: 1153590 - RNA, 15 nt, Mycobacterium bovis subsp bovis AF2122/97
cgucgcggccgucgc

SEQ ID NO: 1153591 - RNA, 18 nt, Mycobacterium bovis subsp bovis AF2122/97
cgucgcggccgagacggc

SEQ ID NO: 1153592 - RNA, 22 nt, Mycobacterium bovis subsp bovis AF2122/97
cgucgcggccgagacggcguug

SEQ ID NO: 1153593 - RNA, 17 nt, Mycobacterium bovis subsp bovis AF2122/97
cgucgcggacggugcgg

SEQ ID NO: 1153594 - RNA, 16 nt, Mycobacterium bovis subsp bovis AF2122/97
cgucgcgcucgcacca

SEQ ID NO: 1153595 - RNA, 13 nt, Mycobacterium bovis subsp bovis AF2122/97
cgucgcugcccgc

SEQ ID NO: 1153596 - RNA, 14 nt, Mycobacterium bovis subsp bovis AF2122/97
cgucgcugcccgcg

SEQ ID NO: 1153597 - RNA, 16 nt, Mycobacterium bovis subsp bovis AF2122/97
cgucgcugcccgcggu

SEQ ID NO: 1153598 - RNA, 20 nt, Mycobacterium bovis subsp bovis AF2122/97
cgucgcugcccgcgguuugc

SEQ ID NO: 1153599 - RNA, 21 nt, Mycobacterium bovis subsp bovis AF2122/97
cgucgcugagcagcgccgcgu

SEQ ID NO: 1153600 - RNA, 19 nt, Mycobacterium bovis subsp bovis AF2122/97
cgucgcugggaggcgcggu

SEQ ID NO: 1153601 - RNA, 20 nt, Mycobacterium bovis subsp bovis AF2122/97
cgucggagucuucgucgucg

SEQ ID NO: 1153602 - RNA, 23 nt, Mycobacterium bovis subsp bovis AF2122/97
cgucggaggugaaccccgccggc

SEQ ID NO: 1153603 - RNA, 16 nt, Mycobacterium bovis subsp bovis AF2122/97
cgucggagucgacggu

SEQ ID NO: 1153604 - RNA, 14 nt, Mycobacterium bovis subsp bovis AF2122/97
cgucgcuggccggc

SEQ ID NO: 1153605 - RNA, 15 nt, Mycobacterium bovis subsp bovis AF2122/97
cgucgcuggccggca

SEQ ID NO: 1153606 - RNA, 18 nt, Mycobacterium bovis subsp bovis AF2122/97
cgucgcuggccggcaccg

SEQ ID NO: 1153607 - RNA, 22 nt, Mycobacterium bovis subsp bovis AF2122/97
cgucgcuggccggcaccgugaa

SEQ ID NO: 1153608 - RNA, 16 nt, Mycobacterium bovis subsp bovis AF2122/97
cgucgcuagaucccag

SEQ ID NO: 1153609 - RNA, 13 nt, Mycobacterium bovis subsp bovis AF2122/97
cgucgcggccgcg

SEQ ID NO: 1153610 - RNA, 15 nt, Mycobacterium bovis subsp bovis AF2122/97
cgucgcugagcaaaa

SEQ ID NO: 1153611 - RNA, 23 nt, Mycobacterium bovis subsp bovis AF2122/97
cgucgcugagcacggcgcggcgg

SEQ ID NO: 1153612 - RNA, 24 nt, Mycobacterium bovis subsp bovis AF2122/97
cgucgcugagcacggcgcggcgga

SEQ ID NO: 1153613 - RNA, 18 nt, Mycobacterium bovis subsp bovis AF2122/97
cgucgcugaaaucggugg

SEQ ID NO: 1153614 - RNA, 18 nt, Mycobacterium bovis subsp bovis AF2122/97
cgucgcugaacagacggc

SEQ ID NO: 1153615 - RNA, 13 nt, Mycobacterium bovis subsp bovis AF2122/97
cgucgcugaccgc

SEQ ID NO: 1153616 - RNA, 21 nt, Mycobacterium bovis subsp bovis AF2122/97
cgucgcuaucgugcgccgacg

SEQ ID NO: 1153617 - RNA, 16 nt, Mycobacterium bovis subsp bovis AF2122/97
cgucaugaacgaucgg

SEQ ID NO: 1153618 - RNA, 20 nt, Mycobacterium bovis subsp bovis AF2122/97
cgucaugaacgaucggacca

SEQ ID NO: 1153619 - RNA, 19 nt, Mycobacterium bovis subsp bovis AF2122/97
cgucaugaugucgacaucg

SEQ ID NO: 1153620 - RNA, 16 nt, Mycobacterium bovis subsp bovis AF2122/97
cgucaugccagucgcc

SEQ ID NO: 1153621 - RNA, 13 nt, Mycobacterium bovis subsp bovis AF2122/97
cgucaugcccacc

SEQ ID NO: 1153622 - RNA, 14 nt, Mycobacterium bovis subsp bovis AF2122/97
cgucaugcccaccg

SEQ ID NO: 1153623 - RNA, 15 nt, Mycobacterium bovis subsp bovis AF2122/97
cgucaugcccaccgc

SEQ ID NO: 1153624 - RNA, 16 nt, Mycobacterium bovis subsp bovis AF2122/97
cgucaugcccaccgcc

SEQ ID NO: 1153625 - RNA, 22 nt, Mycobacterium bovis subsp bovis AF2122/97
cgucaugcccaggugcguccag

SEQ ID NO: 1153626 - RNA, 14 nt, Mycobacterium bovis subsp bovis AF2122/97
cgucaugccgacga

SEQ ID NO: 1153627 - RNA, 21 nt, Mycobacterium bovis subsp bovis AF2122/97
cgucauggcccgaucgaccgc

SEQ ID NO: 1153628 - RNA, 20 nt, Mycobacterium bovis subsp bovis AF2122/97
cgucaugaugucgacaucga

SEQ ID NO: 1153629 - RNA, 18 nt, Mycobacterium bovis subsp bovis AF2122/97
cgucauggcgggugcggc

SEQ ID NO: 1153630 - RNA, 17 nt, Mycobacterium bovis subsp bovis AF2122/97
cgucaugggcggcuucg

SEQ ID NO: 1153631 - RNA, 23 nt, Mycobacterium bovis subsp bovis AF2122/97
cgucauggcgaaccgucagcgcg

SEQ ID NO: 1153632 - RNA, 14 nt, Mycobacterium bovis subsp bovis AF2122/97
cgucauggcgagua

SEQ ID NO: 1153633 - RNA, 23 nt, Mycobacterium bovis subsp bovis AF2122/97
cgucauggcgaguacggccugcc

SEQ ID NO: 1153634 - RNA, 19 nt, Mycobacterium bovis subsp bovis AF2122/97
cgucaucgagcgggaucgg

SEQ ID NO: 1153635 - RNA, 14 nt, Mycobacterium bovis subsp bovis AF2122/97
cgucacgcguacgu

SEQ ID NO: 1153636 - RNA, 15 nt, Mycobacterium bovis subsp bovis AF2122/97
cgucacgccaccgca

SEQ ID NO: 1153637 - RNA, 18 nt, Mycobacterium bovis subsp bovis AF2122/97
cgucaucgccgacccgcc

SEQ ID NO: 1153638 - RNA, 14 nt, Mycobacterium bovis subsp bovis AF2122/97
cgucacgcgcggcg

SEQ ID NO: 1153639 - RNA, 21 nt, Mycobacterium bovis subsp bovis AF2122/97
cgucacgcgcggcggcgucca

SEQ ID NO: 1153640 - RNA, 16 nt, Mycobacterium bovis subsp bovis AF2122/97
cgucaucggcuggccg

SEQ ID NO: 1153641 - RNA, 20 nt, Mycobacterium bovis subsp bovis AF2122/97
cgucaucggcuggccgcgcc

SEQ ID NO: 1153642 - RNA, 17 nt, Mycobacterium bovis subsp bovis AF2122/97
cgucaucgccggguagc

SEQ ID NO: 1153643 - RNA, 17 nt, Mycobacterium bovis subsp bovis AF2122/97
cgucaccguuggccgcg

SEQ ID NO: 1153644 - RNA, 15 nt, Mycobacterium bovis subsp bovis AF2122/97
cgucaccuugacgcc

SEQ ID NO: 1153645 - RNA, 22 nt, Mycobacterium bovis subsp bovis AF2122/97
cgucacgcaaccggcggacacc

SEQ ID NO: 1153646 - RNA, 14 nt, Mycobacterium bovis subsp bovis AF2122/97
cgucacgccaccgc

SEQ ID NO: 1153647 - RNA, 18 nt, Mycobacterium bovis subsp bovis AF2122/97
cgucacgaucgugccggg

SEQ ID NO: 1153648 - RNA, 15 nt, Mycobacterium bovis subsp bovis AF2122/97
cguccagcgccgcgg

SEQ ID NO: 1153649 - RNA, 14 nt, Mycobacterium bovis subsp bovis AF2122/97
cguccagcgccugc

SEQ ID NO: 1153650 - RNA, 19 nt, Mycobacterium bovis subsp bovis AF2122/97
cguccagcgccugcgccca

SEQ ID NO: 1153651 - RNA, 20 nt, Mycobacterium bovis subsp bovis AF2122/97
cguccaacuacgccagccgc

SEQ ID NO: 1153652 - RNA, 16 nt, Mycobacterium bovis subsp bovis AF2122/97
cguccaacucggcccg

SEQ ID NO: 1153653 - RNA, 14 nt, Mycobacterium bovis subsp bovis AF2122/97
cguccagcaggacg

SEQ ID NO: 1153654 - RNA, 14 nt, Mycobacterium bovis subsp bovis AF2122/97
cgucauugccacca

SEQ ID NO: 1153655 - RNA, 16 nt, Mycobacterium bovis subsp bovis AF2122/97
cgucauuuccacaucc

SEQ ID NO: 1153656 - RNA, 21 nt, Mycobacterium bovis subsp bovis AF2122/97
cguccaucucggaccacaucu

SEQ ID NO: 1153657 - RNA, 12 nt, Mycobacterium bovis subsp bovis AF2122/97
cguccagcucgg

SEQ ID NO: 1153658 - RNA, 13 nt, Mycobacterium bovis subsp bovis AF2122/97
cguccagcuggca

SEQ ID NO: 1153659 - RNA, 19 nt, Mycobacterium bovis subsp bovis AF2122/97
cguccucggucagcucguc

SEQ ID NO: 1153660 - RNA, 20 nt, Mycobacterium bovis subsp bovis AF2122/97
cguccucggucacgaucacg

SEQ ID NO: 1153661 - RNA, 15 nt, Mycobacterium bovis subsp bovis AF2122/97
cgucgaacagcaccg

SEQ ID NO: 1153662 - RNA, 20 nt, Mycobacterium bovis subsp bovis AF2122/97
cgucgaagaugaccugaucg

SEQ ID NO: 1153663 - RNA, 19 nt, Mycobacterium bovis subsp bovis AF2122/97
cgucgaacuuugucgcgcu

SEQ ID NO: 1153664 - RNA, 14 nt, Mycobacterium bovis subsp bovis AF2122/97
cgucgaagcggacc

SEQ ID NO: 1153665 - RNA, 15 nt, Mycobacterium bovis subsp bovis AF2122/97
cgucgaagcggacca

SEQ ID NO: 1153666 - RNA, 23 nt, Mycobacterium bovis subsp bovis AF2122/97
cgucgaaggugaugaacaccggc

SEQ ID NO: 1153667 - RNA, 19 nt, Mycobacterium bovis subsp bovis AF2122/97
cgucgaaggugaccaggcg

SEQ ID NO: 1153668 - RNA, 20 nt, Mycobacterium bovis subsp bovis AF2122/97
cgucgaacggaucucggugg

SEQ ID NO: 1153669 - RNA, 17 nt, Mycobacterium bovis subsp bovis AF2122/97
cgucgaauccugccgca

SEQ ID NO: 1153670 - RNA, 23 nt, Mycobacterium bovis subsp bovis AF2122/97
cgucgacaaacagcgccaucgau

SEQ ID NO: 1153671 - RNA, 16 nt, Mycobacterium bovis subsp bovis AF2122/97
cgucgaccgacggguc

SEQ ID NO: 1153672 - RNA, 15 nt, Mycobacterium bovis subsp bovis AF2122/97
cgucgaccgacgggu

SEQ ID NO: 1153673 - RNA, 18 nt, Mycobacterium bovis subsp bovis AF2122/97
cgucgacagucaacaggg

SEQ ID NO: 1153674 - RNA, 14 nt, Mycobacterium bovis subsp bovis AF2122/97
cgucgacacccgca

SEQ ID NO: 1153675 - RNA, 15 nt, Mycobacterium bovis subsp bovis AF2122/97
cgucgacaccgcgga

SEQ ID NO: 1153676 - RNA, 16 nt, Mycobacterium bovis subsp bovis AF2122/97
cgucgaauucagcugc

SEQ ID NO: 1153677 - RNA, 19 nt, Mycobacterium bovis subsp bovis AF2122/97
cgucgacaacaaacccggc

SEQ ID NO: 1153678 - RNA, 20 nt, Mycobacterium bovis subsp bovis AF2122/97
cgucgacaacaaacccggcc

SEQ ID NO: 1153679 - RNA, 16 nt, Mycobacterium bovis subsp bovis AF2122/97
cgucgacaacgaucgc

SEQ ID NO: 1153680 - RNA, 20 nt, Mycobacterium bovis subsp bovis AF2122/97
cguccggaucggucggcacc

SEQ ID NO: 1153681 - RNA, 17 nt, Mycobacterium bovis subsp bovis AF2122/97
cguccggccacgguccg

SEQ ID NO: 1153682 - RNA, 20 nt, Mycobacterium bovis subsp bovis AF2122/97
cguccgcggguagcgguuca

SEQ ID NO: 1153683 - RNA, 24 nt, Mycobacterium bovis subsp bovis AF2122/97
cguccggagaauuccgcuagguca

SEQ ID NO: 1153684 - RNA, 22 nt, Mycobacterium bovis subsp bovis AF2122/97
cguccggccacgguccggccca

SEQ ID NO: 1153685 - RNA, 12 nt, Mycobacterium bovis subsp bovis AF2122/97
cguccggcgaug

SEQ ID NO: 1153686 - RNA, 23 nt, Mycobacterium bovis subsp bovis AF2122/97
cguccucaucguuccacgagucg

SEQ ID NO: 1153687 - RNA, 24 nt, Mycobacterium bovis subsp bovis AF2122/97
cguccucaucguuccacgagucgu

SEQ ID NO: 1153688 - RNA, 22 nt, Mycobacterium bovis subsp bovis AF2122/97
cguccgggcagccgcgccgcgg

SEQ ID NO: 1153689 - RNA, 14 nt, Mycobacterium bovis subsp bovis AF2122/97
cguccggcggcagg

SEQ ID NO: 1153690 - RNA, 20 nt, Mycobacterium bovis subsp bovis AF2122/97
cguccggcggcaggaaucgg

SEQ ID NO: 1153691 - RNA, 18 nt, Mycobacterium bovis subsp bovis AF2122/97
cguccggcgcccacaucg

SEQ ID NO: 1153692 - RNA, 20 nt, Mycobacterium bovis subsp bovis AF2122/97
cgucccacagguuugcgccg

SEQ ID NO: 1153693 - RNA, 19 nt, Mycobacterium bovis subsp bovis AF2122/97
cguccgcgcccaccggcua

SEQ ID NO: 1153694 - RNA, 23 nt, Mycobacterium bovis subsp bovis AF2122/97
cguccgcgcccaccggcuagcug

SEQ ID NO: 1153695 - RNA, 21 nt, Mycobacterium bovis subsp bovis AF2122/97
cguccgcgccaguggccacca

SEQ ID NO: 1153696 - RNA, 17 nt, Mycobacterium bovis subsp bovis AF2122/97
cguccgcgcaccgcagg

SEQ ID NO: 1153697 - RNA, 15 nt, Mycobacterium bovis subsp bovis AF2122/97
cgucccagcgccgca

SEQ ID NO: 1153698 - RNA, 21 nt, Mycobacterium bovis subsp bovis AF2122/97
cgucccaggacuccggccgca

SEQ ID NO: 1153699 - RNA, 16 nt, Mycobacterium bovis subsp bovis AF2122/97
cgucccagggcugccg

SEQ ID NO: 1153700 - RNA, 17 nt, Mycobacterium bovis subsp bovis AF2122/97
cgucccagggcugccgg

SEQ ID NO: 1153701 - RNA, 14 nt, Mycobacterium bovis subsp bovis AF2122/97
cguccgcggaugca

SEQ ID NO: 1153702 - RNA, 14 nt, Mycobacterium bovis subsp bovis AF2122/97
cguccgcgguguug

SEQ ID NO: 1153703 - RNA, 21 nt, Mycobacterium bovis subsp bovis AF2122/97
cguccgcgggggaccgcccga

SEQ ID NO: 1153704 - RNA, 12 nt, Mycobacterium bovis subsp bovis AF2122/97
cggucgccgcga

SEQ ID NO: 1153705 - RNA, 12 nt, Mycobacterium bovis subsp bovis AF2122/97
cggucgccgcgc

SEQ ID NO: 1153706 - RNA, 15 nt, Mycobacterium bovis subsp bovis AF2122/97
cgguuacccggaccg

SEQ ID NO: 1153707 - RNA, 21 nt, Mycobacterium bovis subsp bovis AF2122/97
cgguuacccggaccgucgugg

SEQ ID NO: 1153708 - RNA, 21 nt, Mycobacterium bovis subsp bovis AF2122/97
cggucgccaccgugucacgcg

SEQ ID NO: 1153709 - RNA, 18 nt, Mycobacterium bovis subsp bovis AF2122/97
cggucgccgaauggcugg

SEQ ID NO: 1153710 - RNA, 13 nt, Mycobacterium bovis subsp bovis AF2122/97
cggucgccgacca

SEQ ID NO: 1153711 - RNA, 17 nt, Mycobacterium bovis subsp bovis AF2122/97
cggucgcccgagucgaa

SEQ ID NO: 1153712 - RNA, 18 nt, Mycobacterium bovis subsp bovis AF2122/97
cggucgcccgaucggcgg

SEQ ID NO: 1153713 - RNA, 18 nt, Mycobacterium bovis subsp bovis AF2122/97
cggucgcagugcacccgg

SEQ ID NO: 1153714 - RNA, 21 nt, Mycobacterium bovis subsp bovis AF2122/97
cggucgcagugcacccgggcc

SEQ ID NO: 1153715 - RNA, 23 nt, Mycobacterium bovis subsp bovis AF2122/97
cggucgcagugcacccgggccgc

SEQ ID NO: 1153716 - RNA, 15 nt, Mycobacterium bovis subsp bovis AF2122/97
cggucgcauggucga

SEQ ID NO: 1153717 - RNA, 19 nt, Mycobacterium bovis subsp bovis AF2122/97
cggucgcacuuggcccccg

SEQ ID NO: 1153718 - RNA, 21 nt, Mycobacterium bovis subsp bovis AF2122/97
cggucgcagcagaccacaacg

SEQ ID NO: 1153719 - RNA, 14 nt, Mycobacterium bovis subsp bovis AF2122/97
cggucgcccaggcc

SEQ ID NO: 1153720 - RNA, 14 nt, Mycobacterium bovis subsp bovis AF2122/97
cggucgccaccgcc

SEQ ID NO: 1153721 - RNA, 15 nt, Mycobacterium bovis subsp bovis AF2122/97
cggucgccaccgccg

SEQ ID NO: 1153722 - RNA, 17 nt, Mycobacterium bovis subsp bovis AF2122/97
cggucgccaccgccggc

SEQ ID NO: 1153723 - RNA, 13 nt, Mycobacterium bovis subsp bovis AF2122/97
cggucgccaccgu

SEQ ID NO: 1153724 - RNA, 13 nt, Mycobacterium bovis subsp bovis AF2122/97
cggucgccaccgc

SEQ ID NO: 1153725 - RNA, 13 nt, Mycobacterium bovis subsp bovis AF2122/97
cggucgccacacc

SEQ ID NO: 1153726 - RNA, 18 nt, Mycobacterium bovis subsp bovis AF2122/97
cggucgccacacccgcga

SEQ ID NO: 1153727 - RNA, 17 nt, Mycobacterium bovis subsp bovis AF2122/97
cggucgccaaauccgac

SEQ ID NO: 1153728 - RNA, 17 nt, Mycobacterium bovis subsp bovis AF2122/97
cggucgccaagaucggg

SEQ ID NO: 1153729 - RNA, 17 nt, Mycobacterium bovis subsp bovis AF2122/97
cgguucgaggaucccgc

SEQ ID NO: 1153730 - RNA, 14 nt, Mycobacterium bovis subsp bovis AF2122/97
cgguucgcccagca

SEQ ID NO: 1153731 - RNA, 17 nt, Mycobacterium bovis subsp bovis AF2122/97
cgguucgauggcaucgg

SEQ ID NO: 1153732 - RNA, 14 nt, Mycobacterium bovis subsp bovis AF2122/97
cgguucgccgccgu

SEQ ID NO: 1153733 - RNA, 16 nt, Mycobacterium bovis subsp bovis AF2122/97
cgguucgccgccguug

SEQ ID NO: 1153734 - RNA, 20 nt, Mycobacterium bovis subsp bovis AF2122/97
cgguuauggcauucgauacc

SEQ ID NO: 1153735 - RNA, 21 nt, Mycobacterium bovis subsp bovis AF2122/97
cgguuagaucacccgcagccg

SEQ ID NO: 1153736 - RNA, 21 nt, Mycobacterium bovis subsp bovis AF2122/97
cgguuagggcacgucgagcgu

SEQ ID NO: 1153737 - RNA, 17 nt, Mycobacterium bovis subsp bovis AF2122/97
cgguuugccggugcggu

SEQ ID NO: 1153738 - RNA, 16 nt, Mycobacterium bovis subsp bovis AF2122/97
cgguuugcacgcacca

SEQ ID NO: 1153739 - RNA, 17 nt, Mycobacterium bovis subsp bovis AF2122/97
cgguuucuucggccagc

SEQ ID NO: 1153740 - RNA, 13 nt, Mycobacterium bovis subsp bovis AF2122/97
cgguuucgaucac

SEQ ID NO: 1153741 - RNA, 17 nt, Mycobacterium bovis subsp bovis AF2122/97
cgguuucgaccaccacc

SEQ ID NO: 1153742 - RNA, 15 nt, Mycobacterium bovis subsp bovis AF2122/97
cguaacagccggccg

SEQ ID NO: 1153743 - RNA, 13 nt, Mycobacterium bovis subsp bovis AF2122/97
cgguucggccaga

SEQ ID NO: 1153744 - RNA, 17 nt, Mycobacterium bovis subsp bovis AF2122/97
cgguucgcugcggcggu

SEQ ID NO: 1153745 - RNA, 23 nt, Mycobacterium bovis subsp bovis AF2122/97
cgguucgucgaacggaucucggu

SEQ ID NO: 1153746 - RNA, 16 nt, Mycobacterium bovis subsp bovis AF2122/97
cgguucguagcgggca

SEQ ID NO: 1153747 - RNA, 22 nt, Mycobacterium bovis subsp bovis AF2122/97
cgguucggugagcgggaggaug

SEQ ID NO: 1153748 - RNA, 13 nt, Mycobacterium bovis subsp bovis AF2122/97
cgguugccggcgg

SEQ ID NO: 1153749 - RNA, 18 nt, Mycobacterium bovis subsp bovis AF2122/97
cgguugccggcggcgacg

SEQ ID NO: 1153750 - RNA, 18 nt, Mycobacterium bovis subsp bovis AF2122/97
cgguugccgucugcgguc

SEQ ID NO: 1153751 - RNA, 16 nt, Mycobacterium bovis subsp bovis AF2122/97
cgguugccgcgaucgg

SEQ ID NO: 1153752 - RNA, 20 nt, Mycobacterium bovis subsp bovis AF2122/97
cgguugccccggcgacccgg

SEQ ID NO: 1153753 - RNA, 15 nt, Mycobacterium bovis subsp bovis AF2122/97
cgguugccacgccgc

SEQ ID NO: 1153754 - RNA, 15 nt, Mycobacterium bovis subsp bovis AF2122/97
cgguugaucggccac

SEQ ID NO: 1153755 - RNA, 19 nt, Mycobacterium bovis subsp bovis AF2122/97
cgguugcaaaccgcugcgc

SEQ ID NO: 1153756 - RNA, 17 nt, Mycobacterium bovis subsp bovis AF2122/97
cgguugauugugcccag

SEQ ID NO: 1153757 - RNA, 16 nt, Mycobacterium bovis subsp bovis AF2122/97
cgguugaugcggccgc

SEQ ID NO: 1153758 - RNA, 20 nt, Mycobacterium bovis subsp bovis AF2122/97
cguacaccagggugccgggc

SEQ ID NO: 1153759 - RNA, 15 nt, Mycobacterium bovis subsp bovis AF2122/97
cguacaacacgggca

SEQ ID NO: 1153760 - RNA, 23 nt, Mycobacterium bovis subsp bovis AF2122/97
cguacaaccacccacccgcacca

SEQ ID NO: 1153761 - RNA, 23 nt, Mycobacterium bovis subsp bovis AF2122/97
cguaauuucuucacggucgacga

SEQ ID NO: 1153762 - RNA, 17 nt, Mycobacterium bovis subsp bovis AF2122/97
cguaacugcccgcggcg

SEQ ID NO: 1153763 - RNA, 20 nt, Mycobacterium bovis subsp bovis AF2122/97
cguaaccggcagcgguaagc

SEQ ID NO: 1153764 - RNA, 17 nt, Mycobacterium bovis subsp bovis AF2122/97
cguaaccacgacgacga

SEQ ID NO: 1153765 - RNA, 14 nt, Mycobacterium bovis subsp bovis AF2122/97
cguaaccacgacga

SEQ ID NO: 1153766 - RNA, 16 nt, Mycobacterium bovis subsp bovis AF2122/97
cguaaccgucgccugc

SEQ ID NO: 1153767 - RNA, 22 nt, Mycobacterium bovis subsp bovis AF2122/97
cguaaccgucgccugccgacga

SEQ ID NO: 1153768 - RNA, 15 nt, Mycobacterium bovis subsp bovis AF2122/97
cguaacggucgguga

SEQ ID NO: 1153769 - RNA, 16 nt, Mycobacterium bovis subsp bovis AF2122/97
cguaccagcuggccac

SEQ ID NO: 1153770 - RNA, 17 nt, Mycobacterium bovis subsp bovis AF2122/97
cguacccacgacgggcc

SEQ ID NO: 1153771 - RNA, 16 nt, Mycobacterium bovis subsp bovis AF2122/97
cguaccaauucccgcg

SEQ ID NO: 1153772 - RNA, 23 nt, Mycobacterium bovis subsp bovis AF2122/97
cguacagcccggccuugccgccg

SEQ ID NO: 1153773 - RNA, 15 nt, Mycobacterium bovis subsp bovis AF2122/97
cguacaccucgagcg

SEQ ID NO: 1153774 - RNA, 12 nt, Mycobacterium bovis subsp bovis AF2122/97
cguacagcaccg

SEQ ID NO: 1153775 - RNA, 18 nt, Mycobacterium bovis subsp bovis AF2122/97
cguacaggccggccacca

SEQ ID NO: 1153776 - RNA, 14 nt, Mycobacterium bovis subsp bovis AF2122/97
cguaccgggcgagu

SEQ ID NO: 1153777 - RNA, 12 nt, Mycobacterium bovis subsp bovis AF2122/97
cguaccggugau

SEQ ID NO: 1153778 - RNA, 17 nt, Mycobacterium bovis subsp bovis AF2122/97
cguaccgguugacgggc

SEQ ID NO: 1153779 - RNA, 15 nt, Mycobacterium bovis subsp bovis AF2122/97
cguaccguucgggcc

SEQ ID NO: 1153780 - RNA, 17 nt, Mycobacterium bovis subsp bovis AF2122/97
cguaccguucgggccgu

SEQ ID NO: 1153781 - RNA, 11 nt, Mycobacterium bovis subsp bovis AF2122/97
cguaccgcgcg

SEQ ID NO: 1153782 - RNA, 14 nt, Mycobacterium bovis subsp bovis AF2122/97
cguacccgaucagc

SEQ ID NO: 1153783 - RNA, 20 nt, Mycobacterium bovis subsp bovis AF2122/97
cguacccguuaugcgccgcc

SEQ ID NO: 1153784 - RNA, 20 nt, Mycobacterium bovis subsp bovis AF2122/97
cguacccggccugcgucgaa

SEQ ID NO: 1153785 - RNA, 11 nt, Mycobacterium bovis subsp bovis AF2122/97
cguacgccgua

SEQ ID NO: 1153786 - RNA, 13 nt, Mycobacterium bovis subsp bovis AF2122/97
cguacgcggcugc

SEQ ID NO: 1153787 - RNA, 15 nt, Mycobacterium bovis subsp bovis AF2122/97
cguacggggucgccg

SEQ ID NO: 1153788 - RNA, 15 nt, Mycobacterium bovis subsp bovis AF2122/97
cguacgccggcggug

SEQ ID NO: 1153789 - RNA, 17 nt, Mycobacterium bovis subsp bovis AF2122/97
cguagaacgcuagcgcc

SEQ ID NO: 1153790 - RNA, 16 nt, Mycobacterium bovis subsp bovis AF2122/97
cguagaagcgcuccag

SEQ ID NO: 1153791 - RNA, 19 nt, Mycobacterium bovis subsp bovis AF2122/97
cguacuucgacagcggcga

SEQ ID NO: 1153792 - RNA, 16 nt, Mycobacterium bovis subsp bovis AF2122/97
cguacuccccgcgcgc

SEQ ID NO: 1153793 - RNA, 15 nt, Mycobacterium bovis subsp bovis AF2122/97
cguacucgaccgcga

SEQ ID NO: 1153794 - RNA, 15 nt, Mycobacterium bovis subsp bovis AF2122/97
cguacucggcgcgca

SEQ ID NO: 1153795 - RNA, 20 nt, Mycobacterium bovis subsp bovis AF2122/97
cguacucggucgaguagccg

SEQ ID NO: 1153796 - RNA, 21 nt, Mycobacterium bovis subsp bovis AF2122/97
cguacggggucgccggcaccg

SEQ ID NO: 1153797 - RNA, 19 nt, Mycobacterium bovis subsp bovis AF2122/97
cguacgucgguccacccaa

SEQ ID NO: 1153798 - RNA, 17 nt, Mycobacterium bovis subsp bovis AF2122/97
cguagcggucuccccag

SEQ ID NO: 1153799 - RNA, 14 nt, Mycobacterium bovis subsp bovis AF2122/97
cguagcguccgcgc

SEQ ID NO: 1153800 - RNA, 15 nt, Mycobacterium bovis subsp bovis AF2122/97
cguagcguccgcgcc

SEQ ID NO: 1153801 - RNA, 15 nt, Mycobacterium bovis subsp bovis AF2122/97
aaccccggucggggu

SEQ ID NO: 1153802 - RNA, 23 nt, Mycobacterium bovis subsp bovis AF2122/97
aaccccguccucgaucgcgcaga

SEQ ID NO: 1153803 - RNA, 13 nt, Mycobacterium bovis subsp bovis AF2122/97
cguaggcaccccg

SEQ ID NO: 1153804 - RNA, 22 nt, Mycobacterium bovis subsp bovis AF2122/97
cguaggcaccccggugcccgcg

SEQ ID NO: 1153805 - RNA, 22 nt, Mycobacterium bovis subsp bovis AF2122/97
cguaggcaggaucgccugagcg

SEQ ID NO: 1153806 - RNA, 14 nt, Mycobacterium bovis subsp bovis AF2122/97
cguagcugcgcagc

SEQ ID NO: 1153807 - RNA, 15 nt, Mycobacterium bovis subsp bovis AF2122/97
cguagcucagcggua

SEQ ID NO: 1153808 - RNA, 14 nt, Mycobacterium bovis subsp bovis AF2122/97
cguagcuuccgguc

SEQ ID NO: 1153809 - RNA, 21 nt, Mycobacterium bovis subsp bovis AF2122/97
cguagcuuccgguccagcggc

SEQ ID NO: 1153810 - RNA, 14 nt, Mycobacterium bovis subsp bovis AF2122/97
cguagcugggcacc

SEQ ID NO: 1153811 - RNA, 15 nt, Mycobacterium bovis subsp bovis AF2122/97
cguagcuggucccac

SEQ ID NO: 1153812 - RNA, 16 nt, Mycobacterium bovis subsp bovis AF2122/97
cguagcgcccacucca

SEQ ID NO: 1153813 - RNA, 17 nt, Mycobacterium bovis subsp bovis AF2122/97
aacccagaucggcgacg

SEQ ID NO: 1153814 - RNA, 15 nt, Mycobacterium bovis subsp bovis AF2122/97
aacccccgccgcgca

SEQ ID NO: 1153815 - RNA, 14 nt, Mycobacterium bovis subsp bovis AF2122/97
aacccccgccggcg

SEQ ID NO: 1153816 - RNA, 13 nt, Mycobacterium bovis subsp bovis AF2122/97
aaccccgccggcc

SEQ ID NO: 1153817 - RNA, 12 nt, Mycobacterium bovis subsp bovis AF2122/97
aaccccgcgcgg

SEQ ID NO: 1153818 - RNA, 15 nt, Mycobacterium bovis subsp bovis AF2122/97
cguagcccacgacga

SEQ ID NO: 1153819 - RNA, 19 nt, Mycobacterium bovis subsp bovis AF2122/97
cguagcccacgacgaaguc

SEQ ID NO: 1153820 - RNA, 15 nt, Mycobacterium bovis subsp bovis AF2122/97
cguagcaucgggcga

SEQ ID NO: 1153821 - RNA, 14 nt, Mycobacterium bovis subsp bovis AF2122/97
cguagccagcagcg

SEQ ID NO: 1153822 - RNA, 14 nt, Mycobacterium bovis subsp bovis AF2122/97
cguagcccacccgg

SEQ ID NO: 1153823 - RNA, 16 nt, Mycobacterium bovis subsp bovis AF2122/97
cguagcagcgccggca

SEQ ID NO: 1153824 - RNA, 15 nt, Mycobacterium bovis subsp bovis AF2122/97
cguagcaggucgacg

SEQ ID NO: 1153825 - RNA, 16 nt, Mycobacterium bovis subsp bovis AF2122/97
cguagcaggucgacgg

SEQ ID NO: 1153826 - RNA, 22 nt, Mycobacterium bovis subsp bovis AF2122/97
cguagccgagcuugagcgugag

SEQ ID NO: 1153827 - RNA, 18 nt, Mycobacterium bovis subsp bovis AF2122/97
cguagccgccgucgccgg

SEQ ID NO: 1153828 - RNA, 14 nt, Mycobacterium bovis subsp bovis AF2122/97
cguagccggccggc

SEQ ID NO: 1153829 - RNA, 15 nt, Mycobacterium bovis subsp bovis AF2122/97
cguagccggccggcc

SEQ ID NO: 1153830 - RNA, 14 nt, Mycobacterium bovis subsp bovis AF2122/97
cguagccggcggug

SEQ ID NO: 1153831 - RNA, 13 nt, Mycobacterium bovis subsp bovis AF2122/97
cguagccguacgg

SEQ ID NO: 1153832 - RNA, 17 nt, Mycobacterium bovis subsp bovis AF2122/97
cguagcgaccucgccgc

SEQ ID NO: 1153833 - RNA, 18 nt, Mycobacterium bovis subsp bovis AF2122/97
cguagcgaccucgccgcg

SEQ ID NO: 1153834 - RNA, 14 nt, Mycobacterium bovis subsp bovis AF2122/97
cguagacgccgagc

SEQ ID NO: 1153835 - RNA, 16 nt, Mycobacterium bovis subsp bovis AF2122/97
cguagacggggugagc

SEQ ID NO: 1153836 - RNA, 16 nt, Mycobacterium bovis subsp bovis AF2122/97
cguagacccacagucg

SEQ ID NO: 1153837 - RNA, 23 nt, Mycobacterium bovis subsp bovis AF2122/97
cguagaccgucgauccgucggcg

SEQ ID NO: 1153838 - RNA, 23 nt, Mycobacterium bovis subsp bovis AF2122/97
cguagaccuucuugacacccacc

SEQ ID NO: 1153839 - RNA, 19 nt, Mycobacterium bovis subsp bovis AF2122/97
cguagaccacgccggugac

SEQ ID NO: 1153840 - RNA, 13 nt, Mycobacterium bovis subsp bovis AF2122/97
cguagaccaggcc

SEQ ID NO: 1153841 - RNA, 16 nt, Mycobacterium bovis subsp bovis AF2122/97
cguagaccaggcccag

SEQ ID NO: 1153842 - RNA, 21 nt, Mycobacterium bovis subsp bovis AF2122/97
cguagaccaggcccaggucaa

SEQ ID NO: 1153843 - RNA, 16 nt, Mycobacterium bovis subsp bovis AF2122/97
cguagaaucggcucag

SEQ ID NO: 1153844 - RNA, 18 nt, Mycobacterium bovis subsp bovis AF2122/97
cguagaaguaggcggcga

SEQ ID NO: 1153845 - RNA, 15 nt, Mycobacterium bovis subsp bovis AF2122/97
cguagaagucgaucg

SEQ ID NO: 1153846 - RNA, 20 nt, Mycobacterium bovis subsp bovis AF2122/97
cguagacaaggccaagcgcc

SEQ ID NO: 1153847 - RNA, 18 nt, Mycobacterium bovis subsp bovis AF2122/97
cguagaaggaccgcucgu

SEQ ID NO: 1153848 - RNA, 17 nt, Mycobacterium bovis subsp bovis AF2122/97
cguagaugguggucacc

SEQ ID NO: 1153849 - RNA, 17 nt, Mycobacterium bovis subsp bovis AF2122/97
cguagagcuggugcggg

SEQ ID NO: 1153850 - RNA, 18 nt, Mycobacterium bovis subsp bovis AF2122/97
cguagaugguggucacca

SEQ ID NO: 1153851 - RNA, 21 nt, Mycobacterium bovis subsp bovis AF2122/97
cguagaugguggucaccacca

SEQ ID NO: 1153852 - RNA, 15 nt, Mycobacterium bovis subsp bovis AF2122/97
cguagcaacccagga

SEQ ID NO: 1153853 - RNA, 15 nt, Mycobacterium bovis subsp bovis AF2122/97
cguagcacaccggug

SEQ ID NO: 1153854 - RNA, 22 nt, Mycobacterium bovis subsp bovis AF2122/97
cguagcacaccgguggacccgg

SEQ ID NO: 1153855 - RNA, 15 nt, Mycobacterium bovis subsp bovis AF2122/97
cguagcaccacaucg

SEQ ID NO: 1153856 - RNA, 17 nt, Mycobacterium bovis subsp bovis AF2122/97
cguagagcaugccgccc

SEQ ID NO: 1153857 - RNA, 19 nt, Mycobacterium bovis subsp bovis AF2122/97
cguagagcaugccgcccgc

SEQ ID NO: 1153858 - RNA, 16 nt, Mycobacterium bovis subsp bovis AF2122/97
cguagagccgaucacc

SEQ ID NO: 1153859 - RNA, 23 nt, Mycobacterium bovis subsp bovis AF2122/97
cguagacgguuaccgcgaagcug

SEQ ID NO: 1153860 - RNA, 19 nt, Mycobacterium bovis subsp bovis AF2122/97
cguagaucaucuggcuggu

SEQ ID NO: 1153861 - RNA, 18 nt, Mycobacterium bovis subsp bovis AF2122/97
cguagguggccagcgcgg

SEQ ID NO: 1153862 - RNA, 22 nt, Mycobacterium bovis subsp bovis AF2122/97
cguagguggccagcgcggcgag

SEQ ID NO: 1153863 - RNA, 13 nt, Mycobacterium bovis subsp bovis AF2122/97
cguaggcgccgaa

SEQ ID NO: 1153864 - RNA, 14 nt, Mycobacterium bovis subsp bovis AF2122/97
cguagguggccagc

SEQ ID NO: 1153865 - RNA, 17 nt, Mycobacterium bovis subsp bovis AF2122/97
cguaguagcgaugcacc

SEQ ID NO: 1153866 - RNA, 15 nt, Mycobacterium bovis subsp bovis AF2122/97
cguaguacagcgcga

SEQ ID NO: 1153867 - RNA, 16 nt, Mycobacterium bovis subsp bovis AF2122/97
cguaguaguggccgcc

SEQ ID NO: 1153868 - RNA, 21 nt, Mycobacterium bovis subsp bovis AF2122/97
cguaggccuugcucagccggc

SEQ ID NO: 1153869 - RNA, 22 nt, Mycobacterium bovis subsp bovis AF2122/97
cguaggccuugcucagccggcc

SEQ ID NO: 1153870 - RNA, 18 nt, Mycobacterium bovis subsp bovis AF2122/97
cguaggcccaacgacggc

SEQ ID NO: 1153871 - RNA, 16 nt, Mycobacterium bovis subsp bovis AF2122/97
cguaugacgcccaccg

SEQ ID NO: 1153872 - RNA, 15 nt, Mycobacterium bovis subsp bovis AF2122/97
cguaucggggcacca

SEQ ID NO: 1153873 - RNA, 19 nt, Mycobacterium bovis subsp bovis AF2122/97
cguaucggggcaccacgcc

SEQ ID NO: 1153874 - RNA, 12 nt, Mycobacterium bovis subsp bovis AF2122/97
cguagucggcgg

SEQ ID NO: 1153875 - RNA, 19 nt, Mycobacterium bovis subsp bovis AF2122/97
cguagucgcgggugcggac

SEQ ID NO: 1153876 - RNA, 17 nt, Mycobacterium bovis subsp bovis AF2122/97
cguaguaguggccgcca

SEQ ID NO: 1153877 - RNA, 23 nt, Mycobacterium bovis subsp bovis AF2122/97
cguaguaguggccgccacccgca

SEQ ID NO: 1153878 - RNA, 21 nt, Mycobacterium bovis subsp bovis AF2122/97
cguaguaguucagccaggccg

SEQ ID NO: 1153879 - RNA, 13 nt, Mycobacterium bovis subsp bovis AF2122/97
cguaguccaggcc

SEQ ID NO: 1153880 - RNA, 16 nt, Mycobacterium bovis subsp bovis AF2122/97
cguaucccgugugcgg

SEQ ID NO: 1153881 - RNA, 20 nt, Mycobacterium bovis subsp bovis AF2122/97
cgucaccggaauccccccug

SEQ ID NO: 1153882 - RNA, 17 nt, Mycobacterium bovis subsp bovis AF2122/97
cgucaccggaggccgcc

SEQ ID NO: 1153883 - RNA, 19 nt, Mycobacterium bovis subsp bovis AF2122/97
cgucaccggaggccgccgc

SEQ ID NO: 1153884 - RNA, 21 nt, Mycobacterium bovis subsp bovis AF2122/97
cgucaccggaggccgccgcgc

SEQ ID NO: 1153885 - RNA, 15 nt, Mycobacterium bovis subsp bovis AF2122/97
cgucaccgccggugc

SEQ ID NO: 1153886 - RNA, 13 nt, Mycobacterium bovis subsp bovis AF2122/97
cgucaccgccguc

SEQ ID NO: 1153887 - RNA, 13 nt, Mycobacterium bovis subsp bovis AF2122/97
cgucacccggggc

SEQ ID NO: 1153888 - RNA, 13 nt, Mycobacterium bovis subsp bovis AF2122/97
cgucaccgcgggc

SEQ ID NO: 1153889 - RNA, 13 nt, Mycobacterium bovis subsp bovis AF2122/97
cgucaccgccggc

SEQ ID NO: 1153890 - RNA, 17 nt, Mycobacterium bovis subsp bovis AF2122/97
cgucaccgccggcaccg

SEQ ID NO: 1153891 - RNA, 15 nt, Mycobacterium bovis subsp bovis AF2122/97
cgucaccgccguugc

SEQ ID NO: 1153892 - RNA, 19 nt, Mycobacterium bovis subsp bovis AF2122/97
cgucaccgccguugccgcc

SEQ ID NO: 1153893 - RNA, 13 nt, Mycobacterium bovis subsp bovis AF2122/97
cgucaccguuggc

SEQ ID NO: 1153894 - RNA, 15 nt, Mycobacterium bovis subsp bovis AF2122/97
cgucaccggucagcg

SEQ ID NO: 1153895 - RNA, 18 nt, Mycobacterium bovis subsp bovis AF2122/97
cgucaccggucagcgacg

SEQ ID NO: 1153896 - RNA, 12 nt, Mycobacterium bovis subsp bovis AF2122/97
cgucaccgucau

SEQ ID NO: 1153897 - RNA, 19 nt, Mycobacterium bovis subsp bovis AF2122/97
cgucaccaccgccgccacc

SEQ ID NO: 1153898 - RNA, 15 nt, Mycobacterium bovis subsp bovis AF2122/97
cgucaccacgaucgc

SEQ ID NO: 1153899 - RNA, 23 nt, Mycobacterium bovis subsp bovis AF2122/97
cgucaccccgauucgugucggug

SEQ ID NO: 1153900 - RNA, 16 nt, Mycobacterium bovis subsp bovis AF2122/97
cgucaccacgaucgca

SEQ ID NO: 1153901 - RNA, 17 nt, Mycobacterium bovis subsp bovis AF2122/97
cgucaccgaugcgccgg

SEQ ID NO: 1153902 - RNA, 21 nt, Mycobacterium bovis subsp bovis AF2122/97
cgucaccgaugcgccggacca

SEQ ID NO: 1153903 - RNA, 21 nt, Mycobacterium bovis subsp bovis AF2122/97
cgucaccgcccuugccgccgg

SEQ ID NO: 1153904 - RNA, 13 nt, Mycobacterium bovis subsp bovis AF2122/97
cgucaccgaucga

SEQ ID NO: 1153905 - RNA, 12 nt, Mycobacterium bovis subsp bovis AF2122/97
cgucaccccacc

SEQ ID NO: 1153906 - RNA, 15 nt, Mycobacterium bovis subsp bovis AF2122/97
cgucaccaccgccgc

SEQ ID NO: 1153907 - RNA, 19 nt, Mycobacterium bovis subsp bovis AF2122/97
aacccggaaucgucgcggc

SEQ ID NO: 1153908 - RNA, 22 nt, Mycobacterium bovis subsp bovis AF2122/97
aacccggaaucgucgcggccgu

SEQ ID NO: 1153909 - RNA, 17 nt, Mycobacterium bovis subsp bovis AF2122/97
cgucacauugccaccgu

SEQ ID NO: 1153910 - RNA, 18 nt, Mycobacterium bovis subsp bovis AF2122/97
cgucaccaaacccgaugg

SEQ ID NO: 1153911 - RNA, 17 nt, Mycobacterium bovis subsp bovis AF2122/97
cgucaccaccgccgcca

SEQ ID NO: 1153912 - RNA, 23 nt, Mycobacterium bovis subsp bovis AF2122/97
cgucaaacgcaaagacagcgcgg

SEQ ID NO: 1153913 - RNA, 12 nt, Mycobacterium bovis subsp bovis AF2122/97
aacccgcgccgg

SEQ ID NO: 1153914 - RNA, 16 nt, Mycobacterium bovis subsp bovis AF2122/97
aacccgcgccggccgc

SEQ ID NO: 1153915 - RNA, 18 nt, Mycobacterium bovis subsp bovis AF2122/97
aacccgcucggcggucgg

SEQ ID NO: 1153916 - RNA, 13 nt, Mycobacterium bovis subsp bovis AF2122/97
aacccggaaguug

SEQ ID NO: 1153917 - RNA, 16 nt, Mycobacterium bovis subsp bovis AF2122/97
cgucaaacccagcgac

SEQ ID NO: 1153918 - RNA, 22 nt, Mycobacterium bovis subsp bovis AF2122/97
cgucaaacccagcgacgcggcc

SEQ ID NO: 1153919 - RNA, 19 nt, Mycobacterium bovis subsp bovis AF2122/97
aacccgcaccccggccgcg

SEQ ID NO: 1153920 - RNA, 23 nt, Mycobacterium bovis subsp bovis AF2122/97
aacccgcaccccggccgcgcgca

SEQ ID NO: 1153921 - RNA, 14 nt, Mycobacterium bovis subsp bovis AF2122/97
aacccgcaccggau

SEQ ID NO: 1153922 - RNA, 14 nt, Mycobacterium bovis subsp bovis AF2122/97
cguggcgcgccgca

SEQ ID NO: 1153923 - RNA, 13 nt, Mycobacterium bovis subsp bovis AF2122/97
cguggcgcucggc

SEQ ID NO: 1153924 - RNA, 19 nt, Mycobacterium bovis subsp bovis AF2122/97
cguggcgcucggcgagcaa

SEQ ID NO: 1153925 - RNA, 14 nt, Mycobacterium bovis subsp bovis AF2122/97
cguggcgccggcca

SEQ ID NO: 1153926 - RNA, 13 nt, Mycobacterium bovis subsp bovis AF2122/97
cguggcggcagcg

SEQ ID NO: 1153927 - RNA, 12 nt, Mycobacterium bovis subsp bovis AF2122/97
cguggcggcgcg

SEQ ID NO: 1153928 - RNA, 15 nt, Mycobacterium bovis subsp bovis AF2122/97
cguggucggccaccc

SEQ ID NO: 1153929 - RNA, 14 nt, Mycobacterium bovis subsp bovis AF2122/97
cguggucggccacc

SEQ ID NO: 1153930 - RNA, 13 nt, Mycobacterium bovis subsp bovis AF2122/97
cguggucggagcg

SEQ ID NO: 1153931 - RNA, 15 nt, Mycobacterium bovis subsp bovis AF2122/97
cguggucggagcggg

SEQ ID NO: 1153932 - RNA, 17 nt, Mycobacterium bovis subsp bovis AF2122/97
cgugggccugcccggcg

SEQ ID NO: 1153933 - RNA, 22 nt, Mycobacterium bovis subsp bovis AF2122/97
cgugggccugcccggcgccgua

SEQ ID NO: 1153934 - RNA, 18 nt, Mycobacterium bovis subsp bovis AF2122/97
cguggucggcgaccccga

SEQ ID NO: 1153935 - RNA, 18 nt, Mycobacterium bovis subsp bovis AF2122/97
cguggucucggucagccc

SEQ ID NO: 1153936 - RNA, 16 nt, Mycobacterium bovis subsp bovis AF2122/97
cgugggaugucgagcg

SEQ ID NO: 1153937 - RNA, 19 nt, Mycobacterium bovis subsp bovis AF2122/97
cgugggcaccuuggccggc

SEQ ID NO: 1153938 - RNA, 19 nt, Mycobacterium bovis subsp bovis AF2122/97
cgugggcacuugcccgucg

SEQ ID NO: 1153939 - RNA, 19 nt, Mycobacterium bovis subsp bovis AF2122/97
cgugggcagcgcgaucacc

SEQ ID NO: 1153940 - RNA, 18 nt, Mycobacterium bovis subsp bovis AF2122/97
cgugggcauugcggcgcg

SEQ ID NO: 1153941 - RNA, 20 nt, Mycobacterium bovis subsp bovis AF2122/97
cgugggcauugcggcgcggg

SEQ ID NO: 1153942 - RNA, 20 nt, Mycobacterium bovis subsp bovis AF2122/97
cgugggcagcgcgaucaccg

SEQ ID NO: 1153943 - RNA, 16 nt, Mycobacterium bovis subsp bovis AF2122/97
cgugggcaugcggauu

SEQ ID NO: 1153944 - RNA, 21 nt, Mycobacterium bovis subsp bovis AF2122/97
cgugggccacuugaugcucga

SEQ ID NO: 1153945 - RNA, 23 nt, Mycobacterium bovis subsp bovis AF2122/97
cgugggccacuugaugcucgaug

SEQ ID NO: 1153946 - RNA, 20 nt, Mycobacterium bovis subsp bovis AF2122/97
cguggcgcccgucuccagca

SEQ ID NO: 1153947 - RNA, 17 nt, Mycobacterium bovis subsp bovis AF2122/97
cguggcgcccgugccgc

SEQ ID NO: 1153948 - RNA, 18 nt, Mycobacterium bovis subsp bovis AF2122/97
cguggcgcccgugccgcc

SEQ ID NO: 1153949 - RNA, 22 nt, Mycobacterium bovis subsp bovis AF2122/97
cguggcgcccgugccgcccgcg

SEQ ID NO: 1153950 - RNA, 18 nt, Mycobacterium bovis subsp bovis AF2122/97
cguggcgccggucgccgg

SEQ ID NO: 1153951 - RNA, 19 nt, Mycobacterium bovis subsp bovis AF2122/97
cguggcgccggucgccggc

SEQ ID NO: 1153952 - RNA, 22 nt, Mycobacterium bovis subsp bovis AF2122/97
cguggcgaaugacggccaguug

SEQ ID NO: 1153953 - RNA, 14 nt, Mycobacterium bovis subsp bovis AF2122/97
cguggcgaccggcg

SEQ ID NO: 1153954 - RNA, 13 nt, Mycobacterium bovis subsp bovis AF2122/97
cguggcgaccggc

SEQ ID NO: 1153955 - RNA, 20 nt, Mycobacterium bovis subsp bovis AF2122/97
cguggcgaaugacggccagu

SEQ ID NO: 1153956 - RNA, 21 nt, Mycobacterium bovis subsp bovis AF2122/97
cguggcgaaugacggccaguu

SEQ ID NO: 1153957 - RNA, 14 nt, Mycobacterium bovis subsp bovis AF2122/97
cguggagaucacgu

SEQ ID NO: 1153958 - RNA, 15 nt, Mycobacterium bovis subsp bovis AF2122/97
cguggaagccgacga

SEQ ID NO: 1153959 - RNA, 19 nt, Mycobacterium bovis subsp bovis AF2122/97
cguggacguacugucgucg

SEQ ID NO: 1153960 - RNA, 23 nt, Mycobacterium bovis subsp bovis AF2122/97
cguggacgcccgcccgcacgacg

SEQ ID NO: 1153961 - RNA, 24 nt, Mycobacterium bovis subsp bovis AF2122/97
cguggacgcccgcccgcacgacga

SEQ ID NO: 1153962 - RNA, 15 nt, Mycobacterium bovis subsp bovis AF2122/97
cguggacaagcacag

SEQ ID NO: 1153963 - RNA, 13 nt, Mycobacterium bovis subsp bovis AF2122/97
cguggacaucggg

SEQ ID NO: 1153964 - RNA, 19 nt, Mycobacterium bovis subsp bovis AF2122/97
cguggacaucgggcggcac

SEQ ID NO: 1153965 - RNA, 23 nt, Mycobacterium bovis subsp bovis AF2122/97
cguggacaucgggcggcaccgcu

SEQ ID NO: 1153966 - RNA, 15 nt, Mycobacterium bovis subsp bovis AF2122/97
cguggaauggcgccg

SEQ ID NO: 1153967 - RNA, 21 nt, Mycobacterium bovis subsp bovis AF2122/97
cguggaauggcgccggccggc

SEQ ID NO: 1153968 - RNA, 20 nt, Mycobacterium bovis subsp bovis AF2122/97
cguggaagauguugccgccg

SEQ ID NO: 1153969 - RNA, 18 nt, Mycobacterium bovis subsp bovis AF2122/97
cgugcuuguugcgcgacg

SEQ ID NO: 1153970 - RNA, 16 nt, Mycobacterium bovis subsp bovis AF2122/97
cguggaaagccggcgu

SEQ ID NO: 1153971 - RNA, 22 nt, Mycobacterium bovis subsp bovis AF2122/97
aaccgcggccccgacugccgcg

SEQ ID NO: 1153972 - RNA, 14 nt, Mycobacterium bovis subsp bovis AF2122/97
aaccgccggcugcg

SEQ ID NO: 1153973 - RNA, 12 nt, Mycobacterium bovis subsp bovis AF2122/97
aaccgccggugc

SEQ ID NO: 1153974 - RNA, 21 nt, Mycobacterium bovis subsp bovis AF2122/97
aaccgccggugccgaugaccg

SEQ ID NO: 1153975 - RNA, 15 nt, Mycobacterium bovis subsp bovis AF2122/97
aaccgcgaacccgau

SEQ ID NO: 1153976 - RNA, 12 nt, Mycobacterium bovis subsp bovis AF2122/97
aaccgcgcggcg

SEQ ID NO: 1153977 - RNA, 19 nt, Mycobacterium bovis subsp bovis AF2122/97
aaccgcgcggcgaucgagg

SEQ ID NO: 1153978 - RNA, 22 nt, Mycobacterium bovis subsp bovis AF2122/97
aaccgccgcgucauucaccgcg

SEQ ID NO: 1153979 - RNA, 17 nt, Mycobacterium bovis subsp bovis AF2122/97
aaccgccgccgccgcgu

SEQ ID NO: 1153980 - RNA, 23 nt, Mycobacterium bovis subsp bovis AF2122/97
cgugcgccacuagcccugagcga

SEQ ID NO: 1153981 - RNA, 13 nt, Mycobacterium bovis subsp bovis AF2122/97
cgugcgccgacgg

SEQ ID NO: 1153982 - RNA, 12 nt, Mycobacterium bovis subsp bovis AF2122/97
cgugcgccgacu

SEQ ID NO: 1153983 - RNA, 12 nt, Mycobacterium bovis subsp bovis AF2122/97
cgugcggcggcu

SEQ ID NO: 1153984 - RNA, 17 nt, Mycobacterium bovis subsp bovis AF2122/97
cgugcggcggcugccgg

SEQ ID NO: 1153985 - RNA, 14 nt, Mycobacterium bovis subsp bovis AF2122/97
cgugcggcucgccg

SEQ ID NO: 1153986 - RNA, 15 nt, Mycobacterium bovis subsp bovis AF2122/97
cgugcggcgcggcga

SEQ ID NO: 1153987 - RNA, 15 nt, Mycobacterium bovis subsp bovis AF2122/97
cgugcggcggccucg

SEQ ID NO: 1153988 - RNA, 17 nt, Mycobacterium bovis subsp bovis AF2122/97
cgugcggcggccucggg

SEQ ID NO: 1153989 - RNA, 17 nt, Mycobacterium bovis subsp bovis AF2122/97
cgugcugaacuccgccg

SEQ ID NO: 1153990 - RNA, 20 nt, Mycobacterium bovis subsp bovis AF2122/97
cgugcugaacuccgccgcga

SEQ ID NO: 1153991 - RNA, 23 nt, Mycobacterium bovis subsp bovis AF2122/97
cgugcucggccuguucggcggcu

SEQ ID NO: 1153992 - RNA, 18 nt, Mycobacterium bovis subsp bovis AF2122/97
cgugcucggaggcgauca

SEQ ID NO: 1153993 - RNA, 14 nt, Mycobacterium bovis subsp bovis AF2122/97
cgugcucggccugu

SEQ ID NO: 1153994 - RNA, 17 nt, Mycobacterium bovis subsp bovis AF2122/97
cgugcgggucguccgcc

SEQ ID NO: 1153995 - RNA, 15 nt, Mycobacterium bovis subsp bovis AF2122/97
cgugcgggcgcacca

SEQ ID NO: 1153996 - RNA, 22 nt, Mycobacterium bovis subsp bovis AF2122/97
cgugcgggggacgggucgccgc

SEQ ID NO: 1153997 - RNA, 18 nt, Mycobacterium bovis subsp bovis AF2122/97
cgugcggguucacugccg

SEQ ID NO: 1153998 - RNA, 22 nt, Mycobacterium bovis subsp bovis AF2122/97
cgugcggguucacugccggcca

SEQ ID NO: 1153999 - RNA, 21 nt, Mycobacterium bovis subsp bovis AF2122/97
cgugcugccguauccaggcgu

SEQ ID NO: 1154000 - RNA, 20 nt, Mycobacterium bovis subsp bovis AF2122/97
cgugcugccggagacacccg

SEQ ID NO: 1154001 - RNA, 20 nt, Mycobacterium bovis subsp bovis AF2122/97
cgugcugcccaucccggccg

SEQ ID NO: 1154002 - RNA, 21 nt, Mycobacterium bovis subsp bovis AF2122/97
cgugcugccgauagcgcggca

SEQ ID NO: 1154003 - RNA, 12 nt, Mycobacterium bovis subsp bovis AF2122/97
cgugcugccgcc

SEQ ID NO: 1154004 - RNA, 21 nt, Mycobacterium bovis subsp bovis AF2122/97
cgugcugccgccuuggucgcg

SEQ ID NO: 1154005 - RNA, 22 nt, Mycobacterium bovis subsp bovis AF2122/97
cgugcugaauugccaagcgcgc

SEQ ID NO: 1154006 - RNA, 20 nt, Mycobacterium bovis subsp bovis AF2122/97
cgugcugcagaucggccgga

SEQ ID NO: 1154007 - RNA, 21 nt, Mycobacterium bovis subsp bovis AF2122/97
cgugcugcuagccagucggcc

SEQ ID NO: 1154008 - RNA, 22 nt, Mycobacterium bovis subsp bovis AF2122/97
cgugcugcuagccagucggcca

SEQ ID NO: 1154009 - RNA, 12 nt, Mycobacterium bovis subsp bovis AF2122/97
aaccgcagucgc

SEQ ID NO: 1154010 - RNA, 14 nt, Mycobacterium bovis subsp bovis AF2122/97
cgugcuggcaccag

SEQ ID NO: 1154011 - RNA, 15 nt, Mycobacterium bovis subsp bovis AF2122/97
cgugcuggcaccagc

SEQ ID NO: 1154012 - RNA, 18 nt, Mycobacterium bovis subsp bovis AF2122/97
aaccgcagucgcggcaga

SEQ ID NO: 1154013 - RNA, 18 nt, Mycobacterium bovis subsp bovis AF2122/97
cgugcgacgauaucggga

SEQ ID NO: 1154014 - RNA, 18 nt, Mycobacterium bovis subsp bovis AF2122/97
cgugcgauucugcgucug

SEQ ID NO: 1154015 - RNA, 17 nt, Mycobacterium bovis subsp bovis AF2122/97
cgugcgcacggcgccga

SEQ ID NO: 1154016 - RNA, 15 nt, Mycobacterium bovis subsp bovis AF2122/97
cgugcgcaacgcguc

SEQ ID NO: 1154017 - RNA, 19 nt, Mycobacterium bovis subsp bovis AF2122/97
cgugcgcaacgcgucgucg

SEQ ID NO: 1154018 - RNA, 17 nt, Mycobacterium bovis subsp bovis AF2122/97
cgugccuuccucgccgg

SEQ ID NO: 1154019 - RNA, 18 nt, Mycobacterium bovis subsp bovis AF2122/97
cgugcgaaucgagacggc

SEQ ID NO: 1154020 - RNA, 19 nt, Mycobacterium bovis subsp bovis AF2122/97
cgugcgagggcacggcggu

SEQ ID NO: 1154021 - RNA, 23 nt, Mycobacterium bovis subsp bovis AF2122/97
cgugcgagggcacggcggugugu

SEQ ID NO: 1154022 - RNA, 19 nt, Mycobacterium bovis subsp bovis AF2122/97
cgugcgaucaccuccgcga

SEQ ID NO: 1154023 - RNA, 17 nt, Mycobacterium bovis subsp bovis AF2122/97
cgugcgaugcacaaccg

SEQ ID NO: 1154024 - RNA, 23 nt, Mycobacterium bovis subsp bovis AF2122/97
cgugcgauucacacucgggcggc

SEQ ID NO: 1154025 - RNA, 15 nt, Mycobacterium bovis subsp bovis AF2122/97
cgugccgucgccucc

SEQ ID NO: 1154026 - RNA, 20 nt, Mycobacterium bovis subsp bovis AF2122/97
cgugccgucggcgugcagca

SEQ ID NO: 1154027 - RNA, 17 nt, Mycobacterium bovis subsp bovis AF2122/97
cgugccucgaggacggc

SEQ ID NO: 1154028 - RNA, 19 nt, Mycobacterium bovis subsp bovis AF2122/97
cgugccgucaacgauggug

SEQ ID NO: 1154029 - RNA, 22 nt, Mycobacterium bovis subsp bovis AF2122/97
cgugccguugaagcccaacagc

SEQ ID NO: 1154030 - RNA, 23 nt, Mycobacterium bovis subsp bovis AF2122/97
cgugccguugaagcccaacagca

SEQ ID NO: 1154031 - RNA, 14 nt, Mycobacterium bovis subsp bovis AF2122/97
cgugccuggccggu

SEQ ID NO: 1154032 - RNA, 17 nt, Mycobacterium bovis subsp bovis AF2122/97
cgugccuggccggugcg

SEQ ID NO: 1154033 - RNA, 14 nt, Mycobacterium bovis subsp bovis AF2122/97
cgugccgucggcgu

SEQ ID NO: 1154034 - RNA, 15 nt, Mycobacterium bovis subsp bovis AF2122/97
cgugccgucggcgug

SEQ ID NO: 1154035 - RNA, 22 nt, Mycobacterium bovis subsp bovis AF2122/97
cgugccggggauaucacgacgc

SEQ ID NO: 1154036 - RNA, 16 nt, Mycobacterium bovis subsp bovis AF2122/97
cgugccggggcugccg

SEQ ID NO: 1154037 - RNA, 17 nt, Mycobacterium bovis subsp bovis AF2122/97
cgugccggggcugccga

SEQ ID NO: 1154038 - RNA, 17 nt, Mycobacterium bovis subsp bovis AF2122/97
cgugccgggucaccgau

SEQ ID NO: 1154039 - RNA, 11 nt, Mycobacterium bovis subsp bovis AF2122/97
cgugccgggug

SEQ ID NO: 1154040 - RNA, 13 nt, Mycobacterium bovis subsp bovis AF2122/97
cgugccggcguuu

SEQ ID NO: 1154041 - RNA, 13 nt, Mycobacterium bovis subsp bovis AF2122/97
cgugccgggaccg

SEQ ID NO: 1154042 - RNA, 16 nt, Mycobacterium bovis subsp bovis AF2122/97
cgugccgcagcggcgg

SEQ ID NO: 1154043 - RNA, 21 nt, Mycobacterium bovis subsp bovis AF2122/97
cgugccgcccggucgggcgcg

SEQ ID NO: 1154044 - RNA, 16 nt, Mycobacterium bovis subsp bovis AF2122/97
cgugccgcccggucgg

SEQ ID NO: 1154045 - RNA, 18 nt, Mycobacterium bovis subsp bovis AF2122/97
cgugccgcccucaccgcc

SEQ ID NO: 1154046 - RNA, 19 nt, Mycobacterium bovis subsp bovis AF2122/97
cgugccgccgacaccaccg

SEQ ID NO: 1154047 - RNA, 12 nt, Mycobacterium bovis subsp bovis AF2122/97
cgugccgccgca

SEQ ID NO: 1154048 - RNA, 19 nt, Mycobacterium bovis subsp bovis AF2122/97
cgugccgcggcgacgguga

SEQ ID NO: 1154049 - RNA, 15 nt, Mycobacterium bovis subsp bovis AF2122/97
cguugaacgcgugcu

SEQ ID NO: 1154050 - RNA, 18 nt, Mycobacterium bovis subsp bovis AF2122/97
cguugaacggcaccagcg

SEQ ID NO: 1154051 - RNA, 13 nt, Mycobacterium bovis subsp bovis AF2122/97
cguugaacucgag

SEQ ID NO: 1154052 - RNA, 14 nt, Mycobacterium bovis subsp bovis AF2122/97
cguugaaggcgccg

SEQ ID NO: 1154053 - RNA, 20 nt, Mycobacterium bovis subsp bovis AF2122/97
cguugaacugugcggcagcc

SEQ ID NO: 1154054 - RNA, 15 nt, Mycobacterium bovis subsp bovis AF2122/97
cguugaagacggcca

SEQ ID NO: 1154055 - RNA, 16 nt, Mycobacterium bovis subsp bovis AF2122/97
cguugaagcccaacag

SEQ ID NO: 1154056 - RNA, 19 nt, Mycobacterium bovis subsp bovis AF2122/97
cguugacccagaccggcuc

SEQ ID NO: 1154057 - RNA, 21 nt, Mycobacterium bovis subsp bovis AF2122/97
cguugacccaucucgucgucg

SEQ ID NO: 1154058 - RNA, 20 nt, Mycobacterium bovis subsp bovis AF2122/97
cguugaccgaacgcacgucg

SEQ ID NO: 1154059 - RNA, 14 nt, Mycobacterium bovis subsp bovis AF2122/97
cguugaccgcaucg

SEQ ID NO: 1154060 - RNA, 22 nt, Mycobacterium bovis subsp bovis AF2122/97
cguugaccgcaucgucgagcca

SEQ ID NO: 1154061 - RNA, 23 nt, Mycobacterium bovis subsp bovis AF2122/97
cguugaccgcaucgucgagccac

SEQ ID NO: 1154062 - RNA, 19 nt, Mycobacterium bovis subsp bovis AF2122/97
cguugaccagcacgacugc

SEQ ID NO: 1154063 - RNA, 15 nt, Mycobacterium bovis subsp bovis AF2122/97
cguugaccgggucgc

SEQ ID NO: 1154064 - RNA, 12 nt, Mycobacterium bovis subsp bovis AF2122/97
cguugaccgcgg

SEQ ID NO: 1154065 - RNA, 13 nt, Mycobacterium bovis subsp bovis AF2122/97
cguugacccggcg

SEQ ID NO: 1154066 - RNA, 18 nt, Mycobacterium bovis subsp bovis AF2122/97
cguugaccgggucgccga

SEQ ID NO: 1154067 - RNA, 17 nt, Mycobacterium bovis subsp bovis AF2122/97
cguugaccgcggucugc

SEQ ID NO: 1154068 - RNA, 23 nt, Mycobacterium bovis subsp bovis AF2122/97
cguugaccgugauaucagagggc

SEQ ID NO: 1154069 - RNA, 12 nt, Mycobacterium bovis subsp bovis AF2122/97
cguugacgucaa

SEQ ID NO: 1154070 - RNA, 21 nt, Mycobacterium bovis subsp bovis AF2122/97
cguugacggcgaacccgccga

SEQ ID NO: 1154071 - RNA, 23 nt, Mycobacterium bovis subsp bovis AF2122/97
cguugacggcgaacccgccgaug

SEQ ID NO: 1154072 - RNA, 20 nt, Mycobacterium bovis subsp bovis AF2122/97
cguugacggcuucggcagcc

SEQ ID NO: 1154073 - RNA, 22 nt, Mycobacterium bovis subsp bovis AF2122/97
cguugacggugucuugccacca

SEQ ID NO: 1154074 - RNA, 23 nt, Mycobacterium bovis subsp bovis AF2122/97
cguugacggugucuugccaccac

SEQ ID NO: 1154075 - RNA, 20 nt, Mycobacterium bovis subsp bovis AF2122/97
cguugacucugcguccacca

SEQ ID NO: 1154076 - RNA, 19 nt, Mycobacterium bovis subsp bovis AF2122/97
cguugacucugcguccacc

SEQ ID NO: 1154077 - RNA, 13 nt, Mycobacterium bovis subsp bovis AF2122/97
cguugacgucgag

SEQ ID NO: 1154078 - RNA, 17 nt, Mycobacterium bovis subsp bovis AF2122/97
cguugaugaccaggucg

SEQ ID NO: 1154079 - RNA, 18 nt, Mycobacterium bovis subsp bovis AF2122/97
cguugaugaccgccgccg

SEQ ID NO: 1154080 - RNA, 19 nt, Mycobacterium bovis subsp bovis AF2122/97
cguugaugaccgccgccgg

SEQ ID NO: 1154081 - RNA, 14 nt, Mycobacterium bovis subsp bovis AF2122/97
cguugaugucggcc

SEQ ID NO: 1154082 - RNA, 14 nt, Mycobacterium bovis subsp bovis AF2122/97
cguugauucggccg

SEQ ID NO: 1154083 - RNA, 16 nt, Mycobacterium bovis subsp bovis AF2122/97
cguugauucggccgcc

SEQ ID NO: 1154084 - RNA, 16 nt, Mycobacterium bovis subsp bovis AF2122/97
cguugaugucggccag

SEQ ID NO: 1154085 - RNA, 24 nt, Mycobacterium bovis subsp bovis AF2122/97
cguugaugccgccggagucgaaca

SEQ ID NO: 1154086 - RNA, 16 nt, Mycobacterium bovis subsp bovis AF2122/97
cguugaugucggcagg

SEQ ID NO: 1154087 - RNA, 13 nt, Mycobacterium bovis subsp bovis AF2122/97
cguugccgaacca

SEQ ID NO: 1154088 - RNA, 20 nt, Mycobacterium bovis subsp bovis AF2122/97
cguugccgaucaccacggcg

SEQ ID NO: 1154089 - RNA, 18 nt, Mycobacterium bovis subsp bovis AF2122/97
cguugccgaucagcccgg

SEQ ID NO: 1154090 - RNA, 21 nt, Mycobacterium bovis subsp bovis AF2122/97
cguugccgaucgcuccggccc

SEQ ID NO: 1154091 - RNA, 14 nt, Mycobacterium bovis subsp bovis AF2122/97
cguugccgaucugc

SEQ ID NO: 1154092 - RNA, 21 nt, Mycobacterium bovis subsp bovis AF2122/97
cguugcccccauugccgccgu

SEQ ID NO: 1154093 - RNA, 13 nt, Mycobacterium bovis subsp bovis AF2122/97
cguugcccgaccc

SEQ ID NO: 1154094 - RNA, 17 nt, Mycobacterium bovis subsp bovis AF2122/97
cguugcccgacccgccg

SEQ ID NO: 1154095 - RNA, 20 nt, Mycobacterium bovis subsp bovis AF2122/97
cguugcccgacccgccgacg

SEQ ID NO: 1154096 - RNA, 14 nt, Mycobacterium bovis subsp bovis AF2122/97
cguucggccgggcc

SEQ ID NO: 1154097 - RNA, 15 nt, Mycobacterium bovis subsp bovis AF2122/97
cguucggcgacagcg

SEQ ID NO: 1154098 - RNA, 13 nt, Mycobacterium bovis subsp bovis AF2122/97
cguucggcgagca

SEQ ID NO: 1154099 - RNA, 14 nt, Mycobacterium bovis subsp bovis AF2122/97
cguucggcgagcag

SEQ ID NO: 1154100 - RNA, 13 nt, Mycobacterium bovis subsp bovis AF2122/97
cguuccgaucggc

SEQ ID NO: 1154101 - RNA, 16 nt, Mycobacterium bovis subsp bovis AF2122/97
cguuccgggccgauca

SEQ ID NO: 1154102 - RNA, 13 nt, Mycobacterium bovis subsp bovis AF2122/97
cguuccgcucgag

SEQ ID NO: 1154103 - RNA, 13 nt, Mycobacterium bovis subsp bovis AF2122/97
cguucccgcucgg

SEQ ID NO: 1154104 - RNA, 15 nt, Mycobacterium bovis subsp bovis AF2122/97
cguucccgccggcgc

SEQ ID NO: 1154105 - RNA, 16 nt, Mycobacterium bovis subsp bovis AF2122/97
cguucccgccggcgcc

SEQ ID NO: 1154106 - RNA, 15 nt, Mycobacterium bovis subsp bovis AF2122/97
cguucccgccggcuc

SEQ ID NO: 1154107 - RNA, 19 nt, Mycobacterium bovis subsp bovis AF2122/97
cguucccgccauugccgcc

SEQ ID NO: 1154108 - RNA, 14 nt, Mycobacterium bovis subsp bovis AF2122/97
cguucccgcucggg

SEQ ID NO: 1154109 - RNA, 13 nt, Mycobacterium bovis subsp bovis AF2122/97
cguucccccggca

SEQ ID NO: 1154110 - RNA, 23 nt, Mycobacterium bovis subsp bovis AF2122/97
cguucccccggcaccgccggcuc

SEQ ID NO: 1154111 - RNA, 16 nt, Mycobacterium bovis subsp bovis AF2122/97
cguucggcgagcagcg

SEQ ID NO: 1154112 - RNA, 15 nt, Mycobacterium bovis subsp bovis AF2122/97
cguucggugaucucg

SEQ ID NO: 1154113 - RNA, 13 nt, Mycobacterium bovis subsp bovis AF2122/97
cguucggcgcccg

SEQ ID NO: 1154114 - RNA, 12 nt, Mycobacterium bovis subsp bovis AF2122/97
cguucgggcccg

SEQ ID NO: 1154115 - RNA, 22 nt, Mycobacterium bovis subsp bovis AF2122/97
cguucggggccccgcggcgccg

SEQ ID NO: 1154116 - RNA, 16 nt, Mycobacterium bovis subsp bovis AF2122/97
cguucggcgugucggg

SEQ ID NO: 1154117 - RNA, 14 nt, Mycobacterium bovis subsp bovis AF2122/97
cguucgucgcgggu

SEQ ID NO: 1154118 - RNA, 21 nt, Mycobacterium bovis subsp bovis AF2122/97
cguuaucgucggcuugcugcc

SEQ ID NO: 1154119 - RNA, 16 nt, Mycobacterium bovis subsp bovis AF2122/97
cguuaugaccucgacg

SEQ ID NO: 1154120 - RNA, 18 nt, Mycobacterium bovis subsp bovis AF2122/97
cguuaccaccgucaccgc

SEQ ID NO: 1154121 - RNA, 23 nt, Mycobacterium bovis subsp bovis AF2122/97
cguuaccaccgucaccgccggca

SEQ ID NO: 1154122 - RNA, 20 nt, Mycobacterium bovis subsp bovis AF2122/97
cguucagcccaugcccggcg

SEQ ID NO: 1154123 - RNA, 13 nt, Mycobacterium bovis subsp bovis AF2122/97
cguucagcgacgg

SEQ ID NO: 1154124 - RNA, 14 nt, Mycobacterium bovis subsp bovis AF2122/97
cguucagcgucgac

SEQ ID NO: 1154125 - RNA, 14 nt, Mycobacterium bovis subsp bovis AF2122/97
cguucagcggccag

SEQ ID NO: 1154126 - RNA, 22 nt, Mycobacterium bovis subsp bovis AF2122/97
cguucaaugucguugcccgcga

SEQ ID NO: 1154127 - RNA, 22 nt, Mycobacterium bovis subsp bovis AF2122/97
cguucaccacgaucgcgagccc

SEQ ID NO: 1154128 - RNA, 16 nt, Mycobacterium bovis subsp bovis AF2122/97
cguucaccugcgucgg

SEQ ID NO: 1154129 - RNA, 14 nt, Mycobacterium bovis subsp bovis AF2122/97
cguucaccgcgcgc

SEQ ID NO: 1154130 - RNA, 19 nt, Mycobacterium bovis subsp bovis AF2122/97
cguucaccgcgcgcucgcc

SEQ ID NO: 1154131 - RNA, 22 nt, Mycobacterium bovis subsp bovis AF2122/97
cguucaccgcgcgcucgcccag

SEQ ID NO: 1154132 - RNA, 18 nt, Mycobacterium bovis subsp bovis AF2122/97
cguucacgcgcggaucgg

SEQ ID NO: 1154133 - RNA, 22 nt, Mycobacterium bovis subsp bovis AF2122/97
cgugguguacccgccucgggcc

SEQ ID NO: 1154134 - RNA, 16 nt, Mycobacterium bovis subsp bovis AF2122/97
cgugguguaucgacgg

SEQ ID NO: 1154135 - RNA, 16 nt, Mycobacterium bovis subsp bovis AF2122/97
cgugguguccaccgca

SEQ ID NO: 1154136 - RNA, 21 nt, Mycobacterium bovis subsp bovis AF2122/97
cgugguugcacguucggcgug

SEQ ID NO: 1154137 - RNA, 17 nt, Mycobacterium bovis subsp bovis AF2122/97
cgugguggcguaucggg

SEQ ID NO: 1154138 - RNA, 19 nt, Mycobacterium bovis subsp bovis AF2122/97
cguggugggcgcagaguca

SEQ ID NO: 1154139 - RNA, 20 nt, Mycobacterium bovis subsp bovis AF2122/97
cguggugggcgcagagucaa

SEQ ID NO: 1154140 - RNA, 21 nt, Mycobacterium bovis subsp bovis AF2122/97
cguggucucggucagccccau

SEQ ID NO: 1154141 - RNA, 19 nt, Mycobacterium bovis subsp bovis AF2122/97
cguggugcaacacgccggc

SEQ ID NO: 1154142 - RNA, 19 nt, Mycobacterium bovis subsp bovis AF2122/97
cguggucgggaaaugucgc

SEQ ID NO: 1154143 - RNA, 18 nt, Mycobacterium bovis subsp bovis AF2122/97
cguggugcuagcgccgcc

SEQ ID NO: 1154144 - RNA, 19 nt, Mycobacterium bovis subsp bovis AF2122/97
cguggugcuagcgccgcca

SEQ ID NO: 1154145 - RNA, 19 nt, Mycobacterium bovis subsp bovis AF2122/97
cguggugccuacaccggca

SEQ ID NO: 1154146 - RNA, 20 nt, Mycobacterium bovis subsp bovis AF2122/97
cguggugccuacaccggcaa

SEQ ID NO: 1154147 - RNA, 13 nt, Mycobacterium bovis subsp bovis AF2122/97
cguggugcggccg

SEQ ID NO: 1154148 - RNA, 21 nt, Mycobacterium bovis subsp bovis AF2122/97
cguggugcuagcgccgccagu

SEQ ID NO: 1154149 - RNA, 20 nt, Mycobacterium bovis subsp bovis AF2122/97
cgugguggacgcagagucaa

SEQ ID NO: 1154150 - RNA, 19 nt, Mycobacterium bovis subsp bovis AF2122/97
cgugguggacgcagaguca

SEQ ID NO: 1154151 - RNA, 16 nt, Mycobacterium bovis subsp bovis AF2122/97
cguguugaccgggucg

SEQ ID NO: 1154152 - RNA, 17 nt, Mycobacterium bovis subsp bovis AF2122/97
cguguucugaucggugg

SEQ ID NO: 1154153 - RNA, 19 nt, Mycobacterium bovis subsp bovis AF2122/97
cguguucgggggcggucgc

SEQ ID NO: 1154154 - RNA, 20 nt, Mycobacterium bovis subsp bovis AF2122/97
cguguucgccacacccgugu

SEQ ID NO: 1154155 - RNA, 23 nt, Mycobacterium bovis subsp bovis AF2122/97
cguguugcacgcgggugccgacg

SEQ ID NO: 1154156 - RNA, 13 nt, Mycobacterium bovis subsp bovis AF2122/97
cguguuggccggg

SEQ ID NO: 1154157 - RNA, 15 nt, Mycobacterium bovis subsp bovis AF2122/97
cgugcccgccaccgg

SEQ ID NO: 1154158 - RNA, 14 nt, Mycobacterium bovis subsp bovis AF2122/97
cgugccccggcgcg

SEQ ID NO: 1154159 - RNA, 16 nt, Mycobacterium bovis subsp bovis AF2122/97
cgugccccggcgcggu

SEQ ID NO: 1154160 - RNA, 13 nt, Mycobacterium bovis subsp bovis AF2122/97
cgugccccggcgg

SEQ ID NO: 1154161 - RNA, 13 nt, Mycobacterium bovis subsp bovis AF2122/97
cgugcccgcgcgg

SEQ ID NO: 1154162 - RNA, 22 nt, Mycobacterium bovis subsp bovis AF2122/97
cgugcccccggcuuuuccggca

SEQ ID NO: 1154163 - RNA, 12 nt, Mycobacterium bovis subsp bovis AF2122/97
cgugcccgggcg

SEQ ID NO: 1154164 - RNA, 14 nt, Mycobacterium bovis subsp bovis AF2122/97
cgugcccgggcggu

SEQ ID NO: 1154165 - RNA, 13 nt, Mycobacterium bovis subsp bovis AF2122/97
cgugcccgguguu

SEQ ID NO: 1154166 - RNA, 18 nt, Mycobacterium bovis subsp bovis AF2122/97
cgugcccgccaccggcgc

SEQ ID NO: 1154167 - RNA, 22 nt, Mycobacterium bovis subsp bovis AF2122/97
cgugcccuguccggcgccgagg

SEQ ID NO: 1154168 - RNA, 21 nt, Mycobacterium bovis subsp bovis AF2122/97
cgugccgaaguggagccccga

SEQ ID NO: 1154169 - RNA, 20 nt, Mycobacterium bovis subsp bovis AF2122/97
cgugccgaaaaucgcagcca

SEQ ID NO: 1154170 - RNA, 23 nt, Mycobacterium bovis subsp bovis AF2122/97
cgugccgcaccgccugcucggcg

SEQ ID NO: 1154171 - RNA, 23 nt, Mycobacterium bovis subsp bovis AF2122/97
cgugccgcaaccggcgaucgguu

SEQ ID NO: 1154172 - RNA, 14 nt, Mycobacterium bovis subsp bovis AF2122/97
cgugccgcagcggc

SEQ ID NO: 1154173 - RNA, 14 nt, Mycobacterium bovis subsp bovis AF2122/97
cgugccagcgcccc

SEQ ID NO: 1154174 - RNA, 23 nt, Mycobacterium bovis subsp bovis AF2122/97
cgugccagcaggggacgggcggc

SEQ ID NO: 1154175 - RNA, 17 nt, Mycobacterium bovis subsp bovis AF2122/97
cgugcccaggccaccgg

SEQ ID NO: 1154176 - RNA, 21 nt, Mycobacterium bovis subsp bovis AF2122/97
cgugcccaggccaccggcugc

SEQ ID NO: 1154177 - RNA, 23 nt, Mycobacterium bovis subsp bovis AF2122/97
cgugccaugguugaugugcagga

SEQ ID NO: 1154178 - RNA, 22 nt, Mycobacterium bovis subsp bovis AF2122/97
cgugccagcagcaaucagccgc

SEQ ID NO: 1154179 - RNA, 23 nt, Mycobacterium bovis subsp bovis AF2122/97
cgugccagcagcaaucagccgcc

SEQ ID NO: 1154180 - RNA, 23 nt, Mycobacterium bovis subsp bovis AF2122/97
cgugccaaugauucggcacgccg

SEQ ID NO: 1154181 - RNA, 15 nt, Mycobacterium bovis subsp bovis AF2122/97
cgugccacagcucgc

SEQ ID NO: 1154182 - RNA, 17 nt, Mycobacterium bovis subsp bovis AF2122/97
cgugccacagcucgccg

SEQ ID NO: 1154183 - RNA, 18 nt, Mycobacterium bovis subsp bovis AF2122/97
cgugcagcggcgccgcca

SEQ ID NO: 1154184 - RNA, 18 nt, Mycobacterium bovis subsp bovis AF2122/97
cgugcagcucggucagcg

SEQ ID NO: 1154185 - RNA, 16 nt, Mycobacterium bovis subsp bovis AF2122/97
cgugcagcggcgggcg

SEQ ID NO: 1154186 - RNA, 19 nt, Mycobacterium bovis subsp bovis AF2122/97
cgugcagcggcgggcgaug

SEQ ID NO: 1154187 - RNA, 20 nt, Mycobacterium bovis subsp bovis AF2122/97
cgugcagcggcgggcgauga

SEQ ID NO: 1154188 - RNA, 17 nt, Mycobacterium bovis subsp bovis AF2122/97
cgugcaucgccugcgcc

SEQ ID NO: 1154189 - RNA, 21 nt, Mycobacterium bovis subsp bovis AF2122/97
cgugcaucgcgauuccggcgg

SEQ ID NO: 1154190 - RNA, 23 nt, Mycobacterium bovis subsp bovis AF2122/97
cgugcaucgcgauuccggcggcc

SEQ ID NO: 1154191 - RNA, 23 nt, Mycobacterium bovis subsp bovis AF2122/97
cgugcaggaccagcaccgccgcg

SEQ ID NO: 1154192 - RNA, 16 nt, Mycobacterium bovis subsp bovis AF2122/97
cgugcauaagcccgcg

SEQ ID NO: 1154193 - RNA, 17 nt, Mycobacterium bovis subsp bovis AF2122/97
cgugcauaagcccgcga

SEQ ID NO: 1154194 - RNA, 15 nt, Mycobacterium bovis subsp bovis AF2122/97
cgugcaccgucggga

SEQ ID NO: 1154195 - RNA, 12 nt, Mycobacterium bovis subsp bovis AF2122/97
cgugcaccgcga

SEQ ID NO: 1154196 - RNA, 18 nt, Mycobacterium bovis subsp bovis AF2122/97
cgugcaccgcgaccgcgc

SEQ ID NO: 1154197 - RNA, 19 nt, Mycobacterium bovis subsp bovis AF2122/97
cgugcaccgcgaccgcgca

SEQ ID NO: 1154198 - RNA, 12 nt, Mycobacterium bovis subsp bovis AF2122/97
cgugcaccagcu

SEQ ID NO: 1154199 - RNA, 21 nt, Mycobacterium bovis subsp bovis AF2122/97
cgugcaccagguugcaaccuu

SEQ ID NO: 1154200 - RNA, 17 nt, Mycobacterium bovis subsp bovis AF2122/97
cgugcacgacgacaucg

SEQ ID NO: 1154201 - RNA, 14 nt, Mycobacterium bovis subsp bovis AF2122/97
cgugcacggcggcc

SEQ ID NO: 1154202 - RNA, 15 nt, Mycobacterium bovis subsp bovis AF2122/97
cgugcacggcggcca

SEQ ID NO: 1154203 - RNA, 16 nt, Mycobacterium bovis subsp bovis AF2122/97
cgugcacggcggccag

SEQ ID NO: 1154204 - RNA, 23 nt, Mycobacterium bovis subsp bovis AF2122/97
cgugcagcacuuccaagccgacc

SEQ ID NO: 1154205 - RNA, 20 nt, Mycobacterium bovis subsp bovis AF2122/97
cgugcagcacccccucggcu

SEQ ID NO: 1154206 - RNA, 17 nt, Mycobacterium bovis subsp bovis AF2122/97
cgugcagccgcaggugg

SEQ ID NO: 1154207 - RNA, 18 nt, Mycobacterium bovis subsp bovis AF2122/97
cgugcagccauugacggu

SEQ ID NO: 1154208 - RNA, 20 nt, Mycobacterium bovis subsp bovis AF2122/97
cgugcagaauccguucgacg

SEQ ID NO: 1154209 - RNA, 17 nt, Mycobacterium bovis subsp bovis AF2122/97
cgugcagaucacgggug

SEQ ID NO: 1154210 - RNA, 18 nt, Mycobacterium bovis subsp bovis AF2122/97
cgugcagaucacgggugu

SEQ ID NO: 1154211 - RNA, 22 nt, Mycobacterium bovis subsp bovis AF2122/97
cgugacccggauaucgaccacc

SEQ ID NO: 1154212 - RNA, 17 nt, Mycobacterium bovis subsp bovis AF2122/97
cgugaccgugccgucgg

SEQ ID NO: 1154213 - RNA, 13 nt, Mycobacterium bovis subsp bovis AF2122/97
cgugaccggcaau

SEQ ID NO: 1154214 - RNA, 12 nt, Mycobacterium bovis subsp bovis AF2122/97
cgugaccgagcc

SEQ ID NO: 1154215 - RNA, 16 nt, Mycobacterium bovis subsp bovis AF2122/97
cgugaccgagccgcga

SEQ ID NO: 1154216 - RNA, 15 nt, Mycobacterium bovis subsp bovis AF2122/97
cgugaccgccgcgcc

SEQ ID NO: 1154217 - RNA, 12 nt, Mycobacterium bovis subsp bovis AF2122/97
cgugaccgccgu

SEQ ID NO: 1154218 - RNA, 21 nt, Mycobacterium bovis subsp bovis AF2122/97
cgugacgaccagccccgcugg

SEQ ID NO: 1154219 - RNA, 24 nt, Mycobacterium bovis subsp bovis AF2122/97
cgugacgaccagccccgcuggucg

SEQ ID NO: 1154220 - RNA, 14 nt, Mycobacterium bovis subsp bovis AF2122/97
cgugacgccggcca

SEQ ID NO: 1154221 - RNA, 17 nt, Mycobacterium bovis subsp bovis AF2122/97
cgugacugguggcgcca

SEQ ID NO: 1154222 - RNA, 13 nt, Mycobacterium bovis subsp bovis AF2122/97
cgugacucggccg

SEQ ID NO: 1154223 - RNA, 15 nt, Mycobacterium bovis subsp bovis AF2122/97
cgugacucggccgac

SEQ ID NO: 1154224 - RNA, 20 nt, Mycobacterium bovis subsp bovis AF2122/97
cgugacgucguggcgcucgg

SEQ ID NO: 1154225 - RNA, 13 nt, Mycobacterium bovis subsp bovis AF2122/97
cgugacgucgucg

SEQ ID NO: 1154226 - RNA, 14 nt, Mycobacterium bovis subsp bovis AF2122/97
cgugacgucgucga

SEQ ID NO: 1154227 - RNA, 14 nt, Mycobacterium bovis subsp bovis AF2122/97
cgugacgguccacg

SEQ ID NO: 1154228 - RNA, 16 nt, Mycobacterium bovis subsp bovis AF2122/97
cgugacgguccacgac

SEQ ID NO: 1154229 - RNA, 22 nt, Mycobacterium bovis subsp bovis AF2122/97
cgugacgguccacgacgucgag

SEQ ID NO: 1154230 - RNA, 20 nt, Mycobacterium bovis subsp bovis AF2122/97
cgugacguagggcagcgcca

SEQ ID NO: 1154231 - RNA, 21 nt, Mycobacterium bovis subsp bovis AF2122/97
cgugacguagggcagcgccag

SEQ ID NO: 1154232 - RNA, 19 nt, Mycobacterium bovis subsp bovis AF2122/97
cgugacguaucgccgcggg

SEQ ID NO: 1154233 - RNA, 23 nt, Mycobacterium bovis subsp bovis AF2122/97
cgugagcaguucguuccagauga

SEQ ID NO: 1154234 - RNA, 16 nt, Mycobacterium bovis subsp bovis AF2122/97
cgugagccccagcgac

SEQ ID NO: 1154235 - RNA, 16 nt, Mycobacterium bovis subsp bovis AF2122/97
cgugacucggccgacg

SEQ ID NO: 1154236 - RNA, 16 nt, Mycobacterium bovis subsp bovis AF2122/97
cgugagacgccgucga

SEQ ID NO: 1154237 - RNA, 18 nt, Mycobacterium bovis subsp bovis AF2122/97
cgugagacgccgucgacg

SEQ ID NO: 1154238 - RNA, 20 nt, Mycobacterium bovis subsp bovis AF2122/97
cgugagggucaugucgauca

SEQ ID NO: 1154239 - RNA, 22 nt, Mycobacterium bovis subsp bovis AF2122/97
cgugagcucgucgaggcugacc

SEQ ID NO: 1154240 - RNA, 13 nt, Mycobacterium bovis subsp bovis AF2122/97
cgugagcggccag

SEQ ID NO: 1154241 - RNA, 17 nt, Mycobacterium bovis subsp bovis AF2122/97
cgugagccuguccacgu

SEQ ID NO: 1154242 - RNA, 23 nt, Mycobacterium bovis subsp bovis AF2122/97
cgugagccuuucgugcaccgcga

SEQ ID NO: 1154243 - RNA, 19 nt, Mycobacterium bovis subsp bovis AF2122/97
cgugcaccacauuggcgau

SEQ ID NO: 1154244 - RNA, 21 nt, Mycobacterium bovis subsp bovis AF2122/97
cgugcaaccauggcggcuccg

SEQ ID NO: 1154245 - RNA, 13 nt, Mycobacterium bovis subsp bovis AF2122/97
cgugaugucaacg

SEQ ID NO: 1154246 - RNA, 23 nt, Mycobacterium bovis subsp bovis AF2122/97
cgugaucuucugccuuggccggc

SEQ ID NO: 1154247 - RNA, 21 nt, Mycobacterium bovis subsp bovis AF2122/97
cgugauguggucggacagcgu

SEQ ID NO: 1154248 - RNA, 15 nt, Mycobacterium bovis subsp bovis AF2122/97
cgugaugccacggcg

SEQ ID NO: 1154249 - RNA, 17 nt, Mycobacterium bovis subsp bovis AF2122/97
cgugauggugacuucgg

SEQ ID NO: 1154250 - RNA, 20 nt, Mycobacterium bovis subsp bovis AF2122/97
cgugauggugacuucggugg

SEQ ID NO: 1154251 - RNA, 22 nt, Mycobacterium bovis subsp bovis AF2122/97
cgugauggcguuugccggccga

SEQ ID NO: 1154252 - RNA, 20 nt, Mycobacterium bovis subsp bovis AF2122/97
cgugaugggucaccucggag

SEQ ID NO: 1154253 - RNA, 11 nt, Mycobacterium bovis subsp bovis AF2122/97
cgugaugcggg

SEQ ID NO: 1154254 - RNA, 16 nt, Mycobacterium bovis subsp bovis AF2122/97
cgugaugcggucgcgg

SEQ ID NO: 1154255 - RNA, 20 nt, Mycobacterium bovis subsp bovis AF2122/97
cgugaugcguucggccgggc

SEQ ID NO: 1154256 - RNA, 16 nt, Mycobacterium bovis subsp bovis AF2122/97
cgugaucaccggcauc

SEQ ID NO: 1154257 - RNA, 19 nt, Mycobacterium bovis subsp bovis AF2122/97
cgugaucccgcccaaggug

SEQ ID NO: 1154258 - RNA, 14 nt, Mycobacterium bovis subsp bovis AF2122/97
cgugaucgaccgga

SEQ ID NO: 1154259 - RNA, 13 nt, Mycobacterium bovis subsp bovis AF2122/97
cgugaucgacgac

SEQ ID NO: 1154260 - RNA, 15 nt, Mycobacterium bovis subsp bovis AF2122/97
cgugauccgccgaca

SEQ ID NO: 1154261 - RNA, 16 nt, Mycobacterium bovis subsp bovis AF2122/97
cgugaucgacgaccgu

SEQ ID NO: 1154262 - RNA, 20 nt, Mycobacterium bovis subsp bovis AF2122/97
cgugaucgaggcggcggucg

SEQ ID NO: 1154263 - RNA, 17 nt, Mycobacterium bovis subsp bovis AF2122/97
cgugaucgcuggcgacc

SEQ ID NO: 1154264 - RNA, 16 nt, Mycobacterium bovis subsp bovis AF2122/97
cgugaucggcgucagg

SEQ ID NO: 1154265 - RNA, 17 nt, Mycobacterium bovis subsp bovis AF2122/97
cgugauacagcucggug

SEQ ID NO: 1154266 - RNA, 15 nt, Mycobacterium bovis subsp bovis AF2122/97
cgugaguuucaccac

SEQ ID NO: 1154267 - RNA, 13 nt, Mycobacterium bovis subsp bovis AF2122/97
cgugaguucacgu

SEQ ID NO: 1154268 - RNA, 19 nt, Mycobacterium bovis subsp bovis AF2122/97
cgugaguucacguucggcg

SEQ ID NO: 1154269 - RNA, 20 nt, Mycobacterium bovis subsp bovis AF2122/97
cgugaguucacguucggcgc

SEQ ID NO: 1154270 - RNA, 17 nt, Mycobacterium bovis subsp bovis AF2122/97
cgugaguucgcaaucag

SEQ ID NO: 1154271 - RNA, 16 nt, Mycobacterium bovis subsp bovis AF2122/97
cgugagugccggcgug

SEQ ID NO: 1154272 - RNA, 18 nt, Mycobacterium bovis subsp bovis AF2122/97
cgugagugccggcgugcg

SEQ ID NO: 1154273 - RNA, 15 nt, Mycobacterium bovis subsp bovis AF2122/97
cgucgucgcugccgc

SEQ ID NO: 1154274 - RNA, 18 nt, Mycobacterium bovis subsp bovis AF2122/97
cgucgugaccgaccgcca

SEQ ID NO: 1154275 - RNA, 17 nt, Mycobacterium bovis subsp bovis AF2122/97
cgucgugaccggcggga

SEQ ID NO: 1154276 - RNA, 12 nt, Mycobacterium bovis subsp bovis AF2122/97
cgucgugaggaa

SEQ ID NO: 1154277 - RNA, 13 nt, Mycobacterium bovis subsp bovis AF2122/97
cgucgucgcggga

SEQ ID NO: 1154278 - RNA, 14 nt, Mycobacterium bovis subsp bovis AF2122/97
cgucgucgcggccg

SEQ ID NO: 1154279 - RNA, 16 nt, Mycobacterium bovis subsp bovis AF2122/97
cgucgucgcggccgcu

SEQ ID NO: 1154280 - RNA, 23 nt, Mycobacterium bovis subsp bovis AF2122/97
cgucgucgccgucggugccgccg

SEQ ID NO: 1154281 - RNA, 15 nt, Mycobacterium bovis subsp bovis AF2122/97
cgucgugcacggcgg

SEQ ID NO: 1154282 - RNA, 18 nt, Mycobacterium bovis subsp bovis AF2122/97
cgucgugcacggcggcca

SEQ ID NO: 1154283 - RNA, 20 nt, Mycobacterium bovis subsp bovis AF2122/97
cgucgugcacggcggccagg

SEQ ID NO: 1154284 - RNA, 12 nt, Mycobacterium bovis subsp bovis AF2122/97
cgucgugccacu

SEQ ID NO: 1154285 - RNA, 16 nt, Mycobacterium bovis subsp bovis AF2122/97
cgucgugaugggucac

SEQ ID NO: 1154286 - RNA, 21 nt, Mycobacterium bovis subsp bovis AF2122/97
cgucgucgacggcugcgccga

SEQ ID NO: 1154287 - RNA, 17 nt, Mycobacterium bovis subsp bovis AF2122/97
cgucguggcgcucggcg

SEQ ID NO: 1154288 - RNA, 15 nt, Mycobacterium bovis subsp bovis AF2122/97
cgucgugcgggcggg

SEQ ID NO: 1154289 - RNA, 20 nt, Mycobacterium bovis subsp bovis AF2122/97
cgucgugcgcggccggcacg

SEQ ID NO: 1154290 - RNA, 21 nt, Mycobacterium bovis subsp bovis AF2122/97
cgucgugcgcggccggcacga

SEQ ID NO: 1154291 - RNA, 22 nt, Mycobacterium bovis subsp bovis AF2122/97
cgucgucgcugagcagcgccgc

SEQ ID NO: 1154292 - RNA, 15 nt, Mycobacterium bovis subsp bovis AF2122/97
cgucgugucgccgcc

SEQ ID NO: 1154293 - RNA, 21 nt, Mycobacterium bovis subsp bovis AF2122/97
cgucgugucgccgccguugcc

SEQ ID NO: 1154294 - RNA, 14 nt, Mycobacterium bovis subsp bovis AF2122/97
cgucguggcuuccg

SEQ ID NO: 1154295 - RNA, 15 nt, Mycobacterium bovis subsp bovis AF2122/97
cgucguggucggcga

SEQ ID NO: 1154296 - RNA, 14 nt, Mycobacterium bovis subsp bovis AF2122/97
cgucgucgaaguug

SEQ ID NO: 1154297 - RNA, 22 nt, Mycobacterium bovis subsp bovis AF2122/97
cgucgucgaaguuggcgaagcc

SEQ ID NO: 1154298 - RNA, 19 nt, Mycobacterium bovis subsp bovis AF2122/97
cgucgucgaauccugccgc

SEQ ID NO: 1154299 - RNA, 14 nt, Mycobacterium bovis subsp bovis AF2122/97
cgucgucgacacgg

SEQ ID NO: 1154300 - RNA, 19 nt, Mycobacterium bovis subsp bovis AF2122/97
cgucgucgacacggugauc

SEQ ID NO: 1154301 - RNA, 15 nt, Mycobacterium bovis subsp bovis AF2122/97
cgucgucgaccacga

SEQ ID NO: 1154302 - RNA, 14 nt, Mycobacterium bovis subsp bovis AF2122/97
cgucggccacccgg

SEQ ID NO: 1154303 - RNA, 22 nt, Mycobacterium bovis subsp bovis AF2122/97
cgucggccaaagacccggcacc

SEQ ID NO: 1154304 - RNA, 15 nt, Mycobacterium bovis subsp bovis AF2122/97
cgucggcaucggcgg

SEQ ID NO: 1154305 - RNA, 13 nt, Mycobacterium bovis subsp bovis AF2122/97
cgucgucgccguc

SEQ ID NO: 1154306 - RNA, 21 nt, Mycobacterium bovis subsp bovis AF2122/97
cgucgucgcccaggcgugucg

SEQ ID NO: 1154307 - RNA, 16 nt, Mycobacterium bovis subsp bovis AF2122/97
cgucggcaugggccgg

SEQ ID NO: 1154308 - RNA, 17 nt, Mycobacterium bovis subsp bovis AF2122/97
cgucggcaugggccggc

SEQ ID NO: 1154309 - RNA, 18 nt, Mycobacterium bovis subsp bovis AF2122/97
cgucggcaugggccggcg

SEQ ID NO: 1154310 - RNA, 20 nt, Mycobacterium bovis subsp bovis AF2122/97
cgucggcaugggccggcgcc

SEQ ID NO: 1154311 - RNA, 21 nt, Mycobacterium bovis subsp bovis AF2122/97
cgucggcaauacuccgcugac

SEQ ID NO: 1154312 - RNA, 14 nt, Mycobacterium bovis subsp bovis AF2122/97
cgucggcagcagcg

SEQ ID NO: 1154313 - RNA, 23 nt, Mycobacterium bovis subsp bovis AF2122/97
cgucggcaccgguuuucgccggc

SEQ ID NO: 1154314 - RNA, 20 nt, Mycobacterium bovis subsp bovis AF2122/97
cgucggauggaaggcggcca

SEQ ID NO: 1154315 - RNA, 22 nt, Mycobacterium bovis subsp bovis AF2122/97
cgucggcaaccaaccgcgcgag

SEQ ID NO: 1154316 - RNA, 24 nt, Mycobacterium bovis subsp bovis AF2122/97
cgucggcaaccaaccgcgcgagcc

SEQ ID NO: 1154317 - RNA, 21 nt, Mycobacterium bovis subsp bovis AF2122/97
cgucucuagauauggaccgcc

SEQ ID NO: 1154318 - RNA, 21 nt, Mycobacterium bovis subsp bovis AF2122/97
cgucucucgcagcuccucgcc

SEQ ID NO: 1154319 - RNA, 23 nt, Mycobacterium bovis subsp bovis AF2122/97
cgucguugucgucgccggcggcg

SEQ ID NO: 1154320 - RNA, 16 nt, Mycobacterium bovis subsp bovis AF2122/97
cgucguugccggcgac

SEQ ID NO: 1154321 - RNA, 21 nt, Mycobacterium bovis subsp bovis AF2122/97
cgucguugggcaugucgccga

SEQ ID NO: 1154322 - RNA, 16 nt, Mycobacterium bovis subsp bovis AF2122/97
cgucugacaucgucga

SEQ ID NO: 1154323 - RNA, 13 nt, Mycobacterium bovis subsp bovis AF2122/97
cgucucgguggcu

SEQ ID NO: 1154324 - RNA, 16 nt, Mycobacterium bovis subsp bovis AF2122/97
cgucugacccaccgcc

SEQ ID NO: 1154325 - RNA, 20 nt, Mycobacterium bovis subsp bovis AF2122/97
cgucguugagcaucaccgua

SEQ ID NO: 1154326 - RNA, 18 nt, Mycobacterium bovis subsp bovis AF2122/97
cgucguugaggaagcccg

SEQ ID NO: 1154327 - RNA, 16 nt, Mycobacterium bovis subsp bovis AF2122/97
cgucguugcccgaccc

SEQ ID NO: 1154328 - RNA, 18 nt, Mycobacterium bovis subsp bovis AF2122/97
cgucguugcccgacccgc

SEQ ID NO: 1154329 - RNA, 14 nt, Mycobacterium bovis subsp bovis AF2122/97
cgucguguggggcg

SEQ ID NO: 1154330 - RNA, 19 nt, Mycobacterium bovis subsp bovis AF2122/97
cgucgugugguucacucuc

SEQ ID NO: 1154331 - RNA, 16 nt, Mycobacterium bovis subsp bovis AF2122/97
cgucguguuggccggg

SEQ ID NO: 1154332 - RNA, 17 nt, Mycobacterium bovis subsp bovis AF2122/97
cgucguguuggccgggu

SEQ ID NO: 1154333 - RNA, 20 nt, Mycobacterium bovis subsp bovis AF2122/97
cgucguuaagacggcgacga

SEQ ID NO: 1154334 - RNA, 23 nt, Mycobacterium bovis subsp bovis AF2122/97
cgucguuaagacggcgacgacau

SEQ ID NO: 1154335 - RNA, 20 nt, Mycobacterium bovis subsp bovis AF2122/97
cgucguucaaugucguugcc

SEQ ID NO: 1154336 - RNA, 16 nt, Mycobacterium bovis subsp bovis AF2122/97
cgucugcuggcgcuca

SEQ ID NO: 1154337 - RNA, 16 nt, Mycobacterium bovis subsp bovis AF2122/97
cgucugcucgccgggc

SEQ ID NO: 1154338 - RNA, 17 nt, Mycobacterium bovis subsp bovis AF2122/97
cgucugcucggcggccu

SEQ ID NO: 1154339 - RNA, 15 nt, Mycobacterium bovis subsp bovis AF2122/97
cgucugcucggcgua

SEQ ID NO: 1154340 - RNA, 13 nt, Mycobacterium bovis subsp bovis AF2122/97
cgucugcucggcg

SEQ ID NO: 1154341 - RNA, 15 nt, Mycobacterium bovis subsp bovis AF2122/97
cgucugcucggcgcu

SEQ ID NO: 1154342 - RNA, 16 nt, Mycobacterium bovis subsp bovis AF2122/97
cgucugcucgcgcccg

SEQ ID NO: 1154343 - RNA, 16 nt, Mycobacterium bovis subsp bovis AF2122/97
cgucugcucgcgggua

SEQ ID NO: 1154344 - RNA, 14 nt, Mycobacterium bovis subsp bovis AF2122/97
cgucugcucgcgca

SEQ ID NO: 1154345 - RNA, 12 nt, Mycobacterium bovis subsp bovis AF2122/97
cgucugcucgcg

SEQ ID NO: 1154346 - RNA, 16 nt, Mycobacterium bovis subsp bovis AF2122/97
cgucugcucgccagcg

SEQ ID NO: 1154347 - RNA, 16 nt, Mycobacterium bovis subsp bovis AF2122/97
cgucugcucgccaggc

SEQ ID NO: 1154348 - RNA, 16 nt, Mycobacterium bovis subsp bovis AF2122/97
cgucugcucaccagcg

SEQ ID NO: 1154349 - RNA, 18 nt, Mycobacterium bovis subsp bovis AF2122/97
cgucugccaggcgcagcu

SEQ ID NO: 1154350 - RNA, 20 nt, Mycobacterium bovis subsp bovis AF2122/97
cgucugcagaccuguccggc

SEQ ID NO: 1154351 - RNA, 18 nt, Mycobacterium bovis subsp bovis AF2122/97
cgucugcgaucccgaucg

SEQ ID NO: 1154352 - RNA, 16 nt, Mycobacterium bovis subsp bovis AF2122/97
cgucugcggaccggcg

SEQ ID NO: 1154353 - RNA, 13 nt, Mycobacterium bovis subsp bovis AF2122/97
cgucugcccgccc

SEQ ID NO: 1154354 - RNA, 17 nt, Mycobacterium bovis subsp bovis AF2122/97
cgucugcggucgagggu

SEQ ID NO: 1154355 - RNA, 13 nt, Mycobacterium bovis subsp bovis AF2122/97
cgucugcucacca

SEQ ID NO: 1154356 - RNA, 15 nt, Mycobacterium bovis subsp bovis AF2122/97
cgucugcucaccagc

SEQ ID NO: 1154357 - RNA, 13 nt, Mycobacterium bovis subsp bovis AF2122/97
cgucuucgccgcc

SEQ ID NO: 1154358 - RNA, 16 nt, Mycobacterium bovis subsp bovis AF2122/97
cgucuuaucggcgucg

SEQ ID NO: 1154359 - RNA, 17 nt, Mycobacterium bovis subsp bovis AF2122/97
cgucuuaucggcgucgu

SEQ ID NO: 1154360 - RNA, 17 nt, Mycobacterium bovis subsp bovis AF2122/97
cgucuuccucggccacc

SEQ ID NO: 1154361 - RNA, 18 nt, Mycobacterium bovis subsp bovis AF2122/97
cgucuuccucggccaccc

SEQ ID NO: 1154362 - RNA, 19 nt, Mycobacterium bovis subsp bovis AF2122/97
cgucugguggcagcgcacc

SEQ ID NO: 1154363 - RNA, 19 nt, Mycobacterium bovis subsp bovis AF2122/97
cgucuggucagccgcggcg

SEQ ID NO: 1154364 - RNA, 21 nt, Mycobacterium bovis subsp bovis AF2122/97
cgucuggcaugaccgcugccg

SEQ ID NO: 1154365 - RNA, 13 nt, Mycobacterium bovis subsp bovis AF2122/97
cgugaaccuggcg

SEQ ID NO: 1154366 - RNA, 19 nt, Mycobacterium bovis subsp bovis AF2122/97
cgugaaccuggcgacgcga

SEQ ID NO: 1154367 - RNA, 16 nt, Mycobacterium bovis subsp bovis AF2122/97
cgugaaccgcccgccc

SEQ ID NO: 1154368 - RNA, 15 nt, Mycobacterium bovis subsp bovis AF2122/97
cgugaaaaacgcccg

SEQ ID NO: 1154369 - RNA, 23 nt, Mycobacterium bovis subsp bovis AF2122/97
cgugaaaaacgcccgcgcugccg

SEQ ID NO: 1154370 - RNA, 21 nt, Mycobacterium bovis subsp bovis AF2122/97
cgugaaaccacaccuucgggg

SEQ ID NO: 1154371 - RNA, 20 nt, Mycobacterium bovis subsp bovis AF2122/97
cgucuugcugcacgcucugc

SEQ ID NO: 1154372 - RNA, 17 nt, Mycobacterium bovis subsp bovis AF2122/97
cgucuugcuggucgaug

SEQ ID NO: 1154373 - RNA, 15 nt, Mycobacterium bovis subsp bovis AF2122/97
cgucuugggccggga

SEQ ID NO: 1154374 - RNA, 18 nt, Mycobacterium bovis subsp bovis AF2122/97
cgucuuuggugccgagca

SEQ ID NO: 1154375 - RNA, 13 nt, Mycobacterium bovis subsp bovis AF2122/97
cgucuugcagccu

SEQ ID NO: 1154376 - RNA, 17 nt, Mycobacterium bovis subsp bovis AF2122/97
cgugaagccaagcgacu

SEQ ID NO: 1154377 - RNA, 20 nt, Mycobacterium bovis subsp bovis AF2122/97
cgugacagugaccugggcgc

SEQ ID NO: 1154378 - RNA, 17 nt, Mycobacterium bovis subsp bovis AF2122/97
cgugaccaccgccgaca

SEQ ID NO: 1154379 - RNA, 16 nt, Mycobacterium bovis subsp bovis AF2122/97
cgugaccagaucgacg

SEQ ID NO: 1154380 - RNA, 18 nt, Mycobacterium bovis subsp bovis AF2122/97
cgugaaugguggugucgg

SEQ ID NO: 1154381 - RNA, 17 nt, Mycobacterium bovis subsp bovis AF2122/97
cgugacaaccaucggug

SEQ ID NO: 1154382 - RNA, 23 nt, Mycobacterium bovis subsp bovis AF2122/97
cgugacaaccaucgguggccauc

SEQ ID NO: 1154383 - RNA, 13 nt, Mycobacterium bovis subsp bovis AF2122/97
cgugacaccgggg

SEQ ID NO: 1154384 - RNA, 14 nt, Mycobacterium bovis subsp bovis AF2122/97
cgugacaccgggga

SEQ ID NO: 1154385 - RNA, 13 nt, Mycobacterium bovis subsp bovis AF2122/97
cgugaacggcgcg

SEQ ID NO: 1154386 - RNA, 15 nt, Mycobacterium bovis subsp bovis AF2122/97
cgugaagcgggugcc

SEQ ID NO: 1154387 - RNA, 17 nt, Mycobacterium bovis subsp bovis AF2122/97
cgugaaguggucguaga

SEQ ID NO: 1154388 - RNA, 15 nt, Mycobacterium bovis subsp bovis AF2122/97
cgugaaucgagcacc

SEQ ID NO: 1154389 - RNA, 16 nt, Mycobacterium bovis subsp bovis AF2122/97
cgugaaucgagcaccg

SEQ ID NO: 1154390 - RNA, 16 nt, Mycobacterium bovis subsp bovis AF2122/97
aaccgaacccacccau

SEQ ID NO: 1154391 - RNA, 17 nt, Mycobacterium bovis subsp bovis AF2122/97
aaccgaagccgucgaug

SEQ ID NO: 1154392 - RNA, 12 nt, Mycobacterium bovis subsp bovis AF2122/97
aaccgacccggc

SEQ ID NO: 1154393 - RNA, 23 nt, Mycobacterium bovis subsp bovis AF2122/97
cgugacccauucucggccggcgg

SEQ ID NO: 1154394 - RNA, 13 nt, Mycobacterium bovis subsp bovis AF2122/97
aacccuagggcgg

SEQ ID NO: 1154395 - RNA, 21 nt, Mycobacterium bovis subsp bovis AF2122/97
aacccuccggacccacccgca

SEQ ID NO: 1154396 - RNA, 15 nt, Mycobacterium bovis subsp bovis AF2122/97
aacccucgccacgca

SEQ ID NO: 1154397 - RNA, 15 nt, Mycobacterium bovis subsp bovis AF2122/97
aacccucgccgguca

SEQ ID NO: 1154398 - RNA, 21 nt, Mycobacterium bovis subsp bovis AF2122/97
cgugacccggauaucgaccac

SEQ ID NO: 1154399 - RNA, 19 nt, Mycobacterium bovis subsp bovis AF2122/97
cgugacccgacaugguccg

SEQ ID NO: 1154400 - RNA, 16 nt, Mycobacterium bovis subsp bovis AF2122/97
cgugacccgccggcga

SEQ ID NO: 1154401 - RNA, 19 nt, Mycobacterium bovis subsp bovis AF2122/97
aaccgcaaacccgccgaca

SEQ ID NO: 1154402 - RNA, 18 nt, Mycobacterium bovis subsp bovis AF2122/97
aaccgacgcguccggugc

SEQ ID NO: 1154403 - RNA, 20 nt, Mycobacterium bovis subsp bovis AF2122/97
aaccgagccgaccggcggca

SEQ ID NO: 1154404 - RNA, 22 nt, Mycobacterium bovis subsp bovis AF2122/97
aaccgagggauggccguugagg

SEQ ID NO: 1154405 - RNA, 13 nt, Mycobacterium bovis subsp bovis AF2122/97
aaccgaugacgcg

SEQ ID NO: 1154406 - RNA, 13 nt, Mycobacterium bovis subsp bovis AF2122/97
cugcacaccaccg

SEQ ID NO: 1154407 - RNA, 14 nt, Mycobacterium bovis subsp bovis AF2122/97
cugcacaccaccgc

SEQ ID NO: 1154408 - RNA, 15 nt, Mycobacterium bovis subsp bovis AF2122/97
cugcacaccaccgcc

SEQ ID NO: 1154409 - RNA, 13 nt, Mycobacterium bovis subsp bovis AF2122/97
cugcacagcaggc

SEQ ID NO: 1154410 - RNA, 13 nt, Mycobacterium bovis subsp bovis AF2122/97
cugcacagcagcg

SEQ ID NO: 1154411 - RNA, 13 nt, Mycobacterium bovis subsp bovis AF2122/97
cugcaccaagucg

SEQ ID NO: 1154412 - RNA, 19 nt, Mycobacterium bovis subsp bovis AF2122/97
cugcacagugcggccccga

SEQ ID NO: 1154413 - RNA, 15 nt, Mycobacterium bovis subsp bovis AF2122/97
cugcaccacggcggc

SEQ ID NO: 1154414 - RNA, 20 nt, Mycobacterium bovis subsp bovis AF2122/97
cugcaccacggcggccaccu

SEQ ID NO: 1154415 - RNA, 18 nt, Mycobacterium bovis subsp bovis AF2122/97
cugcaccuccgacggccg

SEQ ID NO: 1154416 - RNA, 19 nt, Mycobacterium bovis subsp bovis AF2122/97
cugcaccuccgacggccgc

SEQ ID NO: 1154417 - RNA, 19 nt, Mycobacterium bovis subsp bovis AF2122/97
cugcaccguuuccggcgcu

SEQ ID NO: 1154418 - RNA, 21 nt, Mycobacterium bovis subsp bovis AF2122/97
cugcaccguuuccggcgcucc

SEQ ID NO: 1154419 - RNA, 17 nt, Mycobacterium bovis subsp bovis AF2122/97
cugcaccgucacgucgu

SEQ ID NO: 1154420 - RNA, 22 nt, Mycobacterium bovis subsp bovis AF2122/97
cugcaccgcauuguugaagaaa

SEQ ID NO: 1154421 - RNA, 17 nt, Mycobacterium bovis subsp bovis AF2122/97
cugcaccuggccgcccg

SEQ ID NO: 1154422 - RNA, 22 nt, Mycobacterium bovis subsp bovis AF2122/97
cugcacgacaucgucgcgacga

SEQ ID NO: 1154423 - RNA, 14 nt, Mycobacterium bovis subsp bovis AF2122/97
cugcaccgauucgg

SEQ ID NO: 1154424 - RNA, 23 nt, Mycobacterium bovis subsp bovis AF2122/97
cugcaccguagugaacggcucgg

SEQ ID NO: 1154425 - RNA, 16 nt, Mycobacterium bovis subsp bovis AF2122/97
cugcacccgccagggc

SEQ ID NO: 1154426 - RNA, 18 nt, Mycobacterium bovis subsp bovis AF2122/97
cugcacccggagaaucgg

SEQ ID NO: 1154427 - RNA, 20 nt, Mycobacterium bovis subsp bovis AF2122/97
cugcacccggagaaucgguc

SEQ ID NO: 1154428 - RNA, 15 nt, Mycobacterium bovis subsp bovis AF2122/97
cugcagcgaugcggc

SEQ ID NO: 1154429 - RNA, 13 nt, Mycobacterium bovis subsp bovis AF2122/97
cugcagcgcaucc

SEQ ID NO: 1154430 - RNA, 18 nt, Mycobacterium bovis subsp bovis AF2122/97
cugcagcgaaacaccggc

SEQ ID NO: 1154431 - RNA, 20 nt, Mycobacterium bovis subsp bovis AF2122/97
cugcagcauggcccuggcga

SEQ ID NO: 1154432 - RNA, 17 nt, Mycobacterium bovis subsp bovis AF2122/97
cugcagcagggcuucgu

SEQ ID NO: 1154433 - RNA, 19 nt, Mycobacterium bovis subsp bovis AF2122/97
cugcagcccgggcagcacc

SEQ ID NO: 1154434 - RNA, 15 nt, Mycobacterium bovis subsp bovis AF2122/97
cugcagcccugcgca

SEQ ID NO: 1154435 - RNA, 15 nt, Mycobacterium bovis subsp bovis AF2122/97
cugcagcacgacgug

SEQ ID NO: 1154436 - RNA, 18 nt, Mycobacterium bovis subsp bovis AF2122/97
cugcagaccuguccggca

SEQ ID NO: 1154437 - RNA, 21 nt, Mycobacterium bovis subsp bovis AF2122/97
cugcacuugaaauugagccgg

SEQ ID NO: 1154438 - RNA, 23 nt, Mycobacterium bovis subsp bovis AF2122/97
cugcagaaacagccgcagcggcc

SEQ ID NO: 1154439 - RNA, 17 nt, Mycobacterium bovis subsp bovis AF2122/97
cugcacgcgcucgcgca

SEQ ID NO: 1154440 - RNA, 20 nt, Mycobacterium bovis subsp bovis AF2122/97
cugcacggagccgccggcgg

SEQ ID NO: 1154441 - RNA, 23 nt, Mycobacterium bovis subsp bovis AF2122/97
cugcacgaacgccugcucgucgg

SEQ ID NO: 1154442 - RNA, 19 nt, Mycobacterium bovis subsp bovis AF2122/97
cugcacggugcccagggcg

SEQ ID NO: 1154443 - RNA, 14 nt, Mycobacterium bovis subsp bovis AF2122/97
cugaugccuggucg

SEQ ID NO: 1154444 - RNA, 17 nt, Mycobacterium bovis subsp bovis AF2122/97
cugaugccuggucgcgg

SEQ ID NO: 1154445 - RNA, 16 nt, Mycobacterium bovis subsp bovis AF2122/97
cugaugcgcugggcca

SEQ ID NO: 1154446 - RNA, 18 nt, Mycobacterium bovis subsp bovis AF2122/97
cugaugcgcugggccagg

SEQ ID NO: 1154447 - RNA, 15 nt, Mycobacterium bovis subsp bovis AF2122/97
cugaugcagggcccg

SEQ ID NO: 1154448 - RNA, 14 nt, Mycobacterium bovis subsp bovis AF2122/97
cugaugagggacga

SEQ ID NO: 1154449 - RNA, 16 nt, Mycobacterium bovis subsp bovis AF2122/97
cugaugagcucaccgg

SEQ ID NO: 1154450 - RNA, 20 nt, Mycobacterium bovis subsp bovis AF2122/97
cugaugguguacacgucgcg

SEQ ID NO: 1154451 - RNA, 19 nt, Mycobacterium bovis subsp bovis AF2122/97
cugauggcggcgacccguc

SEQ ID NO: 1154452 - RNA, 19 nt, Mycobacterium bovis subsp bovis AF2122/97
cugaugggucaggccgacg

SEQ ID NO: 1154453 - RNA, 19 nt, Mycobacterium bovis subsp bovis AF2122/97
cugauggugcugcggcguc

SEQ ID NO: 1154454 - RNA, 22 nt, Mycobacterium bovis subsp bovis AF2122/97
cugaugcguugauacgcgucga

SEQ ID NO: 1154455 - RNA, 12 nt, Mycobacterium bovis subsp bovis AF2122/97
cugaugcuggcc

SEQ ID NO: 1154456 - RNA, 16 nt, Mycobacterium bovis subsp bovis AF2122/97
cugauggacggugcgc

SEQ ID NO: 1154457 - RNA, 19 nt, Mycobacterium bovis subsp bovis AF2122/97
cugaucuucgagccggcgg

SEQ ID NO: 1154458 - RNA, 22 nt, Mycobacterium bovis subsp bovis AF2122/97
cugaucuucgagccggcggccu

SEQ ID NO: 1154459 - RNA, 16 nt, Mycobacterium bovis subsp bovis AF2122/97
cugaugaaacgccguc

SEQ ID NO: 1154460 - RNA, 21 nt, Mycobacterium bovis subsp bovis AF2122/97
cugaugaccguauagccgacg

SEQ ID NO: 1154461 - RNA, 14 nt, Mycobacterium bovis subsp bovis AF2122/97
cugaugacggugug

SEQ ID NO: 1154462 - RNA, 23 nt, Mycobacterium bovis subsp bovis AF2122/97
cugaucggugggcgggugcgcga

SEQ ID NO: 1154463 - RNA, 23 nt, Mycobacterium bovis subsp bovis AF2122/97
cugaucuuccccucggccgcccg

SEQ ID NO: 1154464 - RNA, 14 nt, Mycobacterium bovis subsp bovis AF2122/97
cugaucugccgccg

SEQ ID NO: 1154465 - RNA, 17 nt, Mycobacterium bovis subsp bovis AF2122/97
cugaucugccgccgcgg

SEQ ID NO: 1154466 - RNA, 18 nt, Mycobacterium bovis subsp bovis AF2122/97
cugaucugccgccgcggc

SEQ ID NO: 1154467 - RNA, 22 nt, Mycobacterium bovis subsp bovis AF2122/97
cugaucuggggcaccacgcugu

SEQ ID NO: 1154468 - RNA, 18 nt, Mycobacterium bovis subsp bovis AF2122/97
cugaucuuccccucggcc

SEQ ID NO: 1154469 - RNA, 19 nt, Mycobacterium bovis subsp bovis AF2122/97
cugaucuuccccucggccg

SEQ ID NO: 1154470 - RNA, 15 nt, Mycobacterium bovis subsp bovis AF2122/97
cugaucgcgcagauu

SEQ ID NO: 1154471 - RNA, 19 nt, Mycobacterium bovis subsp bovis AF2122/97
cugaucgccucggacacgg

SEQ ID NO: 1154472 - RNA, 12 nt, Mycobacterium bovis subsp bovis AF2122/97
cugaucagccca

SEQ ID NO: 1154473 - RNA, 19 nt, Mycobacterium bovis subsp bovis AF2122/97
cugaucgcgauccacccgg

SEQ ID NO: 1154474 - RNA, 22 nt, Mycobacterium bovis subsp bovis AF2122/97
cugauccggugccgcgaucgcg

SEQ ID NO: 1154475 - RNA, 15 nt, Mycobacterium bovis subsp bovis AF2122/97
cugaucgccacccgg

SEQ ID NO: 1154476 - RNA, 15 nt, Mycobacterium bovis subsp bovis AF2122/97
cugauccgggcgccg

SEQ ID NO: 1154477 - RNA, 22 nt, Mycobacterium bovis subsp bovis AF2122/97
cugcaagacaaagccgucgacg

SEQ ID NO: 1154478 - RNA, 14 nt, Mycobacterium bovis subsp bovis AF2122/97
cugcaagacgccga

SEQ ID NO: 1154479 - RNA, 15 nt, Mycobacterium bovis subsp bovis AF2122/97
cugcaacgccgcgga

SEQ ID NO: 1154480 - RNA, 18 nt, Mycobacterium bovis subsp bovis AF2122/97
cugcaacggagcgagcuc

SEQ ID NO: 1154481 - RNA, 22 nt, Mycobacterium bovis subsp bovis AF2122/97
cugauugaagccccccgagcug

SEQ ID NO: 1154482 - RNA, 14 nt, Mycobacterium bovis subsp bovis AF2122/97
cugauugaagcccc

SEQ ID NO: 1154483 - RNA, 17 nt, Mycobacterium bovis subsp bovis AF2122/97
cugaugugaguccagcc

SEQ ID NO: 1154484 - RNA, 18 nt, Mycobacterium bovis subsp bovis AF2122/97
cugauguacccggcgacg

SEQ ID NO: 1154485 - RNA, 17 nt, Mycobacterium bovis subsp bovis AF2122/97
cugauuggcccaccgcc

SEQ ID NO: 1154486 - RNA, 16 nt, Mycobacterium bovis subsp bovis AF2122/97
cugauugcgaccgcgc

SEQ ID NO: 1154487 - RNA, 23 nt, Mycobacterium bovis subsp bovis AF2122/97
cugauuuucguguaacgccgacu

SEQ ID NO: 1154488 - RNA, 23 nt, Mycobacterium bovis subsp bovis AF2122/97
cugccccgcaucgcccaagccgu

SEQ ID NO: 1154489 - RNA, 13 nt, Mycobacterium bovis subsp bovis AF2122/97
cugcccgacgacc

SEQ ID NO: 1154490 - RNA, 16 nt, Mycobacterium bovis subsp bovis AF2122/97
cugcccgacgaccauu

SEQ ID NO: 1154491 - RNA, 13 nt, Mycobacterium bovis subsp bovis AF2122/97
cugcccgccagcg

SEQ ID NO: 1154492 - RNA, 19 nt, Mycobacterium bovis subsp bovis AF2122/97
cugcccgccagcgccgccg

SEQ ID NO: 1154493 - RNA, 12 nt, Mycobacterium bovis subsp bovis AF2122/97
cugcccgcgcgg

SEQ ID NO: 1154494 - RNA, 13 nt, Mycobacterium bovis subsp bovis AF2122/97
cugccccagcaca

SEQ ID NO: 1154495 - RNA, 23 nt, Mycobacterium bovis subsp bovis AF2122/97
cugcccccguucuggaaccccga

SEQ ID NO: 1154496 - RNA, 17 nt, Mycobacterium bovis subsp bovis AF2122/97
cugcccccgccggccgu

SEQ ID NO: 1154497 - RNA, 15 nt, Mycobacterium bovis subsp bovis AF2122/97
cugcccccgcgcgca

SEQ ID NO: 1154498 - RNA, 14 nt, Mycobacterium bovis subsp bovis AF2122/97
cugcccccggcgcg

SEQ ID NO: 1154499 - RNA, 15 nt, Mycobacterium bovis subsp bovis AF2122/97
cugcccccggcgcgg

SEQ ID NO: 1154500 - RNA, 16 nt, Mycobacterium bovis subsp bovis AF2122/97
cugcccccggcgcggc

SEQ ID NO: 1154501 - RNA, 18 nt, Mycobacterium bovis subsp bovis AF2122/97
cugcccccggcgcggcgg

SEQ ID NO: 1154502 - RNA, 23 nt, Mycobacterium bovis subsp bovis AF2122/97
cugcccccggcgcggcggaccgu

SEQ ID NO: 1154503 - RNA, 12 nt, Mycobacterium bovis subsp bovis AF2122/97
cugcccaccauc

SEQ ID NO: 1154504 - RNA, 15 nt, Mycobacterium bovis subsp bovis AF2122/97
cugcccaccaucccg

SEQ ID NO: 1154505 - RNA, 15 nt, Mycobacterium bovis subsp bovis AF2122/97
cugcccacgggccgg

SEQ ID NO: 1154506 - RNA, 12 nt, Mycobacterium bovis subsp bovis AF2122/97
cugcccagcacc

SEQ ID NO: 1154507 - RNA, 17 nt, Mycobacterium bovis subsp bovis AF2122/97
cugcccagcaccaccgc

SEQ ID NO: 1154508 - RNA, 13 nt, Mycobacterium bovis subsp bovis AF2122/97
cugcccagcaccc

SEQ ID NO: 1154509 - RNA, 12 nt, Mycobacterium bovis subsp bovis AF2122/97
cugcccagcaga

SEQ ID NO: 1154510 - RNA, 18 nt, Mycobacterium bovis subsp bovis AF2122/97
cugccauugccgcaugcu

SEQ ID NO: 1154511 - RNA, 16 nt, Mycobacterium bovis subsp bovis AF2122/97
cugccaucccgauccc

SEQ ID NO: 1154512 - RNA, 18 nt, Mycobacterium bovis subsp bovis AF2122/97
cugccaucccgaucccgg

SEQ ID NO: 1154513 - RNA, 14 nt, Mycobacterium bovis subsp bovis AF2122/97
cugccaucggcacc

SEQ ID NO: 1154514 - RNA, 18 nt, Mycobacterium bovis subsp bovis AF2122/97
cugccaucggcaccagcg

SEQ ID NO: 1154515 - RNA, 19 nt, Mycobacterium bovis subsp bovis AF2122/97
cugccaucggcaccagcgc

SEQ ID NO: 1154516 - RNA, 18 nt, Mycobacterium bovis subsp bovis AF2122/97
cugccaucuccggugugu

SEQ ID NO: 1154517 - RNA, 15 nt, Mycobacterium bovis subsp bovis AF2122/97
cugccauaggcccac

SEQ ID NO: 1154518 - RNA, 22 nt, Mycobacterium bovis subsp bovis AF2122/97
cugccauaggcccacggcagcg

SEQ ID NO: 1154519 - RNA, 16 nt, Mycobacterium bovis subsp bovis AF2122/97
cugccagugggccgac

SEQ ID NO: 1154520 - RNA, 21 nt, Mycobacterium bovis subsp bovis AF2122/97
cugccagugggccgacgugac

SEQ ID NO: 1154521 - RNA, 15 nt, Mycobacterium bovis subsp bovis AF2122/97
cugccagcgccgccg

SEQ ID NO: 1154522 - RNA, 16 nt, Mycobacterium bovis subsp bovis AF2122/97
cugccagcgccgcggc

SEQ ID NO: 1154523 - RNA, 22 nt, Mycobacterium bovis subsp bovis AF2122/97
cugccagcguugcggagaugcc

SEQ ID NO: 1154524 - RNA, 16 nt, Mycobacterium bovis subsp bovis AF2122/97
cugccagcggccgggc

SEQ ID NO: 1154525 - RNA, 19 nt, Mycobacterium bovis subsp bovis AF2122/97
cugccagccauggccgcca

SEQ ID NO: 1154526 - RNA, 19 nt, Mycobacterium bovis subsp bovis AF2122/97
cugccagcgccgccgccga

SEQ ID NO: 1154527 - RNA, 20 nt, Mycobacterium bovis subsp bovis AF2122/97
cugccagcgccgccgccgac

SEQ ID NO: 1154528 - RNA, 24 nt, Mycobacterium bovis subsp bovis AF2122/97
cugccagcauugacccgacgaugc

SEQ ID NO: 1154529 - RNA, 14 nt, Mycobacterium bovis subsp bovis AF2122/97
cugccacuuggacg

SEQ ID NO: 1154530 - RNA, 14 nt, Mycobacterium bovis subsp bovis AF2122/97
cugccagaucgguc

SEQ ID NO: 1154531 - RNA, 14 nt, Mycobacterium bovis subsp bovis AF2122/97
cugccagcacccug

SEQ ID NO: 1154532 - RNA, 21 nt, Mycobacterium bovis subsp bovis AF2122/97
cugcaggcccaggcuguccga

SEQ ID NO: 1154533 - RNA, 19 nt, Mycobacterium bovis subsp bovis AF2122/97
cugcaggaaguacgcgacg

SEQ ID NO: 1154534 - RNA, 13 nt, Mycobacterium bovis subsp bovis AF2122/97
cugcaggcggccg

SEQ ID NO: 1154535 - RNA, 13 nt, Mycobacterium bovis subsp bovis AF2122/97
cugcaggcggccu

SEQ ID NO: 1154536 - RNA, 11 nt, Mycobacterium bovis subsp bovis AF2122/97
cugcagcgcgg

SEQ ID NO: 1154537 - RNA, 16 nt, Mycobacterium bovis subsp bovis AF2122/97
cugcagcgcggccgga

SEQ ID NO: 1154538 - RNA, 16 nt, Mycobacterium bovis subsp bovis AF2122/97
cugcagcgcgacccgu

SEQ ID NO: 1154539 - RNA, 15 nt, Mycobacterium bovis subsp bovis AF2122/97
cugcagccgaugcuc

SEQ ID NO: 1154540 - RNA, 16 nt, Mycobacterium bovis subsp bovis AF2122/97
cugcagcucgggcagg

SEQ ID NO: 1154541 - RNA, 13 nt, Mycobacterium bovis subsp bovis AF2122/97
cugcagcggcgca

SEQ ID NO: 1154542 - RNA, 22 nt, Mycobacterium bovis subsp bovis AF2122/97
cugcagggccaauuccaugacg

SEQ ID NO: 1154543 - RNA, 12 nt, Mycobacterium bovis subsp bovis AF2122/97
cugcagggucga

SEQ ID NO: 1154544 - RNA, 15 nt, Mycobacterium bovis subsp bovis AF2122/97
cugcagggucgaguu

SEQ ID NO: 1154545 - RNA, 19 nt, Mycobacterium bovis subsp bovis AF2122/97
cugcagggccuggccacac

SEQ ID NO: 1154546 - RNA, 13 nt, Mycobacterium bovis subsp bovis AF2122/97
cugcagggcguga

SEQ ID NO: 1154547 - RNA, 22 nt, Mycobacterium bovis subsp bovis AF2122/97
cugcagguugguaauccgggca

SEQ ID NO: 1154548 - RNA, 21 nt, Mycobacterium bovis subsp bovis AF2122/97
cugcagguuuccggccugcac

SEQ ID NO: 1154549 - RNA, 14 nt, Mycobacterium bovis subsp bovis AF2122/97
cugcaguacggcca

SEQ ID NO: 1154550 - RNA, 18 nt, Mycobacterium bovis subsp bovis AF2122/97
cugcagugaucgugaccg

SEQ ID NO: 1154551 - RNA, 17 nt, Mycobacterium bovis subsp bovis AF2122/97
cugcagugccgugucca

SEQ ID NO: 1154552 - RNA, 21 nt, Mycobacterium bovis subsp bovis AF2122/97
cugcagucgagcaucucgucg

SEQ ID NO: 1154553 - RNA, 14 nt, Mycobacterium bovis subsp bovis AF2122/97
cugcauaggcgcgg

SEQ ID NO: 1154554 - RNA, 19 nt, Mycobacterium bovis subsp bovis AF2122/97
cugcauaggcgcggucacc

SEQ ID NO: 1154555 - RNA, 15 nt, Mycobacterium bovis subsp bovis AF2122/97
cugcaucgucgacga

SEQ ID NO: 1154556 - RNA, 18 nt, Mycobacterium bovis subsp bovis AF2122/97
cugcauccuccucgucga

SEQ ID NO: 1154557 - RNA, 20 nt, Mycobacterium bovis subsp bovis AF2122/97
cugcaugaacugcucgccga

SEQ ID NO: 1154558 - RNA, 18 nt, Mycobacterium bovis subsp bovis AF2122/97
cugccacguugaucccga

SEQ ID NO: 1154559 - RNA, 15 nt, Mycobacterium bovis subsp bovis AF2122/97
cugccaccgcagacg

SEQ ID NO: 1154560 - RNA, 20 nt, Mycobacterium bovis subsp bovis AF2122/97
cugccacgcgugacucggcc

SEQ ID NO: 1154561 - RNA, 17 nt, Mycobacterium bovis subsp bovis AF2122/97
cugccaccggccggcgc

SEQ ID NO: 1154562 - RNA, 18 nt, Mycobacterium bovis subsp bovis AF2122/97
cugccaccggccggcgca

SEQ ID NO: 1154563 - RNA, 18 nt, Mycobacterium bovis subsp bovis AF2122/97
cugccacgaggcaucguc

SEQ ID NO: 1154564 - RNA, 18 nt, Mycobacterium bovis subsp bovis AF2122/97
cugccaaucugcacgcgc

SEQ ID NO: 1154565 - RNA, 23 nt, Mycobacterium bovis subsp bovis AF2122/97
cugccaccagacaacgccgucga

SEQ ID NO: 1154566 - RNA, 14 nt, Mycobacterium bovis subsp bovis AF2122/97
cugccacccagcac

SEQ ID NO: 1154567 - RNA, 14 nt, Mycobacterium bovis subsp bovis AF2122/97
cugccaaggccuuc

SEQ ID NO: 1154568 - RNA, 17 nt, Mycobacterium bovis subsp bovis AF2122/97
cugccaaaagggcggca

SEQ ID NO: 1154569 - RNA, 16 nt, Mycobacterium bovis subsp bovis AF2122/97
cugagcgccggcaucg

SEQ ID NO: 1154570 - RNA, 15 nt, Mycobacterium bovis subsp bovis AF2122/97
cugagcgccaggccg

SEQ ID NO: 1154571 - RNA, 18 nt, Mycobacterium bovis subsp bovis AF2122/97
cugagcgcgcgcggugcg

SEQ ID NO: 1154572 - RNA, 19 nt, Mycobacterium bovis subsp bovis AF2122/97
cugagcgcgcgcggugcgg

SEQ ID NO: 1154573 - RNA, 21 nt, Mycobacterium bovis subsp bovis AF2122/97
cugagcgcgcgcggugcggcc

SEQ ID NO: 1154574 - RNA, 19 nt, Mycobacterium bovis subsp bovis AF2122/97
cugagcgcgcggguggcgg

SEQ ID NO: 1154575 - RNA, 23 nt, Mycobacterium bovis subsp bovis AF2122/97
cugagcgcggguggcagcggcga

SEQ ID NO: 1154576 - RNA, 14 nt, Mycobacterium bovis subsp bovis AF2122/97
cugagcggccggca

SEQ ID NO: 1154577 - RNA, 15 nt, Mycobacterium bovis subsp bovis AF2122/97
cugagcggccucggg

SEQ ID NO: 1154578 - RNA, 20 nt, Mycobacterium bovis subsp bovis AF2122/97
cugagcgggcaacugcagca

SEQ ID NO: 1154579 - RNA, 19 nt, Mycobacterium bovis subsp bovis AF2122/97
cugagcgccggcaucgcgc

SEQ ID NO: 1154580 - RNA, 22 nt, Mycobacterium bovis subsp bovis AF2122/97
cugagcguccgacaacgacugc

SEQ ID NO: 1154581 - RNA, 14 nt, Mycobacterium bovis subsp bovis AF2122/97
cugagcugccgagc

SEQ ID NO: 1154582 - RNA, 15 nt, Mycobacterium bovis subsp bovis AF2122/97
cugagcugccgagcg

SEQ ID NO: 1154583 - RNA, 16 nt, Mycobacterium bovis subsp bovis AF2122/97
cugaggaaagucaccg

SEQ ID NO: 1154584 - RNA, 16 nt, Mycobacterium bovis subsp bovis AF2122/97
cugagcgggcgggccu

SEQ ID NO: 1154585 - RNA, 22 nt, Mycobacterium bovis subsp bovis AF2122/97
cugagcuuggucgccgggcagu

SEQ ID NO: 1154586 - RNA, 22 nt, Mycobacterium bovis subsp bovis AF2122/97
cugaggaacgccggcaucgcgc

SEQ ID NO: 1154587 - RNA, 15 nt, Mycobacterium bovis subsp bovis AF2122/97
cugaggaagcggcgg

SEQ ID NO: 1154588 - RNA, 17 nt, Mycobacterium bovis subsp bovis AF2122/97
cugaggaagcggcggca

SEQ ID NO: 1154589 - RNA, 13 nt, Mycobacterium bovis subsp bovis AF2122/97
cugagcgugcggu

SEQ ID NO: 1154590 - RNA, 17 nt, Mycobacterium bovis subsp bovis AF2122/97
cugagcgugcggugauc

SEQ ID NO: 1154591 - RNA, 15 nt, Mycobacterium bovis subsp bovis AF2122/97
cugagcugcucgccg

SEQ ID NO: 1154592 - RNA, 17 nt, Mycobacterium bovis subsp bovis AF2122/97
cugagcugcucgccggc

SEQ ID NO: 1154593 - RNA, 19 nt, Mycobacterium bovis subsp bovis AF2122/97
cugagcugcucgccggcca

SEQ ID NO: 1154594 - RNA, 21 nt, Mycobacterium bovis subsp bovis AF2122/97
cugagcuggcagcuccucgcg

SEQ ID NO: 1154595 - RNA, 14 nt, Mycobacterium bovis subsp bovis AF2122/97
cugagccggucaua

SEQ ID NO: 1154596 - RNA, 20 nt, Mycobacterium bovis subsp bovis AF2122/97
cugagccgcaucuggccggc

SEQ ID NO: 1154597 - RNA, 16 nt, Mycobacterium bovis subsp bovis AF2122/97
cugagcgacugcagcg

SEQ ID NO: 1154598 - RNA, 14 nt, Mycobacterium bovis subsp bovis AF2122/97
cugagcccgccgcg

SEQ ID NO: 1154599 - RNA, 13 nt, Mycobacterium bovis subsp bovis AF2122/97
cugagccaccccg

SEQ ID NO: 1154600 - RNA, 22 nt, Mycobacterium bovis subsp bovis AF2122/97
cugagaucgcuucccggaagcg

SEQ ID NO: 1154601 - RNA, 20 nt, Mycobacterium bovis subsp bovis AF2122/97
cugagcacgcggaucgcgcu

SEQ ID NO: 1154602 - RNA, 15 nt, Mycobacterium bovis subsp bovis AF2122/97
cugagcacggcgcgg

SEQ ID NO: 1154603 - RNA, 18 nt, Mycobacterium bovis subsp bovis AF2122/97
cugagcacggcgcggcgg

SEQ ID NO: 1154604 - RNA, 19 nt, Mycobacterium bovis subsp bovis AF2122/97
cugagcacguucaccgcgc

SEQ ID NO: 1154605 - RNA, 23 nt, Mycobacterium bovis subsp bovis AF2122/97
cugagcacucaugaugccggacg

SEQ ID NO: 1154606 - RNA, 13 nt, Mycobacterium bovis subsp bovis AF2122/97
cugagcagcgcgg

SEQ ID NO: 1154607 - RNA, 13 nt, Mycobacterium bovis subsp bovis AF2122/97
cugagaugaugcg

SEQ ID NO: 1154608 - RNA, 20 nt, Mycobacterium bovis subsp bovis AF2122/97
cugagagauggucgggcggc

SEQ ID NO: 1154609 - RNA, 21 nt, Mycobacterium bovis subsp bovis AF2122/97
cugagagauggucgggcggcg

SEQ ID NO: 1154610 - RNA, 16 nt, Mycobacterium bovis subsp bovis AF2122/97
cugauccgccugccga

SEQ ID NO: 1154611 - RNA, 18 nt, Mycobacterium bovis subsp bovis AF2122/97
cugaucccggccaggccg

SEQ ID NO: 1154612 - RNA, 18 nt, Mycobacterium bovis subsp bovis AF2122/97
cugaucacucacccgggc

SEQ ID NO: 1154613 - RNA, 23 nt, Mycobacterium bovis subsp bovis AF2122/97
cugaucaccgucguacucggcgg

SEQ ID NO: 1154614 - RNA, 20 nt, Mycobacterium bovis subsp bovis AF2122/97
cugauaccaauccggcugcg

SEQ ID NO: 1154615 - RNA, 14 nt, Mycobacterium bovis subsp bovis AF2122/97
cugauaguggcgcg

SEQ ID NO: 1154616 - RNA, 20 nt, Mycobacterium bovis subsp bovis AF2122/97
cugauaugacuugcgcgcgg

SEQ ID NO: 1154617 - RNA, 22 nt, Mycobacterium bovis subsp bovis AF2122/97
cugagguaggacucacgcagcg

SEQ ID NO: 1154618 - RNA, 14 nt, Mycobacterium bovis subsp bovis AF2122/97
cugaggucaccggc

SEQ ID NO: 1154619 - RNA, 18 nt, Mycobacterium bovis subsp bovis AF2122/97
cugagggcucgguggcgc

SEQ ID NO: 1154620 - RNA, 23 nt, Mycobacterium bovis subsp bovis AF2122/97
cugagggcucgguggcgccgggg

SEQ ID NO: 1154621 - RNA, 16 nt, Mycobacterium bovis subsp bovis AF2122/97
cugaguugcggugugc

SEQ ID NO: 1154622 - RNA, 16 nt, Mycobacterium bovis subsp bovis AF2122/97
cugauaaagcccggcg

SEQ ID NO: 1154623 - RNA, 14 nt, Mycobacterium bovis subsp bovis AF2122/97
cugaguccggcacg

SEQ ID NO: 1154624 - RNA, 15 nt, Mycobacterium bovis subsp bovis AF2122/97
cugaguggacggccg

SEQ ID NO: 1154625 - RNA, 15 nt, Mycobacterium bovis subsp bovis AF2122/97
cugagucgguucagc

SEQ ID NO: 1154626 - RNA, 22 nt, Mycobacterium bovis subsp bovis AF2122/97
cugagucgguucagccacgcag

SEQ ID NO: 1154627 - RNA, 16 nt, Mycobacterium bovis subsp bovis AF2122/97
cugauaccaauccggc

SEQ ID NO: 1154628 - RNA, 23 nt, Mycobacterium bovis subsp bovis AF2122/97
cugacgccauucaucggcaucga

SEQ ID NO: 1154629 - RNA, 16 nt, Mycobacterium bovis subsp bovis AF2122/97
cugacgauggccaggc

SEQ ID NO: 1154630 - RNA, 18 nt, Mycobacterium bovis subsp bovis AF2122/97
cugacgaccaaccaccga

SEQ ID NO: 1154631 - RNA, 11 nt, Mycobacterium bovis subsp bovis AF2122/97
cugacgaccgg

SEQ ID NO: 1154632 - RNA, 22 nt, Mycobacterium bovis subsp bovis AF2122/97
cugacgacgagggccagcagcc

SEQ ID NO: 1154633 - RNA, 18 nt, Mycobacterium bovis subsp bovis AF2122/97
cugacgacugggcgccca

SEQ ID NO: 1154634 - RNA, 17 nt, Mycobacterium bovis subsp bovis AF2122/97
cugacgagccgguggcg

SEQ ID NO: 1154635 - RNA, 18 nt, Mycobacterium bovis subsp bovis AF2122/97
cugacgagccgguggcgu

SEQ ID NO: 1154636 - RNA, 15 nt, Mycobacterium bovis subsp bovis AF2122/97
cugacgacugggcgc

SEQ ID NO: 1154637 - RNA, 20 nt, Mycobacterium bovis subsp bovis AF2122/97
cugaccuuguugaccaccac

SEQ ID NO: 1154638 - RNA, 17 nt, Mycobacterium bovis subsp bovis AF2122/97
cugacgaaauccgccgg

SEQ ID NO: 1154639 - RNA, 21 nt, Mycobacterium bovis subsp bovis AF2122/97
cugacgaaauccgccgggcgc

SEQ ID NO: 1154640 - RNA, 20 nt, Mycobacterium bovis subsp bovis AF2122/97
cugacgaaguccaccacgac

SEQ ID NO: 1154641 - RNA, 22 nt, Mycobacterium bovis subsp bovis AF2122/97
cugacgaaucgccuaccggccu

SEQ ID NO: 1154642 - RNA, 18 nt, Mycobacterium bovis subsp bovis AF2122/97
cugaccgguucccgggca

SEQ ID NO: 1154643 - RNA, 19 nt, Mycobacterium bovis subsp bovis AF2122/97
cugaccuucucacgcacca

SEQ ID NO: 1154644 - RNA, 13 nt, Mycobacterium bovis subsp bovis AF2122/97
cugaccgccaccg

SEQ ID NO: 1154645 - RNA, 14 nt, Mycobacterium bovis subsp bovis AF2122/97
cugaccgccaccgu

SEQ ID NO: 1154646 - RNA, 13 nt, Mycobacterium bovis subsp bovis AF2122/97
cugaccgcgccgg

SEQ ID NO: 1154647 - RNA, 19 nt, Mycobacterium bovis subsp bovis AF2122/97
cugacccggagccgccagg

SEQ ID NO: 1154648 - RNA, 19 nt, Mycobacterium bovis subsp bovis AF2122/97
cugaccgaagaagcccgac

SEQ ID NO: 1154649 - RNA, 17 nt, Mycobacterium bovis subsp bovis AF2122/97
cugaccgucugcgaccc

SEQ ID NO: 1154650 - RNA, 21 nt, Mycobacterium bovis subsp bovis AF2122/97
cugaccgucugcgacccgggc

SEQ ID NO: 1154651 - RNA, 12 nt, Mycobacterium bovis subsp bovis AF2122/97
cugaccguggcg

SEQ ID NO: 1154652 - RNA, 13 nt, Mycobacterium bovis subsp bovis AF2122/97
cugaccggggcgc

SEQ ID NO: 1154653 - RNA, 17 nt, Mycobacterium bovis subsp bovis AF2122/97
cugaccggggcgcccgg

SEQ ID NO: 1154654 - RNA, 17 nt, Mycobacterium bovis subsp bovis AF2122/97
cugaccggucacccgug

SEQ ID NO: 1154655 - RNA, 20 nt, Mycobacterium bovis subsp bovis AF2122/97
cugacuuuugucacugcggc

SEQ ID NO: 1154656 - RNA, 23 nt, Mycobacterium bovis subsp bovis AF2122/97
cugacuuugggucggcgauggcg

SEQ ID NO: 1154657 - RNA, 18 nt, Mycobacterium bovis subsp bovis AF2122/97
cugagaacacguucggcg

SEQ ID NO: 1154658 - RNA, 14 nt, Mycobacterium bovis subsp bovis AF2122/97
cugagacucgucga

SEQ ID NO: 1154659 - RNA, 15 nt, Mycobacterium bovis subsp bovis AF2122/97
cugagacucgucgau

SEQ ID NO: 1154660 - RNA, 21 nt, Mycobacterium bovis subsp bovis AF2122/97
cugagacgguguugcucgccg

SEQ ID NO: 1154661 - RNA, 23 nt, Mycobacterium bovis subsp bovis AF2122/97
cugagacucgucgaugcgguggu

SEQ ID NO: 1154662 - RNA, 17 nt, Mycobacterium bovis subsp bovis AF2122/97
cugacuccugcggcacc

SEQ ID NO: 1154663 - RNA, 18 nt, Mycobacterium bovis subsp bovis AF2122/97
cugacuccugcggcaccg

SEQ ID NO: 1154664 - RNA, 19 nt, Mycobacterium bovis subsp bovis AF2122/97
cugacgugcggcgcggcga

SEQ ID NO: 1154665 - RNA, 17 nt, Mycobacterium bovis subsp bovis AF2122/97
cugacuagggucaccga

SEQ ID NO: 1154666 - RNA, 15 nt, Mycobacterium bovis subsp bovis AF2122/97
cugacggcaaacgac

SEQ ID NO: 1154667 - RNA, 16 nt, Mycobacterium bovis subsp bovis AF2122/97
cugacgcggccgggcg

SEQ ID NO: 1154668 - RNA, 16 nt, Mycobacterium bovis subsp bovis AF2122/97
cugacgcgucagcggc

SEQ ID NO: 1154669 - RNA, 18 nt, Mycobacterium bovis subsp bovis AF2122/97
cugacgcgucagcggcga

SEQ ID NO: 1154670 - RNA, 21 nt, Mycobacterium bovis subsp bovis AF2122/97
cugacgcgucagcggcgagca

SEQ ID NO: 1154671 - RNA, 20 nt, Mycobacterium bovis subsp bovis AF2122/97
cugacgguggggauggcgcc

SEQ ID NO: 1154672 - RNA, 22 nt, Mycobacterium bovis subsp bovis AF2122/97
cugacgguggggauggcgccca

SEQ ID NO: 1154673 - RNA, 21 nt, Mycobacterium bovis subsp bovis AF2122/97
cugacgguggugaccgcgggc

SEQ ID NO: 1154674 - RNA, 18 nt, Mycobacterium bovis subsp bovis AF2122/97
cugacggcgcaacaccuc

SEQ ID NO: 1154675 - RNA, 14 nt, Mycobacterium bovis subsp bovis AF2122/97
cugacggcgccguc

SEQ ID NO: 1154676 - RNA, 22 nt, Mycobacterium bovis subsp bovis AF2122/97
cugacggcuuccaacucggcgg

SEQ ID NO: 1154677 - RNA, 17 nt, Mycobacterium bovis subsp bovis AF2122/97
cugacgucacguucggc

SEQ ID NO: 1154678 - RNA, 17 nt, Mycobacterium bovis subsp bovis AF2122/97
cucggcgucgaccaguu

SEQ ID NO: 1154679 - RNA, 12 nt, Mycobacterium bovis subsp bovis AF2122/97
cucggcgucgag

SEQ ID NO: 1154680 - RNA, 20 nt, Mycobacterium bovis subsp bovis AF2122/97
cucggcguccgcccagcacc

SEQ ID NO: 1154681 - RNA, 14 nt, Mycobacterium bovis subsp bovis AF2122/97
cucggcguccgccc

SEQ ID NO: 1154682 - RNA, 18 nt, Mycobacterium bovis subsp bovis AF2122/97
cucggcguccgcccagca

SEQ ID NO: 1154683 - RNA, 23 nt, Mycobacterium bovis subsp bovis AF2122/97
cucggcguacucgugcaccgucg

SEQ ID NO: 1154684 - RNA, 23 nt, Mycobacterium bovis subsp bovis AF2122/97
cucggcguggcaguacaccggcg

SEQ ID NO: 1154685 - RNA, 19 nt, Mycobacterium bovis subsp bovis AF2122/97
cucggcgugaucaccggca

SEQ ID NO: 1154686 - RNA, 18 nt, Mycobacterium bovis subsp bovis AF2122/97
cucggcgugcugguaacc

SEQ ID NO: 1154687 - RNA, 21 nt, Mycobacterium bovis subsp bovis AF2122/97
cucggcgucgugguggccacg

SEQ ID NO: 1154688 - RNA, 23 nt, Mycobacterium bovis subsp bovis AF2122/97
cucuagauauggaccgccgccga

SEQ ID NO: 1154689 - RNA, 18 nt, Mycobacterium bovis subsp bovis AF2122/97
cucuagcaaagccagcgc

SEQ ID NO: 1154690 - RNA, 19 nt, Mycobacterium bovis subsp bovis AF2122/97
cucuagcaaagccagcgca

SEQ ID NO: 1154691 - RNA, 20 nt, Mycobacterium bovis subsp bovis AF2122/97
cucuaccgguccgucaccac

SEQ ID NO: 1154692 - RNA, 23 nt, Mycobacterium bovis subsp bovis AF2122/97
cucuaccgguccgucaccaccgc

SEQ ID NO: 1154693 - RNA, 13 nt, Mycobacterium bovis subsp bovis AF2122/97
cucugcaaugccu

SEQ ID NO: 1154694 - RNA, 23 nt, Mycobacterium bovis subsp bovis AF2122/97
cucuaucagacgauucggcggcc

SEQ ID NO: 1154695 - RNA, 16 nt, Mycobacterium bovis subsp bovis AF2122/97
cucucacggcgguagc

SEQ ID NO: 1154696 - RNA, 16 nt, Mycobacterium bovis subsp bovis AF2122/97
cucuugcaccagggcc

SEQ ID NO: 1154697 - RNA, 17 nt, Mycobacterium bovis subsp bovis AF2122/97
cucuugcacucggcgcc

SEQ ID NO: 1154698 - RNA, 17 nt, Mycobacterium bovis subsp bovis AF2122/97
cugaaaacaccgcacgg

SEQ ID NO: 1154699 - RNA, 19 nt, Mycobacterium bovis subsp bovis AF2122/97
cucuuugagugccgcgucg

SEQ ID NO: 1154700 - RNA, 16 nt, Mycobacterium bovis subsp bovis AF2122/97
cucuggaucacgucga

SEQ ID NO: 1154701 - RNA, 18 nt, Mycobacterium bovis subsp bovis AF2122/97
cucuggaucacgucgaug

SEQ ID NO: 1154702 - RNA, 23 nt, Mycobacterium bovis subsp bovis AF2122/97
cucugguuuuacacaccagcggu

SEQ ID NO: 1154703 - RNA, 14 nt, Mycobacterium bovis subsp bovis AF2122/97
cucuggugucgucg

SEQ ID NO: 1154704 - RNA, 17 nt, Mycobacterium bovis subsp bovis AF2122/97
cucuguggugucgauug

SEQ ID NO: 1154705 - RNA, 22 nt, Mycobacterium bovis subsp bovis AF2122/97
cugaaccgguugacacccgggc

SEQ ID NO: 1154706 - RNA, 19 nt, Mycobacterium bovis subsp bovis AF2122/97
cugaacgcgagcaacacca

SEQ ID NO: 1154707 - RNA, 13 nt, Mycobacterium bovis subsp bovis AF2122/97
cugaaccagcuga

SEQ ID NO: 1154708 - RNA, 13 nt, Mycobacterium bovis subsp bovis AF2122/97
cugaaccacgcgu

SEQ ID NO: 1154709 - RNA, 17 nt, Mycobacterium bovis subsp bovis AF2122/97
cugaaccgcugggacaa

SEQ ID NO: 1154710 - RNA, 14 nt, Mycobacterium bovis subsp bovis AF2122/97
cugaaccggccgcg

SEQ ID NO: 1154711 - RNA, 15 nt, Mycobacterium bovis subsp bovis AF2122/97
cugaaccggccgcga

SEQ ID NO: 1154712 - RNA, 16 nt, Mycobacterium bovis subsp bovis AF2122/97
cugaaccggccgcgac

SEQ ID NO: 1154713 - RNA, 18 nt, Mycobacterium bovis subsp bovis AF2122/97
cugaaccggccgcgacga

SEQ ID NO: 1154714 - RNA, 22 nt, Mycobacterium bovis subsp bovis AF2122/97
cugaacgguucggccggggcga

SEQ ID NO: 1154715 - RNA, 18 nt, Mycobacterium bovis subsp bovis AF2122/97
cugaacucaacaccagca

SEQ ID NO: 1154716 - RNA, 21 nt, Mycobacterium bovis subsp bovis AF2122/97
cugaagcuguaggcgaccaga

SEQ ID NO: 1154717 - RNA, 13 nt, Mycobacterium bovis subsp bovis AF2122/97
cugaagccgcgcu

SEQ ID NO: 1154718 - RNA, 14 nt, Mycobacterium bovis subsp bovis AF2122/97
cugaagccgcgcug

SEQ ID NO: 1154719 - RNA, 15 nt, Mycobacterium bovis subsp bovis AF2122/97
cugaagccgcgcugc

SEQ ID NO: 1154720 - RNA, 16 nt, Mycobacterium bovis subsp bovis AF2122/97
cugaagccccuuggcg

SEQ ID NO: 1154721 - RNA, 21 nt, Mycobacterium bovis subsp bovis AF2122/97
cugaagccccuuggcgccacc

SEQ ID NO: 1154722 - RNA, 12 nt, Mycobacterium bovis subsp bovis AF2122/97
cugaagccagcg

SEQ ID NO: 1154723 - RNA, 17 nt, Mycobacterium bovis subsp bovis AF2122/97
cugaagccagcgcagca

SEQ ID NO: 1154724 - RNA, 19 nt, Mycobacterium bovis subsp bovis AF2122/97
cugaagccagcgcagcacc

SEQ ID NO: 1154725 - RNA, 21 nt, Mycobacterium bovis subsp bovis AF2122/97
cugaagagcggagccggcgca

SEQ ID NO: 1154726 - RNA, 19 nt, Mycobacterium bovis subsp bovis AF2122/97
cugaagggccgccucgcgg

SEQ ID NO: 1154727 - RNA, 13 nt, Mycobacterium bovis subsp bovis AF2122/97
cugaaggccagcc

SEQ ID NO: 1154728 - RNA, 13 nt, Mycobacterium bovis subsp bovis AF2122/97
cugaaggccggua

SEQ ID NO: 1154729 - RNA, 14 nt, Mycobacterium bovis subsp bovis AF2122/97
cugaaggcggcgau

SEQ ID NO: 1154730 - RNA, 18 nt, Mycobacterium bovis subsp bovis AF2122/97
cugaccccgccgccacgg

SEQ ID NO: 1154731 - RNA, 16 nt, Mycobacterium bovis subsp bovis AF2122/97
cugaccccgccggcug

SEQ ID NO: 1154732 - RNA, 12 nt, Mycobacterium bovis subsp bovis AF2122/97
cugaccaucaca

SEQ ID NO: 1154733 - RNA, 22 nt, Mycobacterium bovis subsp bovis AF2122/97
cugaccaucacacccaucaccc

SEQ ID NO: 1154734 - RNA, 19 nt, Mycobacterium bovis subsp bovis AF2122/97
cugaccccccgaccccgac

SEQ ID NO: 1154735 - RNA, 20 nt, Mycobacterium bovis subsp bovis AF2122/97
cugaccaggucugcggugcu

SEQ ID NO: 1154736 - RNA, 19 nt, Mycobacterium bovis subsp bovis AF2122/97
cugaccaugaccgggcugg

SEQ ID NO: 1154737 - RNA, 18 nt, Mycobacterium bovis subsp bovis AF2122/97
cugacccaccgccccggc

SEQ ID NO: 1154738 - RNA, 11 nt, Mycobacterium bovis subsp bovis AF2122/97
cugaccagccg

SEQ ID NO: 1154739 - RNA, 22 nt, Mycobacterium bovis subsp bovis AF2122/97
cugaccaacauguugucgucgc

SEQ ID NO: 1154740 - RNA, 15 nt, Mycobacterium bovis subsp bovis AF2122/97
cugacacgcccgcga

SEQ ID NO: 1154741 - RNA, 15 nt, Mycobacterium bovis subsp bovis AF2122/97
cugaauuggcgccga

SEQ ID NO: 1154742 - RNA, 20 nt, Mycobacterium bovis subsp bovis AF2122/97
cugacaaggguucaggucgg

SEQ ID NO: 1154743 - RNA, 15 nt, Mycobacterium bovis subsp bovis AF2122/97
cugacacccaucgac

SEQ ID NO: 1154744 - RNA, 21 nt, Mycobacterium bovis subsp bovis AF2122/97
cugacacccaucgaccgcccg

SEQ ID NO: 1154745 - RNA, 20 nt, Mycobacterium bovis subsp bovis AF2122/97
cugacaccgaaccgccgcug

SEQ ID NO: 1154746 - RNA, 18 nt, Mycobacterium bovis subsp bovis AF2122/97
cugacaccgauccggccg

SEQ ID NO: 1154747 - RNA, 22 nt, Mycobacterium bovis subsp bovis AF2122/97
cugacaccgauccggccgccga

SEQ ID NO: 1154748 - RNA, 14 nt, Mycobacterium bovis subsp bovis AF2122/97
cugaaucaccccgg

SEQ ID NO: 1154749 - RNA, 19 nt, Mycobacterium bovis subsp bovis AF2122/97
cugaaucgguucggccaga

SEQ ID NO: 1154750 - RNA, 17 nt, Mycobacterium bovis subsp bovis AF2122/97
cucggcggacccgguga

SEQ ID NO: 1154751 - RNA, 18 nt, Mycobacterium bovis subsp bovis AF2122/97
cucggcggacccggugac

SEQ ID NO: 1154752 - RNA, 14 nt, Mycobacterium bovis subsp bovis AF2122/97
cucggcggaagacc

SEQ ID NO: 1154753 - RNA, 20 nt, Mycobacterium bovis subsp bovis AF2122/97
cucggcggaagaccggaucg

SEQ ID NO: 1154754 - RNA, 13 nt, Mycobacterium bovis subsp bovis AF2122/97
cucggcgcugcgc

SEQ ID NO: 1154755 - RNA, 16 nt, Mycobacterium bovis subsp bovis AF2122/97
cucggcgcugcgcacc

SEQ ID NO: 1154756 - RNA, 18 nt, Mycobacterium bovis subsp bovis AF2122/97
cucggcgaaggccgcgcg

SEQ ID NO: 1154757 - RNA, 24 nt, Mycobacterium bovis subsp bovis AF2122/97
cucggcgaagucacgcacccggcg

SEQ ID NO: 1154758 - RNA, 21 nt, Mycobacterium bovis subsp bovis AF2122/97
cucggccuugaucaccgugcg

SEQ ID NO: 1154759 - RNA, 21 nt, Mycobacterium bovis subsp bovis AF2122/97
cucggccuugacgcacgacug

SEQ ID NO: 1154760 - RNA, 14 nt, Mycobacterium bovis subsp bovis AF2122/97
cucggcggcccggc

SEQ ID NO: 1154761 - RNA, 23 nt, Mycobacterium bovis subsp bovis AF2122/97
cucggcggugccgcggcuaggcc

SEQ ID NO: 1154762 - RNA, 19 nt, Mycobacterium bovis subsp bovis AF2122/97
cucggcggccagcucggcc

SEQ ID NO: 1154763 - RNA, 13 nt, Mycobacterium bovis subsp bovis AF2122/97
cucggcggcagcg

SEQ ID NO: 1154764 - RNA, 15 nt, Mycobacterium bovis subsp bovis AF2122/97
cucggcggcagcggc

SEQ ID NO: 1154765 - RNA, 14 nt, Mycobacterium bovis subsp bovis AF2122/97
cucggcggccagcg

SEQ ID NO: 1154766 - RNA, 14 nt, Mycobacterium bovis subsp bovis AF2122/97
cucggcggccagcu

SEQ ID NO: 1154767 - RNA, 20 nt, Mycobacterium bovis subsp bovis AF2122/97
cucggcgaaugcgauugccg

SEQ ID NO: 1154768 - RNA, 20 nt, Mycobacterium bovis subsp bovis AF2122/97
cucggcggagaaaagcgcgc

SEQ ID NO: 1154769 - RNA, 15 nt, Mycobacterium bovis subsp bovis AF2122/97
cucggccgugaccga

SEQ ID NO: 1154770 - RNA, 21 nt, Mycobacterium bovis subsp bovis AF2122/97
cucggccgugaccgagccgcg

SEQ ID NO: 1154771 - RNA, 16 nt, Mycobacterium bovis subsp bovis AF2122/97
cucggccggcggcgcc

SEQ ID NO: 1154772 - RNA, 14 nt, Mycobacterium bovis subsp bovis AF2122/97
cucggccuccgccg

SEQ ID NO: 1154773 - RNA, 19 nt, Mycobacterium bovis subsp bovis AF2122/97
cucggccucgucgugcacc

SEQ ID NO: 1154774 - RNA, 15 nt, Mycobacterium bovis subsp bovis AF2122/97
cucggccauagcgcc

SEQ ID NO: 1154775 - RNA, 21 nt, Mycobacterium bovis subsp bovis AF2122/97
cucggccauagcgccgcgccc

SEQ ID NO: 1154776 - RNA, 22 nt, Mycobacterium bovis subsp bovis AF2122/97
cucggccauagcgccgcgccca

SEQ ID NO: 1154777 - RNA, 17 nt, Mycobacterium bovis subsp bovis AF2122/97
cucggccaucagaaccu

SEQ ID NO: 1154778 - RNA, 13 nt, Mycobacterium bovis subsp bovis AF2122/97
cucggccccgccg

SEQ ID NO: 1154779 - RNA, 14 nt, Mycobacterium bovis subsp bovis AF2122/97
cucggccccgccgc

SEQ ID NO: 1154780 - RNA, 14 nt, Mycobacterium bovis subsp bovis AF2122/97
cucggcccagcgcg

SEQ ID NO: 1154781 - RNA, 14 nt, Mycobacterium bovis subsp bovis AF2122/97
cucggccgccagcc

SEQ ID NO: 1154782 - RNA, 17 nt, Mycobacterium bovis subsp bovis AF2122/97
cucggccgccagcccca

SEQ ID NO: 1154783 - RNA, 13 nt, Mycobacterium bovis subsp bovis AF2122/97
cucggccgcccgu

SEQ ID NO: 1154784 - RNA, 20 nt, Mycobacterium bovis subsp bovis AF2122/97
cucggccgaugcgcagugca

SEQ ID NO: 1154785 - RNA, 13 nt, Mycobacterium bovis subsp bovis AF2122/97
cucggccgcagcc

SEQ ID NO: 1154786 - RNA, 11 nt, Mycobacterium bovis subsp bovis AF2122/97
cucggccgcau

SEQ ID NO: 1154787 - RNA, 14 nt, Mycobacterium bovis subsp bovis AF2122/97
cucggccgacgaga

SEQ ID NO: 1154788 - RNA, 13 nt, Mycobacterium bovis subsp bovis AF2122/97
cucggcagccggc

SEQ ID NO: 1154789 - RNA, 19 nt, Mycobacterium bovis subsp bovis AF2122/97
cucggcaggaaggacaucg

SEQ ID NO: 1154790 - RNA, 22 nt, Mycobacterium bovis subsp bovis AF2122/97
cucggcaggcccggaggguucg

SEQ ID NO: 1154791 - RNA, 20 nt, Mycobacterium bovis subsp bovis AF2122/97
cucggcagcaucuccgucgg

SEQ ID NO: 1154792 - RNA, 19 nt, Mycobacterium bovis subsp bovis AF2122/97
cucggccaggcuggccaac

SEQ ID NO: 1154793 - RNA, 23 nt, Mycobacterium bovis subsp bovis AF2122/97
cucggcauccaggcugucgcggg

SEQ ID NO: 1154794 - RNA, 17 nt, Mycobacterium bovis subsp bovis AF2122/97
cucggcacccggcagag

SEQ ID NO: 1154795 - RNA, 14 nt, Mycobacterium bovis subsp bovis AF2122/97
cucggcaccgcggc

SEQ ID NO: 1154796 - RNA, 16 nt, Mycobacterium bovis subsp bovis AF2122/97
cucggcaccgcggccg

SEQ ID NO: 1154797 - RNA, 20 nt, Mycobacterium bovis subsp bovis AF2122/97
cucggcaaaccaagcgcgcc

SEQ ID NO: 1154798 - RNA, 19 nt, Mycobacterium bovis subsp bovis AF2122/97
cucggaucuugacguucgc

SEQ ID NO: 1154799 - RNA, 20 nt, Mycobacterium bovis subsp bovis AF2122/97
cucggaucuugacguucgcg

SEQ ID NO: 1154800 - RNA, 17 nt, Mycobacterium bovis subsp bovis AF2122/97
cucggcaaccugcgacc

SEQ ID NO: 1154801 - RNA, 16 nt, Mycobacterium bovis subsp bovis AF2122/97
cucggacacggcagcc

SEQ ID NO: 1154802 - RNA, 15 nt, Mycobacterium bovis subsp bovis AF2122/97
cucggaucgccaggc

SEQ ID NO: 1154803 - RNA, 18 nt, Mycobacterium bovis subsp bovis AF2122/97
cucggaucggcucgccac

SEQ ID NO: 1154804 - RNA, 23 nt, Mycobacterium bovis subsp bovis AF2122/97
cucggacaaagccgucgcgacgu

SEQ ID NO: 1154805 - RNA, 16 nt, Mycobacterium bovis subsp bovis AF2122/97
cucggaaaccgccccg

SEQ ID NO: 1154806 - RNA, 13 nt, Mycobacterium bovis subsp bovis AF2122/97
cucggacccaccc

SEQ ID NO: 1154807 - RNA, 19 nt, Mycobacterium bovis subsp bovis AF2122/97
cucggacugcagcgcggcc

SEQ ID NO: 1154808 - RNA, 14 nt, Mycobacterium bovis subsp bovis AF2122/97
cucgcgggcgaucg

SEQ ID NO: 1154809 - RNA, 15 nt, Mycobacterium bovis subsp bovis AF2122/97
cucgcgggccgcguc

SEQ ID NO: 1154810 - RNA, 16 nt, Mycobacterium bovis subsp bovis AF2122/97
cucgcgggccgcgucg

SEQ ID NO: 1154811 - RNA, 18 nt, Mycobacterium bovis subsp bovis AF2122/97
cucgcgggcgaccaccgc

SEQ ID NO: 1154812 - RNA, 15 nt, Mycobacterium bovis subsp bovis AF2122/97
cucgcuucaggcacc

SEQ ID NO: 1154813 - RNA, 18 nt, Mycobacterium bovis subsp bovis AF2122/97
cucgccgguaggcggcca

SEQ ID NO: 1154814 - RNA, 19 nt, Mycobacterium bovis subsp bovis AF2122/97
cucgccgguaggcggccag

SEQ ID NO: 1154815 - RNA, 17 nt, Mycobacterium bovis subsp bovis AF2122/97
cucgccgggucagcccg

SEQ ID NO: 1154816 - RNA, 15 nt, Mycobacterium bovis subsp bovis AF2122/97
cucgccggcucggcg

SEQ ID NO: 1154817 - RNA, 22 nt, Mycobacterium bovis subsp bovis AF2122/97
cucgccgggaaacaccggcuug

SEQ ID NO: 1154818 - RNA, 21 nt, Mycobacterium bovis subsp bovis AF2122/97
cucgccguagagcuggugcgg

SEQ ID NO: 1154819 - RNA, 23 nt, Mycobacterium bovis subsp bovis AF2122/97
cucgccgggcagcuacggggcgg

SEQ ID NO: 1154820 - RNA, 20 nt, Mycobacterium bovis subsp bovis AF2122/97
cucgccguacaucagcgcga

SEQ ID NO: 1154821 - RNA, 20 nt, Mycobacterium bovis subsp bovis AF2122/97
cucgccgguguccuuggccg

SEQ ID NO: 1154822 - RNA, 18 nt, Mycobacterium bovis subsp bovis AF2122/97
cucgccguaagcaccagc

SEQ ID NO: 1154823 - RNA, 14 nt, Mycobacterium bovis subsp bovis AF2122/97
cucgccggugacgg

SEQ ID NO: 1154824 - RNA, 23 nt, Mycobacterium bovis subsp bovis AF2122/97
cucgccggugacgggguugaccg

SEQ ID NO: 1154825 - RNA, 13 nt, Mycobacterium bovis subsp bovis AF2122/97
cucgccgugacca

SEQ ID NO: 1154826 - RNA, 18 nt, Mycobacterium bovis subsp bovis AF2122/97
cucgccgugguggaugag

SEQ ID NO: 1154827 - RNA, 14 nt, Mycobacterium bovis subsp bovis AF2122/97
cucgccguugaugu

SEQ ID NO: 1154828 - RNA, 20 nt, Mycobacterium bovis subsp bovis AF2122/97
cucgccguugaugucggcag

SEQ ID NO: 1154829 - RNA, 16 nt, Mycobacterium bovis subsp bovis AF2122/97
cucgccugagcgcucg

SEQ ID NO: 1154830 - RNA, 23 nt, Mycobacterium bovis subsp bovis AF2122/97
cucgcggccggcgucggcgucga

SEQ ID NO: 1154831 - RNA, 22 nt, Mycobacterium bovis subsp bovis AF2122/97
cucgcggcuucaguccggcccc

SEQ ID NO: 1154832 - RNA, 15 nt, Mycobacterium bovis subsp bovis AF2122/97
cucgcgggcagggcc

SEQ ID NO: 1154833 - RNA, 22 nt, Mycobacterium bovis subsp bovis AF2122/97
cucgcgggcagggccucggucg

SEQ ID NO: 1154834 - RNA, 14 nt, Mycobacterium bovis subsp bovis AF2122/97
cucgcggcgcggcc

SEQ ID NO: 1154835 - RNA, 13 nt, Mycobacterium bovis subsp bovis AF2122/97
cucgcgcccgcua

SEQ ID NO: 1154836 - RNA, 21 nt, Mycobacterium bovis subsp bovis AF2122/97
cucgcgccaggucggugacga

SEQ ID NO: 1154837 - RNA, 13 nt, Mycobacterium bovis subsp bovis AF2122/97
cucgcgccgguga

SEQ ID NO: 1154838 - RNA, 13 nt, Mycobacterium bovis subsp bovis AF2122/97
cucgcgcagccgg

SEQ ID NO: 1154839 - RNA, 20 nt, Mycobacterium bovis subsp bovis AF2122/97
cucgcgcaccugaucgguca

SEQ ID NO: 1154840 - RNA, 13 nt, Mycobacterium bovis subsp bovis AF2122/97
cucgcgcacgucg

SEQ ID NO: 1154841 - RNA, 17 nt, Mycobacterium bovis subsp bovis AF2122/97
cucgcgcacgucgacga

SEQ ID NO: 1154842 - RNA, 18 nt, Mycobacterium bovis subsp bovis AF2122/97
cucgcgcagggaucgcag

SEQ ID NO: 1154843 - RNA, 21 nt, Mycobacterium bovis subsp bovis AF2122/97
cucgcgcagggaucgcaggga

SEQ ID NO: 1154844 - RNA, 16 nt, Mycobacterium bovis subsp bovis AF2122/97
cucgccugugggugcu

SEQ ID NO: 1154845 - RNA, 24 nt, Mycobacterium bovis subsp bovis AF2122/97
cucgcccugagaacacguucggcg

SEQ ID NO: 1154846 - RNA, 16 nt, Mycobacterium bovis subsp bovis AF2122/97
cucgccgccagcgcuc

SEQ ID NO: 1154847 - RNA, 18 nt, Mycobacterium bovis subsp bovis AF2122/97
cucgccggaucguucgcg

SEQ ID NO: 1154848 - RNA, 24 nt, Mycobacterium bovis subsp bovis AF2122/97
cucgccggaucuugccgcuggugg

SEQ ID NO: 1154849 - RNA, 16 nt, Mycobacterium bovis subsp bovis AF2122/97
cucgccggcaccgacg

SEQ ID NO: 1154850 - RNA, 14 nt, Mycobacterium bovis subsp bovis AF2122/97
cucgccggccaacu

SEQ ID NO: 1154851 - RNA, 23 nt, Mycobacterium bovis subsp bovis AF2122/97
cucgccgcgcaccgaccgcaccg

SEQ ID NO: 1154852 - RNA, 11 nt, Mycobacterium bovis subsp bovis AF2122/97
cucgccggccg

SEQ ID NO: 1154853 - RNA, 13 nt, Mycobacterium bovis subsp bovis AF2122/97
cucgccggcgcgc

SEQ ID NO: 1154854 - RNA, 15 nt, Mycobacterium bovis subsp bovis AF2122/97
cucgccggcgcgcac

SEQ ID NO: 1154855 - RNA, 16 nt, Mycobacterium bovis subsp bovis AF2122/97
cucgccggcgcgcacc

SEQ ID NO: 1154856 - RNA, 12 nt, Mycobacterium bovis subsp bovis AF2122/97
cucgccggcgaa

SEQ ID NO: 1154857 - RNA, 16 nt, Mycobacterium bovis subsp bovis AF2122/97
cucgccggcggacgcc

SEQ ID NO: 1154858 - RNA, 19 nt, Mycobacterium bovis subsp bovis AF2122/97
cucgccggcggcccgcucg

SEQ ID NO: 1154859 - RNA, 21 nt, Mycobacterium bovis subsp bovis AF2122/97
cucgcagguggugacacgacg

SEQ ID NO: 1154860 - RNA, 18 nt, Mycobacterium bovis subsp bovis AF2122/97
cucgcaguucaucgggca

SEQ ID NO: 1154861 - RNA, 14 nt, Mycobacterium bovis subsp bovis AF2122/97
cucgcaugcucacg

SEQ ID NO: 1154862 - RNA, 20 nt, Mycobacterium bovis subsp bovis AF2122/97
cucgcauguucuccacgccg

SEQ ID NO: 1154863 - RNA, 18 nt, Mycobacterium bovis subsp bovis AF2122/97
cucgcauucggcgagccg

SEQ ID NO: 1154864 - RNA, 22 nt, Mycobacterium bovis subsp bovis AF2122/97
cucgcccuauacgcaacaggcc

SEQ ID NO: 1154865 - RNA, 13 nt, Mycobacterium bovis subsp bovis AF2122/97
cucgcagcgggcg

SEQ ID NO: 1154866 - RNA, 13 nt, Mycobacterium bovis subsp bovis AF2122/97
cucgccgaccagc

SEQ ID NO: 1154867 - RNA, 18 nt, Mycobacterium bovis subsp bovis AF2122/97
cucgccgaaaucggccag

SEQ ID NO: 1154868 - RNA, 20 nt, Mycobacterium bovis subsp bovis AF2122/97
cucgccgaaaucggccagcu

SEQ ID NO: 1154869 - RNA, 14 nt, Mycobacterium bovis subsp bovis AF2122/97
cucgccgcacgccg

SEQ ID NO: 1154870 - RNA, 14 nt, Mycobacterium bovis subsp bovis AF2122/97
cucgccgaagcggg

SEQ ID NO: 1154871 - RNA, 23 nt, Mycobacterium bovis subsp bovis AF2122/97
cucgccgaccagcuugaccgacc

SEQ ID NO: 1154872 - RNA, 21 nt, Mycobacterium bovis subsp bovis AF2122/97
cucgcacgacaccucgaaggc

SEQ ID NO: 1154873 - RNA, 20 nt, Mycobacterium bovis subsp bovis AF2122/97
cucgcaccgcccgccgaacg

SEQ ID NO: 1154874 - RNA, 14 nt, Mycobacterium bovis subsp bovis AF2122/97
cucgcaccgcgccg

SEQ ID NO: 1154875 - RNA, 23 nt, Mycobacterium bovis subsp bovis AF2122/97
cucgcaccgugaguacucgguca

SEQ ID NO: 1154876 - RNA, 22 nt, Mycobacterium bovis subsp bovis AF2122/97
cucgcacaauggcggcgccguc

SEQ ID NO: 1154877 - RNA, 14 nt, Mycobacterium bovis subsp bovis AF2122/97
cucgcaggccggcg

SEQ ID NO: 1154878 - RNA, 21 nt, Mycobacterium bovis subsp bovis AF2122/97
cucgaugacaucggucagcgg

SEQ ID NO: 1154879 - RNA, 16 nt, Mycobacterium bovis subsp bovis AF2122/97
cucgcacucguugccg

SEQ ID NO: 1154880 - RNA, 13 nt, Mycobacterium bovis subsp bovis AF2122/97
cucgcagccaacg

SEQ ID NO: 1154881 - RNA, 12 nt, Mycobacterium bovis subsp bovis AF2122/97
cucgaucgucga

SEQ ID NO: 1154882 - RNA, 12 nt, Mycobacterium bovis subsp bovis AF2122/97
cucgaucggcag

SEQ ID NO: 1154883 - RNA, 15 nt, Mycobacterium bovis subsp bovis AF2122/97
cucgaucgcgccguc

SEQ ID NO: 1154884 - RNA, 14 nt, Mycobacterium bovis subsp bovis AF2122/97
cucgaucggcagcc

SEQ ID NO: 1154885 - RNA, 22 nt, Mycobacterium bovis subsp bovis AF2122/97
cucgaugaaugagcggucagcg

SEQ ID NO: 1154886 - RNA, 15 nt, Mycobacterium bovis subsp bovis AF2122/97
cucgagcugcuggcg

SEQ ID NO: 1154887 - RNA, 17 nt, Mycobacterium bovis subsp bovis AF2122/97
cucgagcugcuggcgcg

SEQ ID NO: 1154888 - RNA, 13 nt, Mycobacterium bovis subsp bovis AF2122/97
cucgagcucggcg

SEQ ID NO: 1154889 - RNA, 13 nt, Mycobacterium bovis subsp bovis AF2122/97
cucgagcggcaga

SEQ ID NO: 1154890 - RNA, 20 nt, Mycobacterium bovis subsp bovis AF2122/97
cucgagcgguggcgucgucg

SEQ ID NO: 1154891 - RNA, 13 nt, Mycobacterium bovis subsp bovis AF2122/97
cucgaggaccacc

SEQ ID NO: 1154892 - RNA, 21 nt, Mycobacterium bovis subsp bovis AF2122/97
cucgaggaccaccuggucgcg

SEQ ID NO: 1154893 - RNA, 19 nt, Mycobacterium bovis subsp bovis AF2122/97
cucgaggacggcguagacg

SEQ ID NO: 1154894 - RNA, 17 nt, Mycobacterium bovis subsp bovis AF2122/97
cucgacguacagcgcgg

SEQ ID NO: 1154895 - RNA, 15 nt, Mycobacterium bovis subsp bovis AF2122/97
cucgagcgcggcgau

SEQ ID NO: 1154896 - RNA, 13 nt, Mycobacterium bovis subsp bovis AF2122/97
cucgacgucggcg

SEQ ID NO: 1154897 - RNA, 22 nt, Mycobacterium bovis subsp bovis AF2122/97
cucgacgucgggcauggcggcg

SEQ ID NO: 1154898 - RNA, 23 nt, Mycobacterium bovis subsp bovis AF2122/97
cucgagcgccucgggaggcagcg

SEQ ID NO: 1154899 - RNA, 16 nt, Mycobacterium bovis subsp bovis AF2122/97
cucgagguccucgucg

SEQ ID NO: 1154900 - RNA, 19 nt, Mycobacterium bovis subsp bovis AF2122/97
cucgagguccucgucggcg

SEQ ID NO: 1154901 - RNA, 23 nt, Mycobacterium bovis subsp bovis AF2122/97
cucgagguccucgucggcgucga

SEQ ID NO: 1154902 - RNA, 23 nt, Mycobacterium bovis subsp bovis AF2122/97
cucgagguggucucgguaggcgg

SEQ ID NO: 1154903 - RNA, 19 nt, Mycobacterium bovis subsp bovis AF2122/97
cucgagguuuccgagggug

SEQ ID NO: 1154904 - RNA, 16 nt, Mycobacterium bovis subsp bovis AF2122/97
cucgaguacccaaccg

SEQ ID NO: 1154905 - RNA, 18 nt, Mycobacterium bovis subsp bovis AF2122/97
cucgaguacccaaccggu

SEQ ID NO: 1154906 - RNA, 19 nt, Mycobacterium bovis subsp bovis AF2122/97
cucgauccacugccgcgcg

SEQ ID NO: 1154907 - RNA, 12 nt, Mycobacterium bovis subsp bovis AF2122/97
cucgauccgcaa

SEQ ID NO: 1154908 - RNA, 19 nt, Mycobacterium bovis subsp bovis AF2122/97
cucgaucaucgggagccgc

SEQ ID NO: 1154909 - RNA, 20 nt, Mycobacterium bovis subsp bovis AF2122/97
cucgaccuggaugggcucga

SEQ ID NO: 1154910 - RNA, 22 nt, Mycobacterium bovis subsp bovis AF2122/97
cucgaccuggaugggcucgacg

SEQ ID NO: 1154911 - RNA, 17 nt, Mycobacterium bovis subsp bovis AF2122/97
cucgacgccgcgcagcc

SEQ ID NO: 1154912 - RNA, 13 nt, Mycobacterium bovis subsp bovis AF2122/97
cucgaccguggcg

SEQ ID NO: 1154913 - RNA, 23 nt, Mycobacterium bovis subsp bovis AF2122/97
cucgaccgcguccuugggcgucg

SEQ ID NO: 1154914 - RNA, 16 nt, Mycobacterium bovis subsp bovis AF2122/97
cucgaccugaggcacc

SEQ ID NO: 1154915 - RNA, 12 nt, Mycobacterium bovis subsp bovis AF2122/97
cucgaccgcguc

SEQ ID NO: 1154916 - RNA, 19 nt, Mycobacterium bovis subsp bovis AF2122/97
cucgaccgcggccuuggcg

SEQ ID NO: 1154917 - RNA, 21 nt, Mycobacterium bovis subsp bovis AF2122/97
cucgaccgcggccuuggcggc

SEQ ID NO: 1154918 - RNA, 18 nt, Mycobacterium bovis subsp bovis AF2122/97
cucgaccgauagcuggcc

SEQ ID NO: 1154919 - RNA, 22 nt, Mycobacterium bovis subsp bovis AF2122/97
cucgaccgccagcccggugaug

SEQ ID NO: 1154920 - RNA, 12 nt, Mycobacterium bovis subsp bovis AF2122/97
cucgaccgcgac

SEQ ID NO: 1154921 - RNA, 13 nt, Mycobacterium bovis subsp bovis AF2122/97
cucgaccgcgacg

SEQ ID NO: 1154922 - RNA, 14 nt, Mycobacterium bovis subsp bovis AF2122/97
cucgaccgcgacgg

SEQ ID NO: 1154923 - RNA, 15 nt, Mycobacterium bovis subsp bovis AF2122/97
cucgacggccucguc

SEQ ID NO: 1154924 - RNA, 17 nt, Mycobacterium bovis subsp bovis AF2122/97
cucgacggccucgucga

SEQ ID NO: 1154925 - RNA, 17 nt, Mycobacterium bovis subsp bovis AF2122/97
cucgacggcccgccguc

SEQ ID NO: 1154926 - RNA, 20 nt, Mycobacterium bovis subsp bovis AF2122/97
cucgacggcccgccguccgg

SEQ ID NO: 1154927 - RNA, 15 nt, Mycobacterium bovis subsp bovis AF2122/97
cucgacggcccgccg

SEQ ID NO: 1154928 - RNA, 16 nt, Mycobacterium bovis subsp bovis AF2122/97
cucgacggcccgccgu

SEQ ID NO: 1154929 - RNA, 14 nt, Mycobacterium bovis subsp bovis AF2122/97
cucgacggucaucg

SEQ ID NO: 1154930 - RNA, 12 nt, Mycobacterium bovis subsp bovis AF2122/97
cucgacggugac

SEQ ID NO: 1154931 - RNA, 14 nt, Mycobacterium bovis subsp bovis AF2122/97
cucgacggcgucga

SEQ ID NO: 1154932 - RNA, 17 nt, Mycobacterium bovis subsp bovis AF2122/97
cucgacggugacgacca

SEQ ID NO: 1154933 - RNA, 19 nt, Mycobacterium bovis subsp bovis AF2122/97
cucgacggugacgaccacg

SEQ ID NO: 1154934 - RNA, 20 nt, Mycobacterium bovis subsp bovis AF2122/97
cucgaccgucacgcguacgu

SEQ ID NO: 1154935 - RNA, 19 nt, Mycobacterium bovis subsp bovis AF2122/97
cucgaacugggucggcacg

SEQ ID NO: 1154936 - RNA, 20 nt, Mycobacterium bovis subsp bovis AF2122/97
cucgaacugggucggcacgg

SEQ ID NO: 1154937 - RNA, 14 nt, Mycobacterium bovis subsp bovis AF2122/97
cucgaagcccagca

SEQ ID NO: 1154938 - RNA, 17 nt, Mycobacterium bovis subsp bovis AF2122/97
cucgaaggcacugcgau

SEQ ID NO: 1154939 - RNA, 23 nt, Mycobacterium bovis subsp bovis AF2122/97
cucgaaggcacugcgaucgcgac

SEQ ID NO: 1154940 - RNA, 14 nt, Mycobacterium bovis subsp bovis AF2122/97
cucgaaggccgcac

SEQ ID NO: 1154941 - RNA, 20 nt, Mycobacterium bovis subsp bovis AF2122/97
cucgaaguccgcuugggcgg

SEQ ID NO: 1154942 - RNA, 17 nt, Mycobacterium bovis subsp bovis AF2122/97
cucgaauucggccggcg

SEQ ID NO: 1154943 - RNA, 17 nt, Mycobacterium bovis subsp bovis AF2122/97
cucgaagucgcccaguc

SEQ ID NO: 1154944 - RNA, 16 nt, Mycobacterium bovis subsp bovis AF2122/97
cucgacacccagccgc

SEQ ID NO: 1154945 - RNA, 17 nt, Mycobacterium bovis subsp bovis AF2122/97
cucgacacccagccgca

SEQ ID NO: 1154946 - RNA, 12 nt, Mycobacterium bovis subsp bovis AF2122/97
cuccgcugccgc

SEQ ID NO: 1154947 - RNA, 17 nt, Mycobacterium bovis subsp bovis AF2122/97
cuccggaaagcucucgg

SEQ ID NO: 1154948 - RNA, 21 nt, Mycobacterium bovis subsp bovis AF2122/97
cucccauucccaacacagccg

SEQ ID NO: 1154949 - RNA, 15 nt, Mycobacterium bovis subsp bovis AF2122/97
cuccccaagucgacg

SEQ ID NO: 1154950 - RNA, 20 nt, Mycobacterium bovis subsp bovis AF2122/97
cuccccaagucgacgguggc

SEQ ID NO: 1154951 - RNA, 23 nt, Mycobacterium bovis subsp bovis AF2122/97
cuccggauaacccagcggcgcca

SEQ ID NO: 1154952 - RNA, 15 nt, Mycobacterium bovis subsp bovis AF2122/97
cuccggaaucgcccg

SEQ ID NO: 1154953 - RNA, 16 nt, Mycobacterium bovis subsp bovis AF2122/97
cuccggaaucgcccgg

SEQ ID NO: 1154954 - RNA, 20 nt, Mycobacterium bovis subsp bovis AF2122/97
cuccggaaucgcccgggcgg

SEQ ID NO: 1154955 - RNA, 20 nt, Mycobacterium bovis subsp bovis AF2122/97
cuccggacccacccgcaccg

SEQ ID NO: 1154956 - RNA, 22 nt, Mycobacterium bovis subsp bovis AF2122/97
cuccggacccacccgcaccgcc

SEQ ID NO: 1154957 - RNA, 21 nt, Mycobacterium bovis subsp bovis AF2122/97
cuccggagcccacacgcucac

SEQ ID NO: 1154958 - RNA, 23 nt, Mycobacterium bovis subsp bovis AF2122/97
cuccggcaccaacgccaccgucg

SEQ ID NO: 1154959 - RNA, 14 nt, Mycobacterium bovis subsp bovis AF2122/97
cuccggcaccggca

SEQ ID NO: 1154960 - RNA, 23 nt, Mycobacterium bovis subsp bovis AF2122/97
cuccggcaccuccagcaccaccg

SEQ ID NO: 1154961 - RNA, 23 nt, Mycobacterium bovis subsp bovis AF2122/97
cuccggauugcuguacugcggug

SEQ ID NO: 1154962 - RNA, 16 nt, Mycobacterium bovis subsp bovis AF2122/97
cuccggcaacagcacc

SEQ ID NO: 1154963 - RNA, 16 nt, Mycobacterium bovis subsp bovis AF2122/97
cuccggcaagcacacc

SEQ ID NO: 1154964 - RNA, 20 nt, Mycobacterium bovis subsp bovis AF2122/97
cuccggcaagcacaccgcca

SEQ ID NO: 1154965 - RNA, 23 nt, Mycobacterium bovis subsp bovis AF2122/97
cuccggcaagcacaccgccagcg

SEQ ID NO: 1154966 - RNA, 17 nt, Mycobacterium bovis subsp bovis AF2122/97
cuccgggaauggcgacc

SEQ ID NO: 1154967 - RNA, 18 nt, Mycobacterium bovis subsp bovis AF2122/97
cuccgggaauggcgacca

SEQ ID NO: 1154968 - RNA, 14 nt, Mycobacterium bovis subsp bovis AF2122/97
cuccgggaccaggc

SEQ ID NO: 1154969 - RNA, 15 nt, Mycobacterium bovis subsp bovis AF2122/97
cuccggcagcagcaa

SEQ ID NO: 1154970 - RNA, 16 nt, Mycobacterium bovis subsp bovis AF2122/97
cuccggcagcagcaaa

SEQ ID NO: 1154971 - RNA, 21 nt, Mycobacterium bovis subsp bovis AF2122/97
cucccagugagcaugcgacgu

SEQ ID NO: 1154972 - RNA, 20 nt, Mycobacterium bovis subsp bovis AF2122/97
cucccaucccaugucgagga

SEQ ID NO: 1154973 - RNA, 15 nt, Mycobacterium bovis subsp bovis AF2122/97
cucccaggccgccgc

SEQ ID NO: 1154974 - RNA, 17 nt, Mycobacterium bovis subsp bovis AF2122/97
cucccaggcguuuggcg

SEQ ID NO: 1154975 - RNA, 16 nt, Mycobacterium bovis subsp bovis AF2122/97
cucccagggcucggcg

SEQ ID NO: 1154976 - RNA, 21 nt, Mycobacterium bovis subsp bovis AF2122/97
cucccagggcucggcggcccg

SEQ ID NO: 1154977 - RNA, 19 nt, Mycobacterium bovis subsp bovis AF2122/97
cuccauggcauugcuccgg

SEQ ID NO: 1154978 - RNA, 22 nt, Mycobacterium bovis subsp bovis AF2122/97
cucccacagguagaccgucucc

SEQ ID NO: 1154979 - RNA, 20 nt, Mycobacterium bovis subsp bovis AF2122/97
cucccacgccgccguugccg

SEQ ID NO: 1154980 - RNA, 18 nt, Mycobacterium bovis subsp bovis AF2122/97
cucccacucccgccccgc

SEQ ID NO: 1154981 - RNA, 22 nt, Mycobacterium bovis subsp bovis AF2122/97
cucccagaacgccguccacgcc

SEQ ID NO: 1154982 - RNA, 16 nt, Mycobacterium bovis subsp bovis AF2122/97
cucccagccaacccgu

SEQ ID NO: 1154983 - RNA, 21 nt, Mycobacterium bovis subsp bovis AF2122/97
cuccaugcggaauuugcuugg

SEQ ID NO: 1154984 - RNA, 13 nt, Mycobacterium bovis subsp bovis AF2122/97
cuccauguuggcg

SEQ ID NO: 1154985 - RNA, 24 nt, Mycobacterium bovis subsp bovis AF2122/97
cuccguuguccagcgcgacgucca

SEQ ID NO: 1154986 - RNA, 13 nt, Mycobacterium bovis subsp bovis AF2122/97
cuccucagccgcc

SEQ ID NO: 1154987 - RNA, 15 nt, Mycobacterium bovis subsp bovis AF2122/97
cuccuaucugccggu

SEQ ID NO: 1154988 - RNA, 21 nt, Mycobacterium bovis subsp bovis AF2122/97
cuccuauggcaagcggccgcg

SEQ ID NO: 1154989 - RNA, 15 nt, Mycobacterium bovis subsp bovis AF2122/97
cuccgguaggcgaga

SEQ ID NO: 1154990 - RNA, 14 nt, Mycobacterium bovis subsp bovis AF2122/97
cuccgguaucggcg

SEQ ID NO: 1154991 - RNA, 14 nt, Mycobacterium bovis subsp bovis AF2122/97
cuccguugccccca

SEQ ID NO: 1154992 - RNA, 20 nt, Mycobacterium bovis subsp bovis AF2122/97
cuccguugcccccauugccg

SEQ ID NO: 1154993 - RNA, 23 nt, Mycobacterium bovis subsp bovis AF2122/97
cuccuccgguaucggcgaccagc

SEQ ID NO: 1154994 - RNA, 14 nt, Mycobacterium bovis subsp bovis AF2122/97
cuccuccggcacca

SEQ ID NO: 1154995 - RNA, 15 nt, Mycobacterium bovis subsp bovis AF2122/97
cuccuccccgaccgc

SEQ ID NO: 1154996 - RNA, 14 nt, Mycobacterium bovis subsp bovis AF2122/97
cuccgggucgacga

SEQ ID NO: 1154997 - RNA, 18 nt, Mycobacterium bovis subsp bovis AF2122/97
cuccgggucgaugucggg

SEQ ID NO: 1154998 - RNA, 19 nt, Mycobacterium bovis subsp bovis AF2122/97
cuccgggucgacgacgucg

SEQ ID NO: 1154999 - RNA, 16 nt, Mycobacterium bovis subsp bovis AF2122/97
cuccggguuggcgacg

SEQ ID NO: 1155000 - RNA, 17 nt, Mycobacterium bovis subsp bovis AF2122/97
cuccggguuggcgacga

SEQ ID NO: 1155001 - RNA, 19 nt, Mycobacterium bovis subsp bovis AF2122/97
cuccggguauggcggcgac

SEQ ID NO: 1155002 - RNA, 22 nt, Mycobacterium bovis subsp bovis AF2122/97
cuccgggcucggcgucgccgcc

SEQ ID NO: 1155003 - RNA, 14 nt, Mycobacterium bovis subsp bovis AF2122/97
cuccgggaugucga

SEQ ID NO: 1155004 - RNA, 18 nt, Mycobacterium bovis subsp bovis AF2122/97
cuccgggcccaucgcccg

SEQ ID NO: 1155005 - RNA, 19 nt, Mycobacterium bovis subsp bovis AF2122/97
cuccgggcccaucgcccgg

SEQ ID NO: 1155006 - RNA, 20 nt, Mycobacterium bovis subsp bovis AF2122/97
cuccuggcggguggcgauga

SEQ ID NO: 1155007 - RNA, 16 nt, Mycobacterium bovis subsp bovis AF2122/97
cuccuugaggucaccc

SEQ ID NO: 1155008 - RNA, 19 nt, Mycobacterium bovis subsp bovis AF2122/97
cuccugugcggagccgcca

SEQ ID NO: 1155009 - RNA, 20 nt, Mycobacterium bovis subsp bovis AF2122/97
cuccucgacgagucggcggg

SEQ ID NO: 1155010 - RNA, 18 nt, Mycobacterium bovis subsp bovis AF2122/97
cuccuccuugagccgggc

SEQ ID NO: 1155011 - RNA, 16 nt, Mycobacterium bovis subsp bovis AF2122/97
cuaucgcagaacggac

SEQ ID NO: 1155012 - RNA, 15 nt, Mycobacterium bovis subsp bovis AF2122/97
cuauccggcggccag

SEQ ID NO: 1155013 - RNA, 16 nt, Mycobacterium bovis subsp bovis AF2122/97
cuaucggcgaacccgc

SEQ ID NO: 1155014 - RNA, 20 nt, Mycobacterium bovis subsp bovis AF2122/97
cuaucguggcggcgucgaca

SEQ ID NO: 1155015 - RNA, 18 nt, Mycobacterium bovis subsp bovis AF2122/97
cuaucguuaucgacacca

SEQ ID NO: 1155016 - RNA, 14 nt, Mycobacterium bovis subsp bovis AF2122/97
cuaugcugcccggc

SEQ ID NO: 1155017 - RNA, 20 nt, Mycobacterium bovis subsp bovis AF2122/97
cuaugcuggcgcagcgccau

SEQ ID NO: 1155018 - RNA, 22 nt, Mycobacterium bovis subsp bovis AF2122/97
cuauggcggcuucgacgucggc

SEQ ID NO: 1155019 - RNA, 20 nt, Mycobacterium bovis subsp bovis AF2122/97
cuaugggucguugucggggu

SEQ ID NO: 1155020 - RNA, 23 nt, Mycobacterium bovis subsp bovis AF2122/97
cuauggugccggugauggccgac

SEQ ID NO: 1155021 - RNA, 17 nt, Mycobacterium bovis subsp bovis AF2122/97
cuauggucaaccgcgcc

SEQ ID NO: 1155022 - RNA, 17 nt, Mycobacterium bovis subsp bovis AF2122/97
cuaugucauagcgcacc

SEQ ID NO: 1155023 - RNA, 23 nt, Mycobacterium bovis subsp bovis AF2122/97
cuauuccgaauuaccuugcgguu

SEQ ID NO: 1155024 - RNA, 20 nt, Mycobacterium bovis subsp bovis AF2122/97
cuauucgccagcgccggaug

SEQ ID NO: 1155025 - RNA, 19 nt, Mycobacterium bovis subsp bovis AF2122/97
cuauugcuauuccgcggca

SEQ ID NO: 1155026 - RNA, 21 nt, Mycobacterium bovis subsp bovis AF2122/97
cuauuucgcggauuucucgcc

SEQ ID NO: 1155027 - RNA, 20 nt, Mycobacterium bovis subsp bovis AF2122/97
cuauuggucgcucgcgguca

SEQ ID NO: 1155028 - RNA, 14 nt, Mycobacterium bovis subsp bovis AF2122/97
cucaacaccagcaa

SEQ ID NO: 1155029 - RNA, 20 nt, Mycobacterium bovis subsp bovis AF2122/97
cucaacaccaggccguccuc

SEQ ID NO: 1155030 - RNA, 24 nt, Mycobacterium bovis subsp bovis AF2122/97
cucaaccagcagacgccguagccg

SEQ ID NO: 1155031 - RNA, 19 nt, Mycobacterium bovis subsp bovis AF2122/97
cucaaccaccucgccaaca

SEQ ID NO: 1155032 - RNA, 22 nt, Mycobacterium bovis subsp bovis AF2122/97
cucaacgacaccauaggccgac

SEQ ID NO: 1155033 - RNA, 20 nt, Mycobacterium bovis subsp bovis AF2122/97
cucaacgggaccgaucuugg

SEQ ID NO: 1155034 - RNA, 13 nt, Mycobacterium bovis subsp bovis AF2122/97
cucaacggcggca

SEQ ID NO: 1155035 - RNA, 16 nt, Mycobacterium bovis subsp bovis AF2122/97
cucaacggcggcaacg

SEQ ID NO: 1155036 - RNA, 14 nt, Mycobacterium bovis subsp bovis AF2122/97
cucaacgggccgca

SEQ ID NO: 1155037 - RNA, 16 nt, Mycobacterium bovis subsp bovis AF2122/97
cucaagcaauggugcg

SEQ ID NO: 1155038 - RNA, 20 nt, Mycobacterium bovis subsp bovis AF2122/97
cucaagcaauggugcggucu

SEQ ID NO: 1155039 - RNA, 18 nt, Mycobacterium bovis subsp bovis AF2122/97
cucaaguugggcguucag

SEQ ID NO: 1155040 - RNA, 18 nt, Mycobacterium bovis subsp bovis AF2122/97
cucaagcgcgucgucacg

SEQ ID NO: 1155041 - RNA, 19 nt, Mycobacterium bovis subsp bovis AF2122/97
cucaagucucccggccgca

SEQ ID NO: 1155042 - RNA, 20 nt, Mycobacterium bovis subsp bovis AF2122/97
cguugccgaucugcucgccg

SEQ ID NO: 1155043 - RNA, 22 nt, Mycobacterium bovis subsp bovis AF2122/97
cguugccgaucugcucgccgag

SEQ ID NO: 1155044 - RNA, 15 nt, Mycobacterium bovis subsp bovis AF2122/97
cguugccgccaucac

SEQ ID NO: 1155045 - RNA, 18 nt, Mycobacterium bovis subsp bovis AF2122/97
cguugccgccaucaccgc

SEQ ID NO: 1155046 - RNA, 14 nt, Mycobacterium bovis subsp bovis AF2122/97
cguugccgcccacu

SEQ ID NO: 1155047 - RNA, 12 nt, Mycobacterium bovis subsp bovis AF2122/97
cguugccgccgc

SEQ ID NO: 1155048 - RNA, 18 nt, Mycobacterium bovis subsp bovis AF2122/97
cguugccgccgccuccgc

SEQ ID NO: 1155049 - RNA, 22 nt, Mycobacterium bovis subsp bovis AF2122/97
cguugccgccgccuccgccgag

SEQ ID NO: 1155050 - RNA, 14 nt, Mycobacterium bovis subsp bovis AF2122/97
cguugccgccggcg

SEQ ID NO: 1155051 - RNA, 18 nt, Mycobacterium bovis subsp bovis AF2122/97
cguugccgccggcgccgc

SEQ ID NO: 1155052 - RNA, 20 nt, Mycobacterium bovis subsp bovis AF2122/97
cguugccgccggcgccgccg

SEQ ID NO: 1155053 - RNA, 22 nt, Mycobacterium bovis subsp bovis AF2122/97
cguugccgccggugccacccuu

SEQ ID NO: 1155054 - RNA, 12 nt, Mycobacterium bovis subsp bovis AF2122/97
cguugccgccgu

SEQ ID NO: 1155055 - RNA, 16 nt, Mycobacterium bovis subsp bovis AF2122/97
cguugccgccgucacc

SEQ ID NO: 1155056 - RNA, 15 nt, Mycobacterium bovis subsp bovis AF2122/97
cguugccgccguccc

SEQ ID NO: 1155057 - RNA, 23 nt, Mycobacterium bovis subsp bovis AF2122/97
cguugccgccaucaccgccguua

SEQ ID NO: 1155058 - RNA, 21 nt, Mycobacterium bovis subsp bovis AF2122/97
cguugccgccguuaccgagcc

SEQ ID NO: 1155059 - RNA, 17 nt, Mycobacterium bovis subsp bovis AF2122/97
cguugccggucgcaugg

SEQ ID NO: 1155060 - RNA, 20 nt, Mycobacterium bovis subsp bovis AF2122/97
cguugccggucgcauggucg

SEQ ID NO: 1155061 - RNA, 16 nt, Mycobacterium bovis subsp bovis AF2122/97
cguugccggugccgcc

SEQ ID NO: 1155062 - RNA, 14 nt, Mycobacterium bovis subsp bovis AF2122/97
cguugccggaguug

SEQ ID NO: 1155063 - RNA, 20 nt, Mycobacterium bovis subsp bovis AF2122/97
cguugccggaguugucgacg

SEQ ID NO: 1155064 - RNA, 18 nt, Mycobacterium bovis subsp bovis AF2122/97
cguugccggugccgccgc

SEQ ID NO: 1155065 - RNA, 19 nt, Mycobacterium bovis subsp bovis AF2122/97
cguugccggugccgccgcg

SEQ ID NO: 1155066 - RNA, 20 nt, Mycobacterium bovis subsp bovis AF2122/97
cguugccggugccgccgcgg

SEQ ID NO: 1155067 - RNA, 18 nt, Mycobacterium bovis subsp bovis AF2122/97
cguugccggcguugccgc

SEQ ID NO: 1155068 - RNA, 20 nt, Mycobacterium bovis subsp bovis AF2122/97
cguugccggcguugccgccg

SEQ ID NO: 1155069 - RNA, 15 nt, Mycobacterium bovis subsp bovis AF2122/97
cguugccgcggucgg

SEQ ID NO: 1155070 - RNA, 20 nt, Mycobacterium bovis subsp bovis AF2122/97
cguugccgcggucggcgacg

SEQ ID NO: 1155071 - RNA, 17 nt, Mycobacterium bovis subsp bovis AF2122/97
cguugccgucggugaug

SEQ ID NO: 1155072 - RNA, 15 nt, Mycobacterium bovis subsp bovis AF2122/97
cguugccgucgucgc

SEQ ID NO: 1155073 - RNA, 15 nt, Mycobacterium bovis subsp bovis AF2122/97
cguugccucgcgacg

SEQ ID NO: 1155074 - RNA, 17 nt, Mycobacterium bovis subsp bovis AF2122/97
cguugccucgcgacgag

SEQ ID NO: 1155075 - RNA, 22 nt, Mycobacterium bovis subsp bovis AF2122/97
cuacggggaucuauuggaugcg

SEQ ID NO: 1155076 - RNA, 15 nt, Mycobacterium bovis subsp bovis AF2122/97
cuacggugcccugca

SEQ ID NO: 1155077 - RNA, 22 nt, Mycobacterium bovis subsp bovis AF2122/97
cuacggugcccugcauaggcgc

SEQ ID NO: 1155078 - RNA, 21 nt, Mycobacterium bovis subsp bovis AF2122/97
cuacgucggcucgucgcucga

SEQ ID NO: 1155079 - RNA, 12 nt, Mycobacterium bovis subsp bovis AF2122/97
cuacucgcggcc

SEQ ID NO: 1155080 - RNA, 20 nt, Mycobacterium bovis subsp bovis AF2122/97
cuacucgcggccggcgucgg

SEQ ID NO: 1155081 - RNA, 19 nt, Mycobacterium bovis subsp bovis AF2122/97
cuacuccaacugaucccgu

SEQ ID NO: 1155082 - RNA, 13 nt, Mycobacterium bovis subsp bovis AF2122/97
cuacucccccgcg

SEQ ID NO: 1155083 - RNA, 18 nt, Mycobacterium bovis subsp bovis AF2122/97
cuagcagggugccggcgc

SEQ ID NO: 1155084 - RNA, 22 nt, Mycobacterium bovis subsp bovis AF2122/97
cuagccagggaucagccgugcg

SEQ ID NO: 1155085 - RNA, 14 nt, Mycobacterium bovis subsp bovis AF2122/97
cuagcaccgcgccg

SEQ ID NO: 1155086 - RNA, 20 nt, Mycobacterium bovis subsp bovis AF2122/97
cuagcagagacaugccggcg

SEQ ID NO: 1155087 - RNA, 15 nt, Mycobacterium bovis subsp bovis AF2122/97
cuagcagcgggcugc

SEQ ID NO: 1155088 - RNA, 23 nt, Mycobacterium bovis subsp bovis AF2122/97
cuagcccgguaucgucccggcga

SEQ ID NO: 1155089 - RNA, 23 nt, Mycobacterium bovis subsp bovis AF2122/97
cuagccagggaucagccgugcgg

SEQ ID NO: 1155090 - RNA, 12 nt, Mycobacterium bovis subsp bovis AF2122/97
cuagcccaccac

SEQ ID NO: 1155091 - RNA, 20 nt, Mycobacterium bovis subsp bovis AF2122/97
cuagauauggaccgccgccg

SEQ ID NO: 1155092 - RNA, 16 nt, Mycobacterium bovis subsp bovis AF2122/97
cuagaucgccgagcgu

SEQ ID NO: 1155093 - RNA, 13 nt, Mycobacterium bovis subsp bovis AF2122/97
cuagcaccgcgcc

SEQ ID NO: 1155094 - RNA, 21 nt, Mycobacterium bovis subsp bovis AF2122/97
cuagaucgucgucaacccggu

SEQ ID NO: 1155095 - RNA, 17 nt, Mycobacterium bovis subsp bovis AF2122/97
cuagcgagccggcgccg

SEQ ID NO: 1155096 - RNA, 16 nt, Mycobacterium bovis subsp bovis AF2122/97
cuagccaacgagcgcg

SEQ ID NO: 1155097 - RNA, 14 nt, Mycobacterium bovis subsp bovis AF2122/97
cuagcccgaccggu

SEQ ID NO: 1155098 - RNA, 19 nt, Mycobacterium bovis subsp bovis AF2122/97
cuagccgacagcucaucga

SEQ ID NO: 1155099 - RNA, 14 nt, Mycobacterium bovis subsp bovis AF2122/97
cuagccgcggcacc

SEQ ID NO: 1155100 - RNA, 16 nt, Mycobacterium bovis subsp bovis AF2122/97
cuagccgcggcaccgc

SEQ ID NO: 1155101 - RNA, 22 nt, Mycobacterium bovis subsp bovis AF2122/97
cuagccggcgcgccccaccgcg

SEQ ID NO: 1155102 - RNA, 17 nt, Mycobacterium bovis subsp bovis AF2122/97
cuagccguucggcugcc

SEQ ID NO: 1155103 - RNA, 23 nt, Mycobacterium bovis subsp bovis AF2122/97
cuauaucccgccccgggccacca

SEQ ID NO: 1155104 - RNA, 23 nt, Mycobacterium bovis subsp bovis AF2122/97
cucagcccggcacugaccgcgau

SEQ ID NO: 1155105 - RNA, 19 nt, Mycobacterium bovis subsp bovis AF2122/97
cucagcccggccagccgca

SEQ ID NO: 1155106 - RNA, 12 nt, Mycobacterium bovis subsp bovis AF2122/97
cucagccaccgc

SEQ ID NO: 1155107 - RNA, 13 nt, Mycobacterium bovis subsp bovis AF2122/97
cucagccaccgcg

SEQ ID NO: 1155108 - RNA, 22 nt, Mycobacterium bovis subsp bovis AF2122/97
cucagccaccgcggucagcucg

SEQ ID NO: 1155109 - RNA, 22 nt, Mycobacterium bovis subsp bovis AF2122/97
cucagccaccgggcgugcggcg

SEQ ID NO: 1155110 - RNA, 14 nt, Mycobacterium bovis subsp bovis AF2122/97
cucagcuccggcga

SEQ ID NO: 1155111 - RNA, 13 nt, Mycobacterium bovis subsp bovis AF2122/97
cucagcgguggcg

SEQ ID NO: 1155112 - RNA, 16 nt, Mycobacterium bovis subsp bovis AF2122/97
cucagcgguggcgugg

SEQ ID NO: 1155113 - RNA, 17 nt, Mycobacterium bovis subsp bovis AF2122/97
cucagcagcgccgcgcg

SEQ ID NO: 1155114 - RNA, 19 nt, Mycobacterium bovis subsp bovis AF2122/97
cucagcaccgcuggcagcg

SEQ ID NO: 1155115 - RNA, 15 nt, Mycobacterium bovis subsp bovis AF2122/97
cucagacgacgaucg

SEQ ID NO: 1155116 - RNA, 15 nt, Mycobacterium bovis subsp bovis AF2122/97
cucacgcuccgccgg

SEQ ID NO: 1155117 - RNA, 18 nt, Mycobacterium bovis subsp bovis AF2122/97
cucacggacgcugggcgg

SEQ ID NO: 1155118 - RNA, 12 nt, Mycobacterium bovis subsp bovis AF2122/97
cucacggcggcg

SEQ ID NO: 1155119 - RNA, 20 nt, Mycobacterium bovis subsp bovis AF2122/97
cucacgggcgaucgugcgga

SEQ ID NO: 1155120 - RNA, 16 nt, Mycobacterium bovis subsp bovis AF2122/97
cucacuacccgcaacg

SEQ ID NO: 1155121 - RNA, 19 nt, Mycobacterium bovis subsp bovis AF2122/97
cucacgugcccgcgcggcg

SEQ ID NO: 1155122 - RNA, 20 nt, Mycobacterium bovis subsp bovis AF2122/97
cucacgugcccgcgcggcgc

SEQ ID NO: 1155123 - RNA, 22 nt, Mycobacterium bovis subsp bovis AF2122/97
cucacguggacugaccucguca

SEQ ID NO: 1155124 - RNA, 14 nt, Mycobacterium bovis subsp bovis AF2122/97
cucacugcggcgcc

SEQ ID NO: 1155125 - RNA, 16 nt, Mycobacterium bovis subsp bovis AF2122/97
cucacuucacgccgcc

SEQ ID NO: 1155126 - RNA, 19 nt, Mycobacterium bovis subsp bovis AF2122/97
cucaccgaucucgaccagc

SEQ ID NO: 1155127 - RNA, 20 nt, Mycobacterium bovis subsp bovis AF2122/97
cucaccgaucccgcggccgg

SEQ ID NO: 1155128 - RNA, 18 nt, Mycobacterium bovis subsp bovis AF2122/97
cucaccgaucucgaccag

SEQ ID NO: 1155129 - RNA, 15 nt, Mycobacterium bovis subsp bovis AF2122/97
cucacccggucgcac

SEQ ID NO: 1155130 - RNA, 22 nt, Mycobacterium bovis subsp bovis AF2122/97
cucaccggguuggaagccgcac

SEQ ID NO: 1155131 - RNA, 11 nt, Mycobacterium bovis subsp bovis AF2122/97
cucaccgccgc

SEQ ID NO: 1155132 - RNA, 20 nt, Mycobacterium bovis subsp bovis AF2122/97
cucaccggcuggugccaacu

SEQ ID NO: 1155133 - RNA, 19 nt, Mycobacterium bovis subsp bovis AF2122/97
cucaccgggcccgacgacg

SEQ ID NO: 1155134 - RNA, 20 nt, Mycobacterium bovis subsp bovis AF2122/97
cucaccgggcccgacgacga

SEQ ID NO: 1155135 - RNA, 12 nt, Mycobacterium bovis subsp bovis AF2122/97
cucaccggcgcc

SEQ ID NO: 1155136 - RNA, 13 nt, Mycobacterium bovis subsp bovis AF2122/97
cucaccggcgcgg

SEQ ID NO: 1155137 - RNA, 16 nt, Mycobacterium bovis subsp bovis AF2122/97
cucaccgccgcuaccg

SEQ ID NO: 1155138 - RNA, 17 nt, Mycobacterium bovis subsp bovis AF2122/97
cucaccgccgcuaccgc

SEQ ID NO: 1155139 - RNA, 22 nt, Mycobacterium bovis subsp bovis AF2122/97
cucaccgucgggguaauacgcg

SEQ ID NO: 1155140 - RNA, 18 nt, Mycobacterium bovis subsp bovis AF2122/97
cucaccgaaacgaugcgg

SEQ ID NO: 1155141 - RNA, 19 nt, Mycobacterium bovis subsp bovis AF2122/97
cucacgccaaguccgcuca

SEQ ID NO: 1155142 - RNA, 14 nt, Mycobacterium bovis subsp bovis AF2122/97
cucacgagcaaacc

SEQ ID NO: 1155143 - RNA, 16 nt, Mycobacterium bovis subsp bovis AF2122/97
cucacgagcggcggug

SEQ ID NO: 1155144 - RNA, 20 nt, Mycobacterium bovis subsp bovis AF2122/97
cucacgaggcacaaucaccg

SEQ ID NO: 1155145 - RNA, 16 nt, Mycobacterium bovis subsp bovis AF2122/97
cucacccaggcgccga

SEQ ID NO: 1155146 - RNA, 20 nt, Mycobacterium bovis subsp bovis AF2122/97
cucacccaggcgccgauguc

SEQ ID NO: 1155147 - RNA, 12 nt, Mycobacterium bovis subsp bovis AF2122/97
cucacccgcccg

SEQ ID NO: 1155148 - RNA, 19 nt, Mycobacterium bovis subsp bovis AF2122/97
cucacccgcccggaacggg

SEQ ID NO: 1155149 - RNA, 18 nt, Mycobacterium bovis subsp bovis AF2122/97
cucaccacccagauugcc

SEQ ID NO: 1155150 - RNA, 20 nt, Mycobacterium bovis subsp bovis AF2122/97
cucaccaggcgagccggcgc

SEQ ID NO: 1155151 - RNA, 20 nt, Mycobacterium bovis subsp bovis AF2122/97
cucaccaaucugcgggccgg

SEQ ID NO: 1155152 - RNA, 13 nt, Mycobacterium bovis subsp bovis AF2122/97
cucaccacgucga

SEQ ID NO: 1155153 - RNA, 20 nt, Mycobacterium bovis subsp bovis AF2122/97
cucaccacgucgaccgaacc

SEQ ID NO: 1155154 - RNA, 22 nt, Mycobacterium bovis subsp bovis AF2122/97
cucacauaagcgaggaucucgg

SEQ ID NO: 1155155 - RNA, 22 nt, Mycobacterium bovis subsp bovis AF2122/97
cucacaugcccggacgauggcg

SEQ ID NO: 1155156 - RNA, 21 nt, Mycobacterium bovis subsp bovis AF2122/97
cucacaugugcgcgucgcgcg

SEQ ID NO: 1155157 - RNA, 17 nt, Mycobacterium bovis subsp bovis AF2122/97
cucaccaaggucggcga

SEQ ID NO: 1155158 - RNA, 17 nt, Mycobacterium bovis subsp bovis AF2122/97
cuccaggggcuggugcu

SEQ ID NO: 1155159 - RNA, 14 nt, Mycobacterium bovis subsp bovis AF2122/97
cuccaggcgccacc

SEQ ID NO: 1155160 - RNA, 15 nt, Mycobacterium bovis subsp bovis AF2122/97
cuccaggcgccaccc

SEQ ID NO: 1155161 - RNA, 17 nt, Mycobacterium bovis subsp bovis AF2122/97
cuccaggccuaguccgg

SEQ ID NO: 1155162 - RNA, 23 nt, Mycobacterium bovis subsp bovis AF2122/97
cuccaguagccggugccggcgca

SEQ ID NO: 1155163 - RNA, 19 nt, Mycobacterium bovis subsp bovis AF2122/97
cuccaucaccacaccggca

SEQ ID NO: 1155164 - RNA, 15 nt, Mycobacterium bovis subsp bovis AF2122/97
cuccagugcggccuu

SEQ ID NO: 1155165 - RNA, 16 nt, Mycobacterium bovis subsp bovis AF2122/97
cuccaguggcgccagg

SEQ ID NO: 1155166 - RNA, 17 nt, Mycobacterium bovis subsp bovis AF2122/97
cuccaguacgguccggc

SEQ ID NO: 1155167 - RNA, 17 nt, Mycobacterium bovis subsp bovis AF2122/97
cuccaguagccggugcc

SEQ ID NO: 1155168 - RNA, 21 nt, Mycobacterium bovis subsp bovis AF2122/97
cuccaguagccggugccggcg

SEQ ID NO: 1155169 - RNA, 13 nt, Mycobacterium bovis subsp bovis AF2122/97
cuccagcucggcg

SEQ ID NO: 1155170 - RNA, 14 nt, Mycobacterium bovis subsp bovis AF2122/97
cuccagcucggcca

SEQ ID NO: 1155171 - RNA, 17 nt, Mycobacterium bovis subsp bovis AF2122/97
cuccagcugagcggccg

SEQ ID NO: 1155172 - RNA, 20 nt, Mycobacterium bovis subsp bovis AF2122/97
cuccagcugagcggccggca

SEQ ID NO: 1155173 - RNA, 18 nt, Mycobacterium bovis subsp bovis AF2122/97
cuccagcugggugaccuc

SEQ ID NO: 1155174 - RNA, 21 nt, Mycobacterium bovis subsp bovis AF2122/97
cuccaggaucucuucucggcu

SEQ ID NO: 1155175 - RNA, 16 nt, Mycobacterium bovis subsp bovis AF2122/97
cuccaggagccgagga

SEQ ID NO: 1155176 - RNA, 15 nt, Mycobacterium bovis subsp bovis AF2122/97
cuccaggaucgccgc

SEQ ID NO: 1155177 - RNA, 19 nt, Mycobacterium bovis subsp bovis AF2122/97
cuccagcgguucggugauc

SEQ ID NO: 1155178 - RNA, 23 nt, Mycobacterium bovis subsp bovis AF2122/97
cuccagcgguucggugaucgggc

SEQ ID NO: 1155179 - RNA, 11 nt, Mycobacterium bovis subsp bovis AF2122/97
cuccagcgcgc

SEQ ID NO: 1155180 - RNA, 18 nt, Mycobacterium bovis subsp bovis AF2122/97
cuccacuuuuccgccggc

SEQ ID NO: 1155181 - RNA, 19 nt, Mycobacterium bovis subsp bovis AF2122/97
cuccacggcgggaacggug

SEQ ID NO: 1155182 - RNA, 15 nt, Mycobacterium bovis subsp bovis AF2122/97
cuccacggcggugcc

SEQ ID NO: 1155183 - RNA, 23 nt, Mycobacterium bovis subsp bovis AF2122/97
cuccacggucaggcguagguccu

SEQ ID NO: 1155184 - RNA, 19 nt, Mycobacterium bovis subsp bovis AF2122/97
cuccacguacgcggcugcg

SEQ ID NO: 1155185 - RNA, 14 nt, Mycobacterium bovis subsp bovis AF2122/97
cuccacguccggcg

SEQ ID NO: 1155186 - RNA, 17 nt, Mycobacterium bovis subsp bovis AF2122/97
cuccacuuucugcgguc

SEQ ID NO: 1155187 - RNA, 18 nt, Mycobacterium bovis subsp bovis AF2122/97
cuccacuuucugcgguca

SEQ ID NO: 1155188 - RNA, 22 nt, Mycobacterium bovis subsp bovis AF2122/97
cuccaacaaugccagcuguugc

SEQ ID NO: 1155189 - RNA, 17 nt, Mycobacterium bovis subsp bovis AF2122/97
cuccaaggcggucacca

SEQ ID NO: 1155190 - RNA, 19 nt, Mycobacterium bovis subsp bovis AF2122/97
cuccaagcaauuccaccgc

SEQ ID NO: 1155191 - RNA, 14 nt, Mycobacterium bovis subsp bovis AF2122/97
cuccaagcccgccg

SEQ ID NO: 1155192 - RNA, 17 nt, Mycobacterium bovis subsp bovis AF2122/97
cuccaauugcggccgcg

SEQ ID NO: 1155193 - RNA, 18 nt, Mycobacterium bovis subsp bovis AF2122/97
cuccacacacugugcucg

SEQ ID NO: 1155194 - RNA, 18 nt, Mycobacterium bovis subsp bovis AF2122/97
cucaggcaaucgcgggcg

SEQ ID NO: 1155195 - RNA, 19 nt, Mycobacterium bovis subsp bovis AF2122/97
cucaggcaaucgcgggcga

SEQ ID NO: 1155196 - RNA, 22 nt, Mycobacterium bovis subsp bovis AF2122/97
cucaggacgaacgcuggcggcg

SEQ ID NO: 1155197 - RNA, 19 nt, Mycobacterium bovis subsp bovis AF2122/97
cucaggcgguaguggcgau

SEQ ID NO: 1155198 - RNA, 19 nt, Mycobacterium bovis subsp bovis AF2122/97
cuccaaaagccucagccgc

SEQ ID NO: 1155199 - RNA, 16 nt, Mycobacterium bovis subsp bovis AF2122/97
cuccaaaaucgcggcc

SEQ ID NO: 1155200 - RNA, 20 nt, Mycobacterium bovis subsp bovis AF2122/97
cuccaaaaucgcggccacac

SEQ ID NO: 1155201 - RNA, 17 nt, Mycobacterium bovis subsp bovis AF2122/97
acgcaccgaaacgccga

SEQ ID NO: 1155202 - RNA, 18 nt, Mycobacterium bovis subsp bovis AF2122/97
acgcaccgaaacgccgac

SEQ ID NO: 1155203 - RNA, 20 nt, Mycobacterium bovis subsp bovis AF2122/97
acgcaccgaugccuugaccg

SEQ ID NO: 1155204 - RNA, 21 nt, Mycobacterium bovis subsp bovis AF2122/97
acgcacgacugugcgccgcag

SEQ ID NO: 1155205 - RNA, 21 nt, Mycobacterium bovis subsp bovis AF2122/97
acgcaccucgguggcugccac

SEQ ID NO: 1155206 - RNA, 14 nt, Mycobacterium bovis subsp bovis AF2122/97
acgcaccugcgcgc

SEQ ID NO: 1155207 - RNA, 11 nt, Mycobacterium bovis subsp bovis AF2122/97
acgcaccgcgg

SEQ ID NO: 1155208 - RNA, 12 nt, Mycobacterium bovis subsp bovis AF2122/97
acgcaccggcgc

SEQ ID NO: 1155209 - RNA, 14 nt, Mycobacterium bovis subsp bovis AF2122/97
acgcaccgguaccg

SEQ ID NO: 1155210 - RNA, 22 nt, Mycobacterium bovis subsp bovis AF2122/97
acgcacgauccgcacccggccg

SEQ ID NO: 1155211 - RNA, 21 nt, Mycobacterium bovis subsp bovis AF2122/97
acgcacgcgguucaccacguc

SEQ ID NO: 1155212 - RNA, 13 nt, Mycobacterium bovis subsp bovis AF2122/97
acgcacggccacc

SEQ ID NO: 1155213 - RNA, 12 nt, Mycobacterium bovis subsp bovis AF2122/97
acgcacccgaau

SEQ ID NO: 1155214 - RNA, 17 nt, Mycobacterium bovis subsp bovis AF2122/97
acgcaccacgagcagcc

SEQ ID NO: 1155215 - RNA, 18 nt, Mycobacterium bovis subsp bovis AF2122/97
acgcacagcccgaugccg

SEQ ID NO: 1155216 - RNA, 18 nt, Mycobacterium bovis subsp bovis AF2122/97
acgcaagcaaauucuggu

SEQ ID NO: 1155217 - RNA, 17 nt, Mycobacterium bovis subsp bovis AF2122/97
acgcaccacaauccacg

SEQ ID NO: 1155218 - RNA, 13 nt, Mycobacterium bovis subsp bovis AF2122/97
acgcacacaccgu

SEQ ID NO: 1155219 - RNA, 21 nt, Mycobacterium bovis subsp bovis AF2122/97
acgcacacaccguaccgacga

SEQ ID NO: 1155220 - RNA, 18 nt, Mycobacterium bovis subsp bovis AF2122/97
acgcacaauacggucagc

SEQ ID NO: 1155221 - RNA, 15 nt, Mycobacterium bovis subsp bovis AF2122/97
acgauucccgcggac

SEQ ID NO: 1155222 - RNA, 14 nt, Mycobacterium bovis subsp bovis AF2122/97
acgauucggcggcc

SEQ ID NO: 1155223 - RNA, 23 nt, Mycobacterium bovis subsp bovis AF2122/97
acgauuugguagcggaucgcggu

SEQ ID NO: 1155224 - RNA, 19 nt, Mycobacterium bovis subsp bovis AF2122/97
acgcaaaaucgcccaauuc

SEQ ID NO: 1155225 - RNA, 16 nt, Mycobacterium bovis subsp bovis AF2122/97
acgcaacgccgauggc

SEQ ID NO: 1155226 - RNA, 22 nt, Mycobacterium bovis subsp bovis AF2122/97
acgcaacggugaucagccaccg

SEQ ID NO: 1155227 - RNA, 20 nt, Mycobacterium bovis subsp bovis AF2122/97
acgcaaaaucgcccaauuuc

SEQ ID NO: 1155228 - RNA, 16 nt, Mycobacterium bovis subsp bovis AF2122/97
acgcaaaaucgcccau

SEQ ID NO: 1155229 - RNA, 15 nt, Mycobacterium bovis subsp bovis AF2122/97
acgcaaagacagcgc

SEQ ID NO: 1155230 - RNA, 14 nt, Mycobacterium bovis subsp bovis AF2122/97
acgauguccuggaa

SEQ ID NO: 1155231 - RNA, 19 nt, Mycobacterium bovis subsp bovis AF2122/97
acgaugugguccaucgcgc

SEQ ID NO: 1155232 - RNA, 17 nt, Mycobacterium bovis subsp bovis AF2122/97
acgaugguggcgaucau

SEQ ID NO: 1155233 - RNA, 17 nt, Mycobacterium bovis subsp bovis AF2122/97
acgaugucgaugccgug

SEQ ID NO: 1155234 - RNA, 14 nt, Mycobacterium bovis subsp bovis AF2122/97
acgauguccucgau

SEQ ID NO: 1155235 - RNA, 16 nt, Mycobacterium bovis subsp bovis AF2122/97
acgaugucgucgauga

SEQ ID NO: 1155236 - RNA, 18 nt, Mycobacterium bovis subsp bovis AF2122/97
acgauggcgucggccagg

SEQ ID NO: 1155237 - RNA, 14 nt, Mycobacterium bovis subsp bovis AF2122/97
acgaucggcggcgc

SEQ ID NO: 1155238 - RNA, 15 nt, Mycobacterium bovis subsp bovis AF2122/97
acgaucggcggcgcg

SEQ ID NO: 1155239 - RNA, 19 nt, Mycobacterium bovis subsp bovis AF2122/97
acgaucggcucacgacugc

SEQ ID NO: 1155240 - RNA, 19 nt, Mycobacterium bovis subsp bovis AF2122/97
acgaugguguaacggcggc

SEQ ID NO: 1155241 - RNA, 19 nt, Mycobacterium bovis subsp bovis AF2122/97
acgaugguguacugcugcu

SEQ ID NO: 1155242 - RNA, 16 nt, Mycobacterium bovis subsp bovis AF2122/97
acgaucgcgccgucgu

SEQ ID NO: 1155243 - RNA, 15 nt, Mycobacterium bovis subsp bovis AF2122/97
acgaucgcggcgggc

SEQ ID NO: 1155244 - RNA, 19 nt, Mycobacterium bovis subsp bovis AF2122/97
acgagucgccgcgggcagc

SEQ ID NO: 1155245 - RNA, 15 nt, Mycobacterium bovis subsp bovis AF2122/97
acgagucgucguccg

SEQ ID NO: 1155246 - RNA, 23 nt, Mycobacterium bovis subsp bovis AF2122/97
acgauaaaugcuucgaccgccgu

SEQ ID NO: 1155247 - RNA, 13 nt, Mycobacterium bovis subsp bovis AF2122/97
acgauagcggccc

SEQ ID NO: 1155248 - RNA, 20 nt, Mycobacterium bovis subsp bovis AF2122/97
acgaucccgugauccgccga

SEQ ID NO: 1155249 - RNA, 22 nt, Mycobacterium bovis subsp bovis AF2122/97
acgaucccgugauccgccgaca

SEQ ID NO: 1155250 - RNA, 14 nt, Mycobacterium bovis subsp bovis AF2122/97
acgauccacggcga

SEQ ID NO: 1155251 - RNA, 12 nt, Mycobacterium bovis subsp bovis AF2122/97
acgaucccgccg

SEQ ID NO: 1155252 - RNA, 14 nt, Mycobacterium bovis subsp bovis AF2122/97
acgauagcggcccg

SEQ ID NO: 1155253 - RNA, 20 nt, Mycobacterium bovis subsp bovis AF2122/97
acgauagcggcccgaucacc

SEQ ID NO: 1155254 - RNA, 17 nt, Mycobacterium bovis subsp bovis AF2122/97
acgauccgcacccggcc

SEQ ID NO: 1155255 - RNA, 20 nt, Mycobacterium bovis subsp bovis AF2122/97
acgauccgcgguagcagcag

SEQ ID NO: 1155256 - RNA, 23 nt, Mycobacterium bovis subsp bovis AF2122/97
acgaucgagcccggagcggucag

SEQ ID NO: 1155257 - RNA, 19 nt, Mycobacterium bovis subsp bovis AF2122/97
acgaucgccaggccgagcc

SEQ ID NO: 1155258 - RNA, 18 nt, Mycobacterium bovis subsp bovis AF2122/97
acgacguugccucgcgac

SEQ ID NO: 1155259 - RNA, 19 nt, Mycobacterium bovis subsp bovis AF2122/97
acgacguggcugcguucgc

SEQ ID NO: 1155260 - RNA, 18 nt, Mycobacterium bovis subsp bovis AF2122/97
acgacucacccacccgca

SEQ ID NO: 1155261 - RNA, 15 nt, Mycobacterium bovis subsp bovis AF2122/97
acgacgucgucgccg

SEQ ID NO: 1155262 - RNA, 20 nt, Mycobacterium bovis subsp bovis AF2122/97
acgacgucgccgccgcgggc

SEQ ID NO: 1155263 - RNA, 15 nt, Mycobacterium bovis subsp bovis AF2122/97
acgacgucggccgca

SEQ ID NO: 1155264 - RNA, 22 nt, Mycobacterium bovis subsp bovis AF2122/97
acgacgucggccgcaucgccca

SEQ ID NO: 1155265 - RNA, 16 nt, Mycobacterium bovis subsp bovis AF2122/97
acgacugugcgccgca

SEQ ID NO: 1155266 - RNA, 15 nt, Mycobacterium bovis subsp bovis AF2122/97
acgacuguggcgccg

SEQ ID NO: 1155267 - RNA, 18 nt, Mycobacterium bovis subsp bovis AF2122/97
acgacuguggcgccgccg

SEQ ID NO: 1155268 - RNA, 20 nt, Mycobacterium bovis subsp bovis AF2122/97
acgacuguggcgccgccggc

SEQ ID NO: 1155269 - RNA, 23 nt, Mycobacterium bovis subsp bovis AF2122/97
acgacucccccggcuccgcaacc

SEQ ID NO: 1155270 - RNA, 15 nt, Mycobacterium bovis subsp bovis AF2122/97
acgacuccggcaagc

SEQ ID NO: 1155271 - RNA, 20 nt, Mycobacterium bovis subsp bovis AF2122/97
acgacuccggcaagcacacc

SEQ ID NO: 1155272 - RNA, 15 nt, Mycobacterium bovis subsp bovis AF2122/97
acgagaagacaccgc

SEQ ID NO: 1155273 - RNA, 17 nt, Mycobacterium bovis subsp bovis AF2122/97
acgacuggacaggucgc

SEQ ID NO: 1155274 - RNA, 18 nt, Mycobacterium bovis subsp bovis AF2122/97
acgaggcgagcggccagu

SEQ ID NO: 1155275 - RNA, 19 nt, Mycobacterium bovis subsp bovis AF2122/97
acgaggauucauggcggca

SEQ ID NO: 1155276 - RNA, 23 nt, Mycobacterium bovis subsp bovis AF2122/97
acgaggccgacgacauugggcgc

SEQ ID NO: 1155277 - RNA, 19 nt, Mycobacterium bovis subsp bovis AF2122/97
acgagacgcaaaaucgccc

SEQ ID NO: 1155278 - RNA, 14 nt, Mycobacterium bovis subsp bovis AF2122/97
acgaggacgucacc

SEQ ID NO: 1155279 - RNA, 18 nt, Mycobacterium bovis subsp bovis AF2122/97
acgagcuguacuugggau

SEQ ID NO: 1155280 - RNA, 15 nt, Mycobacterium bovis subsp bovis AF2122/97
acgagcuuccacgcc

SEQ ID NO: 1155281 - RNA, 16 nt, Mycobacterium bovis subsp bovis AF2122/97
acgagauagcauccgc

SEQ ID NO: 1155282 - RNA, 18 nt, Mycobacterium bovis subsp bovis AF2122/97
acgagacgaaccgccgac

SEQ ID NO: 1155283 - RNA, 15 nt, Mycobacterium bovis subsp bovis AF2122/97
acgagacgacgaccg

SEQ ID NO: 1155284 - RNA, 21 nt, Mycobacterium bovis subsp bovis AF2122/97
acgaggcacaaucaccgccgc

SEQ ID NO: 1155285 - RNA, 22 nt, Mycobacterium bovis subsp bovis AF2122/97
acgaggcguucaccacgaucgc

SEQ ID NO: 1155286 - RNA, 20 nt, Mycobacterium bovis subsp bovis AF2122/97
acgagguagcgcgcaacgua

SEQ ID NO: 1155287 - RNA, 13 nt, Mycobacterium bovis subsp bovis AF2122/97
acgaggucgccgc

SEQ ID NO: 1155288 - RNA, 16 nt, Mycobacterium bovis subsp bovis AF2122/97
acgaggucugcggccg

SEQ ID NO: 1155289 - RNA, 14 nt, Mycobacterium bovis subsp bovis AF2122/97
acgaguagccgguc

SEQ ID NO: 1155290 - RNA, 23 nt, Mycobacterium bovis subsp bovis AF2122/97
acgagguugauuggggccagguu

SEQ ID NO: 1155291 - RNA, 13 nt, Mycobacterium bovis subsp bovis AF2122/97
acgacgccggccu

SEQ ID NO: 1155292 - RNA, 13 nt, Mycobacterium bovis subsp bovis AF2122/97
acgacgccgcggu

SEQ ID NO: 1155293 - RNA, 21 nt, Mycobacterium bovis subsp bovis AF2122/97
acgacgccaugagcgcgccca

SEQ ID NO: 1155294 - RNA, 13 nt, Mycobacterium bovis subsp bovis AF2122/97
acgacgccaccgc

SEQ ID NO: 1155295 - RNA, 16 nt, Mycobacterium bovis subsp bovis AF2122/97
acgacgccgacgauga

SEQ ID NO: 1155296 - RNA, 15 nt, Mycobacterium bovis subsp bovis AF2122/97
acgacgcgacacgcc

SEQ ID NO: 1155297 - RNA, 18 nt, Mycobacterium bovis subsp bovis AF2122/97
acgacgcgacacgccggc

SEQ ID NO: 1155298 - RNA, 21 nt, Mycobacterium bovis subsp bovis AF2122/97
acgacgccgucggacaccgca

SEQ ID NO: 1155299 - RNA, 13 nt, Mycobacterium bovis subsp bovis AF2122/97
acgacggccgaca

SEQ ID NO: 1155300 - RNA, 11 nt, Mycobacterium bovis subsp bovis AF2122/97
acgacggcgac

SEQ ID NO: 1155301 - RNA, 22 nt, Mycobacterium bovis subsp bovis AF2122/97
acgacgggaaccagcggucggc

SEQ ID NO: 1155302 - RNA, 19 nt, Mycobacterium bovis subsp bovis AF2122/97
acgacgguuccgccaccgg

SEQ ID NO: 1155303 - RNA, 22 nt, Mycobacterium bovis subsp bovis AF2122/97
acgacgguuccgccaccggaca

SEQ ID NO: 1155304 - RNA, 18 nt, Mycobacterium bovis subsp bovis AF2122/97
acgacgguccguucgcgc

SEQ ID NO: 1155305 - RNA, 22 nt, Mycobacterium bovis subsp bovis AF2122/97
acgacgguccguucgcgccguu

SEQ ID NO: 1155306 - RNA, 23 nt, Mycobacterium bovis subsp bovis AF2122/97
acgacgggccgaguucgucagcg

SEQ ID NO: 1155307 - RNA, 19 nt, Mycobacterium bovis subsp bovis AF2122/97
acgacguccucgacgauca

SEQ ID NO: 1155308 - RNA, 21 nt, Mycobacterium bovis subsp bovis AF2122/97
acgacguagaugguggucacc

SEQ ID NO: 1155309 - RNA, 15 nt, Mycobacterium bovis subsp bovis AF2122/97
acgacgucgccgccg

SEQ ID NO: 1155310 - RNA, 21 nt, Mycobacterium bovis subsp bovis AF2122/97
acgacggguuggcgucgcuac

SEQ ID NO: 1155311 - RNA, 19 nt, Mycobacterium bovis subsp bovis AF2122/97
acgaccugcucauccaccu

SEQ ID NO: 1155312 - RNA, 17 nt, Mycobacterium bovis subsp bovis AF2122/97
acgaccucuugggcacu

SEQ ID NO: 1155313 - RNA, 14 nt, Mycobacterium bovis subsp bovis AF2122/97
acgaccuccacgcc

SEQ ID NO: 1155314 - RNA, 12 nt, Mycobacterium bovis subsp bovis AF2122/97
acgacgacgaca

SEQ ID NO: 1155315 - RNA, 19 nt, Mycobacterium bovis subsp bovis AF2122/97
acgacgacccgacguagcc

SEQ ID NO: 1155316 - RNA, 20 nt, Mycobacterium bovis subsp bovis AF2122/97
acgacgagggccagcagccg

SEQ ID NO: 1155317 - RNA, 14 nt, Mycobacterium bovis subsp bovis AF2122/97
acgacgccaccgcg

SEQ ID NO: 1155318 - RNA, 16 nt, Mycobacterium bovis subsp bovis AF2122/97
acgacgccaccgcgac

SEQ ID NO: 1155319 - RNA, 19 nt, Mycobacterium bovis subsp bovis AF2122/97
acgacgccaccugacgugc

SEQ ID NO: 1155320 - RNA, 14 nt, Mycobacterium bovis subsp bovis AF2122/97
acgacgcaggaggu

SEQ ID NO: 1155321 - RNA, 22 nt, Mycobacterium bovis subsp bovis AF2122/97
acgacgaucaagccuucgucga

SEQ ID NO: 1155322 - RNA, 16 nt, Mycobacterium bovis subsp bovis AF2122/97
acgacgaugaugccgu

SEQ ID NO: 1155323 - RNA, 17 nt, Mycobacterium bovis subsp bovis AF2122/97
acgacgaugaugccguc

SEQ ID NO: 1155324 - RNA, 17 nt, Mycobacterium bovis subsp bovis AF2122/97
acgacaugagcgccacg

SEQ ID NO: 1155325 - RNA, 19 nt, Mycobacterium bovis subsp bovis AF2122/97
acgacaugagcgccacgcc

SEQ ID NO: 1155326 - RNA, 16 nt, Mycobacterium bovis subsp bovis AF2122/97
acgacaugggcaggcc

SEQ ID NO: 1155327 - RNA, 20 nt, Mycobacterium bovis subsp bovis AF2122/97
acgacaugggcaggccgcgu

SEQ ID NO: 1155328 - RNA, 15 nt, Mycobacterium bovis subsp bovis AF2122/97
acgaccaauagcacg

SEQ ID NO: 1155329 - RNA, 22 nt, Mycobacterium bovis subsp bovis AF2122/97
acgaccaccuucugacgcggcc

SEQ ID NO: 1155330 - RNA, 17 nt, Mycobacterium bovis subsp bovis AF2122/97
acgaccagcagauccag

SEQ ID NO: 1155331 - RNA, 13 nt, Mycobacterium bovis subsp bovis AF2122/97
acgaccagccccg

SEQ ID NO: 1155332 - RNA, 14 nt, Mycobacterium bovis subsp bovis AF2122/97
acgaccagccccgc

SEQ ID NO: 1155333 - RNA, 23 nt, Mycobacterium bovis subsp bovis AF2122/97
acgaccagcugagcuggcagcuc

SEQ ID NO: 1155334 - RNA, 17 nt, Mycobacterium bovis subsp bovis AF2122/97
acgacccaagucgccga

SEQ ID NO: 1155335 - RNA, 12 nt, Mycobacterium bovis subsp bovis AF2122/97
acgacccgggcc

SEQ ID NO: 1155336 - RNA, 17 nt, Mycobacterium bovis subsp bovis AF2122/97
acgacccgaagccgacc

SEQ ID NO: 1155337 - RNA, 22 nt, Mycobacterium bovis subsp bovis AF2122/97
acgaccagguaaugguggcguc

SEQ ID NO: 1155338 - RNA, 13 nt, Mycobacterium bovis subsp bovis AF2122/97
acgaccgccgaua

SEQ ID NO: 1155339 - RNA, 16 nt, Mycobacterium bovis subsp bovis AF2122/97
acgaccgucgcgcugc

SEQ ID NO: 1155340 - RNA, 15 nt, Mycobacterium bovis subsp bovis AF2122/97
acgaccgucggcucc

SEQ ID NO: 1155341 - RNA, 16 nt, Mycobacterium bovis subsp bovis AF2122/97
acgaccgugcugggcg

SEQ ID NO: 1155342 - RNA, 21 nt, Mycobacterium bovis subsp bovis AF2122/97
acgaccgugcugggcgccgcg

SEQ ID NO: 1155343 - RNA, 13 nt, Mycobacterium bovis subsp bovis AF2122/97
acgaccggccaac

SEQ ID NO: 1155344 - RNA, 15 nt, Mycobacterium bovis subsp bovis AF2122/97
acgaccggccaacgc

SEQ ID NO: 1155345 - RNA, 20 nt, Mycobacterium bovis subsp bovis AF2122/97
acgaccggccaacgccgccg

SEQ ID NO: 1155346 - RNA, 22 nt, Mycobacterium bovis subsp bovis AF2122/97
acgaccggccaacgccgccgca

SEQ ID NO: 1155347 - RNA, 13 nt, Mycobacterium bovis subsp bovis AF2122/97
acgacaccgcagc

SEQ ID NO: 1155348 - RNA, 15 nt, Mycobacterium bovis subsp bovis AF2122/97
acgacaccucgaagg

SEQ ID NO: 1155349 - RNA, 13 nt, Mycobacterium bovis subsp bovis AF2122/97
acgacacguugac

SEQ ID NO: 1155350 - RNA, 16 nt, Mycobacterium bovis subsp bovis AF2122/97
acgacaccagaucguu

SEQ ID NO: 1155351 - RNA, 14 nt, Mycobacterium bovis subsp bovis AF2122/97
acgacaucaccacc

SEQ ID NO: 1155352 - RNA, 16 nt, Mycobacterium bovis subsp bovis AF2122/97
acgacaggcgcccaca

SEQ ID NO: 1155353 - RNA, 17 nt, Mycobacterium bovis subsp bovis AF2122/97
acgacagcccgccggcg

SEQ ID NO: 1155354 - RNA, 15 nt, Mycobacterium bovis subsp bovis AF2122/97
acgacaaacggcgac

SEQ ID NO: 1155355 - RNA, 16 nt, Mycobacterium bovis subsp bovis AF2122/97
acgacaacagccagcu

SEQ ID NO: 1155356 - RNA, 19 nt, Mycobacterium bovis subsp bovis AF2122/97
acgacaacaggccgucgau

SEQ ID NO: 1155357 - RNA, 14 nt, Mycobacterium bovis subsp bovis AF2122/97
acgacaaccgagcu

SEQ ID NO: 1155358 - RNA, 17 nt, Mycobacterium bovis subsp bovis AF2122/97
acgacaagugcccggcc

SEQ ID NO: 1155359 - RNA, 20 nt, Mycobacterium bovis subsp bovis AF2122/97
acgacaagugcccggccaac

SEQ ID NO: 1155360 - RNA, 15 nt, Mycobacterium bovis subsp bovis AF2122/97
acgaaugaucguccc

SEQ ID NO: 1155361 - RNA, 24 nt, Mycobacterium bovis subsp bovis AF2122/97
acgaaugggucuuugcccgccacg

SEQ ID NO: 1155362 - RNA, 14 nt, Mycobacterium bovis subsp bovis AF2122/97
acgaaugguaucga

SEQ ID NO: 1155363 - RNA, 16 nt, Mycobacterium bovis subsp bovis AF2122/97
acgaaugucaccccgc

SEQ ID NO: 1155364 - RNA, 17 nt, Mycobacterium bovis subsp bovis AF2122/97
acgaauguccgcagacg

SEQ ID NO: 1155365 - RNA, 13 nt, Mycobacterium bovis subsp bovis AF2122/97
acgaagccggcgc

SEQ ID NO: 1155366 - RNA, 20 nt, Mycobacterium bovis subsp bovis AF2122/97
acgaagcguugaccgcgguc

SEQ ID NO: 1155367 - RNA, 22 nt, Mycobacterium bovis subsp bovis AF2122/97
acgaagggaaggacgcgcagca

SEQ ID NO: 1155368 - RNA, 20 nt, Mycobacterium bovis subsp bovis AF2122/97
acgaagucgacgaacucgcc

SEQ ID NO: 1155369 - RNA, 14 nt, Mycobacterium bovis subsp bovis AF2122/97
acgaaucccgcgcc

SEQ ID NO: 1155370 - RNA, 16 nt, Mycobacterium bovis subsp bovis AF2122/97
acgaaucccccggacg

SEQ ID NO: 1155371 - RNA, 13 nt, Mycobacterium bovis subsp bovis AF2122/97
acgaauccccgac

SEQ ID NO: 1155372 - RNA, 22 nt, Mycobacterium bovis subsp bovis AF2122/97
acgaauaacgcggucggcagcg

SEQ ID NO: 1155373 - RNA, 23 nt, Mycobacterium bovis subsp bovis AF2122/97
accuuggcugggcccgccgucac

SEQ ID NO: 1155374 - RNA, 13 nt, Mycobacterium bovis subsp bovis AF2122/97
accuuguucagca

SEQ ID NO: 1155375 - RNA, 14 nt, Mycobacterium bovis subsp bovis AF2122/97
accuuggccgccgg

SEQ ID NO: 1155376 - RNA, 15 nt, Mycobacterium bovis subsp bovis AF2122/97
accuuggucuucgcc

SEQ ID NO: 1155377 - RNA, 18 nt, Mycobacterium bovis subsp bovis AF2122/97
accuuguugaccaccacc

SEQ ID NO: 1155378 - RNA, 20 nt, Mycobacterium bovis subsp bovis AF2122/97
accugcaagacgccgauccg

SEQ ID NO: 1155379 - RNA, 22 nt, Mycobacterium bovis subsp bovis AF2122/97
accugcaagacgccgauccggu

SEQ ID NO: 1155380 - RNA, 22 nt, Mycobacterium bovis subsp bovis AF2122/97
accuugaugccauacgcaucgu

SEQ ID NO: 1155381 - RNA, 14 nt, Mycobacterium bovis subsp bovis AF2122/97
accuugaucgagca

SEQ ID NO: 1155382 - RNA, 21 nt, Mycobacterium bovis subsp bovis AF2122/97
acgaacuggucucggcugaga

SEQ ID NO: 1155383 - RNA, 20 nt, Mycobacterium bovis subsp bovis AF2122/97
acgaagaucgcgugccacag

SEQ ID NO: 1155384 - RNA, 17 nt, Mycobacterium bovis subsp bovis AF2122/97
acgaagaucuucaccgg

SEQ ID NO: 1155385 - RNA, 17 nt, Mycobacterium bovis subsp bovis AF2122/97
acgaacucggccgggcg

SEQ ID NO: 1155386 - RNA, 23 nt, Mycobacterium bovis subsp bovis AF2122/97
acgaagaacaccuugggcagcuu

SEQ ID NO: 1155387 - RNA, 21 nt, Mycobacterium bovis subsp bovis AF2122/97
acgaacgcgccggucagcaau

SEQ ID NO: 1155388 - RNA, 21 nt, Mycobacterium bovis subsp bovis AF2122/97
acgaacgccgucgacgcggcc

SEQ ID NO: 1155389 - RNA, 17 nt, Mycobacterium bovis subsp bovis AF2122/97
acgaacgaaccgccgcc

SEQ ID NO: 1155390 - RNA, 20 nt, Mycobacterium bovis subsp bovis AF2122/97
acgaacgaguccaacucggc

SEQ ID NO: 1155391 - RNA, 19 nt, Mycobacterium bovis subsp bovis AF2122/97
acgaaccgugcugggcauc

SEQ ID NO: 1155392 - RNA, 15 nt, Mycobacterium bovis subsp bovis AF2122/97
acgaacccguuuugg

SEQ ID NO: 1155393 - RNA, 19 nt, Mycobacterium bovis subsp bovis AF2122/97
acgaacccucagccgcgcc

SEQ ID NO: 1155394 - RNA, 20 nt, Mycobacterium bovis subsp bovis AF2122/97
acgaaccgccgacggcgccc

SEQ ID NO: 1155395 - RNA, 20 nt, Mycobacterium bovis subsp bovis AF2122/97
acgaaccgccgccgccgcgu

SEQ ID NO: 1155396 - RNA, 23 nt, Mycobacterium bovis subsp bovis AF2122/97
acgaacccgacaauggcgccagc

SEQ ID NO: 1155397 - RNA, 22 nt, Mycobacterium bovis subsp bovis AF2122/97
acgaaccagcuugcgccgcagc

SEQ ID NO: 1155398 - RNA, 15 nt, Mycobacterium bovis subsp bovis AF2122/97
acgaacaccccgggc

SEQ ID NO: 1155399 - RNA, 22 nt, Mycobacterium bovis subsp bovis AF2122/97
acgaaauugggcgauucugcgu

SEQ ID NO: 1155400 - RNA, 23 nt, Mycobacterium bovis subsp bovis AF2122/97
acgaacagcgguccagccaccgc

SEQ ID NO: 1155401 - RNA, 15 nt, Mycobacterium bovis subsp bovis AF2122/97
acgaaaucggcggcg

SEQ ID NO: 1155402 - RNA, 22 nt, Mycobacterium bovis subsp bovis AF2122/97
acgaaaagccgcgucgcgaugu

SEQ ID NO: 1155403 - RNA, 16 nt, Mycobacterium bovis subsp bovis AF2122/97
accuuuggccgcgacc

SEQ ID NO: 1155404 - RNA, 17 nt, Mycobacterium bovis subsp bovis AF2122/97
acgaaaaaaucgugcgg

SEQ ID NO: 1155405 - RNA, 14 nt, Mycobacterium bovis subsp bovis AF2122/97
accggggccgucgg

SEQ ID NO: 1155406 - RNA, 21 nt, Mycobacterium bovis subsp bovis AF2122/97
accgggcuggccagcgcgcuc

SEQ ID NO: 1155407 - RNA, 19 nt, Mycobacterium bovis subsp bovis AF2122/97
accggggaagaucucggcc

SEQ ID NO: 1155408 - RNA, 17 nt, Mycobacterium bovis subsp bovis AF2122/97
accggggacgucgacuu

SEQ ID NO: 1155409 - RNA, 14 nt, Mycobacterium bovis subsp bovis AF2122/97
accgggcggcggcg

SEQ ID NO: 1155410 - RNA, 17 nt, Mycobacterium bovis subsp bovis AF2122/97
accgggcggcggcgacu

SEQ ID NO: 1155411 - RNA, 15 nt, Mycobacterium bovis subsp bovis AF2122/97
accgggcgggcuggu

SEQ ID NO: 1155412 - RNA, 21 nt, Mycobacterium bovis subsp bovis AF2122/97
accgggcgugcggcggcccau

SEQ ID NO: 1155413 - RNA, 19 nt, Mycobacterium bovis subsp bovis AF2122/97
accgggucaacgccaucac

SEQ ID NO: 1155414 - RNA, 18 nt, Mycobacterium bovis subsp bovis AF2122/97
accgggucgaucaccgac

SEQ ID NO: 1155415 - RNA, 19 nt, Mycobacterium bovis subsp bovis AF2122/97
accgggucgaugacgccgu

SEQ ID NO: 1155416 - RNA, 21 nt, Mycobacterium bovis subsp bovis AF2122/97
accgggucgcaaccgccgcca

SEQ ID NO: 1155417 - RNA, 21 nt, Mycobacterium bovis subsp bovis AF2122/97
accggguccggcguacgccgu

SEQ ID NO: 1155418 - RNA, 21 nt, Mycobacterium bovis subsp bovis AF2122/97
accggguccggugaacccgau

SEQ ID NO: 1155419 - RNA, 20 nt, Mycobacterium bovis subsp bovis AF2122/97
accgggucgggcaccgcgcg

SEQ ID NO: 1155420 - RNA, 17 nt, Mycobacterium bovis subsp bovis AF2122/97
accggcacccgcacggc

SEQ ID NO: 1155421 - RNA, 19 nt, Mycobacterium bovis subsp bovis AF2122/97
accggcacccgcggcgaac

SEQ ID NO: 1155422 - RNA, 23 nt, Mycobacterium bovis subsp bovis AF2122/97
accggcacccgcuggcgguaagc

SEQ ID NO: 1155423 - RNA, 18 nt, Mycobacterium bovis subsp bovis AF2122/97
accggcacccccgucgcc

SEQ ID NO: 1155424 - RNA, 14 nt, Mycobacterium bovis subsp bovis AF2122/97
accggcaaccgccg

SEQ ID NO: 1155425 - RNA, 18 nt, Mycobacterium bovis subsp bovis AF2122/97
accggcaauaccggcauc

SEQ ID NO: 1155426 - RNA, 13 nt, Mycobacterium bovis subsp bovis AF2122/97
accggcaacaucg

SEQ ID NO: 1155427 - RNA, 15 nt, Mycobacterium bovis subsp bovis AF2122/97
accggcaccggccgu

SEQ ID NO: 1155428 - RNA, 18 nt, Mycobacterium bovis subsp bovis AF2122/97
accgggcgauucgcaauc

SEQ ID NO: 1155429 - RNA, 15 nt, Mycobacterium bovis subsp bovis AF2122/97
accggcacgccggcg

SEQ ID NO: 1155430 - RNA, 17 nt, Mycobacterium bovis subsp bovis AF2122/97
accggcacgccggcggc

SEQ ID NO: 1155431 - RNA, 22 nt, Mycobacterium bovis subsp bovis AF2122/97
accggugcucgucgagcaugcg

SEQ ID NO: 1155432 - RNA, 14 nt, Mycobacterium bovis subsp bovis AF2122/97
accggugccgcccg

SEQ ID NO: 1155433 - RNA, 17 nt, Mycobacterium bovis subsp bovis AF2122/97
accggugccgcccgcgc

SEQ ID NO: 1155434 - RNA, 12 nt, Mycobacterium bovis subsp bovis AF2122/97
accggugccggc

SEQ ID NO: 1155435 - RNA, 16 nt, Mycobacterium bovis subsp bovis AF2122/97
accggugagcgcagcu

SEQ ID NO: 1155436 - RNA, 14 nt, Mycobacterium bovis subsp bovis AF2122/97
accggugaggcguu

SEQ ID NO: 1155437 - RNA, 14 nt, Mycobacterium bovis subsp bovis AF2122/97
accggugacgcaca

SEQ ID NO: 1155438 - RNA, 19 nt, Mycobacterium bovis subsp bovis AF2122/97
accggugacgcacagcagc

SEQ ID NO: 1155439 - RNA, 13 nt, Mycobacterium bovis subsp bovis AF2122/97
accggucugaucg

SEQ ID NO: 1155440 - RNA, 22 nt, Mycobacterium bovis subsp bovis AF2122/97
accggucgucugucucggugcc

SEQ ID NO: 1155441 - RNA, 14 nt, Mycobacterium bovis subsp bovis AF2122/97
accgguggccgguc

SEQ ID NO: 1155442 - RNA, 15 nt, Mycobacterium bovis subsp bovis AF2122/97
accgguggccggucg

SEQ ID NO: 1155443 - RNA, 16 nt, Mycobacterium bovis subsp bovis AF2122/97
accgguggccggucgu

SEQ ID NO: 1155444 - RNA, 21 nt, Mycobacterium bovis subsp bovis AF2122/97
accggugggucugcucagcgc

SEQ ID NO: 1155445 - RNA, 17 nt, Mycobacterium bovis subsp bovis AF2122/97
accggugguagcgacga

SEQ ID NO: 1155446 - RNA, 21 nt, Mycobacterium bovis subsp bovis AF2122/97
accggugcugucgacgucggc

SEQ ID NO: 1155447 - RNA, 12 nt, Mycobacterium bovis subsp bovis AF2122/97
accgguggcacc

SEQ ID NO: 1155448 - RNA, 17 nt, Mycobacterium bovis subsp bovis AF2122/97
accgguggcaccggcgg

SEQ ID NO: 1155449 - RNA, 22 nt, Mycobacterium bovis subsp bovis AF2122/97
accgguggcagccugcugcaca

SEQ ID NO: 1155450 - RNA, 17 nt, Mycobacterium bovis subsp bovis AF2122/97
accgguggccaucgcgc

SEQ ID NO: 1155451 - RNA, 16 nt, Mycobacterium bovis subsp bovis AF2122/97
accgguugcggucauc

SEQ ID NO: 1155452 - RNA, 15 nt, Mycobacterium bovis subsp bovis AF2122/97
accgguucggugagc

SEQ ID NO: 1155453 - RNA, 16 nt, Mycobacterium bovis subsp bovis AF2122/97
accgguaccgccggcu

SEQ ID NO: 1155454 - RNA, 14 nt, Mycobacterium bovis subsp bovis AF2122/97
accgguaccggcga

SEQ ID NO: 1155455 - RNA, 20 nt, Mycobacterium bovis subsp bovis AF2122/97
accgguaccugacagcucac

SEQ ID NO: 1155456 - RNA, 12 nt, Mycobacterium bovis subsp bovis AF2122/97
accgguacccgu

SEQ ID NO: 1155457 - RNA, 22 nt, Mycobacterium bovis subsp bovis AF2122/97
accggguuuuccaucuucaucg

SEQ ID NO: 1155458 - RNA, 15 nt, Mycobacterium bovis subsp bovis AF2122/97
accgguaacgccaac

SEQ ID NO: 1155459 - RNA, 19 nt, Mycobacterium bovis subsp bovis AF2122/97
accgguaacgccaacaccg

SEQ ID NO: 1155460 - RNA, 16 nt, Mycobacterium bovis subsp bovis AF2122/97
accggggaucggggca

SEQ ID NO: 1155461 - RNA, 22 nt, Mycobacterium bovis subsp bovis AF2122/97
accgggugugcgucgagguggc

SEQ ID NO: 1155462 - RNA, 19 nt, Mycobacterium bovis subsp bovis AF2122/97
accggguguggucgguggc

SEQ ID NO: 1155463 - RNA, 19 nt, Mycobacterium bovis subsp bovis AF2122/97
accgggugugcgucgaggu

SEQ ID NO: 1155464 - RNA, 12 nt, Mycobacterium bovis subsp bovis AF2122/97
accggucggcca

SEQ ID NO: 1155465 - RNA, 20 nt, Mycobacterium bovis subsp bovis AF2122/97
accggucccugcgccgucaa

SEQ ID NO: 1155466 - RNA, 21 nt, Mycobacterium bovis subsp bovis AF2122/97
accggucccugcgccgucaac

SEQ ID NO: 1155467 - RNA, 13 nt, Mycobacterium bovis subsp bovis AF2122/97
accggucgaccca

SEQ ID NO: 1155468 - RNA, 13 nt, Mycobacterium bovis subsp bovis AF2122/97
accggucaacgug

SEQ ID NO: 1155469 - RNA, 14 nt, Mycobacterium bovis subsp bovis AF2122/97
accggucacccgug

SEQ ID NO: 1155470 - RNA, 14 nt, Mycobacterium bovis subsp bovis AF2122/97
accggucaccgcgc

SEQ ID NO: 1155471 - RNA, 17 nt, Mycobacterium bovis subsp bovis AF2122/97
accggucaccgcgcagc

SEQ ID NO: 1155472 - RNA, 22 nt, Mycobacterium bovis subsp bovis AF2122/97
accggucaaacgcgcgcgccau

SEQ ID NO: 1155473 - RNA, 20 nt, Mycobacterium bovis subsp bovis AF2122/97
accgguaccgaucagcaggg

SEQ ID NO: 1155474 - RNA, 14 nt, Mycobacterium bovis subsp bovis AF2122/97
accgguaucgccgc

SEQ ID NO: 1155475 - RNA, 16 nt, Mycobacterium bovis subsp bovis AF2122/97
accgguauguucggca

SEQ ID NO: 1155476 - RNA, 23 nt, Mycobacterium bovis subsp bovis AF2122/97
accgugauggcguuugccggccg

SEQ ID NO: 1155477 - RNA, 19 nt, Mycobacterium bovis subsp bovis AF2122/97
accgugaccgccgcgccgg

SEQ ID NO: 1155478 - RNA, 14 nt, Mycobacterium bovis subsp bovis AF2122/97
accgucugcuggcc

SEQ ID NO: 1155479 - RNA, 23 nt, Mycobacterium bovis subsp bovis AF2122/97
accgucuggaguucgucaccguu

SEQ ID NO: 1155480 - RNA, 15 nt, Mycobacterium bovis subsp bovis AF2122/97
accgugaacucgcgc

SEQ ID NO: 1155481 - RNA, 17 nt, Mycobacterium bovis subsp bovis AF2122/97
accgucguacucggcgg

SEQ ID NO: 1155482 - RNA, 15 nt, Mycobacterium bovis subsp bovis AF2122/97
accgucgucaccgcg

SEQ ID NO: 1155483 - RNA, 18 nt, Mycobacterium bovis subsp bovis AF2122/97
accgucgucgugcaggcg

SEQ ID NO: 1155484 - RNA, 16 nt, Mycobacterium bovis subsp bovis AF2122/97
accgucggcagcagcg

SEQ ID NO: 1155485 - RNA, 21 nt, Mycobacterium bovis subsp bovis AF2122/97
accgucgggauggacggcagc

SEQ ID NO: 1155486 - RNA, 17 nt, Mycobacterium bovis subsp bovis AF2122/97
accgucggggaugccga

SEQ ID NO: 1155487 - RNA, 22 nt, Mycobacterium bovis subsp bovis AF2122/97
accgucggcagcagcggugcag

SEQ ID NO: 1155488 - RNA, 22 nt, Mycobacterium bovis subsp bovis AF2122/97
accgucggugaaauucgcggcg

SEQ ID NO: 1155489 - RNA, 15 nt, Mycobacterium bovis subsp bovis AF2122/97
accgucucgcaccgc

SEQ ID NO: 1155490 - RNA, 20 nt, Mycobacterium bovis subsp bovis AF2122/97
accgucucggcgaccgacgc

SEQ ID NO: 1155491 - RNA, 19 nt, Mycobacterium bovis subsp bovis AF2122/97
accgucugcaccggcaggc

SEQ ID NO: 1155492 - RNA, 20 nt, Mycobacterium bovis subsp bovis AF2122/97
accgucugcaccggcaggcg

SEQ ID NO: 1155493 - RNA, 20 nt, Mycobacterium bovis subsp bovis AF2122/97
accgucugcgacccgggccg

SEQ ID NO: 1155494 - RNA, 15 nt, Mycobacterium bovis subsp bovis AF2122/97
accgucguggcggug

SEQ ID NO: 1155495 - RNA, 15 nt, Mycobacterium bovis subsp bovis AF2122/97
accguccgucggcgc

SEQ ID NO: 1155496 - RNA, 22 nt, Mycobacterium bovis subsp bovis AF2122/97
accguccucggucacgaucacg

SEQ ID NO: 1155497 - RNA, 14 nt, Mycobacterium bovis subsp bovis AF2122/97
accguccggggccg

SEQ ID NO: 1155498 - RNA, 19 nt, Mycobacterium bovis subsp bovis AF2122/97
accguccgggucaccagcg

SEQ ID NO: 1155499 - RNA, 21 nt, Mycobacterium bovis subsp bovis AF2122/97
accguccgggucaccagcgca

SEQ ID NO: 1155500 - RNA, 13 nt, Mycobacterium bovis subsp bovis AF2122/97
accgucgaagaug

SEQ ID NO: 1155501 - RNA, 14 nt, Mycobacterium bovis subsp bovis AF2122/97
accgucgacagcgu

SEQ ID NO: 1155502 - RNA, 17 nt, Mycobacterium bovis subsp bovis AF2122/97
accgucgacagcgucuc

SEQ ID NO: 1155503 - RNA, 20 nt, Mycobacterium bovis subsp bovis AF2122/97
accgucgagguacacgccga

SEQ ID NO: 1155504 - RNA, 18 nt, Mycobacterium bovis subsp bovis AF2122/97
accgucgauccgucggcg

SEQ ID NO: 1155505 - RNA, 19 nt, Mycobacterium bovis subsp bovis AF2122/97
accgucgggauggacggca

SEQ ID NO: 1155506 - RNA, 13 nt, Mycobacterium bovis subsp bovis AF2122/97
accgucgcggcgg

SEQ ID NO: 1155507 - RNA, 14 nt, Mycobacterium bovis subsp bovis AF2122/97
accgucgcggcggc

SEQ ID NO: 1155508 - RNA, 18 nt, Mycobacterium bovis subsp bovis AF2122/97
accgucgcuaugcgccgc

SEQ ID NO: 1155509 - RNA, 21 nt, Mycobacterium bovis subsp bovis AF2122/97
accgucgcgcugccggccgcg

SEQ ID NO: 1155510 - RNA, 19 nt, Mycobacterium bovis subsp bovis AF2122/97
accgucgccguacaaccac

SEQ ID NO: 1155511 - RNA, 21 nt, Mycobacterium bovis subsp bovis AF2122/97
accgucgccguacaaccaccc

SEQ ID NO: 1155512 - RNA, 17 nt, Mycobacterium bovis subsp bovis AF2122/97
accgucgauuucgacga

SEQ ID NO: 1155513 - RNA, 12 nt, Mycobacterium bovis subsp bovis AF2122/97
accgucgcaccc

SEQ ID NO: 1155514 - RNA, 14 nt, Mycobacterium bovis subsp bovis AF2122/97
accgucgccgccgg

SEQ ID NO: 1155515 - RNA, 14 nt, Mycobacterium bovis subsp bovis AF2122/97
accguaccgaucca

SEQ ID NO: 1155516 - RNA, 17 nt, Mycobacterium bovis subsp bovis AF2122/97
accgguuuucgccggcu

SEQ ID NO: 1155517 - RNA, 17 nt, Mycobacterium bovis subsp bovis AF2122/97
accgguuuugacgggca

SEQ ID NO: 1155518 - RNA, 14 nt, Mycobacterium bovis subsp bovis AF2122/97
accggugucggcca

SEQ ID NO: 1155519 - RNA, 15 nt, Mycobacterium bovis subsp bovis AF2122/97
accgguuucgucggu

SEQ ID NO: 1155520 - RNA, 19 nt, Mycobacterium bovis subsp bovis AF2122/97
accgguuucgucggucugc

SEQ ID NO: 1155521 - RNA, 23 nt, Mycobacterium bovis subsp bovis AF2122/97
accgguuucgucggucugcagau

SEQ ID NO: 1155522 - RNA, 22 nt, Mycobacterium bovis subsp bovis AF2122/97
accgguuucuucggccagcucc

SEQ ID NO: 1155523 - RNA, 22 nt, Mycobacterium bovis subsp bovis AF2122/97
accguagagcaugccgcccgcg

SEQ ID NO: 1155524 - RNA, 23 nt, Mycobacterium bovis subsp bovis AF2122/97
accguagagcaugccgcccgcgc

SEQ ID NO: 1155525 - RNA, 23 nt, Mycobacterium bovis subsp bovis AF2122/97
accgucacaagucgacacgccga

SEQ ID NO: 1155526 - RNA, 22 nt, Mycobacterium bovis subsp bovis AF2122/97
accguagugaacggcucgggca

SEQ ID NO: 1155527 - RNA, 16 nt, Mycobacterium bovis subsp bovis AF2122/97
accgucacccccgaua

SEQ ID NO: 1155528 - RNA, 21 nt, Mycobacterium bovis subsp bovis AF2122/97
accgucagaucguuaugaccu

SEQ ID NO: 1155529 - RNA, 16 nt, Mycobacterium bovis subsp bovis AF2122/97
accgucaccgccggca

SEQ ID NO: 1155530 - RNA, 13 nt, Mycobacterium bovis subsp bovis AF2122/97
accgucacccccg

SEQ ID NO: 1155531 - RNA, 14 nt, Mycobacterium bovis subsp bovis AF2122/97
accgucacccccga

SEQ ID NO: 1155532 - RNA, 14 nt, Mycobacterium bovis subsp bovis AF2122/97
accgucaccgccgu

SEQ ID NO: 1155533 - RNA, 17 nt, Mycobacterium bovis subsp bovis AF2122/97
accgucaguagccacgc

SEQ ID NO: 1155534 - RNA, 14 nt, Mycobacterium bovis subsp bovis AF2122/97
accguccgacggcg

SEQ ID NO: 1155535 - RNA, 16 nt, Mycobacterium bovis subsp bovis AF2122/97
accgucccagcgccgc

SEQ ID NO: 1155536 - RNA, 14 nt, Mycobacterium bovis subsp bovis AF2122/97
accguccccggcgu

SEQ ID NO: 1155537 - RNA, 14 nt, Mycobacterium bovis subsp bovis AF2122/97
accguccaccgacg

SEQ ID NO: 1155538 - RNA, 15 nt, Mycobacterium bovis subsp bovis AF2122/97
accguccacgacagc

SEQ ID NO: 1155539 - RNA, 14 nt, Mycobacterium bovis subsp bovis AF2122/97
accguccagcaaca

SEQ ID NO: 1155540 - RNA, 15 nt, Mycobacterium bovis subsp bovis AF2122/97
accguccagcaacag

SEQ ID NO: 1155541 - RNA, 17 nt, Mycobacterium bovis subsp bovis AF2122/97
accguccagcaacagcg

SEQ ID NO: 1155542 - RNA, 13 nt, Mycobacterium bovis subsp bovis AF2122/97
accguccagcagc

SEQ ID NO: 1155543 - RNA, 15 nt, Mycobacterium bovis subsp bovis AF2122/97
accguccagcagcuc

SEQ ID NO: 1155544 - RNA, 21 nt, Mycobacterium bovis subsp bovis AF2122/97
accgucaucgcggugugccgg

SEQ ID NO: 1155545 - RNA, 23 nt, Mycobacterium bovis subsp bovis AF2122/97
accgucauggcgggugcggcgau

SEQ ID NO: 1155546 - RNA, 16 nt, Mycobacterium bovis subsp bovis AF2122/97
accguccaagccggcu

SEQ ID NO: 1155547 - RNA, 22 nt, Mycobacterium bovis subsp bovis AF2122/97
accguccaauuggcgucgucgg

SEQ ID NO: 1155548 - RNA, 21 nt, Mycobacterium bovis subsp bovis AF2122/97
accgucaugaagccguugccg

SEQ ID NO: 1155549 - RNA, 22 nt, Mycobacterium bovis subsp bovis AF2122/97
accgucaugaagccguugccgc

SEQ ID NO: 1155550 - RNA, 16 nt, Mycobacterium bovis subsp bovis AF2122/97
accgucaugccgacga

SEQ ID NO: 1155551 - RNA, 16 nt, Mycobacterium bovis subsp bovis AF2122/97
accgucauggcgggug

SEQ ID NO: 1155552 - RNA, 14 nt, Mycobacterium bovis subsp bovis AF2122/97
accguugccgccgu

SEQ ID NO: 1155553 - RNA, 21 nt, Mycobacterium bovis subsp bovis AF2122/97
accguugccgccguugccggc

SEQ ID NO: 1155554 - RNA, 13 nt, Mycobacterium bovis subsp bovis AF2122/97
accguugccgucg

SEQ ID NO: 1155555 - RNA, 20 nt, Mycobacterium bovis subsp bovis AF2122/97
accguugaccucuucgggca

SEQ ID NO: 1155556 - RNA, 22 nt, Mycobacterium bovis subsp bovis AF2122/97
accguucggcgacagcgcggcg

SEQ ID NO: 1155557 - RNA, 15 nt, Mycobacterium bovis subsp bovis AF2122/97
accguucacccagcg

SEQ ID NO: 1155558 - RNA, 24 nt, Mycobacterium bovis subsp bovis AF2122/97
accgugguggacgaccgcgcggca

SEQ ID NO: 1155559 - RNA, 16 nt, Mycobacterium bovis subsp bovis AF2122/97
accgugucuacgccgg

SEQ ID NO: 1155560 - RNA, 14 nt, Mycobacterium bovis subsp bovis AF2122/97
accguuaccgccgu

SEQ ID NO: 1155561 - RNA, 19 nt, Mycobacterium bovis subsp bovis AF2122/97
accgugguggucgggcgca

SEQ ID NO: 1155562 - RNA, 20 nt, Mycobacterium bovis subsp bovis AF2122/97
accgugguggacgaccgcgc

SEQ ID NO: 1155563 - RNA, 21 nt, Mycobacterium bovis subsp bovis AF2122/97
accgugguggacgaccgcgcg

SEQ ID NO: 1155564 - RNA, 13 nt, Mycobacterium bovis subsp bovis AF2122/97
accgugucaccgc

SEQ ID NO: 1155565 - RNA, 21 nt, Mycobacterium bovis subsp bovis AF2122/97
accguguggccguuggccgga

SEQ ID NO: 1155566 - RNA, 19 nt, Mycobacterium bovis subsp bovis AF2122/97
accgugugggccccgccga

SEQ ID NO: 1155567 - RNA, 14 nt, Mycobacterium bovis subsp bovis AF2122/97
accgugguggacga

SEQ ID NO: 1155568 - RNA, 19 nt, Mycobacterium bovis subsp bovis AF2122/97
accguggcggggaaaccgg

SEQ ID NO: 1155569 - RNA, 19 nt, Mycobacterium bovis subsp bovis AF2122/97
accgugggcgacggcggcg

SEQ ID NO: 1155570 - RNA, 11 nt, Mycobacterium bovis subsp bovis AF2122/97
accguggucgg

SEQ ID NO: 1155571 - RNA, 16 nt, Mycobacterium bovis subsp bovis AF2122/97
accguggucggaggug

SEQ ID NO: 1155572 - RNA, 18 nt, Mycobacterium bovis subsp bovis AF2122/97
accguggccgcgaucccg

SEQ ID NO: 1155573 - RNA, 13 nt, Mycobacterium bovis subsp bovis AF2122/97
accguggccucga

SEQ ID NO: 1155574 - RNA, 23 nt, Mycobacterium bovis subsp bovis AF2122/97
accgugcugggcgccgcgcucga

SEQ ID NO: 1155575 - RNA, 18 nt, Mycobacterium bovis subsp bovis AF2122/97
accgugccgacgccccga

SEQ ID NO: 1155576 - RNA, 20 nt, Mycobacterium bovis subsp bovis AF2122/97
accguggaagauguugccgc

SEQ ID NO: 1155577 - RNA, 14 nt, Mycobacterium bovis subsp bovis AF2122/97
accgugccgcccgg

SEQ ID NO: 1155578 - RNA, 15 nt, Mycobacterium bovis subsp bovis AF2122/97
accgugcaccagcuc

SEQ ID NO: 1155579 - RNA, 14 nt, Mycobacterium bovis subsp bovis AF2122/97
accgugcacgucag

SEQ ID NO: 1155580 - RNA, 15 nt, Mycobacterium bovis subsp bovis AF2122/97
accgugcacgucagc

SEQ ID NO: 1155581 - RNA, 21 nt, Mycobacterium bovis subsp bovis AF2122/97
accgugcggaucgcgcugcgg

SEQ ID NO: 1155582 - RNA, 19 nt, Mycobacterium bovis subsp bovis AF2122/97
accgugcggggggcagcuc

SEQ ID NO: 1155583 - RNA, 17 nt, Mycobacterium bovis subsp bovis AF2122/97
accgugcuggcaccagc

SEQ ID NO: 1155584 - RNA, 20 nt, Mycobacterium bovis subsp bovis AF2122/97
accgugcugggcgccgcgcu

SEQ ID NO: 1155585 - RNA, 16 nt, Mycobacterium bovis subsp bovis AF2122/97
accgugcggaucgcgc

SEQ ID NO: 1155586 - RNA, 17 nt, Mycobacterium bovis subsp bovis AF2122/97
accguuugagcggccac

SEQ ID NO: 1155587 - RNA, 19 nt, Mycobacterium bovis subsp bovis AF2122/97
accguuugagcggccaccg

SEQ ID NO: 1155588 - RNA, 19 nt, Mycobacterium bovis subsp bovis AF2122/97
accguuugggcgccggugu

SEQ ID NO: 1155589 - RNA, 14 nt, Mycobacterium bovis subsp bovis AF2122/97
accuaacccgcacc

SEQ ID NO: 1155590 - RNA, 18 nt, Mycobacterium bovis subsp bovis AF2122/97
accuaccgagaucaccgc

SEQ ID NO: 1155591 - RNA, 22 nt, Mycobacterium bovis subsp bovis AF2122/97
accuaccgagaucaccgccacc

SEQ ID NO: 1155592 - RNA, 14 nt, Mycobacterium bovis subsp bovis AF2122/97
accuagcaccgcgc

SEQ ID NO: 1155593 - RNA, 17 nt, Mycobacterium bovis subsp bovis AF2122/97
accuccgacggccgcgg

SEQ ID NO: 1155594 - RNA, 20 nt, Mycobacterium bovis subsp bovis AF2122/97
accuccgaggccgccaucgc

SEQ ID NO: 1155595 - RNA, 17 nt, Mycobacterium bovis subsp bovis AF2122/97
accucccacgccgccgu

SEQ ID NO: 1155596 - RNA, 18 nt, Mycobacterium bovis subsp bovis AF2122/97
accucccagggcucggcg

SEQ ID NO: 1155597 - RNA, 17 nt, Mycobacterium bovis subsp bovis AF2122/97
accuccaggaucgccgc

SEQ ID NO: 1155598 - RNA, 16 nt, Mycobacterium bovis subsp bovis AF2122/97
accuccaccgcgccgg

SEQ ID NO: 1155599 - RNA, 17 nt, Mycobacterium bovis subsp bovis AF2122/97
accucaucgcagacggc

SEQ ID NO: 1155600 - RNA, 20 nt, Mycobacterium bovis subsp bovis AF2122/97
accuccuccuugaaccggga

SEQ ID NO: 1155601 - RNA, 11 nt, Mycobacterium bovis subsp bovis AF2122/97
accuccucgaa

SEQ ID NO: 1155602 - RNA, 21 nt, Mycobacterium bovis subsp bovis AF2122/97
accuccgggaugucgaagucg

SEQ ID NO: 1155603 - RNA, 24 nt, Mycobacterium bovis subsp bovis AF2122/97
accucccgggcgagccgugccagc

SEQ ID NO: 1155604 - RNA, 14 nt, Mycobacterium bovis subsp bovis AF2122/97
accuccgcgacggc

SEQ ID NO: 1155605 - RNA, 17 nt, Mycobacterium bovis subsp bovis AF2122/97
accuagcaccgcgccga

SEQ ID NO: 1155606 - RNA, 16 nt, Mycobacterium bovis subsp bovis AF2122/97
accucaacaccaggcc

SEQ ID NO: 1155607 - RNA, 20 nt, Mycobacterium bovis subsp bovis AF2122/97
accuagcagggugccggcgc

SEQ ID NO: 1155608 - RNA, 14 nt, Mycobacterium bovis subsp bovis AF2122/97
accuauuugcgacc

SEQ ID NO: 1155609 - RNA, 20 nt, Mycobacterium bovis subsp bovis AF2122/97
accucaucgcggucgccacc

SEQ ID NO: 1155610 - RNA, 13 nt, Mycobacterium bovis subsp bovis AF2122/97
accucaucggcac

SEQ ID NO: 1155611 - RNA, 20 nt, Mycobacterium bovis subsp bovis AF2122/97
accucacggcauccgcucaa

SEQ ID NO: 1155612 - RNA, 12 nt, Mycobacterium bovis subsp bovis AF2122/97
accucacgggcg

SEQ ID NO: 1155613 - RNA, 17 nt, Mycobacterium bovis subsp bovis AF2122/97
accucgaaaccguggcc

SEQ ID NO: 1155614 - RNA, 21 nt, Mycobacterium bovis subsp bovis AF2122/97
accuccucgaccguggcggcc

SEQ ID NO: 1155615 - RNA, 16 nt, Mycobacterium bovis subsp bovis AF2122/97
accucgagcgcggcga

SEQ ID NO: 1155616 - RNA, 15 nt, Mycobacterium bovis subsp bovis AF2122/97
accucgacggugacg

SEQ ID NO: 1155617 - RNA, 23 nt, Mycobacterium bovis subsp bovis AF2122/97
accucgacggugacgaccacguc

SEQ ID NO: 1155618 - RNA, 13 nt, Mycobacterium bovis subsp bovis AF2122/97
accucgaugcggg

SEQ ID NO: 1155619 - RNA, 17 nt, Mycobacterium bovis subsp bovis AF2122/97
accucgaugcggguggc

SEQ ID NO: 1155620 - RNA, 12 nt, Mycobacterium bovis subsp bovis AF2122/97
accucgccggcg

SEQ ID NO: 1155621 - RNA, 13 nt, Mycobacterium bovis subsp bovis AF2122/97
accucgccggcgg

SEQ ID NO: 1155622 - RNA, 15 nt, Mycobacterium bovis subsp bovis AF2122/97
accucgccggugacg

SEQ ID NO: 1155623 - RNA, 13 nt, Mycobacterium bovis subsp bovis AF2122/97
accucgccgcccu

SEQ ID NO: 1155624 - RNA, 21 nt, Mycobacterium bovis subsp bovis AF2122/97
accucgccacacucccgcgcc

SEQ ID NO: 1155625 - RNA, 15 nt, Mycobacterium bovis subsp bovis AF2122/97
accucgccaucgacc

SEQ ID NO: 1155626 - RNA, 19 nt, Mycobacterium bovis subsp bovis AF2122/97
accucgcgcaccggcuggc

SEQ ID NO: 1155627 - RNA, 23 nt, Mycobacterium bovis subsp bovis AF2122/97
accucgcgcaccggcuggcccag

SEQ ID NO: 1155628 - RNA, 16 nt, Mycobacterium bovis subsp bovis AF2122/97
accucgcgggcgaucg

SEQ ID NO: 1155629 - RNA, 20 nt, Mycobacterium bovis subsp bovis AF2122/97
accucgcgggcgaucggcau

SEQ ID NO: 1155630 - RNA, 18 nt, Mycobacterium bovis subsp bovis AF2122/97
accucggacugcagcgcg

SEQ ID NO: 1155631 - RNA, 21 nt, Mycobacterium bovis subsp bovis AF2122/97
accucggacugcagcgcggcc

SEQ ID NO: 1155632 - RNA, 21 nt, Mycobacterium bovis subsp bovis AF2122/97
accucggagaugaacucggcg

SEQ ID NO: 1155633 - RNA, 22 nt, Mycobacterium bovis subsp bovis AF2122/97
accucggcacggaccgcgucgc

SEQ ID NO: 1155634 - RNA, 23 nt, Mycobacterium bovis subsp bovis AF2122/97
accucggcacggaccgcgucgcg

SEQ ID NO: 1155635 - RNA, 15 nt, Mycobacterium bovis subsp bovis AF2122/97
accucggccgccagc

SEQ ID NO: 1155636 - RNA, 17 nt, Mycobacterium bovis subsp bovis AF2122/97
accucggcgacgucggc

SEQ ID NO: 1155637 - RNA, 14 nt, Mycobacterium bovis subsp bovis AF2122/97
accucggcgaucaa

SEQ ID NO: 1155638 - RNA, 22 nt, Mycobacterium bovis subsp bovis AF2122/97
accucgucggccgacaccgcca

SEQ ID NO: 1155639 - RNA, 17 nt, Mycobacterium bovis subsp bovis AF2122/97
accucgugguucugcag

SEQ ID NO: 1155640 - RNA, 16 nt, Mycobacterium bovis subsp bovis AF2122/97
accucgucgucaucga

SEQ ID NO: 1155641 - RNA, 14 nt, Mycobacterium bovis subsp bovis AF2122/97
accucgucgccuag

SEQ ID NO: 1155642 - RNA, 18 nt, Mycobacterium bovis subsp bovis AF2122/97
accucgucgcgucgccag

SEQ ID NO: 1155643 - RNA, 15 nt, Mycobacterium bovis subsp bovis AF2122/97
accucuucgggcagc

SEQ ID NO: 1155644 - RNA, 18 nt, Mycobacterium bovis subsp bovis AF2122/97
accucucugcgccaggcg

SEQ ID NO: 1155645 - RNA, 21 nt, Mycobacterium bovis subsp bovis AF2122/97
accucgucccagcgguagccg

SEQ ID NO: 1155646 - RNA, 17 nt, Mycobacterium bovis subsp bovis AF2122/97
accucggugccggccgc

SEQ ID NO: 1155647 - RNA, 12 nt, Mycobacterium bovis subsp bovis AF2122/97
accucggugcgg

SEQ ID NO: 1155648 - RNA, 19 nt, Mycobacterium bovis subsp bovis AF2122/97
accucggguacaucgaggc

SEQ ID NO: 1155649 - RNA, 17 nt, Mycobacterium bovis subsp bovis AF2122/97
accucggucccguugcc

SEQ ID NO: 1155650 - RNA, 19 nt, Mycobacterium bovis subsp bovis AF2122/97
accucggucccguugccgc

SEQ ID NO: 1155651 - RNA, 13 nt, Mycobacterium bovis subsp bovis AF2122/97
accucgucgaucg

SEQ ID NO: 1155652 - RNA, 20 nt, Mycobacterium bovis subsp bovis AF2122/97
accucguaugccguggccgc

SEQ ID NO: 1155653 - RNA, 14 nt, Mycobacterium bovis subsp bovis AF2122/97
accucgucaccggu

SEQ ID NO: 1155654 - RNA, 20 nt, Mycobacterium bovis subsp bovis AF2122/97
accucggugcggaacaccgc

SEQ ID NO: 1155655 - RNA, 20 nt, Mycobacterium bovis subsp bovis AF2122/97
accugaccgguggccaucgc

SEQ ID NO: 1155656 - RNA, 21 nt, Mycobacterium bovis subsp bovis AF2122/97
accugacacgcccgcgagcug

SEQ ID NO: 1155657 - RNA, 22 nt, Mycobacterium bovis subsp bovis AF2122/97
accugacgcucggucgccaccg

SEQ ID NO: 1155658 - RNA, 21 nt, Mycobacterium bovis subsp bovis AF2122/97
accugacgugcggcgcggcga

SEQ ID NO: 1155659 - RNA, 18 nt, Mycobacterium bovis subsp bovis AF2122/97
accugagcgcgcgcggug

SEQ ID NO: 1155660 - RNA, 20 nt, Mycobacterium bovis subsp bovis AF2122/97
accugagcgcgcgcggugcg

SEQ ID NO: 1155661 - RNA, 17 nt, Mycobacterium bovis subsp bovis AF2122/97
accugaguccggcacgc

SEQ ID NO: 1155662 - RNA, 13 nt, Mycobacterium bovis subsp bovis AF2122/97
accugauccggcc

SEQ ID NO: 1155663 - RNA, 15 nt, Mycobacterium bovis subsp bovis AF2122/97
accugaacggcaacg

SEQ ID NO: 1155664 - RNA, 15 nt, Mycobacterium bovis subsp bovis AF2122/97
accugaagccagcgc

SEQ ID NO: 1155665 - RNA, 14 nt, Mycobacterium bovis subsp bovis AF2122/97
accugaagccgcgc

SEQ ID NO: 1155666 - RNA, 14 nt, Mycobacterium bovis subsp bovis AF2122/97
accugaaccggccg

SEQ ID NO: 1155667 - RNA, 15 nt, Mycobacterium bovis subsp bovis AF2122/97
accucugcguccagc

SEQ ID NO: 1155668 - RNA, 19 nt, Mycobacterium bovis subsp bovis AF2122/97
accggaucgucgaacagca

SEQ ID NO: 1155669 - RNA, 13 nt, Mycobacterium bovis subsp bovis AF2122/97
accggaucaccgc

SEQ ID NO: 1155670 - RNA, 19 nt, Mycobacterium bovis subsp bovis AF2122/97
accggauacagccacgcaa

SEQ ID NO: 1155671 - RNA, 14 nt, Mycobacterium bovis subsp bovis AF2122/97
accggagucgcccg

SEQ ID NO: 1155672 - RNA, 19 nt, Mycobacterium bovis subsp bovis AF2122/97
accggaucugacggcgccg

SEQ ID NO: 1155673 - RNA, 21 nt, Mycobacterium bovis subsp bovis AF2122/97
accggauccacggagaccggc

SEQ ID NO: 1155674 - RNA, 19 nt, Mycobacterium bovis subsp bovis AF2122/97
accggaugauguggugugc

SEQ ID NO: 1155675 - RNA, 13 nt, Mycobacterium bovis subsp bovis AF2122/97
accggaugcgguc

SEQ ID NO: 1155676 - RNA, 16 nt, Mycobacterium bovis subsp bovis AF2122/97
accggcaacaucagca

SEQ ID NO: 1155677 - RNA, 17 nt, Mycobacterium bovis subsp bovis AF2122/97
accggacgagcgucaga

SEQ ID NO: 1155678 - RNA, 13 nt, Mycobacterium bovis subsp bovis AF2122/97
accggacgaucag

SEQ ID NO: 1155679 - RNA, 16 nt, Mycobacterium bovis subsp bovis AF2122/97
accggacgcccucacg

SEQ ID NO: 1155680 - RNA, 15 nt, Mycobacterium bovis subsp bovis AF2122/97
accggacugcgccgg

SEQ ID NO: 1155681 - RNA, 14 nt, Mycobacterium bovis subsp bovis AF2122/97
accggagagccggu

SEQ ID NO: 1155682 - RNA, 13 nt, Mycobacterium bovis subsp bovis AF2122/97
accggagaucccg

SEQ ID NO: 1155683 - RNA, 18 nt, Mycobacterium bovis subsp bovis AF2122/97
accggagcgccgagcucg

SEQ ID NO: 1155684 - RNA, 21 nt, Mycobacterium bovis subsp bovis AF2122/97
accgcuguucuuggugaccaa

SEQ ID NO: 1155685 - RNA, 16 nt, Mycobacterium bovis subsp bovis AF2122/97
accgcuguugcaucgc

SEQ ID NO: 1155686 - RNA, 21 nt, Mycobacterium bovis subsp bovis AF2122/97
accgcuugaccccuggccgcc

SEQ ID NO: 1155687 - RNA, 17 nt, Mycobacterium bovis subsp bovis AF2122/97
accgcugcuccucgcgg

SEQ ID NO: 1155688 - RNA, 18 nt, Mycobacterium bovis subsp bovis AF2122/97
accgcugcuccucgcggu

SEQ ID NO: 1155689 - RNA, 23 nt, Mycobacterium bovis subsp bovis AF2122/97
accgcugcggguagccgucgauc

SEQ ID NO: 1155690 - RNA, 19 nt, Mycobacterium bovis subsp bovis AF2122/97
accgcugcuugucgaggcg

SEQ ID NO: 1155691 - RNA, 20 nt, Mycobacterium bovis subsp bovis AF2122/97
accgcugcuugucgaggcgc

SEQ ID NO: 1155692 - RNA, 22 nt, Mycobacterium bovis subsp bovis AF2122/97
accgcuggcccggcgcuccaac

SEQ ID NO: 1155693 - RNA, 15 nt, Mycobacterium bovis subsp bovis AF2122/97
accgcugggucgccg

SEQ ID NO: 1155694 - RNA, 19 nt, Mycobacterium bovis subsp bovis AF2122/97
accgcugggacaacgugcc

SEQ ID NO: 1155695 - RNA, 22 nt, Mycobacterium bovis subsp bovis AF2122/97
accgcugaggaacccuccggac

SEQ ID NO: 1155696 - RNA, 15 nt, Mycobacterium bovis subsp bovis AF2122/97
accgcugauagcggu

SEQ ID NO: 1155697 - RNA, 17 nt, Mycobacterium bovis subsp bovis AF2122/97
accgcugauagcggucg

SEQ ID NO: 1155698 - RNA, 20 nt, Mycobacterium bovis subsp bovis AF2122/97
accgcugauagcggucgguc

SEQ ID NO: 1155699 - RNA, 17 nt, Mycobacterium bovis subsp bovis AF2122/97
accgcugccggcgccgc

SEQ ID NO: 1155700 - RNA, 20 nt, Mycobacterium bovis subsp bovis AF2122/97
accgcugccggugugcggcg

SEQ ID NO: 1155701 - RNA, 13 nt, Mycobacterium bovis subsp bovis AF2122/97
accgcugccggca

SEQ ID NO: 1155702 - RNA, 19 nt, Mycobacterium bovis subsp bovis AF2122/97
accgcugccggcacgcaug

SEQ ID NO: 1155703 - RNA, 22 nt, Mycobacterium bovis subsp bovis AF2122/97
accgcugccggcacgcaugccg

SEQ ID NO: 1155704 - RNA, 15 nt, Mycobacterium bovis subsp bovis AF2122/97
accgcugcggcacca

SEQ ID NO: 1155705 - RNA, 22 nt, Mycobacterium bovis subsp bovis AF2122/97
accgcugcggcaccacccggcg

SEQ ID NO: 1155706 - RNA, 17 nt, Mycobacterium bovis subsp bovis AF2122/97
accgcugcgcgaaucgc

SEQ ID NO: 1155707 - RNA, 15 nt, Mycobacterium bovis subsp bovis AF2122/97
accgcguugaugacc

SEQ ID NO: 1155708 - RNA, 17 nt, Mycobacterium bovis subsp bovis AF2122/97
accgcguugaugaccag

SEQ ID NO: 1155709 - RNA, 22 nt, Mycobacterium bovis subsp bovis AF2122/97
accgcguugaugaccgccgccg

SEQ ID NO: 1155710 - RNA, 23 nt, Mycobacterium bovis subsp bovis AF2122/97
accgcguugaugaccgccgccgg

SEQ ID NO: 1155711 - RNA, 13 nt, Mycobacterium bovis subsp bovis AF2122/97
accgcguuggcca

SEQ ID NO: 1155712 - RNA, 22 nt, Mycobacterium bovis subsp bovis AF2122/97
accgcguuucgcgacgucugcc

SEQ ID NO: 1155713 - RNA, 18 nt, Mycobacterium bovis subsp bovis AF2122/97
accgcucgucguccggcc

SEQ ID NO: 1155714 - RNA, 19 nt, Mycobacterium bovis subsp bovis AF2122/97
accgcguuguccgcggcca

SEQ ID NO: 1155715 - RNA, 17 nt, Mycobacterium bovis subsp bovis AF2122/97
accgcucgugcaaucgc

SEQ ID NO: 1155716 - RNA, 17 nt, Mycobacterium bovis subsp bovis AF2122/97
accgcucugcggccacg

SEQ ID NO: 1155717 - RNA, 13 nt, Mycobacterium bovis subsp bovis AF2122/97
accgcugaccgca

SEQ ID NO: 1155718 - RNA, 12 nt, Mycobacterium bovis subsp bovis AF2122/97
accgcgguggcc

SEQ ID NO: 1155719 - RNA, 20 nt, Mycobacterium bovis subsp bovis AF2122/97
accgcggugacucggccucc

SEQ ID NO: 1155720 - RNA, 16 nt, Mycobacterium bovis subsp bovis AF2122/97
accgcggucagcucgg

SEQ ID NO: 1155721 - RNA, 18 nt, Mycobacterium bovis subsp bovis AF2122/97
accgcggugacccggaag

SEQ ID NO: 1155722 - RNA, 15 nt, Mycobacterium bovis subsp bovis AF2122/97
accgcgucggcggcc

SEQ ID NO: 1155723 - RNA, 15 nt, Mycobacterium bovis subsp bovis AF2122/97
accgcgugcgucagc

SEQ ID NO: 1155724 - RNA, 13 nt, Mycobacterium bovis subsp bovis AF2122/97
accgcggucgcca

SEQ ID NO: 1155725 - RNA, 22 nt, Mycobacterium bovis subsp bovis AF2122/97
accgcggucgccaagaucgggu

SEQ ID NO: 1155726 - RNA, 18 nt, Mycobacterium bovis subsp bovis AF2122/97
accgcggucuucuucacc

SEQ ID NO: 1155727 - RNA, 16 nt, Mycobacterium bovis subsp bovis AF2122/97
accgcggugacccgga

SEQ ID NO: 1155728 - RNA, 21 nt, Mycobacterium bovis subsp bovis AF2122/97
accgcggucugcgcgucgcgu

SEQ ID NO: 1155729 - RNA, 23 nt, Mycobacterium bovis subsp bovis AF2122/97
accgcggucugcgcgucgcgugg

SEQ ID NO: 1155730 - RNA, 15 nt, Mycobacterium bovis subsp bovis AF2122/97
accgcgguacgccgg

SEQ ID NO: 1155731 - RNA, 19 nt, Mycobacterium bovis subsp bovis AF2122/97
accgcgguacgccggucgg

SEQ ID NO: 1155732 - RNA, 17 nt, Mycobacterium bovis subsp bovis AF2122/97
accgcgggcggcaucgc

SEQ ID NO: 1155733 - RNA, 19 nt, Mycobacterium bovis subsp bovis AF2122/97
accgcgggcggcaucgccg

SEQ ID NO: 1155734 - RNA, 23 nt, Mycobacterium bovis subsp bovis AF2122/97
accgcggggaugguguggucgau

SEQ ID NO: 1155735 - RNA, 19 nt, Mycobacterium bovis subsp bovis AF2122/97
accgcggggcagcgggccg

SEQ ID NO: 1155736 - RNA, 15 nt, Mycobacterium bovis subsp bovis AF2122/97
accgcggucaccgac

SEQ ID NO: 1155737 - RNA, 12 nt, Mycobacterium bovis subsp bovis AF2122/97
accgcggucagc

SEQ ID NO: 1155738 - RNA, 20 nt, Mycobacterium bovis subsp bovis AF2122/97
accgcgcguugaagucgccg

SEQ ID NO: 1155739 - RNA, 18 nt, Mycobacterium bovis subsp bovis AF2122/97
accgcgcguuguggcgau

SEQ ID NO: 1155740 - RNA, 12 nt, Mycobacterium bovis subsp bovis AF2122/97
accgcgcggcgc

SEQ ID NO: 1155741 - RNA, 17 nt, Mycobacterium bovis subsp bovis AF2122/97
accgcgcuuggagcggg

SEQ ID NO: 1155742 - RNA, 13 nt, Mycobacterium bovis subsp bovis AF2122/97
accgcggacacga

SEQ ID NO: 1155743 - RNA, 18 nt, Mycobacterium bovis subsp bovis AF2122/97
accgcggacacgaucgcg

SEQ ID NO: 1155744 - RNA, 21 nt, Mycobacterium bovis subsp bovis AF2122/97
accgcgaugauggcgguaccg

SEQ ID NO: 1155745 - RNA, 15 nt, Mycobacterium bovis subsp bovis AF2122/97
accgcgaucgccgac

SEQ ID NO: 1155746 - RNA, 12 nt, Mycobacterium bovis subsp bovis AF2122/97
accgcgaucgcg

SEQ ID NO: 1155747 - RNA, 20 nt, Mycobacterium bovis subsp bovis AF2122/97
accgcgauggugguuccgcc

SEQ ID NO: 1155748 - RNA, 16 nt, Mycobacterium bovis subsp bovis AF2122/97
accgcgaugucacgga

SEQ ID NO: 1155749 - RNA, 20 nt, Mycobacterium bovis subsp bovis AF2122/97
accgcgaugucacggaugug

SEQ ID NO: 1155750 - RNA, 19 nt, Mycobacterium bovis subsp bovis AF2122/97
accgcgcaacccggacgaa

SEQ ID NO: 1155751 - RNA, 22 nt, Mycobacterium bovis subsp bovis AF2122/97
accgcgcaacccggacgaacgc

SEQ ID NO: 1155752 - RNA, 15 nt, Mycobacterium bovis subsp bovis AF2122/97
accgcgcggcccgcc

SEQ ID NO: 1155753 - RNA, 17 nt, Mycobacterium bovis subsp bovis AF2122/97
accgcgccgaacacgca

SEQ ID NO: 1155754 - RNA, 17 nt, Mycobacterium bovis subsp bovis AF2122/97
accgcgcgcucgcccag

SEQ ID NO: 1155755 - RNA, 14 nt, Mycobacterium bovis subsp bovis AF2122/97
accgcgcccgccgc

SEQ ID NO: 1155756 - RNA, 16 nt, Mycobacterium bovis subsp bovis AF2122/97
accgcgcacggcuggc

SEQ ID NO: 1155757 - RNA, 11 nt, Mycobacterium bovis subsp bovis AF2122/97
accgcgccacc

SEQ ID NO: 1155758 - RNA, 19 nt, Mycobacterium bovis subsp bovis AF2122/97
accgcgccaccuccgacgg

SEQ ID NO: 1155759 - RNA, 22 nt, Mycobacterium bovis subsp bovis AF2122/97
accgcgcccaccagcggcggca

SEQ ID NO: 1155760 - RNA, 14 nt, Mycobacterium bovis subsp bovis AF2122/97
accgcgaucaccac

SEQ ID NO: 1155761 - RNA, 15 nt, Mycobacterium bovis subsp bovis AF2122/97
accgccugcucggcg

SEQ ID NO: 1155762 - RNA, 19 nt, Mycobacterium bovis subsp bovis AF2122/97
accgcgaucacccacaugg

SEQ ID NO: 1155763 - RNA, 12 nt, Mycobacterium bovis subsp bovis AF2122/97
accgcgaucacc

SEQ ID NO: 1155764 - RNA, 21 nt, Mycobacterium bovis subsp bovis AF2122/97
accgcgagggggguguugagg

SEQ ID NO: 1155765 - RNA, 15 nt, Mycobacterium bovis subsp bovis AF2122/97
accgcgacggcgccg

SEQ ID NO: 1155766 - RNA, 14 nt, Mycobacterium bovis subsp bovis AF2122/97
accgcgacggcagg

SEQ ID NO: 1155767 - RNA, 15 nt, Mycobacterium bovis subsp bovis AF2122/97
accgcgacggcaggc

SEQ ID NO: 1155768 - RNA, 15 nt, Mycobacterium bovis subsp bovis AF2122/97
accgccuccucgaua

SEQ ID NO: 1155769 - RNA, 14 nt, Mycobacterium bovis subsp bovis AF2122/97
accgccuccucgau

SEQ ID NO: 1155770 - RNA, 17 nt, Mycobacterium bovis subsp bovis AF2122/97
accgccucgucgaugcc

SEQ ID NO: 1155771 - RNA, 16 nt, Mycobacterium bovis subsp bovis AF2122/97
accgccugcgccgccc

SEQ ID NO: 1155772 - RNA, 19 nt, Mycobacterium bovis subsp bovis AF2122/97
accgccugcgccgcccgcg

SEQ ID NO: 1155773 - RNA, 23 nt, Mycobacterium bovis subsp bovis AF2122/97
accgccgcggccgccguccccgc

SEQ ID NO: 1155774 - RNA, 24 nt, Mycobacterium bovis subsp bovis AF2122/97
accgccgcggccgccguccccgcc

SEQ ID NO: 1155775 - RNA, 13 nt, Mycobacterium bovis subsp bovis AF2122/97
accgccgcgccgg

SEQ ID NO: 1155776 - RNA, 16 nt, Mycobacterium bovis subsp bovis AF2122/97
accgccgcgccggcac

SEQ ID NO: 1155777 - RNA, 14 nt, Mycobacterium bovis subsp bovis AF2122/97
accgccgcgaccgc

SEQ ID NO: 1155778 - RNA, 19 nt, Mycobacterium bovis subsp bovis AF2122/97
accgccgcgaccgccucgc

SEQ ID NO: 1155779 - RNA, 19 nt, Mycobacterium bovis subsp bovis AF2122/97
accgccgcgaccgcgagca

SEQ ID NO: 1155780 - RNA, 17 nt, Mycobacterium bovis subsp bovis AF2122/97
accgccgccugcccggc

SEQ ID NO: 1155781 - RNA, 13 nt, Mycobacterium bovis subsp bovis AF2122/97
accgccgccggca

SEQ ID NO: 1155782 - RNA, 15 nt, Mycobacterium bovis subsp bovis AF2122/97
accgccgacgccguu

SEQ ID NO: 1155783 - RNA, 18 nt, Mycobacterium bovis subsp bovis AF2122/97
accgccgacgccguugcc

SEQ ID NO: 1155784 - RNA, 18 nt, Mycobacterium bovis subsp bovis AF2122/97
accgcccgcaagucggac

SEQ ID NO: 1155785 - RNA, 14 nt, Mycobacterium bovis subsp bovis AF2122/97
accgcccgcgccac

SEQ ID NO: 1155786 - RNA, 15 nt, Mycobacterium bovis subsp bovis AF2122/97
accgcccgugccguc

SEQ ID NO: 1155787 - RNA, 17 nt, Mycobacterium bovis subsp bovis AF2122/97
accgcccuugccgccgg

SEQ ID NO: 1155788 - RNA, 19 nt, Mycobacterium bovis subsp bovis AF2122/97
accgcccuugccgccggcc

SEQ ID NO: 1155789 - RNA, 21 nt, Mycobacterium bovis subsp bovis AF2122/97
accgcccuugccgccggcccc

SEQ ID NO: 1155790 - RNA, 19 nt, Mycobacterium bovis subsp bovis AF2122/97
accgccgaccggaccgggg

SEQ ID NO: 1155791 - RNA, 23 nt, Mycobacterium bovis subsp bovis AF2122/97
accgcccgcgccaccggcaccgc

SEQ ID NO: 1155792 - RNA, 16 nt, Mycobacterium bovis subsp bovis AF2122/97
accgccgacaggccgg

SEQ ID NO: 1155793 - RNA, 17 nt, Mycobacterium bovis subsp bovis AF2122/97
accgccgacaggccggc

SEQ ID NO: 1155794 - RNA, 12 nt, Mycobacterium bovis subsp bovis AF2122/97
accgccggcccg

SEQ ID NO: 1155795 - RNA, 17 nt, Mycobacterium bovis subsp bovis AF2122/97
accgccggcaccgccag

SEQ ID NO: 1155796 - RNA, 15 nt, Mycobacterium bovis subsp bovis AF2122/97
accgccggcaccgcc

SEQ ID NO: 1155797 - RNA, 16 nt, Mycobacterium bovis subsp bovis AF2122/97
accgccggcaccgcca

SEQ ID NO: 1155798 - RNA, 15 nt, Mycobacterium bovis subsp bovis AF2122/97
accgccgcugccgau

SEQ ID NO: 1155799 - RNA, 19 nt, Mycobacterium bovis subsp bovis AF2122/97
accgccgcugccgccgagc

SEQ ID NO: 1155800 - RNA, 23 nt, Mycobacterium bovis subsp bovis AF2122/97
accgccgcugccgccgagcuggc

SEQ ID NO: 1155801 - RNA, 17 nt, Mycobacterium bovis subsp bovis AF2122/97
accgccgcugccgcgcg

SEQ ID NO: 1155802 - RNA, 15 nt, Mycobacterium bovis subsp bovis AF2122/97
accgccgcuacccca

SEQ ID NO: 1155803 - RNA, 18 nt, Mycobacterium bovis subsp bovis AF2122/97
accgccgcuaccccagcc

SEQ ID NO: 1155804 - RNA, 21 nt, Mycobacterium bovis subsp bovis AF2122/97
accgccgcuaccccagccggc

SEQ ID NO: 1155805 - RNA, 12 nt, Mycobacterium bovis subsp bovis AF2122/97
accgccgcugcc

SEQ ID NO: 1155806 - RNA, 14 nt, Mycobacterium bovis subsp bovis AF2122/97
accgccgcuaccgc

SEQ ID NO: 1155807 - RNA, 18 nt, Mycobacterium bovis subsp bovis AF2122/97
accgccgcuaccgcccgc

SEQ ID NO: 1155808 - RNA, 21 nt, Mycobacterium bovis subsp bovis AF2122/97
accgccgcuaccgcccgcgcc

SEQ ID NO: 1155809 - RNA, 11 nt, Mycobacterium bovis subsp bovis AF2122/97
accgccggcgg

SEQ ID NO: 1155810 - RNA, 14 nt, Mycobacterium bovis subsp bovis AF2122/97
accgccggcgccgg

SEQ ID NO: 1155811 - RNA, 17 nt, Mycobacterium bovis subsp bovis AF2122/97
accgccggcgccggugc

SEQ ID NO: 1155812 - RNA, 18 nt, Mycobacterium bovis subsp bovis AF2122/97
accgccggcgccggugcc

SEQ ID NO: 1155813 - RNA, 21 nt, Mycobacterium bovis subsp bovis AF2122/97
accgccggcgccggugccgcc

SEQ ID NO: 1155814 - RNA, 14 nt, Mycobacterium bovis subsp bovis AF2122/97
accgccggcgccac

SEQ ID NO: 1155815 - RNA, 23 nt, Mycobacterium bovis subsp bovis AF2122/97
accgccggcgccaccgucgccgu

SEQ ID NO: 1155816 - RNA, 20 nt, Mycobacterium bovis subsp bovis AF2122/97
accgccggcgcccaggccga

SEQ ID NO: 1155817 - RNA, 18 nt, Mycobacterium bovis subsp bovis AF2122/97
accgccggcaccgccggc

SEQ ID NO: 1155818 - RNA, 20 nt, Mycobacterium bovis subsp bovis AF2122/97
accgccggcaccgccggcgc

SEQ ID NO: 1155819 - RNA, 14 nt, Mycobacterium bovis subsp bovis AF2122/97
accgccuccaccgc

SEQ ID NO: 1155820 - RNA, 20 nt, Mycobacterium bovis subsp bovis AF2122/97
accgccuccaccgccgcgcg

SEQ ID NO: 1155821 - RNA, 13 nt, Mycobacterium bovis subsp bovis AF2122/97
accgccggcggcg

SEQ ID NO: 1155822 - RNA, 18 nt, Mycobacterium bovis subsp bovis AF2122/97
accgccggcuccgccguu

SEQ ID NO: 1155823 - RNA, 23 nt, Mycobacterium bovis subsp bovis AF2122/97
accgccggcuccgccguugccgc

SEQ ID NO: 1155824 - RNA, 15 nt, Mycobacterium bovis subsp bovis AF2122/97
accgccgggaagccg

SEQ ID NO: 1155825 - RNA, 18 nt, Mycobacterium bovis subsp bovis AF2122/97
accgccguugggccgcgc

SEQ ID NO: 1155826 - RNA, 19 nt, Mycobacterium bovis subsp bovis AF2122/97
accgccguugggccgcgcc

SEQ ID NO: 1155827 - RNA, 17 nt, Mycobacterium bovis subsp bovis AF2122/97
accgccguugucgaccu

SEQ ID NO: 1155828 - RNA, 18 nt, Mycobacterium bovis subsp bovis AF2122/97
accgccguuugcgccguu

SEQ ID NO: 1155829 - RNA, 21 nt, Mycobacterium bovis subsp bovis AF2122/97
accgccguuugcgccguugcc

SEQ ID NO: 1155830 - RNA, 18 nt, Mycobacterium bovis subsp bovis AF2122/97
accgccagccgcgagccg

SEQ ID NO: 1155831 - RNA, 13 nt, Mycobacterium bovis subsp bovis AF2122/97
accgccagcggca

SEQ ID NO: 1155832 - RNA, 14 nt, Mycobacterium bovis subsp bovis AF2122/97
accgccagcggccg

SEQ ID NO: 1155833 - RNA, 15 nt, Mycobacterium bovis subsp bovis AF2122/97
accgccagcggccgc

SEQ ID NO: 1155834 - RNA, 18 nt, Mycobacterium bovis subsp bovis AF2122/97
accgcccgacccaucacc

SEQ ID NO: 1155835 - RNA, 16 nt, Mycobacterium bovis subsp bovis AF2122/97
accgcaugaucgcacc

SEQ ID NO: 1155836 - RNA, 15 nt, Mycobacterium bovis subsp bovis AF2122/97
accgcaucggugcca

SEQ ID NO: 1155837 - RNA, 21 nt, Mycobacterium bovis subsp bovis AF2122/97
accgcaucgguggggcgccgg

SEQ ID NO: 1155838 - RNA, 16 nt, Mycobacterium bovis subsp bovis AF2122/97
accgcaggugccaccu

SEQ ID NO: 1155839 - RNA, 15 nt, Mycobacterium bovis subsp bovis AF2122/97
accgcagucccagca

SEQ ID NO: 1155840 - RNA, 16 nt, Mycobacterium bovis subsp bovis AF2122/97
accgcagucccagcac

SEQ ID NO: 1155841 - RNA, 14 nt, Mycobacterium bovis subsp bovis AF2122/97
accgcagucgcggc

SEQ ID NO: 1155842 - RNA, 16 nt, Mycobacterium bovis subsp bovis AF2122/97
accgcauaacgcgaac

SEQ ID NO: 1155843 - RNA, 21 nt, Mycobacterium bovis subsp bovis AF2122/97
accgcauaacgcgaacccgcg

SEQ ID NO: 1155844 - RNA, 22 nt, Mycobacterium bovis subsp bovis AF2122/97
accgcagcgugaucuggccacg

SEQ ID NO: 1155845 - RNA, 18 nt, Mycobacterium bovis subsp bovis AF2122/97
accgcagccaacgucacc

SEQ ID NO: 1155846 - RNA, 23 nt, Mycobacterium bovis subsp bovis AF2122/97
accgcacggaggcggaccaggcc

SEQ ID NO: 1155847 - RNA, 21 nt, Mycobacterium bovis subsp bovis AF2122/97
accgcagauccccgccaccga

SEQ ID NO: 1155848 - RNA, 21 nt, Mycobacterium bovis subsp bovis AF2122/97
accgcagacgugguagccggc

SEQ ID NO: 1155849 - RNA, 22 nt, Mycobacterium bovis subsp bovis AF2122/97
accgcagacgugguagccggcg

SEQ ID NO: 1155850 - RNA, 23 nt, Mycobacterium bovis subsp bovis AF2122/97
accgcagacgugguagccggcga

SEQ ID NO: 1155851 - RNA, 14 nt, Mycobacterium bovis subsp bovis AF2122/97
accgaucggugccg

SEQ ID NO: 1155852 - RNA, 15 nt, Mycobacterium bovis subsp bovis AF2122/97
accgaucggugccgg

SEQ ID NO: 1155853 - RNA, 20 nt, Mycobacterium bovis subsp bovis AF2122/97
accgaugacgaucggcggcg

SEQ ID NO: 1155854 - RNA, 18 nt, Mycobacterium bovis subsp bovis AF2122/97
accgaucuuggccaccgc

SEQ ID NO: 1155855 - RNA, 15 nt, Mycobacterium bovis subsp bovis AF2122/97
accgaucaauccgcc

SEQ ID NO: 1155856 - RNA, 19 nt, Mycobacterium bovis subsp bovis AF2122/97
accgaucagcagggcggcg

SEQ ID NO: 1155857 - RNA, 20 nt, Mycobacterium bovis subsp bovis AF2122/97
accgaucccgcggccgggcc

SEQ ID NO: 1155858 - RNA, 12 nt, Mycobacterium bovis subsp bovis AF2122/97
accgaucggcag

SEQ ID NO: 1155859 - RNA, 14 nt, Mycobacterium bovis subsp bovis AF2122/97
accgauggcgcacc

SEQ ID NO: 1155860 - RNA, 19 nt, Mycobacterium bovis subsp bovis AF2122/97
accgauggcgcaccggcgu

SEQ ID NO: 1155861 - RNA, 21 nt, Mycobacterium bovis subsp bovis AF2122/97
accgauggcgcaccggcgucg

SEQ ID NO: 1155862 - RNA, 23 nt, Mycobacterium bovis subsp bovis AF2122/97
accgauggcgcgcucaacggcga

SEQ ID NO: 1155863 - RNA, 18 nt, Mycobacterium bovis subsp bovis AF2122/97
accgaugccuugaccgcg

SEQ ID NO: 1155864 - RNA, 17 nt, Mycobacterium bovis subsp bovis AF2122/97
accgauggcaucucgau

SEQ ID NO: 1155865 - RNA, 18 nt, Mycobacterium bovis subsp bovis AF2122/97
accgaugguggugccaac

SEQ ID NO: 1155866 - RNA, 22 nt, Mycobacterium bovis subsp bovis AF2122/97
accgaugugggcgccgucgccg

SEQ ID NO: 1155867 - RNA, 23 nt, Mycobacterium bovis subsp bovis AF2122/97
accgaugugggcgccgucgccgu

SEQ ID NO: 1155868 - RNA, 12 nt, Mycobacterium bovis subsp bovis AF2122/97
accgcaccggca

SEQ ID NO: 1155869 - RNA, 14 nt, Mycobacterium bovis subsp bovis AF2122/97
accgcaccggccgc

SEQ ID NO: 1155870 - RNA, 18 nt, Mycobacterium bovis subsp bovis AF2122/97
accgcaccgugccgacgc

SEQ ID NO: 1155871 - RNA, 23 nt, Mycobacterium bovis subsp bovis AF2122/97
accgcacgaccagcugagcuggc

SEQ ID NO: 1155872 - RNA, 18 nt, Mycobacterium bovis subsp bovis AF2122/97
accgcaccaaagcgaaau

SEQ ID NO: 1155873 - RNA, 16 nt, Mycobacterium bovis subsp bovis AF2122/97
accgcaacgacggccg

SEQ ID NO: 1155874 - RNA, 22 nt, Mycobacterium bovis subsp bovis AF2122/97
accgcaacgcguauucggcauc

SEQ ID NO: 1155875 - RNA, 18 nt, Mycobacterium bovis subsp bovis AF2122/97
accgaugcugacgaugcg

SEQ ID NO: 1155876 - RNA, 15 nt, Mycobacterium bovis subsp bovis AF2122/97
accgcaauggcggcc

SEQ ID NO: 1155877 - RNA, 16 nt, Mycobacterium bovis subsp bovis AF2122/97
accgcaacgcuucggc

SEQ ID NO: 1155878 - RNA, 15 nt, Mycobacterium bovis subsp bovis AF2122/97
accgcaacucgccga

SEQ ID NO: 1155879 - RNA, 17 nt, Mycobacterium bovis subsp bovis AF2122/97
accgauucggccagcgc

SEQ ID NO: 1155880 - RNA, 15 nt, Mycobacterium bovis subsp bovis AF2122/97
accgauucggcgacg

SEQ ID NO: 1155881 - RNA, 16 nt, Mycobacterium bovis subsp bovis AF2122/97
accgauugucggcaac

SEQ ID NO: 1155882 - RNA, 17 nt, Mycobacterium bovis subsp bovis AF2122/97
accgcaaacccgccgac

SEQ ID NO: 1155883 - RNA, 18 nt, Mycobacterium bovis subsp bovis AF2122/97
accgcaaacccgccgaca

SEQ ID NO: 1155884 - RNA, 23 nt, Mycobacterium bovis subsp bovis AF2122/97
accgacagccccaucaccaccgg

SEQ ID NO: 1155885 - RNA, 16 nt, Mycobacterium bovis subsp bovis AF2122/97
accgacaccgugccgc

SEQ ID NO: 1155886 - RNA, 19 nt, Mycobacterium bovis subsp bovis AF2122/97
accgacaccgugucgccgg

SEQ ID NO: 1155887 - RNA, 18 nt, Mycobacterium bovis subsp bovis AF2122/97
accgacaccggccgcgac

SEQ ID NO: 1155888 - RNA, 14 nt, Mycobacterium bovis subsp bovis AF2122/97
accgacaucccaac

SEQ ID NO: 1155889 - RNA, 16 nt, Mycobacterium bovis subsp bovis AF2122/97
accgaagccgccgggu

SEQ ID NO: 1155890 - RNA, 20 nt, Mycobacterium bovis subsp bovis AF2122/97
accgaaucgggucggccgcu

SEQ ID NO: 1155891 - RNA, 16 nt, Mycobacterium bovis subsp bovis AF2122/97
accgaauggccgccgc

SEQ ID NO: 1155892 - RNA, 19 nt, Mycobacterium bovis subsp bovis AF2122/97
accgaaucagcacggugug

SEQ ID NO: 1155893 - RNA, 16 nt, Mycobacterium bovis subsp bovis AF2122/97
acccggaaccagccgc

SEQ ID NO: 1155894 - RNA, 16 nt, Mycobacterium bovis subsp bovis AF2122/97
acccgcugcacgccgu

SEQ ID NO: 1155895 - RNA, 18 nt, Mycobacterium bovis subsp bovis AF2122/97
acccgcuggcccgccaga

SEQ ID NO: 1155896 - RNA, 17 nt, Mycobacterium bovis subsp bovis AF2122/97
acccgcuggucgaugcc

SEQ ID NO: 1155897 - RNA, 14 nt, Mycobacterium bovis subsp bovis AF2122/97
accgaacgacucga

SEQ ID NO: 1155898 - RNA, 14 nt, Mycobacterium bovis subsp bovis AF2122/97
accgaacgcaccga

SEQ ID NO: 1155899 - RNA, 17 nt, Mycobacterium bovis subsp bovis AF2122/97
accgaacgcaccgaaac

SEQ ID NO: 1155900 - RNA, 19 nt, Mycobacterium bovis subsp bovis AF2122/97
accgaacccgccaccgcga

SEQ ID NO: 1155901 - RNA, 19 nt, Mycobacterium bovis subsp bovis AF2122/97
accgaacgcggccaccgac

SEQ ID NO: 1155902 - RNA, 16 nt, Mycobacterium bovis subsp bovis AF2122/97
accgaagaacaguugc

SEQ ID NO: 1155903 - RNA, 20 nt, Mycobacterium bovis subsp bovis AF2122/97
accgaagagcuccgucgcgg

SEQ ID NO: 1155904 - RNA, 22 nt, Mycobacterium bovis subsp bovis AF2122/97
acccggaccuucggcggugcca

SEQ ID NO: 1155905 - RNA, 17 nt, Mycobacterium bovis subsp bovis AF2122/97
acccggaaccagccgcg

SEQ ID NO: 1155906 - RNA, 15 nt, Mycobacterium bovis subsp bovis AF2122/97
acccggaaucgucgc

SEQ ID NO: 1155907 - RNA, 18 nt, Mycobacterium bovis subsp bovis AF2122/97
acccggaaucgucgcggc

SEQ ID NO: 1155908 - RNA, 15 nt, Mycobacterium bovis subsp bovis AF2122/97
acccggacagggcgg

SEQ ID NO: 1155909 - RNA, 20 nt, Mycobacterium bovis subsp bovis AF2122/97
acccggacauagccgcgcuc

SEQ ID NO: 1155910 - RNA, 14 nt, Mycobacterium bovis subsp bovis AF2122/97
acccggagccgcca

SEQ ID NO: 1155911 - RNA, 18 nt, Mycobacterium bovis subsp bovis AF2122/97
acccggagccgccaggug

SEQ ID NO: 1155912 - RNA, 15 nt, Mycobacterium bovis subsp bovis AF2122/97
acccggaggcaaucc

SEQ ID NO: 1155913 - RNA, 13 nt, Mycobacterium bovis subsp bovis AF2122/97
accgaacagucgc

SEQ ID NO: 1155914 - RNA, 16 nt, Mycobacterium bovis subsp bovis AF2122/97
accgagcugauccggg

SEQ ID NO: 1155915 - RNA, 17 nt, Mycobacterium bovis subsp bovis AF2122/97
accgagcugagcggcca

SEQ ID NO: 1155916 - RNA, 14 nt, Mycobacterium bovis subsp bovis AF2122/97
accgacgcgaacgc

SEQ ID NO: 1155917 - RNA, 12 nt, Mycobacterium bovis subsp bovis AF2122/97
accgacgccggu

SEQ ID NO: 1155918 - RNA, 22 nt, Mycobacterium bovis subsp bovis AF2122/97
accgacgcgcccgcgcgcuccg

SEQ ID NO: 1155919 - RNA, 13 nt, Mycobacterium bovis subsp bovis AF2122/97
accgacgcaccuc

SEQ ID NO: 1155920 - RNA, 13 nt, Mycobacterium bovis subsp bovis AF2122/97
accgacgccgcca

SEQ ID NO: 1155921 - RNA, 15 nt, Mycobacterium bovis subsp bovis AF2122/97
accgacgccgccagg

SEQ ID NO: 1155922 - RNA, 21 nt, Mycobacterium bovis subsp bovis AF2122/97
accgacgccgccagguccgcc

SEQ ID NO: 1155923 - RNA, 15 nt, Mycobacterium bovis subsp bovis AF2122/97
accgaccggcucacg

SEQ ID NO: 1155924 - RNA, 20 nt, Mycobacterium bovis subsp bovis AF2122/97
accgaccuacugcggucgcc

SEQ ID NO: 1155925 - RNA, 12 nt, Mycobacterium bovis subsp bovis AF2122/97
accgacgacggc

SEQ ID NO: 1155926 - RNA, 18 nt, Mycobacterium bovis subsp bovis AF2122/97
accgacgacggcgacggc

SEQ ID NO: 1155927 - RNA, 18 nt, Mycobacterium bovis subsp bovis AF2122/97
accgaccucggcgaccgc

SEQ ID NO: 1155928 - RNA, 14 nt, Mycobacterium bovis subsp bovis AF2122/97
accgacccgcugcc

SEQ ID NO: 1155929 - RNA, 18 nt, Mycobacterium bovis subsp bovis AF2122/97
accgacccgcugccaccc

SEQ ID NO: 1155930 - RNA, 15 nt, Mycobacterium bovis subsp bovis AF2122/97
accgaccgaaagccg

SEQ ID NO: 1155931 - RNA, 14 nt, Mycobacterium bovis subsp bovis AF2122/97
accgacaccaccag

SEQ ID NO: 1155932 - RNA, 14 nt, Mycobacterium bovis subsp bovis AF2122/97
accgaccaccgcga

SEQ ID NO: 1155933 - RNA, 20 nt, Mycobacterium bovis subsp bovis AF2122/97
accgaccacgcgagggcauc

SEQ ID NO: 1155934 - RNA, 18 nt, Mycobacterium bovis subsp bovis AF2122/97
accgaggugccgcgcagc

SEQ ID NO: 1155935 - RNA, 20 nt, Mycobacterium bovis subsp bovis AF2122/97
accgaggucgagcgacccca

SEQ ID NO: 1155936 - RNA, 15 nt, Mycobacterium bovis subsp bovis AF2122/97
accgaggucgccaac

SEQ ID NO: 1155937 - RNA, 17 nt, Mycobacterium bovis subsp bovis AF2122/97
accgaggucggccagca

SEQ ID NO: 1155938 - RNA, 13 nt, Mycobacterium bovis subsp bovis AF2122/97
accgaucaccggu

SEQ ID NO: 1155939 - RNA, 22 nt, Mycobacterium bovis subsp bovis AF2122/97
accgauauggccggguccagcc

SEQ ID NO: 1155940 - RNA, 13 nt, Mycobacterium bovis subsp bovis AF2122/97
accgaucaauccg

SEQ ID NO: 1155941 - RNA, 17 nt, Mycobacterium bovis subsp bovis AF2122/97
accgauagccugcggcg

SEQ ID NO: 1155942 - RNA, 21 nt, Mycobacterium bovis subsp bovis AF2122/97
accgauagccugcggcggcgu

SEQ ID NO: 1155943 - RNA, 19 nt, Mycobacterium bovis subsp bovis AF2122/97
accgaggaucucgcggucc

SEQ ID NO: 1155944 - RNA, 13 nt, Mycobacterium bovis subsp bovis AF2122/97
accgagucgacgg

SEQ ID NO: 1155945 - RNA, 17 nt, Mycobacterium bovis subsp bovis AF2122/97
accgagucgacggccag

SEQ ID NO: 1155946 - RNA, 17 nt, Mycobacterium bovis subsp bovis AF2122/97
accgauaccucgccauc

SEQ ID NO: 1155947 - RNA, 20 nt, Mycobacterium bovis subsp bovis AF2122/97
accaguaauacugccguucg

SEQ ID NO: 1155948 - RNA, 16 nt, Mycobacterium bovis subsp bovis AF2122/97
accagguugguuucga

SEQ ID NO: 1155949 - RNA, 16 nt, Mycobacterium bovis subsp bovis AF2122/97
accagguaaugguggc

SEQ ID NO: 1155950 - RNA, 17 nt, Mycobacterium bovis subsp bovis AF2122/97
accaggucgccagcucg

SEQ ID NO: 1155951 - RNA, 16 nt, Mycobacterium bovis subsp bovis AF2122/97
accagucgucgcgcuc

SEQ ID NO: 1155952 - RNA, 21 nt, Mycobacterium bovis subsp bovis AF2122/97
accaguccucgggcaggcggc

SEQ ID NO: 1155953 - RNA, 16 nt, Mycobacterium bovis subsp bovis AF2122/97
accaguaccaccggca

SEQ ID NO: 1155954 - RNA, 14 nt, Mycobacterium bovis subsp bovis AF2122/97
accaggugcccgcc

SEQ ID NO: 1155955 - RNA, 16 nt, Mycobacterium bovis subsp bovis AF2122/97
accaggugcccgcccc

SEQ ID NO: 1155956 - RNA, 20 nt, Mycobacterium bovis subsp bovis AF2122/97
accaggugccgugaucgcug

SEQ ID NO: 1155957 - RNA, 18 nt, Mycobacterium bovis subsp bovis AF2122/97
accaggucuucgaccacg

SEQ ID NO: 1155958 - RNA, 15 nt, Mycobacterium bovis subsp bovis AF2122/97
accaggucggucagg

SEQ ID NO: 1155959 - RNA, 16 nt, Mycobacterium bovis subsp bovis AF2122/97
accagggugccggcgg

SEQ ID NO: 1155960 - RNA, 17 nt, Mycobacterium bovis subsp bovis AF2122/97
accaggggaccgcggcg

SEQ ID NO: 1155961 - RNA, 18 nt, Mycobacterium bovis subsp bovis AF2122/97
accaggggaccgcggcgc

SEQ ID NO: 1155962 - RNA, 19 nt, Mycobacterium bovis subsp bovis AF2122/97
accaggggaccgcggcgcg

SEQ ID NO: 1155963 - RNA, 13 nt, Mycobacterium bovis subsp bovis AF2122/97
accaggggcgcgu

SEQ ID NO: 1155964 - RNA, 16 nt, Mycobacterium bovis subsp bovis AF2122/97
accagggcgcaacgga

SEQ ID NO: 1155965 - RNA, 13 nt, Mycobacterium bovis subsp bovis AF2122/97
accaggguggcau

SEQ ID NO: 1155966 - RNA, 16 nt, Mycobacterium bovis subsp bovis AF2122/97
accagguaaucaccug

SEQ ID NO: 1155967 - RNA, 20 nt, Mycobacterium bovis subsp bovis AF2122/97
accagguccaccccgccgau

SEQ ID NO: 1155968 - RNA, 17 nt, Mycobacterium bovis subsp bovis AF2122/97
accaggucauugccggc

SEQ ID NO: 1155969 - RNA, 14 nt, Mycobacterium bovis subsp bovis AF2122/97
accagggcagcggc

SEQ ID NO: 1155970 - RNA, 15 nt, Mycobacterium bovis subsp bovis AF2122/97
accagggccaccgcg

SEQ ID NO: 1155971 - RNA, 19 nt, Mycobacterium bovis subsp bovis AF2122/97
accagggccuccacccgcc

SEQ ID NO: 1155972 - RNA, 16 nt, Mycobacterium bovis subsp bovis AF2122/97
accaggcuccggccgg

SEQ ID NO: 1155973 - RNA, 15 nt, Mycobacterium bovis subsp bovis AF2122/97
accaggcggacgccg

SEQ ID NO: 1155974 - RNA, 13 nt, Mycobacterium bovis subsp bovis AF2122/97
accaggccggccc

SEQ ID NO: 1155975 - RNA, 17 nt, Mycobacterium bovis subsp bovis AF2122/97
accaggccggcccgcaa

SEQ ID NO: 1155976 - RNA, 15 nt, Mycobacterium bovis subsp bovis AF2122/97
accaggcgagccggc

SEQ ID NO: 1155977 - RNA, 13 nt, Mycobacterium bovis subsp bovis AF2122/97
accaggccgagcu

SEQ ID NO: 1155978 - RNA, 15 nt, Mycobacterium bovis subsp bovis AF2122/97
accaggccgagcucg

SEQ ID NO: 1155979 - RNA, 20 nt, Mycobacterium bovis subsp bovis AF2122/97
accaggccgcgcgcaccggu

SEQ ID NO: 1155980 - RNA, 21 nt, Mycobacterium bovis subsp bovis AF2122/97
acauaagcgaggaucucggcg

SEQ ID NO: 1155981 - RNA, 17 nt, Mycobacterium bovis subsp bovis AF2122/97
accauagucgccgucgu

SEQ ID NO: 1155982 - RNA, 13 nt, Mycobacterium bovis subsp bovis AF2122/97
accaguccagcgg

SEQ ID NO: 1155983 - RNA, 15 nt, Mycobacterium bovis subsp bovis AF2122/97
accagugcgguggca

SEQ ID NO: 1155984 - RNA, 13 nt, Mycobacterium bovis subsp bovis AF2122/97
accaguggcgccc

SEQ ID NO: 1155985 - RNA, 15 nt, Mycobacterium bovis subsp bovis AF2122/97
accagugcagcucga

SEQ ID NO: 1155986 - RNA, 16 nt, Mycobacterium bovis subsp bovis AF2122/97
accagugaucagcgca

SEQ ID NO: 1155987 - RNA, 20 nt, Mycobacterium bovis subsp bovis AF2122/97
accagugccccgccgagcgg

SEQ ID NO: 1155988 - RNA, 20 nt, Mycobacterium bovis subsp bovis AF2122/97
accaucacgguggccgcacg

SEQ ID NO: 1155989 - RNA, 23 nt, Mycobacterium bovis subsp bovis AF2122/97
accaucaccgccuuugccgccgg

SEQ ID NO: 1155990 - RNA, 14 nt, Mycobacterium bovis subsp bovis AF2122/97
accaucaccgcgcc

SEQ ID NO: 1155991 - RNA, 17 nt, Mycobacterium bovis subsp bovis AF2122/97
accaucaccgcgccagc

SEQ ID NO: 1155992 - RNA, 22 nt, Mycobacterium bovis subsp bovis AF2122/97
accaucaucaccucucgcuugc

SEQ ID NO: 1155993 - RNA, 17 nt, Mycobacterium bovis subsp bovis AF2122/97
accaucgaggcgaucac

SEQ ID NO: 1155994 - RNA, 20 nt, Mycobacterium bovis subsp bovis AF2122/97
accaucgaggcgaucaccgc

SEQ ID NO: 1155995 - RNA, 14 nt, Mycobacterium bovis subsp bovis AF2122/97
accaucgccagccg

SEQ ID NO: 1155996 - RNA, 18 nt, Mycobacterium bovis subsp bovis AF2122/97
accaucgccagccggcga

SEQ ID NO: 1155997 - RNA, 14 nt, Mycobacterium bovis subsp bovis AF2122/97
accaucgccgccgc

SEQ ID NO: 1155998 - RNA, 18 nt, Mycobacterium bovis subsp bovis AF2122/97
accaucgccgccgcgcgu

SEQ ID NO: 1155999 - RNA, 20 nt, Mycobacterium bovis subsp bovis AF2122/97
accaucgccucggcgcugcg

SEQ ID NO: 1156000 - RNA, 17 nt, Mycobacterium bovis subsp bovis AF2122/97
accaucgcggccgcugg

SEQ ID NO: 1156001 - RNA, 21 nt, Mycobacterium bovis subsp bovis AF2122/97
accaucgcggccgcugggccc

SEQ ID NO: 1156002 - RNA, 18 nt, Mycobacterium bovis subsp bovis AF2122/97
accaugccgucgucggcg

SEQ ID NO: 1156003 - RNA, 19 nt, Mycobacterium bovis subsp bovis AF2122/97
accaugccgucgucggcgu

SEQ ID NO: 1156004 - RNA, 14 nt, Mycobacterium bovis subsp bovis AF2122/97
accaugagccggcg

SEQ ID NO: 1156005 - RNA, 17 nt, Mycobacterium bovis subsp bovis AF2122/97
accaugagccggcgccg

SEQ ID NO: 1156006 - RNA, 21 nt, Mycobacterium bovis subsp bovis AF2122/97
accaugaucacaccgagcgca

SEQ ID NO: 1156007 - RNA, 18 nt, Mycobacterium bovis subsp bovis AF2122/97
accaugaugccuaccggg

SEQ ID NO: 1156008 - RNA, 20 nt, Mycobacterium bovis subsp bovis AF2122/97
accaucuguuccgugccagc

SEQ ID NO: 1156009 - RNA, 21 nt, Mycobacterium bovis subsp bovis AF2122/97
accaucguugccggugccgcc

SEQ ID NO: 1156010 - RNA, 23 nt, Mycobacterium bovis subsp bovis AF2122/97
accaucuccgccgucgccaccgg

SEQ ID NO: 1156011 - RNA, 21 nt, Mycobacterium bovis subsp bovis AF2122/97
accaucuccggugugaucggc

SEQ ID NO: 1156012 - RNA, 21 nt, Mycobacterium bovis subsp bovis AF2122/97
accaucgguaucgagggcagc

SEQ ID NO: 1156013 - RNA, 20 nt, Mycobacterium bovis subsp bovis AF2122/97
accaucgcuugcgcacggau

SEQ ID NO: 1156014 - RNA, 15 nt, Mycobacterium bovis subsp bovis AF2122/97
acccccagcacccgg

SEQ ID NO: 1156015 - RNA, 18 nt, Mycobacterium bovis subsp bovis AF2122/97
acccccagcacccggcuu

SEQ ID NO: 1156016 - RNA, 14 nt, Mycobacterium bovis subsp bovis AF2122/97
accccacacgccga

SEQ ID NO: 1156017 - RNA, 16 nt, Mycobacterium bovis subsp bovis AF2122/97
accccacacagucggu

SEQ ID NO: 1156018 - RNA, 16 nt, Mycobacterium bovis subsp bovis AF2122/97
accccaaguccagcag

SEQ ID NO: 1156019 - RNA, 23 nt, Mycobacterium bovis subsp bovis AF2122/97
acccaugccgaauaccgguggca

SEQ ID NO: 1156020 - RNA, 15 nt, Mycobacterium bovis subsp bovis AF2122/97
acccaugucggcgcg

SEQ ID NO: 1156021 - RNA, 15 nt, Mycobacterium bovis subsp bovis AF2122/97
acccauucggcggcg

SEQ ID NO: 1156022 - RNA, 14 nt, Mycobacterium bovis subsp bovis AF2122/97
acccccgccgcgca

SEQ ID NO: 1156023 - RNA, 20 nt, Mycobacterium bovis subsp bovis AF2122/97
acccccgauggcgucgccgg

SEQ ID NO: 1156024 - RNA, 22 nt, Mycobacterium bovis subsp bovis AF2122/97
acccccgacgagauacggccac

SEQ ID NO: 1156025 - RNA, 15 nt, Mycobacterium bovis subsp bovis AF2122/97
acccccgagauccgu

SEQ ID NO: 1156026 - RNA, 17 nt, Mycobacterium bovis subsp bovis AF2122/97
acccccgauagcgaccg

SEQ ID NO: 1156027 - RNA, 15 nt, Mycobacterium bovis subsp bovis AF2122/97
accccccagcgccgc

SEQ ID NO: 1156028 - RNA, 17 nt, Mycobacterium bovis subsp bovis AF2122/97
accccccagcgccgccg

SEQ ID NO: 1156029 - RNA, 18 nt, Mycobacterium bovis subsp bovis AF2122/97
acccccagcugcagggcg

SEQ ID NO: 1156030 - RNA, 21 nt, Mycobacterium bovis subsp bovis AF2122/97
acccccaggcgcucagcgcgg

SEQ ID NO: 1156031 - RNA, 19 nt, Mycobacterium bovis subsp bovis AF2122/97
acccccccgugcggugucg

SEQ ID NO: 1156032 - RNA, 19 nt, Mycobacterium bovis subsp bovis AF2122/97
accccccgaccccgacggc

SEQ ID NO: 1156033 - RNA, 13 nt, Mycobacterium bovis subsp bovis AF2122/97
acccccagcgccc

SEQ ID NO: 1156034 - RNA, 19 nt, Mycobacterium bovis subsp bovis AF2122/97
accccgaauagucggcauc

SEQ ID NO: 1156035 - RNA, 20 nt, Mycobacterium bovis subsp bovis AF2122/97
accccgaauagucggcaucg

SEQ ID NO: 1156036 - RNA, 17 nt, Mycobacterium bovis subsp bovis AF2122/97
accccgaccucccggca

SEQ ID NO: 1156037 - RNA, 24 nt, Mycobacterium bovis subsp bovis AF2122/97
accccgaagaugccugcuagcagc

SEQ ID NO: 1156038 - RNA, 19 nt, Mycobacterium bovis subsp bovis AF2122/97
accccgaacauccgccgcc

SEQ ID NO: 1156039 - RNA, 20 nt, Mycobacterium bovis subsp bovis AF2122/97
accccgaacauugcgcccag

SEQ ID NO: 1156040 - RNA, 17 nt, Mycobacterium bovis subsp bovis AF2122/97
acccccgucgccaccga

SEQ ID NO: 1156041 - RNA, 20 nt, Mycobacterium bovis subsp bovis AF2122/97
accccgaagcucaucaccgg

SEQ ID NO: 1156042 - RNA, 18 nt, Mycobacterium bovis subsp bovis AF2122/97
acccccuccgcgaugccg

SEQ ID NO: 1156043 - RNA, 20 nt, Mycobacterium bovis subsp bovis AF2122/97
acccccgucgaucagcggca

SEQ ID NO: 1156044 - RNA, 22 nt, Mycobacterium bovis subsp bovis AF2122/97
acccccgucgaucagcggcagc

SEQ ID NO: 1156045 - RNA, 14 nt, Mycobacterium bovis subsp bovis AF2122/97
acccccuucacccu

SEQ ID NO: 1156046 - RNA, 15 nt, Mycobacterium bovis subsp bovis AF2122/97
acccccugccacagc

SEQ ID NO: 1156047 - RNA, 17 nt, Mycobacterium bovis subsp bovis AF2122/97
accccgcgcgccagcuc

SEQ ID NO: 1156048 - RNA, 19 nt, Mycobacterium bovis subsp bovis AF2122/97
accccgcgcgccagcucgg

SEQ ID NO: 1156049 - RNA, 18 nt, Mycobacterium bovis subsp bovis AF2122/97
accccgaggcaacaagca

SEQ ID NO: 1156050 - RNA, 13 nt, Mycobacterium bovis subsp bovis AF2122/97
accccgaggccga

SEQ ID NO: 1156051 - RNA, 23 nt, Mycobacterium bovis subsp bovis AF2122/97
accccgagccgcagcucgccgag

SEQ ID NO: 1156052 - RNA, 21 nt, Mycobacterium bovis subsp bovis AF2122/97
accccgagcggagccgccgac

SEQ ID NO: 1156053 - RNA, 16 nt, Mycobacterium bovis subsp bovis AF2122/97
accccgaggccgaccu

SEQ ID NO: 1156054 - RNA, 16 nt, Mycobacterium bovis subsp bovis AF2122/97
accccgcguaugccag

SEQ ID NO: 1156055 - RNA, 19 nt, Mycobacterium bovis subsp bovis AF2122/97
accccggcauacaacuggu

SEQ ID NO: 1156056 - RNA, 21 nt, Mycobacterium bovis subsp bovis AF2122/97
acccaucccguucagcgacca

SEQ ID NO: 1156057 - RNA, 21 nt, Mycobacterium bovis subsp bovis AF2122/97
acccauccucgcggugcgcca

SEQ ID NO: 1156058 - RNA, 21 nt, Mycobacterium bovis subsp bovis AF2122/97
acccaucgaccgcccgccagc

SEQ ID NO: 1156059 - RNA, 17 nt, Mycobacterium bovis subsp bovis AF2122/97
acccaucaccgccagcc

SEQ ID NO: 1156060 - RNA, 18 nt, Mycobacterium bovis subsp bovis AF2122/97
acccaucaucgccaccac

SEQ ID NO: 1156061 - RNA, 16 nt, Mycobacterium bovis subsp bovis AF2122/97
acccaucgccacaccc

SEQ ID NO: 1156062 - RNA, 15 nt, Mycobacterium bovis subsp bovis AF2122/97
acccaucgccagcau

SEQ ID NO: 1156063 - RNA, 19 nt, Mycobacterium bovis subsp bovis AF2122/97
acccaucgucgagccgcca

SEQ ID NO: 1156064 - RNA, 20 nt, Mycobacterium bovis subsp bovis AF2122/97
acccaucgucgagccgccag

SEQ ID NO: 1156065 - RNA, 16 nt, Mycobacterium bovis subsp bovis AF2122/97
acccaucucgaaggug

SEQ ID NO: 1156066 - RNA, 14 nt, Mycobacterium bovis subsp bovis AF2122/97
acccagcgugcccg

SEQ ID NO: 1156067 - RNA, 22 nt, Mycobacterium bovis subsp bovis AF2122/97
acccagcgugcccgccaccggc

SEQ ID NO: 1156068 - RNA, 17 nt, Mycobacterium bovis subsp bovis AF2122/97
acccagcucgcgcaccc

SEQ ID NO: 1156069 - RNA, 18 nt, Mycobacterium bovis subsp bovis AF2122/97
acccagcucgucgacguc

SEQ ID NO: 1156070 - RNA, 18 nt, Mycobacterium bovis subsp bovis AF2122/97
acccagcugggucccgcu

SEQ ID NO: 1156071 - RNA, 13 nt, Mycobacterium bovis subsp bovis AF2122/97
acccaucaccagc

SEQ ID NO: 1156072 - RNA, 16 nt, Mycobacterium bovis subsp bovis AF2122/97
acccaucaccagcggc

SEQ ID NO: 1156073 - RNA, 14 nt, Mycobacterium bovis subsp bovis AF2122/97
acccaucaccgcca

SEQ ID NO: 1156074 - RNA, 16 nt, Mycobacterium bovis subsp bovis AF2122/97
acccagccgcgccagc

SEQ ID NO: 1156075 - RNA, 18 nt, Mycobacterium bovis subsp bovis AF2122/97
acccagcgcagcagcggc

SEQ ID NO: 1156076 - RNA, 17 nt, Mycobacterium bovis subsp bovis AF2122/97
acccagcgcccggccac

SEQ ID NO: 1156077 - RNA, 14 nt, Mycobacterium bovis subsp bovis AF2122/97
acccagcggcgcca

SEQ ID NO: 1156078 - RNA, 16 nt, Mycobacterium bovis subsp bovis AF2122/97
acccagcggcgccacg

SEQ ID NO: 1156079 - RNA, 17 nt, Mycobacterium bovis subsp bovis AF2122/97
accauguuaacgcgcgu

SEQ ID NO: 1156080 - RNA, 21 nt, Mycobacterium bovis subsp bovis AF2122/97
accauuguuccguccccgacg

SEQ ID NO: 1156081 - RNA, 16 nt, Mycobacterium bovis subsp bovis AF2122/97
acccagccagcagcgg

SEQ ID NO: 1156082 - RNA, 18 nt, Mycobacterium bovis subsp bovis AF2122/97
acccagccagcagcggcg

SEQ ID NO: 1156083 - RNA, 15 nt, Mycobacterium bovis subsp bovis AF2122/97
acccagccagccgcg

SEQ ID NO: 1156084 - RNA, 22 nt, Mycobacterium bovis subsp bovis AF2122/97
acccgcggggaaucacccacuc

SEQ ID NO: 1156085 - RNA, 17 nt, Mycobacterium bovis subsp bovis AF2122/97
acccgcgggucguccgg

SEQ ID NO: 1156086 - RNA, 19 nt, Mycobacterium bovis subsp bovis AF2122/97
acccgcgggucguccggcg

SEQ ID NO: 1156087 - RNA, 22 nt, Mycobacterium bovis subsp bovis AF2122/97
acccgcgggucguccggcggca

SEQ ID NO: 1156088 - RNA, 16 nt, Mycobacterium bovis subsp bovis AF2122/97
acccgcgguagcggac

SEQ ID NO: 1156089 - RNA, 15 nt, Mycobacterium bovis subsp bovis AF2122/97
acccgcggcgccguu

SEQ ID NO: 1156090 - RNA, 12 nt, Mycobacterium bovis subsp bovis AF2122/97
acccgcggcagc

SEQ ID NO: 1156091 - RNA, 18 nt, Mycobacterium bovis subsp bovis AF2122/97
acccgcuacgacgguccg

SEQ ID NO: 1156092 - RNA, 17 nt, Mycobacterium bovis subsp bovis AF2122/97
acccgcguugaaggcgc

SEQ ID NO: 1156093 - RNA, 20 nt, Mycobacterium bovis subsp bovis AF2122/97
acccgcguugaaggcgccgg

SEQ ID NO: 1156094 - RNA, 16 nt, Mycobacterium bovis subsp bovis AF2122/97
acccgcuccagcucgg

SEQ ID NO: 1156095 - RNA, 13 nt, Mycobacterium bovis subsp bovis AF2122/97
acccgcucgcccg

SEQ ID NO: 1156096 - RNA, 19 nt, Mycobacterium bovis subsp bovis AF2122/97
acccgcucgcccgccgcca

SEQ ID NO: 1156097 - RNA, 23 nt, Mycobacterium bovis subsp bovis AF2122/97
acccgcucacgcucacccggcgu

SEQ ID NO: 1156098 - RNA, 13 nt, Mycobacterium bovis subsp bovis AF2122/97
acccgcuccaccc

SEQ ID NO: 1156099 - RNA, 23 nt, Mycobacterium bovis subsp bovis AF2122/97
acccgccgugaguagguccacgu

SEQ ID NO: 1156100 - RNA, 19 nt, Mycobacterium bovis subsp bovis AF2122/97
acccgccguugccaccggu

SEQ ID NO: 1156101 - RNA, 23 nt, Mycobacterium bovis subsp bovis AF2122/97
acccgccguugccaccggugccg

SEQ ID NO: 1156102 - RNA, 21 nt, Mycobacterium bovis subsp bovis AF2122/97
acccgccuaaagcgugucgcc

SEQ ID NO: 1156103 - RNA, 15 nt, Mycobacterium bovis subsp bovis AF2122/97
acccgccucgggccg

SEQ ID NO: 1156104 - RNA, 18 nt, Mycobacterium bovis subsp bovis AF2122/97
acccgccucgggccggcg

SEQ ID NO: 1156105 - RNA, 19 nt, Mycobacterium bovis subsp bovis AF2122/97
acccgccucgggccggcgu

SEQ ID NO: 1156106 - RNA, 18 nt, Mycobacterium bovis subsp bovis AF2122/97
acccgcgaacgcgacagc

SEQ ID NO: 1156107 - RNA, 20 nt, Mycobacterium bovis subsp bovis AF2122/97
acccgcgaacgcgacagcca

SEQ ID NO: 1156108 - RNA, 14 nt, Mycobacterium bovis subsp bovis AF2122/97
acccgcgccgcccg

SEQ ID NO: 1156109 - RNA, 16 nt, Mycobacterium bovis subsp bovis AF2122/97
acccgcgccgcgcauc

SEQ ID NO: 1156110 - RNA, 21 nt, Mycobacterium bovis subsp bovis AF2122/97
acccgcgccgcgcaucgcggc

SEQ ID NO: 1156111 - RNA, 19 nt, Mycobacterium bovis subsp bovis AF2122/97
acccgccuguaccggcguu

SEQ ID NO: 1156112 - RNA, 18 nt, Mycobacterium bovis subsp bovis AF2122/97
acccgcgagaucgggccg

SEQ ID NO: 1156113 - RNA, 20 nt, Mycobacterium bovis subsp bovis AF2122/97
acccgcgagaucgggccggc

SEQ ID NO: 1156114 - RNA, 23 nt, Mycobacterium bovis subsp bovis AF2122/97
acccgcgagaucgggccggccgc

SEQ ID NO: 1156115 - RNA, 20 nt, Mycobacterium bovis subsp bovis AF2122/97
acccgcgagcaucgacgaac

SEQ ID NO: 1156116 - RNA, 20 nt, Mycobacterium bovis subsp bovis AF2122/97
acccgcgagguugaccacca

SEQ ID NO: 1156117 - RNA, 13 nt, Mycobacterium bovis subsp bovis AF2122/97
acccgcgcgaugc

SEQ ID NO: 1156118 - RNA, 13 nt, Mycobacterium bovis subsp bovis AF2122/97
acccgcgcgccgg

SEQ ID NO: 1156119 - RNA, 16 nt, Mycobacterium bovis subsp bovis AF2122/97
acccgcgcgccggcga

SEQ ID NO: 1156120 - RNA, 15 nt, Mycobacterium bovis subsp bovis AF2122/97
acccgcgccggccgc

SEQ ID NO: 1156121 - RNA, 12 nt, Mycobacterium bovis subsp bovis AF2122/97
accccggccacu

SEQ ID NO: 1156122 - RNA, 19 nt, Mycobacterium bovis subsp bovis AF2122/97
accccggccuugccaccgg

SEQ ID NO: 1156123 - RNA, 20 nt, Mycobacterium bovis subsp bovis AF2122/97
accccggccuuggcggcggc

SEQ ID NO: 1156124 - RNA, 16 nt, Mycobacterium bovis subsp bovis AF2122/97
accccggccggcuagc

SEQ ID NO: 1156125 - RNA, 21 nt, Mycobacterium bovis subsp bovis AF2122/97
accccggccccgacggucaac

SEQ ID NO: 1156126 - RNA, 16 nt, Mycobacterium bovis subsp bovis AF2122/97
accccggcguugccgc

SEQ ID NO: 1156127 - RNA, 15 nt, Mycobacterium bovis subsp bovis AF2122/97
accccggcgguaccg

SEQ ID NO: 1156128 - RNA, 15 nt, Mycobacterium bovis subsp bovis AF2122/97
accccggcggucagg

SEQ ID NO: 1156129 - RNA, 21 nt, Mycobacterium bovis subsp bovis AF2122/97
acccgaguuauagaagccgac

SEQ ID NO: 1156130 - RNA, 23 nt, Mycobacterium bovis subsp bovis AF2122/97
acccgaguuauagaagccgacgu

SEQ ID NO: 1156131 - RNA, 16 nt, Mycobacterium bovis subsp bovis AF2122/97
acccgaucaaugcggu

SEQ ID NO: 1156132 - RNA, 23 nt, Mycobacterium bovis subsp bovis AF2122/97
acccgaucagguacgccaggugc

SEQ ID NO: 1156133 - RNA, 20 nt, Mycobacterium bovis subsp bovis AF2122/97
acccgcagguagucgucgac

SEQ ID NO: 1156134 - RNA, 13 nt, Mycobacterium bovis subsp bovis AF2122/97
acccgcaggucgc

SEQ ID NO: 1156135 - RNA, 16 nt, Mycobacterium bovis subsp bovis AF2122/97
acccgcaggucgcacc

SEQ ID NO: 1156136 - RNA, 14 nt, Mycobacterium bovis subsp bovis AF2122/97
acccgcagucgguc

SEQ ID NO: 1156137 - RNA, 15 nt, Mycobacterium bovis subsp bovis AF2122/97
acccgcaacuacggc

SEQ ID NO: 1156138 - RNA, 16 nt, Mycobacterium bovis subsp bovis AF2122/97
acccgcaacuacggcg

SEQ ID NO: 1156139 - RNA, 18 nt, Mycobacterium bovis subsp bovis AF2122/97
acccgaugcgucucgcgc

SEQ ID NO: 1156140 - RNA, 16 nt, Mycobacterium bovis subsp bovis AF2122/97
acccgcccacggcacc

SEQ ID NO: 1156141 - RNA, 13 nt, Mycobacterium bovis subsp bovis AF2122/97
acccgccaccgcg

SEQ ID NO: 1156142 - RNA, 22 nt, Mycobacterium bovis subsp bovis AF2122/97
acccgccaccgcgacaccccgg

SEQ ID NO: 1156143 - RNA, 21 nt, Mycobacterium bovis subsp bovis AF2122/97
acccgcauggacgcgaugacc

SEQ ID NO: 1156144 - RNA, 17 nt, Mycobacterium bovis subsp bovis AF2122/97
acccgcauggcagcggc

SEQ ID NO: 1156145 - RNA, 15 nt, Mycobacterium bovis subsp bovis AF2122/97
acccgcaugacgccg

SEQ ID NO: 1156146 - RNA, 17 nt, Mycobacterium bovis subsp bovis AF2122/97
acccgcauggacgcgau

SEQ ID NO: 1156147 - RNA, 15 nt, Mycobacterium bovis subsp bovis AF2122/97
acccgcaguggucgg

SEQ ID NO: 1156148 - RNA, 14 nt, Mycobacterium bovis subsp bovis AF2122/97
accccggccaccag

SEQ ID NO: 1156149 - RNA, 22 nt, Mycobacterium bovis subsp bovis AF2122/97
acccgcccggaacggguuggcg

SEQ ID NO: 1156150 - RNA, 18 nt, Mycobacterium bovis subsp bovis AF2122/97
acccgccagggcggcauc

SEQ ID NO: 1156151 - RNA, 14 nt, Mycobacterium bovis subsp bovis AF2122/97
acggcggccgccac

SEQ ID NO: 1156152 - RNA, 23 nt, Mycobacterium bovis subsp bovis AF2122/97
acggcggaagaagugcacugcga

SEQ ID NO: 1156153 - RNA, 14 nt, Mycobacterium bovis subsp bovis AF2122/97
acggcggccauggc

SEQ ID NO: 1156154 - RNA, 17 nt, Mycobacterium bovis subsp bovis AF2122/97
acggcggcaggccggcc

SEQ ID NO: 1156155 - RNA, 18 nt, Mycobacterium bovis subsp bovis AF2122/97
acggcggcaggccggcca

SEQ ID NO: 1156156 - RNA, 14 nt, Mycobacterium bovis subsp bovis AF2122/97
acggcggcagucgc

SEQ ID NO: 1156157 - RNA, 20 nt, Mycobacterium bovis subsp bovis AF2122/97
acggcggcagucgcgguacc

SEQ ID NO: 1156158 - RNA, 18 nt, Mycobacterium bovis subsp bovis AF2122/97
acggcggccaaggucgac

SEQ ID NO: 1156159 - RNA, 12 nt, Mycobacterium bovis subsp bovis AF2122/97
acggcggccacg

SEQ ID NO: 1156160 - RNA, 16 nt, Mycobacterium bovis subsp bovis AF2122/97
acggcggccgcgaugg

SEQ ID NO: 1156161 - RNA, 13 nt, Mycobacterium bovis subsp bovis AF2122/97
acggcggcgacgg

SEQ ID NO: 1156162 - RNA, 21 nt, Mycobacterium bovis subsp bovis AF2122/97
acggcggcgaggcggucgccg

SEQ ID NO: 1156163 - RNA, 22 nt, Mycobacterium bovis subsp bovis AF2122/97
acggcggcgaggcggucgccga

SEQ ID NO: 1156164 - RNA, 15 nt, Mycobacterium bovis subsp bovis AF2122/97
acggcggcgccgccc

SEQ ID NO: 1156165 - RNA, 18 nt, Mycobacterium bovis subsp bovis AF2122/97
acggcggcgccgcccaac

SEQ ID NO: 1156166 - RNA, 23 nt, Mycobacterium bovis subsp bovis AF2122/97
acggcggcgugggagguggcgcg

SEQ ID NO: 1156167 - RNA, 17 nt, Mycobacterium bovis subsp bovis AF2122/97
acggcggccgcgauggc

SEQ ID NO: 1156168 - RNA, 13 nt, Mycobacterium bovis subsp bovis AF2122/97
acggcggcgucgc

SEQ ID NO: 1156169 - RNA, 16 nt, Mycobacterium bovis subsp bovis AF2122/97
acggcggcgucgcggu

SEQ ID NO: 1156170 - RNA, 16 nt, Mycobacterium bovis subsp bovis AF2122/97
acggcggcgucgauga

SEQ ID NO: 1156171 - RNA, 18 nt, Mycobacterium bovis subsp bovis AF2122/97
acggcgggccgcgcggcg

SEQ ID NO: 1156172 - RNA, 21 nt, Mycobacterium bovis subsp bovis AF2122/97
acggcgggccgcgcggcgaca

SEQ ID NO: 1156173 - RNA, 15 nt, Mycobacterium bovis subsp bovis AF2122/97
acggcggcugucggc

SEQ ID NO: 1156174 - RNA, 15 nt, Mycobacterium bovis subsp bovis AF2122/97
acggcgggcgacccg

SEQ ID NO: 1156175 - RNA, 21 nt, Mycobacterium bovis subsp bovis AF2122/97
acggcgggcgauuucggcgcc

SEQ ID NO: 1156176 - RNA, 17 nt, Mycobacterium bovis subsp bovis AF2122/97
acggccagugccaucgc

SEQ ID NO: 1156177 - RNA, 21 nt, Mycobacterium bovis subsp bovis AF2122/97
acggccagugcgcagaacacc

SEQ ID NO: 1156178 - RNA, 14 nt, Mycobacterium bovis subsp bovis AF2122/97
acggccagcgcguc

SEQ ID NO: 1156179 - RNA, 14 nt, Mycobacterium bovis subsp bovis AF2122/97
acggccaggucgac

SEQ ID NO: 1156180 - RNA, 15 nt, Mycobacterium bovis subsp bovis AF2122/97
acggcggcagcggcg

SEQ ID NO: 1156181 - RNA, 23 nt, Mycobacterium bovis subsp bovis AF2122/97
acggcggcaacggcggcaucggc

SEQ ID NO: 1156182 - RNA, 19 nt, Mycobacterium bovis subsp bovis AF2122/97
acggcggcacgggcggcca

SEQ ID NO: 1156183 - RNA, 23 nt, Mycobacterium bovis subsp bovis AF2122/97
acggcggcacgggcggccauggc

SEQ ID NO: 1156184 - RNA, 23 nt, Mycobacterium bovis subsp bovis AF2122/97
acggccagugucagcacgacgac

SEQ ID NO: 1156185 - RNA, 19 nt, Mycobacterium bovis subsp bovis AF2122/97
acggccaguugguagccgc

SEQ ID NO: 1156186 - RNA, 17 nt, Mycobacterium bovis subsp bovis AF2122/97
acggccauauugggagu

SEQ ID NO: 1156187 - RNA, 20 nt, Mycobacterium bovis subsp bovis AF2122/97
acggcgggaacggugccgau

SEQ ID NO: 1156188 - RNA, 19 nt, Mycobacterium bovis subsp bovis AF2122/97
acggcggugcggguggugc

SEQ ID NO: 1156189 - RNA, 20 nt, Mycobacterium bovis subsp bovis AF2122/97
acggcguagacguccgcggu

SEQ ID NO: 1156190 - RNA, 18 nt, Mycobacterium bovis subsp bovis AF2122/97
acggcggguuuucucgcc

SEQ ID NO: 1156191 - RNA, 15 nt, Mycobacterium bovis subsp bovis AF2122/97
acggcgguaccgccg

SEQ ID NO: 1156192 - RNA, 16 nt, Mycobacterium bovis subsp bovis AF2122/97
acggcgguaccgccgc

SEQ ID NO: 1156193 - RNA, 14 nt, Mycobacterium bovis subsp bovis AF2122/97
acggcggggcggcg

SEQ ID NO: 1156194 - RNA, 18 nt, Mycobacterium bovis subsp bovis AF2122/97
acggcggggcggcggugg

SEQ ID NO: 1156195 - RNA, 16 nt, Mycobacterium bovis subsp bovis AF2122/97
acggcgggcggccgcu

SEQ ID NO: 1156196 - RNA, 18 nt, Mycobacterium bovis subsp bovis AF2122/97
acggcggggccggcggcu

SEQ ID NO: 1156197 - RNA, 21 nt, Mycobacterium bovis subsp bovis AF2122/97
acggcgggaugcagcugcccg

SEQ ID NO: 1156198 - RNA, 22 nt, Mycobacterium bovis subsp bovis AF2122/97
acggcgggccgcgcggcgacag

SEQ ID NO: 1156199 - RNA, 15 nt, Mycobacterium bovis subsp bovis AF2122/97
acgggacgacggcaa

SEQ ID NO: 1156200 - RNA, 14 nt, Mycobacterium bovis subsp bovis AF2122/97
acgggauagccguu

SEQ ID NO: 1156201 - RNA, 16 nt, Mycobacterium bovis subsp bovis AF2122/97
acgggaucgacccgcc

SEQ ID NO: 1156202 - RNA, 12 nt, Mycobacterium bovis subsp bovis AF2122/97
acgggaacgucc

SEQ ID NO: 1156203 - RNA, 17 nt, Mycobacterium bovis subsp bovis AF2122/97
acgggaaacuccgcggc

SEQ ID NO: 1156204 - RNA, 18 nt, Mycobacterium bovis subsp bovis AF2122/97
acggcguacgccggaccc

SEQ ID NO: 1156205 - RNA, 20 nt, Mycobacterium bovis subsp bovis AF2122/97
acggcguacgccggacccgg

SEQ ID NO: 1156206 - RNA, 13 nt, Mycobacterium bovis subsp bovis AF2122/97
acgggcggccagg

SEQ ID NO: 1156207 - RNA, 19 nt, Mycobacterium bovis subsp bovis AF2122/97
acgggcggggacggcggca

SEQ ID NO: 1156208 - RNA, 16 nt, Mycobacterium bovis subsp bovis AF2122/97
acgggcuaccggcagc

SEQ ID NO: 1156209 - RNA, 12 nt, Mycobacterium bovis subsp bovis AF2122/97
acgggcucggca

SEQ ID NO: 1156210 - RNA, 21 nt, Mycobacterium bovis subsp bovis AF2122/97
acgggcugacgaucuccaccc

SEQ ID NO: 1156211 - RNA, 14 nt, Mycobacterium bovis subsp bovis AF2122/97
acgggcacgcggcg

SEQ ID NO: 1156212 - RNA, 15 nt, Mycobacterium bovis subsp bovis AF2122/97
acgggcacgcggcga

SEQ ID NO: 1156213 - RNA, 19 nt, Mycobacterium bovis subsp bovis AF2122/97
acgggcgcguccucgccgc

SEQ ID NO: 1156214 - RNA, 21 nt, Mycobacterium bovis subsp bovis AF2122/97
acgggcgcguccucgccgcac

SEQ ID NO: 1156215 - RNA, 17 nt, Mycobacterium bovis subsp bovis AF2122/97
acgggacgccgugugca

SEQ ID NO: 1156216 - RNA, 13 nt, Mycobacterium bovis subsp bovis AF2122/97
acgggaugccggc

SEQ ID NO: 1156217 - RNA, 15 nt, Mycobacterium bovis subsp bovis AF2122/97
acgggaugccggcga

SEQ ID NO: 1156218 - RNA, 20 nt, Mycobacterium bovis subsp bovis AF2122/97
acgggcaaaccauugcgccu

SEQ ID NO: 1156219 - RNA, 16 nt, Mycobacterium bovis subsp bovis AF2122/97
acggguuggcgaucau

SEQ ID NO: 1156220 - RNA, 17 nt, Mycobacterium bovis subsp bovis AF2122/97
acgggucguaggacacc

SEQ ID NO: 1156221 - RNA, 20 nt, Mycobacterium bovis subsp bovis AF2122/97
acgggucuggccaacgccgg

SEQ ID NO: 1156222 - RNA, 21 nt, Mycobacterium bovis subsp bovis AF2122/97
acgggugaaggaugcggcccc

SEQ ID NO: 1156223 - RNA, 16 nt, Mycobacterium bovis subsp bovis AF2122/97
acgggucgccgccauc

SEQ ID NO: 1156224 - RNA, 12 nt, Mycobacterium bovis subsp bovis AF2122/97
acgggucgcggu

SEQ ID NO: 1156225 - RNA, 12 nt, Mycobacterium bovis subsp bovis AF2122/97
acgggucggcga

SEQ ID NO: 1156226 - RNA, 15 nt, Mycobacterium bovis subsp bovis AF2122/97
acgggucggcgccga

SEQ ID NO: 1156227 - RNA, 14 nt, Mycobacterium bovis subsp bovis AF2122/97
acggucaccggcgc

SEQ ID NO: 1156228 - RNA, 19 nt, Mycobacterium bovis subsp bovis AF2122/97
acggucaccggcgcaccgg

SEQ ID NO: 1156229 - RNA, 19 nt, Mycobacterium bovis subsp bovis AF2122/97
acggucagcagacugccga

SEQ ID NO: 1156230 - RNA, 23 nt, Mycobacterium bovis subsp bovis AF2122/97
acggucaaaugaauggugaccgg

SEQ ID NO: 1156231 - RNA, 14 nt, Mycobacterium bovis subsp bovis AF2122/97
acggucaagccggc

SEQ ID NO: 1156232 - RNA, 15 nt, Mycobacterium bovis subsp bovis AF2122/97
acggucaagccggcg

SEQ ID NO: 1156233 - RNA, 16 nt, Mycobacterium bovis subsp bovis AF2122/97
acggucaagccggcgc

SEQ ID NO: 1156234 - RNA, 22 nt, Mycobacterium bovis subsp bovis AF2122/97
acggucaaggugcgccgccauc

SEQ ID NO: 1156235 - RNA, 15 nt, Mycobacterium bovis subsp bovis AF2122/97
acggucaaucccggc

SEQ ID NO: 1156236 - RNA, 23 nt, Mycobacterium bovis subsp bovis AF2122/97
acggucaaucccggccaggggcg

SEQ ID NO: 1156237 - RNA, 21 nt, Mycobacterium bovis subsp bovis AF2122/97
acggucacacgccagccgguu

SEQ ID NO: 1156238 - RNA, 12 nt, Mycobacterium bovis subsp bovis AF2122/97
acggucaccggc

SEQ ID NO: 1156239 - RNA, 22 nt, Mycobacterium bovis subsp bovis AF2122/97
acggucagcucgcugacggcaa

SEQ ID NO: 1156240 - RNA, 16 nt, Mycobacterium bovis subsp bovis AF2122/97
acggucauccggccgu

SEQ ID NO: 1156241 - RNA, 15 nt, Mycobacterium bovis subsp bovis AF2122/97
acgguagccaagcga

SEQ ID NO: 1156242 - RNA, 20 nt, Mycobacterium bovis subsp bovis AF2122/97
acgguacugugggcgaucgg

SEQ ID NO: 1156243 - RNA, 18 nt, Mycobacterium bovis subsp bovis AF2122/97
acgguccguucgcgccgu

SEQ ID NO: 1156244 - RNA, 19 nt, Mycobacterium bovis subsp bovis AF2122/97
acgguccgccacggcgggc

SEQ ID NO: 1156245 - RNA, 17 nt, Mycobacterium bovis subsp bovis AF2122/97
acgguccggcccaccag

SEQ ID NO: 1156246 - RNA, 22 nt, Mycobacterium bovis subsp bovis AF2122/97
acgguccggcccaccagcgcag

SEQ ID NO: 1156247 - RNA, 12 nt, Mycobacterium bovis subsp bovis AF2122/97
acgguccggcgu

SEQ ID NO: 1156248 - RNA, 15 nt, Mycobacterium bovis subsp bovis AF2122/97
acggucguuggucgg

SEQ ID NO: 1156249 - RNA, 18 nt, Mycobacterium bovis subsp bovis AF2122/97
acggucguuggucggggu

SEQ ID NO: 1156250 - RNA, 17 nt, Mycobacterium bovis subsp bovis AF2122/97
acgguggcuucgacggc

SEQ ID NO: 1156251 - RNA, 20 nt, Mycobacterium bovis subsp bovis AF2122/97
acgguggcuucgacggcggc

SEQ ID NO: 1156252 - RNA, 22 nt, Mycobacterium bovis subsp bovis AF2122/97
acgguggcuucgacggcggcca

SEQ ID NO: 1156253 - RNA, 13 nt, Mycobacterium bovis subsp bovis AF2122/97
acggucagcucgc

SEQ ID NO: 1156254 - RNA, 15 nt, Mycobacterium bovis subsp bovis AF2122/97
acgguggcgccgaac

SEQ ID NO: 1156255 - RNA, 20 nt, Mycobacterium bovis subsp bovis AF2122/97
acgguggcgccgaacgcaac

SEQ ID NO: 1156256 - RNA, 16 nt, Mycobacterium bovis subsp bovis AF2122/97
acggugucaacggcac

SEQ ID NO: 1156257 - RNA, 13 nt, Mycobacterium bovis subsp bovis AF2122/97
acggugucccgcg

SEQ ID NO: 1156258 - RNA, 17 nt, Mycobacterium bovis subsp bovis AF2122/97
acgguguagccgccggc

SEQ ID NO: 1156259 - RNA, 20 nt, Mycobacterium bovis subsp bovis AF2122/97
acgguguagccgccggcagu

SEQ ID NO: 1156260 - RNA, 21 nt, Mycobacterium bovis subsp bovis AF2122/97
acgguguagccgccggcagug

SEQ ID NO: 1156261 - RNA, 17 nt, Mycobacterium bovis subsp bovis AF2122/97
acgguggugaccgcggg

SEQ ID NO: 1156262 - RNA, 20 nt, Mycobacterium bovis subsp bovis AF2122/97
acggugguaagacgccgaac

SEQ ID NO: 1156263 - RNA, 18 nt, Mycobacterium bovis subsp bovis AF2122/97
acgguguggaaaccgcgg

SEQ ID NO: 1156264 - RNA, 22 nt, Mycobacterium bovis subsp bovis AF2122/97
acggugucgcgaugcuucccgg

SEQ ID NO: 1156265 - RNA, 13 nt, Mycobacterium bovis subsp bovis AF2122/97
acgguguccggau

SEQ ID NO: 1156266 - RNA, 22 nt, Mycobacterium bovis subsp bovis AF2122/97
acgguguuggugaccgggucga

SEQ ID NO: 1156267 - RNA, 22 nt, Mycobacterium bovis subsp bovis AF2122/97
acgguguugguggccgggucga

SEQ ID NO: 1156268 - RNA, 22 nt, Mycobacterium bovis subsp bovis AF2122/97
acgguguugguguucgggucga

SEQ ID NO: 1156269 - RNA, 16 nt, Mycobacterium bovis subsp bovis AF2122/97
acgguuacccagccgu

SEQ ID NO: 1156270 - RNA, 15 nt, Mycobacterium bovis subsp bovis AF2122/97
acgguugccgcgauc

SEQ ID NO: 1156271 - RNA, 22 nt, Mycobacterium bovis subsp bovis AF2122/97
acgucgcgguaggcgggagaga

SEQ ID NO: 1156272 - RNA, 21 nt, Mycobacterium bovis subsp bovis AF2122/97
acgucgcggguaaccggcucc

SEQ ID NO: 1156273 - RNA, 19 nt, Mycobacterium bovis subsp bovis AF2122/97
acgucgcggauugccgcgc

SEQ ID NO: 1156274 - RNA, 20 nt, Mycobacterium bovis subsp bovis AF2122/97
acgucgcggcguuguugcgg

SEQ ID NO: 1156275 - RNA, 17 nt, Mycobacterium bovis subsp bovis AF2122/97
acgucggcaaucucgau

SEQ ID NO: 1156276 - RNA, 17 nt, Mycobacterium bovis subsp bovis AF2122/97
acgucgcuagaucccag

SEQ ID NO: 1156277 - RNA, 15 nt, Mycobacterium bovis subsp bovis AF2122/97
acgucggcaucggcg

SEQ ID NO: 1156278 - RNA, 15 nt, Mycobacterium bovis subsp bovis AF2122/97
acgucgcgcaucgcc

SEQ ID NO: 1156279 - RNA, 15 nt, Mycobacterium bovis subsp bovis AF2122/97
acgucgccucgagau

SEQ ID NO: 1156280 - RNA, 14 nt, Mycobacterium bovis subsp bovis AF2122/97
acgucgccgcggcg

SEQ ID NO: 1156281 - RNA, 20 nt, Mycobacterium bovis subsp bovis AF2122/97
acgucgccgacccgggggcg

SEQ ID NO: 1156282 - RNA, 18 nt, Mycobacterium bovis subsp bovis AF2122/97
acgucgccggcuaccgcc

SEQ ID NO: 1156283 - RNA, 17 nt, Mycobacterium bovis subsp bovis AF2122/97
acguauccacggucgac

SEQ ID NO: 1156284 - RNA, 19 nt, Mycobacterium bovis subsp bovis AF2122/97
acgguugguccgccgucga

SEQ ID NO: 1156285 - RNA, 22 nt, Mycobacterium bovis subsp bovis AF2122/97
acgguugguccgccgucgacca

SEQ ID NO: 1156286 - RNA, 17 nt, Mycobacterium bovis subsp bovis AF2122/97
acgguugccgcgaucgg

SEQ ID NO: 1156287 - RNA, 16 nt, Mycobacterium bovis subsp bovis AF2122/97
acgguugccggcggcg

SEQ ID NO: 1156288 - RNA, 20 nt, Mycobacterium bovis subsp bovis AF2122/97
acgguugcucguccaagccg

SEQ ID NO: 1156289 - RNA, 17 nt, Mycobacterium bovis subsp bovis AF2122/97
acgguuucgaccaccac

SEQ ID NO: 1156290 - RNA, 17 nt, Mycobacterium bovis subsp bovis AF2122/97
acguagcgaccgcgguc

SEQ ID NO: 1156291 - RNA, 16 nt, Mycobacterium bovis subsp bovis AF2122/97
acguagugcaccgccu

SEQ ID NO: 1156292 - RNA, 14 nt, Mycobacterium bovis subsp bovis AF2122/97
acguauaccgcacc

SEQ ID NO: 1156293 - RNA, 16 nt, Mycobacterium bovis subsp bovis AF2122/97
acguaggacugccagc

SEQ ID NO: 1156294 - RNA, 18 nt, Mycobacterium bovis subsp bovis AF2122/97
acgugcaugagcguucag

SEQ ID NO: 1156295 - RNA, 22 nt, Mycobacterium bovis subsp bovis AF2122/97
acgugccaaugauucggcacgc

SEQ ID NO: 1156296 - RNA, 15 nt, Mycobacterium bovis subsp bovis AF2122/97
acgugcgucggcccg

SEQ ID NO: 1156297 - RNA, 15 nt, Mycobacterium bovis subsp bovis AF2122/97
acgugcaggaacacc

SEQ ID NO: 1156298 - RNA, 17 nt, Mycobacterium bovis subsp bovis AF2122/97
acgugcaggaacaccca

SEQ ID NO: 1156299 - RNA, 16 nt, Mycobacterium bovis subsp bovis AF2122/97
acgugaucgacgaccg

SEQ ID NO: 1156300 - RNA, 16 nt, Mycobacterium bovis subsp bovis AF2122/97
acgugcuggugggccg

SEQ ID NO: 1156301 - RNA, 23 nt, Mycobacterium bovis subsp bovis AF2122/97
acgugcucguagacuugcugcuc

SEQ ID NO: 1156302 - RNA, 13 nt, Mycobacterium bovis subsp bovis AF2122/97
acgugcugccgau

SEQ ID NO: 1156303 - RNA, 18 nt, Mycobacterium bovis subsp bovis AF2122/97
acgugcugccgauagcgc

SEQ ID NO: 1156304 - RNA, 16 nt, Mycobacterium bovis subsp bovis AF2122/97
acguggaugucucgau

SEQ ID NO: 1156305 - RNA, 16 nt, Mycobacterium bovis subsp bovis AF2122/97
acguggcccuccucgg

SEQ ID NO: 1156306 - RNA, 17 nt, Mycobacterium bovis subsp bovis AF2122/97
acguggcccuccucggu

SEQ ID NO: 1156307 - RNA, 19 nt, Mycobacterium bovis subsp bovis AF2122/97
acguggcgcuggaccgggu

SEQ ID NO: 1156308 - RNA, 15 nt, Mycobacterium bovis subsp bovis AF2122/97
acguggcgaccggcg

SEQ ID NO: 1156309 - RNA, 20 nt, Mycobacterium bovis subsp bovis AF2122/97
acguggguacgcaucucgag

SEQ ID NO: 1156310 - RNA, 22 nt, Mycobacterium bovis subsp bovis AF2122/97
acguggcuugaguuucggcgca

SEQ ID NO: 1156311 - RNA, 18 nt, Mycobacterium bovis subsp bovis AF2122/97
acgugggccaacgacgcc

SEQ ID NO: 1156312 - RNA, 13 nt, Mycobacterium bovis subsp bovis AF2122/97
acgucgucguggu

SEQ ID NO: 1156313 - RNA, 14 nt, Mycobacterium bovis subsp bovis AF2122/97
acgucgugaccggc

SEQ ID NO: 1156314 - RNA, 16 nt, Mycobacterium bovis subsp bovis AF2122/97
acgucgugaccggcgg

SEQ ID NO: 1156315 - RNA, 22 nt, Mycobacterium bovis subsp bovis AF2122/97
acgucgucgaauccugccgcac

SEQ ID NO: 1156316 - RNA, 18 nt, Mycobacterium bovis subsp bovis AF2122/97
acgucguggcgcucggcg

SEQ ID NO: 1156317 - RNA, 23 nt, Mycobacterium bovis subsp bovis AF2122/97
acgucguuuggccucagcccggc

SEQ ID NO: 1156318 - RNA, 16 nt, Mycobacterium bovis subsp bovis AF2122/97
acgucguugccgucca

SEQ ID NO: 1156319 - RNA, 22 nt, Mycobacterium bovis subsp bovis AF2122/97
acgucguugggcaugucgccga

SEQ ID NO: 1156320 - RNA, 22 nt, Mycobacterium bovis subsp bovis AF2122/97
acgucguugugcagaucgucgc

SEQ ID NO: 1156321 - RNA, 23 nt, Mycobacterium bovis subsp bovis AF2122/97
acgugauggugacuucgguggcg

SEQ ID NO: 1156322 - RNA, 22 nt, Mycobacterium bovis subsp bovis AF2122/97
acgugauauccuuugccgccga

SEQ ID NO: 1156323 - RNA, 22 nt, Mycobacterium bovis subsp bovis AF2122/97
acgugaugcguucggccgggcc

SEQ ID NO: 1156324 - RNA, 20 nt, Mycobacterium bovis subsp bovis AF2122/97
acgugauauccuuugccgcc

SEQ ID NO: 1156325 - RNA, 20 nt, Mycobacterium bovis subsp bovis AF2122/97
acgugauagcuugcgucgca

SEQ ID NO: 1156326 - RNA, 15 nt, Mycobacterium bovis subsp bovis AF2122/97
acgugagugccggcg

SEQ ID NO: 1156327 - RNA, 16 nt, Mycobacterium bovis subsp bovis AF2122/97
acgugagugccggcgu

SEQ ID NO: 1156328 - RNA, 17 nt, Mycobacterium bovis subsp bovis AF2122/97
acguuguucaccgacgc

SEQ ID NO: 1156329 - RNA, 21 nt, Mycobacterium bovis subsp bovis AF2122/97
acguuguuggauccggccacc

SEQ ID NO: 1156330 - RNA, 15 nt, Mycobacterium bovis subsp bovis AF2122/97
acguuuagggugccc

SEQ ID NO: 1156331 - RNA, 19 nt, Mycobacterium bovis subsp bovis AF2122/97
acguucggcacaaccaacg

SEQ ID NO: 1156332 - RNA, 18 nt, Mycobacterium bovis subsp bovis AF2122/97
acguuggcggccagcgca

SEQ ID NO: 1156333 - RNA, 18 nt, Mycobacterium bovis subsp bovis AF2122/97
acguuggcgugcaccgca

SEQ ID NO: 1156334 - RNA, 16 nt, Mycobacterium bovis subsp bovis AF2122/97
acguguucuggucgcg

SEQ ID NO: 1156335 - RNA, 22 nt, Mycobacterium bovis subsp bovis AF2122/97
acguuagcauugaguucggcca

SEQ ID NO: 1156336 - RNA, 17 nt, Mycobacterium bovis subsp bovis AF2122/97
acuacggccuggccacc

SEQ ID NO: 1156337 - RNA, 18 nt, Mycobacterium bovis subsp bovis AF2122/97
acuacgggucuggccaac

SEQ ID NO: 1156338 - RNA, 14 nt, Mycobacterium bovis subsp bovis AF2122/97
acuacggugcccug

SEQ ID NO: 1156339 - RNA, 15 nt, Mycobacterium bovis subsp bovis AF2122/97
acuacggcguccccg

SEQ ID NO: 1156340 - RNA, 14 nt, Mycobacterium bovis subsp bovis AF2122/97
acuaccgccggcgg

SEQ ID NO: 1156341 - RNA, 16 nt, Mycobacterium bovis subsp bovis AF2122/97
acuaccgccggcggcg

SEQ ID NO: 1156342 - RNA, 18 nt, Mycobacterium bovis subsp bovis AF2122/97
acuaccgugcauaccgca

SEQ ID NO: 1156343 - RNA, 14 nt, Mycobacterium bovis subsp bovis AF2122/97
acuacccagccagc

SEQ ID NO: 1156344 - RNA, 13 nt, Mycobacterium bovis subsp bovis AF2122/97
acuaccacccgca

SEQ ID NO: 1156345 - RNA, 16 nt, Mycobacterium bovis subsp bovis AF2122/97
acuaggcccagcacgg

SEQ ID NO: 1156346 - RNA, 20 nt, Mycobacterium bovis subsp bovis AF2122/97
acuaggccccuggccgccgc

SEQ ID NO: 1156347 - RNA, 16 nt, Mycobacterium bovis subsp bovis AF2122/97
acuagcauugucgccg

SEQ ID NO: 1156348 - RNA, 13 nt, Mycobacterium bovis subsp bovis AF2122/97
acuagccgaucca

SEQ ID NO: 1156349 - RNA, 22 nt, Mycobacterium bovis subsp bovis AF2122/97
acuagccgauccagcaggccgu

SEQ ID NO: 1156350 - RNA, 14 nt, Mycobacterium bovis subsp bovis AF2122/97
acuagcgagccggc

SEQ ID NO: 1156351 - RNA, 23 nt, Mycobacterium bovis subsp bovis AF2122/97
acuagcgccccuggcaccucgcc

SEQ ID NO: 1156352 - RNA, 23 nt, Mycobacterium bovis subsp bovis AF2122/97
acuacuaggccccuggccgccgc

SEQ ID NO: 1156353 - RNA, 14 nt, Mycobacterium bovis subsp bovis AF2122/97
acuacuccgguccc

SEQ ID NO: 1156354 - RNA, 18 nt, Mycobacterium bovis subsp bovis AF2122/97
acuaaacaggccgccacc

SEQ ID NO: 1156355 - RNA, 16 nt, Mycobacterium bovis subsp bovis AF2122/97
acgcggucaucgagcu

SEQ ID NO: 1156356 - RNA, 16 nt, Mycobacterium bovis subsp bovis AF2122/97
acgcgguccucgagcc

SEQ ID NO: 1156357 - RNA, 17 nt, Mycobacterium bovis subsp bovis AF2122/97
acgcgguccucgagccg

SEQ ID NO: 1156358 - RNA, 18 nt, Mycobacterium bovis subsp bovis AF2122/97
acgcgguccucgagccga

SEQ ID NO: 1156359 - RNA, 13 nt, Mycobacterium bovis subsp bovis AF2122/97
acgcggucugcuc

SEQ ID NO: 1156360 - RNA, 21 nt, Mycobacterium bovis subsp bovis AF2122/97
acgcggucggcagcgacgccg

SEQ ID NO: 1156361 - RNA, 15 nt, Mycobacterium bovis subsp bovis AF2122/97
acgcggucggcggcc

SEQ ID NO: 1156362 - RNA, 18 nt, Mycobacterium bovis subsp bovis AF2122/97
acgcgggugccgacgucg

SEQ ID NO: 1156363 - RNA, 16 nt, Mycobacterium bovis subsp bovis AF2122/97
acgcggcuuugacgcc

SEQ ID NO: 1156364 - RNA, 22 nt, Mycobacterium bovis subsp bovis AF2122/97
acgcggaguucgcugacggcca

SEQ ID NO: 1156365 - RNA, 20 nt, Mycobacterium bovis subsp bovis AF2122/97
acgcgggcuaucgguucagc

SEQ ID NO: 1156366 - RNA, 17 nt, Mycobacterium bovis subsp bovis AF2122/97
acgcgggcacugguggc

SEQ ID NO: 1156367 - RNA, 23 nt, Mycobacterium bovis subsp bovis AF2122/97
acgcgcuugaagguucgaucgcg

SEQ ID NO: 1156368 - RNA, 17 nt, Mycobacterium bovis subsp bovis AF2122/97
acgcggaaaccaucgcc

SEQ ID NO: 1156369 - RNA, 15 nt, Mycobacterium bovis subsp bovis AF2122/97
acgcggacaccgcgg

SEQ ID NO: 1156370 - RNA, 17 nt, Mycobacterium bovis subsp bovis AF2122/97
acgcggacaccgcggcg

SEQ ID NO: 1156371 - RNA, 16 nt, Mycobacterium bovis subsp bovis AF2122/97
acgcgcucggugccgc

SEQ ID NO: 1156372 - RNA, 19 nt, Mycobacterium bovis subsp bovis AF2122/97
acgcgcugaaucaccccgg

SEQ ID NO: 1156373 - RNA, 16 nt, Mycobacterium bovis subsp bovis AF2122/97
acgcgcuugguguggc

SEQ ID NO: 1156374 - RNA, 23 nt, Mycobacterium bovis subsp bovis AF2122/97
acgcugauccacgauaucgaugc

SEQ ID NO: 1156375 - RNA, 21 nt, Mycobacterium bovis subsp bovis AF2122/97
acgcugaucuuccccucggcc

SEQ ID NO: 1156376 - RNA, 22 nt, Mycobacterium bovis subsp bovis AF2122/97
acgcucggcguccgcccagcac

SEQ ID NO: 1156377 - RNA, 18 nt, Mycobacterium bovis subsp bovis AF2122/97
acgcucgcgaagccgguu

SEQ ID NO: 1156378 - RNA, 18 nt, Mycobacterium bovis subsp bovis AF2122/97
acgcucggcggggaccgc

SEQ ID NO: 1156379 - RNA, 21 nt, Mycobacterium bovis subsp bovis AF2122/97
acgcucggcggggaccgcggu

SEQ ID NO: 1156380 - RNA, 12 nt, Mycobacterium bovis subsp bovis AF2122/97
acgcucggcgcc

SEQ ID NO: 1156381 - RNA, 19 nt, Mycobacterium bovis subsp bovis AF2122/97
acgcuccagcucggccagu

SEQ ID NO: 1156382 - RNA, 22 nt, Mycobacterium bovis subsp bovis AF2122/97
acgcuccaggccuaguccggca

SEQ ID NO: 1156383 - RNA, 22 nt, Mycobacterium bovis subsp bovis AF2122/97
acgcuccgccggguuggcgccg

SEQ ID NO: 1156384 - RNA, 20 nt, Mycobacterium bovis subsp bovis AF2122/97
acgcuccgggaauggcgacc

SEQ ID NO: 1156385 - RNA, 21 nt, Mycobacterium bovis subsp bovis AF2122/97
acgcucccuacgagcccacgc

SEQ ID NO: 1156386 - RNA, 22 nt, Mycobacterium bovis subsp bovis AF2122/97
acgcggugacgauugccaccaa

SEQ ID NO: 1156387 - RNA, 13 nt, Mycobacterium bovis subsp bovis AF2122/97
acgcucacgggcu

SEQ ID NO: 1156388 - RNA, 14 nt, Mycobacterium bovis subsp bovis AF2122/97
acgcgaccgcgauc

SEQ ID NO: 1156389 - RNA, 15 nt, Mycobacterium bovis subsp bovis AF2122/97
acgcgaccgcgaugg

SEQ ID NO: 1156390 - RNA, 20 nt, Mycobacterium bovis subsp bovis AF2122/97
acgcgaccaucucgacgucg

SEQ ID NO: 1156391 - RNA, 19 nt, Mycobacterium bovis subsp bovis AF2122/97
acgcgacacgccgauucgc

SEQ ID NO: 1156392 - RNA, 16 nt, Mycobacterium bovis subsp bovis AF2122/97
acgcgacacgccggcg

SEQ ID NO: 1156393 - RNA, 17 nt, Mycobacterium bovis subsp bovis AF2122/97
acgcgacacgccggcgg

SEQ ID NO: 1156394 - RNA, 16 nt, Mycobacterium bovis subsp bovis AF2122/97
acgcgacacacgccgc

SEQ ID NO: 1156395 - RNA, 15 nt, Mycobacterium bovis subsp bovis AF2122/97
acgcgacgagccgca

SEQ ID NO: 1156396 - RNA, 22 nt, Mycobacterium bovis subsp bovis AF2122/97
acgcgaccaucucgacgucggu

SEQ ID NO: 1156397 - RNA, 18 nt, Mycobacterium bovis subsp bovis AF2122/97
acgcgcaacgccgccagc

SEQ ID NO: 1156398 - RNA, 15 nt, Mycobacterium bovis subsp bovis AF2122/97
acgcgcaucgcacgg

SEQ ID NO: 1156399 - RNA, 16 nt, Mycobacterium bovis subsp bovis AF2122/97
acgcgcggaucggcgg

SEQ ID NO: 1156400 - RNA, 20 nt, Mycobacterium bovis subsp bovis AF2122/97
acgcgcaugccccgaccgcg

SEQ ID NO: 1156401 - RNA, 21 nt, Mycobacterium bovis subsp bovis AF2122/97
acgcgcaugccccgaccgcgu

SEQ ID NO: 1156402 - RNA, 18 nt, Mycobacterium bovis subsp bovis AF2122/97
acgcgcggaucggcggcc

SEQ ID NO: 1156403 - RNA, 19 nt, Mycobacterium bovis subsp bovis AF2122/97
acgcgcgcucgcucaccgg

SEQ ID NO: 1156404 - RNA, 22 nt, Mycobacterium bovis subsp bovis AF2122/97
acgcgcgcucgcucaccggcug

SEQ ID NO: 1156405 - RNA, 14 nt, Mycobacterium bovis subsp bovis AF2122/97
acgcgcacucgacg

SEQ ID NO: 1156406 - RNA, 17 nt, Mycobacterium bovis subsp bovis AF2122/97
acgcgcacucgacgcca

SEQ ID NO: 1156407 - RNA, 17 nt, Mycobacterium bovis subsp bovis AF2122/97
acgcgcagagcguuccg

SEQ ID NO: 1156408 - RNA, 15 nt, Mycobacterium bovis subsp bovis AF2122/97
acgccuugagccgag

SEQ ID NO: 1156409 - RNA, 23 nt, Mycobacterium bovis subsp bovis AF2122/97
acgccuugcacaagcugaacuac

SEQ ID NO: 1156410 - RNA, 16 nt, Mycobacterium bovis subsp bovis AF2122/97
acgcagaccguccagc

SEQ ID NO: 1156411 - RNA, 22 nt, Mycobacterium bovis subsp bovis AF2122/97
acgcagagucgcacugcgccgg

SEQ ID NO: 1156412 - RNA, 17 nt, Mycobacterium bovis subsp bovis AF2122/97
acgcagaucaggguggc

SEQ ID NO: 1156413 - RNA, 15 nt, Mycobacterium bovis subsp bovis AF2122/97
acgcagaccguccag

SEQ ID NO: 1156414 - RNA, 21 nt, Mycobacterium bovis subsp bovis AF2122/97
acgcagaagcccccaaaccgg

SEQ ID NO: 1156415 - RNA, 23 nt, Mycobacterium bovis subsp bovis AF2122/97
acgcagaaguugauggucaaugc

SEQ ID NO: 1156416 - RNA, 20 nt, Mycobacterium bovis subsp bovis AF2122/97
acgcagaaucgcccaauuuc

SEQ ID NO: 1156417 - RNA, 15 nt, Mycobacterium bovis subsp bovis AF2122/97
acgcacugccccgca

SEQ ID NO: 1156418 - RNA, 17 nt, Mycobacterium bovis subsp bovis AF2122/97
acgccuugacugaacuc

SEQ ID NO: 1156419 - RNA, 17 nt, Mycobacterium bovis subsp bovis AF2122/97
acgccuuguuggcgccc

SEQ ID NO: 1156420 - RNA, 12 nt, Mycobacterium bovis subsp bovis AF2122/97
aaacaccagaca

SEQ ID NO: 1156421 - RNA, 14 nt, Mycobacterium bovis subsp bovis AF2122/97
aaacagcgcgccgg

SEQ ID NO: 1156422 - RNA, 22 nt, Mycobacterium bovis subsp bovis AF2122/97
acgcgaauaccagaccggccga

SEQ ID NO: 1156423 - RNA, 13 nt, Mycobacterium bovis subsp bovis AF2122/97
acgcgaacgcggc

SEQ ID NO: 1156424 - RNA, 22 nt, Mycobacterium bovis subsp bovis AF2122/97
acgcgaaaugccugcgcgaugc

SEQ ID NO: 1156425 - RNA, 12 nt, Mycobacterium bovis subsp bovis AF2122/97
acgcuggccacg

SEQ ID NO: 1156426 - RNA, 22 nt, Mycobacterium bovis subsp bovis AF2122/97
acgcugugcgguaucggucagc

SEQ ID NO: 1156427 - RNA, 19 nt, Mycobacterium bovis subsp bovis AF2122/97
acgcuguccgcgugaaucc

SEQ ID NO: 1156428 - RNA, 17 nt, Mycobacterium bovis subsp bovis AF2122/97
acgcuuaacagcggguc

SEQ ID NO: 1156429 - RNA, 17 nt, Mycobacterium bovis subsp bovis AF2122/97
acgcuguggcucgacga

SEQ ID NO: 1156430 - RNA, 22 nt, Mycobacterium bovis subsp bovis AF2122/97
acgcuguggcucgacgaugcgg

SEQ ID NO: 1156431 - RNA, 23 nt, Mycobacterium bovis subsp bovis AF2122/97
acgcuguggcucgacgaugcggu

SEQ ID NO: 1156432 - RNA, 21 nt, Mycobacterium bovis subsp bovis AF2122/97
acgcugugggcuuugccgucg

SEQ ID NO: 1156433 - RNA, 18 nt, Mycobacterium bovis subsp bovis AF2122/97
acgcuggaggcgaucugc

SEQ ID NO: 1156434 - RNA, 17 nt, Mycobacterium bovis subsp bovis AF2122/97
acgcugcucgacgguca

SEQ ID NO: 1156435 - RNA, 19 nt, Mycobacterium bovis subsp bovis AF2122/97
acgcugcucgacggucagu

SEQ ID NO: 1156436 - RNA, 19 nt, Mycobacterium bovis subsp bovis AF2122/97
acgcugcucuggacgguca

SEQ ID NO: 1156437 - RNA, 20 nt, Mycobacterium bovis subsp bovis AF2122/97
acgcugcuggcaugcaggug

SEQ ID NO: 1156438 - RNA, 18 nt, Mycobacterium bovis subsp bovis AF2122/97
acgcugauugcgaccgcg

SEQ ID NO: 1156439 - RNA, 14 nt, Mycobacterium bovis subsp bovis AF2122/97
acgcugagucccca

SEQ ID NO: 1156440 - RNA, 21 nt, Mycobacterium bovis subsp bovis AF2122/97
acgcugcccaaaagcgcggca

SEQ ID NO: 1156441 - RNA, 21 nt, Mycobacterium bovis subsp bovis AF2122/97
acgcugcccacgggccggccg

SEQ ID NO: 1156442 - RNA, 17 nt, Mycobacterium bovis subsp bovis AF2122/97
acgcugccccgccgcca

SEQ ID NO: 1156443 - RNA, 19 nt, Mycobacterium bovis subsp bovis AF2122/97
acgcugcaggcggccgagc

SEQ ID NO: 1156444 - RNA, 23 nt, Mycobacterium bovis subsp bovis AF2122/97
acgcugcaggcggccgagcuggu

SEQ ID NO: 1156445 - RNA, 15 nt, Mycobacterium bovis subsp bovis AF2122/97
acgcugccgccaggc

SEQ ID NO: 1156446 - RNA, 17 nt, Mycobacterium bovis subsp bovis AF2122/97
acggacuccggccggcc

SEQ ID NO: 1156447 - RNA, 18 nt, Mycobacterium bovis subsp bovis AF2122/97
acggacuccggccggccu

SEQ ID NO: 1156448 - RNA, 22 nt, Mycobacterium bovis subsp bovis AF2122/97
acggacuucccgcgcgagccgc

SEQ ID NO: 1156449 - RNA, 17 nt, Mycobacterium bovis subsp bovis AF2122/97
acggagaccggccgggu

SEQ ID NO: 1156450 - RNA, 11 nt, Mycobacterium bovis subsp bovis AF2122/97
acggaccgcca

SEQ ID NO: 1156451 - RNA, 14 nt, Mycobacterium bovis subsp bovis AF2122/97
acggaccgucgccg

SEQ ID NO: 1156452 - RNA, 12 nt, Mycobacterium bovis subsp bovis AF2122/97
acggaccgccac

SEQ ID NO: 1156453 - RNA, 14 nt, Mycobacterium bovis subsp bovis AF2122/97
acggagcgagcuca

SEQ ID NO: 1156454 - RNA, 17 nt, Mycobacterium bovis subsp bovis AF2122/97
acggagcgagcucagcg

SEQ ID NO: 1156455 - RNA, 22 nt, Mycobacterium bovis subsp bovis AF2122/97
acggagugucgaugcgcgccgg

SEQ ID NO: 1156456 - RNA, 18 nt, Mycobacterium bovis subsp bovis AF2122/97
acggacaguuccccgggc

SEQ ID NO: 1156457 - RNA, 19 nt, Mycobacterium bovis subsp bovis AF2122/97
acggaccaucuccggugug

SEQ ID NO: 1156458 - RNA, 20 nt, Mycobacterium bovis subsp bovis AF2122/97
acggaaguaucgccggccgc

SEQ ID NO: 1156459 - RNA, 20 nt, Mycobacterium bovis subsp bovis AF2122/97
acggaaucgguuucgaccug

SEQ ID NO: 1156460 - RNA, 12 nt, Mycobacterium bovis subsp bovis AF2122/97
acggaaccaccg

SEQ ID NO: 1156461 - RNA, 14 nt, Mycobacterium bovis subsp bovis AF2122/97
acggaagaccgcgg

SEQ ID NO: 1156462 - RNA, 22 nt, Mycobacterium bovis subsp bovis AF2122/97
acgcuucuuccgcgcgccggcg

SEQ ID NO: 1156463 - RNA, 14 nt, Mycobacterium bovis subsp bovis AF2122/97
acgcuuucccgaug

SEQ ID NO: 1156464 - RNA, 17 nt, Mycobacterium bovis subsp bovis AF2122/97
acgcuucaccucgucga

SEQ ID NO: 1156465 - RNA, 18 nt, Mycobacterium bovis subsp bovis AF2122/97
acgcuucaccucgucgac

SEQ ID NO: 1156466 - RNA, 21 nt, Mycobacterium bovis subsp bovis AF2122/97
acgcuucggcacgcuugaugu

SEQ ID NO: 1156467 - RNA, 13 nt, Mycobacterium bovis subsp bovis AF2122/97
acgcuucggcagc

SEQ ID NO: 1156468 - RNA, 22 nt, Mycobacterium bovis subsp bovis AF2122/97
acgcuucggcagcucccgccac

SEQ ID NO: 1156469 - RNA, 16 nt, Mycobacterium bovis subsp bovis AF2122/97
acggcauucgaccuca

SEQ ID NO: 1156470 - RNA, 13 nt, Mycobacterium bovis subsp bovis AF2122/97
acggccagaaacc

SEQ ID NO: 1156471 - RNA, 19 nt, Mycobacterium bovis subsp bovis AF2122/97
acggccacgguggagcgcg

SEQ ID NO: 1156472 - RNA, 17 nt, Mycobacterium bovis subsp bovis AF2122/97
acggccacaccgucacg

SEQ ID NO: 1156473 - RNA, 22 nt, Mycobacterium bovis subsp bovis AF2122/97
acggccacaccgucacgccacc

SEQ ID NO: 1156474 - RNA, 17 nt, Mycobacterium bovis subsp bovis AF2122/97
acggccacaugccacag

SEQ ID NO: 1156475 - RNA, 14 nt, Mycobacterium bovis subsp bovis AF2122/97
acggccaacauccg

SEQ ID NO: 1156476 - RNA, 14 nt, Mycobacterium bovis subsp bovis AF2122/97
acggcagccgggcg

SEQ ID NO: 1156477 - RNA, 13 nt, Mycobacterium bovis subsp bovis AF2122/97
acggcagccaccg

SEQ ID NO: 1156478 - RNA, 22 nt, Mycobacterium bovis subsp bovis AF2122/97
acggcagcgcccagaucgccga

SEQ ID NO: 1156479 - RNA, 15 nt, Mycobacterium bovis subsp bovis AF2122/97
acggcagcgccgguc

SEQ ID NO: 1156480 - RNA, 16 nt, Mycobacterium bovis subsp bovis AF2122/97
acggcagcgccggucg

SEQ ID NO: 1156481 - RNA, 14 nt, Mycobacterium bovis subsp bovis AF2122/97
acggcaggcggccg

SEQ ID NO: 1156482 - RNA, 16 nt, Mycobacterium bovis subsp bovis AF2122/97
acggcaggcggccgcc

SEQ ID NO: 1156483 - RNA, 14 nt, Mycobacterium bovis subsp bovis AF2122/97
acggcagccaccgu

SEQ ID NO: 1156484 - RNA, 12 nt, Mycobacterium bovis subsp bovis AF2122/97
acggcaccgcgc

SEQ ID NO: 1156485 - RNA, 19 nt, Mycobacterium bovis subsp bovis AF2122/97
acggcaccgcgcccaccag

SEQ ID NO: 1156486 - RNA, 12 nt, Mycobacterium bovis subsp bovis AF2122/97
acggcaccggcc

SEQ ID NO: 1156487 - RNA, 21 nt, Mycobacterium bovis subsp bovis AF2122/97
acggcaccaccaagcucggcc

SEQ ID NO: 1156488 - RNA, 13 nt, Mycobacterium bovis subsp bovis AF2122/97
acggcacccccga

SEQ ID NO: 1156489 - RNA, 19 nt, Mycobacterium bovis subsp bovis AF2122/97
acggcacuggguccacgcg

SEQ ID NO: 1156490 - RNA, 19 nt, Mycobacterium bovis subsp bovis AF2122/97
acggcacugugcguccgca

SEQ ID NO: 1156491 - RNA, 23 nt, Mycobacterium bovis subsp bovis AF2122/97
acggcacugugcguccgcaacag

SEQ ID NO: 1156492 - RNA, 20 nt, Mycobacterium bovis subsp bovis AF2122/97
acggcaauacccgccgcgau

SEQ ID NO: 1156493 - RNA, 15 nt, Mycobacterium bovis subsp bovis AF2122/97
acggcaaucaacgca

SEQ ID NO: 1156494 - RNA, 19 nt, Mycobacterium bovis subsp bovis AF2122/97
acggcaaggucgcggccag

SEQ ID NO: 1156495 - RNA, 16 nt, Mycobacterium bovis subsp bovis AF2122/97
acggcaccaccaagcu

SEQ ID NO: 1156496 - RNA, 16 nt, Mycobacterium bovis subsp bovis AF2122/97
acggcaagucuggcgg

SEQ ID NO: 1156497 - RNA, 19 nt, Mycobacterium bovis subsp bovis AF2122/97
acggcaagggcauacagca

SEQ ID NO: 1156498 - RNA, 21 nt, Mycobacterium bovis subsp bovis AF2122/97
acggcaagggcauacagcaug

SEQ ID NO: 1156499 - RNA, 18 nt, Mycobacterium bovis subsp bovis AF2122/97
acggcaagcacgguggcc

SEQ ID NO: 1156500 - RNA, 20 nt, Mycobacterium bovis subsp bovis AF2122/97
acggcaaaacacaccgaaca

SEQ ID NO: 1156501 - RNA, 17 nt, Mycobacterium bovis subsp bovis AF2122/97
acggcaagcuaccggcc

SEQ ID NO: 1156502 - RNA, 15 nt, Mycobacterium bovis subsp bovis AF2122/97
acggaucgcggcggc

SEQ ID NO: 1156503 - RNA, 16 nt, Mycobacterium bovis subsp bovis AF2122/97
acggaggugccggcgc

SEQ ID NO: 1156504 - RNA, 17 nt, Mycobacterium bovis subsp bovis AF2122/97
acggauaucagcaacag

SEQ ID NO: 1156505 - RNA, 18 nt, Mycobacterium bovis subsp bovis AF2122/97
acggaucaggcccgggcg

SEQ ID NO: 1156506 - RNA, 18 nt, Mycobacterium bovis subsp bovis AF2122/97
acggaguuggcccgacgc

SEQ ID NO: 1156507 - RNA, 19 nt, Mycobacterium bovis subsp bovis AF2122/97
acggauaauucaacagcac

SEQ ID NO: 1156508 - RNA, 23 nt, Mycobacterium bovis subsp bovis AF2122/97
acggaucgucgugcacggcggcc

SEQ ID NO: 1156509 - RNA, 21 nt, Mycobacterium bovis subsp bovis AF2122/97
acggaucugagcuagccguuc

SEQ ID NO: 1156510 - RNA, 14 nt, Mycobacterium bovis subsp bovis AF2122/97
acggaugucgccca

SEQ ID NO: 1156511 - RNA, 22 nt, Mycobacterium bovis subsp bovis AF2122/97
acggaugugcucaggucgcaga

SEQ ID NO: 1156512 - RNA, 20 nt, Mycobacterium bovis subsp bovis AF2122/97
acuggcccccacaccacgcu

SEQ ID NO: 1156513 - RNA, 15 nt, Mycobacterium bovis subsp bovis AF2122/97
acuggccccgccagc

SEQ ID NO: 1156514 - RNA, 17 nt, Mycobacterium bovis subsp bovis AF2122/97
acuggccguuucggcgc

SEQ ID NO: 1156515 - RNA, 14 nt, Mycobacterium bovis subsp bovis AF2122/97
acuggccgcccggc

SEQ ID NO: 1156516 - RNA, 15 nt, Mycobacterium bovis subsp bovis AF2122/97
acuggccgcccggcg

SEQ ID NO: 1156517 - RNA, 21 nt, Mycobacterium bovis subsp bovis AF2122/97
acuggccgccgcgcaccgcgg

SEQ ID NO: 1156518 - RNA, 13 nt, Mycobacterium bovis subsp bovis AF2122/97
acugggucgccuc

SEQ ID NO: 1156519 - RNA, 21 nt, Mycobacterium bovis subsp bovis AF2122/97
acugggucgccuccugccgcc

SEQ ID NO: 1156520 - RNA, 23 nt, Mycobacterium bovis subsp bovis AF2122/97
acuggccguuucggcgccgucgc

SEQ ID NO: 1156521 - RNA, 16 nt, Mycobacterium bovis subsp bovis AF2122/97
acugcggcccgacccg

SEQ ID NO: 1156522 - RNA, 19 nt, Mycobacterium bovis subsp bovis AF2122/97
acugcgugccgcaccgccu

SEQ ID NO: 1156523 - RNA, 15 nt, Mycobacterium bovis subsp bovis AF2122/97
acugcggucgcccag

SEQ ID NO: 1156524 - RNA, 15 nt, Mycobacterium bovis subsp bovis AF2122/97
acugcgucggcggcu

SEQ ID NO: 1156525 - RNA, 16 nt, Mycobacterium bovis subsp bovis AF2122/97
acugcgccggccggcg

SEQ ID NO: 1156526 - RNA, 20 nt, Mycobacterium bovis subsp bovis AF2122/97
acugcgccggugccggccau

SEQ ID NO: 1156527 - RNA, 16 nt, Mycobacterium bovis subsp bovis AF2122/97
acugccgcggcaccgc

SEQ ID NO: 1156528 - RNA, 17 nt, Mycobacterium bovis subsp bovis AF2122/97
acugccgagcacgacga

SEQ ID NO: 1156529 - RNA, 20 nt, Mycobacterium bovis subsp bovis AF2122/97
acugccggacuaccgccggc

SEQ ID NO: 1156530 - RNA, 12 nt, Mycobacterium bovis subsp bovis AF2122/97
acugccgcggca

SEQ ID NO: 1156531 - RNA, 14 nt, Mycobacterium bovis subsp bovis AF2122/97
acugcgccgccggc

SEQ ID NO: 1156532 - RNA, 15 nt, Mycobacterium bovis subsp bovis AF2122/97
acugcgccgccggcg

SEQ ID NO: 1156533 - RNA, 17 nt, Mycobacterium bovis subsp bovis AF2122/97
acugcgccgccggcgcg

SEQ ID NO: 1156534 - RNA, 14 nt, Mycobacterium bovis subsp bovis AF2122/97
acuggugacccuga

SEQ ID NO: 1156535 - RNA, 13 nt, Mycobacterium bovis subsp bovis AF2122/97
acuggugccugcc

SEQ ID NO: 1156536 - RNA, 15 nt, Mycobacterium bovis subsp bovis AF2122/97
acuggucgacgccga

SEQ ID NO: 1156537 - RNA, 19 nt, Mycobacterium bovis subsp bovis AF2122/97
acuggucgccaacgccagc

SEQ ID NO: 1156538 - RNA, 14 nt, Mycobacterium bovis subsp bovis AF2122/97
acuggucgcggcgc

SEQ ID NO: 1156539 - RNA, 12 nt, Mycobacterium bovis subsp bovis AF2122/97
acuggucgacgc

SEQ ID NO: 1156540 - RNA, 18 nt, Mycobacterium bovis subsp bovis AF2122/97
acuggucgacgccgagac

SEQ ID NO: 1156541 - RNA, 22 nt, Mycobacterium bovis subsp bovis AF2122/97
acugguagcccggaccgcccgu

SEQ ID NO: 1156542 - RNA, 21 nt, Mycobacterium bovis subsp bovis AF2122/97
acuggucaacgggaugccggc

SEQ ID NO: 1156543 - RNA, 22 nt, Mycobacterium bovis subsp bovis AF2122/97
acuggucaacgggaugccggcg

SEQ ID NO: 1156544 - RNA, 17 nt, Mycobacterium bovis subsp bovis AF2122/97
acuguggcgccgccggc

SEQ ID NO: 1156545 - RNA, 16 nt, Mycobacterium bovis subsp bovis AF2122/97
acugugcguccgcaac

SEQ ID NO: 1156546 - RNA, 17 nt, Mycobacterium bovis subsp bovis AF2122/97
acugugcguccgcaaca

SEQ ID NO: 1156547 - RNA, 19 nt, Mycobacterium bovis subsp bovis AF2122/97
acugugaaucugacgacgc

SEQ ID NO: 1156548 - RNA, 15 nt, Mycobacterium bovis subsp bovis AF2122/97
acugugacgccgggc

SEQ ID NO: 1156549 - RNA, 18 nt, Mycobacterium bovis subsp bovis AF2122/97
acugguggcgauccguag

SEQ ID NO: 1156550 - RNA, 18 nt, Mycobacterium bovis subsp bovis AF2122/97
acuuagcgggugccagcc

SEQ ID NO: 1156551 - RNA, 22 nt, Mycobacterium bovis subsp bovis AF2122/97
acuuagcccgauggugccgacc

SEQ ID NO: 1156552 - RNA, 13 nt, Mycobacterium bovis subsp bovis AF2122/97
acuuacgcgacgc

SEQ ID NO: 1156553 - RNA, 22 nt, Mycobacterium bovis subsp bovis AF2122/97
acuuaaccaggcgagccgccac

SEQ ID NO: 1156554 - RNA, 18 nt, Mycobacterium bovis subsp bovis AF2122/97
acugcacggagccgccgg

SEQ ID NO: 1156555 - RNA, 20 nt, Mycobacterium bovis subsp bovis AF2122/97
acugcacggagccgccggcg

SEQ ID NO: 1156556 - RNA, 22 nt, Mycobacterium bovis subsp bovis AF2122/97
acugcacggagccgccggcggu

SEQ ID NO: 1156557 - RNA, 18 nt, Mycobacterium bovis subsp bovis AF2122/97
acugcacaccaccgccga

SEQ ID NO: 1156558 - RNA, 15 nt, Mycobacterium bovis subsp bovis AF2122/97
acugaugucacccgc

SEQ ID NO: 1156559 - RNA, 14 nt, Mycobacterium bovis subsp bovis AF2122/97
acugauggcgcgca

SEQ ID NO: 1156560 - RNA, 22 nt, Mycobacterium bovis subsp bovis AF2122/97
acugaucuucgagccggcggcc

SEQ ID NO: 1156561 - RNA, 19 nt, Mycobacterium bovis subsp bovis AF2122/97
acugaucuuggcccgggcc

SEQ ID NO: 1156562 - RNA, 21 nt, Mycobacterium bovis subsp bovis AF2122/97
acugaucaggccgaugacgau

SEQ ID NO: 1156563 - RNA, 22 nt, Mycobacterium bovis subsp bovis AF2122/97
acugcagcgccucgauccgcau

SEQ ID NO: 1156564 - RNA, 13 nt, Mycobacterium bovis subsp bovis AF2122/97
acugcagcgcggc

SEQ ID NO: 1156565 - RNA, 23 nt, Mycobacterium bovis subsp bovis AF2122/97
acugcaguaguagcgcaaccgcg

SEQ ID NO: 1156566 - RNA, 19 nt, Mycobacterium bovis subsp bovis AF2122/97
acugcaggcugucgagucg

SEQ ID NO: 1156567 - RNA, 18 nt, Mycobacterium bovis subsp bovis AF2122/97
acugcaugguggcgccga

SEQ ID NO: 1156568 - RNA, 13 nt, Mycobacterium bovis subsp bovis AF2122/97
acugccaccgcga

SEQ ID NO: 1156569 - RNA, 21 nt, Mycobacterium bovis subsp bovis AF2122/97
acugccaccgugugcacgcga

SEQ ID NO: 1156570 - RNA, 22 nt, Mycobacterium bovis subsp bovis AF2122/97
acugcccgaugaucugugccgc

SEQ ID NO: 1156571 - RNA, 15 nt, Mycobacterium bovis subsp bovis AF2122/97
acugcccgccgacgc

SEQ ID NO: 1156572 - RNA, 17 nt, Mycobacterium bovis subsp bovis AF2122/97
acugcccgccgacgcca

SEQ ID NO: 1156573 - RNA, 22 nt, Mycobacterium bovis subsp bovis AF2122/97
acugcccgcguuugcgaagccc

SEQ ID NO: 1156574 - RNA, 18 nt, Mycobacterium bovis subsp bovis AF2122/97
acugccccgcaucgccca

SEQ ID NO: 1156575 - RNA, 14 nt, Mycobacterium bovis subsp bovis AF2122/97
acugccagcgccgc

SEQ ID NO: 1156576 - RNA, 17 nt, Mycobacterium bovis subsp bovis AF2122/97
acugccagcgccgcggc

SEQ ID NO: 1156577 - RNA, 22 nt, Mycobacterium bovis subsp bovis AF2122/97
acugccgccgcuuucgccggcg

SEQ ID NO: 1156578 - RNA, 21 nt, Mycobacterium bovis subsp bovis AF2122/97
acugccgccgguuccgccggc

SEQ ID NO: 1156579 - RNA, 22 nt, Mycobacterium bovis subsp bovis AF2122/97
acugccgccgguuccgccggcc

SEQ ID NO: 1156580 - RNA, 22 nt, Mycobacterium bovis subsp bovis AF2122/97
acugcccucaacgaucgcgccg

SEQ ID NO: 1156581 - RNA, 22 nt, Mycobacterium bovis subsp bovis AF2122/97
acugcccugauugaagcccccc

SEQ ID NO: 1156582 - RNA, 17 nt, Mycobacterium bovis subsp bovis AF2122/97
acugaccgcgaucgccg

SEQ ID NO: 1156583 - RNA, 20 nt, Mycobacterium bovis subsp bovis AF2122/97
acugaccgcggcugucacgc

SEQ ID NO: 1156584 - RNA, 14 nt, Mycobacterium bovis subsp bovis AF2122/97
acugaccacgucgg

SEQ ID NO: 1156585 - RNA, 16 nt, Mycobacterium bovis subsp bovis AF2122/97
acugaccacgucggac

SEQ ID NO: 1156586 - RNA, 14 nt, Mycobacterium bovis subsp bovis AF2122/97
acugaccccgccgc

SEQ ID NO: 1156587 - RNA, 21 nt, Mycobacterium bovis subsp bovis AF2122/97
acugaauuuggugaagccgua

SEQ ID NO: 1156588 - RNA, 18 nt, Mycobacterium bovis subsp bovis AF2122/97
acugacuuugggucggcg

SEQ ID NO: 1156589 - RNA, 15 nt, Mycobacterium bovis subsp bovis AF2122/97
acugaaccgagugca

SEQ ID NO: 1156590 - RNA, 16 nt, Mycobacterium bovis subsp bovis AF2122/97
acuaggucgccggcca

SEQ ID NO: 1156591 - RNA, 19 nt, Mycobacterium bovis subsp bovis AF2122/97
acuaucgcaccuccggcgu

SEQ ID NO: 1156592 - RNA, 20 nt, Mycobacterium bovis subsp bovis AF2122/97
acuaucggccgccggaucag

SEQ ID NO: 1156593 - RNA, 15 nt, Mycobacterium bovis subsp bovis AF2122/97
acuaucguugugcgg

SEQ ID NO: 1156594 - RNA, 17 nt, Mycobacterium bovis subsp bovis AF2122/97
acuuccgcgucgccggc

SEQ ID NO: 1156595 - RNA, 15 nt, Mycobacterium bovis subsp bovis AF2122/97
acuuauccggccagu

SEQ ID NO: 1156596 - RNA, 18 nt, Mycobacterium bovis subsp bovis AF2122/97
agaaaacauugcggcccu

SEQ ID NO: 1156597 - RNA, 15 nt, Mycobacterium bovis subsp bovis AF2122/97
acuuugguugcccgc

SEQ ID NO: 1156598 - RNA, 13 nt, Mycobacterium bovis subsp bovis AF2122/97
acuuugucgcgga

SEQ ID NO: 1156599 - RNA, 18 nt, Mycobacterium bovis subsp bovis AF2122/97
acuuuuccgccggccagg

SEQ ID NO: 1156600 - RNA, 16 nt, Mycobacterium bovis subsp bovis AF2122/97
acuuuucgguggcggc

SEQ ID NO: 1156601 - RNA, 12 nt, Mycobacterium bovis subsp bovis AF2122/97
agaacaccaccg

SEQ ID NO: 1156602 - RNA, 18 nt, Mycobacterium bovis subsp bovis AF2122/97
agaaaucgguggugcggu

SEQ ID NO: 1156603 - RNA, 13 nt, Mycobacterium bovis subsp bovis AF2122/97
agaaacccggcga

SEQ ID NO: 1156604 - RNA, 15 nt, Mycobacterium bovis subsp bovis AF2122/97
agaaacgccgagcgc

SEQ ID NO: 1156605 - RNA, 17 nt, Mycobacterium bovis subsp bovis AF2122/97
agaaacgccgagcgcca

SEQ ID NO: 1156606 - RNA, 22 nt, Mycobacterium bovis subsp bovis AF2122/97
agaaccggguaaugcgacgccg

SEQ ID NO: 1156607 - RNA, 15 nt, Mycobacterium bovis subsp bovis AF2122/97
agaacccuccgcacc

SEQ ID NO: 1156608 - RNA, 12 nt, Mycobacterium bovis subsp bovis AF2122/97
agaaccccgaag

SEQ ID NO: 1156609 - RNA, 15 nt, Mycobacterium bovis subsp bovis AF2122/97
agaacgauguccgcg

SEQ ID NO: 1156610 - RNA, 16 nt, Mycobacterium bovis subsp bovis AF2122/97
agaacgcgucguagcg

SEQ ID NO: 1156611 - RNA, 15 nt, Mycobacterium bovis subsp bovis AF2122/97
agaacguagcgccca

SEQ ID NO: 1156612 - RNA, 20 nt, Mycobacterium bovis subsp bovis AF2122/97
agaacgugcuggugggccgg

SEQ ID NO: 1156613 - RNA, 20 nt, Mycobacterium bovis subsp bovis AF2122/97
agaacgguggcgcggugccg

SEQ ID NO: 1156614 - RNA, 14 nt, Mycobacterium bovis subsp bovis AF2122/97
agaacggcgaucac

SEQ ID NO: 1156615 - RNA, 19 nt, Mycobacterium bovis subsp bovis AF2122/97
agaacggaugccggucggc

SEQ ID NO: 1156616 - RNA, 17 nt, Mycobacterium bovis subsp bovis AF2122/97
agaagaacucggugccc

SEQ ID NO: 1156617 - RNA, 20 nt, Mycobacterium bovis subsp bovis AF2122/97
agaagaccuggcggugccgg

SEQ ID NO: 1156618 - RNA, 21 nt, Mycobacterium bovis subsp bovis AF2122/97
agaacggaugccggucggcgu

SEQ ID NO: 1156619 - RNA, 16 nt, Mycobacterium bovis subsp bovis AF2122/97
agaagccagagaucga

SEQ ID NO: 1156620 - RNA, 13 nt, Mycobacterium bovis subsp bovis AF2122/97
agaaggccgcacc

SEQ ID NO: 1156621 - RNA, 13 nt, Mycobacterium bovis subsp bovis AF2122/97
agaauaugccgau

SEQ ID NO: 1156622 - RNA, 13 nt, Mycobacterium bovis subsp bovis AF2122/97
agaauucggcgcg

SEQ ID NO: 1156623 - RNA, 17 nt, Mycobacterium bovis subsp bovis AF2122/97
agacgaccccggugagc

SEQ ID NO: 1156624 - RNA, 16 nt, Mycobacterium bovis subsp bovis AF2122/97
agacgacccgguugug

SEQ ID NO: 1156625 - RNA, 20 nt, Mycobacterium bovis subsp bovis AF2122/97
agacgaccgugcugggcgcc

SEQ ID NO: 1156626 - RNA, 18 nt, Mycobacterium bovis subsp bovis AF2122/97
agacgacgaugaugccgu

SEQ ID NO: 1156627 - RNA, 18 nt, Mycobacterium bovis subsp bovis AF2122/97
agacgaaguagccgacca

SEQ ID NO: 1156628 - RNA, 19 nt, Mycobacterium bovis subsp bovis AF2122/97
agaccuggccugcggcagg

SEQ ID NO: 1156629 - RNA, 20 nt, Mycobacterium bovis subsp bovis AF2122/97
agaccuggcggugccggcgg

SEQ ID NO: 1156630 - RNA, 15 nt, Mycobacterium bovis subsp bovis AF2122/97
agacgaaccgccgac

SEQ ID NO: 1156631 - RNA, 24 nt, Mycobacterium bovis subsp bovis AF2122/97
agacgcaaaauccccucgcaaccg

SEQ ID NO: 1156632 - RNA, 19 nt, Mycobacterium bovis subsp bovis AF2122/97
agacgcaaaaucgcccaau

SEQ ID NO: 1156633 - RNA, 19 nt, Mycobacterium bovis subsp bovis AF2122/97
agacgcauaagcccccgca

SEQ ID NO: 1156634 - RNA, 21 nt, Mycobacterium bovis subsp bovis AF2122/97
agacgccgccgcugccgcccu

SEQ ID NO: 1156635 - RNA, 22 nt, Mycobacterium bovis subsp bovis AF2122/97
agacgccgccgcugccgcccuu

SEQ ID NO: 1156636 - RNA, 18 nt, Mycobacterium bovis subsp bovis AF2122/97
agacgcagaagcccccaa

SEQ ID NO: 1156637 - RNA, 14 nt, Mycobacterium bovis subsp bovis AF2122/97
agacgauucggcgg

SEQ ID NO: 1156638 - RNA, 20 nt, Mycobacterium bovis subsp bovis AF2122/97
agacgcaaaagcuccuaaau

SEQ ID NO: 1156639 - RNA, 13 nt, Mycobacterium bovis subsp bovis AF2122/97
agaccgacagcgg

SEQ ID NO: 1156640 - RNA, 14 nt, Mycobacterium bovis subsp bovis AF2122/97
agaccgacagcggc

SEQ ID NO: 1156641 - RNA, 16 nt, Mycobacterium bovis subsp bovis AF2122/97
agaccgacagcggcac

SEQ ID NO: 1156642 - RNA, 12 nt, Mycobacterium bovis subsp bovis AF2122/97
agacccgguggc

SEQ ID NO: 1156643 - RNA, 20 nt, Mycobacterium bovis subsp bovis AF2122/97
agacccgucaccgccgacga

SEQ ID NO: 1156644 - RNA, 14 nt, Mycobacterium bovis subsp bovis AF2122/97
agacccguucgccg

SEQ ID NO: 1156645 - RNA, 18 nt, Mycobacterium bovis subsp bovis AF2122/97
agaccgcgugcucgagca

SEQ ID NO: 1156646 - RNA, 15 nt, Mycobacterium bovis subsp bovis AF2122/97
agaccgaacagcggc

SEQ ID NO: 1156647 - RNA, 18 nt, Mycobacterium bovis subsp bovis AF2122/97
agaccgaacagcggcagc

SEQ ID NO: 1156648 - RNA, 22 nt, Mycobacterium bovis subsp bovis AF2122/97
agaccgccgcugccgccgagcu

SEQ ID NO: 1156649 - RNA, 14 nt, Mycobacterium bovis subsp bovis AF2122/97
agaccgccuccacc

SEQ ID NO: 1156650 - RNA, 22 nt, Mycobacterium bovis subsp bovis AF2122/97
agaccguggauaacgacugaca

SEQ ID NO: 1156651 - RNA, 18 nt, Mycobacterium bovis subsp bovis AF2122/97
agaccgucgauccgucgg

SEQ ID NO: 1156652 - RNA, 12 nt, Mycobacterium bovis subsp bovis AF2122/97
agaccgggcggu

SEQ ID NO: 1156653 - RNA, 19 nt, Mycobacterium bovis subsp bovis AF2122/97
agaccgggcgguugguggu

SEQ ID NO: 1156654 - RNA, 18 nt, Mycobacterium bovis subsp bovis AF2122/97
agaccguuacaccaucaa

SEQ ID NO: 1156655 - RNA, 23 nt, Mycobacterium bovis subsp bovis AF2122/97
agaccguucguucccgcucgggc

SEQ ID NO: 1156656 - RNA, 19 nt, Mycobacterium bovis subsp bovis AF2122/97
agaccucucugcgccaggc

SEQ ID NO: 1156657 - RNA, 16 nt, Mycobacterium bovis subsp bovis AF2122/97
agaccacgccggugac

SEQ ID NO: 1156658 - RNA, 21 nt, Mycobacterium bovis subsp bovis AF2122/97
agaccacaacgccucgccauc

SEQ ID NO: 1156659 - RNA, 18 nt, Mycobacterium bovis subsp bovis AF2122/97
agaccaccggcagcgcga

SEQ ID NO: 1156660 - RNA, 22 nt, Mycobacterium bovis subsp bovis AF2122/97
agaccccaaucgaccgcccgcc

SEQ ID NO: 1156661 - RNA, 21 nt, Mycobacterium bovis subsp bovis AF2122/97
agacccgcauccacgucgccc

SEQ ID NO: 1156662 - RNA, 12 nt, Mycobacterium bovis subsp bovis AF2122/97
agacccggcacc

SEQ ID NO: 1156663 - RNA, 20 nt, Mycobacterium bovis subsp bovis AF2122/97
agaccagggcagcggccagg

SEQ ID NO: 1156664 - RNA, 18 nt, Mycobacterium bovis subsp bovis AF2122/97
agaccagucucguggcgc

SEQ ID NO: 1156665 - RNA, 23 nt, Mycobacterium bovis subsp bovis AF2122/97
agacccacgauggcaaacgcacc

SEQ ID NO: 1156666 - RNA, 19 nt, Mycobacterium bovis subsp bovis AF2122/97
agaccaugccgacgacggg

SEQ ID NO: 1156667 - RNA, 14 nt, Mycobacterium bovis subsp bovis AF2122/97
agacaacgccgucg

SEQ ID NO: 1156668 - RNA, 19 nt, Mycobacterium bovis subsp bovis AF2122/97
agacaggauugccgagcgu

SEQ ID NO: 1156669 - RNA, 15 nt, Mycobacterium bovis subsp bovis AF2122/97
agacacuggucgcgg

SEQ ID NO: 1156670 - RNA, 17 nt, Mycobacterium bovis subsp bovis AF2122/97
agacgugguagccggcg

SEQ ID NO: 1156671 - RNA, 13 nt, Mycobacterium bovis subsp bovis AF2122/97
agacgugcgucag

SEQ ID NO: 1156672 - RNA, 17 nt, Mycobacterium bovis subsp bovis AF2122/97
agacguuuugcggcccg

SEQ ID NO: 1156673 - RNA, 17 nt, Mycobacterium bovis subsp bovis AF2122/97
agacucgucgaugcggu

SEQ ID NO: 1156674 - RNA, 15 nt, Mycobacterium bovis subsp bovis AF2122/97
agacguacugggcga

SEQ ID NO: 1156675 - RNA, 19 nt, Mycobacterium bovis subsp bovis AF2122/97
agacggugucacccucgcg

SEQ ID NO: 1156676 - RNA, 22 nt, Mycobacterium bovis subsp bovis AF2122/97
agacggugcagcuccccgccgg

SEQ ID NO: 1156677 - RNA, 19 nt, Mycobacterium bovis subsp bovis AF2122/97
agacguaaaagcccccgca

SEQ ID NO: 1156678 - RNA, 14 nt, Mycobacterium bovis subsp bovis AF2122/97
agacgguuaccgcg

SEQ ID NO: 1156679 - RNA, 16 nt, Mycobacterium bovis subsp bovis AF2122/97
agacgguuaccgcgaa

SEQ ID NO: 1156680 - RNA, 15 nt, Mycobacterium bovis subsp bovis AF2122/97
agacgguccggucgc

SEQ ID NO: 1156681 - RNA, 15 nt, Mycobacterium bovis subsp bovis AF2122/97
agacggucgaucaca

SEQ ID NO: 1156682 - RNA, 17 nt, Mycobacterium bovis subsp bovis AF2122/97
agacggugaagccgagc

SEQ ID NO: 1156683 - RNA, 15 nt, Mycobacterium bovis subsp bovis AF2122/97
agacggcggcaucgg

SEQ ID NO: 1156684 - RNA, 19 nt, Mycobacterium bovis subsp bovis AF2122/97
agacggggugagccgaccc

SEQ ID NO: 1156685 - RNA, 20 nt, Mycobacterium bovis subsp bovis AF2122/97
agacggcguugauccgcacc

SEQ ID NO: 1156686 - RNA, 13 nt, Mycobacterium bovis subsp bovis AF2122/97
agacggccaccgg

SEQ ID NO: 1156687 - RNA, 17 nt, Mycobacterium bovis subsp bovis AF2122/97
agacggcacccccgacg

SEQ ID NO: 1156688 - RNA, 18 nt, Mycobacterium bovis subsp bovis AF2122/97
agacggcacccccgacga

SEQ ID NO: 1156689 - RNA, 15 nt, Mycobacterium bovis subsp bovis AF2122/97
agacgcugcccaaaa

SEQ ID NO: 1156690 - RNA, 14 nt, Mycobacterium bovis subsp bovis AF2122/97
agacgccggggaac

SEQ ID NO: 1156691 - RNA, 16 nt, Mycobacterium bovis subsp bovis AF2122/97
agacgccgucggcgcc

SEQ ID NO: 1156692 - RNA, 22 nt, Mycobacterium bovis subsp bovis AF2122/97
agacgcuaaagcccccgcacgc

SEQ ID NO: 1156693 - RNA, 12 nt, Mycobacterium bovis subsp bovis AF2122/97
agacgcggcagg

SEQ ID NO: 1156694 - RNA, 23 nt, Mycobacterium bovis subsp bovis AF2122/97
agacgcggucgacgacgcccuca

SEQ ID NO: 1156695 - RNA, 11 nt, Mycobacterium bovis subsp bovis AF2122/97
agagccggcgg

SEQ ID NO: 1156696 - RNA, 14 nt, Mycobacterium bovis subsp bovis AF2122/97
agagcgcaccgcga

SEQ ID NO: 1156697 - RNA, 15 nt, Mycobacterium bovis subsp bovis AF2122/97
agagcggcaccagau

SEQ ID NO: 1156698 - RNA, 13 nt, Mycobacterium bovis subsp bovis AF2122/97
agagccgaucacc

SEQ ID NO: 1156699 - RNA, 21 nt, Mycobacterium bovis subsp bovis AF2122/97
agagccgccguugccgccggc

SEQ ID NO: 1156700 - RNA, 17 nt, Mycobacterium bovis subsp bovis AF2122/97
agagccccgaccagcag

SEQ ID NO: 1156701 - RNA, 21 nt, Mycobacterium bovis subsp bovis AF2122/97
agagcauucgggcgcccucau

SEQ ID NO: 1156702 - RNA, 13 nt, Mycobacterium bovis subsp bovis AF2122/97
agagcagccagcc

SEQ ID NO: 1156703 - RNA, 17 nt, Mycobacterium bovis subsp bovis AF2122/97
agagcaguacgucugcg

SEQ ID NO: 1156704 - RNA, 14 nt, Mycobacterium bovis subsp bovis AF2122/97
agacugcgccgccg

SEQ ID NO: 1156705 - RNA, 16 nt, Mycobacterium bovis subsp bovis AF2122/97
agacugcgccgccggc

SEQ ID NO: 1156706 - RNA, 21 nt, Mycobacterium bovis subsp bovis AF2122/97
agacuuccucggauugcagcg

SEQ ID NO: 1156707 - RNA, 19 nt, Mycobacterium bovis subsp bovis AF2122/97
agagaguuagugacguaga

SEQ ID NO: 1156708 - RNA, 19 nt, Mycobacterium bovis subsp bovis AF2122/97
agagaaggcggcgucgagc

SEQ ID NO: 1156709 - RNA, 14 nt, Mycobacterium bovis subsp bovis AF2122/97
agaucucggccagg

SEQ ID NO: 1156710 - RNA, 21 nt, Mycobacterium bovis subsp bovis AF2122/97
agaucucgauuaucgcgcgca

SEQ ID NO: 1156711 - RNA, 22 nt, Mycobacterium bovis subsp bovis AF2122/97
agaucuugcgcaaugccgacgc

SEQ ID NO: 1156712 - RNA, 19 nt, Mycobacterium bovis subsp bovis AF2122/97
agaucuucgagcgcaucag

SEQ ID NO: 1156713 - RNA, 22 nt, Mycobacterium bovis subsp bovis AF2122/97
agaucguugccucgucgccgcg

SEQ ID NO: 1156714 - RNA, 14 nt, Mycobacterium bovis subsp bovis AF2122/97
agaucguuccaggc

SEQ ID NO: 1156715 - RNA, 20 nt, Mycobacterium bovis subsp bovis AF2122/97
agaucguagggacgccgagc

SEQ ID NO: 1156716 - RNA, 18 nt, Mycobacterium bovis subsp bovis AF2122/97
agaucggcucaccgaacg

SEQ ID NO: 1156717 - RNA, 16 nt, Mycobacterium bovis subsp bovis AF2122/97
agaucgggccggccgc

SEQ ID NO: 1156718 - RNA, 20 nt, Mycobacterium bovis subsp bovis AF2122/97
agaucggguggcgggucagc

SEQ ID NO: 1156719 - RNA, 20 nt, Mycobacterium bovis subsp bovis AF2122/97
agaucggcgaaucgggcaaa

SEQ ID NO: 1156720 - RNA, 21 nt, Mycobacterium bovis subsp bovis AF2122/97
agaucgccucgacgcggcagg

SEQ ID NO: 1156721 - RNA, 12 nt, Mycobacterium bovis subsp bovis AF2122/97
agaucggaucga

SEQ ID NO: 1156722 - RNA, 15 nt, Mycobacterium bovis subsp bovis AF2122/97
agaucgcggcgaccc

SEQ ID NO: 1156723 - RNA, 22 nt, Mycobacterium bovis subsp bovis AF2122/97
agaucgcggcgacccggucgcg

SEQ ID NO: 1156724 - RNA, 22 nt, Mycobacterium bovis subsp bovis AF2122/97
agaucgcgguccgagcggcauc

SEQ ID NO: 1156725 - RNA, 15 nt, Mycobacterium bovis subsp bovis AF2122/97
agaucgaagcgcagc

SEQ ID NO: 1156726 - RNA, 14 nt, Mycobacterium bovis subsp bovis AF2122/97
agaucgccgagcgu

SEQ ID NO: 1156727 - RNA, 20 nt, Mycobacterium bovis subsp bovis AF2122/97
agaucgaacgcagccagcgc

SEQ ID NO: 1156728 - RNA, 22 nt, Mycobacterium bovis subsp bovis AF2122/97
agauccgggccuugcgcgcgca

SEQ ID NO: 1156729 - RNA, 15 nt, Mycobacterium bovis subsp bovis AF2122/97
agauccucgucgagg

SEQ ID NO: 1156730 - RNA, 21 nt, Mycobacterium bovis subsp bovis AF2122/97
agaugggccuccaccgcgucc

SEQ ID NO: 1156731 - RNA, 14 nt, Mycobacterium bovis subsp bovis AF2122/97
agauggucaccgga

SEQ ID NO: 1156732 - RNA, 20 nt, Mycobacterium bovis subsp bovis AF2122/97
agauggucggucgcuucagc

SEQ ID NO: 1156733 - RNA, 13 nt, Mycobacterium bovis subsp bovis AF2122/97
agaugucgaucag

SEQ ID NO: 1156734 - RNA, 14 nt, Mycobacterium bovis subsp bovis AF2122/97
agaugcugcacccg

SEQ ID NO: 1156735 - RNA, 21 nt, Mycobacterium bovis subsp bovis AF2122/97
agauggcaccgcccccgucgg

SEQ ID NO: 1156736 - RNA, 16 nt, Mycobacterium bovis subsp bovis AF2122/97
agaugcccgcgaucau

SEQ ID NO: 1156737 - RNA, 21 nt, Mycobacterium bovis subsp bovis AF2122/97
agaugcagcgggucgccgggc

SEQ ID NO: 1156738 - RNA, 15 nt, Mycobacterium bovis subsp bovis AF2122/97
agaugcggcccgggc

SEQ ID NO: 1156739 - RNA, 16 nt, Mycobacterium bovis subsp bovis AF2122/97
agaugcggaacgccga

SEQ ID NO: 1156740 - RNA, 19 nt, Mycobacterium bovis subsp bovis AF2122/97
agaugccugcuagcagcag

SEQ ID NO: 1156741 - RNA, 21 nt, Mycobacterium bovis subsp bovis AF2122/97
agaugcgcggggaucacaccc

SEQ ID NO: 1156742 - RNA, 20 nt, Mycobacterium bovis subsp bovis AF2122/97
agaugaugccguucggaccc

SEQ ID NO: 1156743 - RNA, 16 nt, Mycobacterium bovis subsp bovis AF2122/97
agaugaauugccgggc

SEQ ID NO: 1156744 - RNA, 17 nt, Mycobacterium bovis subsp bovis AF2122/97
agaugaauugccgggcg

SEQ ID NO: 1156745 - RNA, 22 nt, Mycobacterium bovis subsp bovis AF2122/97
agaguggccucguccagcucgg

SEQ ID NO: 1156746 - RNA, 22 nt, Mycobacterium bovis subsp bovis AF2122/97
agaguguccccggcugccagcg

SEQ ID NO: 1156747 - RNA, 15 nt, Mycobacterium bovis subsp bovis AF2122/97
agagucgcacugcgc

SEQ ID NO: 1156748 - RNA, 13 nt, Mycobacterium bovis subsp bovis AF2122/97
agaguucccgaaa

SEQ ID NO: 1156749 - RNA, 21 nt, Mycobacterium bovis subsp bovis AF2122/97
agaguucgcgcgccgcgacga

SEQ ID NO: 1156750 - RNA, 17 nt, Mycobacterium bovis subsp bovis AF2122/97
agagggccgcgguuugg

SEQ ID NO: 1156751 - RNA, 14 nt, Mycobacterium bovis subsp bovis AF2122/97
agaggcgcaccucc

SEQ ID NO: 1156752 - RNA, 15 nt, Mycobacterium bovis subsp bovis AF2122/97
agagggugucgcccu

SEQ ID NO: 1156753 - RNA, 15 nt, Mycobacterium bovis subsp bovis AF2122/97
agagguagagcagau

SEQ ID NO: 1156754 - RNA, 18 nt, Mycobacterium bovis subsp bovis AF2122/97
agagcuccgucgcggccg

SEQ ID NO: 1156755 - RNA, 19 nt, Mycobacterium bovis subsp bovis AF2122/97
agagcgucaaccacggccg

SEQ ID NO: 1156756 - RNA, 20 nt, Mycobacterium bovis subsp bovis AF2122/97
agaucagcaccgacagcccg

SEQ ID NO: 1156757 - RNA, 21 nt, Mycobacterium bovis subsp bovis AF2122/97
agaucagcaccgacagcccga

SEQ ID NO: 1156758 - RNA, 21 nt, Mycobacterium bovis subsp bovis AF2122/97
agaucaccucccgcggcaccu

SEQ ID NO: 1156759 - RNA, 22 nt, Mycobacterium bovis subsp bovis AF2122/97
agaucaccuugccuagccgcag

SEQ ID NO: 1156760 - RNA, 13 nt, Mycobacterium bovis subsp bovis AF2122/97
agaucagcaccgu

SEQ ID NO: 1156761 - RNA, 14 nt, Mycobacterium bovis subsp bovis AF2122/97
agaucagccggcag

SEQ ID NO: 1156762 - RNA, 17 nt, Mycobacterium bovis subsp bovis AF2122/97
agaucagccggcagcga

SEQ ID NO: 1156763 - RNA, 17 nt, Mycobacterium bovis subsp bovis AF2122/97
agaucagccucgcgggc

SEQ ID NO: 1156764 - RNA, 13 nt, Mycobacterium bovis subsp bovis AF2122/97
agaucaccgccac

SEQ ID NO: 1156765 - RNA, 24 nt, Mycobacterium bovis subsp bovis AF2122/97
agaucaccgccaccaccagggcaa

SEQ ID NO: 1156766 - RNA, 22 nt, Mycobacterium bovis subsp bovis AF2122/97
agaucaccgccagcugggcagc

SEQ ID NO: 1156767 - RNA, 22 nt, Mycobacterium bovis subsp bovis AF2122/97
agaucagcagcggcgaccgcgg

SEQ ID NO: 1156768 - RNA, 15 nt, Mycobacterium bovis subsp bovis AF2122/97
agaucagccgccgcc

SEQ ID NO: 1156769 - RNA, 16 nt, Mycobacterium bovis subsp bovis AF2122/97
aacucaccagcacccc

SEQ ID NO: 1156770 - RNA, 22 nt, Mycobacterium bovis subsp bovis AF2122/97
aacucgaacugggucggcacgg

SEQ ID NO: 1156771 - RNA, 21 nt, Mycobacterium bovis subsp bovis AF2122/97
aacucgaagaccucgucgcgu

SEQ ID NO: 1156772 - RNA, 16 nt, Mycobacterium bovis subsp bovis AF2122/97
aacuccagcagcccgg

SEQ ID NO: 1156773 - RNA, 23 nt, Mycobacterium bovis subsp bovis AF2122/97
aacuccgccaccaucgccucggc

SEQ ID NO: 1156774 - RNA, 19 nt, Mycobacterium bovis subsp bovis AF2122/97
aacggccaagacuucuccg

SEQ ID NO: 1156775 - RNA, 18 nt, Mycobacterium bovis subsp bovis AF2122/97
aacggcauccuguggcgg

SEQ ID NO: 1156776 - RNA, 22 nt, Mycobacterium bovis subsp bovis AF2122/97
aacggcagcccaaagcgccagc

SEQ ID NO: 1156777 - RNA, 19 nt, Mycobacterium bovis subsp bovis AF2122/97
aacggcagccgaagcgccc

SEQ ID NO: 1156778 - RNA, 15 nt, Mycobacterium bovis subsp bovis AF2122/97
aacucacccgagcca

SEQ ID NO: 1156779 - RNA, 22 nt, Mycobacterium bovis subsp bovis AF2122/97
aacugccggacuaccgccggcg

SEQ ID NO: 1156780 - RNA, 15 nt, Mycobacterium bovis subsp bovis AF2122/97
aacugcgccguucgc

SEQ ID NO: 1156781 - RNA, 16 nt, Mycobacterium bovis subsp bovis AF2122/97
aacugcgaucggccgc

SEQ ID NO: 1156782 - RNA, 21 nt, Mycobacterium bovis subsp bovis AF2122/97
aacugcgaucggccgccgaau

SEQ ID NO: 1156783 - RNA, 12 nt, Mycobacterium bovis subsp bovis AF2122/97
aacugagggcgg

SEQ ID NO: 1156784 - RNA, 13 nt, Mycobacterium bovis subsp bovis AF2122/97
aacucggcgucgu

SEQ ID NO: 1156785 - RNA, 15 nt, Mycobacterium bovis subsp bovis AF2122/97
aacucggcgucgugg

SEQ ID NO: 1156786 - RNA, 14 nt, Mycobacterium bovis subsp bovis AF2122/97
aacucgggggcugc

SEQ ID NO: 1156787 - RNA, 15 nt, Mycobacterium bovis subsp bovis AF2122/97
aacucggcccgggug

SEQ ID NO: 1156788 - RNA, 21 nt, Mycobacterium bovis subsp bovis AF2122/97
aacucggcgaucucgucgcgg

SEQ ID NO: 1156789 - RNA, 22 nt, Mycobacterium bovis subsp bovis AF2122/97
aacucggcgaucucgucgcggu

SEQ ID NO: 1156790 - RNA, 15 nt, Mycobacterium bovis subsp bovis AF2122/97
aacucgccccgcgug

SEQ ID NO: 1156791 - RNA, 12 nt, Mycobacterium bovis subsp bovis AF2122/97
aacucgccgaaa

SEQ ID NO: 1156792 - RNA, 20 nt, Mycobacterium bovis subsp bovis AF2122/97
aacucgccgaaaucggccag

SEQ ID NO: 1156793 - RNA, 20 nt, Mycobacterium bovis subsp bovis AF2122/97
aacucgagaguggccucguc

SEQ ID NO: 1156794 - RNA, 17 nt, Mycobacterium bovis subsp bovis AF2122/97
aacucguccagcagugc

SEQ ID NO: 1156795 - RNA, 22 nt, Mycobacterium bovis subsp bovis AF2122/97
aacucuggauucuucagcgcgg

SEQ ID NO: 1156796 - RNA, 18 nt, Mycobacterium bovis subsp bovis AF2122/97
aacucuguggugucgauu

SEQ ID NO: 1156797 - RNA, 17 nt, Mycobacterium bovis subsp bovis AF2122/97
aagaagagguuggcggc

SEQ ID NO: 1156798 - RNA, 14 nt, Mycobacterium bovis subsp bovis AF2122/97
aagaccccuaccgg

SEQ ID NO: 1156799 - RNA, 22 nt, Mycobacterium bovis subsp bovis AF2122/97
aagacaaguggugguaggccgg

SEQ ID NO: 1156800 - RNA, 17 nt, Mycobacterium bovis subsp bovis AF2122/97
aagacagccugcgccac

SEQ ID NO: 1156801 - RNA, 15 nt, Mycobacterium bovis subsp bovis AF2122/97
aagacaccaggcccg

SEQ ID NO: 1156802 - RNA, 21 nt, Mycobacterium bovis subsp bovis AF2122/97
aacuggucgccaacgccagca

SEQ ID NO: 1156803 - RNA, 15 nt, Mycobacterium bovis subsp bovis AF2122/97
aacugggggccggca

SEQ ID NO: 1156804 - RNA, 16 nt, Mycobacterium bovis subsp bovis AF2122/97
aacugggggccggcac

SEQ ID NO: 1156805 - RNA, 22 nt, Mycobacterium bovis subsp bovis AF2122/97
aacugcuugcgcaucgccgaca

SEQ ID NO: 1156806 - RNA, 17 nt, Mycobacterium bovis subsp bovis AF2122/97
aacuggaccacagccgc

SEQ ID NO: 1156807 - RNA, 19 nt, Mycobacterium bovis subsp bovis AF2122/97
aacuggacuggggcgccac

SEQ ID NO: 1156808 - RNA, 20 nt, Mycobacterium bovis subsp bovis AF2122/97
aacuugcggaccuggcggcg

SEQ ID NO: 1156809 - RNA, 14 nt, Mycobacterium bovis subsp bovis AF2122/97
aacacgucggccag

SEQ ID NO: 1156810 - RNA, 12 nt, Mycobacterium bovis subsp bovis AF2122/97
aacacgggcagc

SEQ ID NO: 1156811 - RNA, 15 nt, Mycobacterium bovis subsp bovis AF2122/97
aacacgaugcgcggu

SEQ ID NO: 1156812 - RNA, 16 nt, Mycobacterium bovis subsp bovis AF2122/97
aacacgaugcgcggug

SEQ ID NO: 1156813 - RNA, 17 nt, Mycobacterium bovis subsp bovis AF2122/97
aacacgccgucgaccgg

SEQ ID NO: 1156814 - RNA, 17 nt, Mycobacterium bovis subsp bovis AF2122/97
aacacgccucgccgaag

SEQ ID NO: 1156815 - RNA, 12 nt, Mycobacterium bovis subsp bovis AF2122/97
aacacgccggcc

SEQ ID NO: 1156816 - RNA, 21 nt, Mycobacterium bovis subsp bovis AF2122/97
aacacgacugucccgcgcaac

SEQ ID NO: 1156817 - RNA, 11 nt, Mycobacterium bovis subsp bovis AF2122/97
aacaccggcug

SEQ ID NO: 1156818 - RNA, 18 nt, Mycobacterium bovis subsp bovis AF2122/97
aacaccgugcaccagcuc

SEQ ID NO: 1156819 - RNA, 15 nt, Mycobacterium bovis subsp bovis AF2122/97
aacaccucggcacgg

SEQ ID NO: 1156820 - RNA, 22 nt, Mycobacterium bovis subsp bovis AF2122/97
aaccggcgaucgguuggugagg

SEQ ID NO: 1156821 - RNA, 21 nt, Mycobacterium bovis subsp bovis AF2122/97
aaccggcgcaguagccgacca

SEQ ID NO: 1156822 - RNA, 15 nt, Mycobacterium bovis subsp bovis AF2122/97
aaccggcgcgccccg

SEQ ID NO: 1156823 - RNA, 14 nt, Mycobacterium bovis subsp bovis AF2122/97
aaccggcggcgacg

SEQ ID NO: 1156824 - RNA, 20 nt, Mycobacterium bovis subsp bovis AF2122/97
aaccggcggcgacggcggca

SEQ ID NO: 1156825 - RNA, 21 nt, Mycobacterium bovis subsp bovis AF2122/97
aaccggcggcgacggcggcac

SEQ ID NO: 1156826 - RNA, 22 nt, Mycobacterium bovis subsp bovis AF2122/97
aaccggcggcgacggcggcacg

SEQ ID NO: 1156827 - RNA, 15 nt, Mycobacterium bovis subsp bovis AF2122/97
aaccggccgcgacga

SEQ ID NO: 1156828 - RNA, 20 nt, Mycobacterium bovis subsp bovis AF2122/97
aaccggccaucgaccguccg

SEQ ID NO: 1156829 - RNA, 13 nt, Mycobacterium bovis subsp bovis AF2122/97
aaccggaugcggu

SEQ ID NO: 1156830 - RNA, 22 nt, Mycobacterium bovis subsp bovis AF2122/97
aaccggaugcggucccugauca

SEQ ID NO: 1156831 - RNA, 12 nt, Mycobacterium bovis subsp bovis AF2122/97
aaccggacgccc

SEQ ID NO: 1156832 - RNA, 16 nt, Mycobacterium bovis subsp bovis AF2122/97
aaccggacgcccucac

SEQ ID NO: 1156833 - RNA, 22 nt, Mycobacterium bovis subsp bovis AF2122/97
aaccgcugccggugugcggcgu

SEQ ID NO: 1156834 - RNA, 15 nt, Mycobacterium bovis subsp bovis AF2122/97
aaccgcuuugaauug

SEQ ID NO: 1156835 - RNA, 22 nt, Mycobacterium bovis subsp bovis AF2122/97
aaccgcugcgcgaaucgcgucg

SEQ ID NO: 1156836 - RNA, 23 nt, Mycobacterium bovis subsp bovis AF2122/97
aaccgcugcgcgaaucgcgucga

SEQ ID NO: 1156837 - RNA, 21 nt, Mycobacterium bovis subsp bovis AF2122/97
aaccgcugcuccucgcgguag

SEQ ID NO: 1156838 - RNA, 13 nt, Mycobacterium bovis subsp bovis AF2122/97
aaccgcugcugcu

SEQ ID NO: 1156839 - RNA, 13 nt, Mycobacterium bovis subsp bovis AF2122/97
aaccggucguggu

SEQ ID NO: 1156840 - RNA, 22 nt, Mycobacterium bovis subsp bovis AF2122/97
aaccggucaaacgcgcgcgcca

SEQ ID NO: 1156841 - RNA, 21 nt, Mycobacterium bovis subsp bovis AF2122/97
aaccgguguagcagcgccagc

SEQ ID NO: 1156842 - RNA, 16 nt, Mycobacterium bovis subsp bovis AF2122/97
aaccguagcccugcuc

SEQ ID NO: 1156843 - RNA, 23 nt, Mycobacterium bovis subsp bovis AF2122/97
aaccguggccgcgaucccggccg

SEQ ID NO: 1156844 - RNA, 13 nt, Mycobacterium bovis subsp bovis AF2122/97
aaccgugagcacc

SEQ ID NO: 1156845 - RNA, 17 nt, Mycobacterium bovis subsp bovis AF2122/97
aaccguucggcgacagc

SEQ ID NO: 1156846 - RNA, 21 nt, Mycobacterium bovis subsp bovis AF2122/97
aaccguucggcgacagcgcgg

SEQ ID NO: 1156847 - RNA, 14 nt, Mycobacterium bovis subsp bovis AF2122/97
aaccguucccggca

SEQ ID NO: 1156848 - RNA, 19 nt, Mycobacterium bovis subsp bovis AF2122/97
aaccguugcgcaagcuggu

SEQ ID NO: 1156849 - RNA, 20 nt, Mycobacterium bovis subsp bovis AF2122/97
aaccguccggggccgcggcc

SEQ ID NO: 1156850 - RNA, 17 nt, Mycobacterium bovis subsp bovis AF2122/97
aaccgucagcgcgccgu

SEQ ID NO: 1156851 - RNA, 16 nt, Mycobacterium bovis subsp bovis AF2122/97
aaccgucagcggcaac

SEQ ID NO: 1156852 - RNA, 20 nt, Mycobacterium bovis subsp bovis AF2122/97
aaccgggacaaucucggccg

SEQ ID NO: 1156853 - RNA, 22 nt, Mycobacterium bovis subsp bovis AF2122/97
aaccuguaccgccacggcggcu

SEQ ID NO: 1156854 - RNA, 20 nt, Mycobacterium bovis subsp bovis AF2122/97
aaccugcgaccaggcgcggc

SEQ ID NO: 1156855 - RNA, 13 nt, Mycobacterium bovis subsp bovis AF2122/97
aaccugcgcggcg

SEQ ID NO: 1156856 - RNA, 14 nt, Mycobacterium bovis subsp bovis AF2122/97
aaccugcgcggcga

SEQ ID NO: 1156857 - RNA, 14 nt, Mycobacterium bovis subsp bovis AF2122/97
aaccugaguccggc

SEQ ID NO: 1156858 - RNA, 24 nt, Mycobacterium bovis subsp bovis AF2122/97
aaccguuucgggaagucgggccgg

SEQ ID NO: 1156859 - RNA, 17 nt, Mycobacterium bovis subsp bovis AF2122/97
aacgcgucccgccgcac

SEQ ID NO: 1156860 - RNA, 22 nt, Mycobacterium bovis subsp bovis AF2122/97
aacgcgucccgccgcaccgccg

SEQ ID NO: 1156861 - RNA, 20 nt, Mycobacterium bovis subsp bovis AF2122/97
aacgcguauucggcaucgcc

SEQ ID NO: 1156862 - RNA, 18 nt, Mycobacterium bovis subsp bovis AF2122/97
aacgcggccucgucgagu

SEQ ID NO: 1156863 - RNA, 15 nt, Mycobacterium bovis subsp bovis AF2122/97
aacgcggcgucgaug

SEQ ID NO: 1156864 - RNA, 16 nt, Mycobacterium bovis subsp bovis AF2122/97
aacgcgcuuggugugg

SEQ ID NO: 1156865 - RNA, 14 nt, Mycobacterium bovis subsp bovis AF2122/97
aacgcggccucguc

SEQ ID NO: 1156866 - RNA, 18 nt, Mycobacterium bovis subsp bovis AF2122/97
aacgcggacaccgcggcg

SEQ ID NO: 1156867 - RNA, 20 nt, Mycobacterium bovis subsp bovis AF2122/97
aacgcuguaagcaugccguu

SEQ ID NO: 1156868 - RNA, 20 nt, Mycobacterium bovis subsp bovis AF2122/97
aacgcugcgcccggaccacu

SEQ ID NO: 1156869 - RNA, 19 nt, Mycobacterium bovis subsp bovis AF2122/97
aacgcgucgccgacgccgg

SEQ ID NO: 1156870 - RNA, 15 nt, Mycobacterium bovis subsp bovis AF2122/97
aacgcgucguagcgc

SEQ ID NO: 1156871 - RNA, 16 nt, Mycobacterium bovis subsp bovis AF2122/97
aacgcgucgucgguca

SEQ ID NO: 1156872 - RNA, 21 nt, Mycobacterium bovis subsp bovis AF2122/97
aacgcugaggaagcggcggca

SEQ ID NO: 1156873 - RNA, 15 nt, Mycobacterium bovis subsp bovis AF2122/97
aacgccucugcgauc

SEQ ID NO: 1156874 - RNA, 13 nt, Mycobacterium bovis subsp bovis AF2122/97
aacgccucaccga

SEQ ID NO: 1156875 - RNA, 15 nt, Mycobacterium bovis subsp bovis AF2122/97
aacgccgugccguac

SEQ ID NO: 1156876 - RNA, 15 nt, Mycobacterium bovis subsp bovis AF2122/97
aacgccgucacggca

SEQ ID NO: 1156877 - RNA, 13 nt, Mycobacterium bovis subsp bovis AF2122/97
aacgcccgggcgg

SEQ ID NO: 1156878 - RNA, 13 nt, Mycobacterium bovis subsp bovis AF2122/97
aacgacgacgaca

SEQ ID NO: 1156879 - RNA, 22 nt, Mycobacterium bovis subsp bovis AF2122/97
aacgacuguggcgccgccggca

SEQ ID NO: 1156880 - RNA, 23 nt, Mycobacterium bovis subsp bovis AF2122/97
aacgacuguggcgccgccggcac

SEQ ID NO: 1156881 - RNA, 17 nt, Mycobacterium bovis subsp bovis AF2122/97
aacgacgguuccgccac

SEQ ID NO: 1156882 - RNA, 23 nt, Mycobacterium bovis subsp bovis AF2122/97
aacgacgucgccgacccgggggc

SEQ ID NO: 1156883 - RNA, 24 nt, Mycobacterium bovis subsp bovis AF2122/97
aacgacgggaaccagcggucggcg

SEQ ID NO: 1156884 - RNA, 24 nt, Mycobacterium bovis subsp bovis AF2122/97
aacgacgccaugagcgcgcccaac

SEQ ID NO: 1156885 - RNA, 16 nt, Mycobacterium bovis subsp bovis AF2122/97
aacgacucgagagcga

SEQ ID NO: 1156886 - RNA, 17 nt, Mycobacterium bovis subsp bovis AF2122/97
aacgacuuucaucgcga

SEQ ID NO: 1156887 - RNA, 21 nt, Mycobacterium bovis subsp bovis AF2122/97
aacgaggcgcccagcgacaac

SEQ ID NO: 1156888 - RNA, 14 nt, Mycobacterium bovis subsp bovis AF2122/97
aacgagcggccgcg

SEQ ID NO: 1156889 - RNA, 16 nt, Mycobacterium bovis subsp bovis AF2122/97
aacgaggccgacgaca

SEQ ID NO: 1156890 - RNA, 16 nt, Mycobacterium bovis subsp bovis AF2122/97
aacgaggucgccgcaa

SEQ ID NO: 1156891 - RNA, 13 nt, Mycobacterium bovis subsp bovis AF2122/97
aaggcgacucggu

SEQ ID NO: 1156892 - RNA, 18 nt, Mycobacterium bovis subsp bovis AF2122/97
aaggcguugguagccagg

SEQ ID NO: 1156893 - RNA, 18 nt, Mycobacterium bovis subsp bovis AF2122/97
aaggcccguugucgaccg

SEQ ID NO: 1156894 - RNA, 15 nt, Mycobacterium bovis subsp bovis AF2122/97
aaggccgcaccgcca

SEQ ID NO: 1156895 - RNA, 18 nt, Mycobacterium bovis subsp bovis AF2122/97
aaggccgcgcgcagggcg

SEQ ID NO: 1156896 - RNA, 15 nt, Mycobacterium bovis subsp bovis AF2122/97
aaggccgguagcgcg

SEQ ID NO: 1156897 - RNA, 20 nt, Mycobacterium bovis subsp bovis AF2122/97
aaggccgccgccgucggcga

SEQ ID NO: 1156898 - RNA, 23 nt, Mycobacterium bovis subsp bovis AF2122/97
aaggccuucagcggucgcagcuc

SEQ ID NO: 1156899 - RNA, 15 nt, Mycobacterium bovis subsp bovis AF2122/97
aaggucuccggcaag

SEQ ID NO: 1156900 - RNA, 19 nt, Mycobacterium bovis subsp bovis AF2122/97
aaggucgcugcuugcgggc

SEQ ID NO: 1156901 - RNA, 11 nt, Mycobacterium bovis subsp bovis AF2122/97
aaggucggcga

SEQ ID NO: 1156902 - RNA, 15 nt, Mycobacterium bovis subsp bovis AF2122/97
aaggcucaccaggcg

SEQ ID NO: 1156903 - RNA, 14 nt, Mycobacterium bovis subsp bovis AF2122/97
aaggcucaccaggc

SEQ ID NO: 1156904 - RNA, 16 nt, Mycobacterium bovis subsp bovis AF2122/97
aagcgcaucgagcacc

SEQ ID NO: 1156905 - RNA, 21 nt, Mycobacterium bovis subsp bovis AF2122/97
aagcgccgaaacagcacccag

SEQ ID NO: 1156906 - RNA, 20 nt, Mycobacterium bovis subsp bovis AF2122/97
aagcgggacugcagcgcggu

SEQ ID NO: 1156907 - RNA, 22 nt, Mycobacterium bovis subsp bovis AF2122/97
aagcgggcgugcucggaggcga

SEQ ID NO: 1156908 - RNA, 16 nt, Mycobacterium bovis subsp bovis AF2122/97
aaggccaagcgccaac

SEQ ID NO: 1156909 - RNA, 22 nt, Mycobacterium bovis subsp bovis AF2122/97
aaggccacccgcgaagccgcca

SEQ ID NO: 1156910 - RNA, 12 nt, Mycobacterium bovis subsp bovis AF2122/97
aagccgccgggc

SEQ ID NO: 1156911 - RNA, 11 nt, Mycobacterium bovis subsp bovis AF2122/97
aagccgcggcu

SEQ ID NO: 1156912 - RNA, 14 nt, Mycobacterium bovis subsp bovis AF2122/97
aagccgcugaugua

SEQ ID NO: 1156913 - RNA, 15 nt, Mycobacterium bovis subsp bovis AF2122/97
aagccggagcccggc

SEQ ID NO: 1156914 - RNA, 23 nt, Mycobacterium bovis subsp bovis AF2122/97
aagccgaccggguugauggcgua

SEQ ID NO: 1156915 - RNA, 12 nt, Mycobacterium bovis subsp bovis AF2122/97
aagccgacgauc

SEQ ID NO: 1156916 - RNA, 21 nt, Mycobacterium bovis subsp bovis AF2122/97
aagccgauguccgacgccacc

SEQ ID NO: 1156917 - RNA, 18 nt, Mycobacterium bovis subsp bovis AF2122/97
aagccgacaucggcggcc

SEQ ID NO: 1156918 - RNA, 19 nt, Mycobacterium bovis subsp bovis AF2122/97
aagccgaccaccgccgggc

SEQ ID NO: 1156919 - RNA, 14 nt, Mycobacterium bovis subsp bovis AF2122/97
aagcgauccggcug

SEQ ID NO: 1156920 - RNA, 14 nt, Mycobacterium bovis subsp bovis AF2122/97
aagcgauucccaac

SEQ ID NO: 1156921 - RNA, 19 nt, Mycobacterium bovis subsp bovis AF2122/97
aagccggcgcccgccgcga

SEQ ID NO: 1156922 - RNA, 18 nt, Mycobacterium bovis subsp bovis AF2122/97
aagccggcgcggcggcgu

SEQ ID NO: 1156923 - RNA, 19 nt, Mycobacterium bovis subsp bovis AF2122/97
aagccgugcagcucgguca

SEQ ID NO: 1156924 - RNA, 16 nt, Mycobacterium bovis subsp bovis AF2122/97
aagccgucgacgcggu

SEQ ID NO: 1156925 - RNA, 19 nt, Mycobacterium bovis subsp bovis AF2122/97
aagccgggucucggugcgg

SEQ ID NO: 1156926 - RNA, 23 nt, Mycobacterium bovis subsp bovis AF2122/97
aagccguagaccaggcccagguc

SEQ ID NO: 1156927 - RNA, 22 nt, Mycobacterium bovis subsp bovis AF2122/97
aagccguucgcgucgccgauga

SEQ ID NO: 1156928 - RNA, 18 nt, Mycobacterium bovis subsp bovis AF2122/97
aagccguguucgaccgca

SEQ ID NO: 1156929 - RNA, 22 nt, Mycobacterium bovis subsp bovis AF2122/97
aagccguugccgccacgggcgg

SEQ ID NO: 1156930 - RNA, 16 nt, Mycobacterium bovis subsp bovis AF2122/97
aagccguguucgaccg

SEQ ID NO: 1156931 - RNA, 21 nt, Mycobacterium bovis subsp bovis AF2122/97
aagccuaguccuggcucggca

SEQ ID NO: 1156932 - RNA, 14 nt, Mycobacterium bovis subsp bovis AF2122/97
aagacggccaccgg

SEQ ID NO: 1156933 - RNA, 12 nt, Mycobacterium bovis subsp bovis AF2122/97
aagacgucgagg

SEQ ID NO: 1156934 - RNA, 14 nt, Mycobacterium bovis subsp bovis AF2122/97
aagacgucggacgg

SEQ ID NO: 1156935 - RNA, 13 nt, Mycobacterium bovis subsp bovis AF2122/97
aagacgucggcgu

SEQ ID NO: 1156936 - RNA, 18 nt, Mycobacterium bovis subsp bovis AF2122/97
aagacguuggcgcgguug

SEQ ID NO: 1156937 - RNA, 20 nt, Mycobacterium bovis subsp bovis AF2122/97
aagaccguucguucccgcuc

SEQ ID NO: 1156938 - RNA, 14 nt, Mycobacterium bovis subsp bovis AF2122/97
aagacgcgggucuu

SEQ ID NO: 1156939 - RNA, 16 nt, Mycobacterium bovis subsp bovis AF2122/97
aagacgaauaacgccg

SEQ ID NO: 1156940 - RNA, 20 nt, Mycobacterium bovis subsp bovis AF2122/97
aagccagcgcagccaggcug

SEQ ID NO: 1156941 - RNA, 20 nt, Mycobacterium bovis subsp bovis AF2122/97
aagccagaucgcuaggaccg

SEQ ID NO: 1156942 - RNA, 16 nt, Mycobacterium bovis subsp bovis AF2122/97
aagccacgccggucgc

SEQ ID NO: 1156943 - RNA, 21 nt, Mycobacterium bovis subsp bovis AF2122/97
aagacugcgccgccggcgcgu

SEQ ID NO: 1156944 - RNA, 12 nt, Mycobacterium bovis subsp bovis AF2122/97
aauacggcggcg

SEQ ID NO: 1156945 - RNA, 12 nt, Mycobacterium bovis subsp bovis AF2122/97
aaguuggccgcc

SEQ ID NO: 1156946 - RNA, 18 nt, Mycobacterium bovis subsp bovis AF2122/97
aaguuggcugagcagcgc

SEQ ID NO: 1156947 - RNA, 16 nt, Mycobacterium bovis subsp bovis AF2122/97
aaguucucggugcgca

SEQ ID NO: 1156948 - RNA, 14 nt, Mycobacterium bovis subsp bovis AF2122/97
aaguugcccaggug

SEQ ID NO: 1156949 - RNA, 15 nt, Mycobacterium bovis subsp bovis AF2122/97
aaguugaugucgcgu

SEQ ID NO: 1156950 - RNA, 16 nt, Mycobacterium bovis subsp bovis AF2122/97
aaguggaucuggcgca

SEQ ID NO: 1156951 - RNA, 16 nt, Mycobacterium bovis subsp bovis AF2122/97
aagugucuccggcaac

SEQ ID NO: 1156952 - RNA, 23 nt, Mycobacterium bovis subsp bovis AF2122/97
aagugggcgguaccucgucgagc

SEQ ID NO: 1156953 - RNA, 18 nt, Mycobacterium bovis subsp bovis AF2122/97
aagugggcguuggcggca

SEQ ID NO: 1156954 - RNA, 13 nt, Mycobacterium bovis subsp bovis AF2122/97
aagugccggcgcg

SEQ ID NO: 1156955 - RNA, 13 nt, Mycobacterium bovis subsp bovis AF2122/97
aagugccucgcgg

SEQ ID NO: 1156956 - RNA, 18 nt, Mycobacterium bovis subsp bovis AF2122/97
aaguucgugagcgaacgg

SEQ ID NO: 1156957 - RNA, 15 nt, Mycobacterium bovis subsp bovis AF2122/97
aagucguugcgcggu

SEQ ID NO: 1156958 - RNA, 12 nt, Mycobacterium bovis subsp bovis AF2122/97
aaggugcugcgc

SEQ ID NO: 1156959 - RNA, 13 nt, Mycobacterium bovis subsp bovis AF2122/97
aagguguccucca

SEQ ID NO: 1156960 - RNA, 21 nt, Mycobacterium bovis subsp bovis AF2122/97
aagucugugcucacggcggcg

SEQ ID NO: 1156961 - RNA, 20 nt, Mycobacterium bovis subsp bovis AF2122/97
acagcagccgccggccggca

SEQ ID NO: 1156962 - RNA, 13 nt, Mycobacterium bovis subsp bovis AF2122/97
acagcagccggug

SEQ ID NO: 1156963 - RNA, 22 nt, Mycobacterium bovis subsp bovis AF2122/97
acagcaggcucgaaccgacgcg

SEQ ID NO: 1156964 - RNA, 18 nt, Mycobacterium bovis subsp bovis AF2122/97
acagcaucacgcccacga

SEQ ID NO: 1156965 - RNA, 22 nt, Mycobacterium bovis subsp bovis AF2122/97
acagcgaguucuggaauccggc

SEQ ID NO: 1156966 - RNA, 15 nt, Mycobacterium bovis subsp bovis AF2122/97
acagcgacgccaugg

SEQ ID NO: 1156967 - RNA, 13 nt, Mycobacterium bovis subsp bovis AF2122/97
acagcgacagcgu

SEQ ID NO: 1156968 - RNA, 19 nt, Mycobacterium bovis subsp bovis AF2122/97
acagcgaacagacaugcgc

SEQ ID NO: 1156969 - RNA, 14 nt, Mycobacterium bovis subsp bovis AF2122/97
acagcgaaccgccg

SEQ ID NO: 1156970 - RNA, 15 nt, Mycobacterium bovis subsp bovis AF2122/97
acagcggaccccacg

SEQ ID NO: 1156971 - RNA, 18 nt, Mycobacterium bovis subsp bovis AF2122/97
acagcgggggcagcgcga

SEQ ID NO: 1156972 - RNA, 22 nt, Mycobacterium bovis subsp bovis AF2122/97
acagcgggcgcuguagucgcgc

SEQ ID NO: 1156973 - RNA, 19 nt, Mycobacterium bovis subsp bovis AF2122/97
acagcggcaucgcgggcgg

SEQ ID NO: 1156974 - RNA, 18 nt, Mycobacterium bovis subsp bovis AF2122/97
acagcgcuccagccgcgc

SEQ ID NO: 1156975 - RNA, 13 nt, Mycobacterium bovis subsp bovis AF2122/97
acagcgauccgau

SEQ ID NO: 1156976 - RNA, 17 nt, Mycobacterium bovis subsp bovis AF2122/97
acagcgcaaaaucaccg

SEQ ID NO: 1156977 - RNA, 20 nt, Mycobacterium bovis subsp bovis AF2122/97
acagcgccaagacgucggcg

SEQ ID NO: 1156978 - RNA, 19 nt, Mycobacterium bovis subsp bovis AF2122/97
acaggucgcccaacaccgc

SEQ ID NO: 1156979 - RNA, 12 nt, Mycobacterium bovis subsp bovis AF2122/97
acaggucagcgc

SEQ ID NO: 1156980 - RNA, 13 nt, Mycobacterium bovis subsp bovis AF2122/97
acaggucggccca

SEQ ID NO: 1156981 - RNA, 15 nt, Mycobacterium bovis subsp bovis AF2122/97
acaggugccaaacgc

SEQ ID NO: 1156982 - RNA, 13 nt, Mycobacterium bovis subsp bovis AF2122/97
acagguagucgcc

SEQ ID NO: 1156983 - RNA, 15 nt, Mycobacterium bovis subsp bovis AF2122/97
acagguagucgccgg

SEQ ID NO: 1156984 - RNA, 13 nt, Mycobacterium bovis subsp bovis AF2122/97
acaggucgaaugg

SEQ ID NO: 1156985 - RNA, 17 nt, Mycobacterium bovis subsp bovis AF2122/97
acaggcguccaucgcca

SEQ ID NO: 1156986 - RNA, 18 nt, Mycobacterium bovis subsp bovis AF2122/97
acaggcggccagcaucgc

SEQ ID NO: 1156987 - RNA, 15 nt, Mycobacterium bovis subsp bovis AF2122/97
acaggccgccaccgu

SEQ ID NO: 1156988 - RNA, 14 nt, Mycobacterium bovis subsp bovis AF2122/97
acaggccggccacc

SEQ ID NO: 1156989 - RNA, 14 nt, Mycobacterium bovis subsp bovis AF2122/97
acaggccggcucgc

SEQ ID NO: 1156990 - RNA, 13 nt, Mycobacterium bovis subsp bovis AF2122/97
acaggacgucggc

SEQ ID NO: 1156991 - RNA, 21 nt, Mycobacterium bovis subsp bovis AF2122/97
acaggccggccaccaccgcgc

SEQ ID NO: 1156992 - RNA, 24 nt, Mycobacterium bovis subsp bovis AF2122/97
acaggccggccaccaccgcgccgu

SEQ ID NO: 1156993 - RNA, 14 nt, Mycobacterium bovis subsp bovis AF2122/97
acaggaagcgaccg

SEQ ID NO: 1156994 - RNA, 22 nt, Mycobacterium bovis subsp bovis AF2122/97
acaggaagucgcggacgucgcc

SEQ ID NO: 1156995 - RNA, 16 nt, Mycobacterium bovis subsp bovis AF2122/97
acagcugcccgccagc

SEQ ID NO: 1156996 - RNA, 15 nt, Mycobacterium bovis subsp bovis AF2122/97
acagaccgaacagca

SEQ ID NO: 1156997 - RNA, 16 nt, Mycobacterium bovis subsp bovis AF2122/97
acagaccuagcaccgc

SEQ ID NO: 1156998 - RNA, 19 nt, Mycobacterium bovis subsp bovis AF2122/97
acagaccgaacagcaccga

SEQ ID NO: 1156999 - RNA, 16 nt, Mycobacterium bovis subsp bovis AF2122/97
acagacggggucgccc

SEQ ID NO: 1157000 - RNA, 17 nt, Mycobacterium bovis subsp bovis AF2122/97
acagacggggucgcccg

SEQ ID NO: 1157001 - RNA, 15 nt, Mycobacterium bovis subsp bovis AF2122/97
acagagucaccgcgc

SEQ ID NO: 1157002 - RNA, 20 nt, Mycobacterium bovis subsp bovis AF2122/97
acagacaggauugccgagcg

SEQ ID NO: 1157003 - RNA, 18 nt, Mycobacterium bovis subsp bovis AF2122/97
acagaucuggguucccga

SEQ ID NO: 1157004 - RNA, 15 nt, Mycobacterium bovis subsp bovis AF2122/97
acagcacccggccac

SEQ ID NO: 1157005 - RNA, 21 nt, Mycobacterium bovis subsp bovis AF2122/97
acagcacccgggccacgucga

SEQ ID NO: 1157006 - RNA, 13 nt, Mycobacterium bovis subsp bovis AF2122/97
acagcaccccgcc

SEQ ID NO: 1157007 - RNA, 17 nt, Mycobacterium bovis subsp bovis AF2122/97
acagcaccccgccgggg

SEQ ID NO: 1157008 - RNA, 14 nt, Mycobacterium bovis subsp bovis AF2122/97
acagcaauccgcaa

SEQ ID NO: 1157009 - RNA, 23 nt, Mycobacterium bovis subsp bovis AF2122/97
acagcaagauuauggcgagcgcg

SEQ ID NO: 1157010 - RNA, 13 nt, Mycobacterium bovis subsp bovis AF2122/97
acagcaacccgcc

SEQ ID NO: 1157011 - RNA, 15 nt, Mycobacterium bovis subsp bovis AF2122/97
acagaaucgaccgcc

SEQ ID NO: 1157012 - RNA, 14 nt, Mycobacterium bovis subsp bovis AF2122/97
acacguucggcguc

SEQ ID NO: 1157013 - RNA, 15 nt, Mycobacterium bovis subsp bovis AF2122/97
acacguugacgaugu

SEQ ID NO: 1157014 - RNA, 17 nt, Mycobacterium bovis subsp bovis AF2122/97
acacggugcugccguug

SEQ ID NO: 1157015 - RNA, 21 nt, Mycobacterium bovis subsp bovis AF2122/97
acacgguacugugggcgaucg

SEQ ID NO: 1157016 - RNA, 17 nt, Mycobacterium bovis subsp bovis AF2122/97
acacggucgucgcgagc

SEQ ID NO: 1157017 - RNA, 17 nt, Mycobacterium bovis subsp bovis AF2122/97
acacguccaguggcagc

SEQ ID NO: 1157018 - RNA, 16 nt, Mycobacterium bovis subsp bovis AF2122/97
acacguccgcgcaccg

SEQ ID NO: 1157019 - RNA, 21 nt, Mycobacterium bovis subsp bovis AF2122/97
acacguccggcgaugaccaga

SEQ ID NO: 1157020 - RNA, 12 nt, Mycobacterium bovis subsp bovis AF2122/97
acacucggccgg

SEQ ID NO: 1157021 - RNA, 17 nt, Mycobacterium bovis subsp bovis AF2122/97
acacucgaagucgccca

SEQ ID NO: 1157022 - RNA, 21 nt, Mycobacterium bovis subsp bovis AF2122/97
acacguuggcggaugcccgca

SEQ ID NO: 1157023 - RNA, 19 nt, Mycobacterium bovis subsp bovis AF2122/97
acacguuucacguggucgg

SEQ ID NO: 1157024 - RNA, 20 nt, Mycobacterium bovis subsp bovis AF2122/97
acacuaaccgaauuguugua

SEQ ID NO: 1157025 - RNA, 18 nt, Mycobacterium bovis subsp bovis AF2122/97
acaccacggugccgacga

SEQ ID NO: 1157026 - RNA, 21 nt, Mycobacterium bovis subsp bovis AF2122/97
acaccacgcuuaacagcgggu

SEQ ID NO: 1157027 - RNA, 19 nt, Mycobacterium bovis subsp bovis AF2122/97
acaccacggaccagcgccg

SEQ ID NO: 1157028 - RNA, 18 nt, Mycobacterium bovis subsp bovis AF2122/97
acaccacgauggcggcca

SEQ ID NO: 1157029 - RNA, 19 nt, Mycobacterium bovis subsp bovis AF2122/97
acaccacgauggcggccac

SEQ ID NO: 1157030 - RNA, 22 nt, Mycobacterium bovis subsp bovis AF2122/97
acaccacgauggcggccaccgu

SEQ ID NO: 1157031 - RNA, 17 nt, Mycobacterium bovis subsp bovis AF2122/97
acaccagacacuggccg

SEQ ID NO: 1157032 - RNA, 14 nt, Mycobacterium bovis subsp bovis AF2122/97
acaccaccgccaga

SEQ ID NO: 1157033 - RNA, 13 nt, Mycobacterium bovis subsp bovis AF2122/97
acaccaacccacc

SEQ ID NO: 1157034 - RNA, 17 nt, Mycobacterium bovis subsp bovis AF2122/97
acaccaacaccgcggcg

SEQ ID NO: 1157035 - RNA, 13 nt, Mycobacterium bovis subsp bovis AF2122/97
acaccaacaccgg

SEQ ID NO: 1157036 - RNA, 14 nt, Mycobacterium bovis subsp bovis AF2122/97
acacauugccggcc

SEQ ID NO: 1157037 - RNA, 23 nt, Mycobacterium bovis subsp bovis AF2122/97
acacaggaagcguugucgcccac

SEQ ID NO: 1157038 - RNA, 22 nt, Mycobacterium bovis subsp bovis AF2122/97
acacccgacacggcucgccggc

SEQ ID NO: 1157039 - RNA, 15 nt, Mycobacterium bovis subsp bovis AF2122/97
acacccaucaccgcc

SEQ ID NO: 1157040 - RNA, 20 nt, Mycobacterium bovis subsp bovis AF2122/97
acacccaucgaccgcccgcc

SEQ ID NO: 1157041 - RNA, 18 nt, Mycobacterium bovis subsp bovis AF2122/97
acacccaaaccggcccgc

SEQ ID NO: 1157042 - RNA, 18 nt, Mycobacterium bovis subsp bovis AF2122/97
acaccagaugcaccucgc

SEQ ID NO: 1157043 - RNA, 18 nt, Mycobacterium bovis subsp bovis AF2122/97
acaccagggugccgggca

SEQ ID NO: 1157044 - RNA, 22 nt, Mycobacterium bovis subsp bovis AF2122/97
acaccaucaaggacucggacgc

SEQ ID NO: 1157045 - RNA, 21 nt, Mycobacterium bovis subsp bovis AF2122/97
acaccaugaucaggccccaca

SEQ ID NO: 1157046 - RNA, 17 nt, Mycobacterium bovis subsp bovis AF2122/97
acaccaguaaugcccau

SEQ ID NO: 1157047 - RNA, 16 nt, Mycobacterium bovis subsp bovis AF2122/97
acaccaguagcaccag

SEQ ID NO: 1157048 - RNA, 14 nt, Mycobacterium bovis subsp bovis AF2122/97
acaccagcgcgccg

SEQ ID NO: 1157049 - RNA, 16 nt, Mycobacterium bovis subsp bovis AF2122/97
acaccagcccggcggc

SEQ ID NO: 1157050 - RNA, 19 nt, Mycobacterium bovis subsp bovis AF2122/97
acaccagcgaggccagcgg

SEQ ID NO: 1157051 - RNA, 12 nt, Mycobacterium bovis subsp bovis AF2122/97
acaccagcgcag

SEQ ID NO: 1157052 - RNA, 13 nt, Mycobacterium bovis subsp bovis AF2122/97
acaccagcgcagc

SEQ ID NO: 1157053 - RNA, 13 nt, Mycobacterium bovis subsp bovis AF2122/97
acaccggccgcga

SEQ ID NO: 1157054 - RNA, 12 nt, Mycobacterium bovis subsp bovis AF2122/97
acaccggcugac

SEQ ID NO: 1157055 - RNA, 17 nt, Mycobacterium bovis subsp bovis AF2122/97
acaccggcugaccgacc

SEQ ID NO: 1157056 - RNA, 20 nt, Mycobacterium bovis subsp bovis AF2122/97
acaccggccaccagcccgau

SEQ ID NO: 1157057 - RNA, 17 nt, Mycobacterium bovis subsp bovis AF2122/97
acaccggccagcggccc

SEQ ID NO: 1157058 - RNA, 14 nt, Mycobacterium bovis subsp bovis AF2122/97
acaccggccaggcc

SEQ ID NO: 1157059 - RNA, 21 nt, Mycobacterium bovis subsp bovis AF2122/97
acaccggccaggccggcggcg

SEQ ID NO: 1157060 - RNA, 16 nt, Mycobacterium bovis subsp bovis AF2122/97
acaccgcggccgaggg

SEQ ID NO: 1157061 - RNA, 21 nt, Mycobacterium bovis subsp bovis AF2122/97
acaccggcaagccacgccggu

SEQ ID NO: 1157062 - RNA, 21 nt, Mycobacterium bovis subsp bovis AF2122/97
acaccgcgaacuugcugacga

SEQ ID NO: 1157063 - RNA, 20 nt, Mycobacterium bovis subsp bovis AF2122/97
acaccgccgccaagcucggc

SEQ ID NO: 1157064 - RNA, 24 nt, Mycobacterium bovis subsp bovis AF2122/97
acaccgcgaucaccaccggaucgc

SEQ ID NO: 1157065 - RNA, 14 nt, Mycobacterium bovis subsp bovis AF2122/97
acaccgcgaucacc

SEQ ID NO: 1157066 - RNA, 11 nt, Mycobacterium bovis subsp bovis AF2122/97
acaccgcggca

SEQ ID NO: 1157067 - RNA, 14 nt, Mycobacterium bovis subsp bovis AF2122/97
acaccgcgcccgcc

SEQ ID NO: 1157068 - RNA, 17 nt, Mycobacterium bovis subsp bovis AF2122/97
acaccgcgcccgccgau

SEQ ID NO: 1157069 - RNA, 15 nt, Mycobacterium bovis subsp bovis AF2122/97
acaccgccagcggca

SEQ ID NO: 1157070 - RNA, 15 nt, Mycobacterium bovis subsp bovis AF2122/97
acaccgccagcauga

SEQ ID NO: 1157071 - RNA, 13 nt, Mycobacterium bovis subsp bovis AF2122/97
acaccgacacgcc

SEQ ID NO: 1157072 - RNA, 16 nt, Mycobacterium bovis subsp bovis AF2122/97
acaccgacgcggucgg

SEQ ID NO: 1157073 - RNA, 23 nt, Mycobacterium bovis subsp bovis AF2122/97
acaccgacgcggucggcggccgc

SEQ ID NO: 1157074 - RNA, 14 nt, Mycobacterium bovis subsp bovis AF2122/97
acaccgagccacga

SEQ ID NO: 1157075 - RNA, 14 nt, Mycobacterium bovis subsp bovis AF2122/97
acaccgcagcgggc

SEQ ID NO: 1157076 - RNA, 20 nt, Mycobacterium bovis subsp bovis AF2122/97
acacccugggugccggcagc

SEQ ID NO: 1157077 - RNA, 23 nt, Mycobacterium bovis subsp bovis AF2122/97
acacccugggugccggcagcggc

SEQ ID NO: 1157078 - RNA, 19 nt, Mycobacterium bovis subsp bovis AF2122/97
acaccgaggcgaccggacc

SEQ ID NO: 1157079 - RNA, 17 nt, Mycobacterium bovis subsp bovis AF2122/97
acaccgaggucgccaac

SEQ ID NO: 1157080 - RNA, 13 nt, Mycobacterium bovis subsp bovis AF2122/97
acacccgccaggc

SEQ ID NO: 1157081 - RNA, 18 nt, Mycobacterium bovis subsp bovis AF2122/97
acacccgagcaacggcgg

SEQ ID NO: 1157082 - RNA, 13 nt, Mycobacterium bovis subsp bovis AF2122/97
acacccgcccggg

SEQ ID NO: 1157083 - RNA, 16 nt, Mycobacterium bovis subsp bovis AF2122/97
acacccgggccaucgc

SEQ ID NO: 1157084 - RNA, 19 nt, Mycobacterium bovis subsp bovis AF2122/97
acacccuccacagcggcca

SEQ ID NO: 1157085 - RNA, 20 nt, Mycobacterium bovis subsp bovis AF2122/97
acacccgucaugcccaccgc

SEQ ID NO: 1157086 - RNA, 19 nt, Mycobacterium bovis subsp bovis AF2122/97
acacggcgacauacccgau

SEQ ID NO: 1157087 - RNA, 15 nt, Mycobacterium bovis subsp bovis AF2122/97
acacggucgucgcga

SEQ ID NO: 1157088 - RNA, 14 nt, Mycobacterium bovis subsp bovis AF2122/97
acacgccgaugccg

SEQ ID NO: 1157089 - RNA, 21 nt, Mycobacterium bovis subsp bovis AF2122/97
acacgccgaggucuccggugc

SEQ ID NO: 1157090 - RNA, 12 nt, Mycobacterium bovis subsp bovis AF2122/97
acacgcgguccc

SEQ ID NO: 1157091 - RNA, 20 nt, Mycobacterium bovis subsp bovis AF2122/97
acacgcggucccacucgucg

SEQ ID NO: 1157092 - RNA, 13 nt, Mycobacterium bovis subsp bovis AF2122/97
acacgccagccgg

SEQ ID NO: 1157093 - RNA, 15 nt, Mycobacterium bovis subsp bovis AF2122/97
acacgcccucgacgc

SEQ ID NO: 1157094 - RNA, 20 nt, Mycobacterium bovis subsp bovis AF2122/97
acacgcccucgacgccgcgc

SEQ ID NO: 1157095 - RNA, 21 nt, Mycobacterium bovis subsp bovis AF2122/97
acacgcccucgacgccgcgca

SEQ ID NO: 1157096 - RNA, 18 nt, Mycobacterium bovis subsp bovis AF2122/97
acaccguggaucggcagc

SEQ ID NO: 1157097 - RNA, 18 nt, Mycobacterium bovis subsp bovis AF2122/97
acaccgugaccagccggu

SEQ ID NO: 1157098 - RNA, 16 nt, Mycobacterium bovis subsp bovis AF2122/97
acaccgucaugccguu

SEQ ID NO: 1157099 - RNA, 19 nt, Mycobacterium bovis subsp bovis AF2122/97
acaccgugaccgccgcgcc

SEQ ID NO: 1157100 - RNA, 13 nt, Mycobacterium bovis subsp bovis AF2122/97
acaccgugucgcc

SEQ ID NO: 1157101 - RNA, 15 nt, Mycobacterium bovis subsp bovis AF2122/97
acaccgugucgccgg

SEQ ID NO: 1157102 - RNA, 14 nt, Mycobacterium bovis subsp bovis AF2122/97
acaccguguugcug

SEQ ID NO: 1157103 - RNA, 17 nt, Mycobacterium bovis subsp bovis AF2122/97
acaccuaugggaccggc

SEQ ID NO: 1157104 - RNA, 16 nt, Mycobacterium bovis subsp bovis AF2122/97
acaccucaaacgccug

SEQ ID NO: 1157105 - RNA, 17 nt, Mycobacterium bovis subsp bovis AF2122/97
acaccucgagcgcggcg

SEQ ID NO: 1157106 - RNA, 17 nt, Mycobacterium bovis subsp bovis AF2122/97
acaccucauacgccaau

SEQ ID NO: 1157107 - RNA, 18 nt, Mycobacterium bovis subsp bovis AF2122/97
acaccguccgucggcgcu

SEQ ID NO: 1157108 - RNA, 14 nt, Mycobacterium bovis subsp bovis AF2122/97
acaccgucggcagc

SEQ ID NO: 1157109 - RNA, 16 nt, Mycobacterium bovis subsp bovis AF2122/97
acaccgucggcagcag

SEQ ID NO: 1157110 - RNA, 19 nt, Mycobacterium bovis subsp bovis AF2122/97
acaccgucggcagcagcgg

SEQ ID NO: 1157111 - RNA, 16 nt, Mycobacterium bovis subsp bovis AF2122/97
acaccgguggcuucaa

SEQ ID NO: 1157112 - RNA, 18 nt, Mycobacterium bovis subsp bovis AF2122/97
acaccgguggacccggcg

SEQ ID NO: 1157113 - RNA, 23 nt, Mycobacterium bovis subsp bovis AF2122/97
acaccgucaccgagcccgaucgc

SEQ ID NO: 1157114 - RNA, 13 nt, Mycobacterium bovis subsp bovis AF2122/97
acaccgucacgcc

SEQ ID NO: 1157115 - RNA, 22 nt, Mycobacterium bovis subsp bovis AF2122/97
acaccggggacgucgacuucgc

SEQ ID NO: 1157116 - RNA, 17 nt, Mycobacterium bovis subsp bovis AF2122/97
acaccggggacgucgac

SEQ ID NO: 1157117 - RNA, 22 nt, Mycobacterium bovis subsp bovis AF2122/97
acaccgguaacgccaacaccgg

SEQ ID NO: 1157118 - RNA, 21 nt, Mycobacterium bovis subsp bovis AF2122/97
acaccuuggccgccggccgcg

SEQ ID NO: 1157119 - RNA, 14 nt, Mycobacterium bovis subsp bovis AF2122/97
acaccuugggcagc

SEQ ID NO: 1157120 - RNA, 17 nt, Mycobacterium bovis subsp bovis AF2122/97
acaccuuguggacccgc

SEQ ID NO: 1157121 - RNA, 18 nt, Mycobacterium bovis subsp bovis AF2122/97
acaccuuguggacccgcc

SEQ ID NO: 1157122 - RNA, 13 nt, Mycobacterium bovis subsp bovis AF2122/97
acaccucgggguu

SEQ ID NO: 1157123 - RNA, 13 nt, Mycobacterium bovis subsp bovis AF2122/97
acaccuccucgag

SEQ ID NO: 1157124 - RNA, 19 nt, Mycobacterium bovis subsp bovis AF2122/97
acaccugcgcggcgugcgc

SEQ ID NO: 1157125 - RNA, 22 nt, Mycobacterium bovis subsp bovis AF2122/97
acacgaagucgaacggcuuggc

SEQ ID NO: 1157126 - RNA, 14 nt, Mycobacterium bovis subsp bovis AF2122/97
acacgaauccggcc

SEQ ID NO: 1157127 - RNA, 18 nt, Mycobacterium bovis subsp bovis AF2122/97
acacgacugucccgcgca

SEQ ID NO: 1157128 - RNA, 19 nt, Mycobacterium bovis subsp bovis AF2122/97
acacgacugucccgcgcaa

SEQ ID NO: 1157129 - RNA, 16 nt, Mycobacterium bovis subsp bovis AF2122/97
acaaagccgucgacgc

SEQ ID NO: 1157130 - RNA, 19 nt, Mycobacterium bovis subsp bovis AF2122/97
acaaaucggcgguggcggu

SEQ ID NO: 1157131 - RNA, 23 nt, Mycobacterium bovis subsp bovis AF2122/97
aauuucgacacgaaggucgcggu

SEQ ID NO: 1157132 - RNA, 22 nt, Mycobacterium bovis subsp bovis AF2122/97
acaaccgguccugggauccggc

SEQ ID NO: 1157133 - RNA, 15 nt, Mycobacterium bovis subsp bovis AF2122/97
acaacccggccgggc

SEQ ID NO: 1157134 - RNA, 12 nt, Mycobacterium bovis subsp bovis AF2122/97
acaacaucgccg

SEQ ID NO: 1157135 - RNA, 23 nt, Mycobacterium bovis subsp bovis AF2122/97
acaacacagaacucaccgacgga

SEQ ID NO: 1157136 - RNA, 22 nt, Mycobacterium bovis subsp bovis AF2122/97
acaacaccacggugccgacgau

SEQ ID NO: 1157137 - RNA, 15 nt, Mycobacterium bovis subsp bovis AF2122/97
acaacacgccgucga

SEQ ID NO: 1157138 - RNA, 15 nt, Mycobacterium bovis subsp bovis AF2122/97
acaacagccgcucgc

SEQ ID NO: 1157139 - RNA, 12 nt, Mycobacterium bovis subsp bovis AF2122/97
acaacagcuugg

SEQ ID NO: 1157140 - RNA, 17 nt, Mycobacterium bovis subsp bovis AF2122/97
acaacgcgcaaccagcc

SEQ ID NO: 1157141 - RNA, 16 nt, Mycobacterium bovis subsp bovis AF2122/97
acaacgcgacgccgcu

SEQ ID NO: 1157142 - RNA, 13 nt, Mycobacterium bovis subsp bovis AF2122/97
acaacgccgcgac

SEQ ID NO: 1157143 - RNA, 22 nt, Mycobacterium bovis subsp bovis AF2122/97
acaacgccauacacaacgccau

SEQ ID NO: 1157144 - RNA, 20 nt, Mycobacterium bovis subsp bovis AF2122/97
acaacgcaauauccuccagc

SEQ ID NO: 1157145 - RNA, 17 nt, Mycobacterium bovis subsp bovis AF2122/97
acaacgacacgccgcau

SEQ ID NO: 1157146 - RNA, 20 nt, Mycobacterium bovis subsp bovis AF2122/97
acaacggccacaugccacag

SEQ ID NO: 1157147 - RNA, 21 nt, Mycobacterium bovis subsp bovis AF2122/97
acaacgcugggcggcuaccca

SEQ ID NO: 1157148 - RNA, 16 nt, Mycobacterium bovis subsp bovis AF2122/97
acaacgggauccgcgc

SEQ ID NO: 1157149 - RNA, 19 nt, Mycobacterium bovis subsp bovis AF2122/97
acaacgggauccgcgcgcu

SEQ ID NO: 1157150 - RNA, 23 nt, Mycobacterium bovis subsp bovis AF2122/97
acaacuaucgucgugucgccgcc

SEQ ID NO: 1157151 - RNA, 22 nt, Mycobacterium bovis subsp bovis AF2122/97
acaacucgcgaagcaucgcguu

SEQ ID NO: 1157152 - RNA, 19 nt, Mycobacterium bovis subsp bovis AF2122/97
acaacucgcguggcaccga

SEQ ID NO: 1157153 - RNA, 15 nt, Mycobacterium bovis subsp bovis AF2122/97
acaacugccgagcag

SEQ ID NO: 1157154 - RNA, 20 nt, Mycobacterium bovis subsp bovis AF2122/97
acaacugcgccggugccggc

SEQ ID NO: 1157155 - RNA, 22 nt, Mycobacterium bovis subsp bovis AF2122/97
acaagauucgcucaccaccgac

SEQ ID NO: 1157156 - RNA, 12 nt, Mycobacterium bovis subsp bovis AF2122/97
acaagcacagcg

SEQ ID NO: 1157157 - RNA, 21 nt, Mycobacterium bovis subsp bovis AF2122/97
acaagcacauuauucuucgcg

SEQ ID NO: 1157158 - RNA, 23 nt, Mycobacterium bovis subsp bovis AF2122/97
acaagccgugcagcucggucagc

SEQ ID NO: 1157159 - RNA, 15 nt, Mycobacterium bovis subsp bovis AF2122/97
acaagccugccggcu

SEQ ID NO: 1157160 - RNA, 23 nt, Mycobacterium bovis subsp bovis AF2122/97
acaagcuccucgcgagucggcgg

SEQ ID NO: 1157161 - RNA, 14 nt, Mycobacterium bovis subsp bovis AF2122/97
acaagcugacacga

SEQ ID NO: 1157162 - RNA, 15 nt, Mycobacterium bovis subsp bovis AF2122/97
acaaggccaagcgcc

SEQ ID NO: 1157163 - RNA, 12 nt, Mycobacterium bovis subsp bovis AF2122/97
acaagguguggu

SEQ ID NO: 1157164 - RNA, 14 nt, Mycobacterium bovis subsp bovis AF2122/97
acaagugccggcgc

SEQ ID NO: 1157165 - RNA, 16 nt, Mycobacterium bovis subsp bovis AF2122/97
acaaguaccgcaucga

SEQ ID NO: 1157166 - RNA, 18 nt, Mycobacterium bovis subsp bovis AF2122/97
acaagucgacacgccgaa

SEQ ID NO: 1157167 - RNA, 16 nt, Mycobacterium bovis subsp bovis AF2122/97
acaaucaccgccgcga

SEQ ID NO: 1157168 - RNA, 18 nt, Mycobacterium bovis subsp bovis AF2122/97
acaaucaccgccgcgacc

SEQ ID NO: 1157169 - RNA, 23 nt, Mycobacterium bovis subsp bovis AF2122/97
acacagcguccgucgucggcguc

SEQ ID NO: 1157170 - RNA, 14 nt, Mycobacterium bovis subsp bovis AF2122/97
acacagccgguggc

SEQ ID NO: 1157171 - RNA, 12 nt, Mycobacterium bovis subsp bovis AF2122/97
acacagccgcgc

SEQ ID NO: 1157172 - RNA, 17 nt, Mycobacterium bovis subsp bovis AF2122/97
acacaccguaccgacga

SEQ ID NO: 1157173 - RNA, 12 nt, Mycobacterium bovis subsp bovis AF2122/97
acacaaccgacg

SEQ ID NO: 1157174 - RNA, 20 nt, Mycobacterium bovis subsp bovis AF2122/97
acaauccgguguugagaucg

SEQ ID NO: 1157175 - RNA, 13 nt, Mycobacterium bovis subsp bovis AF2122/97
acaaugucggcga

SEQ ID NO: 1157176 - RNA, 22 nt, Mycobacterium bovis subsp bovis AF2122/97
aaugcgggucugcggucaucgc

SEQ ID NO: 1157177 - RNA, 13 nt, Mycobacterium bovis subsp bovis AF2122/97
aaugcuggcggcg

SEQ ID NO: 1157178 - RNA, 14 nt, Mycobacterium bovis subsp bovis AF2122/97
aaugcuggcggcgc

SEQ ID NO: 1157179 - RNA, 13 nt, Mycobacterium bovis subsp bovis AF2122/97
aaugcuucgaccg

SEQ ID NO: 1157180 - RNA, 13 nt, Mycobacterium bovis subsp bovis AF2122/97
aauggcgccggcc

SEQ ID NO: 1157181 - RNA, 17 nt, Mycobacterium bovis subsp bovis AF2122/97
aauggcgccggccggcg

SEQ ID NO: 1157182 - RNA, 16 nt, Mycobacterium bovis subsp bovis AF2122/97
aaugacucggccgcac

SEQ ID NO: 1157183 - RNA, 18 nt, Mycobacterium bovis subsp bovis AF2122/97
aaugcaacuccucgaccg

SEQ ID NO: 1157184 - RNA, 18 nt, Mycobacterium bovis subsp bovis AF2122/97
aaugccaccgcggccgcg

SEQ ID NO: 1157185 - RNA, 20 nt, Mycobacterium bovis subsp bovis AF2122/97
aaugccaccucgacgcaccu

SEQ ID NO: 1157186 - RNA, 15 nt, Mycobacterium bovis subsp bovis AF2122/97
aaugccgacgccaac

SEQ ID NO: 1157187 - RNA, 23 nt, Mycobacterium bovis subsp bovis AF2122/97
aaugccgacucaggucggugcgg

SEQ ID NO: 1157188 - RNA, 22 nt, Mycobacterium bovis subsp bovis AF2122/97
aaucaccgaauaccgccgcgca

SEQ ID NO: 1157189 - RNA, 16 nt, Mycobacterium bovis subsp bovis AF2122/97
aaucaccggagcgccg

SEQ ID NO: 1157190 - RNA, 22 nt, Mycobacterium bovis subsp bovis AF2122/97
aauugaguagaucccaccaccg

SEQ ID NO: 1157191 - RNA, 22 nt, Mycobacterium bovis subsp bovis AF2122/97
aauucgacuucggggucaccgg

SEQ ID NO: 1157192 - RNA, 16 nt, Mycobacterium bovis subsp bovis AF2122/97
aauugcccugacgauc

SEQ ID NO: 1157193 - RNA, 21 nt, Mycobacterium bovis subsp bovis AF2122/97
aauuggcgucgucggcggcga

SEQ ID NO: 1157194 - RNA, 21 nt, Mycobacterium bovis subsp bovis AF2122/97
aauugggcgaugcggcgucga

SEQ ID NO: 1157195 - RNA, 20 nt, Mycobacterium bovis subsp bovis AF2122/97
aauggcggacagggcggcaa

SEQ ID NO: 1157196 - RNA, 15 nt, Mycobacterium bovis subsp bovis AF2122/97
aauggcgccaccggc

SEQ ID NO: 1157197 - RNA, 17 nt, Mycobacterium bovis subsp bovis AF2122/97
aauggcgucgccggcac

SEQ ID NO: 1157198 - RNA, 20 nt, Mycobacterium bovis subsp bovis AF2122/97
aauggcucugaggucaccgg

SEQ ID NO: 1157199 - RNA, 18 nt, Mycobacterium bovis subsp bovis AF2122/97
aauguugccgccgcggcg

SEQ ID NO: 1157200 - RNA, 20 nt, Mycobacterium bovis subsp bovis AF2122/97
aauggucguucccgccggca

SEQ ID NO: 1157201 - RNA, 21 nt, Mycobacterium bovis subsp bovis AF2122/97
aauggucguucccgccggcac

SEQ ID NO: 1157202 - RNA, 13 nt, Mycobacterium bovis subsp bovis AF2122/97
aaugggggcuggu

SEQ ID NO: 1157203 - RNA, 21 nt, Mycobacterium bovis subsp bovis AF2122/97
aaugggggcuggucgccguac

SEQ ID NO: 1157204 - RNA, 20 nt, Mycobacterium bovis subsp bovis AF2122/97
aaugggguguuugucgcggu

SEQ ID NO: 1157205 - RNA, 19 nt, Mycobacterium bovis subsp bovis AF2122/97
aauguugcgaucugcggcg

SEQ ID NO: 1157206 - RNA, 19 nt, Mycobacterium bovis subsp bovis AF2122/97
aauuccagccagccgcccu

SEQ ID NO: 1157207 - RNA, 22 nt, Mycobacterium bovis subsp bovis AF2122/97
aauuccggugaucgcgguggcg

SEQ ID NO: 1157208 - RNA, 11 nt, Mycobacterium bovis subsp bovis AF2122/97
aauuccgcgag

SEQ ID NO: 1157209 - RNA, 21 nt, Mycobacterium bovis subsp bovis AF2122/97
aaaacccggaaucgucgcggc

SEQ ID NO: 1157210 - RNA, 14 nt, Mycobacterium bovis subsp bovis AF2122/97
aaaacgcccggcac

SEQ ID NO: 1157211 - RNA, 19 nt, Mycobacterium bovis subsp bovis AF2122/97
aaaaucggcaagacgcggu

SEQ ID NO: 1157212 - RNA, 20 nt, Mycobacterium bovis subsp bovis AF2122/97
aaaaggcgacucggugcggu

SEQ ID NO: 1157213 - RNA, 16 nt, Mycobacterium bovis subsp bovis AF2122/97
aaaagguaccgcgugc

SEQ ID NO: 1157214 - RNA, 23 nt, Mycobacterium bovis subsp bovis AF2122/97
aaaagcccccgcacgcucggcgu

SEQ ID NO: 1157215 - RNA, 21 nt, Mycobacterium bovis subsp bovis AF2122/97
aaacgggcucuucgcagcggu

SEQ ID NO: 1157216 - RNA, 14 nt, Mycobacterium bovis subsp bovis AF2122/97
aaacgggccggugc

SEQ ID NO: 1157217 - RNA, 23 nt, Mycobacterium bovis subsp bovis AF2122/97
aaacgccggauuauucgcgguag

SEQ ID NO: 1157218 - RNA, 16 nt, Mycobacterium bovis subsp bovis AF2122/97
aaacgccccggcgcgg

SEQ ID NO: 1157219 - RNA, 13 nt, Mycobacterium bovis subsp bovis AF2122/97
aaagcagcagcgg

SEQ ID NO: 1157220 - RNA, 16 nt, Mycobacterium bovis subsp bovis AF2122/97
aaagccucagccgcuc

SEQ ID NO: 1157221 - RNA, 14 nt, Mycobacterium bovis subsp bovis AF2122/97
aaagcccgacacga

SEQ ID NO: 1157222 - RNA, 14 nt, Mycobacterium bovis subsp bovis AF2122/97
aaagcccgacauga

SEQ ID NO: 1157223 - RNA, 24 nt, Mycobacterium bovis subsp bovis AF2122/97
aaagcgguuauguauccgcgccgc

SEQ ID NO: 1157224 - RNA, 21 nt, Mycobacterium bovis subsp bovis AF2122/97
aaaggucggggaacgcggcga

SEQ ID NO: 1157225 - RNA, 16 nt, Mycobacterium bovis subsp bovis AF2122/97
aaacagguaagcagcc

SEQ ID NO: 1157226 - RNA, 20 nt, Mycobacterium bovis subsp bovis AF2122/97
aaacagcuugcugcgcacca

SEQ ID NO: 1157227 - RNA, 13 nt, Mycobacterium bovis subsp bovis AF2122/97
aaaccgcugcgcg

SEQ ID NO: 1157228 - RNA, 19 nt, Mycobacterium bovis subsp bovis AF2122/97
aaaccagguggccaggccg

SEQ ID NO: 1157229 - RNA, 14 nt, Mycobacterium bovis subsp bovis AF2122/97
aaaccccggccacc

SEQ ID NO: 1157230 - RNA, 13 nt, Mycobacterium bovis subsp bovis AF2122/97
aaaccagccacca

SEQ ID NO: 1157231 - RNA, 22 nt, Mycobacterium bovis subsp bovis AF2122/97
aaaccggcggcgacggcggcac

SEQ ID NO: 1157232 - RNA, 21 nt, Mycobacterium bovis subsp bovis AF2122/97
aaaccggugguagcgacgaug

SEQ ID NO: 1157233 - RNA, 20 nt, Mycobacterium bovis subsp bovis AF2122/97
aaaccucgccccaccggccg

SEQ ID NO: 1157234 - RNA, 17 nt, Mycobacterium bovis subsp bovis AF2122/97
aaaccuucaacaacgau

SEQ ID NO: 1157235 - RNA, 22 nt, Mycobacterium bovis subsp bovis AF2122/97
aaaccuggcuaucgcagaacgg

SEQ ID NO: 1157236 - RNA, 15 nt, Mycobacterium bovis subsp bovis AF2122/97
aaaacauaucggugc

SEQ ID NO: 1157237 - RNA, 23 nt, Mycobacterium bovis subsp bovis AF2122/97
aaaucggccagcuucccgguagc

SEQ ID NO: 1157238 - RNA, 14 nt, Mycobacterium bovis subsp bovis AF2122/97
aaaucgcacagcgc

SEQ ID NO: 1157239 - RNA, 22 nt, Mycobacterium bovis subsp bovis AF2122/97
aaaucgucgauggucuccggac

SEQ ID NO: 1157240 - RNA, 11 nt, Mycobacterium bovis subsp bovis AF2122/97
aacaccgccag

SEQ ID NO: 1157241 - RNA, 13 nt, Mycobacterium bovis subsp bovis AF2122/97
aacaccgccagca

SEQ ID NO: 1157242 - RNA, 13 nt, Mycobacterium bovis subsp bovis AF2122/97
aacaccgcgccga

SEQ ID NO: 1157243 - RNA, 22 nt, Mycobacterium bovis subsp bovis AF2122/97
aacaccgcggugaguucgccgg

SEQ ID NO: 1157244 - RNA, 16 nt, Mycobacterium bovis subsp bovis AF2122/97
aacaccaucagcgaca

SEQ ID NO: 1157245 - RNA, 15 nt, Mycobacterium bovis subsp bovis AF2122/97
aacaccccccgucca

SEQ ID NO: 1157246 - RNA, 13 nt, Mycobacterium bovis subsp bovis AF2122/97
aacacccggccgc

SEQ ID NO: 1157247 - RNA, 13 nt, Mycobacterium bovis subsp bovis AF2122/97
aacaccagaugca

SEQ ID NO: 1157248 - RNA, 16 nt, Mycobacterium bovis subsp bovis AF2122/97
aacacagccgucgcac

SEQ ID NO: 1157249 - RNA, 16 nt, Mycobacterium bovis subsp bovis AF2122/97
aacaauucacgcacca

SEQ ID NO: 1157250 - RNA, 22 nt, Mycobacterium bovis subsp bovis AF2122/97
uuuucgagguacagcgggcacg

SEQ ID NO: 1157251 - RNA, 21 nt, Mycobacterium bovis subsp bovis AF2122/97
uuuuccgccuguacggcggcu

SEQ ID NO: 1157252 - RNA, 14 nt, Mycobacterium bovis subsp bovis AF2122/97
uuuugucaggauau

SEQ ID NO: 1157253 - RNA, 17 nt, Mycobacterium bovis subsp bovis AF2122/97
uucuccagauccacgcc

SEQ ID NO: 1157254 - RNA, 22 nt, Mycobacterium bovis subsp bovis AF2122/97
uucuaacggucagcuugucagc

SEQ ID NO: 1157255 - RNA, 17 nt, Mycobacterium bovis subsp bovis AF2122/97
uucgucguggagcucac

SEQ ID NO: 1157256 - RNA, 18 nt, Mycobacterium bovis subsp bovis AF2122/97
uucgucguaguccaggcc

SEQ ID NO: 1157257 - RNA, 12 nt, Mycobacterium bovis subsp bovis AF2122/97
uucguccccaga

SEQ ID NO: 1157258 - RNA, 22 nt, Mycobacterium bovis subsp bovis AF2122/97
uucggcccgaggugccggggcc

SEQ ID NO: 1157259 - RNA, 21 nt, Mycobacterium bovis subsp bovis AF2122/97
uucggccauguagccguugcc

SEQ ID NO: 1157260 - RNA, 14 nt, Mycobacterium bovis subsp bovis AF2122/97
uucggccagcgccc

SEQ ID NO: 1157261 - RNA, 13 nt, Mycobacterium bovis subsp bovis AF2122/97
uucggccaccaac

SEQ ID NO: 1157262 - RNA, 18 nt, Mycobacterium bovis subsp bovis AF2122/97
uucggcauaacccuggcc

SEQ ID NO: 1157263 - RNA, 12 nt, Mycobacterium bovis subsp bovis AF2122/97
uucucgcuguug

SEQ ID NO: 1157264 - RNA, 13 nt, Mycobacterium bovis subsp bovis AF2122/97
uucugaagcccga

SEQ ID NO: 1157265 - RNA, 13 nt, Mycobacterium bovis subsp bovis AF2122/97
uucuggcccgcag

SEQ ID NO: 1157266 - RNA, 13 nt, Mycobacterium bovis subsp bovis AF2122/97
uucuucagcagcg

SEQ ID NO: 1157267 - RNA, 12 nt, Mycobacterium bovis subsp bovis AF2122/97
uucuucaacucc

SEQ ID NO: 1157268 - RNA, 19 nt, Mycobacterium bovis subsp bovis AF2122/97
uugaacgcccgcuucagca

SEQ ID NO: 1157269 - RNA, 14 nt, Mycobacterium bovis subsp bovis AF2122/97
uugaacguucccuc

SEQ ID NO: 1157270 - RNA, 15 nt, Mycobacterium bovis subsp bovis AF2122/97
uugaacucuggugac

SEQ ID NO: 1157271 - RNA, 17 nt, Mycobacterium bovis subsp bovis AF2122/97
uugacaacccuguuguu

SEQ ID NO: 1157272 - RNA, 11 nt, Mycobacterium bovis subsp bovis AF2122/97
uugaccucuuc

SEQ ID NO: 1157273 - RNA, 21 nt, Mycobacterium bovis subsp bovis AF2122/97
uucuuggcaggugccuucuuc

SEQ ID NO: 1157274 - RNA, 22 nt, Mycobacterium bovis subsp bovis AF2122/97
uucuuggcaggugccuucuucg

SEQ ID NO: 1157275 - RNA, 20 nt, Mycobacterium bovis subsp bovis AF2122/97
uugaaccgguacaaccccca

SEQ ID NO: 1157276 - RNA, 14 nt, Mycobacterium bovis subsp bovis AF2122/97
uugauccuggcuca

SEQ ID NO: 1157277 - RNA, 21 nt, Mycobacterium bovis subsp bovis AF2122/97
uugaucgcccgguucagcgcu

SEQ ID NO: 1157278 - RNA, 16 nt, Mycobacterium bovis subsp bovis AF2122/97
uugagcucgcugauca

SEQ ID NO: 1157279 - RNA, 14 nt, Mycobacterium bovis subsp bovis AF2122/97
uugagcauaugacg

SEQ ID NO: 1157280 - RNA, 23 nt, Mycobacterium bovis subsp bovis AF2122/97
uugagcagcuugguggcguggcc

SEQ ID NO: 1157281 - RNA, 12 nt, Mycobacterium bovis subsp bovis AF2122/97
uugagccgccgc

SEQ ID NO: 1157282 - RNA, 9 nt, Mycobacterium bovis subsp bovis AF2122/97
uugagcccg

SEQ ID NO: 1157283 - RNA, 15 nt, Mycobacterium bovis subsp bovis AF2122/97
uugaucugcccuguu

SEQ ID NO: 1157284 - RNA, 16 nt, Mycobacterium bovis subsp bovis AF2122/97
uugaucuccaccuucu

SEQ ID NO: 1157285 - RNA, 22 nt, Mycobacterium bovis subsp bovis AF2122/97
uugaucuccaccuucuggucca

SEQ ID NO: 1157286 - RNA, 22 nt, Mycobacterium bovis subsp bovis AF2122/97
uugaugcauccagaaguaggcg

SEQ ID NO: 1157287 - RNA, 12 nt, Mycobacterium bovis subsp bovis AF2122/97
uugauugaccaa

SEQ ID NO: 1157288 - RNA, 21 nt, Mycobacterium bovis subsp bovis AF2122/97
uugcagcgggccacugagcca

SEQ ID NO: 1157289 - RNA, 23 nt, Mycobacterium bovis subsp bovis AF2122/97
uugcucggugaugcccagcgccg

SEQ ID NO: 1157290 - RNA, 13 nt, Mycobacterium bovis subsp bovis AF2122/97
uugcgcagcagcg

SEQ ID NO: 1157291 - RNA, 12 nt, Mycobacterium bovis subsp bovis AF2122/97
uugcgccagcgg

SEQ ID NO: 1157292 - RNA, 11 nt, Mycobacterium bovis subsp bovis AF2122/97
uugcggcccgg

SEQ ID NO: 1157293 - RNA, 17 nt, Mycobacterium bovis subsp bovis AF2122/97
uugccggcguugccgcc

SEQ ID NO: 1157294 - RNA, 16 nt, Mycobacterium bovis subsp bovis AF2122/97
uugccucccuuuucca

SEQ ID NO: 1157295 - RNA, 19 nt, Mycobacterium bovis subsp bovis AF2122/97
uugccaucaaggccaccuc

SEQ ID NO: 1157296 - RNA, 15 nt, Mycobacterium bovis subsp bovis AF2122/97
uugcccacaaagauc

SEQ ID NO: 1157297 - RNA, 17 nt, Mycobacterium bovis subsp bovis AF2122/97
uugcccacaaagauccg

SEQ ID NO: 1157298 - RNA, 14 nt, Mycobacterium bovis subsp bovis AF2122/97
uugccggcgccuug

SEQ ID NO: 1157299 - RNA, 15 nt, Mycobacterium bovis subsp bovis AF2122/97
uugccggcuuggccu

SEQ ID NO: 1157300 - RNA, 21 nt, Mycobacterium bovis subsp bovis AF2122/97
uugcccagcaugaagucccgg

SEQ ID NO: 1157301 - RNA, 15 nt, Mycobacterium bovis subsp bovis AF2122/97
uugccacgccgccgg

SEQ ID NO: 1157302 - RNA, 16 nt, Mycobacterium bovis subsp bovis AF2122/97
uugccaccguugccgc

SEQ ID NO: 1157303 - RNA, 19 nt, Mycobacterium bovis subsp bovis AF2122/97
uugcaguggcgacgagcaa

SEQ ID NO: 1157304 - RNA, 19 nt, Mycobacterium bovis subsp bovis AF2122/97
uugcaggcccgaguuguug

SEQ ID NO: 1157305 - RNA, 12 nt, Mycobacterium bovis subsp bovis AF2122/97
uuggcaccagcc

SEQ ID NO: 1157306 - RNA, 16 nt, Mycobacterium bovis subsp bovis AF2122/97
uuggcaacacagcuga

SEQ ID NO: 1157307 - RNA, 14 nt, Mycobacterium bovis subsp bovis AF2122/97
uugcuugcagggcc

SEQ ID NO: 1157308 - RNA, 15 nt, Mycobacterium bovis subsp bovis AF2122/97
uugcuugcagggcca

SEQ ID NO: 1157309 - RNA, 15 nt, Mycobacterium bovis subsp bovis AF2122/97
uuggggcugugcagg

SEQ ID NO: 1157310 - RNA, 14 nt, Mycobacterium bovis subsp bovis AF2122/97
uugggagccaccgg

SEQ ID NO: 1157311 - RNA, 14 nt, Mycobacterium bovis subsp bovis AF2122/97
uugggaaaagcccg

SEQ ID NO: 1157312 - RNA, 10 nt, Mycobacterium bovis subsp bovis AF2122/97
uuggcugccg

SEQ ID NO: 1157313 - RNA, 19 nt, Mycobacterium bovis subsp bovis AF2122/97
uuggccgcgcaggcuucca

SEQ ID NO: 1157314 - RNA, 11 nt, Mycobacterium bovis subsp bovis AF2122/97
uuggccgccac

SEQ ID NO: 1157315 - RNA, 18 nt, Mycobacterium bovis subsp bovis AF2122/97
uuggccccgcggagcgca

SEQ ID NO: 1157316 - RNA, 14 nt, Mycobacterium bovis subsp bovis AF2122/97
uuggcccaccgccg

SEQ ID NO: 1157317 - RNA, 15 nt, Mycobacterium bovis subsp bovis AF2122/97
uuggccgggcacgcg

SEQ ID NO: 1157318 - RNA, 15 nt, Mycobacterium bovis subsp bovis AF2122/97
uuggccggcuugucg

SEQ ID NO: 1157319 - RNA, 19 nt, Mycobacterium bovis subsp bovis AF2122/97
uuggccggguuggccggcg

SEQ ID NO: 1157320 - RNA, 15 nt, Mycobacterium bovis subsp bovis AF2122/97
uuggcucggcgcagc

SEQ ID NO: 1157321 - RNA, 14 nt, Mycobacterium bovis subsp bovis AF2122/97
uuggucuugaaccc

SEQ ID NO: 1157322 - RNA, 18 nt, Mycobacterium bovis subsp bovis AF2122/97
uuggugaguagauugcug

SEQ ID NO: 1157323 - RNA, 18 nt, Mycobacterium bovis subsp bovis AF2122/97
uuggugcagaccaccgcc

SEQ ID NO: 1157324 - RNA, 18 nt, Mycobacterium bovis subsp bovis AF2122/97
uugguugcgccaggaacc

SEQ ID NO: 1157325 - RNA, 21 nt, Mycobacterium bovis subsp bovis AF2122/97
uugggugcgccgucagcccag

SEQ ID NO: 1157326 - RNA, 13 nt, Mycobacterium bovis subsp bovis AF2122/97
uuggucgccggcg

SEQ ID NO: 1157327 - RNA, 17 nt, Mycobacterium bovis subsp bovis AF2122/97
uuggucagugugaacug

SEQ ID NO: 1157328 - RNA, 17 nt, Mycobacterium bovis subsp bovis AF2122/97
uugucgccggaguucug

SEQ ID NO: 1157329 - RNA, 13 nt, Mycobacterium bovis subsp bovis AF2122/97
uugucgcagcgca

SEQ ID NO: 1157330 - RNA, 17 nt, Mycobacterium bovis subsp bovis AF2122/97
uuguccuucagccaguc

SEQ ID NO: 1157331 - RNA, 12 nt, Mycobacterium bovis subsp bovis AF2122/97
uuguccggugag

SEQ ID NO: 1157332 - RNA, 17 nt, Mycobacterium bovis subsp bovis AF2122/97
uuguccggugguggcga

SEQ ID NO: 1157333 - RNA, 22 nt, Mycobacterium bovis subsp bovis AF2122/97
uuguccgguuacuuuucgagug

SEQ ID NO: 1157334 - RNA, 17 nt, Mycobacterium bovis subsp bovis AF2122/97
uuguagcgggcaagaug

SEQ ID NO: 1157335 - RNA, 16 nt, Mycobacterium bovis subsp bovis AF2122/97
uuguuaucgaagcccg

SEQ ID NO: 1157336 - RNA, 13 nt, Mycobacterium bovis subsp bovis AF2122/97
uuguuggagaugu

SEQ ID NO: 1157337 - RNA, 18 nt, Mycobacterium bovis subsp bovis AF2122/97
uuguuggauccggccacc

SEQ ID NO: 1157338 - RNA, 17 nt, Mycobacterium bovis subsp bovis AF2122/97
uuguugcgcgacgccgc

SEQ ID NO: 1157339 - RNA, 14 nt, Mycobacterium bovis subsp bovis AF2122/97
uuguugcaggagcc

SEQ ID NO: 1157340 - RNA, 12 nt, Mycobacterium bovis subsp bovis AF2122/97
uuguucaacucg

SEQ ID NO: 1157341 - RNA, 13 nt, Mycobacterium bovis subsp bovis AF2122/97
uuguugaagcccg

SEQ ID NO: 1157342 - RNA, 13 nt, Mycobacterium bovis subsp bovis AF2122/97
uuccggcgcggcc

SEQ ID NO: 1157343 - RNA, 16 nt, Mycobacterium bovis subsp bovis AF2122/97
uuccggcggccacgcc

SEQ ID NO: 1157344 - RNA, 19 nt, Mycobacterium bovis subsp bovis AF2122/97
uuccgggacuaccacccgc

SEQ ID NO: 1157345 - RNA, 22 nt, Mycobacterium bovis subsp bovis AF2122/97
uuccggucgacuccagcaccag

SEQ ID NO: 1157346 - RNA, 15 nt, Mycobacterium bovis subsp bovis AF2122/97
uuccguuaggcucca

SEQ ID NO: 1157347 - RNA, 14 nt, Mycobacterium bovis subsp bovis AF2122/97
uuccuccggcagca

SEQ ID NO: 1157348 - RNA, 15 nt, Mycobacterium bovis subsp bovis AF2122/97
uuccucuucaggccc

SEQ ID NO: 1157349 - RNA, 22 nt, Mycobacterium bovis subsp bovis AF2122/97
uuccucaaggucggccaggcug

SEQ ID NO: 1157350 - RNA, 18 nt, Mycobacterium bovis subsp bovis AF2122/97
uuccugcgccgguaacug

SEQ ID NO: 1157351 - RNA, 16 nt, Mycobacterium bovis subsp bovis AF2122/97
uuccugaggguuucca

SEQ ID NO: 1157352 - RNA, 21 nt, Mycobacterium bovis subsp bovis AF2122/97
uucgccgcgaaugucgccgcc

SEQ ID NO: 1157353 - RNA, 16 nt, Mycobacterium bovis subsp bovis AF2122/97
uucgccggaauacacc

SEQ ID NO: 1157354 - RNA, 20 nt, Mycobacterium bovis subsp bovis AF2122/97
uucgccgacuagcugggguc

SEQ ID NO: 1157355 - RNA, 22 nt, Mycobacterium bovis subsp bovis AF2122/97
uucgcccgcccgucuuccagcc

SEQ ID NO: 1157356 - RNA, 18 nt, Mycobacterium bovis subsp bovis AF2122/97
uucgccccugcacagcag

SEQ ID NO: 1157357 - RNA, 14 nt, Mycobacterium bovis subsp bovis AF2122/97
uucgccaacuucaa

SEQ ID NO: 1157358 - RNA, 21 nt, Mycobacterium bovis subsp bovis AF2122/97
uucgccaccgcaagaaucagc

SEQ ID NO: 1157359 - RNA, 11 nt, Mycobacterium bovis subsp bovis AF2122/97
uucgccagcgc

SEQ ID NO: 1157360 - RNA, 20 nt, Mycobacterium bovis subsp bovis AF2122/97
uucggaaaaccgcaccgucc

SEQ ID NO: 1157361 - RNA, 13 nt, Mycobacterium bovis subsp bovis AF2122/97
uucgcucaucugu

SEQ ID NO: 1157362 - RNA, 15 nt, Mycobacterium bovis subsp bovis AF2122/97
uucgcgaagcugugc

SEQ ID NO: 1157363 - RNA, 20 nt, Mycobacterium bovis subsp bovis AF2122/97
uucgcgggauccaggcccag

SEQ ID NO: 1157364 - RNA, 16 nt, Mycobacterium bovis subsp bovis AF2122/97
uucgcgggccgaggcc

SEQ ID NO: 1157365 - RNA, 13 nt, Mycobacterium bovis subsp bovis AF2122/97
uucgaugggugca

SEQ ID NO: 1157366 - RNA, 21 nt, Mycobacterium bovis subsp bovis AF2122/97
uucgaucaacugcagauagga

SEQ ID NO: 1157367 - RNA, 18 nt, Mycobacterium bovis subsp bovis AF2122/97
uucgcacccguucgugag

SEQ ID NO: 1157368 - RNA, 14 nt, Mycobacterium bovis subsp bovis AF2122/97
uucgaccuugcacc

SEQ ID NO: 1157369 - RNA, 23 nt, Mycobacterium bovis subsp bovis AF2122/97
uucgacucggccucuagcuugac

SEQ ID NO: 1157370 - RNA, 20 nt, Mycobacterium bovis subsp bovis AF2122/97
uucgagcaccgacaccggcc

SEQ ID NO: 1157371 - RNA, 17 nt, Mycobacterium bovis subsp bovis AF2122/97
uucccccggcaccgccg

SEQ ID NO: 1157372 - RNA, 18 nt, Mycobacterium bovis subsp bovis AF2122/97
uuccccgcccuugccgcc

SEQ ID NO: 1157373 - RNA, 14 nt, Mycobacterium bovis subsp bovis AF2122/97
uucccgaaacccga

SEQ ID NO: 1157374 - RNA, 17 nt, Mycobacterium bovis subsp bovis AF2122/97
uucccaccaccaccgcc

SEQ ID NO: 1157375 - RNA, 14 nt, Mycobacterium bovis subsp bovis AF2122/97
uucccaacacagcc

SEQ ID NO: 1157376 - RNA, 19 nt, Mycobacterium bovis subsp bovis AF2122/97
uuccauucgcgguccauca

SEQ ID NO: 1157377 - RNA, 20 nt, Mycobacterium bovis subsp bovis AF2122/97
uuccgcgaaucaacaggacc

SEQ ID NO: 1157378 - RNA, 22 nt, Mycobacterium bovis subsp bovis AF2122/97
uuccgcagucccgaacaauuca

SEQ ID NO: 1157379 - RNA, 14 nt, Mycobacterium bovis subsp bovis AF2122/97
uuccgcagcgccac

SEQ ID NO: 1157380 - RNA, 16 nt, Mycobacterium bovis subsp bovis AF2122/97
uuccgauagccgacca

SEQ ID NO: 1157381 - RNA, 15 nt, Mycobacterium bovis subsp bovis AF2122/97
uuccgaggagggccg

SEQ ID NO: 1157382 - RNA, 23 nt, Mycobacterium bovis subsp bovis AF2122/97
uucccgccauugccgccgucgcc

SEQ ID NO: 1157383 - RNA, 15 nt, Mycobacterium bovis subsp bovis AF2122/97
uucccggacccacca

SEQ ID NO: 1157384 - RNA, 23 nt, Mycobacterium bovis subsp bovis AF2122/97
uuccgaacaacaucacugccuug

SEQ ID NO: 1157385 - RNA, 13 nt, Mycobacterium bovis subsp bovis AF2122/97
uucccuggccgcc

SEQ ID NO: 1157386 - RNA, 19 nt, Mycobacterium bovis subsp bovis AF2122/97
uuccaucacggaccaggcc

SEQ ID NO: 1157387 - RNA, 15 nt, Mycobacterium bovis subsp bovis AF2122/97
uuccaucgcgaccuc

SEQ ID NO: 1157388 - RNA, 20 nt, Mycobacterium bovis subsp bovis AF2122/97
uuccagguacacguaccggu

SEQ ID NO: 1157389 - RNA, 16 nt, Mycobacterium bovis subsp bovis AF2122/97
uuccagcccgagcaga

SEQ ID NO: 1157390 - RNA, 14 nt, Mycobacterium bovis subsp bovis AF2122/97
uuccagccggugcc

SEQ ID NO: 1157391 - RNA, 20 nt, Mycobacterium bovis subsp bovis AF2122/97
uuccacugggccugccaguc

SEQ ID NO: 1157392 - RNA, 23 nt, Mycobacterium bovis subsp bovis AF2122/97
uuccacuccccagccccacccgc

SEQ ID NO: 1157393 - RNA, 11 nt, Mycobacterium bovis subsp bovis AF2122/97
uuccaccgccg

SEQ ID NO: 1157394 - RNA, 21 nt, Mycobacterium bovis subsp bovis AF2122/97
uuccacaaauccaaaccuuug

SEQ ID NO: 1157395 - RNA, 19 nt, Mycobacterium bovis subsp bovis AF2122/97
uuccacaggggccagcgcg

SEQ ID NO: 1157396 - RNA, 20 nt, Mycobacterium bovis subsp bovis AF2122/97
uuccacaucaacuugccgcc

SEQ ID NO: 1157397 - RNA, 19 nt, Mycobacterium bovis subsp bovis AF2122/97
uuccaacuccugcagcccg

SEQ ID NO: 1157398 - RNA, 20 nt, Mycobacterium bovis subsp bovis AF2122/97
uuccaagucagaacggcggc

SEQ ID NO: 1157399 - RNA, 20 nt, Mycobacterium bovis subsp bovis AF2122/97
uuccaaaaucaucugcacau

SEQ ID NO: 1157400 - RNA, 23 nt, Mycobacterium bovis subsp bovis AF2122/97
uucagguccaccgcugccggcag

SEQ ID NO: 1157401 - RNA, 21 nt, Mycobacterium bovis subsp bovis AF2122/97
uucaggucggggucagaucca

SEQ ID NO: 1157402 - RNA, 15 nt, Mycobacterium bovis subsp bovis AF2122/97
uucaggaugccagga

SEQ ID NO: 1157403 - RNA, 16 nt, Mycobacterium bovis subsp bovis AF2122/97
uucagcuauuccuaca

SEQ ID NO: 1157404 - RNA, 17 nt, Mycobacterium bovis subsp bovis AF2122/97
uucagcugcgccaggaa

SEQ ID NO: 1157405 - RNA, 20 nt, Mycobacterium bovis subsp bovis AF2122/97
uucagcgcauuucggaucuc

SEQ ID NO: 1157406 - RNA, 16 nt, Mycobacterium bovis subsp bovis AF2122/97
uucaguuccaccgcgc

SEQ ID NO: 1157407 - RNA, 16 nt, Mycobacterium bovis subsp bovis AF2122/97
uucauguggcgcgggu

SEQ ID NO: 1157408 - RNA, 17 nt, Mycobacterium bovis subsp bovis AF2122/97
uucauuccgaacaacau

SEQ ID NO: 1157409 - RNA, 21 nt, Mycobacterium bovis subsp bovis AF2122/97
uucauuccgaacaacaucacu

SEQ ID NO: 1157410 - RNA, 16 nt, Mycobacterium bovis subsp bovis AF2122/97
uucaccaguccaaucu

SEQ ID NO: 1157411 - RNA, 17 nt, Mycobacterium bovis subsp bovis AF2122/97
uucaccacccuguuguu

SEQ ID NO: 1157412 - RNA, 22 nt, Mycobacterium bovis subsp bovis AF2122/97
uucaccacccuguuguugcccc

SEQ ID NO: 1157413 - RNA, 22 nt, Mycobacterium bovis subsp bovis AF2122/97
uucaccacucggucguugccgc

SEQ ID NO: 1157414 - RNA, 22 nt, Mycobacterium bovis subsp bovis AF2122/97
uucaauaauggcaaccagcuuc

SEQ ID NO: 1157415 - RNA, 16 nt, Mycobacterium bovis subsp bovis AF2122/97
uucacgcaccacaaac

SEQ ID NO: 1157416 - RNA, 12 nt, Mycobacterium bovis subsp bovis AF2122/97
uucacccugcca

SEQ ID NO: 1157417 - RNA, 18 nt, Mycobacterium bovis subsp bovis AF2122/97
uucaccgcgauuagcaaa

SEQ ID NO: 1157418 - RNA, 18 nt, Mycobacterium bovis subsp bovis AF2122/97
uucacugugccgcugcau

SEQ ID NO: 1157419 - RNA, 21 nt, Mycobacterium bovis subsp bovis AF2122/97
uucacucguugaccggccgga

SEQ ID NO: 1157420 - RNA, 21 nt, Mycobacterium bovis subsp bovis AF2122/97
uucacguucggcgacgcgccg

SEQ ID NO: 1157421 - RNA, 15 nt, Mycobacterium bovis subsp bovis AF2122/97
uggcgucggccagga

SEQ ID NO: 1157422 - RNA, 22 nt, Mycobacterium bovis subsp bovis AF2122/97
uggcgucggugaaugccgucgc

SEQ ID NO: 1157423 - RNA, 18 nt, Mycobacterium bovis subsp bovis AF2122/97
uggcgucgaugcgggcca

SEQ ID NO: 1157424 - RNA, 22 nt, Mycobacterium bovis subsp bovis AF2122/97
uggcgucgaaccagucgaagaa

SEQ ID NO: 1157425 - RNA, 14 nt, Mycobacterium bovis subsp bovis AF2122/97
uggcgucagcagca

SEQ ID NO: 1157426 - RNA, 15 nt, Mycobacterium bovis subsp bovis AF2122/97
uggcgucagcagcaa

SEQ ID NO: 1157427 - RNA, 15 nt, Mycobacterium bovis subsp bovis AF2122/97
uggcgucagugcaga

SEQ ID NO: 1157428 - RNA, 20 nt, Mycobacterium bovis subsp bovis AF2122/97
uggcuaacaccgcaggcaca

SEQ ID NO: 1157429 - RNA, 14 nt, Mycobacterium bovis subsp bovis AF2122/97
uggcguugggcagc

SEQ ID NO: 1157430 - RNA, 16 nt, Mycobacterium bovis subsp bovis AF2122/97
uggcguugccaccgga

SEQ ID NO: 1157431 - RNA, 20 nt, Mycobacterium bovis subsp bovis AF2122/97
uggcguugccaccggagccg

SEQ ID NO: 1157432 - RNA, 20 nt, Mycobacterium bovis subsp bovis AF2122/97
uggcguggucucggucagcc

SEQ ID NO: 1157433 - RNA, 16 nt, Mycobacterium bovis subsp bovis AF2122/97
uggcguggcccucggc

SEQ ID NO: 1157434 - RNA, 13 nt, Mycobacterium bovis subsp bovis AF2122/97
uggcguguggcuu

SEQ ID NO: 1157435 - RNA, 14 nt, Mycobacterium bovis subsp bovis AF2122/97
uggcucggcauccc

SEQ ID NO: 1157436 - RNA, 16 nt, Mycobacterium bovis subsp bovis AF2122/97
uggcucggggugcaga

SEQ ID NO: 1157437 - RNA, 13 nt, Mycobacterium bovis subsp bovis AF2122/97
uggcucgccgaac

SEQ ID NO: 1157438 - RNA, 20 nt, Mycobacterium bovis subsp bovis AF2122/97
uggcucgcggaugcucguug

SEQ ID NO: 1157439 - RNA, 13 nt, Mycobacterium bovis subsp bovis AF2122/97
uggcuacgcccca

SEQ ID NO: 1157440 - RNA, 23 nt, Mycobacterium bovis subsp bovis AF2122/97
uggcuaguugggugggugcagca

SEQ ID NO: 1157441 - RNA, 12 nt, Mycobacterium bovis subsp bovis AF2122/97
uggcucaccagc

SEQ ID NO: 1157442 - RNA, 15 nt, Mycobacterium bovis subsp bovis AF2122/97
uggcgcugaugcugg

SEQ ID NO: 1157443 - RNA, 13 nt, Mycobacterium bovis subsp bovis AF2122/97
uggcgcggggccg

SEQ ID NO: 1157444 - RNA, 21 nt, Mycobacterium bovis subsp bovis AF2122/97
uggcgcgccgcaucggcgaac

SEQ ID NO: 1157445 - RNA, 19 nt, Mycobacterium bovis subsp bovis AF2122/97
uggcgcggagcugauugug

SEQ ID NO: 1157446 - RNA, 22 nt, Mycobacterium bovis subsp bovis AF2122/97
uggcgcggccgaaagagccagc

SEQ ID NO: 1157447 - RNA, 16 nt, Mycobacterium bovis subsp bovis AF2122/97
uggcggcggugcagca

SEQ ID NO: 1157448 - RNA, 14 nt, Mycobacterium bovis subsp bovis AF2122/97
uggcggcggcggca

SEQ ID NO: 1157449 - RNA, 13 nt, Mycobacterium bovis subsp bovis AF2122/97
uggcggcgcugcg

SEQ ID NO: 1157450 - RNA, 14 nt, Mycobacterium bovis subsp bovis AF2122/97
uggcggcgcgcgcu

SEQ ID NO: 1157451 - RNA, 18 nt, Mycobacterium bovis subsp bovis AF2122/97
uggcggcgagcggacaca

SEQ ID NO: 1157452 - RNA, 20 nt, Mycobacterium bovis subsp bovis AF2122/97
uggcggaacuguaggucaca

SEQ ID NO: 1157453 - RNA, 22 nt, Mycobacterium bovis subsp bovis AF2122/97
uggcggaacagcuucgcgcagc

SEQ ID NO: 1157454 - RNA, 16 nt, Mycobacterium bovis subsp bovis AF2122/97
uggcgggcgccuuggu

SEQ ID NO: 1157455 - RNA, 15 nt, Mycobacterium bovis subsp bovis AF2122/97
uggcggcucacgacc

SEQ ID NO: 1157456 - RNA, 12 nt, Mycobacterium bovis subsp bovis AF2122/97
uggcggcucgcg

SEQ ID NO: 1157457 - RNA, 22 nt, Mycobacterium bovis subsp bovis AF2122/97
uggcggcucguugcgggcggga

SEQ ID NO: 1157458 - RNA, 14 nt, Mycobacterium bovis subsp bovis AF2122/97
uggcggcugcagcc

SEQ ID NO: 1157459 - RNA, 16 nt, Mycobacterium bovis subsp bovis AF2122/97
uggcgggagccuuggu

SEQ ID NO: 1157460 - RNA, 18 nt, Mycobacterium bovis subsp bovis AF2122/97
uggcggggaucagcgagu

SEQ ID NO: 1157461 - RNA, 20 nt, Mycobacterium bovis subsp bovis AF2122/97
uggcgggguugaucaccgac

SEQ ID NO: 1157462 - RNA, 17 nt, Mycobacterium bovis subsp bovis AF2122/97
uggcggucuugccgcag

SEQ ID NO: 1157463 - RNA, 21 nt, Mycobacterium bovis subsp bovis AF2122/97
uggcggucuugccgcaggccu

SEQ ID NO: 1157464 - RNA, 15 nt, Mycobacterium bovis subsp bovis AF2122/97
uggcggugagcacuu

SEQ ID NO: 1157465 - RNA, 21 nt, Mycobacterium bovis subsp bovis AF2122/97
uggcgguguugcucccggccg

SEQ ID NO: 1157466 - RNA, 18 nt, Mycobacterium bovis subsp bovis AF2122/97
uggcggucccgcauaucc

SEQ ID NO: 1157467 - RNA, 20 nt, Mycobacterium bovis subsp bovis AF2122/97
uggcggucggcagaccgacc

SEQ ID NO: 1157468 - RNA, 17 nt, Mycobacterium bovis subsp bovis AF2122/97
uggcgguaagcgaaaca

SEQ ID NO: 1157469 - RNA, 15 nt, Mycobacterium bovis subsp bovis AF2122/97
uggcguagugcagcu

SEQ ID NO: 1157470 - RNA, 14 nt, Mycobacterium bovis subsp bovis AF2122/97
uggcuugcucugcg

SEQ ID NO: 1157471 - RNA, 18 nt, Mycobacterium bovis subsp bovis AF2122/97
uggcuugggccagcgcau

SEQ ID NO: 1157472 - RNA, 15 nt, Mycobacterium bovis subsp bovis AF2122/97
uggcuuggugcccaa

SEQ ID NO: 1157473 - RNA, 17 nt, Mycobacterium bovis subsp bovis AF2122/97
uggcuugacgcccgggc

SEQ ID NO: 1157474 - RNA, 21 nt, Mycobacterium bovis subsp bovis AF2122/97
ugggaaucagugaagacacca

SEQ ID NO: 1157475 - RNA, 15 nt, Mycobacterium bovis subsp bovis AF2122/97
ugggaaccaccagca

SEQ ID NO: 1157476 - RNA, 19 nt, Mycobacterium bovis subsp bovis AF2122/97
uggcugaucccggccaggc

SEQ ID NO: 1157477 - RNA, 14 nt, Mycobacterium bovis subsp bovis AF2122/97
uggcuggccgccac

SEQ ID NO: 1157478 - RNA, 17 nt, Mycobacterium bovis subsp bovis AF2122/97
uggcuguccgcgggccg

SEQ ID NO: 1157479 - RNA, 22 nt, Mycobacterium bovis subsp bovis AF2122/97
ugggcgccgcaaccgccgcguc

SEQ ID NO: 1157480 - RNA, 17 nt, Mycobacterium bovis subsp bovis AF2122/97
ugggcgcccgcgguccg

SEQ ID NO: 1157481 - RNA, 11 nt, Mycobacterium bovis subsp bovis AF2122/97
ugggcgccggu

SEQ ID NO: 1157482 - RNA, 22 nt, Mycobacterium bovis subsp bovis AF2122/97
ugggcgcugucacguagcgagc

SEQ ID NO: 1157483 - RNA, 13 nt, Mycobacterium bovis subsp bovis AF2122/97
ugggcggcacugg

SEQ ID NO: 1157484 - RNA, 13 nt, Mycobacterium bovis subsp bovis AF2122/97
ugggcgcggcagg

SEQ ID NO: 1157485 - RNA, 16 nt, Mycobacterium bovis subsp bovis AF2122/97
ugggcgcggcaggccu

SEQ ID NO: 1157486 - RNA, 13 nt, Mycobacterium bovis subsp bovis AF2122/97
ugggcgcggcgcc

SEQ ID NO: 1157487 - RNA, 20 nt, Mycobacterium bovis subsp bovis AF2122/97
ugggcgcguagcucagcggu

SEQ ID NO: 1157488 - RNA, 22 nt, Mycobacterium bovis subsp bovis AF2122/97
ugggcggccuggucggccaggu

SEQ ID NO: 1157489 - RNA, 12 nt, Mycobacterium bovis subsp bovis AF2122/97
ugggcggccagc

SEQ ID NO: 1157490 - RNA, 14 nt, Mycobacterium bovis subsp bovis AF2122/97
ugggcgguagcuuc

SEQ ID NO: 1157491 - RNA, 15 nt, Mycobacterium bovis subsp bovis AF2122/97
ugggcggugucgucg

SEQ ID NO: 1157492 - RNA, 23 nt, Mycobacterium bovis subsp bovis AF2122/97
ugggcguaaaccguggccgcgau

SEQ ID NO: 1157493 - RNA, 22 nt, Mycobacterium bovis subsp bovis AF2122/97
uggggaccggcaggccggcguc

SEQ ID NO: 1157494 - RNA, 18 nt, Mycobacterium bovis subsp bovis AF2122/97
uggggacccgcuccaagc

SEQ ID NO: 1157495 - RNA, 15 nt, Mycobacterium bovis subsp bovis AF2122/97
uggggauuccgcacc

SEQ ID NO: 1157496 - RNA, 22 nt, Mycobacterium bovis subsp bovis AF2122/97
uggggaucgcaccgugggcccu

SEQ ID NO: 1157497 - RNA, 13 nt, Mycobacterium bovis subsp bovis AF2122/97
ugggcgucaagca

SEQ ID NO: 1157498 - RNA, 13 nt, Mycobacterium bovis subsp bovis AF2122/97
ugggcuuggcugu

SEQ ID NO: 1157499 - RNA, 12 nt, Mycobacterium bovis subsp bovis AF2122/97
ugggcuuggugc

SEQ ID NO: 1157500 - RNA, 15 nt, Mycobacterium bovis subsp bovis AF2122/97
ugggcccgccagccc

SEQ ID NO: 1157501 - RNA, 22 nt, Mycobacterium bovis subsp bovis AF2122/97
ugggccccgaucccgaggggag

SEQ ID NO: 1157502 - RNA, 19 nt, Mycobacterium bovis subsp bovis AF2122/97
ugggccgagagcagccagc

SEQ ID NO: 1157503 - RNA, 15 nt, Mycobacterium bovis subsp bovis AF2122/97
ugggccaggcccagc

SEQ ID NO: 1157504 - RNA, 13 nt, Mycobacterium bovis subsp bovis AF2122/97
ugggccagcagca

SEQ ID NO: 1157505 - RNA, 23 nt, Mycobacterium bovis subsp bovis AF2122/97
ugggccaugcuaggaccaccagc

SEQ ID NO: 1157506 - RNA, 15 nt, Mycobacterium bovis subsp bovis AF2122/97
ugggcccagcggccg

SEQ ID NO: 1157507 - RNA, 19 nt, Mycobacterium bovis subsp bovis AF2122/97
ugggcccagcggccgcgau

SEQ ID NO: 1157508 - RNA, 17 nt, Mycobacterium bovis subsp bovis AF2122/97
ugggccagugaaaccac

SEQ ID NO: 1157509 - RNA, 20 nt, Mycobacterium bovis subsp bovis AF2122/97
ugggccagugaaaccaccgg

SEQ ID NO: 1157510 - RNA, 21 nt, Mycobacterium bovis subsp bovis AF2122/97
ugggacaggacgacuggaagg

SEQ ID NO: 1157511 - RNA, 22 nt, Mycobacterium bovis subsp bovis AF2122/97
ugggaccgggcguuucccugcc

SEQ ID NO: 1157512 - RNA, 18 nt, Mycobacterium bovis subsp bovis AF2122/97
ugggacaggucggcaucc

SEQ ID NO: 1157513 - RNA, 16 nt, Mycobacterium bovis subsp bovis AF2122/97
ugggccaccggcgccg

SEQ ID NO: 1157514 - RNA, 21 nt, Mycobacterium bovis subsp bovis AF2122/97
ugggagguggcgcggggccgc

SEQ ID NO: 1157515 - RNA, 14 nt, Mycobacterium bovis subsp bovis AF2122/97
ugguggucgggcgc

SEQ ID NO: 1157516 - RNA, 14 nt, Mycobacterium bovis subsp bovis AF2122/97
ugguggucaccacc

SEQ ID NO: 1157517 - RNA, 21 nt, Mycobacterium bovis subsp bovis AF2122/97
uggugguugcguuccaguccc

SEQ ID NO: 1157518 - RNA, 14 nt, Mycobacterium bovis subsp bovis AF2122/97
ugguggugccaacc

SEQ ID NO: 1157519 - RNA, 18 nt, Mycobacterium bovis subsp bovis AF2122/97
ugguggugccaaccuggg

SEQ ID NO: 1157520 - RNA, 13 nt, Mycobacterium bovis subsp bovis AF2122/97
ugguggugcccgg

SEQ ID NO: 1157521 - RNA, 21 nt, Mycobacterium bovis subsp bovis AF2122/97
uggugcugacauuuccaccac

SEQ ID NO: 1157522 - RNA, 15 nt, Mycobacterium bovis subsp bovis AF2122/97
uggugggaucgcagc

SEQ ID NO: 1157523 - RNA, 22 nt, Mycobacterium bovis subsp bovis AF2122/97
uggugcccaaggcagaccccca

SEQ ID NO: 1157524 - RNA, 23 nt, Mycobacterium bovis subsp bovis AF2122/97
uggugcccaaggcagacccccag

SEQ ID NO: 1157525 - RNA, 17 nt, Mycobacterium bovis subsp bovis AF2122/97
uggugcccuugaagaaa

SEQ ID NO: 1157526 - RNA, 16 nt, Mycobacterium bovis subsp bovis AF2122/97
uggugccgcggccacc

SEQ ID NO: 1157527 - RNA, 17 nt, Mycobacterium bovis subsp bovis AF2122/97
uggugccgcggccaccg

SEQ ID NO: 1157528 - RNA, 19 nt, Mycobacterium bovis subsp bovis AF2122/97
uggugcggucuggcgacuc

SEQ ID NO: 1157529 - RNA, 14 nt, Mycobacterium bovis subsp bovis AF2122/97
uggugcgcgucagc

SEQ ID NO: 1157530 - RNA, 20 nt, Mycobacterium bovis subsp bovis AF2122/97
uggugcguagcccacccggg

SEQ ID NO: 1157531 - RNA, 14 nt, Mycobacterium bovis subsp bovis AF2122/97
uggucgccaugucg

SEQ ID NO: 1157532 - RNA, 14 nt, Mycobacterium bovis subsp bovis AF2122/97
uggucgccgggcag

SEQ ID NO: 1157533 - RNA, 13 nt, Mycobacterium bovis subsp bovis AF2122/97
uggucgcggcugc

SEQ ID NO: 1157534 - RNA, 19 nt, Mycobacterium bovis subsp bovis AF2122/97
uggucgccgucgaagcgga

SEQ ID NO: 1157535 - RNA, 14 nt, Mycobacterium bovis subsp bovis AF2122/97
uggucgcugcugcc

SEQ ID NO: 1157536 - RNA, 14 nt, Mycobacterium bovis subsp bovis AF2122/97
uggucgcggggccg

SEQ ID NO: 1157537 - RNA, 18 nt, Mycobacterium bovis subsp bovis AF2122/97
uggucgcgguggcggcgg

SEQ ID NO: 1157538 - RNA, 19 nt, Mycobacterium bovis subsp bovis AF2122/97
uggucggccaggucgagca

SEQ ID NO: 1157539 - RNA, 19 nt, Mycobacterium bovis subsp bovis AF2122/97
uggucggcggccucggucu

SEQ ID NO: 1157540 - RNA, 20 nt, Mycobacterium bovis subsp bovis AF2122/97
uggucggcggccucggucug

SEQ ID NO: 1157541 - RNA, 18 nt, Mycobacterium bovis subsp bovis AF2122/97
uggucggagguggggugg

SEQ ID NO: 1157542 - RNA, 20 nt, Mycobacterium bovis subsp bovis AF2122/97
uggucggcuacggccagugc

SEQ ID NO: 1157543 - RNA, 12 nt, Mycobacterium bovis subsp bovis AF2122/97
uggucugccagc

SEQ ID NO: 1157544 - RNA, 12 nt, Mycobacterium bovis subsp bovis AF2122/97
uggucugccaaa

SEQ ID NO: 1157545 - RNA, 16 nt, Mycobacterium bovis subsp bovis AF2122/97
uggucuggacugcagc

SEQ ID NO: 1157546 - RNA, 16 nt, Mycobacterium bovis subsp bovis AF2122/97
uggugaaggcaaacac

SEQ ID NO: 1157547 - RNA, 18 nt, Mycobacterium bovis subsp bovis AF2122/97
uggugaugcaacucggca

SEQ ID NO: 1157548 - RNA, 22 nt, Mycobacterium bovis subsp bovis AF2122/97
ugguagguuacgccgggguaga

SEQ ID NO: 1157549 - RNA, 14 nt, Mycobacterium bovis subsp bovis AF2122/97
ugguaguaggccug

SEQ ID NO: 1157550 - RNA, 16 nt, Mycobacterium bovis subsp bovis AF2122/97
ugguaguaggccuggc

SEQ ID NO: 1157551 - RNA, 17 nt, Mycobacterium bovis subsp bovis AF2122/97
uggucaaugcgcuggcg

SEQ ID NO: 1157552 - RNA, 18 nt, Mycobacterium bovis subsp bovis AF2122/97
uggucacacccagcgcgc

SEQ ID NO: 1157553 - RNA, 17 nt, Mycobacterium bovis subsp bovis AF2122/97
uggucaacggccgacuu

SEQ ID NO: 1157554 - RNA, 15 nt, Mycobacterium bovis subsp bovis AF2122/97
uggucaacagcggca

SEQ ID NO: 1157555 - RNA, 19 nt, Mycobacterium bovis subsp bovis AF2122/97
uggucauguucggggcgca

SEQ ID NO: 1157556 - RNA, 14 nt, Mycobacterium bovis subsp bovis AF2122/97
ugguccaaccagca

SEQ ID NO: 1157557 - RNA, 16 nt, Mycobacterium bovis subsp bovis AF2122/97
ugguccaaccgggccg

SEQ ID NO: 1157558 - RNA, 23 nt, Mycobacterium bovis subsp bovis AF2122/97
uggucaccaggccgaaauccaga

SEQ ID NO: 1157559 - RNA, 17 nt, Mycobacterium bovis subsp bovis AF2122/97
uggggcuguagucgaug

SEQ ID NO: 1157560 - RNA, 19 nt, Mycobacterium bovis subsp bovis AF2122/97
uggggcugugcaggcggga

SEQ ID NO: 1157561 - RNA, 20 nt, Mycobacterium bovis subsp bovis AF2122/97
ugggggccggcacugccgag

SEQ ID NO: 1157562 - RNA, 16 nt, Mycobacterium bovis subsp bovis AF2122/97
ugggggcaucaggguc

SEQ ID NO: 1157563 - RNA, 12 nt, Mycobacterium bovis subsp bovis AF2122/97
ugggguggcagc

SEQ ID NO: 1157564 - RNA, 14 nt, Mycobacterium bovis subsp bovis AF2122/97
uggggugacgcacc

SEQ ID NO: 1157565 - RNA, 13 nt, Mycobacterium bovis subsp bovis AF2122/97
ugguagccagggc

SEQ ID NO: 1157566 - RNA, 21 nt, Mycobacterium bovis subsp bovis AF2122/97
ugguuggcacgcaacaccgcc

SEQ ID NO: 1157567 - RNA, 15 nt, Mycobacterium bovis subsp bovis AF2122/97
ugguugugucggccu

SEQ ID NO: 1157568 - RNA, 21 nt, Mycobacterium bovis subsp bovis AF2122/97
ugguuucggccgcauccccgg

SEQ ID NO: 1157569 - RNA, 16 nt, Mycobacterium bovis subsp bovis AF2122/97
ugguuucgacucgguu

SEQ ID NO: 1157570 - RNA, 19 nt, Mycobacterium bovis subsp bovis AF2122/97
ugguucccgacgucggccu

SEQ ID NO: 1157571 - RNA, 17 nt, Mycobacterium bovis subsp bovis AF2122/97
ugguuccggcgugcagc

SEQ ID NO: 1157572 - RNA, 19 nt, Mycobacterium bovis subsp bovis AF2122/97
ugguucggcgucgacccag

SEQ ID NO: 1157573 - RNA, 14 nt, Mycobacterium bovis subsp bovis AF2122/97
ugguucgcacaccu

SEQ ID NO: 1157574 - RNA, 17 nt, Mycobacterium bovis subsp bovis AF2122/97
ugguguacacacccgcc

SEQ ID NO: 1157575 - RNA, 13 nt, Mycobacterium bovis subsp bovis AF2122/97
ugguguagcuucg

SEQ ID NO: 1157576 - RNA, 16 nt, Mycobacterium bovis subsp bovis AF2122/97
ugguguacugcugcuu

SEQ ID NO: 1157577 - RNA, 19 nt, Mycobacterium bovis subsp bovis AF2122/97
ugguguagccgagcacggg

SEQ ID NO: 1157578 - RNA, 21 nt, Mycobacterium bovis subsp bovis AF2122/97
ugguuagaggauggucagcag

SEQ ID NO: 1157579 - RNA, 22 nt, Mycobacterium bovis subsp bovis AF2122/97
ugguuagaggauggucagcagc

SEQ ID NO: 1157580 - RNA, 14 nt, Mycobacterium bovis subsp bovis AF2122/97
ugguuagguggcug

SEQ ID NO: 1157581 - RNA, 21 nt, Mycobacterium bovis subsp bovis AF2122/97
uguacaggcuguccagcagcg

SEQ ID NO: 1157582 - RNA, 20 nt, Mycobacterium bovis subsp bovis AF2122/97
uguacaccgcgcccgccgau

SEQ ID NO: 1157583 - RNA, 17 nt, Mycobacterium bovis subsp bovis AF2122/97
ugucagcuuuaucggcc

SEQ ID NO: 1157584 - RNA, 18 nt, Mycobacterium bovis subsp bovis AF2122/97
ugucagugaucaccaacc

SEQ ID NO: 1157585 - RNA, 20 nt, Mycobacterium bovis subsp bovis AF2122/97
ugucagugaucaccaacccg

SEQ ID NO: 1157586 - RNA, 14 nt, Mycobacterium bovis subsp bovis AF2122/97
ugucaguucccgcu

SEQ ID NO: 1157587 - RNA, 13 nt, Mycobacterium bovis subsp bovis AF2122/97
ugucaaaggugca

SEQ ID NO: 1157588 - RNA, 23 nt, Mycobacterium bovis subsp bovis AF2122/97
uguccagaacggcgaucaccgag

SEQ ID NO: 1157589 - RNA, 13 nt, Mycobacterium bovis subsp bovis AF2122/97
uguccagaacggu

SEQ ID NO: 1157590 - RNA, 18 nt, Mycobacterium bovis subsp bovis AF2122/97
uguccagaauccaggugg

SEQ ID NO: 1157591 - RNA, 13 nt, Mycobacterium bovis subsp bovis AF2122/97
uguccacugccac

SEQ ID NO: 1157592 - RNA, 17 nt, Mycobacterium bovis subsp bovis AF2122/97
uguccacguccagcccg

SEQ ID NO: 1157593 - RNA, 18 nt, Mycobacterium bovis subsp bovis AF2122/97
uguccaccagcguguagc

SEQ ID NO: 1157594 - RNA, 20 nt, Mycobacterium bovis subsp bovis AF2122/97
uguccauauagaucacugcu

SEQ ID NO: 1157595 - RNA, 19 nt, Mycobacterium bovis subsp bovis AF2122/97
uguccaggcgcgcaccacc

SEQ ID NO: 1157596 - RNA, 20 nt, Mycobacterium bovis subsp bovis AF2122/97
uguccaggcgcgcaccaccg

SEQ ID NO: 1157597 - RNA, 16 nt, Mycobacterium bovis subsp bovis AF2122/97
uguccagcguccuggc

SEQ ID NO: 1157598 - RNA, 15 nt, Mycobacterium bovis subsp bovis AF2122/97
uguccagcaugcccg

SEQ ID NO: 1157599 - RNA, 11 nt, Mycobacterium bovis subsp bovis AF2122/97
uguccccgacg

SEQ ID NO: 1157600 - RNA, 23 nt, Mycobacterium bovis subsp bovis AF2122/97
uguccccggcggcagcauauccg

SEQ ID NO: 1157601 - RNA, 17 nt, Mycobacterium bovis subsp bovis AF2122/97
ugucccgcacccggccc

SEQ ID NO: 1157602 - RNA, 21 nt, Mycobacterium bovis subsp bovis AF2122/97
uguccuugagagauuucuuga

SEQ ID NO: 1157603 - RNA, 22 nt, Mycobacterium bovis subsp bovis AF2122/97
uguccuggcccgauaaaugccg

SEQ ID NO: 1157604 - RNA, 16 nt, Mycobacterium bovis subsp bovis AF2122/97
uguccuacuuuuccac

SEQ ID NO: 1157605 - RNA, 19 nt, Mycobacterium bovis subsp bovis AF2122/97
uguccuauuugcagccuuc

SEQ ID NO: 1157606 - RNA, 13 nt, Mycobacterium bovis subsp bovis AF2122/97
uguccucacaugc

SEQ ID NO: 1157607 - RNA, 14 nt, Mycobacterium bovis subsp bovis AF2122/97
uguccucccauccc

SEQ ID NO: 1157608 - RNA, 15 nt, Mycobacterium bovis subsp bovis AF2122/97
uguccgucgcguccg

SEQ ID NO: 1157609 - RNA, 23 nt, Mycobacterium bovis subsp bovis AF2122/97
uguccgauaccgcgaugauggcg

SEQ ID NO: 1157610 - RNA, 19 nt, Mycobacterium bovis subsp bovis AF2122/97
uguccccgccgagggcuug

SEQ ID NO: 1157611 - RNA, 17 nt, Mycobacterium bovis subsp bovis AF2122/97
uguccgcagcggugcgc

SEQ ID NO: 1157612 - RNA, 15 nt, Mycobacterium bovis subsp bovis AF2122/97
uguccggccgguccg

SEQ ID NO: 1157613 - RNA, 16 nt, Mycobacterium bovis subsp bovis AF2122/97
ugucgcacucagucug

SEQ ID NO: 1157614 - RNA, 21 nt, Mycobacterium bovis subsp bovis AF2122/97
ugucgccgaguaccggccagc

SEQ ID NO: 1157615 - RNA, 16 nt, Mycobacterium bovis subsp bovis AF2122/97
ugucgacggccacccc

SEQ ID NO: 1157616 - RNA, 22 nt, Mycobacterium bovis subsp bovis AF2122/97
ugucgacggucggcggaaacaa

SEQ ID NO: 1157617 - RNA, 12 nt, Mycobacterium bovis subsp bovis AF2122/97
ugucgacggugu

SEQ ID NO: 1157618 - RNA, 22 nt, Mycobacterium bovis subsp bovis AF2122/97
ugucgacgacaacgaugucacc

SEQ ID NO: 1157619 - RNA, 16 nt, Mycobacterium bovis subsp bovis AF2122/97
ugucgaguugaauggc

SEQ ID NO: 1157620 - RNA, 12 nt, Mycobacterium bovis subsp bovis AF2122/97
ugucgaacuggu

SEQ ID NO: 1157621 - RNA, 16 nt, Mycobacterium bovis subsp bovis AF2122/97
uguccuuugccaccuc

SEQ ID NO: 1157622 - RNA, 14 nt, Mycobacterium bovis subsp bovis AF2122/97
uguccuuggccgcc

SEQ ID NO: 1157623 - RNA, 17 nt, Mycobacterium bovis subsp bovis AF2122/97
ugucgcggucgcccgcu

SEQ ID NO: 1157624 - RNA, 13 nt, Mycobacterium bovis subsp bovis AF2122/97
ugucgcggugcgg

SEQ ID NO: 1157625 - RNA, 19 nt, Mycobacterium bovis subsp bovis AF2122/97
ugucgcgccgguggucagg

SEQ ID NO: 1157626 - RNA, 15 nt, Mycobacterium bovis subsp bovis AF2122/97
ugucgcugcggcgcu

SEQ ID NO: 1157627 - RNA, 22 nt, Mycobacterium bovis subsp bovis AF2122/97
ugucgcugcggcgcuggccagc

SEQ ID NO: 1157628 - RNA, 19 nt, Mycobacterium bovis subsp bovis AF2122/97
ugucggcgagggcgcgccg

SEQ ID NO: 1157629 - RNA, 21 nt, Mycobacterium bovis subsp bovis AF2122/97
ugucggcgaaccacggcagcc

SEQ ID NO: 1157630 - RNA, 15 nt, Mycobacterium bovis subsp bovis AF2122/97
ugucggccccggccg

SEQ ID NO: 1157631 - RNA, 16 nt, Mycobacterium bovis subsp bovis AF2122/97
ugucggccacccggac

SEQ ID NO: 1157632 - RNA, 14 nt, Mycobacterium bovis subsp bovis AF2122/97
ugucggugccgucg

SEQ ID NO: 1157633 - RNA, 16 nt, Mycobacterium bovis subsp bovis AF2122/97
ugucggggccgucguc

SEQ ID NO: 1157634 - RNA, 22 nt, Mycobacterium bovis subsp bovis AF2122/97
ugucggggucgcaggccagggu

SEQ ID NO: 1157635 - RNA, 14 nt, Mycobacterium bovis subsp bovis AF2122/97
ugucgggccaggcg

SEQ ID NO: 1157636 - RNA, 18 nt, Mycobacterium bovis subsp bovis AF2122/97
ugucgucuuuggucagcc

SEQ ID NO: 1157637 - RNA, 13 nt, Mycobacterium bovis subsp bovis AF2122/97
ugucgguucgucg

SEQ ID NO: 1157638 - RNA, 19 nt, Mycobacterium bovis subsp bovis AF2122/97
ugucgguuggcagccacgg

SEQ ID NO: 1157639 - RNA, 22 nt, Mycobacterium bovis subsp bovis AF2122/97
ugucgguguacagucgcgcgcu

SEQ ID NO: 1157640 - RNA, 17 nt, Mycobacterium bovis subsp bovis AF2122/97
ugucuacgccgggaauu

SEQ ID NO: 1157641 - RNA, 22 nt, Mycobacterium bovis subsp bovis AF2122/97
ugucuccuccggaaagcucucg

SEQ ID NO: 1157642 - RNA, 21 nt, Mycobacterium bovis subsp bovis AF2122/97
ugucucggcaccacagugaaa

SEQ ID NO: 1157643 - RNA, 17 nt, Mycobacterium bovis subsp bovis AF2122/97
ugucucccuugccgcca

SEQ ID NO: 1157644 - RNA, 15 nt, Mycobacterium bovis subsp bovis AF2122/97
ugugauccgguggug

SEQ ID NO: 1157645 - RNA, 12 nt, Mycobacterium bovis subsp bovis AF2122/97
ugucugcccgag

SEQ ID NO: 1157646 - RNA, 11 nt, Mycobacterium bovis subsp bovis AF2122/97
ugugccgccgg

SEQ ID NO: 1157647 - RNA, 21 nt, Mycobacterium bovis subsp bovis AF2122/97
ugugcccggcuccuccccggc

SEQ ID NO: 1157648 - RNA, 13 nt, Mycobacterium bovis subsp bovis AF2122/97
ugugcccaugaug

SEQ ID NO: 1157649 - RNA, 22 nt, Mycobacterium bovis subsp bovis AF2122/97
ugugcccaugaugcucgaugau

SEQ ID NO: 1157650 - RNA, 20 nt, Mycobacterium bovis subsp bovis AF2122/97
ugugccgaucggccaacagg

SEQ ID NO: 1157651 - RNA, 16 nt, Mycobacterium bovis subsp bovis AF2122/97
ugugcugccaccggcc

SEQ ID NO: 1157652 - RNA, 21 nt, Mycobacterium bovis subsp bovis AF2122/97
ugugccacuucuucacuggcg

SEQ ID NO: 1157653 - RNA, 19 nt, Mycobacterium bovis subsp bovis AF2122/97
ugugcaacggugaaucgaa

SEQ ID NO: 1157654 - RNA, 13 nt, Mycobacterium bovis subsp bovis AF2122/97
ugugccacggggc

SEQ ID NO: 1157655 - RNA, 20 nt, Mycobacterium bovis subsp bovis AF2122/97
uguggugacagauccgcccc

SEQ ID NO: 1157656 - RNA, 16 nt, Mycobacterium bovis subsp bovis AF2122/97
uguggucgcugcugcc

SEQ ID NO: 1157657 - RNA, 19 nt, Mycobacterium bovis subsp bovis AF2122/97
uguggucggugccagcacc

SEQ ID NO: 1157658 - RNA, 19 nt, Mycobacterium bovis subsp bovis AF2122/97
uguggacggcauagcagcc

SEQ ID NO: 1157659 - RNA, 19 nt, Mycobacterium bovis subsp bovis AF2122/97
uguggacuucagcaggccc

SEQ ID NO: 1157660 - RNA, 12 nt, Mycobacterium bovis subsp bovis AF2122/97
uguggacccgcc

SEQ ID NO: 1157661 - RNA, 18 nt, Mycobacterium bovis subsp bovis AF2122/97
uguggacccgccagggca

SEQ ID NO: 1157662 - RNA, 13 nt, Mycobacterium bovis subsp bovis AF2122/97
uguggcacccggc

SEQ ID NO: 1157663 - RNA, 16 nt, Mycobacterium bovis subsp bovis AF2122/97
uguugaccgggucguc

SEQ ID NO: 1157664 - RNA, 15 nt, Mycobacterium bovis subsp bovis AF2122/97
uguugaugggcagcc

SEQ ID NO: 1157665 - RNA, 15 nt, Mycobacterium bovis subsp bovis AF2122/97
uguugccccggucgg

SEQ ID NO: 1157666 - RNA, 15 nt, Mycobacterium bovis subsp bovis AF2122/97
uguugaagaagcccg

SEQ ID NO: 1157667 - RNA, 21 nt, Mycobacterium bovis subsp bovis AF2122/97
uguugaagaggcgcaccuccu

SEQ ID NO: 1157668 - RNA, 22 nt, Mycobacterium bovis subsp bovis AF2122/97
uguugaaauugaugaucugcag

SEQ ID NO: 1157669 - RNA, 21 nt, Mycobacterium bovis subsp bovis AF2122/97
uguucuugagccggacguucu

SEQ ID NO: 1157670 - RNA, 13 nt, Mycobacterium bovis subsp bovis AF2122/97
uguucaucaucug

SEQ ID NO: 1157671 - RNA, 14 nt, Mycobacterium bovis subsp bovis AF2122/97
uguucggagccaau

SEQ ID NO: 1157672 - RNA, 21 nt, Mycobacterium bovis subsp bovis AF2122/97
uguucggcccuauggguuccu

SEQ ID NO: 1157673 - RNA, 14 nt, Mycobacterium bovis subsp bovis AF2122/97
uguucggucuugcc

SEQ ID NO: 1157674 - RNA, 12 nt, Mycobacterium bovis subsp bovis AF2122/97
uguucugcacgu

SEQ ID NO: 1157675 - RNA, 19 nt, Mycobacterium bovis subsp bovis AF2122/97
uguguucgccggcaggguu

SEQ ID NO: 1157676 - RNA, 22 nt, Mycobacterium bovis subsp bovis AF2122/97
uguguuccaacuccugcagccc

SEQ ID NO: 1157677 - RNA, 22 nt, Mycobacterium bovis subsp bovis AF2122/97
uguguucggagcugggcugaug

SEQ ID NO: 1157678 - RNA, 19 nt, Mycobacterium bovis subsp bovis AF2122/97
uguuagugaggcccgaguu

SEQ ID NO: 1157679 - RNA, 21 nt, Mycobacterium bovis subsp bovis AF2122/97
uguuauuuuuggccaugcucu

SEQ ID NO: 1157680 - RNA, 18 nt, Mycobacterium bovis subsp bovis AF2122/97
uuaccccaccggaaucga

SEQ ID NO: 1157681 - RNA, 17 nt, Mycobacterium bovis subsp bovis AF2122/97
uuacccaucgccacacc

SEQ ID NO: 1157682 - RNA, 14 nt, Mycobacterium bovis subsp bovis AF2122/97
uuacgccgagcaca

SEQ ID NO: 1157683 - RNA, 15 nt, Mycobacterium bovis subsp bovis AF2122/97
uuacgcaccgaggcc

SEQ ID NO: 1157684 - RNA, 21 nt, Mycobacterium bovis subsp bovis AF2122/97
uuacgcaccgaugccuugacc

SEQ ID NO: 1157685 - RNA, 21 nt, Mycobacterium bovis subsp bovis AF2122/97
uuacgaugcucagcuggucgg

SEQ ID NO: 1157686 - RNA, 21 nt, Mycobacterium bovis subsp bovis AF2122/97
uuacgcucgcgggccaaagcc

SEQ ID NO: 1157687 - RNA, 13 nt, Mycobacterium bovis subsp bovis AF2122/97
uuacgucugcucg

SEQ ID NO: 1157688 - RNA, 14 nt, Mycobacterium bovis subsp bovis AF2122/97
uuacaugucacacc

SEQ ID NO: 1157689 - RNA, 17 nt, Mycobacterium bovis subsp bovis AF2122/97
uuacaugucacacccac

SEQ ID NO: 1157690 - RNA, 22 nt, Mycobacterium bovis subsp bovis AF2122/97
uguugcccaauucgacugcaac

SEQ ID NO: 1157691 - RNA, 18 nt, Mycobacterium bovis subsp bovis AF2122/97
uguugcggcugaccuccc

SEQ ID NO: 1157692 - RNA, 12 nt, Mycobacterium bovis subsp bovis AF2122/97
uuaugccaggcg

SEQ ID NO: 1157693 - RNA, 20 nt, Mycobacterium bovis subsp bovis AF2122/97
ugcaucgcggcggcgcucuu

SEQ ID NO: 1157694 - RNA, 18 nt, Mycobacterium bovis subsp bovis AF2122/97
ugcauccggcccacucac

SEQ ID NO: 1157695 - RNA, 20 nt, Mycobacterium bovis subsp bovis AF2122/97
ugcaucauggccgugaacug

SEQ ID NO: 1157696 - RNA, 19 nt, Mycobacterium bovis subsp bovis AF2122/97
ugcaugagcguucagcacg

SEQ ID NO: 1157697 - RNA, 14 nt, Mycobacterium bovis subsp bovis AF2122/97
ugcacuacaggguu

SEQ ID NO: 1157698 - RNA, 23 nt, Mycobacterium bovis subsp bovis AF2122/97
ugcacucggcgcccuccuuggcg

SEQ ID NO: 1157699 - RNA, 17 nt, Mycobacterium bovis subsp bovis AF2122/97
ugcagugccgcacccag

SEQ ID NO: 1157700 - RNA, 21 nt, Mycobacterium bovis subsp bovis AF2122/97
ugcacugcugguugaugaagg

SEQ ID NO: 1157701 - RNA, 23 nt, Mycobacterium bovis subsp bovis AF2122/97
ugcagugccguguccagcaugcc

SEQ ID NO: 1157702 - RNA, 13 nt, Mycobacterium bovis subsp bovis AF2122/97
ugcagugcgaccc

SEQ ID NO: 1157703 - RNA, 21 nt, Mycobacterium bovis subsp bovis AF2122/97
ugcauagcaauccgcacagcg

SEQ ID NO: 1157704 - RNA, 19 nt, Mycobacterium bovis subsp bovis AF2122/97
ugcauagcaauccgcacag

SEQ ID NO: 1157705 - RNA, 14 nt, Mycobacterium bovis subsp bovis AF2122/97
ugcaucaccacugg

SEQ ID NO: 1157706 - RNA, 20 nt, Mycobacterium bovis subsp bovis AF2122/97
ugcaucacaagggugcccgg

SEQ ID NO: 1157707 - RNA, 13 nt, Mycobacterium bovis subsp bovis AF2122/97
ugccacgccgccg

SEQ ID NO: 1157708 - RNA, 22 nt, Mycobacterium bovis subsp bovis AF2122/97
ugccacguucgcgggcgucccg

SEQ ID NO: 1157709 - RNA, 23 nt, Mycobacterium bovis subsp bovis AF2122/97
ugccacgcguuccuccagcagcg

SEQ ID NO: 1157710 - RNA, 23 nt, Mycobacterium bovis subsp bovis AF2122/97
ugccacgaacgcuuccagcgugu

SEQ ID NO: 1157711 - RNA, 22 nt, Mycobacterium bovis subsp bovis AF2122/97
ugccacgacgaacaccagcgcg

SEQ ID NO: 1157712 - RNA, 14 nt, Mycobacterium bovis subsp bovis AF2122/97
ugccacacaggcgu

SEQ ID NO: 1157713 - RNA, 12 nt, Mycobacterium bovis subsp bovis AF2122/97
ugccacagaccg

SEQ ID NO: 1157714 - RNA, 16 nt, Mycobacterium bovis subsp bovis AF2122/97
ugccacagaccgaaca

SEQ ID NO: 1157715 - RNA, 15 nt, Mycobacterium bovis subsp bovis AF2122/97
ugccacccuugccgc

SEQ ID NO: 1157716 - RNA, 21 nt, Mycobacterium bovis subsp bovis AF2122/97
ugccaccgcgacggcaggcuc

SEQ ID NO: 1157717 - RNA, 14 nt, Mycobacterium bovis subsp bovis AF2122/97
ugccaccgcggccg

SEQ ID NO: 1157718 - RNA, 12 nt, Mycobacterium bovis subsp bovis AF2122/97
ugccaccgugca

SEQ ID NO: 1157719 - RNA, 14 nt, Mycobacterium bovis subsp bovis AF2122/97
ugccaccgccgccg

SEQ ID NO: 1157720 - RNA, 14 nt, Mycobacterium bovis subsp bovis AF2122/97
ugccaauuccagcc

SEQ ID NO: 1157721 - RNA, 16 nt, Mycobacterium bovis subsp bovis AF2122/97
ugccaauuccagcccc

SEQ ID NO: 1157722 - RNA, 22 nt, Mycobacterium bovis subsp bovis AF2122/97
ugccaacaaaggccggguggcc

SEQ ID NO: 1157723 - RNA, 20 nt, Mycobacterium bovis subsp bovis AF2122/97
ugccagggugcgccgguccu

SEQ ID NO: 1157724 - RNA, 16 nt, Mycobacterium bovis subsp bovis AF2122/97
ugccagcggccgggcg

SEQ ID NO: 1157725 - RNA, 11 nt, Mycobacterium bovis subsp bovis AF2122/97
ugccagcggca

SEQ ID NO: 1157726 - RNA, 16 nt, Mycobacterium bovis subsp bovis AF2122/97
ugccagcggcacaccc

SEQ ID NO: 1157727 - RNA, 13 nt, Mycobacterium bovis subsp bovis AF2122/97
ugccagccgugca

SEQ ID NO: 1157728 - RNA, 15 nt, Mycobacterium bovis subsp bovis AF2122/97
ugccagccgugcagg

SEQ ID NO: 1157729 - RNA, 15 nt, Mycobacterium bovis subsp bovis AF2122/97
ugccagaccagggca

SEQ ID NO: 1157730 - RNA, 17 nt, Mycobacterium bovis subsp bovis AF2122/97
ugccauggauguaggcu

SEQ ID NO: 1157731 - RNA, 17 nt, Mycobacterium bovis subsp bovis AF2122/97
ugccaucggcaccagcg

SEQ ID NO: 1157732 - RNA, 24 nt, Mycobacterium bovis subsp bovis AF2122/97
ugccaucggcaccagcgcgcgccg

SEQ ID NO: 1157733 - RNA, 18 nt, Mycobacterium bovis subsp bovis AF2122/97
ugccaucgggaccgggga

SEQ ID NO: 1157734 - RNA, 22 nt, Mycobacterium bovis subsp bovis AF2122/97
ugccaucgcggcguugugaccg

SEQ ID NO: 1157735 - RNA, 19 nt, Mycobacterium bovis subsp bovis AF2122/97
ugccaucgggcgcgguaac

SEQ ID NO: 1157736 - RNA, 22 nt, Mycobacterium bovis subsp bovis AF2122/97
ugccaucgggcgcgguaaccac

SEQ ID NO: 1157737 - RNA, 15 nt, Mycobacterium bovis subsp bovis AF2122/97
ugccaggugggugaa

SEQ ID NO: 1157738 - RNA, 18 nt, Mycobacterium bovis subsp bovis AF2122/97
ugccaggugcuguuuggu

SEQ ID NO: 1157739 - RNA, 15 nt, Mycobacterium bovis subsp bovis AF2122/97
ugccgccgcacaucu

SEQ ID NO: 1157740 - RNA, 19 nt, Mycobacterium bovis subsp bovis AF2122/97
ugccgccgagggcgccggg

SEQ ID NO: 1157741 - RNA, 14 nt, Mycobacterium bovis subsp bovis AF2122/97
ugccgccgagcugg

SEQ ID NO: 1157742 - RNA, 17 nt, Mycobacterium bovis subsp bovis AF2122/97
ugccgccgcagaugggc

SEQ ID NO: 1157743 - RNA, 23 nt, Mycobacterium bovis subsp bovis AF2122/97
ugccgccgacaccaccggcgccg

SEQ ID NO: 1157744 - RNA, 13 nt, Mycobacterium bovis subsp bovis AF2122/97
ugccgccggugcc

SEQ ID NO: 1157745 - RNA, 16 nt, Mycobacterium bovis subsp bovis AF2122/97
ugccgccggugccacc

SEQ ID NO: 1157746 - RNA, 23 nt, Mycobacterium bovis subsp bovis AF2122/97
ugccgccgguggugccggcgccg

SEQ ID NO: 1157747 - RNA, 23 nt, Mycobacterium bovis subsp bovis AF2122/97
ugccgccgguguugccguuaccg

SEQ ID NO: 1157748 - RNA, 18 nt, Mycobacterium bovis subsp bovis AF2122/97
ugccgccguugccggcuu

SEQ ID NO: 1157749 - RNA, 21 nt, Mycobacterium bovis subsp bovis AF2122/97
ugccgccgguuccgccggccc

SEQ ID NO: 1157750 - RNA, 19 nt, Mycobacterium bovis subsp bovis AF2122/97
ugccgccgucaccgccguu

SEQ ID NO: 1157751 - RNA, 19 nt, Mycobacterium bovis subsp bovis AF2122/97
ugccgccgucgccgccguc

SEQ ID NO: 1157752 - RNA, 22 nt, Mycobacterium bovis subsp bovis AF2122/97
ugccgccgucgccgccgucacc

SEQ ID NO: 1157753 - RNA, 19 nt, Mycobacterium bovis subsp bovis AF2122/97
ugccgccgucgccgccguu

SEQ ID NO: 1157754 - RNA, 17 nt, Mycobacterium bovis subsp bovis AF2122/97
ugccgccgucgccgcca

SEQ ID NO: 1157755 - RNA, 17 nt, Mycobacterium bovis subsp bovis AF2122/97
ugccgccgucgccgccg

SEQ ID NO: 1157756 - RNA, 19 nt, Mycobacterium bovis subsp bovis AF2122/97
ugccgccguuaccgccgcu

SEQ ID NO: 1157757 - RNA, 23 nt, Mycobacterium bovis subsp bovis AF2122/97
ugccgccguuaccgccgcugccg

SEQ ID NO: 1157758 - RNA, 17 nt, Mycobacterium bovis subsp bovis AF2122/97
ugccgccguugccgcca

SEQ ID NO: 1157759 - RNA, 16 nt, Mycobacterium bovis subsp bovis AF2122/97
ugccgcccaugccggg

SEQ ID NO: 1157760 - RNA, 17 nt, Mycobacterium bovis subsp bovis AF2122/97
ugccgcccgcgccgccg

SEQ ID NO: 1157761 - RNA, 22 nt, Mycobacterium bovis subsp bovis AF2122/97
ugccgcagaugaaagugccagu

SEQ ID NO: 1157762 - RNA, 16 nt, Mycobacterium bovis subsp bovis AF2122/97
ugccgcauacgcggcu

SEQ ID NO: 1157763 - RNA, 12 nt, Mycobacterium bovis subsp bovis AF2122/97
ugcccucggccg

SEQ ID NO: 1157764 - RNA, 21 nt, Mycobacterium bovis subsp bovis AF2122/97
ugcccugcacuucgggauaag

SEQ ID NO: 1157765 - RNA, 16 nt, Mycobacterium bovis subsp bovis AF2122/97
ugcccugcgugcagau

SEQ ID NO: 1157766 - RNA, 20 nt, Mycobacterium bovis subsp bovis AF2122/97
ugcccugcgcucgggcugcc

SEQ ID NO: 1157767 - RNA, 18 nt, Mycobacterium bovis subsp bovis AF2122/97
ugccgagcuucagcgcgc

SEQ ID NO: 1157768 - RNA, 17 nt, Mycobacterium bovis subsp bovis AF2122/97
ugccgaguuccugcacg

SEQ ID NO: 1157769 - RNA, 15 nt, Mycobacterium bovis subsp bovis AF2122/97
ugccgauagcgcggc

SEQ ID NO: 1157770 - RNA, 22 nt, Mycobacterium bovis subsp bovis AF2122/97
ugccgaucaaccccccgggccc

SEQ ID NO: 1157771 - RNA, 14 nt, Mycobacterium bovis subsp bovis AF2122/97
ugccgaucagcagu

SEQ ID NO: 1157772 - RNA, 12 nt, Mycobacterium bovis subsp bovis AF2122/97
ugccgaucggcc

SEQ ID NO: 1157773 - RNA, 19 nt, Mycobacterium bovis subsp bovis AF2122/97
ugccgaucggccaacaggu

SEQ ID NO: 1157774 - RNA, 14 nt, Mycobacterium bovis subsp bovis AF2122/97
ugccgcacccccuc

SEQ ID NO: 1157775 - RNA, 15 nt, Mycobacterium bovis subsp bovis AF2122/97
ugccgcacccccucc

SEQ ID NO: 1157776 - RNA, 15 nt, Mycobacterium bovis subsp bovis AF2122/97
ugccgcaccggugcu

SEQ ID NO: 1157777 - RNA, 15 nt, Mycobacterium bovis subsp bovis AF2122/97
ugccgcacccagacc

SEQ ID NO: 1157778 - RNA, 16 nt, Mycobacterium bovis subsp bovis AF2122/97
ugccccacccgcggcg

SEQ ID NO: 1157779 - RNA, 23 nt, Mycobacterium bovis subsp bovis AF2122/97
ugcccgaaccaccaccggcaaca

SEQ ID NO: 1157780 - RNA, 16 nt, Mycobacterium bovis subsp bovis AF2122/97
ugcccccggcgcggcg

SEQ ID NO: 1157781 - RNA, 19 nt, Mycobacterium bovis subsp bovis AF2122/97
ugcccccauugccgccguc

SEQ ID NO: 1157782 - RNA, 23 nt, Mycobacterium bovis subsp bovis AF2122/97
ugccccaguccgaagcugcugcu

SEQ ID NO: 1157783 - RNA, 18 nt, Mycobacterium bovis subsp bovis AF2122/97
ugcccggcaaccuggacu

SEQ ID NO: 1157784 - RNA, 23 nt, Mycobacterium bovis subsp bovis AF2122/97
ugcccggcaaccuggacuggguc

SEQ ID NO: 1157785 - RNA, 19 nt, Mycobacterium bovis subsp bovis AF2122/97
ugcccgcugaucagauccu

SEQ ID NO: 1157786 - RNA, 19 nt, Mycobacterium bovis subsp bovis AF2122/97
ugcccgcguugccaaagcc

SEQ ID NO: 1157787 - RNA, 16 nt, Mycobacterium bovis subsp bovis AF2122/97
ugcccguucugcccag

SEQ ID NO: 1157788 - RNA, 20 nt, Mycobacterium bovis subsp bovis AF2122/97
ugcccucaacgaucgcgccg

SEQ ID NO: 1157789 - RNA, 18 nt, Mycobacterium bovis subsp bovis AF2122/97
ugcccguucugcccaggc

SEQ ID NO: 1157790 - RNA, 18 nt, Mycobacterium bovis subsp bovis AF2122/97
ugcccgagcccagcgccu

SEQ ID NO: 1157791 - RNA, 13 nt, Mycobacterium bovis subsp bovis AF2122/97
ugcccgacgaugc

SEQ ID NO: 1157792 - RNA, 23 nt, Mycobacterium bovis subsp bovis AF2122/97
ugcccgacccgccgacgccgccg

SEQ ID NO: 1157793 - RNA, 16 nt, Mycobacterium bovis subsp bovis AF2122/97
ugcccgacacccgcau

SEQ ID NO: 1157794 - RNA, 23 nt, Mycobacterium bovis subsp bovis AF2122/97
ugcccgacacccgcauggcagcg

SEQ ID NO: 1157795 - RNA, 23 nt, Mycobacterium bovis subsp bovis AF2122/97
ugcccgacaccgccccgccgcga

SEQ ID NO: 1157796 - RNA, 24 nt, Mycobacterium bovis subsp bovis AF2122/97
ugcccgcggugacgagcacaugcu

SEQ ID NO: 1157797 - RNA, 16 nt, Mycobacterium bovis subsp bovis AF2122/97
ugccggacaaccuggg

SEQ ID NO: 1157798 - RNA, 18 nt, Mycobacterium bovis subsp bovis AF2122/97
ugccggacagcucgcgcu

SEQ ID NO: 1157799 - RNA, 21 nt, Mycobacterium bovis subsp bovis AF2122/97
ugccggcauaaaccgcguccg

SEQ ID NO: 1157800 - RNA, 21 nt, Mycobacterium bovis subsp bovis AF2122/97
ugccggcgagagcgucaacca

SEQ ID NO: 1157801 - RNA, 19 nt, Mycobacterium bovis subsp bovis AF2122/97
ugccggcgagggccacggc

SEQ ID NO: 1157802 - RNA, 20 nt, Mycobacterium bovis subsp bovis AF2122/97
ugccggcgaccaggauuaag

SEQ ID NO: 1157803 - RNA, 22 nt, Mycobacterium bovis subsp bovis AF2122/97
ugccggcgaagccggccgggaa

SEQ ID NO: 1157804 - RNA, 17 nt, Mycobacterium bovis subsp bovis AF2122/97
ugccggcgaaggccagc

SEQ ID NO: 1157805 - RNA, 20 nt, Mycobacterium bovis subsp bovis AF2122/97
ugccggcgauguuggccagc

SEQ ID NO: 1157806 - RNA, 15 nt, Mycobacterium bovis subsp bovis AF2122/97
ugccggcgccacccc

SEQ ID NO: 1157807 - RNA, 17 nt, Mycobacterium bovis subsp bovis AF2122/97
ugccggcgcaccacacc

SEQ ID NO: 1157808 - RNA, 21 nt, Mycobacterium bovis subsp bovis AF2122/97
ugccgggaucgccguccagca

SEQ ID NO: 1157809 - RNA, 16 nt, Mycobacterium bovis subsp bovis AF2122/97
ugccgggaugccgccg

SEQ ID NO: 1157810 - RNA, 18 nt, Mycobacterium bovis subsp bovis AF2122/97
ugccgggggcccgaccug

SEQ ID NO: 1157811 - RNA, 14 nt, Mycobacterium bovis subsp bovis AF2122/97
ugccggggccccau

SEQ ID NO: 1157812 - RNA, 18 nt, Mycobacterium bovis subsp bovis AF2122/97
ugccgggcaccaccacac

SEQ ID NO: 1157813 - RNA, 20 nt, Mycobacterium bovis subsp bovis AF2122/97
ugccgggcccagcaggucgu

SEQ ID NO: 1157814 - RNA, 22 nt, Mycobacterium bovis subsp bovis AF2122/97
ugccgggcccagcaggucgucg

SEQ ID NO: 1157815 - RNA, 18 nt, Mycobacterium bovis subsp bovis AF2122/97
ugccgggccgccgagcgg

SEQ ID NO: 1157816 - RNA, 17 nt, Mycobacterium bovis subsp bovis AF2122/97
ugccgcgcagcgcggcg

SEQ ID NO: 1157817 - RNA, 20 nt, Mycobacterium bovis subsp bovis AF2122/97
ugccgcgaaugaagcccucg

SEQ ID NO: 1157818 - RNA, 16 nt, Mycobacterium bovis subsp bovis AF2122/97
ugccgccuugcuugcg

SEQ ID NO: 1157819 - RNA, 14 nt, Mycobacterium bovis subsp bovis AF2122/97
ugccgcgccacugu

SEQ ID NO: 1157820 - RNA, 15 nt, Mycobacterium bovis subsp bovis AF2122/97
ugccgcgcagcugcc

SEQ ID NO: 1157821 - RNA, 16 nt, Mycobacterium bovis subsp bovis AF2122/97
ugccgcgcagcugccg

SEQ ID NO: 1157822 - RNA, 20 nt, Mycobacterium bovis subsp bovis AF2122/97
ugccgcggcuaggccaagcc

SEQ ID NO: 1157823 - RNA, 21 nt, Mycobacterium bovis subsp bovis AF2122/97
ugccgcggccggcgugccagc

SEQ ID NO: 1157824 - RNA, 17 nt, Mycobacterium bovis subsp bovis AF2122/97
ugccgcggccaccgccg

SEQ ID NO: 1157825 - RNA, 13 nt, Mycobacterium bovis subsp bovis AF2122/97
ugccgcgcgcccg

SEQ ID NO: 1157826 - RNA, 20 nt, Mycobacterium bovis subsp bovis AF2122/97
ugccgcgguugugcugggug

SEQ ID NO: 1157827 - RNA, 20 nt, Mycobacterium bovis subsp bovis AF2122/97
ugccgcguagaacccaggcc

SEQ ID NO: 1157828 - RNA, 19 nt, Mycobacterium bovis subsp bovis AF2122/97
ugccgcguagguggccagc

SEQ ID NO: 1157829 - RNA, 17 nt, Mycobacterium bovis subsp bovis AF2122/97
ugccgcgggcagcgugu

SEQ ID NO: 1157830 - RNA, 23 nt, Mycobacterium bovis subsp bovis AF2122/97
ugccgcguagguggccagcgcgg

SEQ ID NO: 1157831 - RNA, 14 nt, Mycobacterium bovis subsp bovis AF2122/97
ugccggucauacca

SEQ ID NO: 1157832 - RNA, 17 nt, Mycobacterium bovis subsp bovis AF2122/97
ugccggugcgcaccagc

SEQ ID NO: 1157833 - RNA, 19 nt, Mycobacterium bovis subsp bovis AF2122/97
ugccgguaucccucaaggu

SEQ ID NO: 1157834 - RNA, 17 nt, Mycobacterium bovis subsp bovis AF2122/97
ugccgguaugcgccauc

SEQ ID NO: 1157835 - RNA, 18 nt, Mycobacterium bovis subsp bovis AF2122/97
ugccgguguugccgaagc

SEQ ID NO: 1157836 - RNA, 13 nt, Mycobacterium bovis subsp bovis AF2122/97
ugccguuccggcu

SEQ ID NO: 1157837 - RNA, 17 nt, Mycobacterium bovis subsp bovis AF2122/97
ugccguguucagcaccc

SEQ ID NO: 1157838 - RNA, 15 nt, Mycobacterium bovis subsp bovis AF2122/97
ugccgugccgggcca

SEQ ID NO: 1157839 - RNA, 19 nt, Mycobacterium bovis subsp bovis AF2122/97
ugccgugccggugugucca

SEQ ID NO: 1157840 - RNA, 18 nt, Mycobacterium bovis subsp bovis AF2122/97
ugccgugcggaucacucc

SEQ ID NO: 1157841 - RNA, 20 nt, Mycobacterium bovis subsp bovis AF2122/97
ugccucgcagccaacgcugu

SEQ ID NO: 1157842 - RNA, 21 nt, Mycobacterium bovis subsp bovis AF2122/97
ugccucgcgggaagucccgag

SEQ ID NO: 1157843 - RNA, 12 nt, Mycobacterium bovis subsp bovis AF2122/97
ugccuccaucaa

SEQ ID NO: 1157844 - RNA, 15 nt, Mycobacterium bovis subsp bovis AF2122/97
ugccugcuagcagca

SEQ ID NO: 1157845 - RNA, 16 nt, Mycobacterium bovis subsp bovis AF2122/97
ugccugcuagcagcag

SEQ ID NO: 1157846 - RNA, 22 nt, Mycobacterium bovis subsp bovis AF2122/97
ugccugcuggucggugaugguc

SEQ ID NO: 1157847 - RNA, 11 nt, Mycobacterium bovis subsp bovis AF2122/97
ugccuggcccg

SEQ ID NO: 1157848 - RNA, 14 nt, Mycobacterium bovis subsp bovis AF2122/97
ugccugggcggccg

SEQ ID NO: 1157849 - RNA, 16 nt, Mycobacterium bovis subsp bovis AF2122/97
ugcgccgcgcgcggcg

SEQ ID NO: 1157850 - RNA, 13 nt, Mycobacterium bovis subsp bovis AF2122/97
ugcgccgcgggcu

SEQ ID NO: 1157851 - RNA, 22 nt, Mycobacterium bovis subsp bovis AF2122/97
ugcgccggcguuugggcaucau

SEQ ID NO: 1157852 - RNA, 18 nt, Mycobacterium bovis subsp bovis AF2122/97
ugcgccggaccagcuccu

SEQ ID NO: 1157853 - RNA, 14 nt, Mycobacterium bovis subsp bovis AF2122/97
ugcgccgccagcgc

SEQ ID NO: 1157854 - RNA, 16 nt, Mycobacterium bovis subsp bovis AF2122/97
ugcgccgccggcgcgu

SEQ ID NO: 1157855 - RNA, 16 nt, Mycobacterium bovis subsp bovis AF2122/97
ugcgccgaggcauugc

SEQ ID NO: 1157856 - RNA, 18 nt, Mycobacterium bovis subsp bovis AF2122/97
ugcgccgauacccagcgg

SEQ ID NO: 1157857 - RNA, 16 nt, Mycobacterium bovis subsp bovis AF2122/97
ugcgccgaucccgccc

SEQ ID NO: 1157858 - RNA, 19 nt, Mycobacterium bovis subsp bovis AF2122/97
ugcgccgcacgccgaccgg

SEQ ID NO: 1157859 - RNA, 20 nt, Mycobacterium bovis subsp bovis AF2122/97
ugcgccgaacgcuccaggcc

SEQ ID NO: 1157860 - RNA, 21 nt, Mycobacterium bovis subsp bovis AF2122/97
ugcgccgaacgcuccaggccu

SEQ ID NO: 1157861 - RNA, 23 nt, Mycobacterium bovis subsp bovis AF2122/97
ugcgccaucacaucggccucuga

SEQ ID NO: 1157862 - RNA, 22 nt, Mycobacterium bovis subsp bovis AF2122/97
ugcgcccagcgacccggccagc

SEQ ID NO: 1157863 - RNA, 12 nt, Mycobacterium bovis subsp bovis AF2122/97
ugcgcccacccg

SEQ ID NO: 1157864 - RNA, 11 nt, Mycobacterium bovis subsp bovis AF2122/97
ugcgcccagca

SEQ ID NO: 1157865 - RNA, 17 nt, Mycobacterium bovis subsp bovis AF2122/97
ugcgccauugcgggaac

SEQ ID NO: 1157866 - RNA, 21 nt, Mycobacterium bovis subsp bovis AF2122/97
ugcgcccauagcugccggccc

SEQ ID NO: 1157867 - RNA, 12 nt, Mycobacterium bovis subsp bovis AF2122/97
ugccuucuuugc

SEQ ID NO: 1157868 - RNA, 17 nt, Mycobacterium bovis subsp bovis AF2122/97
ugccuucguagcggccg

SEQ ID NO: 1157869 - RNA, 20 nt, Mycobacterium bovis subsp bovis AF2122/97
ugccuuccucggcaaaccaa

SEQ ID NO: 1157870 - RNA, 19 nt, Mycobacterium bovis subsp bovis AF2122/97
ugcgccaggagcgcggccc

SEQ ID NO: 1157871 - RNA, 21 nt, Mycobacterium bovis subsp bovis AF2122/97
ugcgccaggagcgcggcccgc

SEQ ID NO: 1157872 - RNA, 23 nt, Mycobacterium bovis subsp bovis AF2122/97
ugcgccagcgagcgcaaaucgau

SEQ ID NO: 1157873 - RNA, 18 nt, Mycobacterium bovis subsp bovis AF2122/97
ugcgccaguaggcuucga

SEQ ID NO: 1157874 - RNA, 20 nt, Mycobacterium bovis subsp bovis AF2122/97
ugcgccagaucaccgucgac

SEQ ID NO: 1157875 - RNA, 18 nt, Mycobacterium bovis subsp bovis AF2122/97
ugcgccacgccacuucuu

SEQ ID NO: 1157876 - RNA, 15 nt, Mycobacterium bovis subsp bovis AF2122/97
ugcgcgaggggccgg

SEQ ID NO: 1157877 - RNA, 16 nt, Mycobacterium bovis subsp bovis AF2122/97
ugcgcgaccgaccagc

SEQ ID NO: 1157878 - RNA, 19 nt, Mycobacterium bovis subsp bovis AF2122/97
ugcgcgaccacccgccgca

SEQ ID NO: 1157879 - RNA, 21 nt, Mycobacterium bovis subsp bovis AF2122/97
ugcgccguggcaucgccucca

SEQ ID NO: 1157880 - RNA, 18 nt, Mycobacterium bovis subsp bovis AF2122/97
ugcgccguucgcuccccc

SEQ ID NO: 1157881 - RNA, 15 nt, Mycobacterium bovis subsp bovis AF2122/97
ugcgccguugccgcc

SEQ ID NO: 1157882 - RNA, 18 nt, Mycobacterium bovis subsp bovis AF2122/97
ugcgccgucgcagccagc

SEQ ID NO: 1157883 - RNA, 22 nt, Mycobacterium bovis subsp bovis AF2122/97
ugcgccgucggugggugccagc

SEQ ID NO: 1157884 - RNA, 20 nt, Mycobacterium bovis subsp bovis AF2122/97
ugcgccguguuccagguaca

SEQ ID NO: 1157885 - RNA, 15 nt, Mycobacterium bovis subsp bovis AF2122/97
ugcgccuccgggacg

SEQ ID NO: 1157886 - RNA, 18 nt, Mycobacterium bovis subsp bovis AF2122/97
ugcgccucggcggccagc

SEQ ID NO: 1157887 - RNA, 16 nt, Mycobacterium bovis subsp bovis AF2122/97
ugcgcggucgcgcgau

SEQ ID NO: 1157888 - RNA, 18 nt, Mycobacterium bovis subsp bovis AF2122/97
ugcgcggugacgagccac

SEQ ID NO: 1157889 - RNA, 22 nt, Mycobacterium bovis subsp bovis AF2122/97
ugcgcggugacgagccaccacc

SEQ ID NO: 1157890 - RNA, 16 nt, Mycobacterium bovis subsp bovis AF2122/97
ugcgcggugccggccg

SEQ ID NO: 1157891 - RNA, 13 nt, Mycobacterium bovis subsp bovis AF2122/97
ugcgcggcauccc

SEQ ID NO: 1157892 - RNA, 19 nt, Mycobacterium bovis subsp bovis AF2122/97
ugcgcgggcaucgucgucg

SEQ ID NO: 1157893 - RNA, 23 nt, Mycobacterium bovis subsp bovis AF2122/97
ugcgcggaguacuccagccgcaa

SEQ ID NO: 1157894 - RNA, 21 nt, Mycobacterium bovis subsp bovis AF2122/97
ugcgcggccauggcagcgcgc

SEQ ID NO: 1157895 - RNA, 15 nt, Mycobacterium bovis subsp bovis AF2122/97
ugcgcgcggccgcgc

SEQ ID NO: 1157896 - RNA, 21 nt, Mycobacterium bovis subsp bovis AF2122/97
ugcgcgccgauaugcgugagc

SEQ ID NO: 1157897 - RNA, 15 nt, Mycobacterium bovis subsp bovis AF2122/97
ugcgcgcccgggcgg

SEQ ID NO: 1157898 - RNA, 21 nt, Mycobacterium bovis subsp bovis AF2122/97
ugcgcgccauuggcgccgccg

SEQ ID NO: 1157899 - RNA, 14 nt, Mycobacterium bovis subsp bovis AF2122/97
ugcgcgccaggcuc

SEQ ID NO: 1157900 - RNA, 13 nt, Mycobacterium bovis subsp bovis AF2122/97
ugcgcgccagaca

SEQ ID NO: 1157901 - RNA, 15 nt, Mycobacterium bovis subsp bovis AF2122/97
ugcgcgugcugcgga

SEQ ID NO: 1157902 - RNA, 21 nt, Mycobacterium bovis subsp bovis AF2122/97
ugcgcguuacccaucgccaca

SEQ ID NO: 1157903 - RNA, 19 nt, Mycobacterium bovis subsp bovis AF2122/97
ugcgcgucgagcagcacca

SEQ ID NO: 1157904 - RNA, 18 nt, Mycobacterium bovis subsp bovis AF2122/97
ugcgcgucagccgcaccc

SEQ ID NO: 1157905 - RNA, 16 nt, Mycobacterium bovis subsp bovis AF2122/97
ugcgcgucaggccagc

SEQ ID NO: 1157906 - RNA, 16 nt, Mycobacterium bovis subsp bovis AF2122/97
ugcgcguggcagugca

SEQ ID NO: 1157907 - RNA, 15 nt, Mycobacterium bovis subsp bovis AF2122/97
ugcgcgucgcgcgcg

SEQ ID NO: 1157908 - RNA, 14 nt, Mycobacterium bovis subsp bovis AF2122/97
ugcgcucacugcag

SEQ ID NO: 1157909 - RNA, 16 nt, Mycobacterium bovis subsp bovis AF2122/97
ugcggaaacccggccg

SEQ ID NO: 1157910 - RNA, 17 nt, Mycobacterium bovis subsp bovis AF2122/97
ugcggaaacccggccgc

SEQ ID NO: 1157911 - RNA, 13 nt, Mycobacterium bovis subsp bovis AF2122/97
ugcggaaaucgga

SEQ ID NO: 1157912 - RNA, 19 nt, Mycobacterium bovis subsp bovis AF2122/97
ugcggacuggcauccgccc

SEQ ID NO: 1157913 - RNA, 17 nt, Mycobacterium bovis subsp bovis AF2122/97
ugcggacuucgccgccc

SEQ ID NO: 1157914 - RNA, 18 nt, Mycobacterium bovis subsp bovis AF2122/97
ugcggaucggcggaccgc

SEQ ID NO: 1157915 - RNA, 19 nt, Mycobacterium bovis subsp bovis AF2122/97
ugcggccgaauuccucaag

SEQ ID NO: 1157916 - RNA, 14 nt, Mycobacterium bovis subsp bovis AF2122/97
ugcggccgggucgc

SEQ ID NO: 1157917 - RNA, 23 nt, Mycobacterium bovis subsp bovis AF2122/97
ugcggcccucgagcagugccgug

SEQ ID NO: 1157918 - RNA, 21 nt, Mycobacterium bovis subsp bovis AF2122/97
ugcggccgcugaucaacagac

SEQ ID NO: 1157919 - RNA, 14 nt, Mycobacterium bovis subsp bovis AF2122/97
ugcggccuagggcg

SEQ ID NO: 1157920 - RNA, 15 nt, Mycobacterium bovis subsp bovis AF2122/97
ugcggcccacaccag

SEQ ID NO: 1157921 - RNA, 21 nt, Mycobacterium bovis subsp bovis AF2122/97
ugcggcccacaccagcgcagc

SEQ ID NO: 1157922 - RNA, 15 nt, Mycobacterium bovis subsp bovis AF2122/97
ugcggccagcgcggc

SEQ ID NO: 1157923 - RNA, 24 nt, Mycobacterium bovis subsp bovis AF2122/97
ugcggccauggucggucaagucug

SEQ ID NO: 1157924 - RNA, 14 nt, Mycobacterium bovis subsp bovis AF2122/97
ugcggcauggcagg

SEQ ID NO: 1157925 - RNA, 23 nt, Mycobacterium bovis subsp bovis AF2122/97
ugcgggcccucuaugcgggcagc

SEQ ID NO: 1157926 - RNA, 15 nt, Mycobacterium bovis subsp bovis AF2122/97
ugcgggccgccaggc

SEQ ID NO: 1157927 - RNA, 14 nt, Mycobacterium bovis subsp bovis AF2122/97
ugcgggccaucaag

SEQ ID NO: 1157928 - RNA, 13 nt, Mycobacterium bovis subsp bovis AF2122/97
ugcgggccaggcc

SEQ ID NO: 1157929 - RNA, 16 nt, Mycobacterium bovis subsp bovis AF2122/97
ugcgggccgugacccu

SEQ ID NO: 1157930 - RNA, 11 nt, Mycobacterium bovis subsp bovis AF2122/97
ugcgggcuagg

SEQ ID NO: 1157931 - RNA, 19 nt, Mycobacterium bovis subsp bovis AF2122/97
ugcgggcggugcacaccgu

SEQ ID NO: 1157932 - RNA, 22 nt, Mycobacterium bovis subsp bovis AF2122/97
ugcggcgcccggucgagccagc

SEQ ID NO: 1157933 - RNA, 19 nt, Mycobacterium bovis subsp bovis AF2122/97
ugcggcgaggacgcgcccg

SEQ ID NO: 1157934 - RNA, 18 nt, Mycobacterium bovis subsp bovis AF2122/97
ugcggucgcggcugacaa

SEQ ID NO: 1157935 - RNA, 16 nt, Mycobacterium bovis subsp bovis AF2122/97
ugcggucgagagccaa

SEQ ID NO: 1157936 - RNA, 22 nt, Mycobacterium bovis subsp bovis AF2122/97
ugcggucuccgcccgcgggccc

SEQ ID NO: 1157937 - RNA, 21 nt, Mycobacterium bovis subsp bovis AF2122/97
ugcggugaccgugaacggcuc

SEQ ID NO: 1157938 - RNA, 20 nt, Mycobacterium bovis subsp bovis AF2122/97
ugcggugcaucgccaccacc

SEQ ID NO: 1157939 - RNA, 13 nt, Mycobacterium bovis subsp bovis AF2122/97
ugcggggccgggc

SEQ ID NO: 1157940 - RNA, 21 nt, Mycobacterium bovis subsp bovis AF2122/97
ugcggggauuggugcccagcg

SEQ ID NO: 1157941 - RNA, 24 nt, Mycobacterium bovis subsp bovis AF2122/97
ugcggggguacgucaccggguccg

SEQ ID NO: 1157942 - RNA, 22 nt, Mycobacterium bovis subsp bovis AF2122/97
ugcgggguugaccguggucgga

SEQ ID NO: 1157943 - RNA, 15 nt, Mycobacterium bovis subsp bovis AF2122/97
ugcgggguuggccgu

SEQ ID NO: 1157944 - RNA, 22 nt, Mycobacterium bovis subsp bovis AF2122/97
ugcggucauauaggagcgggug

SEQ ID NO: 1157945 - RNA, 14 nt, Mycobacterium bovis subsp bovis AF2122/97
ugcgguccaggccg

SEQ ID NO: 1157946 - RNA, 16 nt, Mycobacterium bovis subsp bovis AF2122/97
ugcgucugcucgcccu

SEQ ID NO: 1157947 - RNA, 14 nt, Mycobacterium bovis subsp bovis AF2122/97
ugcgugccggcagc

SEQ ID NO: 1157948 - RNA, 23 nt, Mycobacterium bovis subsp bovis AF2122/97
ugcggugcuaugcaacaccgcac

SEQ ID NO: 1157949 - RNA, 12 nt, Mycobacterium bovis subsp bovis AF2122/97
ugcgguggcagg

SEQ ID NO: 1157950 - RNA, 22 nt, Mycobacterium bovis subsp bovis AF2122/97
ugcggugguaggacgccagcaa

SEQ ID NO: 1157951 - RNA, 15 nt, Mycobacterium bovis subsp bovis AF2122/97
ugcggugggccaggu

SEQ ID NO: 1157952 - RNA, 16 nt, Mycobacterium bovis subsp bovis AF2122/97
ugcggugggccagguu

SEQ ID NO: 1157953 - RNA, 22 nt, Mycobacterium bovis subsp bovis AF2122/97
ugcgguuguucgugaagcgggu

SEQ ID NO: 1157954 - RNA, 23 nt, Mycobacterium bovis subsp bovis AF2122/97
ugcgguuguucgugaagcgggug

SEQ ID NO: 1157955 - RNA, 14 nt, Mycobacterium bovis subsp bovis AF2122/97
ugcugcccaucccg

SEQ ID NO: 1157956 - RNA, 21 nt, Mycobacterium bovis subsp bovis AF2122/97
ugcugccccauaaacucugug

SEQ ID NO: 1157957 - RNA, 15 nt, Mycobacterium bovis subsp bovis AF2122/97
ugcugccauugccgc

SEQ ID NO: 1157958 - RNA, 20 nt, Mycobacterium bovis subsp bovis AF2122/97
ugcugccaacgggccauggg

SEQ ID NO: 1157959 - RNA, 21 nt, Mycobacterium bovis subsp bovis AF2122/97
ugcugcagacccguucgccgu

SEQ ID NO: 1157960 - RNA, 12 nt, Mycobacterium bovis subsp bovis AF2122/97
ugcugcaccugg

SEQ ID NO: 1157961 - RNA, 16 nt, Mycobacterium bovis subsp bovis AF2122/97
ugcugcagggccuggc

SEQ ID NO: 1157962 - RNA, 16 nt, Mycobacterium bovis subsp bovis AF2122/97
ugcugcaugccgaccc

SEQ ID NO: 1157963 - RNA, 15 nt, Mycobacterium bovis subsp bovis AF2122/97
ugcugcacccggaga

SEQ ID NO: 1157964 - RNA, 12 nt, Mycobacterium bovis subsp bovis AF2122/97
ugcugcaaggaa

SEQ ID NO: 1157965 - RNA, 16 nt, Mycobacterium bovis subsp bovis AF2122/97
ugcugaugggucaggc

SEQ ID NO: 1157966 - RNA, 21 nt, Mycobacterium bovis subsp bovis AF2122/97
ugcucgucggccaccgcggcg

SEQ ID NO: 1157967 - RNA, 22 nt, Mycobacterium bovis subsp bovis AF2122/97
ugcucgucggcgccggcggccg

SEQ ID NO: 1157968 - RNA, 22 nt, Mycobacterium bovis subsp bovis AF2122/97
ugcucguguuguugaagcccga

SEQ ID NO: 1157969 - RNA, 22 nt, Mycobacterium bovis subsp bovis AF2122/97
ugcucgucauccauccgggccg

SEQ ID NO: 1157970 - RNA, 22 nt, Mycobacterium bovis subsp bovis AF2122/97
ugcucguaggugccgaagauga

SEQ ID NO: 1157971 - RNA, 14 nt, Mycobacterium bovis subsp bovis AF2122/97
ugcucguccaagcc

SEQ ID NO: 1157972 - RNA, 14 nt, Mycobacterium bovis subsp bovis AF2122/97
ugcucguccacccc

SEQ ID NO: 1157973 - RNA, 21 nt, Mycobacterium bovis subsp bovis AF2122/97
ugcucggugaugcccagcgcc

SEQ ID NO: 1157974 - RNA, 17 nt, Mycobacterium bovis subsp bovis AF2122/97
ugcucgucgagccgacc

SEQ ID NO: 1157975 - RNA, 14 nt, Mycobacterium bovis subsp bovis AF2122/97
ugcucguguuguug

SEQ ID NO: 1157976 - RNA, 20 nt, Mycobacterium bovis subsp bovis AF2122/97
ugcugagcguaggccagcga

SEQ ID NO: 1157977 - RNA, 15 nt, Mycobacterium bovis subsp bovis AF2122/97
ugcugagucgguuca

SEQ ID NO: 1157978 - RNA, 17 nt, Mycobacterium bovis subsp bovis AF2122/97
ugcugagcguaggccag

SEQ ID NO: 1157979 - RNA, 22 nt, Mycobacterium bovis subsp bovis AF2122/97
ugcugacgguggggauggcgcc

SEQ ID NO: 1157980 - RNA, 12 nt, Mycobacterium bovis subsp bovis AF2122/97
ugcugacggugc

SEQ ID NO: 1157981 - RNA, 20 nt, Mycobacterium bovis subsp bovis AF2122/97
ugcugacggugcaggaccag

SEQ ID NO: 1157982 - RNA, 23 nt, Mycobacterium bovis subsp bovis AF2122/97
ugcugagcaaguccugcagcugg

SEQ ID NO: 1157983 - RNA, 15 nt, Mycobacterium bovis subsp bovis AF2122/97
ugcguuggaugaagu

SEQ ID NO: 1157984 - RNA, 21 nt, Mycobacterium bovis subsp bovis AF2122/97
ugcguugggaucccagcgcag

SEQ ID NO: 1157985 - RNA, 17 nt, Mycobacterium bovis subsp bovis AF2122/97
ugcucgacgaggccacg

SEQ ID NO: 1157986 - RNA, 18 nt, Mycobacterium bovis subsp bovis AF2122/97
ugcucgacgcccgccacc

SEQ ID NO: 1157987 - RNA, 16 nt, Mycobacterium bovis subsp bovis AF2122/97
ugcucgacggcuccga

SEQ ID NO: 1157988 - RNA, 19 nt, Mycobacterium bovis subsp bovis AF2122/97
ugcucgagcaccucggccu

SEQ ID NO: 1157989 - RNA, 19 nt, Mycobacterium bovis subsp bovis AF2122/97
ugcucgaucugucgcgccg

SEQ ID NO: 1157990 - RNA, 14 nt, Mycobacterium bovis subsp bovis AF2122/97
ugcucgaugaucag

SEQ ID NO: 1157991 - RNA, 14 nt, Mycobacterium bovis subsp bovis AF2122/97
ugcucgccaggcaa

SEQ ID NO: 1157992 - RNA, 16 nt, Mycobacterium bovis subsp bovis AF2122/97
ugcucguaggugccga

SEQ ID NO: 1157993 - RNA, 21 nt, Mycobacterium bovis subsp bovis AF2122/97
ugcucguagacuugcugcucc

SEQ ID NO: 1157994 - RNA, 22 nt, Mycobacterium bovis subsp bovis AF2122/97
ugcucguagacuugcugcuccu

SEQ ID NO: 1157995 - RNA, 19 nt, Mycobacterium bovis subsp bovis AF2122/97
ugcucgccgaccagcuuga

SEQ ID NO: 1157996 - RNA, 19 nt, Mycobacterium bovis subsp bovis AF2122/97
ugcucgccggaucuugccg

SEQ ID NO: 1157997 - RNA, 12 nt, Mycobacterium bovis subsp bovis AF2122/97
ugcucgccggcc

SEQ ID NO: 1157998 - RNA, 20 nt, Mycobacterium bovis subsp bovis AF2122/97
ugcuccugcguccagaucuc

SEQ ID NO: 1157999 - RNA, 17 nt, Mycobacterium bovis subsp bovis AF2122/97
ugcuccugguggcagaa

SEQ ID NO: 1158000 - RNA, 17 nt, Mycobacterium bovis subsp bovis AF2122/97
ugcuccgcagcagacuc

SEQ ID NO: 1158001 - RNA, 21 nt, Mycobacterium bovis subsp bovis AF2122/97
ugcuccgcagcagacuccguu

SEQ ID NO: 1158002 - RNA, 17 nt, Mycobacterium bovis subsp bovis AF2122/97
ugcugccgaccuuccgu

SEQ ID NO: 1158003 - RNA, 13 nt, Mycobacterium bovis subsp bovis AF2122/97
ugcugccuuugcg

SEQ ID NO: 1158004 - RNA, 14 nt, Mycobacterium bovis subsp bovis AF2122/97
ugcugcucgugagc

SEQ ID NO: 1158005 - RNA, 15 nt, Mycobacterium bovis subsp bovis AF2122/97
ugcugccgcacacgc

SEQ ID NO: 1158006 - RNA, 20 nt, Mycobacterium bovis subsp bovis AF2122/97
ugcugccgcacacgcgugca

SEQ ID NO: 1158007 - RNA, 17 nt, Mycobacterium bovis subsp bovis AF2122/97
ugcugggcccgccagcc

SEQ ID NO: 1158008 - RNA, 21 nt, Mycobacterium bovis subsp bovis AF2122/97
ugcuggggccuggucccaccg

SEQ ID NO: 1158009 - RNA, 22 nt, Mycobacterium bovis subsp bovis AF2122/97
ugcuugcagggccacuggccgg

SEQ ID NO: 1158010 - RNA, 13 nt, Mycobacterium bovis subsp bovis AF2122/97
ugcuugcagggcc

SEQ ID NO: 1158011 - RNA, 22 nt, Mycobacterium bovis subsp bovis AF2122/97
ugagcaguucguuccagaugag

SEQ ID NO: 1158012 - RNA, 16 nt, Mycobacterium bovis subsp bovis AF2122/97
ugagcauggcuagggc

SEQ ID NO: 1158013 - RNA, 13 nt, Mycobacterium bovis subsp bovis AF2122/97
ugagcaugcccag

SEQ ID NO: 1158014 - RNA, 18 nt, Mycobacterium bovis subsp bovis AF2122/97
ugagucgaaaacagcgau

SEQ ID NO: 1158015 - RNA, 16 nt, Mycobacterium bovis subsp bovis AF2122/97
ugaguccgcugagcgg

SEQ ID NO: 1158016 - RNA, 20 nt, Mycobacterium bovis subsp bovis AF2122/97
ugaguccccaggugggcagc

SEQ ID NO: 1158017 - RNA, 18 nt, Mycobacterium bovis subsp bovis AF2122/97
ugaguucggccaccaacc

SEQ ID NO: 1158018 - RNA, 11 nt, Mycobacterium bovis subsp bovis AF2122/97
ugaguucggug

SEQ ID NO: 1158019 - RNA, 15 nt, Mycobacterium bovis subsp bovis AF2122/97
ugaguucggccacca

SEQ ID NO: 1158020 - RNA, 17 nt, Mycobacterium bovis subsp bovis AF2122/97
ugauacagcgccagggg

SEQ ID NO: 1158021 - RNA, 17 nt, Mycobacterium bovis subsp bovis AF2122/97
ugauaggcgcgcaguga

SEQ ID NO: 1158022 - RNA, 13 nt, Mycobacterium bovis subsp bovis AF2122/97
ugaucaccaaccc

SEQ ID NO: 1158023 - RNA, 16 nt, Mycobacterium bovis subsp bovis AF2122/97
ugaucacaccgagcgc

SEQ ID NO: 1158024 - RNA, 18 nt, Mycobacterium bovis subsp bovis AF2122/97
ugaucagggucagcgccg

SEQ ID NO: 1158025 - RNA, 18 nt, Mycobacterium bovis subsp bovis AF2122/97
ugaucaggccccacacga

SEQ ID NO: 1158026 - RNA, 16 nt, Mycobacterium bovis subsp bovis AF2122/97
ugaucuggcaacgcgu

SEQ ID NO: 1158027 - RNA, 21 nt, Mycobacterium bovis subsp bovis AF2122/97
ugaucugggcugcggccgcga

SEQ ID NO: 1158028 - RNA, 21 nt, Mycobacterium bovis subsp bovis AF2122/97
ugaucucgccggugagccgga

SEQ ID NO: 1158029 - RNA, 14 nt, Mycobacterium bovis subsp bovis AF2122/97
ugaucggugcccaa

SEQ ID NO: 1158030 - RNA, 17 nt, Mycobacterium bovis subsp bovis AF2122/97
ugaucguccagcccaga

SEQ ID NO: 1158031 - RNA, 12 nt, Mycobacterium bovis subsp bovis AF2122/97
ugaucaugaacg

SEQ ID NO: 1158032 - RNA, 22 nt, Mycobacterium bovis subsp bovis AF2122/97
ugaugaucgguucgggacgcga

SEQ ID NO: 1158033 - RNA, 16 nt, Mycobacterium bovis subsp bovis AF2122/97
ugaugaacagacgccc

SEQ ID NO: 1158034 - RNA, 16 nt, Mycobacterium bovis subsp bovis AF2122/97
ugaucuuggcccgggc

SEQ ID NO: 1158035 - RNA, 22 nt, Mycobacterium bovis subsp bovis AF2122/97
ugaucuugccacuccaggagcc

SEQ ID NO: 1158036 - RNA, 18 nt, Mycobacterium bovis subsp bovis AF2122/97
ugaucuugccgcccuuga

SEQ ID NO: 1158037 - RNA, 22 nt, Mycobacterium bovis subsp bovis AF2122/97
ugauugcggaacaccaccaggc

SEQ ID NO: 1158038 - RNA, 22 nt, Mycobacterium bovis subsp bovis AF2122/97
ugauugcgaccgcgccaacaga

SEQ ID NO: 1158039 - RNA, 16 nt, Mycobacterium bovis subsp bovis AF2122/97
ugaugcgccccggagc

SEQ ID NO: 1158040 - RNA, 19 nt, Mycobacterium bovis subsp bovis AF2122/97
ugaugccuggucgcggggc

SEQ ID NO: 1158041 - RNA, 14 nt, Mycobacterium bovis subsp bovis AF2122/97
ugauuccacugggc

SEQ ID NO: 1158042 - RNA, 12 nt, Mycobacterium bovis subsp bovis AF2122/97
ugcaccagcuca

SEQ ID NO: 1158043 - RNA, 20 nt, Mycobacterium bovis subsp bovis AF2122/97
ugcaccagcucacccggagc

SEQ ID NO: 1158044 - RNA, 23 nt, Mycobacterium bovis subsp bovis AF2122/97
ugcaccagcucggugaucaccau

SEQ ID NO: 1158045 - RNA, 20 nt, Mycobacterium bovis subsp bovis AF2122/97
ugcacccacaucaccaaaaa

SEQ ID NO: 1158046 - RNA, 20 nt, Mycobacterium bovis subsp bovis AF2122/97
ugcacccaccccgaagaugc

SEQ ID NO: 1158047 - RNA, 22 nt, Mycobacterium bovis subsp bovis AF2122/97
ugcacccaggcaucggugagcc

SEQ ID NO: 1158048 - RNA, 18 nt, Mycobacterium bovis subsp bovis AF2122/97
ugcaccagcgaccagguc

SEQ ID NO: 1158049 - RNA, 18 nt, Mycobacterium bovis subsp bovis AF2122/97
ugcaccagguugcaaccu

SEQ ID NO: 1158050 - RNA, 16 nt, Mycobacterium bovis subsp bovis AF2122/97
ugcaccauucgcaccg

SEQ ID NO: 1158051 - RNA, 13 nt, Mycobacterium bovis subsp bovis AF2122/97
ugcacccgggccg

SEQ ID NO: 1158052 - RNA, 18 nt, Mycobacterium bovis subsp bovis AF2122/97
ugcaccgaagauggccag

SEQ ID NO: 1158053 - RNA, 19 nt, Mycobacterium bovis subsp bovis AF2122/97
ugcaccgaagauggccagc

SEQ ID NO: 1158054 - RNA, 16 nt, Mycobacterium bovis subsp bovis AF2122/97
ugcaccgaagauggcc

SEQ ID NO: 1158055 - RNA, 18 nt, Mycobacterium bovis subsp bovis AF2122/97
ugcacccggagaaucggu

SEQ ID NO: 1158056 - RNA, 13 nt, Mycobacterium bovis subsp bovis AF2122/97
ugcacccgcaccg

SEQ ID NO: 1158057 - RNA, 21 nt, Mycobacterium bovis subsp bovis AF2122/97
ugcaauuucagccuuguugcc

SEQ ID NO: 1158058 - RNA, 18 nt, Mycobacterium bovis subsp bovis AF2122/97
ugcacgcgauggccauca

SEQ ID NO: 1158059 - RNA, 19 nt, Mycobacterium bovis subsp bovis AF2122/97
ugcacgcggacaugacagc

SEQ ID NO: 1158060 - RNA, 18 nt, Mycobacterium bovis subsp bovis AF2122/97
ugcacgcaccacaaucca

SEQ ID NO: 1158061 - RNA, 15 nt, Mycobacterium bovis subsp bovis AF2122/97
ugcacgcacagcccg

SEQ ID NO: 1158062 - RNA, 20 nt, Mycobacterium bovis subsp bovis AF2122/97
ugcacgcucugcgccacagc

SEQ ID NO: 1158063 - RNA, 22 nt, Mycobacterium bovis subsp bovis AF2122/97
ugcacgcucugcgccacagcag

SEQ ID NO: 1158064 - RNA, 20 nt, Mycobacterium bovis subsp bovis AF2122/97
ugcacgcgggcguuggccag

SEQ ID NO: 1158065 - RNA, 22 nt, Mycobacterium bovis subsp bovis AF2122/97
ugcacgcgggcguuggccagca

SEQ ID NO: 1158066 - RNA, 20 nt, Mycobacterium bovis subsp bovis AF2122/97
ugcacgcgggugccgacguc

SEQ ID NO: 1158067 - RNA, 13 nt, Mycobacterium bovis subsp bovis AF2122/97
ugcaccgcggcca

SEQ ID NO: 1158068 - RNA, 21 nt, Mycobacterium bovis subsp bovis AF2122/97
ugcaccggcuugggccaggcc

SEQ ID NO: 1158069 - RNA, 20 nt, Mycobacterium bovis subsp bovis AF2122/97
ugcaccgcauuguugaagaa

SEQ ID NO: 1158070 - RNA, 16 nt, Mycobacterium bovis subsp bovis AF2122/97
ugcaccgccgccgccc

SEQ ID NO: 1158071 - RNA, 19 nt, Mycobacterium bovis subsp bovis AF2122/97
ugcaccgagaaagugcagu

SEQ ID NO: 1158072 - RNA, 19 nt, Mycobacterium bovis subsp bovis AF2122/97
ugcaccucguguccgggga

SEQ ID NO: 1158073 - RNA, 20 nt, Mycobacterium bovis subsp bovis AF2122/97
ugcaccuccgacggccgcgg

SEQ ID NO: 1158074 - RNA, 16 nt, Mycobacterium bovis subsp bovis AF2122/97
ugcaccguuguaugcu

SEQ ID NO: 1158075 - RNA, 15 nt, Mycobacterium bovis subsp bovis AF2122/97
ugcaacucggcagau

SEQ ID NO: 1158076 - RNA, 21 nt, Mycobacterium bovis subsp bovis AF2122/97
ugcaaccgugccgcaucaccc

SEQ ID NO: 1158077 - RNA, 19 nt, Mycobacterium bovis subsp bovis AF2122/97
ugcaaccccaaguccagca

SEQ ID NO: 1158078 - RNA, 22 nt, Mycobacterium bovis subsp bovis AF2122/97
ugcaaccccaaguccagcagcg

SEQ ID NO: 1158079 - RNA, 21 nt, Mycobacterium bovis subsp bovis AF2122/97
ugcaacggugaaucgaagccc

SEQ ID NO: 1158080 - RNA, 19 nt, Mycobacterium bovis subsp bovis AF2122/97
ugcaacgauugaacucugg

SEQ ID NO: 1158081 - RNA, 12 nt, Mycobacterium bovis subsp bovis AF2122/97
ugcaacacaccg

SEQ ID NO: 1158082 - RNA, 15 nt, Mycobacterium bovis subsp bovis AF2122/97
ugcaacaccgcaccg

SEQ ID NO: 1158083 - RNA, 18 nt, Mycobacterium bovis subsp bovis AF2122/97
ugcaaauuuguucuggug

SEQ ID NO: 1158084 - RNA, 13 nt, Mycobacterium bovis subsp bovis AF2122/97
ugacgggccgcug

SEQ ID NO: 1158085 - RNA, 16 nt, Mycobacterium bovis subsp bovis AF2122/97
ugacgggcagaggcug

SEQ ID NO: 1158086 - RNA, 18 nt, Mycobacterium bovis subsp bovis AF2122/97
ugacgguacagcuccaca

SEQ ID NO: 1158087 - RNA, 15 nt, Mycobacterium bovis subsp bovis AF2122/97
ugacggugcaggacc

SEQ ID NO: 1158088 - RNA, 12 nt, Mycobacterium bovis subsp bovis AF2122/97
ugacguccaaca

SEQ ID NO: 1158089 - RNA, 20 nt, Mycobacterium bovis subsp bovis AF2122/97
ugacguagucgucuucguca

SEQ ID NO: 1158090 - RNA, 12 nt, Mycobacterium bovis subsp bovis AF2122/97
ugacguagacgg

SEQ ID NO: 1158091 - RNA, 19 nt, Mycobacterium bovis subsp bovis AF2122/97
ugacgucgcggauugccgc

SEQ ID NO: 1158092 - RNA, 12 nt, Mycobacterium bovis subsp bovis AF2122/97
ugacgugcauga

SEQ ID NO: 1158093 - RNA, 15 nt, Mycobacterium bovis subsp bovis AF2122/97
ugacguuagcauuga

SEQ ID NO: 1158094 - RNA, 16 nt, Mycobacterium bovis subsp bovis AF2122/97
ugacugaacucaacac

SEQ ID NO: 1158095 - RNA, 18 nt, Mycobacterium bovis subsp bovis AF2122/97
ugacucugcguccaccac

SEQ ID NO: 1158096 - RNA, 19 nt, Mycobacterium bovis subsp bovis AF2122/97
ugacucugcguccaccgga

SEQ ID NO: 1158097 - RNA, 17 nt, Mycobacterium bovis subsp bovis AF2122/97
ugagaaccggcucacca

SEQ ID NO: 1158098 - RNA, 20 nt, Mycobacterium bovis subsp bovis AF2122/97
ugagacaaaggugccgaccg

SEQ ID NO: 1158099 - RNA, 20 nt, Mycobacterium bovis subsp bovis AF2122/97
ugagcaaguccugcagcugg

SEQ ID NO: 1158100 - RNA, 23 nt, Mycobacterium bovis subsp bovis AF2122/97
ugagcaacuggcauuucagcugg

SEQ ID NO: 1158101 - RNA, 21 nt, Mycobacterium bovis subsp bovis AF2122/97
ugagcaagaaguacgugcaca

SEQ ID NO: 1158102 - RNA, 14 nt, Mycobacterium bovis subsp bovis AF2122/97
ugagcaaguccugc

SEQ ID NO: 1158103 - RNA, 16 nt, Mycobacterium bovis subsp bovis AF2122/97
ugagacgccggggaac

SEQ ID NO: 1158104 - RNA, 23 nt, Mycobacterium bovis subsp bovis AF2122/97
ugacccguacccacgacgggccg

SEQ ID NO: 1158105 - RNA, 14 nt, Mycobacterium bovis subsp bovis AF2122/97
ugaccgaagaagcc

SEQ ID NO: 1158106 - RNA, 17 nt, Mycobacterium bovis subsp bovis AF2122/97
ugaccgaagucugcaga

SEQ ID NO: 1158107 - RNA, 15 nt, Mycobacterium bovis subsp bovis AF2122/97
ugaccgcagucccag

SEQ ID NO: 1158108 - RNA, 20 nt, Mycobacterium bovis subsp bovis AF2122/97
ugaccgcaucgucgagccac

SEQ ID NO: 1158109 - RNA, 18 nt, Mycobacterium bovis subsp bovis AF2122/97
ugaccgccaucgccaaca

SEQ ID NO: 1158110 - RNA, 18 nt, Mycobacterium bovis subsp bovis AF2122/97
ugaccgcaccggccgcua

SEQ ID NO: 1158111 - RNA, 22 nt, Mycobacterium bovis subsp bovis AF2122/97
ugaccaacgucgcuccgaugug

SEQ ID NO: 1158112 - RNA, 15 nt, Mycobacterium bovis subsp bovis AF2122/97
ugaccagcagcucgu

SEQ ID NO: 1158113 - RNA, 14 nt, Mycobacterium bovis subsp bovis AF2122/97
ugaccagcagcuga

SEQ ID NO: 1158114 - RNA, 14 nt, Mycobacterium bovis subsp bovis AF2122/97
ugaccagcacaccg

SEQ ID NO: 1158115 - RNA, 12 nt, Mycobacterium bovis subsp bovis AF2122/97
ugaccagcuucg

SEQ ID NO: 1158116 - RNA, 21 nt, Mycobacterium bovis subsp bovis AF2122/97
ugaccaggccgagcucguugc

SEQ ID NO: 1158117 - RNA, 17 nt, Mycobacterium bovis subsp bovis AF2122/97
ugaccagggucugcuca

SEQ ID NO: 1158118 - RNA, 16 nt, Mycobacterium bovis subsp bovis AF2122/97
ugaccagucgcggcgu

SEQ ID NO: 1158119 - RNA, 15 nt, Mycobacterium bovis subsp bovis AF2122/97
ugacccgcugggccg

SEQ ID NO: 1158120 - RNA, 10 nt, Mycobacterium bovis subsp bovis AF2122/97
ugaccaggug

SEQ ID NO: 1158121 - RNA, 22 nt, Mycobacterium bovis subsp bovis AF2122/97
ugacaucggccaagguugucgc

SEQ ID NO: 1158122 - RNA, 15 nt, Mycobacterium bovis subsp bovis AF2122/97
ugacaucggucagca

SEQ ID NO: 1158123 - RNA, 20 nt, Mycobacterium bovis subsp bovis AF2122/97
ugacauccuugacgcggcca

SEQ ID NO: 1158124 - RNA, 14 nt, Mycobacterium bovis subsp bovis AF2122/97
ugacgaacaagaaa

SEQ ID NO: 1158125 - RNA, 16 nt, Mycobacterium bovis subsp bovis AF2122/97
ugacgaacaugccaug

SEQ ID NO: 1158126 - RNA, 14 nt, Mycobacterium bovis subsp bovis AF2122/97
ugacgaacccaccg

SEQ ID NO: 1158127 - RNA, 14 nt, Mycobacterium bovis subsp bovis AF2122/97
ugacgaaucgccua

SEQ ID NO: 1158128 - RNA, 18 nt, Mycobacterium bovis subsp bovis AF2122/97
ugaccuuggccgugcccg

SEQ ID NO: 1158129 - RNA, 15 nt, Mycobacterium bovis subsp bovis AF2122/97
ugacgaaagcgccca

SEQ ID NO: 1158130 - RNA, 18 nt, Mycobacterium bovis subsp bovis AF2122/97
ugaccgcggucugcgcgu

SEQ ID NO: 1158131 - RNA, 19 nt, Mycobacterium bovis subsp bovis AF2122/97
ugaccgcggucuucuucac

SEQ ID NO: 1158132 - RNA, 17 nt, Mycobacterium bovis subsp bovis AF2122/97
ugaccgcguccacggga

SEQ ID NO: 1158133 - RNA, 17 nt, Mycobacterium bovis subsp bovis AF2122/97
ugaccuguuuggggcug

SEQ ID NO: 1158134 - RNA, 17 nt, Mycobacterium bovis subsp bovis AF2122/97
ugaccgcguagaccagu

SEQ ID NO: 1158135 - RNA, 21 nt, Mycobacterium bovis subsp bovis AF2122/97
ugaccgcguagagcagcagau

SEQ ID NO: 1158136 - RNA, 14 nt, Mycobacterium bovis subsp bovis AF2122/97
ugacgccgagcugg

SEQ ID NO: 1158137 - RNA, 20 nt, Mycobacterium bovis subsp bovis AF2122/97
ugacgccauuguugggccgc

SEQ ID NO: 1158138 - RNA, 17 nt, Mycobacterium bovis subsp bovis AF2122/97
ugacgacgucgccgccg

SEQ ID NO: 1158139 - RNA, 17 nt, Mycobacterium bovis subsp bovis AF2122/97
ugacgacgagggccagc

SEQ ID NO: 1158140 - RNA, 15 nt, Mycobacterium bovis subsp bovis AF2122/97
ugacgaccagccccg

SEQ ID NO: 1158141 - RNA, 22 nt, Mycobacterium bovis subsp bovis AF2122/97
ugacgacgagggccagcagccg

SEQ ID NO: 1158142 - RNA, 17 nt, Mycobacterium bovis subsp bovis AF2122/97
ugacgacgagggcggga

SEQ ID NO: 1158143 - RNA, 20 nt, Mycobacterium bovis subsp bovis AF2122/97
ugacgacgagggcgggaccc

SEQ ID NO: 1158144 - RNA, 16 nt, Mycobacterium bovis subsp bovis AF2122/97
ugacgcacagcagcac

SEQ ID NO: 1158145 - RNA, 16 nt, Mycobacterium bovis subsp bovis AF2122/97
ugacgccguugccacc

SEQ ID NO: 1158146 - RNA, 20 nt, Mycobacterium bovis subsp bovis AF2122/97
ugacgccucgacacccagcc

SEQ ID NO: 1158147 - RNA, 15 nt, Mycobacterium bovis subsp bovis AF2122/97
ugacgcgccguaaca

SEQ ID NO: 1158148 - RNA, 18 nt, Mycobacterium bovis subsp bovis AF2122/97
ugacggcgguaccgccgc

SEQ ID NO: 1158149 - RNA, 17 nt, Mycobacterium bovis subsp bovis AF2122/97
ugaacgcccgcuucagc

SEQ ID NO: 1158150 - RNA, 16 nt, Mycobacterium bovis subsp bovis AF2122/97
ugaacgcccgcuucag

SEQ ID NO: 1158151 - RNA, 21 nt, Mycobacterium bovis subsp bovis AF2122/97
ugaacggcaaggucgcggcca

SEQ ID NO: 1158152 - RNA, 17 nt, Mycobacterium bovis subsp bovis AF2122/97
ugaacgcugucccagcc

SEQ ID NO: 1158153 - RNA, 15 nt, Mycobacterium bovis subsp bovis AF2122/97
ugaacggcaccagcg

SEQ ID NO: 1158154 - RNA, 19 nt, Mycobacterium bovis subsp bovis AF2122/97
ugaacggcucgggaacuuc

SEQ ID NO: 1158155 - RNA, 14 nt, Mycobacterium bovis subsp bovis AF2122/97
ugaacucgaagacc

SEQ ID NO: 1158156 - RNA, 13 nt, Mycobacterium bovis subsp bovis AF2122/97
ugaagagaagucu

SEQ ID NO: 1158157 - RNA, 14 nt, Mycobacterium bovis subsp bovis AF2122/97
ugaagagaagucuc

SEQ ID NO: 1158158 - RNA, 22 nt, Mycobacterium bovis subsp bovis AF2122/97
ugaagaccaccgcccacagcaa

SEQ ID NO: 1158159 - RNA, 23 nt, Mycobacterium bovis subsp bovis AF2122/97
ugaagaccaccgcccacagcaac

SEQ ID NO: 1158160 - RNA, 20 nt, Mycobacterium bovis subsp bovis AF2122/97
ugaagaaugccgucugauca

SEQ ID NO: 1158161 - RNA, 11 nt, Mycobacterium bovis subsp bovis AF2122/97
ugaagaagccg

SEQ ID NO: 1158162 - RNA, 11 nt, Mycobacterium bovis subsp bovis AF2122/97
ugaagaagccc

SEQ ID NO: 1158163 - RNA, 22 nt, Mycobacterium bovis subsp bovis AF2122/97
ugaagggccgccucgcggauga

SEQ ID NO: 1158164 - RNA, 18 nt, Mycobacterium bovis subsp bovis AF2122/97
ugaaggcaaacaccagcc

SEQ ID NO: 1158165 - RNA, 14 nt, Mycobacterium bovis subsp bovis AF2122/97
ugaagcagacguca

SEQ ID NO: 1158166 - RNA, 17 nt, Mycobacterium bovis subsp bovis AF2122/97
ugaagccccuuggcgcc

SEQ ID NO: 1158167 - RNA, 22 nt, Mycobacterium bovis subsp bovis AF2122/97
ugaagccagcgcagcaccgaac

SEQ ID NO: 1158168 - RNA, 13 nt, Mycobacterium bovis subsp bovis AF2122/97
ugaagcaguuggc

SEQ ID NO: 1158169 - RNA, 22 nt, Mycobacterium bovis subsp bovis AF2122/97
ugaagccaaaugcgcugucgcc

SEQ ID NO: 1158170 - RNA, 21 nt, Mycobacterium bovis subsp bovis AF2122/97
ugaagccgggcgcuugcacca

SEQ ID NO: 1158171 - RNA, 15 nt, Mycobacterium bovis subsp bovis AF2122/97
ugaagccgcgcugcg

SEQ ID NO: 1158172 - RNA, 14 nt, Mycobacterium bovis subsp bovis AF2122/97
ugaagcccuggcca

SEQ ID NO: 1158173 - RNA, 13 nt, Mycobacterium bovis subsp bovis AF2122/97
ugaaguggcacaa

SEQ ID NO: 1158174 - RNA, 19 nt, Mycobacterium bovis subsp bovis AF2122/97
ugaagugaaagacaguggc

SEQ ID NO: 1158175 - RNA, 13 nt, Mycobacterium bovis subsp bovis AF2122/97
ugaauggcagcac

SEQ ID NO: 1158176 - RNA, 14 nt, Mycobacterium bovis subsp bovis AF2122/97
ugaauggcagcacg

SEQ ID NO: 1158177 - RNA, 21 nt, Mycobacterium bovis subsp bovis AF2122/97
ugaauuuggugaagccguaga

SEQ ID NO: 1158178 - RNA, 13 nt, Mycobacterium bovis subsp bovis AF2122/97
uccuucaccagcu

SEQ ID NO: 1158179 - RNA, 18 nt, Mycobacterium bovis subsp bovis AF2122/97
uccuucgaaugccgugcc

SEQ ID NO: 1158180 - RNA, 14 nt, Mycobacterium bovis subsp bovis AF2122/97
uccuuccuggguug

SEQ ID NO: 1158181 - RNA, 22 nt, Mycobacterium bovis subsp bovis AF2122/97
uccuugcgcagcaccagggugg

SEQ ID NO: 1158182 - RNA, 17 nt, Mycobacterium bovis subsp bovis AF2122/97
uccuugcgguccaggcc

SEQ ID NO: 1158183 - RNA, 19 nt, Mycobacterium bovis subsp bovis AF2122/97
uccuugaggucacccauca

SEQ ID NO: 1158184 - RNA, 19 nt, Mycobacterium bovis subsp bovis AF2122/97
uccuugaucaaggugucga

SEQ ID NO: 1158185 - RNA, 14 nt, Mycobacterium bovis subsp bovis AF2122/97
uccuugaugccuuc

SEQ ID NO: 1158186 - RNA, 21 nt, Mycobacterium bovis subsp bovis AF2122/97
uccuucuccagauccacgccg

SEQ ID NO: 1158187 - RNA, 18 nt, Mycobacterium bovis subsp bovis AF2122/97
ucagcgacuugcggugcu

SEQ ID NO: 1158188 - RNA, 22 nt, Mycobacterium bovis subsp bovis AF2122/97
ucagcgacggccgccagcagcu

SEQ ID NO: 1158189 - RNA, 18 nt, Mycobacterium bovis subsp bovis AF2122/97
ucagcgaguagccgcuag

SEQ ID NO: 1158190 - RNA, 16 nt, Mycobacterium bovis subsp bovis AF2122/97
ucagcgaguggucccg

SEQ ID NO: 1158191 - RNA, 17 nt, Mycobacterium bovis subsp bovis AF2122/97
uccugcagugcggcguu

SEQ ID NO: 1158192 - RNA, 18 nt, Mycobacterium bovis subsp bovis AF2122/97
uccugcgucaaguccgag

SEQ ID NO: 1158193 - RNA, 14 nt, Mycobacterium bovis subsp bovis AF2122/97
uccugcguccagau

SEQ ID NO: 1158194 - RNA, 19 nt, Mycobacterium bovis subsp bovis AF2122/97
uccuggccacucccagcca

SEQ ID NO: 1158195 - RNA, 15 nt, Mycobacterium bovis subsp bovis AF2122/97
uccuggccgccgccc

SEQ ID NO: 1158196 - RNA, 20 nt, Mycobacterium bovis subsp bovis AF2122/97
uccuggaugaaguguuuggc

SEQ ID NO: 1158197 - RNA, 14 nt, Mycobacterium bovis subsp bovis AF2122/97
ucgaacgcugagga

SEQ ID NO: 1158198 - RNA, 13 nt, Mycobacterium bovis subsp bovis AF2122/97
ucgaaguccacau

SEQ ID NO: 1158199 - RNA, 13 nt, Mycobacterium bovis subsp bovis AF2122/97
ucgaaguaauagc

SEQ ID NO: 1158200 - RNA, 14 nt, Mycobacterium bovis subsp bovis AF2122/97
ucgaauacaccugc

SEQ ID NO: 1158201 - RNA, 15 nt, Mycobacterium bovis subsp bovis AF2122/97
ucgaacaggccggcc

SEQ ID NO: 1158202 - RNA, 17 nt, Mycobacterium bovis subsp bovis AF2122/97
ucgaacaucaucggguc

SEQ ID NO: 1158203 - RNA, 15 nt, Mycobacterium bovis subsp bovis AF2122/97
ucgaacagcaccgcc

SEQ ID NO: 1158204 - RNA, 19 nt, Mycobacterium bovis subsp bovis AF2122/97
ucgaacaccguccaauugg

SEQ ID NO: 1158205 - RNA, 14 nt, Mycobacterium bovis subsp bovis AF2122/97
ucgaccgccgcgag

SEQ ID NO: 1158206 - RNA, 17 nt, Mycobacterium bovis subsp bovis AF2122/97
ucgaccgccguggcccg

SEQ ID NO: 1158207 - RNA, 21 nt, Mycobacterium bovis subsp bovis AF2122/97
ucgacccgcccauucccauau

SEQ ID NO: 1158208 - RNA, 19 nt, Mycobacterium bovis subsp bovis AF2122/97
ucgaccggacaaagcugcu

SEQ ID NO: 1158209 - RNA, 18 nt, Mycobacterium bovis subsp bovis AF2122/97
ucgaccgcggccuuggcg

SEQ ID NO: 1158210 - RNA, 22 nt, Mycobacterium bovis subsp bovis AF2122/97
ucgaccgcgccauagcagagcc

SEQ ID NO: 1158211 - RNA, 13 nt, Mycobacterium bovis subsp bovis AF2122/97
ucgaccgcggccc

SEQ ID NO: 1158212 - RNA, 16 nt, Mycobacterium bovis subsp bovis AF2122/97
ucgaccucagacagcu

SEQ ID NO: 1158213 - RNA, 21 nt, Mycobacterium bovis subsp bovis AF2122/97
ucgaccguggcugcgcucgcc

SEQ ID NO: 1158214 - RNA, 10 nt, Mycobacterium bovis subsp bovis AF2122/97
ucgaccgugu

SEQ ID NO: 1158215 - RNA, 18 nt, Mycobacterium bovis subsp bovis AF2122/97
ucgaccgugucaccgccg

SEQ ID NO: 1158216 - RNA, 17 nt, Mycobacterium bovis subsp bovis AF2122/97
ucgaauagguguguggc

SEQ ID NO: 1158217 - RNA, 15 nt, Mycobacterium bovis subsp bovis AF2122/97
ucgaaucaggcucca

SEQ ID NO: 1158218 - RNA, 15 nt, Mycobacterium bovis subsp bovis AF2122/97
ucgacaaccgcugcc

SEQ ID NO: 1158219 - RNA, 16 nt, Mycobacterium bovis subsp bovis AF2122/97
ucgacaccaccauucc

SEQ ID NO: 1158220 - RNA, 23 nt, Mycobacterium bovis subsp bovis AF2122/97
ucgacaccgagccacgacccagc

SEQ ID NO: 1158221 - RNA, 20 nt, Mycobacterium bovis subsp bovis AF2122/97
ucgacaccgaggaccucguc

SEQ ID NO: 1158222 - RNA, 12 nt, Mycobacterium bovis subsp bovis AF2122/97
ucgacaccgccc

SEQ ID NO: 1158223 - RNA, 16 nt, Mycobacterium bovis subsp bovis AF2122/97
ucgacaccgcggugcc

SEQ ID NO: 1158224 - RNA, 14 nt, Mycobacterium bovis subsp bovis AF2122/97
ucgacacgccgaac

SEQ ID NO: 1158225 - RNA, 13 nt, Mycobacterium bovis subsp bovis AF2122/97
uccuuggccgcca

SEQ ID NO: 1158226 - RNA, 14 nt, Mycobacterium bovis subsp bovis AF2122/97
uccuuguuggccag

SEQ ID NO: 1158227 - RNA, 22 nt, Mycobacterium bovis subsp bovis AF2122/97
uccuugucggccccggccgcgu

SEQ ID NO: 1158228 - RNA, 13 nt, Mycobacterium bovis subsp bovis AF2122/97
uccuugucggccc

SEQ ID NO: 1158229 - RNA, 18 nt, Mycobacterium bovis subsp bovis AF2122/97
ucgaaaaggugcaccauu

SEQ ID NO: 1158230 - RNA, 17 nt, Mycobacterium bovis subsp bovis AF2122/97
ucgaaagcgauauugga

SEQ ID NO: 1158231 - RNA, 18 nt, Mycobacterium bovis subsp bovis AF2122/97
ucgaaaaccgaggcauuc

SEQ ID NO: 1158232 - RNA, 21 nt, Mycobacterium bovis subsp bovis AF2122/97
ucgaaaccgcccguauugaug

SEQ ID NO: 1158233 - RNA, 18 nt, Mycobacterium bovis subsp bovis AF2122/97
ucgaggcugaccguggcg

SEQ ID NO: 1158234 - RNA, 18 nt, Mycobacterium bovis subsp bovis AF2122/97
ucgaggguaccaggcgcc

SEQ ID NO: 1158235 - RNA, 20 nt, Mycobacterium bovis subsp bovis AF2122/97
ucgagggcagccgcccaccc

SEQ ID NO: 1158236 - RNA, 16 nt, Mycobacterium bovis subsp bovis AF2122/97
ucgagggggacgcuga

SEQ ID NO: 1158237 - RNA, 22 nt, Mycobacterium bovis subsp bovis AF2122/97
ucgaggguuuccauggcgugcc

SEQ ID NO: 1158238 - RNA, 21 nt, Mycobacterium bovis subsp bovis AF2122/97
ucgagguacagcgggcacgcu

SEQ ID NO: 1158239 - RNA, 21 nt, Mycobacterium bovis subsp bovis AF2122/97
ucgagcuuuucgaccuucacc

SEQ ID NO: 1158240 - RNA, 19 nt, Mycobacterium bovis subsp bovis AF2122/97
ucgaggaaggugugcgucu

SEQ ID NO: 1158241 - RNA, 23 nt, Mycobacterium bovis subsp bovis AF2122/97
ucgaggcaggccucggcgccgcc

SEQ ID NO: 1158242 - RNA, 16 nt, Mycobacterium bovis subsp bovis AF2122/97
ucgaggccacgccagc

SEQ ID NO: 1158243 - RNA, 17 nt, Mycobacterium bovis subsp bovis AF2122/97
ucgacggccagugcgca

SEQ ID NO: 1158244 - RNA, 22 nt, Mycobacterium bovis subsp bovis AF2122/97
ucgagcucggcgaugcugagcc

SEQ ID NO: 1158245 - RNA, 22 nt, Mycobacterium bovis subsp bovis AF2122/97
ucgagcucguaggugaagagca

SEQ ID NO: 1158246 - RNA, 19 nt, Mycobacterium bovis subsp bovis AF2122/97
ucgagcugacgauggccag

SEQ ID NO: 1158247 - RNA, 17 nt, Mycobacterium bovis subsp bovis AF2122/97
ucgacgccggccagcgg

SEQ ID NO: 1158248 - RNA, 22 nt, Mycobacterium bovis subsp bovis AF2122/97
ucgacgcgcgcuugggguuggg

SEQ ID NO: 1158249 - RNA, 15 nt, Mycobacterium bovis subsp bovis AF2122/97
ucgacgcauuccucg

SEQ ID NO: 1158250 - RNA, 13 nt, Mycobacterium bovis subsp bovis AF2122/97
ucgaucaccugca

SEQ ID NO: 1158251 - RNA, 12 nt, Mycobacterium bovis subsp bovis AF2122/97
ucgaucaccgac

SEQ ID NO: 1158252 - RNA, 18 nt, Mycobacterium bovis subsp bovis AF2122/97
ucgaucaacaccaaucgg

SEQ ID NO: 1158253 - RNA, 19 nt, Mycobacterium bovis subsp bovis AF2122/97
ucgaucaacaggucuaccc

SEQ ID NO: 1158254 - RNA, 18 nt, Mycobacterium bovis subsp bovis AF2122/97
ucgaucagaaucugccuc

SEQ ID NO: 1158255 - RNA, 22 nt, Mycobacterium bovis subsp bovis AF2122/97
ucgauauaacccggcuccagca

SEQ ID NO: 1158256 - RNA, 18 nt, Mycobacterium bovis subsp bovis AF2122/97
ucgauaaccgcgaccagc

SEQ ID NO: 1158257 - RNA, 21 nt, Mycobacterium bovis subsp bovis AF2122/97
ucgaggucguuucccuggccg

SEQ ID NO: 1158258 - RNA, 18 nt, Mycobacterium bovis subsp bovis AF2122/97
ucgagguguagcccuccg

SEQ ID NO: 1158259 - RNA, 15 nt, Mycobacterium bovis subsp bovis AF2122/97
ucgagguccaccacc

SEQ ID NO: 1158260 - RNA, 16 nt, Mycobacterium bovis subsp bovis AF2122/97
ucgagguccaccaccc

SEQ ID NO: 1158261 - RNA, 17 nt, Mycobacterium bovis subsp bovis AF2122/97
ucgagguccuugaggau

SEQ ID NO: 1158262 - RNA, 19 nt, Mycobacterium bovis subsp bovis AF2122/97
ucgaguagucgcuggccag

SEQ ID NO: 1158263 - RNA, 17 nt, Mycobacterium bovis subsp bovis AF2122/97
ucgaguccaccaccugg

SEQ ID NO: 1158264 - RNA, 18 nt, Mycobacterium bovis subsp bovis AF2122/97
ucgaguucgcagucgaug

SEQ ID NO: 1158265 - RNA, 16 nt, Mycobacterium bovis subsp bovis AF2122/97
ucgagugcgaagguaa

SEQ ID NO: 1158266 - RNA, 17 nt, Mycobacterium bovis subsp bovis AF2122/97
ucgaguuccgcaucggc

SEQ ID NO: 1158267 - RNA, 16 nt, Mycobacterium bovis subsp bovis AF2122/97
ucgaucaccugcagca

SEQ ID NO: 1158268 - RNA, 14 nt, Mycobacterium bovis subsp bovis AF2122/97
ucgaucuccaggcc

SEQ ID NO: 1158269 - RNA, 22 nt, Mycobacterium bovis subsp bovis AF2122/97
ucgaucuccucuugcaccaggg

SEQ ID NO: 1158270 - RNA, 19 nt, Mycobacterium bovis subsp bovis AF2122/97
ucgaugaccagcacaccgc

SEQ ID NO: 1158271 - RNA, 17 nt, Mycobacterium bovis subsp bovis AF2122/97
ucgauugccaccgagau

SEQ ID NO: 1158272 - RNA, 23 nt, Mycobacterium bovis subsp bovis AF2122/97
ucgaugaggcgcagcgccagcgg

SEQ ID NO: 1158273 - RNA, 18 nt, Mycobacterium bovis subsp bovis AF2122/97
ucgcaccagaucagguga

SEQ ID NO: 1158274 - RNA, 14 nt, Mycobacterium bovis subsp bovis AF2122/97
ucgcaccagucguc

SEQ ID NO: 1158275 - RNA, 14 nt, Mycobacterium bovis subsp bovis AF2122/97
ucgcacccugcgaa

SEQ ID NO: 1158276 - RNA, 21 nt, Mycobacterium bovis subsp bovis AF2122/97
ucgcaccaccacgugaucaga

SEQ ID NO: 1158277 - RNA, 14 nt, Mycobacterium bovis subsp bovis AF2122/97
ucgcacagcaccac

SEQ ID NO: 1158278 - RNA, 13 nt, Mycobacterium bovis subsp bovis AF2122/97
ucgcacagcgcga

SEQ ID NO: 1158279 - RNA, 20 nt, Mycobacterium bovis subsp bovis AF2122/97
ucgcaauggucguagggugg

SEQ ID NO: 1158280 - RNA, 15 nt, Mycobacterium bovis subsp bovis AF2122/97
ucgcaaucagcuggu

SEQ ID NO: 1158281 - RNA, 19 nt, Mycobacterium bovis subsp bovis AF2122/97
ucgcaaucguuggccaugc

SEQ ID NO: 1158282 - RNA, 15 nt, Mycobacterium bovis subsp bovis AF2122/97
ucgcagacggcugcc

SEQ ID NO: 1158283 - RNA, 21 nt, Mycobacterium bovis subsp bovis AF2122/97
ucgcagacggcugccacgcgu

SEQ ID NO: 1158284 - RNA, 19 nt, Mycobacterium bovis subsp bovis AF2122/97
ucgcacugcgccggccggc

SEQ ID NO: 1158285 - RNA, 18 nt, Mycobacterium bovis subsp bovis AF2122/97
ucgcacggugccgccguc

SEQ ID NO: 1158286 - RNA, 18 nt, Mycobacterium bovis subsp bovis AF2122/97
ucgcacggaaggcccggc

SEQ ID NO: 1158287 - RNA, 15 nt, Mycobacterium bovis subsp bovis AF2122/97
ucgcacggaugaugc

SEQ ID NO: 1158288 - RNA, 14 nt, Mycobacterium bovis subsp bovis AF2122/97
ucgcacgagccaac

SEQ ID NO: 1158289 - RNA, 15 nt, Mycobacterium bovis subsp bovis AF2122/97
ucgcccgcugagcac

SEQ ID NO: 1158290 - RNA, 23 nt, Mycobacterium bovis subsp bovis AF2122/97
ucgcccgggcgggauccacccag

SEQ ID NO: 1158291 - RNA, 20 nt, Mycobacterium bovis subsp bovis AF2122/97
ucgcccgaguugaagaagcc

SEQ ID NO: 1158292 - RNA, 14 nt, Mycobacterium bovis subsp bovis AF2122/97
ucgcccgcacacag

SEQ ID NO: 1158293 - RNA, 15 nt, Mycobacterium bovis subsp bovis AF2122/97
ucgcccugacaccca

SEQ ID NO: 1158294 - RNA, 13 nt, Mycobacterium bovis subsp bovis AF2122/97
ucgcccagggugg

SEQ ID NO: 1158295 - RNA, 18 nt, Mycobacterium bovis subsp bovis AF2122/97
ucgcccaggccaaggugg

SEQ ID NO: 1158296 - RNA, 23 nt, Mycobacterium bovis subsp bovis AF2122/97
ucgcccaggccaagguggccacc

SEQ ID NO: 1158297 - RNA, 16 nt, Mycobacterium bovis subsp bovis AF2122/97
ucgcccagcgugaacu

SEQ ID NO: 1158298 - RNA, 17 nt, Mycobacterium bovis subsp bovis AF2122/97
ucgcccagcgugaacug

SEQ ID NO: 1158299 - RNA, 12 nt, Mycobacterium bovis subsp bovis AF2122/97
ucgcccagcaag

SEQ ID NO: 1158300 - RNA, 15 nt, Mycobacterium bovis subsp bovis AF2122/97
ucgcccagcaaggcc

SEQ ID NO: 1158301 - RNA, 15 nt, Mycobacterium bovis subsp bovis AF2122/97
ucgcccauuggccag

SEQ ID NO: 1158302 - RNA, 18 nt, Mycobacterium bovis subsp bovis AF2122/97
ucgcccaacaccgcgccg

SEQ ID NO: 1158303 - RNA, 18 nt, Mycobacterium bovis subsp bovis AF2122/97
ucgccaaugcccaggugu

SEQ ID NO: 1158304 - RNA, 18 nt, Mycobacterium bovis subsp bovis AF2122/97
ucgcaguacuugguugcg

SEQ ID NO: 1158305 - RNA, 20 nt, Mycobacterium bovis subsp bovis AF2122/97
ucgccaacgacucacccacc

SEQ ID NO: 1158306 - RNA, 14 nt, Mycobacterium bovis subsp bovis AF2122/97
ucgccgcuggccag

SEQ ID NO: 1158307 - RNA, 23 nt, Mycobacterium bovis subsp bovis AF2122/97
ucgccgcguccucgcccuggccg

SEQ ID NO: 1158308 - RNA, 21 nt, Mycobacterium bovis subsp bovis AF2122/97
ucgccggacgacaacaggccg

SEQ ID NO: 1158309 - RNA, 19 nt, Mycobacterium bovis subsp bovis AF2122/97
ucgccggacugcggcccga

SEQ ID NO: 1158310 - RNA, 20 nt, Mycobacterium bovis subsp bovis AF2122/97
ucgccgauguuggcagggcc

SEQ ID NO: 1158311 - RNA, 14 nt, Mycobacterium bovis subsp bovis AF2122/97
ucgccgcgcggaac

SEQ ID NO: 1158312 - RNA, 24 nt, Mycobacterium bovis subsp bovis AF2122/97
ucgccgccauugccgccggugccg

SEQ ID NO: 1158313 - RNA, 17 nt, Mycobacterium bovis subsp bovis AF2122/97
ucgccgaacgccaccac

SEQ ID NO: 1158314 - RNA, 16 nt, Mycobacterium bovis subsp bovis AF2122/97
ucgccgaagcgccgcu

SEQ ID NO: 1158315 - RNA, 15 nt, Mycobacterium bovis subsp bovis AF2122/97
ucgcccuugccgcag

SEQ ID NO: 1158316 - RNA, 17 nt, Mycobacterium bovis subsp bovis AF2122/97
ucgccgaagccggaccg

SEQ ID NO: 1158317 - RNA, 17 nt, Mycobacterium bovis subsp bovis AF2122/97
ucgccgaaucgcugacc

SEQ ID NO: 1158318 - RNA, 20 nt, Mycobacterium bovis subsp bovis AF2122/97
ucgccgacagcgccuuguug

SEQ ID NO: 1158319 - RNA, 22 nt, Mycobacterium bovis subsp bovis AF2122/97
ucgccgacgauuuuggcugcag

SEQ ID NO: 1158320 - RNA, 18 nt, Mycobacterium bovis subsp bovis AF2122/97
ucgccgauaucugccacg

SEQ ID NO: 1158321 - RNA, 14 nt, Mycobacterium bovis subsp bovis AF2122/97
ucgcgcacccagcc

SEQ ID NO: 1158322 - RNA, 22 nt, Mycobacterium bovis subsp bovis AF2122/97
ucgcgcaccggaucgccgucgc

SEQ ID NO: 1158323 - RNA, 14 nt, Mycobacterium bovis subsp bovis AF2122/97
ucgccuucccagcc

SEQ ID NO: 1158324 - RNA, 15 nt, Mycobacterium bovis subsp bovis AF2122/97
ucgccuucccagccg

SEQ ID NO: 1158325 - RNA, 21 nt, Mycobacterium bovis subsp bovis AF2122/97
ucgccggagucgacccugccc

SEQ ID NO: 1158326 - RNA, 16 nt, Mycobacterium bovis subsp bovis AF2122/97
ucgccguaagcaccag

SEQ ID NO: 1158327 - RNA, 19 nt, Mycobacterium bovis subsp bovis AF2122/97
ucgccguacaucagcgcga

SEQ ID NO: 1158328 - RNA, 21 nt, Mycobacterium bovis subsp bovis AF2122/97
ucgccguacaucagcgcgaac

SEQ ID NO: 1158329 - RNA, 15 nt, Mycobacterium bovis subsp bovis AF2122/97
ucgccgucgcggcac

SEQ ID NO: 1158330 - RNA, 14 nt, Mycobacterium bovis subsp bovis AF2122/97
ucgccgguguccuu

SEQ ID NO: 1158331 - RNA, 20 nt, Mycobacterium bovis subsp bovis AF2122/97
ucggcgaauccgccgccuag

SEQ ID NO: 1158332 - RNA, 15 nt, Mycobacterium bovis subsp bovis AF2122/97
ucggcgaccaccagc

SEQ ID NO: 1158333 - RNA, 16 nt, Mycobacterium bovis subsp bovis AF2122/97
ucggcgaacggcacca

SEQ ID NO: 1158334 - RNA, 17 nt, Mycobacterium bovis subsp bovis AF2122/97
ucggcgaagcacaccgu

SEQ ID NO: 1158335 - RNA, 13 nt, Mycobacterium bovis subsp bovis AF2122/97
ucggcgacgccgu

SEQ ID NO: 1158336 - RNA, 19 nt, Mycobacterium bovis subsp bovis AF2122/97
ucggcgaccugccggaccg

SEQ ID NO: 1158337 - RNA, 16 nt, Mycobacterium bovis subsp bovis AF2122/97
ucggccugccggcagc

SEQ ID NO: 1158338 - RNA, 17 nt, Mycobacterium bovis subsp bovis AF2122/97
ucggccucgucgugcac

SEQ ID NO: 1158339 - RNA, 18 nt, Mycobacterium bovis subsp bovis AF2122/97
ucggccuggcaggguggg

SEQ ID NO: 1158340 - RNA, 16 nt, Mycobacterium bovis subsp bovis AF2122/97
ucggcgaacgcgucca

SEQ ID NO: 1158341 - RNA, 21 nt, Mycobacterium bovis subsp bovis AF2122/97
ucggcgaacggauucccgccc

SEQ ID NO: 1158342 - RNA, 21 nt, Mycobacterium bovis subsp bovis AF2122/97
ucggcccgaggugccggggcc

SEQ ID NO: 1158343 - RNA, 19 nt, Mycobacterium bovis subsp bovis AF2122/97
ucggcccgaucaccaucca

SEQ ID NO: 1158344 - RNA, 14 nt, Mycobacterium bovis subsp bovis AF2122/97
ucggcccgcugacc

SEQ ID NO: 1158345 - RNA, 22 nt, Mycobacterium bovis subsp bovis AF2122/97
ucggccgaaucuccgccgugag

SEQ ID NO: 1158346 - RNA, 20 nt, Mycobacterium bovis subsp bovis AF2122/97
ucggccgacaccgccaccac

SEQ ID NO: 1158347 - RNA, 11 nt, Mycobacterium bovis subsp bovis AF2122/97
ucggccgccag

SEQ ID NO: 1158348 - RNA, 20 nt, Mycobacterium bovis subsp bovis AF2122/97
ucggccgccggguccggaac

SEQ ID NO: 1158349 - RNA, 20 nt, Mycobacterium bovis subsp bovis AF2122/97
ucggccgcgagacgcauguc

SEQ ID NO: 1158350 - RNA, 18 nt, Mycobacterium bovis subsp bovis AF2122/97
ucggccgaccgggcucug

SEQ ID NO: 1158351 - RNA, 15 nt, Mycobacterium bovis subsp bovis AF2122/97
ucggccgcaccagca

SEQ ID NO: 1158352 - RNA, 20 nt, Mycobacterium bovis subsp bovis AF2122/97
ucggccggcaccccacggcc

SEQ ID NO: 1158353 - RNA, 15 nt, Mycobacterium bovis subsp bovis AF2122/97
ucggccggcgucagc

SEQ ID NO: 1158354 - RNA, 21 nt, Mycobacterium bovis subsp bovis AF2122/97
ucggccggcggcgcccaucgc

SEQ ID NO: 1158355 - RNA, 21 nt, Mycobacterium bovis subsp bovis AF2122/97
ucggccgcuggaggcggcgcc

SEQ ID NO: 1158356 - RNA, 20 nt, Mycobacterium bovis subsp bovis AF2122/97
ucggccggagccgccggccc

SEQ ID NO: 1158357 - RNA, 16 nt, Mycobacterium bovis subsp bovis AF2122/97
ucggccggggccaccc

SEQ ID NO: 1158358 - RNA, 15 nt, Mycobacterium bovis subsp bovis AF2122/97
ucggccgggcucuau

SEQ ID NO: 1158359 - RNA, 19 nt, Mycobacterium bovis subsp bovis AF2122/97
ucggccgucauggcccgau

SEQ ID NO: 1158360 - RNA, 21 nt, Mycobacterium bovis subsp bovis AF2122/97
ucggccgugaauucgccgaac

SEQ ID NO: 1158361 - RNA, 20 nt, Mycobacterium bovis subsp bovis AF2122/97
ucggccggguuaucggcagc

SEQ ID NO: 1158362 - RNA, 17 nt, Mycobacterium bovis subsp bovis AF2122/97
ucggccagcagcagugc

SEQ ID NO: 1158363 - RNA, 15 nt, Mycobacterium bovis subsp bovis AF2122/97
ucggccagcacgccg

SEQ ID NO: 1158364 - RNA, 21 nt, Mycobacterium bovis subsp bovis AF2122/97
ucggccagcagaucagguccu

SEQ ID NO: 1158365 - RNA, 13 nt, Mycobacterium bovis subsp bovis AF2122/97
ucggccagcagcg

SEQ ID NO: 1158366 - RNA, 21 nt, Mycobacterium bovis subsp bovis AF2122/97
ucggccagguaauugccgacc

SEQ ID NO: 1158367 - RNA, 17 nt, Mycobacterium bovis subsp bovis AF2122/97
ucggccauggcggcgcc

SEQ ID NO: 1158368 - RNA, 21 nt, Mycobacterium bovis subsp bovis AF2122/97
ucggccaucagaaccuccucg

SEQ ID NO: 1158369 - RNA, 16 nt, Mycobacterium bovis subsp bovis AF2122/97
ucggccaucguccagc

SEQ ID NO: 1158370 - RNA, 18 nt, Mycobacterium bovis subsp bovis AF2122/97
ucggcccauaacagcugg

SEQ ID NO: 1158371 - RNA, 14 nt, Mycobacterium bovis subsp bovis AF2122/97
ucggcccaugcagc

SEQ ID NO: 1158372 - RNA, 21 nt, Mycobacterium bovis subsp bovis AF2122/97
ucggcccaugcagcggcgaag

SEQ ID NO: 1158373 - RNA, 21 nt, Mycobacterium bovis subsp bovis AF2122/97
ucggcccccaagcucugcguc

SEQ ID NO: 1158374 - RNA, 18 nt, Mycobacterium bovis subsp bovis AF2122/97
ucggcccacggugucccg

SEQ ID NO: 1158375 - RNA, 12 nt, Mycobacterium bovis subsp bovis AF2122/97
ucggccagcaac

SEQ ID NO: 1158376 - RNA, 15 nt, Mycobacterium bovis subsp bovis AF2122/97
ucggccaccggcguc

SEQ ID NO: 1158377 - RNA, 13 nt, Mycobacterium bovis subsp bovis AF2122/97
ucggccaccgccu

SEQ ID NO: 1158378 - RNA, 16 nt, Mycobacterium bovis subsp bovis AF2122/97
ucggccaccgccugag

SEQ ID NO: 1158379 - RNA, 13 nt, Mycobacterium bovis subsp bovis AF2122/97
ucggccacccggu

SEQ ID NO: 1158380 - RNA, 15 nt, Mycobacterium bovis subsp bovis AF2122/97
ucggccaccagcgcc

SEQ ID NO: 1158381 - RNA, 12 nt, Mycobacterium bovis subsp bovis AF2122/97
ucggccaccauc

SEQ ID NO: 1158382 - RNA, 14 nt, Mycobacterium bovis subsp bovis AF2122/97
ucggccaccaucgc

SEQ ID NO: 1158383 - RNA, 24 nt, Mycobacterium bovis subsp bovis AF2122/97
ucggcaaccaccucgugggccacu

SEQ ID NO: 1158384 - RNA, 13 nt, Mycobacterium bovis subsp bovis AF2122/97
ucggccaccaacu

SEQ ID NO: 1158385 - RNA, 19 nt, Mycobacterium bovis subsp bovis AF2122/97
ucggaugucucggcaccac

SEQ ID NO: 1158386 - RNA, 16 nt, Mycobacterium bovis subsp bovis AF2122/97
ucggcaaaccaagcgc

SEQ ID NO: 1158387 - RNA, 13 nt, Mycobacterium bovis subsp bovis AF2122/97
ucgcgcagcgccg

SEQ ID NO: 1158388 - RNA, 17 nt, Mycobacterium bovis subsp bovis AF2122/97
ucgcugugcgcuggucg

SEQ ID NO: 1158389 - RNA, 20 nt, Mycobacterium bovis subsp bovis AF2122/97
ucgcuguaggccagcccggc

SEQ ID NO: 1158390 - RNA, 18 nt, Mycobacterium bovis subsp bovis AF2122/97
ucgcuggguggcgggccg

SEQ ID NO: 1158391 - RNA, 22 nt, Mycobacterium bovis subsp bovis AF2122/97
ucgcuguaggccagcccggcgu

SEQ ID NO: 1158392 - RNA, 14 nt, Mycobacterium bovis subsp bovis AF2122/97
ucgcuggccggcac

SEQ ID NO: 1158393 - RNA, 13 nt, Mycobacterium bovis subsp bovis AF2122/97
ucggauagccccg

SEQ ID NO: 1158394 - RNA, 15 nt, Mycobacterium bovis subsp bovis AF2122/97
ucggaucgccaggcc

SEQ ID NO: 1158395 - RNA, 18 nt, Mycobacterium bovis subsp bovis AF2122/97
ucggagccggccaccucg

SEQ ID NO: 1158396 - RNA, 18 nt, Mycobacterium bovis subsp bovis AF2122/97
ucgcuuuugaaccggguc

SEQ ID NO: 1158397 - RNA, 18 nt, Mycobacterium bovis subsp bovis AF2122/97
ucggagauuucgucgcug

SEQ ID NO: 1158398 - RNA, 20 nt, Mycobacterium bovis subsp bovis AF2122/97
ucggagauuucgucgcugag

SEQ ID NO: 1158399 - RNA, 13 nt, Mycobacterium bovis subsp bovis AF2122/97
ucggaggcgacca

SEQ ID NO: 1158400 - RNA, 21 nt, Mycobacterium bovis subsp bovis AF2122/97
ucggaggcccgccacaacggc

SEQ ID NO: 1158401 - RNA, 19 nt, Mycobacterium bovis subsp bovis AF2122/97
ucggagcgggcuccggcuc

SEQ ID NO: 1158402 - RNA, 14 nt, Mycobacterium bovis subsp bovis AF2122/97
ucggcgcggcuguc

SEQ ID NO: 1158403 - RNA, 16 nt, Mycobacterium bovis subsp bovis AF2122/97
ucggcgcuagcugcug

SEQ ID NO: 1158404 - RNA, 17 nt, Mycobacterium bovis subsp bovis AF2122/97
ucggcgcgcggguuguc

SEQ ID NO: 1158405 - RNA, 21 nt, Mycobacterium bovis subsp bovis AF2122/97
ucggcgcgccggucgccgacg

SEQ ID NO: 1158406 - RNA, 15 nt, Mycobacterium bovis subsp bovis AF2122/97
ucggcggcgccgaag

SEQ ID NO: 1158407 - RNA, 21 nt, Mycobacterium bovis subsp bovis AF2122/97
ucggcggccgagcgcaccgcu

SEQ ID NO: 1158408 - RNA, 14 nt, Mycobacterium bovis subsp bovis AF2122/97
ucggcggccgccag

SEQ ID NO: 1158409 - RNA, 22 nt, Mycobacterium bovis subsp bovis AF2122/97
ucggcggccggcacgggcgggg

SEQ ID NO: 1158410 - RNA, 19 nt, Mycobacterium bovis subsp bovis AF2122/97
ucggcggccgagcgcaccg

SEQ ID NO: 1158411 - RNA, 19 nt, Mycobacterium bovis subsp bovis AF2122/97
ucggcggcguccagcagcg

SEQ ID NO: 1158412 - RNA, 12 nt, Mycobacterium bovis subsp bovis AF2122/97
ucggcgccggcg

SEQ ID NO: 1158413 - RNA, 23 nt, Mycobacterium bovis subsp bovis AF2122/97
ucggcgccggcggccgcggugcc

SEQ ID NO: 1158414 - RNA, 13 nt, Mycobacterium bovis subsp bovis AF2122/97
ucggcgcgcaccu

SEQ ID NO: 1158415 - RNA, 12 nt, Mycobacterium bovis subsp bovis AF2122/97
ucggcgcaggcg

SEQ ID NO: 1158416 - RNA, 23 nt, Mycobacterium bovis subsp bovis AF2122/97
ucggcgcccuccuuggcguugcc

SEQ ID NO: 1158417 - RNA, 21 nt, Mycobacterium bovis subsp bovis AF2122/97
ucggcgaucaacgcgcacgcg

SEQ ID NO: 1158418 - RNA, 19 nt, Mycobacterium bovis subsp bovis AF2122/97
ucggcgaugggccgguccg

SEQ ID NO: 1158419 - RNA, 14 nt, Mycobacterium bovis subsp bovis AF2122/97
ucggcgcaaucaac

SEQ ID NO: 1158420 - RNA, 21 nt, Mycobacterium bovis subsp bovis AF2122/97
ucggcgaugacaucaccgacc

SEQ ID NO: 1158421 - RNA, 22 nt, Mycobacterium bovis subsp bovis AF2122/97
ucggcgaugauguugagcugga

SEQ ID NO: 1158422 - RNA, 16 nt, Mycobacterium bovis subsp bovis AF2122/97
ucggcgaugcgcacca

SEQ ID NO: 1158423 - RNA, 16 nt, Mycobacterium bovis subsp bovis AF2122/97
ucggcgucccagggca

SEQ ID NO: 1158424 - RNA, 19 nt, Mycobacterium bovis subsp bovis AF2122/97
ucggcguccuugcgcagca

SEQ ID NO: 1158425 - RNA, 20 nt, Mycobacterium bovis subsp bovis AF2122/97
ucggcgggucugggucaggc

SEQ ID NO: 1158426 - RNA, 19 nt, Mycobacterium bovis subsp bovis AF2122/97
ucggcgucgucgacggcug

SEQ ID NO: 1158427 - RNA, 20 nt, Mycobacterium bovis subsp bovis AF2122/97
ucggcgucgugguggccacg

SEQ ID NO: 1158428 - RNA, 14 nt, Mycobacterium bovis subsp bovis AF2122/97
ucggcgggcaccuc

SEQ ID NO: 1158429 - RNA, 21 nt, Mycobacterium bovis subsp bovis AF2122/97
ucggcggguagaaccagcccg

SEQ ID NO: 1158430 - RNA, 13 nt, Mycobacterium bovis subsp bovis AF2122/97
ucggcgggucagg

SEQ ID NO: 1158431 - RNA, 17 nt, Mycobacterium bovis subsp bovis AF2122/97
ucggcgggucaggccag

SEQ ID NO: 1158432 - RNA, 13 nt, Mycobacterium bovis subsp bovis AF2122/97
ucggcggugcaga

SEQ ID NO: 1158433 - RNA, 15 nt, Mycobacterium bovis subsp bovis AF2122/97
ucggcggugccacca

SEQ ID NO: 1158434 - RNA, 21 nt, Mycobacterium bovis subsp bovis AF2122/97
ucggcggugccgcggcuaggc

SEQ ID NO: 1158435 - RNA, 22 nt, Mycobacterium bovis subsp bovis AF2122/97
ucggcgguguccuacuuuucca

SEQ ID NO: 1158436 - RNA, 12 nt, Mycobacterium bovis subsp bovis AF2122/97
ucggcuggcccg

SEQ ID NO: 1158437 - RNA, 16 nt, Mycobacterium bovis subsp bovis AF2122/97
ucggcugccgcggcug

SEQ ID NO: 1158438 - RNA, 15 nt, Mycobacterium bovis subsp bovis AF2122/97
ucggcuugggaaacc

SEQ ID NO: 1158439 - RNA, 16 nt, Mycobacterium bovis subsp bovis AF2122/97
ucggcuugggaaaccc

SEQ ID NO: 1158440 - RNA, 20 nt, Mycobacterium bovis subsp bovis AF2122/97
ucggcuugggaaacccggcc

SEQ ID NO: 1158441 - RNA, 20 nt, Mycobacterium bovis subsp bovis AF2122/97
ucggcguggucgcgcggcac

SEQ ID NO: 1158442 - RNA, 23 nt, Mycobacterium bovis subsp bovis AF2122/97
ucggcuagcaacgggucgauguc

SEQ ID NO: 1158443 - RNA, 15 nt, Mycobacterium bovis subsp bovis AF2122/97
ucggcguuggggcuc

SEQ ID NO: 1158444 - RNA, 14 nt, Mycobacterium bovis subsp bovis AF2122/97
ucgggcagcacgcc

SEQ ID NO: 1158445 - RNA, 13 nt, Mycobacterium bovis subsp bovis AF2122/97
ucgggcagcagca

SEQ ID NO: 1158446 - RNA, 16 nt, Mycobacterium bovis subsp bovis AF2122/97
ucgggcagcuucaaca

SEQ ID NO: 1158447 - RNA, 14 nt, Mycobacterium bovis subsp bovis AF2122/97
ucgggcagcgcggc

SEQ ID NO: 1158448 - RNA, 16 nt, Mycobacterium bovis subsp bovis AF2122/97
ucgggcaugcucuggc

SEQ ID NO: 1158449 - RNA, 15 nt, Mycobacterium bovis subsp bovis AF2122/97
ucgggcauggucgcc

SEQ ID NO: 1158450 - RNA, 18 nt, Mycobacterium bovis subsp bovis AF2122/97
ucgggcccagcagcgcaa

SEQ ID NO: 1158451 - RNA, 19 nt, Mycobacterium bovis subsp bovis AF2122/97
ucgggauggacaccaccuc

SEQ ID NO: 1158452 - RNA, 21 nt, Mycobacterium bovis subsp bovis AF2122/97
ucgggauggacggcagccagc

SEQ ID NO: 1158453 - RNA, 17 nt, Mycobacterium bovis subsp bovis AF2122/97
ucgggaucugggcucgg

SEQ ID NO: 1158454 - RNA, 15 nt, Mycobacterium bovis subsp bovis AF2122/97
ucgggaugcaaggaa

SEQ ID NO: 1158455 - RNA, 19 nt, Mycobacterium bovis subsp bovis AF2122/97
ucgggaagccgccgggcau

SEQ ID NO: 1158456 - RNA, 20 nt, Mycobacterium bovis subsp bovis AF2122/97
ucgggaacgcucgucgacag

SEQ ID NO: 1158457 - RNA, 17 nt, Mycobacterium bovis subsp bovis AF2122/97
ucggcuuugccgcugug

SEQ ID NO: 1158458 - RNA, 11 nt, Mycobacterium bovis subsp bovis AF2122/97
ucgggagauga

SEQ ID NO: 1158459 - RNA, 14 nt, Mycobacterium bovis subsp bovis AF2122/97
ucgggaucgcugcc

SEQ ID NO: 1158460 - RNA, 13 nt, Mycobacterium bovis subsp bovis AF2122/97
ucgggagcggcug

SEQ ID NO: 1158461 - RNA, 18 nt, Mycobacterium bovis subsp bovis AF2122/97
ucgggagcggcugcggca

SEQ ID NO: 1158462 - RNA, 19 nt, Mycobacterium bovis subsp bovis AF2122/97
ucgggagucuucggcgaca

SEQ ID NO: 1158463 - RNA, 16 nt, Mycobacterium bovis subsp bovis AF2122/97
ucggguguggucacca

SEQ ID NO: 1158464 - RNA, 11 nt, Mycobacterium bovis subsp bovis AF2122/97
ucgggugcagc

SEQ ID NO: 1158465 - RNA, 13 nt, Mycobacterium bovis subsp bovis AF2122/97
ucggguaccagca

SEQ ID NO: 1158466 - RNA, 12 nt, Mycobacterium bovis subsp bovis AF2122/97
ucgggucagcac

SEQ ID NO: 1158467 - RNA, 22 nt, Mycobacterium bovis subsp bovis AF2122/97
ucggggucgaacaugauccgcc

SEQ ID NO: 1158468 - RNA, 14 nt, Mycobacterium bovis subsp bovis AF2122/97
ucgggggcagcgcc

SEQ ID NO: 1158469 - RNA, 15 nt, Mycobacterium bovis subsp bovis AF2122/97
ucgggggcgccggcg

SEQ ID NO: 1158470 - RNA, 16 nt, Mycobacterium bovis subsp bovis AF2122/97
ucgggcgugaucccgc

SEQ ID NO: 1158471 - RNA, 18 nt, Mycobacterium bovis subsp bovis AF2122/97
ucgggcgugaucccgccc

SEQ ID NO: 1158472 - RNA, 17 nt, Mycobacterium bovis subsp bovis AF2122/97
ucgggcgcgguaaccac

SEQ ID NO: 1158473 - RNA, 17 nt, Mycobacterium bovis subsp bovis AF2122/97
ucgggcgcccaugcuga

SEQ ID NO: 1158474 - RNA, 21 nt, Mycobacterium bovis subsp bovis AF2122/97
ucgggcgcgaaaccgcauguc

SEQ ID NO: 1158475 - RNA, 17 nt, Mycobacterium bovis subsp bovis AF2122/97
ucggggccgcaggccag

SEQ ID NO: 1158476 - RNA, 11 nt, Mycobacterium bovis subsp bovis AF2122/97
ucggggaacac

SEQ ID NO: 1158477 - RNA, 18 nt, Mycobacterium bovis subsp bovis AF2122/97
ucggggaugcugaccuuc

SEQ ID NO: 1158478 - RNA, 16 nt, Mycobacterium bovis subsp bovis AF2122/97
ucgggcucggagauga

SEQ ID NO: 1158479 - RNA, 16 nt, Mycobacterium bovis subsp bovis AF2122/97
ucgggcucguccagca

SEQ ID NO: 1158480 - RNA, 19 nt, Mycobacterium bovis subsp bovis AF2122/97
ucgggcucguccagcaacc

SEQ ID NO: 1158481 - RNA, 21 nt, Mycobacterium bovis subsp bovis AF2122/97
ucgggcugccgcaugcgcucc

SEQ ID NO: 1158482 - RNA, 14 nt, Mycobacterium bovis subsp bovis AF2122/97
ucgggcgucagcag

SEQ ID NO: 1158483 - RNA, 19 nt, Mycobacterium bovis subsp bovis AF2122/97
ucgggcuugacccuugggc

SEQ ID NO: 1158484 - RNA, 19 nt, Mycobacterium bovis subsp bovis AF2122/97
ucggugucuuccuccucga

SEQ ID NO: 1158485 - RNA, 14 nt, Mycobacterium bovis subsp bovis AF2122/97
ucggugucggccgc

SEQ ID NO: 1158486 - RNA, 12 nt, Mycobacterium bovis subsp bovis AF2122/97
ucggugaagacg

SEQ ID NO: 1158487 - RNA, 19 nt, Mycobacterium bovis subsp bovis AF2122/97
ucggugaacccgccggcaa

SEQ ID NO: 1158488 - RNA, 16 nt, Mycobacterium bovis subsp bovis AF2122/97
ucggugacgaagagca

SEQ ID NO: 1158489 - RNA, 19 nt, Mycobacterium bovis subsp bovis AF2122/97
ucggugaucuuguccgggc

SEQ ID NO: 1158490 - RNA, 19 nt, Mycobacterium bovis subsp bovis AF2122/97
ucggugagcagggcggcga

SEQ ID NO: 1158491 - RNA, 15 nt, Mycobacterium bovis subsp bovis AF2122/97
ucggugagccgugcc

SEQ ID NO: 1158492 - RNA, 14 nt, Mycobacterium bovis subsp bovis AF2122/97
ucggugcagcagcg

SEQ ID NO: 1158493 - RNA, 17 nt, Mycobacterium bovis subsp bovis AF2122/97
ucggugccggggcugcc

SEQ ID NO: 1158494 - RNA, 23 nt, Mycobacterium bovis subsp bovis AF2122/97
ucggugccggggcugccgccguu

SEQ ID NO: 1158495 - RNA, 15 nt, Mycobacterium bovis subsp bovis AF2122/97
ucggugcggugcaca

SEQ ID NO: 1158496 - RNA, 22 nt, Mycobacterium bovis subsp bovis AF2122/97
ucgguggggucgcugccgccgu

SEQ ID NO: 1158497 - RNA, 17 nt, Mycobacterium bovis subsp bovis AF2122/97
ucggugggugccagccg

SEQ ID NO: 1158498 - RNA, 22 nt, Mycobacterium bovis subsp bovis AF2122/97
ucggugguacgugcgagcccac

SEQ ID NO: 1158499 - RNA, 16 nt, Mycobacterium bovis subsp bovis AF2122/97
ucggugggcgugacgu

SEQ ID NO: 1158500 - RNA, 15 nt, Mycobacterium bovis subsp bovis AF2122/97
ucggucgucucgggc

SEQ ID NO: 1158501 - RNA, 21 nt, Mycobacterium bovis subsp bovis AF2122/97
ucggucgccauguugaagcga

SEQ ID NO: 1158502 - RNA, 20 nt, Mycobacterium bovis subsp bovis AF2122/97
ucggucugcaugcgcuggaa

SEQ ID NO: 1158503 - RNA, 21 nt, Mycobacterium bovis subsp bovis AF2122/97
ucggucuuggcgauccaggcc

SEQ ID NO: 1158504 - RNA, 16 nt, Mycobacterium bovis subsp bovis AF2122/97
ucggucgccaccgccg

SEQ ID NO: 1158505 - RNA, 13 nt, Mycobacterium bovis subsp bovis AF2122/97
ucgguccugccaa

SEQ ID NO: 1158506 - RNA, 14 nt, Mycobacterium bovis subsp bovis AF2122/97
ucggucaguuccuc

SEQ ID NO: 1158507 - RNA, 15 nt, Mycobacterium bovis subsp bovis AF2122/97
ucggucagcugugcg

SEQ ID NO: 1158508 - RNA, 19 nt, Mycobacterium bovis subsp bovis AF2122/97
ucggucagcgccgacucca

SEQ ID NO: 1158509 - RNA, 19 nt, Mycobacterium bovis subsp bovis AF2122/97
ucggucacgacggcacgcc

SEQ ID NO: 1158510 - RNA, 19 nt, Mycobacterium bovis subsp bovis AF2122/97
ucggucagccaccugacaa

SEQ ID NO: 1158511 - RNA, 17 nt, Mycobacterium bovis subsp bovis AF2122/97
ucgguacgguggguggu

SEQ ID NO: 1158512 - RNA, 19 nt, Mycobacterium bovis subsp bovis AF2122/97
ucgguaccccagcgcuguc

SEQ ID NO: 1158513 - RNA, 23 nt, Mycobacterium bovis subsp bovis AF2122/97
ucgggugucacaguggugggcgu

SEQ ID NO: 1158514 - RNA, 22 nt, Mycobacterium bovis subsp bovis AF2122/97
ucguacucccaggccgccgcca

SEQ ID NO: 1158515 - RNA, 22 nt, Mycobacterium bovis subsp bovis AF2122/97
ucguaccuaaggcucaccaggc

SEQ ID NO: 1158516 - RNA, 17 nt, Mycobacterium bovis subsp bovis AF2122/97
ucguccacgaccccggc

SEQ ID NO: 1158517 - RNA, 13 nt, Mycobacterium bovis subsp bovis AF2122/97
ucguccagcacca

SEQ ID NO: 1158518 - RNA, 17 nt, Mycobacterium bovis subsp bovis AF2122/97
ucguaugauucacgcuc

SEQ ID NO: 1158519 - RNA, 21 nt, Mycobacterium bovis subsp bovis AF2122/97
ucguauucgaugccguaggcg

SEQ ID NO: 1158520 - RNA, 21 nt, Mycobacterium bovis subsp bovis AF2122/97
ucguauccgguucugggccug

SEQ ID NO: 1158521 - RNA, 15 nt, Mycobacterium bovis subsp bovis AF2122/97
ucguccgacgggccg

SEQ ID NO: 1158522 - RNA, 20 nt, Mycobacterium bovis subsp bovis AF2122/97
ucgucccggcgaccgggucc

SEQ ID NO: 1158523 - RNA, 11 nt, Mycobacterium bovis subsp bovis AF2122/97
ucguccccaga

SEQ ID NO: 1158524 - RNA, 22 nt, Mycobacterium bovis subsp bovis AF2122/97
ucguccggccacgguccggccc

SEQ ID NO: 1158525 - RNA, 19 nt, Mycobacterium bovis subsp bovis AF2122/97
ucgucgccaagcccaggcg

SEQ ID NO: 1158526 - RNA, 20 nt, Mycobacterium bovis subsp bovis AF2122/97
ucgucgccccguucacgcuc

SEQ ID NO: 1158527 - RNA, 14 nt, Mycobacterium bovis subsp bovis AF2122/97
ucgucgccagggcc

SEQ ID NO: 1158528 - RNA, 22 nt, Mycobacterium bovis subsp bovis AF2122/97
ucgucgccugcgacuaagggca

SEQ ID NO: 1158529 - RNA, 20 nt, Mycobacterium bovis subsp bovis AF2122/97
ucgucgcgauccacuccggc

SEQ ID NO: 1158530 - RNA, 14 nt, Mycobacterium bovis subsp bovis AF2122/97
ucgucgccgagcgg

SEQ ID NO: 1158531 - RNA, 21 nt, Mycobacterium bovis subsp bovis AF2122/97
ucgucgcugcccaucacaccc

SEQ ID NO: 1158532 - RNA, 15 nt, Mycobacterium bovis subsp bovis AF2122/97
ucgucggacucgucc

SEQ ID NO: 1158533 - RNA, 17 nt, Mycobacterium bovis subsp bovis AF2122/97
ucgucggccggcacccc

SEQ ID NO: 1158534 - RNA, 18 nt, Mycobacterium bovis subsp bovis AF2122/97
ucgucggcaugggccggc

SEQ ID NO: 1158535 - RNA, 22 nt, Mycobacterium bovis subsp bovis AF2122/97
ucgucggcaugggccggcgccg

SEQ ID NO: 1158536 - RNA, 17 nt, Mycobacterium bovis subsp bovis AF2122/97
ucgucgggcaugcucug

SEQ ID NO: 1158537 - RNA, 21 nt, Mycobacterium bovis subsp bovis AF2122/97
ucgucggucaaaccggugccg

SEQ ID NO: 1158538 - RNA, 13 nt, Mycobacterium bovis subsp bovis AF2122/97
ucgucggucugca

SEQ ID NO: 1158539 - RNA, 16 nt, Mycobacterium bovis subsp bovis AF2122/97
ucgucgguuccgggcg

SEQ ID NO: 1158540 - RNA, 17 nt, Mycobacterium bovis subsp bovis AF2122/97
ucgucguacaugggcag

SEQ ID NO: 1158541 - RNA, 14 nt, Mycobacterium bovis subsp bovis AF2122/97
ucgucgugucgccg

SEQ ID NO: 1158542 - RNA, 17 nt, Mycobacterium bovis subsp bovis AF2122/97
ucgucgugucgccgccg

SEQ ID NO: 1158543 - RNA, 15 nt, Mycobacterium bovis subsp bovis AF2122/97
ucgucgguugccacg

SEQ ID NO: 1158544 - RNA, 21 nt, Mycobacterium bovis subsp bovis AF2122/97
ucgucgugagucacccggccg

SEQ ID NO: 1158545 - RNA, 18 nt, Mycobacterium bovis subsp bovis AF2122/97
ucgucguaguccaggccg

SEQ ID NO: 1158546 - RNA, 20 nt, Mycobacterium bovis subsp bovis AF2122/97
ucgucguccuguccgggcug

SEQ ID NO: 1158547 - RNA, 20 nt, Mycobacterium bovis subsp bovis AF2122/97
ucgucgucggcguagucgcu

SEQ ID NO: 1158548 - RNA, 20 nt, Mycobacterium bovis subsp bovis AF2122/97
ucgucguugugugccagcgu

SEQ ID NO: 1158549 - RNA, 14 nt, Mycobacterium bovis subsp bovis AF2122/97
ucgugaagcgggug

SEQ ID NO: 1158550 - RNA, 18 nt, Mycobacterium bovis subsp bovis AF2122/97
ucguucgcgucacaccag

SEQ ID NO: 1158551 - RNA, 12 nt, Mycobacterium bovis subsp bovis AF2122/97
ucguucaauguc

SEQ ID NO: 1158552 - RNA, 18 nt, Mycobacterium bovis subsp bovis AF2122/97
ucguucagcgccagcgcc

SEQ ID NO: 1158553 - RNA, 21 nt, Mycobacterium bovis subsp bovis AF2122/97
ucgugacguuguaggagaacg

SEQ ID NO: 1158554 - RNA, 14 nt, Mycobacterium bovis subsp bovis AF2122/97
ucgugaucagcagg

SEQ ID NO: 1158555 - RNA, 14 nt, Mycobacterium bovis subsp bovis AF2122/97
ucgugagacugggc

SEQ ID NO: 1158556 - RNA, 22 nt, Mycobacterium bovis subsp bovis AF2122/97
ucgugaugucaacgugucccaa

SEQ ID NO: 1158557 - RNA, 20 nt, Mycobacterium bovis subsp bovis AF2122/97
ucuaaauaccuuuggcuccc

SEQ ID NO: 1158558 - RNA, 20 nt, Mycobacterium bovis subsp bovis AF2122/97
ucucugagcgggcgggccug

SEQ ID NO: 1158559 - RNA, 16 nt, Mycobacterium bovis subsp bovis AF2122/97
ucucugcgccaggcgg

SEQ ID NO: 1158560 - RNA, 14 nt, Mycobacterium bovis subsp bovis AF2122/97
ucucgguggugagu

SEQ ID NO: 1158561 - RNA, 18 nt, Mycobacterium bovis subsp bovis AF2122/97
ucucggugguccagcgcu

SEQ ID NO: 1158562 - RNA, 17 nt, Mycobacterium bovis subsp bovis AF2122/97
ucucguggaucugccuc

SEQ ID NO: 1158563 - RNA, 18 nt, Mycobacterium bovis subsp bovis AF2122/97
ucucggcgucgaccaguu

SEQ ID NO: 1158564 - RNA, 21 nt, Mycobacterium bovis subsp bovis AF2122/97
ucucggcgggucaggccaggg

SEQ ID NO: 1158565 - RNA, 22 nt, Mycobacterium bovis subsp bovis AF2122/97
ucucgguaccaccggcacggug

SEQ ID NO: 1158566 - RNA, 15 nt, Mycobacterium bovis subsp bovis AF2122/97
ucucggucagcccca

SEQ ID NO: 1158567 - RNA, 19 nt, Mycobacterium bovis subsp bovis AF2122/97
ucucgguggacggcaggcg

SEQ ID NO: 1158568 - RNA, 13 nt, Mycobacterium bovis subsp bovis AF2122/97
ucucggucccgcc

SEQ ID NO: 1158569 - RNA, 19 nt, Mycobacterium bovis subsp bovis AF2122/97
ucucggcgcagccggugag

SEQ ID NO: 1158570 - RNA, 12 nt, Mycobacterium bovis subsp bovis AF2122/97
ucucggccggcg

SEQ ID NO: 1158571 - RNA, 14 nt, Mycobacterium bovis subsp bovis AF2122/97
ucucgcaccgcguu

SEQ ID NO: 1158572 - RNA, 16 nt, Mycobacterium bovis subsp bovis AF2122/97
ucucgcagcaacggcg

SEQ ID NO: 1158573 - RNA, 18 nt, Mycobacterium bovis subsp bovis AF2122/97
ucucgcuguugaagccgc

SEQ ID NO: 1158574 - RNA, 21 nt, Mycobacterium bovis subsp bovis AF2122/97
ucucggaaacggaccuccucg

SEQ ID NO: 1158575 - RNA, 15 nt, Mycobacterium bovis subsp bovis AF2122/97
ucucgaguccaggca

SEQ ID NO: 1158576 - RNA, 13 nt, Mycobacterium bovis subsp bovis AF2122/97
ucucgaucaccuc

SEQ ID NO: 1158577 - RNA, 21 nt, Mycobacterium bovis subsp bovis AF2122/97
ucuccugcugugggauucggg

SEQ ID NO: 1158578 - RNA, 20 nt, Mycobacterium bovis subsp bovis AF2122/97
ucuccucuugcaccagggcc

SEQ ID NO: 1158579 - RNA, 15 nt, Mycobacterium bovis subsp bovis AF2122/97
ucuccugcccuccgu

SEQ ID NO: 1158580 - RNA, 22 nt, Mycobacterium bovis subsp bovis AF2122/97
ucuccggcaccggucuuggugc

SEQ ID NO: 1158581 - RNA, 14 nt, Mycobacterium bovis subsp bovis AF2122/97
ucuccucgugcagc

SEQ ID NO: 1158582 - RNA, 17 nt, Mycobacterium bovis subsp bovis AF2122/97
ucuccucuugcaccagg

SEQ ID NO: 1158583 - RNA, 20 nt, Mycobacterium bovis subsp bovis AF2122/97
ucuccgccgucgccaccggu

SEQ ID NO: 1158584 - RNA, 11 nt, Mycobacterium bovis subsp bovis AF2122/97
ucucccuugcc

SEQ ID NO: 1158585 - RNA, 14 nt, Mycobacterium bovis subsp bovis AF2122/97
ucuccgacauuggc

SEQ ID NO: 1158586 - RNA, 16 nt, Mycobacterium bovis subsp bovis AF2122/97
ucucccggccgcaccc

SEQ ID NO: 1158587 - RNA, 16 nt, Mycobacterium bovis subsp bovis AF2122/97
ucucccgaccgccgag

SEQ ID NO: 1158588 - RNA, 17 nt, Mycobacterium bovis subsp bovis AF2122/97
ucuccagcaccaaaagg

SEQ ID NO: 1158589 - RNA, 20 nt, Mycobacterium bovis subsp bovis AF2122/97
ucuccagaggaaaccgcuag

SEQ ID NO: 1158590 - RNA, 18 nt, Mycobacterium bovis subsp bovis AF2122/97
ucugugugacggaggucg

SEQ ID NO: 1158591 - RNA, 15 nt, Mycobacterium bovis subsp bovis AF2122/97
ucuguaaccuccucg

SEQ ID NO: 1158592 - RNA, 20 nt, Mycobacterium bovis subsp bovis AF2122/97
ucuggacaucggccggcguc

SEQ ID NO: 1158593 - RNA, 18 nt, Mycobacterium bovis subsp bovis AF2122/97
ucuggagugaggcugugc

SEQ ID NO: 1158594 - RNA, 22 nt, Mycobacterium bovis subsp bovis AF2122/97
ucuggagugaggcugugcccca

SEQ ID NO: 1158595 - RNA, 18 nt, Mycobacterium bovis subsp bovis AF2122/97
ucuggcuggaccacucgc

SEQ ID NO: 1158596 - RNA, 13 nt, Mycobacterium bovis subsp bovis AF2122/97
ucugcuccaggcg

SEQ ID NO: 1158597 - RNA, 13 nt, Mycobacterium bovis subsp bovis AF2122/97
ucugcucgccagc

SEQ ID NO: 1158598 - RNA, 15 nt, Mycobacterium bovis subsp bovis AF2122/97
ucugcucgccagcgg

SEQ ID NO: 1158599 - RNA, 15 nt, Mycobacterium bovis subsp bovis AF2122/97
ucugcucgccaggcc

SEQ ID NO: 1158600 - RNA, 21 nt, Mycobacterium bovis subsp bovis AF2122/97
ucuggaaccccgagcugccaa

SEQ ID NO: 1158601 - RNA, 22 nt, Mycobacterium bovis subsp bovis AF2122/97
ucugcacguugauccgcgcaac

SEQ ID NO: 1158602 - RNA, 15 nt, Mycobacterium bovis subsp bovis AF2122/97
ucugcacgucggccc

SEQ ID NO: 1158603 - RNA, 13 nt, Mycobacterium bovis subsp bovis AF2122/97
ucugcagcacgcg

SEQ ID NO: 1158604 - RNA, 14 nt, Mycobacterium bovis subsp bovis AF2122/97
ucugcgcgcggaag

SEQ ID NO: 1158605 - RNA, 20 nt, Mycobacterium bovis subsp bovis AF2122/97
ucugcgcgucaggccagcgc

SEQ ID NO: 1158606 - RNA, 18 nt, Mycobacterium bovis subsp bovis AF2122/97
ucugcggggugagugacc

SEQ ID NO: 1158607 - RNA, 14 nt, Mycobacterium bovis subsp bovis AF2122/97
ucugcagcccaugg

SEQ ID NO: 1158608 - RNA, 22 nt, Mycobacterium bovis subsp bovis AF2122/97
ucugcgcucccguacgccggcg

SEQ ID NO: 1158609 - RNA, 13 nt, Mycobacterium bovis subsp bovis AF2122/97
ucugcggccacgc

SEQ ID NO: 1158610 - RNA, 18 nt, Mycobacterium bovis subsp bovis AF2122/97
ucuucaccggccggugcc

SEQ ID NO: 1158611 - RNA, 22 nt, Mycobacterium bovis subsp bovis AF2122/97
ucuucaacgucgagauccucgu

SEQ ID NO: 1158612 - RNA, 23 nt, Mycobacterium bovis subsp bovis AF2122/97
ucuucaacgucgagauccucguc

SEQ ID NO: 1158613 - RNA, 19 nt, Mycobacterium bovis subsp bovis AF2122/97
ucuugggggccaaccgggu

SEQ ID NO: 1158614 - RNA, 15 nt, Mycobacterium bovis subsp bovis AF2122/97
ucuuggguuucgucg

SEQ ID NO: 1158615 - RNA, 13 nt, Mycobacterium bovis subsp bovis AF2122/97
ucuugggccggga

SEQ ID NO: 1158616 - RNA, 23 nt, Mycobacterium bovis subsp bovis AF2122/97
ucuugggccgggaugaagccacc

SEQ ID NO: 1158617 - RNA, 13 nt, Mycobacterium bovis subsp bovis AF2122/97
ucuuggccagcag

SEQ ID NO: 1158618 - RNA, 23 nt, Mycobacterium bovis subsp bovis AF2122/97
ucuuggcgggagccuugguagcc

SEQ ID NO: 1158619 - RNA, 18 nt, Mycobacterium bovis subsp bovis AF2122/97
ucuuggcgauccaggcca

SEQ ID NO: 1158620 - RNA, 19 nt, Mycobacterium bovis subsp bovis AF2122/97
ucuuggcgaucuccagcgg

SEQ ID NO: 1158621 - RNA, 15 nt, Mycobacterium bovis subsp bovis AF2122/97
ucuuggacagcagca

SEQ ID NO: 1158622 - RNA, 15 nt, Mycobacterium bovis subsp bovis AF2122/97
ucuuccagccaggcc

SEQ ID NO: 1158623 - RNA, 23 nt, Mycobacterium bovis subsp bovis AF2122/97
ucuuucgaaaugaggucuuugcu

SEQ ID NO: 1158624 - RNA, 20 nt, Mycobacterium bovis subsp bovis AF2122/97
ucuuugcucucggucugcau

SEQ ID NO: 1158625 - RNA, 22 nt, Mycobacterium bovis subsp bovis AF2122/97
ucuuugcucucggucugcaugc

SEQ ID NO: 1158626 - RNA, 16 nt, Mycobacterium bovis subsp bovis AF2122/97
ucuuugguagucugca

SEQ ID NO: 1158627 - RNA, 12 nt, Mycobacterium bovis subsp bovis AF2122/97
ucuuugagugcc

SEQ ID NO: 1158628 - RNA, 16 nt, Mycobacterium bovis subsp bovis AF2122/97
ugaaacguccuugaac

SEQ ID NO: 1158629 - RNA, 15 nt, Mycobacterium bovis subsp bovis AF2122/97
ugaaaguucaugcca

SEQ ID NO: 1158630 - RNA, 21 nt, Mycobacterium bovis subsp bovis AF2122/97
ugaaaauaggccgggcagugc

SEQ ID NO: 1158631 - RNA, 22 nt, Mycobacterium bovis subsp bovis AF2122/97
ugaaacagucgaccgaggccuc

SEQ ID NO: 1158632 - RNA, 15 nt, Mycobacterium bovis subsp bovis AF2122/97
ugaacgagaugccgc

SEQ ID NO: 1158633 - RNA, 16 nt, Mycobacterium bovis subsp bovis AF2122/97
ugaacgagaugccgcg

SEQ ID NO: 1158634 - RNA, 13 nt, Mycobacterium bovis subsp bovis AF2122/97
ugaacgcaccaac

SEQ ID NO: 1158635 - RNA, 23 nt, Mycobacterium bovis subsp bovis AF2122/97
ugaacgcaccaacguugugccgc

SEQ ID NO: 1158636 - RNA, 17 nt, Mycobacterium bovis subsp bovis AF2122/97
ugaaccguagcgcccac

SEQ ID NO: 1158637 - RNA, 15 nt, Mycobacterium bovis subsp bovis AF2122/97
ugaaccagaugggug

SEQ ID NO: 1158638 - RNA, 20 nt, Mycobacterium bovis subsp bovis AF2122/97
ugaacagcgacgccaugguc

SEQ ID NO: 1158639 - RNA, 14 nt, Mycobacterium bovis subsp bovis AF2122/97
ugaacaccccuccu

SEQ ID NO: 1158640 - RNA, 17 nt, Mycobacterium bovis subsp bovis AF2122/97
gggacaccaucuccgcc

SEQ ID NO: 1158641 - RNA, 20 nt, Mycobacterium bovis subsp bovis AF2122/97
gggacagauggcggccgagg

SEQ ID NO: 1158642 - RNA, 21 nt, Mycobacterium bovis subsp bovis AF2122/97
gggacagauggcggccgaggu

SEQ ID NO: 1158643 - RNA, 15 nt, Mycobacterium bovis subsp bovis AF2122/97
gggaauucccgcagg

SEQ ID NO: 1158644 - RNA, 19 nt, Mycobacterium bovis subsp bovis AF2122/97
gggacaaucucggccgcau

SEQ ID NO: 1158645 - RNA, 20 nt, Mycobacterium bovis subsp bovis AF2122/97
gggacauccagugcgguggc

SEQ ID NO: 1158646 - RNA, 19 nt, Mycobacterium bovis subsp bovis AF2122/97
gggaccgcaucgguggggc

SEQ ID NO: 1158647 - RNA, 14 nt, Mycobacterium bovis subsp bovis AF2122/97
gggaccgccccggc

SEQ ID NO: 1158648 - RNA, 14 nt, Mycobacterium bovis subsp bovis AF2122/97
gggaccgcgccagg

SEQ ID NO: 1158649 - RNA, 16 nt, Mycobacterium bovis subsp bovis AF2122/97
gggaccggcaggccgg

SEQ ID NO: 1158650 - RNA, 21 nt, Mycobacterium bovis subsp bovis AF2122/97
gggaccgggcguuucccugcc

SEQ ID NO: 1158651 - RNA, 13 nt, Mycobacterium bovis subsp bovis AF2122/97
gggaccggggacg

SEQ ID NO: 1158652 - RNA, 23 nt, Mycobacterium bovis subsp bovis AF2122/97
gggaccgugacguaucgccgcgg

SEQ ID NO: 1158653 - RNA, 17 nt, Mycobacterium bovis subsp bovis AF2122/97
gggacccgagcagugga

SEQ ID NO: 1158654 - RNA, 17 nt, Mycobacterium bovis subsp bovis AF2122/97
gggacccgcuccaagcg

SEQ ID NO: 1158655 - RNA, 21 nt, Mycobacterium bovis subsp bovis AF2122/97
gggacgccuugaucggcgagg

SEQ ID NO: 1158656 - RNA, 17 nt, Mycobacterium bovis subsp bovis AF2122/97
gggacggcggcaagggc

SEQ ID NO: 1158657 - RNA, 12 nt, Mycobacterium bovis subsp bovis AF2122/97
gggacgggcgcg

SEQ ID NO: 1158658 - RNA, 13 nt, Mycobacterium bovis subsp bovis AF2122/97
gggacgggcggcc

SEQ ID NO: 1158659 - RNA, 18 nt, Mycobacterium bovis subsp bovis AF2122/97
gggagaaaacggcggcgc

SEQ ID NO: 1158660 - RNA, 23 nt, Mycobacterium bovis subsp bovis AF2122/97
gggacucugccacccagcacgcg

SEQ ID NO: 1158661 - RNA, 16 nt, Mycobacterium bovis subsp bovis AF2122/97
gggaagccgccgggca

SEQ ID NO: 1158662 - RNA, 22 nt, Mycobacterium bovis subsp bovis AF2122/97
gggaagcccggcagaugcagcg

SEQ ID NO: 1158663 - RNA, 21 nt, Mycobacterium bovis subsp bovis AF2122/97
gggaagccguuuucgaaacug

SEQ ID NO: 1158664 - RNA, 15 nt, Mycobacterium bovis subsp bovis AF2122/97
ggcuuugagccgcuc

SEQ ID NO: 1158665 - RNA, 15 nt, Mycobacterium bovis subsp bovis AF2122/97
ggcuuugucaccggc

SEQ ID NO: 1158666 - RNA, 19 nt, Mycobacterium bovis subsp bovis AF2122/97
ggcuuuugcgcccagcacg

SEQ ID NO: 1158667 - RNA, 14 nt, Mycobacterium bovis subsp bovis AF2122/97
gggaaggaaccggg

SEQ ID NO: 1158668 - RNA, 23 nt, Mycobacterium bovis subsp bovis AF2122/97
gggaaucacccacucgccgagcu

SEQ ID NO: 1158669 - RNA, 18 nt, Mycobacterium bovis subsp bovis AF2122/97
ggccgcacgccgaccagc

SEQ ID NO: 1158670 - RNA, 13 nt, Mycobacterium bovis subsp bovis AF2122/97
ggccgcaccagca

SEQ ID NO: 1158671 - RNA, 21 nt, Mycobacterium bovis subsp bovis AF2122/97
ggccgcacuuucuuccucggg

SEQ ID NO: 1158672 - RNA, 21 nt, Mycobacterium bovis subsp bovis AF2122/97
ggccgcagcggccagcccagc

SEQ ID NO: 1158673 - RNA, 19 nt, Mycobacterium bovis subsp bovis AF2122/97
ggccgcacgccggccagcg

SEQ ID NO: 1158674 - RNA, 13 nt, Mycobacterium bovis subsp bovis AF2122/97
ggccgccagcugc

SEQ ID NO: 1158675 - RNA, 13 nt, Mycobacterium bovis subsp bovis AF2122/97
ggccgccaucccc

SEQ ID NO: 1158676 - RNA, 19 nt, Mycobacterium bovis subsp bovis AF2122/97
ggccgccauccccuggcca

SEQ ID NO: 1158677 - RNA, 21 nt, Mycobacterium bovis subsp bovis AF2122/97
ggccgccauccccuggccagc

SEQ ID NO: 1158678 - RNA, 22 nt, Mycobacterium bovis subsp bovis AF2122/97
ggccgccauccccuggccagca

SEQ ID NO: 1158679 - RNA, 22 nt, Mycobacterium bovis subsp bovis AF2122/97
ggcugugauguuguucagcagg

SEQ ID NO: 1158680 - RNA, 17 nt, Mycobacterium bovis subsp bovis AF2122/97
ggcugucgugauacagc

SEQ ID NO: 1158681 - RNA, 19 nt, Mycobacterium bovis subsp bovis AF2122/97
ggcugucgugccucucggg

SEQ ID NO: 1158682 - RNA, 23 nt, Mycobacterium bovis subsp bovis AF2122/97
ggcugucgugccucucgggggcc

SEQ ID NO: 1158683 - RNA, 17 nt, Mycobacterium bovis subsp bovis AF2122/97
ggcugugaacagcgcgu

SEQ ID NO: 1158684 - RNA, 15 nt, Mycobacterium bovis subsp bovis AF2122/97
ggccgccccaggcug

SEQ ID NO: 1158685 - RNA, 22 nt, Mycobacterium bovis subsp bovis AF2122/97
ggccgccccaggcugguccggg

SEQ ID NO: 1158686 - RNA, 14 nt, Mycobacterium bovis subsp bovis AF2122/97
ggccgcccagaugu

SEQ ID NO: 1158687 - RNA, 16 nt, Mycobacterium bovis subsp bovis AF2122/97
ggccgccccggccgcu

SEQ ID NO: 1158688 - RNA, 21 nt, Mycobacterium bovis subsp bovis AF2122/97
ggcugucacaagccugccggc

SEQ ID NO: 1158689 - RNA, 15 nt, Mycobacterium bovis subsp bovis AF2122/97
ggcugucacgccugc

SEQ ID NO: 1158690 - RNA, 14 nt, Mycobacterium bovis subsp bovis AF2122/97
ggcuugccccgccg

SEQ ID NO: 1158691 - RNA, 16 nt, Mycobacterium bovis subsp bovis AF2122/97
ggcuugcgcagcagcg

SEQ ID NO: 1158692 - RNA, 20 nt, Mycobacterium bovis subsp bovis AF2122/97
ggcuugcgcgcaggugcugg

SEQ ID NO: 1158693 - RNA, 21 nt, Mycobacterium bovis subsp bovis AF2122/97
ggcuucaguccggcccccgac

SEQ ID NO: 1158694 - RNA, 13 nt, Mycobacterium bovis subsp bovis AF2122/97
ggcuucaucuggc

SEQ ID NO: 1158695 - RNA, 19 nt, Mycobacterium bovis subsp bovis AF2122/97
ggcuuccaacucggcggcc

SEQ ID NO: 1158696 - RNA, 13 nt, Mycobacterium bovis subsp bovis AF2122/97
ggcuuccagccac

SEQ ID NO: 1158697 - RNA, 15 nt, Mycobacterium bovis subsp bovis AF2122/97
ggcuucuagcccguu

SEQ ID NO: 1158698 - RNA, 19 nt, Mycobacterium bovis subsp bovis AF2122/97
ggcuucacccaaccccgcc

SEQ ID NO: 1158699 - RNA, 13 nt, Mycobacterium bovis subsp bovis AF2122/97
ggcuuagcggcuu

SEQ ID NO: 1158700 - RNA, 21 nt, Mycobacterium bovis subsp bovis AF2122/97
ggcuuaugcgucugcucgccc

SEQ ID NO: 1158701 - RNA, 17 nt, Mycobacterium bovis subsp bovis AF2122/97
gggccgccgagcggacc

SEQ ID NO: 1158702 - RNA, 12 nt, Mycobacterium bovis subsp bovis AF2122/97
gggccgccgccc

SEQ ID NO: 1158703 - RNA, 13 nt, Mycobacterium bovis subsp bovis AF2122/97
gggccgccgcccu

SEQ ID NO: 1158704 - RNA, 16 nt, Mycobacterium bovis subsp bovis AF2122/97
gggccgccagcggcga

SEQ ID NO: 1158705 - RNA, 14 nt, Mycobacterium bovis subsp bovis AF2122/97
gggccgccgaagcu

SEQ ID NO: 1158706 - RNA, 15 nt, Mycobacterium bovis subsp bovis AF2122/97
gggccggcggcucgg

SEQ ID NO: 1158707 - RNA, 23 nt, Mycobacterium bovis subsp bovis AF2122/97
gggccgcgcgcagagcguacagg

SEQ ID NO: 1158708 - RNA, 13 nt, Mycobacterium bovis subsp bovis AF2122/97
gggccggcgcggu

SEQ ID NO: 1158709 - RNA, 14 nt, Mycobacterium bovis subsp bovis AF2122/97
gggccggcuagggc

SEQ ID NO: 1158710 - RNA, 23 nt, Mycobacterium bovis subsp bovis AF2122/97
gggccggcuagggcagcagcccg

SEQ ID NO: 1158711 - RNA, 13 nt, Mycobacterium bovis subsp bovis AF2122/97
gggccgguccggg

SEQ ID NO: 1158712 - RNA, 12 nt, Mycobacterium bovis subsp bovis AF2122/97
gggccggugcga

SEQ ID NO: 1158713 - RNA, 22 nt, Mycobacterium bovis subsp bovis AF2122/97
gggccggugcgcaccagagugg

SEQ ID NO: 1158714 - RNA, 16 nt, Mycobacterium bovis subsp bovis AF2122/97
gggccgacugggcgcg

SEQ ID NO: 1158715 - RNA, 22 nt, Mycobacterium bovis subsp bovis AF2122/97
gggccgauugcucggggaggaa

SEQ ID NO: 1158716 - RNA, 16 nt, Mycobacterium bovis subsp bovis AF2122/97
gggccgagcgcgccgu

SEQ ID NO: 1158717 - RNA, 12 nt, Mycobacterium bovis subsp bovis AF2122/97
gggccgagcgca

SEQ ID NO: 1158718 - RNA, 21 nt, Mycobacterium bovis subsp bovis AF2122/97
gggcccuuugcuguccccgcc

SEQ ID NO: 1158719 - RNA, 20 nt, Mycobacterium bovis subsp bovis AF2122/97
gggccgaagcgcgcgcguga

SEQ ID NO: 1158720 - RNA, 22 nt, Mycobacterium bovis subsp bovis AF2122/97
gggcccuucacuguugcccuug

SEQ ID NO: 1158721 - RNA, 23 nt, Mycobacterium bovis subsp bovis AF2122/97
gggcagcgaucuugguggccuca

SEQ ID NO: 1158722 - RNA, 11 nt, Mycobacterium bovis subsp bovis AF2122/97
gggcagccgcg

SEQ ID NO: 1158723 - RNA, 11 nt, Mycobacterium bovis subsp bovis AF2122/97
gggcagccugc

SEQ ID NO: 1158724 - RNA, 15 nt, Mycobacterium bovis subsp bovis AF2122/97
gggcagcgccaggcc

SEQ ID NO: 1158725 - RNA, 15 nt, Mycobacterium bovis subsp bovis AF2122/97
gggcagcgcggccag

SEQ ID NO: 1158726 - RNA, 13 nt, Mycobacterium bovis subsp bovis AF2122/97
gggccagcagccg

SEQ ID NO: 1158727 - RNA, 12 nt, Mycobacterium bovis subsp bovis AF2122/97
gggccagccgcu

SEQ ID NO: 1158728 - RNA, 13 nt, Mycobacterium bovis subsp bovis AF2122/97
gggccagccgcuc

SEQ ID NO: 1158729 - RNA, 16 nt, Mycobacterium bovis subsp bovis AF2122/97
gggccagcgucaccuc

SEQ ID NO: 1158730 - RNA, 13 nt, Mycobacterium bovis subsp bovis AF2122/97
gggccaggcugcg

SEQ ID NO: 1158731 - RNA, 23 nt, Mycobacterium bovis subsp bovis AF2122/97
gggccaggucagccgcgcggguc

SEQ ID NO: 1158732 - RNA, 13 nt, Mycobacterium bovis subsp bovis AF2122/97
gggccaggucggc

SEQ ID NO: 1158733 - RNA, 15 nt, Mycobacterium bovis subsp bovis AF2122/97
gggccaggcccagcu

SEQ ID NO: 1158734 - RNA, 19 nt, Mycobacterium bovis subsp bovis AF2122/97
gggcccaggacagcagccg

SEQ ID NO: 1158735 - RNA, 14 nt, Mycobacterium bovis subsp bovis AF2122/97
gggcccugggagau

SEQ ID NO: 1158736 - RNA, 15 nt, Mycobacterium bovis subsp bovis AF2122/97
gggcccagccggacc

SEQ ID NO: 1158737 - RNA, 15 nt, Mycobacterium bovis subsp bovis AF2122/97
gggcagauggugaag

SEQ ID NO: 1158738 - RNA, 11 nt, Mycobacterium bovis subsp bovis AF2122/97
gggcagccgca

SEQ ID NO: 1158739 - RNA, 15 nt, Mycobacterium bovis subsp bovis AF2122/97
gggcagccgcccgcc

SEQ ID NO: 1158740 - RNA, 16 nt, Mycobacterium bovis subsp bovis AF2122/97
gggcagccccuccgcg

SEQ ID NO: 1158741 - RNA, 12 nt, Mycobacterium bovis subsp bovis AF2122/97
gggcagcaaaaa

SEQ ID NO: 1158742 - RNA, 14 nt, Mycobacterium bovis subsp bovis AF2122/97
gggcacucuugucc

SEQ ID NO: 1158743 - RNA, 22 nt, Mycobacterium bovis subsp bovis AF2122/97
gggcacucggcccggcccgggu

SEQ ID NO: 1158744 - RNA, 14 nt, Mycobacterium bovis subsp bovis AF2122/97
gggcacugguggcg

SEQ ID NO: 1158745 - RNA, 15 nt, Mycobacterium bovis subsp bovis AF2122/97
gggcagaagaguguc

SEQ ID NO: 1158746 - RNA, 20 nt, Mycobacterium bovis subsp bovis AF2122/97
gggcagaaucggugggcggg

SEQ ID NO: 1158747 - RNA, 20 nt, Mycobacterium bovis subsp bovis AF2122/97
gggcagaccgaucggcaggc

SEQ ID NO: 1158748 - RNA, 14 nt, Mycobacterium bovis subsp bovis AF2122/97
gggcaacugcagca

SEQ ID NO: 1158749 - RNA, 19 nt, Mycobacterium bovis subsp bovis AF2122/97
gggcaaggacaagccgcug

SEQ ID NO: 1158750 - RNA, 22 nt, Mycobacterium bovis subsp bovis AF2122/97
gggcaaucgcucugugucgccg

SEQ ID NO: 1158751 - RNA, 17 nt, Mycobacterium bovis subsp bovis AF2122/97
gggcaaaucaagcacag

SEQ ID NO: 1158752 - RNA, 18 nt, Mycobacterium bovis subsp bovis AF2122/97
gggcaaaucaagcacagc

SEQ ID NO: 1158753 - RNA, 14 nt, Mycobacterium bovis subsp bovis AF2122/97
gggcaacgccucga

SEQ ID NO: 1158754 - RNA, 15 nt, Mycobacterium bovis subsp bovis AF2122/97
gggauccgcgcgcug

SEQ ID NO: 1158755 - RNA, 18 nt, Mycobacterium bovis subsp bovis AF2122/97
gggauccagcaggccggg

SEQ ID NO: 1158756 - RNA, 17 nt, Mycobacterium bovis subsp bovis AF2122/97
gggaucccagcgcagcg

SEQ ID NO: 1158757 - RNA, 14 nt, Mycobacterium bovis subsp bovis AF2122/97
gggaucgaccaugg

SEQ ID NO: 1158758 - RNA, 14 nt, Mycobacterium bovis subsp bovis AF2122/97
gggaucgacccgcc

SEQ ID NO: 1158759 - RNA, 16 nt, Mycobacterium bovis subsp bovis AF2122/97
gggaucaggcugggca

SEQ ID NO: 1158760 - RNA, 12 nt, Mycobacterium bovis subsp bovis AF2122/97
gggaucagcucc

SEQ ID NO: 1158761 - RNA, 18 nt, Mycobacterium bovis subsp bovis AF2122/97
gggagcccgagcucaccg

SEQ ID NO: 1158762 - RNA, 19 nt, Mycobacterium bovis subsp bovis AF2122/97
gggagcagagaaaccgcga

SEQ ID NO: 1158763 - RNA, 13 nt, Mycobacterium bovis subsp bovis AF2122/97
gggagccaccggc

SEQ ID NO: 1158764 - RNA, 19 nt, Mycobacterium bovis subsp bovis AF2122/97
gggagcaccgaccagggcc

SEQ ID NO: 1158765 - RNA, 15 nt, Mycobacterium bovis subsp bovis AF2122/97
gggagcacuacccca

SEQ ID NO: 1158766 - RNA, 20 nt, Mycobacterium bovis subsp bovis AF2122/97
gggagcacuaccccacaagc

SEQ ID NO: 1158767 - RNA, 14 nt, Mycobacterium bovis subsp bovis AF2122/97
gggaucgcccaggc

SEQ ID NO: 1158768 - RNA, 19 nt, Mycobacterium bovis subsp bovis AF2122/97
gggaucgccguccagcaau

SEQ ID NO: 1158769 - RNA, 21 nt, Mycobacterium bovis subsp bovis AF2122/97
gggaucgagagccgaccgggu

SEQ ID NO: 1158770 - RNA, 14 nt, Mycobacterium bovis subsp bovis AF2122/97
gggaucgcugccag

SEQ ID NO: 1158771 - RNA, 14 nt, Mycobacterium bovis subsp bovis AF2122/97
gggauucggcagcg

SEQ ID NO: 1158772 - RNA, 19 nt, Mycobacterium bovis subsp bovis AF2122/97
gggauugcgggccugcacg

SEQ ID NO: 1158773 - RNA, 19 nt, Mycobacterium bovis subsp bovis AF2122/97
gggauucgucgugcgggcg

SEQ ID NO: 1158774 - RNA, 14 nt, Mycobacterium bovis subsp bovis AF2122/97
ggggcgccugaugc

SEQ ID NO: 1158775 - RNA, 23 nt, Mycobacterium bovis subsp bovis AF2122/97
ggggcgccuuaggcguccgagcg

SEQ ID NO: 1158776 - RNA, 15 nt, Mycobacterium bovis subsp bovis AF2122/97
ggggcgcagcgcggc

SEQ ID NO: 1158777 - RNA, 12 nt, Mycobacterium bovis subsp bovis AF2122/97
ggggcgcccggc

SEQ ID NO: 1158778 - RNA, 12 nt, Mycobacterium bovis subsp bovis AF2122/97
ggggcgcgccgg

SEQ ID NO: 1158779 - RNA, 19 nt, Mycobacterium bovis subsp bovis AF2122/97
ggggcgcucgcgcgcuggg

SEQ ID NO: 1158780 - RNA, 11 nt, Mycobacterium bovis subsp bovis AF2122/97
ggggcgcgugg

SEQ ID NO: 1158781 - RNA, 13 nt, Mycobacterium bovis subsp bovis AF2122/97
ggggcgcccggcc

SEQ ID NO: 1158782 - RNA, 22 nt, Mycobacterium bovis subsp bovis AF2122/97
ggggcgcuuccguggcccaacc

SEQ ID NO: 1158783 - RNA, 14 nt, Mycobacterium bovis subsp bovis AF2122/97
ggggcggcgguggg

SEQ ID NO: 1158784 - RNA, 14 nt, Mycobacterium bovis subsp bovis AF2122/97
ggggcgucgccgcc

SEQ ID NO: 1158785 - RNA, 22 nt, Mycobacterium bovis subsp bovis AF2122/97
ggggcgugccgccgcagauggg

SEQ ID NO: 1158786 - RNA, 19 nt, Mycobacterium bovis subsp bovis AF2122/97
ggggcuauggcgcagcugg

SEQ ID NO: 1158787 - RNA, 22 nt, Mycobacterium bovis subsp bovis AF2122/97
ggggcgucguucgcgggugcgc

SEQ ID NO: 1158788 - RNA, 16 nt, Mycobacterium bovis subsp bovis AF2122/97
ggggcucagcgguggc

SEQ ID NO: 1158789 - RNA, 19 nt, Mycobacterium bovis subsp bovis AF2122/97
ggggcucagcgguggcgug

SEQ ID NO: 1158790 - RNA, 18 nt, Mycobacterium bovis subsp bovis AF2122/97
ggggcuacuaggcccagc

SEQ ID NO: 1158791 - RNA, 20 nt, Mycobacterium bovis subsp bovis AF2122/97
ggggcuacuaggcccagcac

SEQ ID NO: 1158792 - RNA, 20 nt, Mycobacterium bovis subsp bovis AF2122/97
ggggcucagcgguggcgugg

SEQ ID NO: 1158793 - RNA, 16 nt, Mycobacterium bovis subsp bovis AF2122/97
ggggcugccgccguug

SEQ ID NO: 1158794 - RNA, 20 nt, Mycobacterium bovis subsp bovis AF2122/97
ggggcugcugcucggccugg

SEQ ID NO: 1158795 - RNA, 19 nt, Mycobacterium bovis subsp bovis AF2122/97
ggggcugggcgccaugcgc

SEQ ID NO: 1158796 - RNA, 12 nt, Mycobacterium bovis subsp bovis AF2122/97
ggggcugugcag

SEQ ID NO: 1158797 - RNA, 16 nt, Mycobacterium bovis subsp bovis AF2122/97
ggggcugugcaggcgg

SEQ ID NO: 1158798 - RNA, 18 nt, Mycobacterium bovis subsp bovis AF2122/97
ggggcuucugcgucugcu

SEQ ID NO: 1158799 - RNA, 16 nt, Mycobacterium bovis subsp bovis AF2122/97
gggggcaagcuccagu

SEQ ID NO: 1158800 - RNA, 12 nt, Mycobacterium bovis subsp bovis AF2122/97
gggggccgagcc

SEQ ID NO: 1158801 - RNA, 18 nt, Mycobacterium bovis subsp bovis AF2122/97
gggggccgagccgacauc

SEQ ID NO: 1158802 - RNA, 13 nt, Mycobacterium bovis subsp bovis AF2122/97
gggggcgccggcg

SEQ ID NO: 1158803 - RNA, 17 nt, Mycobacterium bovis subsp bovis AF2122/97
gggggucuugccgagca

SEQ ID NO: 1158804 - RNA, 17 nt, Mycobacterium bovis subsp bovis AF2122/97
ggggguucuggccguag

SEQ ID NO: 1158805 - RNA, 19 nt, Mycobacterium bovis subsp bovis AF2122/97
ggggguugcggcagcuggc

SEQ ID NO: 1158806 - RNA, 17 nt, Mycobacterium bovis subsp bovis AF2122/97
ggggguagccgccggcg

SEQ ID NO: 1158807 - RNA, 14 nt, Mycobacterium bovis subsp bovis AF2122/97
gggguacaggcugc

SEQ ID NO: 1158808 - RNA, 16 nt, Mycobacterium bovis subsp bovis AF2122/97
gggguagccgccggcg

SEQ ID NO: 1158809 - RNA, 20 nt, Mycobacterium bovis subsp bovis AF2122/97
gggguccggauggccccgcc

SEQ ID NO: 1158810 - RNA, 13 nt, Mycobacterium bovis subsp bovis AF2122/97
gggguccggcggc

SEQ ID NO: 1158811 - RNA, 14 nt, Mycobacterium bovis subsp bovis AF2122/97
gggguccagcgucc

SEQ ID NO: 1158812 - RNA, 18 nt, Mycobacterium bovis subsp bovis AF2122/97
ggggucgcugugcagcgg

SEQ ID NO: 1158813 - RNA, 16 nt, Mycobacterium bovis subsp bovis AF2122/97
ggggucccgccgggug

SEQ ID NO: 1158814 - RNA, 22 nt, Mycobacterium bovis subsp bovis AF2122/97
gggguaucgacccuccagcacg

SEQ ID NO: 1158815 - RNA, 24 nt, Mycobacterium bovis subsp bovis AF2122/97
gggguaucgacccuccagcacgcc

SEQ ID NO: 1158816 - RNA, 21 nt, Mycobacterium bovis subsp bovis AF2122/97
gggguaucgccagccaaccgu

SEQ ID NO: 1158817 - RNA, 16 nt, Mycobacterium bovis subsp bovis AF2122/97
ggggucggcccgccaa

SEQ ID NO: 1158818 - RNA, 17 nt, Mycobacterium bovis subsp bovis AF2122/97
ggggucugauggcggcu

SEQ ID NO: 1158819 - RNA, 12 nt, Mycobacterium bovis subsp bovis AF2122/97
ggggugccggcg

SEQ ID NO: 1158820 - RNA, 22 nt, Mycobacterium bovis subsp bovis AF2122/97
ggggugcacgccuugagccgag

SEQ ID NO: 1158821 - RNA, 17 nt, Mycobacterium bovis subsp bovis AF2122/97
ggggugcccggccgcca

SEQ ID NO: 1158822 - RNA, 23 nt, Mycobacterium bovis subsp bovis AF2122/97
gggucggccggguugcccuggug

SEQ ID NO: 1158823 - RNA, 18 nt, Mycobacterium bovis subsp bovis AF2122/97
gggucggccugcggcacc

SEQ ID NO: 1158824 - RNA, 18 nt, Mycobacterium bovis subsp bovis AF2122/97
gggucgggacgcugccgg

SEQ ID NO: 1158825 - RNA, 22 nt, Mycobacterium bovis subsp bovis AF2122/97
gggugaucgaaaacgggggcgc

SEQ ID NO: 1158826 - RNA, 18 nt, Mycobacterium bovis subsp bovis AF2122/97
gggugccggcagcggcgc

SEQ ID NO: 1158827 - RNA, 15 nt, Mycobacterium bovis subsp bovis AF2122/97
gggugccggcgccgc

SEQ ID NO: 1158828 - RNA, 15 nt, Mycobacterium bovis subsp bovis AF2122/97
gggugccggcgucgc

SEQ ID NO: 1158829 - RNA, 12 nt, Mycobacterium bovis subsp bovis AF2122/97
gggugccgcagc

SEQ ID NO: 1158830 - RNA, 19 nt, Mycobacterium bovis subsp bovis AF2122/97
gggugcagcacggcgccgc

SEQ ID NO: 1158831 - RNA, 21 nt, Mycobacterium bovis subsp bovis AF2122/97
gggugccagcccguugcagga

SEQ ID NO: 1158832 - RNA, 23 nt, Mycobacterium bovis subsp bovis AF2122/97
gggucgcaauauccggccgagcc

SEQ ID NO: 1158833 - RNA, 19 nt, Mycobacterium bovis subsp bovis AF2122/97
gggucgcaccccggcggcg

SEQ ID NO: 1158834 - RNA, 22 nt, Mycobacterium bovis subsp bovis AF2122/97
gggucgccgccaucagcccuuc

SEQ ID NO: 1158835 - RNA, 21 nt, Mycobacterium bovis subsp bovis AF2122/97
gggucgcgggguaggcccagc

SEQ ID NO: 1158836 - RNA, 15 nt, Mycobacterium bovis subsp bovis AF2122/97
gggucaggccagggu

SEQ ID NO: 1158837 - RNA, 13 nt, Mycobacterium bovis subsp bovis AF2122/97
gggucaggccagg

SEQ ID NO: 1158838 - RNA, 22 nt, Mycobacterium bovis subsp bovis AF2122/97
gggucgaacaggccggccgcga

SEQ ID NO: 1158839 - RNA, 17 nt, Mycobacterium bovis subsp bovis AF2122/97
gggucagcugggacccg

SEQ ID NO: 1158840 - RNA, 21 nt, Mycobacterium bovis subsp bovis AF2122/97
gggucagcugggacccgagca

SEQ ID NO: 1158841 - RNA, 12 nt, Mycobacterium bovis subsp bovis AF2122/97
gggucacccccg

SEQ ID NO: 1158842 - RNA, 21 nt, Mycobacterium bovis subsp bovis AF2122/97
gggucaccucgucgccuagcc

SEQ ID NO: 1158843 - RNA, 11 nt, Mycobacterium bovis subsp bovis AF2122/97
ggguaccuccc

SEQ ID NO: 1158844 - RNA, 19 nt, Mycobacterium bovis subsp bovis AF2122/97
ggguacgacaccgcagcgg

SEQ ID NO: 1158845 - RNA, 20 nt, Mycobacterium bovis subsp bovis AF2122/97
gggucaaugcuggcagcggc

SEQ ID NO: 1158846 - RNA, 19 nt, Mycobacterium bovis subsp bovis AF2122/97
gggguggcgcgggccggcg

SEQ ID NO: 1158847 - RNA, 11 nt, Mycobacterium bovis subsp bovis AF2122/97
ggggugguggu

SEQ ID NO: 1158848 - RNA, 12 nt, Mycobacterium bovis subsp bovis AF2122/97
gggguggcggca

SEQ ID NO: 1158849 - RNA, 23 nt, Mycobacterium bovis subsp bovis AF2122/97
ggggugugcgggguugggcggag

SEQ ID NO: 1158850 - RNA, 18 nt, Mycobacterium bovis subsp bovis AF2122/97
gggguguugaggccggug

SEQ ID NO: 1158851 - RNA, 15 nt, Mycobacterium bovis subsp bovis AF2122/97
gggguugggcggggu

SEQ ID NO: 1158852 - RNA, 21 nt, Mycobacterium bovis subsp bovis AF2122/97
gggguuaggaguggccgggcg

SEQ ID NO: 1158853 - RNA, 17 nt, Mycobacterium bovis subsp bovis AF2122/97
gggguugacuggccgcc

SEQ ID NO: 1158854 - RNA, 16 nt, Mycobacterium bovis subsp bovis AF2122/97
gggguugcggcagcug

SEQ ID NO: 1158855 - RNA, 17 nt, Mycobacterium bovis subsp bovis AF2122/97
gggguuggcucggcgca

SEQ ID NO: 1158856 - RNA, 16 nt, Mycobacterium bovis subsp bovis AF2122/97
gggccgucgccgucca

SEQ ID NO: 1158857 - RNA, 23 nt, Mycobacterium bovis subsp bovis AF2122/97
gggccguccggcuuggcggcgau

SEQ ID NO: 1158858 - RNA, 13 nt, Mycobacterium bovis subsp bovis AF2122/97
gggccguccgggu

SEQ ID NO: 1158859 - RNA, 22 nt, Mycobacterium bovis subsp bovis AF2122/97
gggccguccggcuuggcggcga

SEQ ID NO: 1158860 - RNA, 20 nt, Mycobacterium bovis subsp bovis AF2122/97
gggccguacggcgcguacgg

SEQ ID NO: 1158861 - RNA, 12 nt, Mycobacterium bovis subsp bovis AF2122/97
gggccuccugcu

SEQ ID NO: 1158862 - RNA, 17 nt, Mycobacterium bovis subsp bovis AF2122/97
gggcggcaacggcggca

SEQ ID NO: 1158863 - RNA, 18 nt, Mycobacterium bovis subsp bovis AF2122/97
gggcggcaacggcggcaa

SEQ ID NO: 1158864 - RNA, 21 nt, Mycobacterium bovis subsp bovis AF2122/97
gggcggcaacgggggcgccgg

SEQ ID NO: 1158865 - RNA, 14 nt, Mycobacterium bovis subsp bovis AF2122/97
gggcggcaucccca

SEQ ID NO: 1158866 - RNA, 18 nt, Mycobacterium bovis subsp bovis AF2122/97
gggcggcauuaccaacgc

SEQ ID NO: 1158867 - RNA, 12 nt, Mycobacterium bovis subsp bovis AF2122/97
gggcggccagca

SEQ ID NO: 1158868 - RNA, 14 nt, Mycobacterium bovis subsp bovis AF2122/97
gggcggccaggauc

SEQ ID NO: 1158869 - RNA, 14 nt, Mycobacterium bovis subsp bovis AF2122/97
gggcggccaggcgc

SEQ ID NO: 1158870 - RNA, 23 nt, Mycobacterium bovis subsp bovis AF2122/97
gggcgcugccaauccgaucgagg

SEQ ID NO: 1158871 - RNA, 13 nt, Mycobacterium bovis subsp bovis AF2122/97
gggccugcccggc

SEQ ID NO: 1158872 - RNA, 13 nt, Mycobacterium bovis subsp bovis AF2122/97
gggccugcgcaga

SEQ ID NO: 1158873 - RNA, 20 nt, Mycobacterium bovis subsp bovis AF2122/97
gggccugcacgccggcgcug

SEQ ID NO: 1158874 - RNA, 21 nt, Mycobacterium bovis subsp bovis AF2122/97
gggcggcggugggcgcggacc

SEQ ID NO: 1158875 - RNA, 18 nt, Mycobacterium bovis subsp bovis AF2122/97
gggcggcggcgcgaucga

SEQ ID NO: 1158876 - RNA, 20 nt, Mycobacterium bovis subsp bovis AF2122/97
gggcgggguggaauucaucc

SEQ ID NO: 1158877 - RNA, 15 nt, Mycobacterium bovis subsp bovis AF2122/97
gggcgggucugggug

SEQ ID NO: 1158878 - RNA, 17 nt, Mycobacterium bovis subsp bovis AF2122/97
gggcuaccggcagcugc

SEQ ID NO: 1158879 - RNA, 18 nt, Mycobacterium bovis subsp bovis AF2122/97
gggcuacuaggcccagca

SEQ ID NO: 1158880 - RNA, 17 nt, Mycobacterium bovis subsp bovis AF2122/97
gggcuaauccagcagca

SEQ ID NO: 1158881 - RNA, 13 nt, Mycobacterium bovis subsp bovis AF2122/97
gggcucggcggcc

SEQ ID NO: 1158882 - RNA, 20 nt, Mycobacterium bovis subsp bovis AF2122/97
gggcucgcuucaggcaccgg

SEQ ID NO: 1158883 - RNA, 18 nt, Mycobacterium bovis subsp bovis AF2122/97
gggcucgcucgccgagcu

SEQ ID NO: 1158884 - RNA, 16 nt, Mycobacterium bovis subsp bovis AF2122/97
gggcucguccagcaac

SEQ ID NO: 1158885 - RNA, 19 nt, Mycobacterium bovis subsp bovis AF2122/97
gggcucguaggugggcucg

SEQ ID NO: 1158886 - RNA, 19 nt, Mycobacterium bovis subsp bovis AF2122/97
gggcucucgaguccaggca

SEQ ID NO: 1158887 - RNA, 14 nt, Mycobacterium bovis subsp bovis AF2122/97
gggcucuggccagu

SEQ ID NO: 1158888 - RNA, 23 nt, Mycobacterium bovis subsp bovis AF2122/97
gggcucgacguauuggcgcagca

SEQ ID NO: 1158889 - RNA, 22 nt, Mycobacterium bovis subsp bovis AF2122/97
gggcuccccggauuccucguca

SEQ ID NO: 1158890 - RNA, 15 nt, Mycobacterium bovis subsp bovis AF2122/97
gggcucaagucuccc

SEQ ID NO: 1158891 - RNA, 13 nt, Mycobacterium bovis subsp bovis AF2122/97
gggcuagucgggg

SEQ ID NO: 1158892 - RNA, 21 nt, Mycobacterium bovis subsp bovis AF2122/97
ggggcagcgacggcagcucgg

SEQ ID NO: 1158893 - RNA, 12 nt, Mycobacterium bovis subsp bovis AF2122/97
ggggcagcgcgg

SEQ ID NO: 1158894 - RNA, 20 nt, Mycobacterium bovis subsp bovis AF2122/97
ggggcacgacgccggccugg

SEQ ID NO: 1158895 - RNA, 15 nt, Mycobacterium bovis subsp bovis AF2122/97
ggggccgagccgaca

SEQ ID NO: 1158896 - RNA, 15 nt, Mycobacterium bovis subsp bovis AF2122/97
ggggccccgcgccgg

SEQ ID NO: 1158897 - RNA, 13 nt, Mycobacterium bovis subsp bovis AF2122/97
ggggccccaugcc

SEQ ID NO: 1158898 - RNA, 15 nt, Mycobacterium bovis subsp bovis AF2122/97
ggggccgcgccuugc

SEQ ID NO: 1158899 - RNA, 17 nt, Mycobacterium bovis subsp bovis AF2122/97
ggggccgccgcggccgg

SEQ ID NO: 1158900 - RNA, 14 nt, Mycobacterium bovis subsp bovis AF2122/97
ggggccgcuggggc

SEQ ID NO: 1158901 - RNA, 13 nt, Mycobacterium bovis subsp bovis AF2122/97
ggggccggauguc

SEQ ID NO: 1158902 - RNA, 15 nt, Mycobacterium bovis subsp bovis AF2122/97
ggggccgcuggggcg

SEQ ID NO: 1158903 - RNA, 20 nt, Mycobacterium bovis subsp bovis AF2122/97
ggggccggcacugccgagca

SEQ ID NO: 1158904 - RNA, 13 nt, Mycobacterium bovis subsp bovis AF2122/97
ggggccgggcucc

SEQ ID NO: 1158905 - RNA, 20 nt, Mycobacterium bovis subsp bovis AF2122/97
ggggccggggucggcccgcc

SEQ ID NO: 1158906 - RNA, 19 nt, Mycobacterium bovis subsp bovis AF2122/97
ggggccgucucgccgugga

SEQ ID NO: 1158907 - RNA, 11 nt, Mycobacterium bovis subsp bovis AF2122/97
ggggccgggcg

SEQ ID NO: 1158908 - RNA, 22 nt, Mycobacterium bovis subsp bovis AF2122/97
ggggccgucgucggucaccgac

SEQ ID NO: 1158909 - RNA, 15 nt, Mycobacterium bovis subsp bovis AF2122/97
ggggcgcaccgagcg

SEQ ID NO: 1158910 - RNA, 12 nt, Mycobacterium bovis subsp bovis AF2122/97
ggggcgaccugg

SEQ ID NO: 1158911 - RNA, 22 nt, Mycobacterium bovis subsp bovis AF2122/97
gggcuguugacgccacgacgcc

SEQ ID NO: 1158912 - RNA, 19 nt, Mycobacterium bovis subsp bovis AF2122/97
gggcuuagcgcgggccugg

SEQ ID NO: 1158913 - RNA, 19 nt, Mycobacterium bovis subsp bovis AF2122/97
gggcuuccaacaggccggu

SEQ ID NO: 1158914 - RNA, 16 nt, Mycobacterium bovis subsp bovis AF2122/97
gggcuugccgcgcacc

SEQ ID NO: 1158915 - RNA, 14 nt, Mycobacterium bovis subsp bovis AF2122/97
gggcuucggccaga

SEQ ID NO: 1158916 - RNA, 19 nt, Mycobacterium bovis subsp bovis AF2122/97
gggcugguguagaccucaa

SEQ ID NO: 1158917 - RNA, 18 nt, Mycobacterium bovis subsp bovis AF2122/97
gggcuguacucgcggcgc

SEQ ID NO: 1158918 - RNA, 23 nt, Mycobacterium bovis subsp bovis AF2122/97
gggcuguucggccauggcggcgc

SEQ ID NO: 1158919 - RNA, 17 nt, Mycobacterium bovis subsp bovis AF2122/97
gggcuggguggccaacc

SEQ ID NO: 1158920 - RNA, 19 nt, Mycobacterium bovis subsp bovis AF2122/97
gggcuguccgaccucgccg

SEQ ID NO: 1158921 - RNA, 18 nt, Mycobacterium bovis subsp bovis AF2122/97
gggcugaccgaagaagcc

SEQ ID NO: 1158922 - RNA, 15 nt, Mycobacterium bovis subsp bovis AF2122/97
ggggaguaguggugg

SEQ ID NO: 1158923 - RNA, 21 nt, Mycobacterium bovis subsp bovis AF2122/97
ggggaguucgcgcagcaccgg

SEQ ID NO: 1158924 - RNA, 14 nt, Mycobacterium bovis subsp bovis AF2122/97
ggggagcggccgcc

SEQ ID NO: 1158925 - RNA, 13 nt, Mycobacterium bovis subsp bovis AF2122/97
ggggaggaaaucc

SEQ ID NO: 1158926 - RNA, 16 nt, Mycobacterium bovis subsp bovis AF2122/97
ggggaggaaauccaau

SEQ ID NO: 1158927 - RNA, 15 nt, Mycobacterium bovis subsp bovis AF2122/97
ggggauaccgcuggg

SEQ ID NO: 1158928 - RNA, 18 nt, Mycobacterium bovis subsp bovis AF2122/97
ggggaucguccggccggg

SEQ ID NO: 1158929 - RNA, 17 nt, Mycobacterium bovis subsp bovis AF2122/97
ggggaucucgagccgcg

SEQ ID NO: 1158930 - RNA, 19 nt, Mycobacterium bovis subsp bovis AF2122/97
ggggauccagcaggccggg

SEQ ID NO: 1158931 - RNA, 21 nt, Mycobacterium bovis subsp bovis AF2122/97
ggggaugacgguuugcagcgg

SEQ ID NO: 1158932 - RNA, 17 nt, Mycobacterium bovis subsp bovis AF2122/97
ggggaugggggagccgg

SEQ ID NO: 1158933 - RNA, 14 nt, Mycobacterium bovis subsp bovis AF2122/97
ggggauggucccgc

SEQ ID NO: 1158934 - RNA, 12 nt, Mycobacterium bovis subsp bovis AF2122/97
ggggauggcgcc

SEQ ID NO: 1158935 - RNA, 21 nt, Mycobacterium bovis subsp bovis AF2122/97
ggggaugccgaaccgcugcgg

SEQ ID NO: 1158936 - RNA, 14 nt, Mycobacterium bovis subsp bovis AF2122/97
ggggauggagccgg

SEQ ID NO: 1158937 - RNA, 21 nt, Mycobacterium bovis subsp bovis AF2122/97
ggggcaacgaucagguuggcg

SEQ ID NO: 1158938 - RNA, 16 nt, Mycobacterium bovis subsp bovis AF2122/97
ggggcaauccccugga

SEQ ID NO: 1158939 - RNA, 17 nt, Mycobacterium bovis subsp bovis AF2122/97
ggggcaaacggggucaa

SEQ ID NO: 1158940 - RNA, 18 nt, Mycobacterium bovis subsp bovis AF2122/97
ggggauuggugcccagcg

SEQ ID NO: 1158941 - RNA, 16 nt, Mycobacterium bovis subsp bovis AF2122/97
gggugucgaagagcag

SEQ ID NO: 1158942 - RNA, 22 nt, Mycobacterium bovis subsp bovis AF2122/97
gggugguucaccucggcgacga

SEQ ID NO: 1158943 - RNA, 19 nt, Mycobacterium bovis subsp bovis AF2122/97
ggguggugucgcggccgcc

SEQ ID NO: 1158944 - RNA, 23 nt, Mycobacterium bovis subsp bovis AF2122/97
ggguggugaaguagucggcgccg

SEQ ID NO: 1158945 - RNA, 17 nt, Mycobacterium bovis subsp bovis AF2122/97
gggugguaccggcggcg

SEQ ID NO: 1158946 - RNA, 23 nt, Mycobacterium bovis subsp bovis AF2122/97
gggugguagcugacgcugcucug

SEQ ID NO: 1158947 - RNA, 12 nt, Mycobacterium bovis subsp bovis AF2122/97
ggguggcggcgc

SEQ ID NO: 1158948 - RNA, 16 nt, Mycobacterium bovis subsp bovis AF2122/97
gguagccauccgugaa

SEQ ID NO: 1158949 - RNA, 14 nt, Mycobacterium bovis subsp bovis AF2122/97
gguagccgaccagc

SEQ ID NO: 1158950 - RNA, 16 nt, Mycobacterium bovis subsp bovis AF2122/97
gguagccgccggcgcc

SEQ ID NO: 1158951 - RNA, 16 nt, Mycobacterium bovis subsp bovis AF2122/97
ggguguugaggccggu

SEQ ID NO: 1158952 - RNA, 15 nt, Mycobacterium bovis subsp bovis AF2122/97
gggugucgggcgcgc

SEQ ID NO: 1158953 - RNA, 16 nt, Mycobacterium bovis subsp bovis AF2122/97
gguagccgucgauccc

SEQ ID NO: 1158954 - RNA, 14 nt, Mycobacterium bovis subsp bovis AF2122/97
gguagccugaccag

SEQ ID NO: 1158955 - RNA, 15 nt, Mycobacterium bovis subsp bovis AF2122/97
gguagcgcggguggc

SEQ ID NO: 1158956 - RNA, 21 nt, Mycobacterium bovis subsp bovis AF2122/97
gguagcgcggguggcucgggu

SEQ ID NO: 1158957 - RNA, 16 nt, Mycobacterium bovis subsp bovis AF2122/97
gguagcgaucgugcug

SEQ ID NO: 1158958 - RNA, 19 nt, Mycobacterium bovis subsp bovis AF2122/97
gguagcggaucaagcgcac

SEQ ID NO: 1158959 - RNA, 21 nt, Mycobacterium bovis subsp bovis AF2122/97
gguagcgcucgaucagguugg

SEQ ID NO: 1158960 - RNA, 21 nt, Mycobacterium bovis subsp bovis AF2122/97
gguagcguccaggucaugccg

SEQ ID NO: 1158961 - RNA, 16 nt, Mycobacterium bovis subsp bovis AF2122/97
ggucaaacgcgcgcgc

SEQ ID NO: 1158962 - RNA, 17 nt, Mycobacterium bovis subsp bovis AF2122/97
gguauccacgccgggca

SEQ ID NO: 1158963 - RNA, 16 nt, Mycobacterium bovis subsp bovis AF2122/97
gguaucgagggcagcc

SEQ ID NO: 1158964 - RNA, 17 nt, Mycobacterium bovis subsp bovis AF2122/97
gguaucgagggcagccg

SEQ ID NO: 1158965 - RNA, 18 nt, Mycobacterium bovis subsp bovis AF2122/97
gguaucgagggcagccgc

SEQ ID NO: 1158966 - RNA, 20 nt, Mycobacterium bovis subsp bovis AF2122/97
gguauucguggucggccucg

SEQ ID NO: 1158967 - RNA, 18 nt, Mycobacterium bovis subsp bovis AF2122/97
ggucaccacgcggcgguc

SEQ ID NO: 1158968 - RNA, 14 nt, Mycobacterium bovis subsp bovis AF2122/97
ggucacaaacggca

SEQ ID NO: 1158969 - RNA, 20 nt, Mycobacterium bovis subsp bovis AF2122/97
ggucacacucccauccgccu

SEQ ID NO: 1158970 - RNA, 14 nt, Mycobacterium bovis subsp bovis AF2122/97
ggucaagacccgca

SEQ ID NO: 1158971 - RNA, 14 nt, Mycobacterium bovis subsp bovis AF2122/97
ggucaacggcagau

SEQ ID NO: 1158972 - RNA, 18 nt, Mycobacterium bovis subsp bovis AF2122/97
ggucaagacccgcaucca

SEQ ID NO: 1158973 - RNA, 13 nt, Mycobacterium bovis subsp bovis AF2122/97
ggucaaaucaacg

SEQ ID NO: 1158974 - RNA, 13 nt, Mycobacterium bovis subsp bovis AF2122/97
ggucaacagcguc

SEQ ID NO: 1158975 - RNA, 21 nt, Mycobacterium bovis subsp bovis AF2122/97
ggucagcacgcugaccacaac

SEQ ID NO: 1158976 - RNA, 22 nt, Mycobacterium bovis subsp bovis AF2122/97
ggucagcacccaacccggcggc

SEQ ID NO: 1158977 - RNA, 21 nt, Mycobacterium bovis subsp bovis AF2122/97
ggucaguccgacaccggcggc

SEQ ID NO: 1158978 - RNA, 16 nt, Mycobacterium bovis subsp bovis AF2122/97
ggucaguucccagacc

SEQ ID NO: 1158979 - RNA, 15 nt, Mycobacterium bovis subsp bovis AF2122/97
ggucaguccgacacc

SEQ ID NO: 1158980 - RNA, 19 nt, Mycobacterium bovis subsp bovis AF2122/97
ggucaguccgucggccugg

SEQ ID NO: 1158981 - RNA, 15 nt, Mycobacterium bovis subsp bovis AF2122/97
ggucagugcgggcgg

SEQ ID NO: 1158982 - RNA, 14 nt, Mycobacterium bovis subsp bovis AF2122/97
ggucacguccgcgg

SEQ ID NO: 1158983 - RNA, 17 nt, Mycobacterium bovis subsp bovis AF2122/97
ggucaauugugcggccc

SEQ ID NO: 1158984 - RNA, 15 nt, Mycobacterium bovis subsp bovis AF2122/97
ggucaucgggcagcg

SEQ ID NO: 1158985 - RNA, 20 nt, Mycobacterium bovis subsp bovis AF2122/97
gguccagccgguagagcggg

SEQ ID NO: 1158986 - RNA, 22 nt, Mycobacterium bovis subsp bovis AF2122/97
gguccagcagcucggccgaggc

SEQ ID NO: 1158987 - RNA, 13 nt, Mycobacterium bovis subsp bovis AF2122/97
gguccagccaacg

SEQ ID NO: 1158988 - RNA, 15 nt, Mycobacterium bovis subsp bovis AF2122/97
gguccaggcguugga

SEQ ID NO: 1158989 - RNA, 17 nt, Mycobacterium bovis subsp bovis AF2122/97
gguccccacauggcccg

SEQ ID NO: 1158990 - RNA, 18 nt, Mycobacterium bovis subsp bovis AF2122/97
gguccaucgcgcugcggc

SEQ ID NO: 1158991 - RNA, 15 nt, Mycobacterium bovis subsp bovis AF2122/97
ggucccggcagcugg

SEQ ID NO: 1158992 - RNA, 16 nt, Mycobacterium bovis subsp bovis AF2122/97
ggucccgaugaccuug

SEQ ID NO: 1158993 - RNA, 15 nt, Mycobacterium bovis subsp bovis AF2122/97
ggucccgcauauccg

SEQ ID NO: 1158994 - RNA, 18 nt, Mycobacterium bovis subsp bovis AF2122/97
gguccauggacggccagg

SEQ ID NO: 1158995 - RNA, 14 nt, Mycobacterium bovis subsp bovis AF2122/97
ggucccccgcagcc

SEQ ID NO: 1158996 - RNA, 19 nt, Mycobacterium bovis subsp bovis AF2122/97
ggucccaccgcauugggcc

SEQ ID NO: 1158997 - RNA, 14 nt, Mycobacterium bovis subsp bovis AF2122/97
ggucccagccuggc

SEQ ID NO: 1158998 - RNA, 22 nt, Mycobacterium bovis subsp bovis AF2122/97
gguccaagugcuuccggccauu

SEQ ID NO: 1158999 - RNA, 17 nt, Mycobacterium bovis subsp bovis AF2122/97
gguccaagugggccggc

SEQ ID NO: 1159000 - RNA, 16 nt, Mycobacterium bovis subsp bovis AF2122/97
gguccacagccggcgg

SEQ ID NO: 1159001 - RNA, 17 nt, Mycobacterium bovis subsp bovis AF2122/97
gguccacagccggcggc

SEQ ID NO: 1159002 - RNA, 19 nt, Mycobacterium bovis subsp bovis AF2122/97
gguccacaaaccgugcacg

SEQ ID NO: 1159003 - RNA, 14 nt, Mycobacterium bovis subsp bovis AF2122/97
gguccaccggccag

SEQ ID NO: 1159004 - RNA, 18 nt, Mycobacterium bovis subsp bovis AF2122/97
gguccaccggcccucgcc

SEQ ID NO: 1159005 - RNA, 18 nt, Mycobacterium bovis subsp bovis AF2122/97
gguccaccuuggucgcca

SEQ ID NO: 1159006 - RNA, 23 nt, Mycobacterium bovis subsp bovis AF2122/97
gguccagacaucagugcgccggc

SEQ ID NO: 1159007 - RNA, 15 nt, Mycobacterium bovis subsp bovis AF2122/97
ggucaugucgaucag

SEQ ID NO: 1159008 - RNA, 17 nt, Mycobacterium bovis subsp bovis AF2122/97
gguccaaagcacguccu

SEQ ID NO: 1159009 - RNA, 22 nt, Mycobacterium bovis subsp bovis AF2122/97
ggugacaaguggugcccuugaa

SEQ ID NO: 1159010 - RNA, 16 nt, Mycobacterium bovis subsp bovis AF2122/97
ggugaccagcaggccg

SEQ ID NO: 1159011 - RNA, 17 nt, Mycobacterium bovis subsp bovis AF2122/97
ggugaccaggccgagcu

SEQ ID NO: 1159012 - RNA, 22 nt, Mycobacterium bovis subsp bovis AF2122/97
ggugaccaggccggcccgcaac

SEQ ID NO: 1159013 - RNA, 17 nt, Mycobacterium bovis subsp bovis AF2122/97
ggugacccccgagaucc

SEQ ID NO: 1159014 - RNA, 14 nt, Mycobacterium bovis subsp bovis AF2122/97
ggugaccgagaucg

SEQ ID NO: 1159015 - RNA, 16 nt, Mycobacterium bovis subsp bovis AF2122/97
ggugagauugguggcc

SEQ ID NO: 1159016 - RNA, 22 nt, Mycobacterium bovis subsp bovis AF2122/97
ggugagacaaaggugccgaccg

SEQ ID NO: 1159017 - RNA, 14 nt, Mycobacterium bovis subsp bovis AF2122/97
ggugagaccagguu

SEQ ID NO: 1159018 - RNA, 21 nt, Mycobacterium bovis subsp bovis AF2122/97
ggugaccacgccguggcccgc

SEQ ID NO: 1159019 - RNA, 16 nt, Mycobacterium bovis subsp bovis AF2122/97
ggugacccgcugggcc

SEQ ID NO: 1159020 - RNA, 16 nt, Mycobacterium bovis subsp bovis AF2122/97
ggugacccugguggug

SEQ ID NO: 1159021 - RNA, 19 nt, Mycobacterium bovis subsp bovis AF2122/97
ggugagcuuagcgcauggg

SEQ ID NO: 1159022 - RNA, 15 nt, Mycobacterium bovis subsp bovis AF2122/97
ggugaggaagcggcc

SEQ ID NO: 1159023 - RNA, 18 nt, Mycobacterium bovis subsp bovis AF2122/97
ggugaggcgggucgccgc

SEQ ID NO: 1159024 - RNA, 15 nt, Mycobacterium bovis subsp bovis AF2122/97
ggugagccgguggcc

SEQ ID NO: 1159025 - RNA, 20 nt, Mycobacterium bovis subsp bovis AF2122/97
ggugagccgguggcccgccg

SEQ ID NO: 1159026 - RNA, 15 nt, Mycobacterium bovis subsp bovis AF2122/97
ggugagcgaccuggg

SEQ ID NO: 1159027 - RNA, 18 nt, Mycobacterium bovis subsp bovis AF2122/97
ggugagcauggcuagggc

SEQ ID NO: 1159028 - RNA, 20 nt, Mycobacterium bovis subsp bovis AF2122/97
ggucugccaaaagggcggca

SEQ ID NO: 1159029 - RNA, 16 nt, Mycobacterium bovis subsp bovis AF2122/97
ggucugcgccaaaauc

SEQ ID NO: 1159030 - RNA, 21 nt, Mycobacterium bovis subsp bovis AF2122/97
ggucugcgccgccggcggcgg

SEQ ID NO: 1159031 - RNA, 11 nt, Mycobacterium bovis subsp bovis AF2122/97
ggucugcucau

SEQ ID NO: 1159032 - RNA, 17 nt, Mycobacterium bovis subsp bovis AF2122/97
ggucugcuccaggcgcg

SEQ ID NO: 1159033 - RNA, 15 nt, Mycobacterium bovis subsp bovis AF2122/97
ggucuggacugcagc

SEQ ID NO: 1159034 - RNA, 19 nt, Mycobacterium bovis subsp bovis AF2122/97
ggugaaguagugcucgcag

SEQ ID NO: 1159035 - RNA, 17 nt, Mycobacterium bovis subsp bovis AF2122/97
ggugaauccgugcaggg

SEQ ID NO: 1159036 - RNA, 20 nt, Mycobacterium bovis subsp bovis AF2122/97
ggugaaucgacaccgcccga

SEQ ID NO: 1159037 - RNA, 23 nt, Mycobacterium bovis subsp bovis AF2122/97
ggugccacugccguugccgccgg

SEQ ID NO: 1159038 - RNA, 11 nt, Mycobacterium bovis subsp bovis AF2122/97
ggugccagcag

SEQ ID NO: 1159039 - RNA, 13 nt, Mycobacterium bovis subsp bovis AF2122/97
ggugccaacugcg

SEQ ID NO: 1159040 - RNA, 20 nt, Mycobacterium bovis subsp bovis AF2122/97
ggugccacccuugccgccgg

SEQ ID NO: 1159041 - RNA, 22 nt, Mycobacterium bovis subsp bovis AF2122/97
ggugccaccgcgacggcaggcu

SEQ ID NO: 1159042 - RNA, 17 nt, Mycobacterium bovis subsp bovis AF2122/97
ggugccacgaucggcgg

SEQ ID NO: 1159043 - RNA, 18 nt, Mycobacterium bovis subsp bovis AF2122/97
ggugccacguucgcgggc

SEQ ID NO: 1159044 - RNA, 19 nt, Mycobacterium bovis subsp bovis AF2122/97
ggugccacguucgcgggcg

SEQ ID NO: 1159045 - RNA, 16 nt, Mycobacterium bovis subsp bovis AF2122/97
ggugccaucgggcgcg

SEQ ID NO: 1159046 - RNA, 21 nt, Mycobacterium bovis subsp bovis AF2122/97
ggugcagucgauuucggcggc

SEQ ID NO: 1159047 - RNA, 22 nt, Mycobacterium bovis subsp bovis AF2122/97
ggugcagugaccucgucggcga

SEQ ID NO: 1159048 - RNA, 14 nt, Mycobacterium bovis subsp bovis AF2122/97
ggugcauucgcaug

SEQ ID NO: 1159049 - RNA, 22 nt, Mycobacterium bovis subsp bovis AF2122/97
ggugaugacgccgucggcgcgc

SEQ ID NO: 1159050 - RNA, 18 nt, Mycobacterium bovis subsp bovis AF2122/97
ggugaugcaugcuaggca

SEQ ID NO: 1159051 - RNA, 17 nt, Mycobacterium bovis subsp bovis AF2122/97
ggugauggcuuggacca

SEQ ID NO: 1159052 - RNA, 15 nt, Mycobacterium bovis subsp bovis AF2122/97
ggugauggagccggu

SEQ ID NO: 1159053 - RNA, 14 nt, Mycobacterium bovis subsp bovis AF2122/97
ggugaugagucagg

SEQ ID NO: 1159054 - RNA, 19 nt, Mycobacterium bovis subsp bovis AF2122/97
ggugaguccgcugagcggg

SEQ ID NO: 1159055 - RNA, 18 nt, Mycobacterium bovis subsp bovis AF2122/97
ggugaugggggagccggu

SEQ ID NO: 1159056 - RNA, 14 nt, Mycobacterium bovis subsp bovis AF2122/97
ggugaugguggcaa

SEQ ID NO: 1159057 - RNA, 21 nt, Mycobacterium bovis subsp bovis AF2122/97
ggugauggugugcagcagcau

SEQ ID NO: 1159058 - RNA, 20 nt, Mycobacterium bovis subsp bovis AF2122/97
ggugcaggauucggcggucg

SEQ ID NO: 1159059 - RNA, 22 nt, Mycobacterium bovis subsp bovis AF2122/97
ggugcagcuccccgccggaacu

SEQ ID NO: 1159060 - RNA, 20 nt, Mycobacterium bovis subsp bovis AF2122/97
ggugcaacacgccggcccgg

SEQ ID NO: 1159061 - RNA, 12 nt, Mycobacterium bovis subsp bovis AF2122/97
ggucgggcggcg

SEQ ID NO: 1159062 - RNA, 15 nt, Mycobacterium bovis subsp bovis AF2122/97
ggucggugacugugc

SEQ ID NO: 1159063 - RNA, 18 nt, Mycobacterium bovis subsp bovis AF2122/97
ggucgguaccgguaccug

SEQ ID NO: 1159064 - RNA, 17 nt, Mycobacterium bovis subsp bovis AF2122/97
ggucggcugauuggccc

SEQ ID NO: 1159065 - RNA, 13 nt, Mycobacterium bovis subsp bovis AF2122/97
ggucgcggcugcc

SEQ ID NO: 1159066 - RNA, 15 nt, Mycobacterium bovis subsp bovis AF2122/97
ggucucgagggugaa

SEQ ID NO: 1159067 - RNA, 15 nt, Mycobacterium bovis subsp bovis AF2122/97
ggucucgaccgcgcc

SEQ ID NO: 1159068 - RNA, 16 nt, Mycobacterium bovis subsp bovis AF2122/97
ggucuccggaucgccg

SEQ ID NO: 1159069 - RNA, 17 nt, Mycobacterium bovis subsp bovis AF2122/97
ggucuccuugggcgacg

SEQ ID NO: 1159070 - RNA, 14 nt, Mycobacterium bovis subsp bovis AF2122/97
ggucucgcaccagu

SEQ ID NO: 1159071 - RNA, 15 nt, Mycobacterium bovis subsp bovis AF2122/97
ggucuccaccaggug

SEQ ID NO: 1159072 - RNA, 13 nt, Mycobacterium bovis subsp bovis AF2122/97
ggucucaucccag

SEQ ID NO: 1159073 - RNA, 23 nt, Mycobacterium bovis subsp bovis AF2122/97
ggucucccagaggucgagcgccu

SEQ ID NO: 1159074 - RNA, 15 nt, Mycobacterium bovis subsp bovis AF2122/97
ggucucacucaucgg

SEQ ID NO: 1159075 - RNA, 15 nt, Mycobacterium bovis subsp bovis AF2122/97
ggucguuggucgggg

SEQ ID NO: 1159076 - RNA, 21 nt, Mycobacterium bovis subsp bovis AF2122/97
ggucguacaacacgggcagcu

SEQ ID NO: 1159077 - RNA, 22 nt, Mycobacterium bovis subsp bovis AF2122/97
ggucggugaugguuucggcggg

SEQ ID NO: 1159078 - RNA, 19 nt, Mycobacterium bovis subsp bovis AF2122/97
gguccgggaagucgcugaa

SEQ ID NO: 1159079 - RNA, 14 nt, Mycobacterium bovis subsp bovis AF2122/97
gguccggcggccgg

SEQ ID NO: 1159080 - RNA, 13 nt, Mycobacterium bovis subsp bovis AF2122/97
gguccgccagcgc

SEQ ID NO: 1159081 - RNA, 19 nt, Mycobacterium bovis subsp bovis AF2122/97
ggucccggccgggucuucc

SEQ ID NO: 1159082 - RNA, 21 nt, Mycobacterium bovis subsp bovis AF2122/97
ggucccuuuguggggccgggc

SEQ ID NO: 1159083 - RNA, 16 nt, Mycobacterium bovis subsp bovis AF2122/97
gguccgccgggccccg

SEQ ID NO: 1159084 - RNA, 19 nt, Mycobacterium bovis subsp bovis AF2122/97
gguccugcucgcacagcac

SEQ ID NO: 1159085 - RNA, 21 nt, Mycobacterium bovis subsp bovis AF2122/97
gguccugcucgcacagcacca

SEQ ID NO: 1159086 - RNA, 15 nt, Mycobacterium bovis subsp bovis AF2122/97
ggucgcgcgauggac

SEQ ID NO: 1159087 - RNA, 22 nt, Mycobacterium bovis subsp bovis AF2122/97
ggucgcggucccacggccggcc

SEQ ID NO: 1159088 - RNA, 13 nt, Mycobacterium bovis subsp bovis AF2122/97
ggucgcggcgguc

SEQ ID NO: 1159089 - RNA, 14 nt, Mycobacterium bovis subsp bovis AF2122/97
gguccucgcggagc

SEQ ID NO: 1159090 - RNA, 17 nt, Mycobacterium bovis subsp bovis AF2122/97
gguccgucaccaccgcc

SEQ ID NO: 1159091 - RNA, 15 nt, Mycobacterium bovis subsp bovis AF2122/97
gguccucgucggcga

SEQ ID NO: 1159092 - RNA, 21 nt, Mycobacterium bovis subsp bovis AF2122/97
gguccucgagguccucgucgg

SEQ ID NO: 1159093 - RNA, 15 nt, Mycobacterium bovis subsp bovis AF2122/97
gguccucgucggcgu

SEQ ID NO: 1159094 - RNA, 15 nt, Mycobacterium bovis subsp bovis AF2122/97
gguccucgucgucga

SEQ ID NO: 1159095 - RNA, 19 nt, Mycobacterium bovis subsp bovis AF2122/97
ggugugcgcgccaggcucg

SEQ ID NO: 1159096 - RNA, 14 nt, Mycobacterium bovis subsp bovis AF2122/97
gguguagggcggcg

SEQ ID NO: 1159097 - RNA, 17 nt, Mycobacterium bovis subsp bovis AF2122/97
ggugucacagugguggg

SEQ ID NO: 1159098 - RNA, 23 nt, Mycobacterium bovis subsp bovis AF2122/97
gguguauccgacuggccccgcca

SEQ ID NO: 1159099 - RNA, 20 nt, Mycobacterium bovis subsp bovis AF2122/97
gguguaggccucggcagcaa

SEQ ID NO: 1159100 - RNA, 20 nt, Mycobacterium bovis subsp bovis AF2122/97
gguguagcaagucgccgagg

SEQ ID NO: 1159101 - RNA, 13 nt, Mycobacterium bovis subsp bovis AF2122/97
gguguacugcugc

SEQ ID NO: 1159102 - RNA, 14 nt, Mycobacterium bovis subsp bovis AF2122/97
gguguacagucgcg

SEQ ID NO: 1159103 - RNA, 13 nt, Mycobacterium bovis subsp bovis AF2122/97
ggugugucggguu

SEQ ID NO: 1159104 - RNA, 19 nt, Mycobacterium bovis subsp bovis AF2122/97
ggugugcgucuccagcugg

SEQ ID NO: 1159105 - RNA, 14 nt, Mycobacterium bovis subsp bovis AF2122/97
ggugugcugcacgg

SEQ ID NO: 1159106 - RNA, 16 nt, Mycobacterium bovis subsp bovis AF2122/97
gguguggacugggcca

SEQ ID NO: 1159107 - RNA, 19 nt, Mycobacterium bovis subsp bovis AF2122/97
gguguggacuucagcaggc

SEQ ID NO: 1159108 - RNA, 22 nt, Mycobacterium bovis subsp bovis AF2122/97
gguguguuuggcauggucaggc

SEQ ID NO: 1159109 - RNA, 17 nt, Mycobacterium bovis subsp bovis AF2122/97
gguguucgaugggugca

SEQ ID NO: 1159110 - RNA, 13 nt, Mycobacterium bovis subsp bovis AF2122/97
gguggggccggcg

SEQ ID NO: 1159111 - RNA, 16 nt, Mycobacterium bovis subsp bovis AF2122/97
gguggggccggcgucg

SEQ ID NO: 1159112 - RNA, 22 nt, Mycobacterium bovis subsp bovis AF2122/97
gguggggcgcacgauggugugc

SEQ ID NO: 1159113 - RNA, 14 nt, Mycobacterium bovis subsp bovis AF2122/97
ggugggcguggcug

SEQ ID NO: 1159114 - RNA, 15 nt, Mycobacterium bovis subsp bovis AF2122/97
ggugggcgggugcgc

SEQ ID NO: 1159115 - RNA, 13 nt, Mycobacterium bovis subsp bovis AF2122/97
ggugggcgcuggg

SEQ ID NO: 1159116 - RNA, 15 nt, Mycobacterium bovis subsp bovis AF2122/97
ggugggcgugacugg

SEQ ID NO: 1159117 - RNA, 14 nt, Mycobacterium bovis subsp bovis AF2122/97
gguggguagccagc

SEQ ID NO: 1159118 - RNA, 22 nt, Mycobacterium bovis subsp bovis AF2122/97
ggugggugaacgccugcgggaa

SEQ ID NO: 1159119 - RNA, 13 nt, Mycobacterium bovis subsp bovis AF2122/97
ggugggugcagca

SEQ ID NO: 1159120 - RNA, 17 nt, Mycobacterium bovis subsp bovis AF2122/97
ggugggugccggcgucg

SEQ ID NO: 1159121 - RNA, 16 nt, Mycobacterium bovis subsp bovis AF2122/97
ggugguaagacgccga

SEQ ID NO: 1159122 - RNA, 17 nt, Mycobacterium bovis subsp bovis AF2122/97
ggugguacagggugugc

SEQ ID NO: 1159123 - RNA, 15 nt, Mycobacterium bovis subsp bovis AF2122/97
gguguaacggcggcu

SEQ ID NO: 1159124 - RNA, 18 nt, Mycobacterium bovis subsp bovis AF2122/97
ggugguaccggcgccacc

SEQ ID NO: 1159125 - RNA, 20 nt, Mycobacterium bovis subsp bovis AF2122/97
ggugcuggugaucugcuggg

SEQ ID NO: 1159126 - RNA, 17 nt, Mycobacterium bovis subsp bovis AF2122/97
ggugcugguccagccgg

SEQ ID NO: 1159127 - RNA, 23 nt, Mycobacterium bovis subsp bovis AF2122/97
ggugcucucguggauggccgcca

SEQ ID NO: 1159128 - RNA, 18 nt, Mycobacterium bovis subsp bovis AF2122/97
ggugcugcgcgggugugg

SEQ ID NO: 1159129 - RNA, 22 nt, Mycobacterium bovis subsp bovis AF2122/97
ggugcugaccccgccggcugcg

SEQ ID NO: 1159130 - RNA, 17 nt, Mycobacterium bovis subsp bovis AF2122/97
ggugcugaccgcgccgg

SEQ ID NO: 1159131 - RNA, 15 nt, Mycobacterium bovis subsp bovis AF2122/97
ggugcucgggcggcg

SEQ ID NO: 1159132 - RNA, 17 nt, Mycobacterium bovis subsp bovis AF2122/97
ggugcccugccggcagc

SEQ ID NO: 1159133 - RNA, 14 nt, Mycobacterium bovis subsp bovis AF2122/97
ggugcccggcggcc

SEQ ID NO: 1159134 - RNA, 23 nt, Mycobacterium bovis subsp bovis AF2122/97
ggugcccagcguggcuggcaccu

SEQ ID NO: 1159135 - RNA, 22 nt, Mycobacterium bovis subsp bovis AF2122/97
ggugcccaagcaguccacgagc

SEQ ID NO: 1159136 - RNA, 16 nt, Mycobacterium bovis subsp bovis AF2122/97
gguggccagcgcggcg

SEQ ID NO: 1159137 - RNA, 23 nt, Mycobacterium bovis subsp bovis AF2122/97
gguggccaggccguaguggccgg

SEQ ID NO: 1159138 - RNA, 21 nt, Mycobacterium bovis subsp bovis AF2122/97
gguggcccgccggcagugagu

SEQ ID NO: 1159139 - RNA, 15 nt, Mycobacterium bovis subsp bovis AF2122/97
gguggccucauccac

SEQ ID NO: 1159140 - RNA, 21 nt, Mycobacterium bovis subsp bovis AF2122/97
gguggccagaucgaacgcagc

SEQ ID NO: 1159141 - RNA, 14 nt, Mycobacterium bovis subsp bovis AF2122/97
gguggcagcgcggc

SEQ ID NO: 1159142 - RNA, 14 nt, Mycobacterium bovis subsp bovis AF2122/97
gguggcagcacagc

SEQ ID NO: 1159143 - RNA, 13 nt, Mycobacterium bovis subsp bovis AF2122/97
gguggcagcgcac

SEQ ID NO: 1159144 - RNA, 23 nt, Mycobacterium bovis subsp bovis AF2122/97
ggugcuguugcgcggucgcgcga

SEQ ID NO: 1159145 - RNA, 15 nt, Mycobacterium bovis subsp bovis AF2122/97
gguggcacgcugagc

SEQ ID NO: 1159146 - RNA, 13 nt, Mycobacterium bovis subsp bovis AF2122/97
gguuccacucccc

SEQ ID NO: 1159147 - RNA, 22 nt, Mycobacterium bovis subsp bovis AF2122/97
gguuccgaucgcguuagccagg

SEQ ID NO: 1159148 - RNA, 13 nt, Mycobacterium bovis subsp bovis AF2122/97
gguuccggccggc

SEQ ID NO: 1159149 - RNA, 20 nt, Mycobacterium bovis subsp bovis AF2122/97
gguuccgcugucgagccggu

SEQ ID NO: 1159150 - RNA, 17 nt, Mycobacterium bovis subsp bovis AF2122/97
gguucgcacaccuccuc

SEQ ID NO: 1159151 - RNA, 20 nt, Mycobacterium bovis subsp bovis AF2122/97
gguucgagucccgucacuca

SEQ ID NO: 1159152 - RNA, 18 nt, Mycobacterium bovis subsp bovis AF2122/97
gguucagccacgcagcac

SEQ ID NO: 1159153 - RNA, 16 nt, Mycobacterium bovis subsp bovis AF2122/97
gguucagguugagugu

SEQ ID NO: 1159154 - RNA, 20 nt, Mycobacterium bovis subsp bovis AF2122/97
gguucagcgcuggcaggccg

SEQ ID NO: 1159155 - RNA, 19 nt, Mycobacterium bovis subsp bovis AF2122/97
gguucaucgccggcgcgcc

SEQ ID NO: 1159156 - RNA, 21 nt, Mycobacterium bovis subsp bovis AF2122/97
gguucaucgccggcgcgccga

SEQ ID NO: 1159157 - RNA, 19 nt, Mycobacterium bovis subsp bovis AF2122/97
gguucacuuccgggcagcu

SEQ ID NO: 1159158 - RNA, 13 nt, Mycobacterium bovis subsp bovis AF2122/97
gguucaccucccc

SEQ ID NO: 1159159 - RNA, 13 nt, Mycobacterium bovis subsp bovis AF2122/97
gguuagcgcggcc

SEQ ID NO: 1159160 - RNA, 17 nt, Mycobacterium bovis subsp bovis AF2122/97
gguuaucgucgggucac

SEQ ID NO: 1159161 - RNA, 11 nt, Mycobacterium bovis subsp bovis AF2122/97
gguucaaagca

SEQ ID NO: 1159162 - RNA, 20 nt, Mycobacterium bovis subsp bovis AF2122/97
gguucaaagcagcgcaccaa

SEQ ID NO: 1159163 - RNA, 15 nt, Mycobacterium bovis subsp bovis AF2122/97
gguuaucggcagcag

SEQ ID NO: 1159164 - RNA, 21 nt, Mycobacterium bovis subsp bovis AF2122/97
gguguugcggcugaccuccca

SEQ ID NO: 1159165 - RNA, 19 nt, Mycobacterium bovis subsp bovis AF2122/97
gguguugaugggcagccgc

SEQ ID NO: 1159166 - RNA, 15 nt, Mycobacterium bovis subsp bovis AF2122/97
gguguucgggcagcu

SEQ ID NO: 1159167 - RNA, 18 nt, Mycobacterium bovis subsp bovis AF2122/97
gguguuguaggccgggcc

SEQ ID NO: 1159168 - RNA, 14 nt, Mycobacterium bovis subsp bovis AF2122/97
gguuagccgcggcc

SEQ ID NO: 1159169 - RNA, 17 nt, Mycobacterium bovis subsp bovis AF2122/97
gguuuucccgucgccgc

SEQ ID NO: 1159170 - RNA, 14 nt, Mycobacterium bovis subsp bovis AF2122/97
gguucgucaggucc

SEQ ID NO: 1159171 - RNA, 23 nt, Mycobacterium bovis subsp bovis AF2122/97
gguucgaucgcggugaccggcuc

SEQ ID NO: 1159172 - RNA, 20 nt, Mycobacterium bovis subsp bovis AF2122/97
gguucggagucacgcagccg

SEQ ID NO: 1159173 - RNA, 19 nt, Mycobacterium bovis subsp bovis AF2122/97
gguucggacacacaggcgg

SEQ ID NO: 1159174 - RNA, 15 nt, Mycobacterium bovis subsp bovis AF2122/97
gguucgcgguugucc

SEQ ID NO: 1159175 - RNA, 22 nt, Mycobacterium bovis subsp bovis AF2122/97
gguucgccgaagccggaccgca

SEQ ID NO: 1159176 - RNA, 24 nt, Mycobacterium bovis subsp bovis AF2122/97
gguucgccccugcacagcaggcuc

SEQ ID NO: 1159177 - RNA, 16 nt, Mycobacterium bovis subsp bovis AF2122/97
gguugacgggcucggc

SEQ ID NO: 1159178 - RNA, 17 nt, Mycobacterium bovis subsp bovis AF2122/97
gguugacgucaggcuga

SEQ ID NO: 1159179 - RNA, 17 nt, Mycobacterium bovis subsp bovis AF2122/97
gguugaaccgguacaac

SEQ ID NO: 1159180 - RNA, 15 nt, Mycobacterium bovis subsp bovis AF2122/97
gguugaucggccacg

SEQ ID NO: 1159181 - RNA, 15 nt, Mycobacterium bovis subsp bovis AF2122/97
gguugaucuuguccu

SEQ ID NO: 1159182 - RNA, 17 nt, Mycobacterium bovis subsp bovis AF2122/97
gguugaucaccgacacc

SEQ ID NO: 1159183 - RNA, 17 nt, Mycobacterium bovis subsp bovis AF2122/97
gguugaugaaggucaac

SEQ ID NO: 1159184 - RNA, 16 nt, Mycobacterium bovis subsp bovis AF2122/97
gguugaugaguuccuu

SEQ ID NO: 1159185 - RNA, 18 nt, Mycobacterium bovis subsp bovis AF2122/97
gguugauggaguggcugu

SEQ ID NO: 1159186 - RNA, 22 nt, Mycobacterium bovis subsp bovis AF2122/97
gguugaucagccagaccaacau

SEQ ID NO: 1159187 - RNA, 11 nt, Mycobacterium bovis subsp bovis AF2122/97
gguugccaacc

SEQ ID NO: 1159188 - RNA, 15 nt, Mycobacterium bovis subsp bovis AF2122/97
gguugccggcggcga

SEQ ID NO: 1159189 - RNA, 23 nt, Mycobacterium bovis subsp bovis AF2122/97
gguugccgucagggucagcuggg

SEQ ID NO: 1159190 - RNA, 16 nt, Mycobacterium bovis subsp bovis AF2122/97
gguugcccccagggcc

SEQ ID NO: 1159191 - RNA, 16 nt, Mycobacterium bovis subsp bovis AF2122/97
gguuggauacggugcg

SEQ ID NO: 1159192 - RNA, 15 nt, Mycobacterium bovis subsp bovis AF2122/97
gguugcggcagcugg

SEQ ID NO: 1159193 - RNA, 19 nt, Mycobacterium bovis subsp bovis AF2122/97
gguugcggcagcuggcgca

SEQ ID NO: 1159194 - RNA, 15 nt, Mycobacterium bovis subsp bovis AF2122/97
gguuggucggugcug

SEQ ID NO: 1159195 - RNA, 16 nt, Mycobacterium bovis subsp bovis AF2122/97
gguugucgucgguggg

SEQ ID NO: 1159196 - RNA, 13 nt, Mycobacterium bovis subsp bovis AF2122/97
gguuguccucggc

SEQ ID NO: 1159197 - RNA, 12 nt, Mycobacterium bovis subsp bovis AF2122/97
gguugggguggc

SEQ ID NO: 1159198 - RNA, 19 nt, Mycobacterium bovis subsp bovis AF2122/97
gguugggguggcggugccg

SEQ ID NO: 1159199 - RNA, 23 nt, Mycobacterium bovis subsp bovis AF2122/97
gguuggcauccaaaaucgccuga

SEQ ID NO: 1159200 - RNA, 22 nt, Mycobacterium bovis subsp bovis AF2122/97
gguuggcggcugcacgcugcgg

SEQ ID NO: 1159201 - RNA, 14 nt, Mycobacterium bovis subsp bovis AF2122/97
guaaaagccgauga

SEQ ID NO: 1159202 - RNA, 17 nt, Mycobacterium bovis subsp bovis AF2122/97
guaauccgagcgcggcg

SEQ ID NO: 1159203 - RNA, 20 nt, Mycobacterium bovis subsp bovis AF2122/97
guaauccacacacagccggu

SEQ ID NO: 1159204 - RNA, 17 nt, Mycobacterium bovis subsp bovis AF2122/97
guacaccagggugccgg

SEQ ID NO: 1159205 - RNA, 16 nt, Mycobacterium bovis subsp bovis AF2122/97
guacaccccaucgaua

SEQ ID NO: 1159206 - RNA, 18 nt, Mycobacterium bovis subsp bovis AF2122/97
guacacccgcucgcccgc

SEQ ID NO: 1159207 - RNA, 19 nt, Mycobacterium bovis subsp bovis AF2122/97
guacaccggcuggaaucug

SEQ ID NO: 1159208 - RNA, 21 nt, Mycobacterium bovis subsp bovis AF2122/97
guacacguccaguggcagcca

SEQ ID NO: 1159209 - RNA, 17 nt, Mycobacterium bovis subsp bovis AF2122/97
guacagugucugccaug

SEQ ID NO: 1159210 - RNA, 15 nt, Mycobacterium bovis subsp bovis AF2122/97
guacaggucgccggg

SEQ ID NO: 1159211 - RNA, 15 nt, Mycobacterium bovis subsp bovis AF2122/97
guacaggcuguccag

SEQ ID NO: 1159212 - RNA, 23 nt, Mycobacterium bovis subsp bovis AF2122/97
guacaagucgaccaugagccggc

SEQ ID NO: 1159213 - RNA, 13 nt, Mycobacterium bovis subsp bovis AF2122/97
guacacagacccg

SEQ ID NO: 1159214 - RNA, 17 nt, Mycobacterium bovis subsp bovis AF2122/97
guacacauaggugcggg

SEQ ID NO: 1159215 - RNA, 17 nt, Mycobacterium bovis subsp bovis AF2122/97
guaccagcccaccggcg

SEQ ID NO: 1159216 - RNA, 22 nt, Mycobacterium bovis subsp bovis AF2122/97
guaccagggugucgucuugcgu

SEQ ID NO: 1159217 - RNA, 16 nt, Mycobacterium bovis subsp bovis AF2122/97
guacgacaccgcagcg

SEQ ID NO: 1159218 - RNA, 18 nt, Mycobacterium bovis subsp bovis AF2122/97
guacgaucgugagacgcc

SEQ ID NO: 1159219 - RNA, 19 nt, Mycobacterium bovis subsp bovis AF2122/97
guacgcccuggaaugccgc

SEQ ID NO: 1159220 - RNA, 20 nt, Mycobacterium bovis subsp bovis AF2122/97
guacgccguaucggggcacc

SEQ ID NO: 1159221 - RNA, 19 nt, Mycobacterium bovis subsp bovis AF2122/97
guacucggcauccaggcug

SEQ ID NO: 1159222 - RNA, 17 nt, Mycobacterium bovis subsp bovis AF2122/97
guagccgaccggcagcg

SEQ ID NO: 1159223 - RNA, 20 nt, Mycobacterium bovis subsp bovis AF2122/97
guagcgcucgaucagguugg

SEQ ID NO: 1159224 - RNA, 17 nt, Mycobacterium bovis subsp bovis AF2122/97
guagccggcgccgccgu

SEQ ID NO: 1159225 - RNA, 13 nt, Mycobacterium bovis subsp bovis AF2122/97
guagccggccgcu

SEQ ID NO: 1159226 - RNA, 22 nt, Mycobacterium bovis subsp bovis AF2122/97
guagcgggcaaacgaacgggug

SEQ ID NO: 1159227 - RNA, 16 nt, Mycobacterium bovis subsp bovis AF2122/97
guagcggcgccgcccu

SEQ ID NO: 1159228 - RNA, 14 nt, Mycobacterium bovis subsp bovis AF2122/97
guagcgggggagcg

SEQ ID NO: 1159229 - RNA, 12 nt, Mycobacterium bovis subsp bovis AF2122/97
guagcggccggg

SEQ ID NO: 1159230 - RNA, 14 nt, Mycobacterium bovis subsp bovis AF2122/97
guagcgguccagcg

SEQ ID NO: 1159231 - RNA, 22 nt, Mycobacterium bovis subsp bovis AF2122/97
guagcccacccgggugggccag

SEQ ID NO: 1159232 - RNA, 22 nt, Mycobacterium bovis subsp bovis AF2122/97
guagcaggucgacggccacggu

SEQ ID NO: 1159233 - RNA, 15 nt, Mycobacterium bovis subsp bovis AF2122/97
guagcauccagcgcg

SEQ ID NO: 1159234 - RNA, 22 nt, Mycobacterium bovis subsp bovis AF2122/97
guagccaaccugaagccagcgc

SEQ ID NO: 1159235 - RNA, 19 nt, Mycobacterium bovis subsp bovis AF2122/97
guagccaagcgagcggucg

SEQ ID NO: 1159236 - RNA, 14 nt, Mycobacterium bovis subsp bovis AF2122/97
guagccacgcccac

SEQ ID NO: 1159237 - RNA, 23 nt, Mycobacterium bovis subsp bovis AF2122/97
guagccacgcccacaggggcagc

SEQ ID NO: 1159238 - RNA, 22 nt, Mycobacterium bovis subsp bovis AF2122/97
guagccaaugcccuuggccagc

SEQ ID NO: 1159239 - RNA, 15 nt, Mycobacterium bovis subsp bovis AF2122/97
guagaagcccaggac

SEQ ID NO: 1159240 - RNA, 15 nt, Mycobacterium bovis subsp bovis AF2122/97
guagaacccaggccg

SEQ ID NO: 1159241 - RNA, 18 nt, Mycobacterium bovis subsp bovis AF2122/97
guagaacgcuagcgccaa

SEQ ID NO: 1159242 - RNA, 14 nt, Mycobacterium bovis subsp bovis AF2122/97
guagaagcgcucca

SEQ ID NO: 1159243 - RNA, 19 nt, Mycobacterium bovis subsp bovis AF2122/97
guagaagcgcuccagcuga

SEQ ID NO: 1159244 - RNA, 19 nt, Mycobacterium bovis subsp bovis AF2122/97
guagacauuggcuccgaac

SEQ ID NO: 1159245 - RNA, 18 nt, Mycobacterium bovis subsp bovis AF2122/97
guagacaggaccgguggg

SEQ ID NO: 1159246 - RNA, 23 nt, Mycobacterium bovis subsp bovis AF2122/97
guagcacucgggauucggcagcg

SEQ ID NO: 1159247 - RNA, 16 nt, Mycobacterium bovis subsp bovis AF2122/97
guagcagcagcgggcc

SEQ ID NO: 1159248 - RNA, 15 nt, Mycobacterium bovis subsp bovis AF2122/97
guagcagcgccagca

SEQ ID NO: 1159249 - RNA, 18 nt, Mycobacterium bovis subsp bovis AF2122/97
guagcagcgccagcagcu

SEQ ID NO: 1159250 - RNA, 14 nt, Mycobacterium bovis subsp bovis AF2122/97
guagcaacccagga

SEQ ID NO: 1159251 - RNA, 21 nt, Mycobacterium bovis subsp bovis AF2122/97
guagacagucugcgacuggau

SEQ ID NO: 1159252 - RNA, 19 nt, Mycobacterium bovis subsp bovis AF2122/97
guaggagaacgucaaaccc

SEQ ID NO: 1159253 - RNA, 18 nt, Mycobacterium bovis subsp bovis AF2122/97
guagcuuccgguccagcg

SEQ ID NO: 1159254 - RNA, 12 nt, Mycobacterium bovis subsp bovis AF2122/97
guagcugcgcag

SEQ ID NO: 1159255 - RNA, 18 nt, Mycobacterium bovis subsp bovis AF2122/97
guagcuguggcccgcggu

SEQ ID NO: 1159256 - RNA, 18 nt, Mycobacterium bovis subsp bovis AF2122/97
guauagcgcacugccggg

SEQ ID NO: 1159257 - RNA, 22 nt, Mycobacterium bovis subsp bovis AF2122/97
guauagccgacgccggugccgg

SEQ ID NO: 1159258 - RNA, 19 nt, Mycobacterium bovis subsp bovis AF2122/97
guauagcucacgguggccg

SEQ ID NO: 1159259 - RNA, 14 nt, Mycobacterium bovis subsp bovis AF2122/97
guauccgacuggcc

SEQ ID NO: 1159260 - RNA, 18 nt, Mycobacterium bovis subsp bovis AF2122/97
guaucccucaaggucuuu

SEQ ID NO: 1159261 - RNA, 18 nt, Mycobacterium bovis subsp bovis AF2122/97
guauggacgaggagcuca

SEQ ID NO: 1159262 - RNA, 19 nt, Mycobacterium bovis subsp bovis AF2122/97
guaugccgccaaccgcgug

SEQ ID NO: 1159263 - RNA, 23 nt, Mycobacterium bovis subsp bovis AF2122/97
guaugagcuuccgcgcgcagaug

SEQ ID NO: 1159264 - RNA, 20 nt, Mycobacterium bovis subsp bovis AF2122/97
guaugauucacgcucggcgu

SEQ ID NO: 1159265 - RNA, 22 nt, Mycobacterium bovis subsp bovis AF2122/97
guauggcggcgacggccgcucg

SEQ ID NO: 1159266 - RNA, 15 nt, Mycobacterium bovis subsp bovis AF2122/97
guaucgagcggcaca

SEQ ID NO: 1159267 - RNA, 15 nt, Mycobacterium bovis subsp bovis AF2122/97
guaucgacggcggcc

SEQ ID NO: 1159268 - RNA, 9 nt, Mycobacterium bovis subsp bovis AF2122/97
guaucggca

SEQ ID NO: 1159269 - RNA, 23 nt, Mycobacterium bovis subsp bovis AF2122/97
gucaccugcaucgucgccaagcc

SEQ ID NO: 1159270 - RNA, 13 nt, Mycobacterium bovis subsp bovis AF2122/97
gucaccagcgcau

SEQ ID NO: 1159271 - RNA, 17 nt, Mycobacterium bovis subsp bovis AF2122/97
gucaccauagcucaggg

SEQ ID NO: 1159272 - RNA, 21 nt, Mycobacterium bovis subsp bovis AF2122/97
gucacccacguugaugaugcc

SEQ ID NO: 1159273 - RNA, 13 nt, Mycobacterium bovis subsp bovis AF2122/97
gucacgcaccgcg

SEQ ID NO: 1159274 - RNA, 16 nt, Mycobacterium bovis subsp bovis AF2122/97
gucacgcagcacccug

SEQ ID NO: 1159275 - RNA, 14 nt, Mycobacterium bovis subsp bovis AF2122/97
gucacgaccugcuc

SEQ ID NO: 1159276 - RNA, 21 nt, Mycobacterium bovis subsp bovis AF2122/97
gucaccaggccgaaauccaga

SEQ ID NO: 1159277 - RNA, 18 nt, Mycobacterium bovis subsp bovis AF2122/97
gucacauccgacagcagc

SEQ ID NO: 1159278 - RNA, 14 nt, Mycobacterium bovis subsp bovis AF2122/97
gucacagugguggg

SEQ ID NO: 1159279 - RNA, 13 nt, Mycobacterium bovis subsp bovis AF2122/97
gucacaguucugc

SEQ ID NO: 1159280 - RNA, 15 nt, Mycobacterium bovis subsp bovis AF2122/97
gucacaguucugccu

SEQ ID NO: 1159281 - RNA, 17 nt, Mycobacterium bovis subsp bovis AF2122/97
gucacacguuggcagcc

SEQ ID NO: 1159282 - RNA, 14 nt, Mycobacterium bovis subsp bovis AF2122/97
gucacacccacacc

SEQ ID NO: 1159283 - RNA, 23 nt, Mycobacterium bovis subsp bovis AF2122/97
gucacaacgcgugaccagggccu

SEQ ID NO: 1159284 - RNA, 15 nt, Mycobacterium bovis subsp bovis AF2122/97
gucacaagccugccg

SEQ ID NO: 1159285 - RNA, 13 nt, Mycobacterium bovis subsp bovis AF2122/97
gucacagcucacc

SEQ ID NO: 1159286 - RNA, 15 nt, Mycobacterium bovis subsp bovis AF2122/97
gucaagucugugcuc

SEQ ID NO: 1159287 - RNA, 20 nt, Mycobacterium bovis subsp bovis AF2122/97
guauugaucgaauacaccug

SEQ ID NO: 1159288 - RNA, 22 nt, Mycobacterium bovis subsp bovis AF2122/97
guauucccgcuuggcgugaccu

SEQ ID NO: 1159289 - RNA, 18 nt, Mycobacterium bovis subsp bovis AF2122/97
guauugggcgcggcaggc

SEQ ID NO: 1159290 - RNA, 15 nt, Mycobacterium bovis subsp bovis AF2122/97
guauuggucgguggg

SEQ ID NO: 1159291 - RNA, 21 nt, Mycobacterium bovis subsp bovis AF2122/97
guauuugccgugcucaccggc

SEQ ID NO: 1159292 - RNA, 17 nt, Mycobacterium bovis subsp bovis AF2122/97
guccagccggcgcgccg

SEQ ID NO: 1159293 - RNA, 21 nt, Mycobacterium bovis subsp bovis AF2122/97
guccagccgguagagcgggcc

SEQ ID NO: 1159294 - RNA, 14 nt, Mycobacterium bovis subsp bovis AF2122/97
guccagcggccgcc

SEQ ID NO: 1159295 - RNA, 15 nt, Mycobacterium bovis subsp bovis AF2122/97
guccagcggccgccg

SEQ ID NO: 1159296 - RNA, 16 nt, Mycobacterium bovis subsp bovis AF2122/97
guccagcgccgcggcc

SEQ ID NO: 1159297 - RNA, 20 nt, Mycobacterium bovis subsp bovis AF2122/97
guccagcgcgacguccacca

SEQ ID NO: 1159298 - RNA, 21 nt, Mycobacterium bovis subsp bovis AF2122/97
guccagcgcgacguccaccag

SEQ ID NO: 1159299 - RNA, 15 nt, Mycobacterium bovis subsp bovis AF2122/97
guccagcgcggccuu

SEQ ID NO: 1159300 - RNA, 13 nt, Mycobacterium bovis subsp bovis AF2122/97
guccagcgggcau

SEQ ID NO: 1159301 - RNA, 15 nt, Mycobacterium bovis subsp bovis AF2122/97
guccaggagugcggg

SEQ ID NO: 1159302 - RNA, 13 nt, Mycobacterium bovis subsp bovis AF2122/97
guccagcuggccg

SEQ ID NO: 1159303 - RNA, 22 nt, Mycobacterium bovis subsp bovis AF2122/97
guccagcuggccgggugcgugc

SEQ ID NO: 1159304 - RNA, 16 nt, Mycobacterium bovis subsp bovis AF2122/97
guccaggguggucagu

SEQ ID NO: 1159305 - RNA, 21 nt, Mycobacterium bovis subsp bovis AF2122/97
guccagguccaaguccuccac

SEQ ID NO: 1159306 - RNA, 15 nt, Mycobacterium bovis subsp bovis AF2122/97
guccagugcauuccc

SEQ ID NO: 1159307 - RNA, 22 nt, Mycobacterium bovis subsp bovis AF2122/97
guccaugcggguaaaccaggug

SEQ ID NO: 1159308 - RNA, 17 nt, Mycobacterium bovis subsp bovis AF2122/97
guccagacccagcucgu

SEQ ID NO: 1159309 - RNA, 15 nt, Mycobacterium bovis subsp bovis AF2122/97
guccagaacgguggc

SEQ ID NO: 1159310 - RNA, 10 nt, Mycobacterium bovis subsp bovis AF2122/97
guccagaccg

SEQ ID NO: 1159311 - RNA, 20 nt, Mycobacterium bovis subsp bovis AF2122/97
guccagcagcgacgcugccg

SEQ ID NO: 1159312 - RNA, 17 nt, Mycobacterium bovis subsp bovis AF2122/97
guccagcagcucggccg

SEQ ID NO: 1159313 - RNA, 19 nt, Mycobacterium bovis subsp bovis AF2122/97
guccagcaccugccguucc

SEQ ID NO: 1159314 - RNA, 15 nt, Mycobacterium bovis subsp bovis AF2122/97
guccagccacgcugu

SEQ ID NO: 1159315 - RNA, 13 nt, Mycobacterium bovis subsp bovis AF2122/97
guccagcaccggg

SEQ ID NO: 1159316 - RNA, 22 nt, Mycobacterium bovis subsp bovis AF2122/97
guccacgcgcucggugccgccc

SEQ ID NO: 1159317 - RNA, 16 nt, Mycobacterium bovis subsp bovis AF2122/97
guccacguucggcugc

SEQ ID NO: 1159318 - RNA, 14 nt, Mycobacterium bovis subsp bovis AF2122/97
guccacgacagcag

SEQ ID NO: 1159319 - RNA, 16 nt, Mycobacterium bovis subsp bovis AF2122/97
guccaccgcugccggc

SEQ ID NO: 1159320 - RNA, 21 nt, Mycobacterium bovis subsp bovis AF2122/97
guccacgcaccacgagcagcc

SEQ ID NO: 1159321 - RNA, 20 nt, Mycobacterium bovis subsp bovis AF2122/97
guccaccgccgacauggcgg

SEQ ID NO: 1159322 - RNA, 14 nt, Mycobacterium bovis subsp bovis AF2122/97
guccaccgccacca

SEQ ID NO: 1159323 - RNA, 13 nt, Mycobacterium bovis subsp bovis AF2122/97
guccaccaccugg

SEQ ID NO: 1159324 - RNA, 17 nt, Mycobacterium bovis subsp bovis AF2122/97
guccaacucggcccggg

SEQ ID NO: 1159325 - RNA, 17 nt, Mycobacterium bovis subsp bovis AF2122/97
guccaagugcuuccggc

SEQ ID NO: 1159326 - RNA, 20 nt, Mycobacterium bovis subsp bovis AF2122/97
guccaagccguagaccaggc

SEQ ID NO: 1159327 - RNA, 22 nt, Mycobacterium bovis subsp bovis AF2122/97
guccaagccguagaccaggccc

SEQ ID NO: 1159328 - RNA, 21 nt, Mycobacterium bovis subsp bovis AF2122/97
guccaagcugucaagcgggcu

SEQ ID NO: 1159329 - RNA, 13 nt, Mycobacterium bovis subsp bovis AF2122/97
guccaacagcgcc

SEQ ID NO: 1159330 - RNA, 15 nt, Mycobacterium bovis subsp bovis AF2122/97
gucaugucggccacc

SEQ ID NO: 1159331 - RNA, 19 nt, Mycobacterium bovis subsp bovis AF2122/97
guccaauuccgcagagacc

SEQ ID NO: 1159332 - RNA, 16 nt, Mycobacterium bovis subsp bovis AF2122/97
guccaagccggccacg

SEQ ID NO: 1159333 - RNA, 23 nt, Mycobacterium bovis subsp bovis AF2122/97
guccaagccggccacgcauucca

SEQ ID NO: 1159334 - RNA, 13 nt, Mycobacterium bovis subsp bovis AF2122/97
guccaacagcgcu

SEQ ID NO: 1159335 - RNA, 14 nt, Mycobacterium bovis subsp bovis AF2122/97
guccacagccggcg

SEQ ID NO: 1159336 - RNA, 22 nt, Mycobacterium bovis subsp bovis AF2122/97
gucauccggccgucggcgggca

SEQ ID NO: 1159337 - RNA, 14 nt, Mycobacterium bovis subsp bovis AF2122/97
gucaucgagcugac

SEQ ID NO: 1159338 - RNA, 19 nt, Mycobacterium bovis subsp bovis AF2122/97
gucauccaacgcacgccac

SEQ ID NO: 1159339 - RNA, 20 nt, Mycobacterium bovis subsp bovis AF2122/97
gucaucaaucuucccaccuu

SEQ ID NO: 1159340 - RNA, 15 nt, Mycobacterium bovis subsp bovis AF2122/97
gucaucaacguucaa

SEQ ID NO: 1159341 - RNA, 15 nt, Mycobacterium bovis subsp bovis AF2122/97
gucacgccaccgcaa

SEQ ID NO: 1159342 - RNA, 21 nt, Mycobacterium bovis subsp bovis AF2122/97
gucgaccuucucgaugcugac

SEQ ID NO: 1159343 - RNA, 14 nt, Mycobacterium bovis subsp bovis AF2122/97
gucgacgacgucgc

SEQ ID NO: 1159344 - RNA, 16 nt, Mycobacterium bovis subsp bovis AF2122/97
gucgacgacgucgcgc

SEQ ID NO: 1159345 - RNA, 16 nt, Mycobacterium bovis subsp bovis AF2122/97
gucgacgacguggcug

SEQ ID NO: 1159346 - RNA, 15 nt, Mycobacterium bovis subsp bovis AF2122/97
gucgacgaggucagc

SEQ ID NO: 1159347 - RNA, 22 nt, Mycobacterium bovis subsp bovis AF2122/97
gucgaccaugagccggcgccgc

SEQ ID NO: 1159348 - RNA, 23 nt, Mycobacterium bovis subsp bovis AF2122/97
gucgacccccugccacagcgaca

SEQ ID NO: 1159349 - RNA, 21 nt, Mycobacterium bovis subsp bovis AF2122/97
gucgaccgaaacggggcgacg

SEQ ID NO: 1159350 - RNA, 17 nt, Mycobacterium bovis subsp bovis AF2122/97
gucgaccgcggcccgga

SEQ ID NO: 1159351 - RNA, 11 nt, Mycobacterium bovis subsp bovis AF2122/97
gucgaccaccc

SEQ ID NO: 1159352 - RNA, 17 nt, Mycobacterium bovis subsp bovis AF2122/97
gucgacaccgaggaccu

SEQ ID NO: 1159353 - RNA, 23 nt, Mycobacterium bovis subsp bovis AF2122/97
gucgacaccgaggaccucgucac

SEQ ID NO: 1159354 - RNA, 15 nt, Mycobacterium bovis subsp bovis AF2122/97
gucgacagcgaaggc

SEQ ID NO: 1159355 - RNA, 12 nt, Mycobacterium bovis subsp bovis AF2122/97
gucgaaguggua

SEQ ID NO: 1159356 - RNA, 21 nt, Mycobacterium bovis subsp bovis AF2122/97
gucgacuccagcaccagcacg

SEQ ID NO: 1159357 - RNA, 15 nt, Mycobacterium bovis subsp bovis AF2122/97
gucgacucggcggcg

SEQ ID NO: 1159358 - RNA, 20 nt, Mycobacterium bovis subsp bovis AF2122/97
gucgagcaacgugacccgga

SEQ ID NO: 1159359 - RNA, 22 nt, Mycobacterium bovis subsp bovis AF2122/97
gucgagcaccacccgggccucg

SEQ ID NO: 1159360 - RNA, 19 nt, Mycobacterium bovis subsp bovis AF2122/97
gucgagcaccugccgaucg

SEQ ID NO: 1159361 - RNA, 16 nt, Mycobacterium bovis subsp bovis AF2122/97
gucgagcacgcugcug

SEQ ID NO: 1159362 - RNA, 17 nt, Mycobacterium bovis subsp bovis AF2122/97
gucgagcacggugagcc

SEQ ID NO: 1159363 - RNA, 16 nt, Mycobacterium bovis subsp bovis AF2122/97
gucgacgccggccagc

SEQ ID NO: 1159364 - RNA, 23 nt, Mycobacterium bovis subsp bovis AF2122/97
gucgacgucucuggugcagguga

SEQ ID NO: 1159365 - RNA, 16 nt, Mycobacterium bovis subsp bovis AF2122/97
gucgacggcuccuccg

SEQ ID NO: 1159366 - RNA, 14 nt, Mycobacterium bovis subsp bovis AF2122/97
gucgacuccagcac

SEQ ID NO: 1159367 - RNA, 19 nt, Mycobacterium bovis subsp bovis AF2122/97
gucgacuccagcaccagca

SEQ ID NO: 1159368 - RNA, 22 nt, Mycobacterium bovis subsp bovis AF2122/97
gucgaagggaucacgaccgcgc

SEQ ID NO: 1159369 - RNA, 20 nt, Mycobacterium bovis subsp bovis AF2122/97
gucgaagaauaugccgauga

SEQ ID NO: 1159370 - RNA, 20 nt, Mycobacterium bovis subsp bovis AF2122/97
gucgaagagguggggcagga

SEQ ID NO: 1159371 - RNA, 17 nt, Mycobacterium bovis subsp bovis AF2122/97
gucgaagaucgccuggg

SEQ ID NO: 1159372 - RNA, 18 nt, Mycobacterium bovis subsp bovis AF2122/97
gucgaagaugaccugauc

SEQ ID NO: 1159373 - RNA, 20 nt, Mycobacterium bovis subsp bovis AF2122/97
gucgaagccccucaccucgg

SEQ ID NO: 1159374 - RNA, 13 nt, Mycobacterium bovis subsp bovis AF2122/97
gucgaacugggcg

SEQ ID NO: 1159375 - RNA, 14 nt, Mycobacterium bovis subsp bovis AF2122/97
gucgaacaucaucg

SEQ ID NO: 1159376 - RNA, 13 nt, Mycobacterium bovis subsp bovis AF2122/97
gucgaaauacccg

SEQ ID NO: 1159377 - RNA, 18 nt, Mycobacterium bovis subsp bovis AF2122/97
guccucgagugccgccgu

SEQ ID NO: 1159378 - RNA, 22 nt, Mycobacterium bovis subsp bovis AF2122/97
guccucccaucccaugucgagg

SEQ ID NO: 1159379 - RNA, 22 nt, Mycobacterium bovis subsp bovis AF2122/97
guccucccauucccaacacagc

SEQ ID NO: 1159380 - RNA, 19 nt, Mycobacterium bovis subsp bovis AF2122/97
guccucgccgcacgccggc

SEQ ID NO: 1159381 - RNA, 19 nt, Mycobacterium bovis subsp bovis AF2122/97
guccucgcggagccgucgc

SEQ ID NO: 1159382 - RNA, 22 nt, Mycobacterium bovis subsp bovis AF2122/97
guccucgagugccgccgucgcc

SEQ ID NO: 1159383 - RNA, 18 nt, Mycobacterium bovis subsp bovis AF2122/97
gucgaaacgguacgccgc

SEQ ID NO: 1159384 - RNA, 20 nt, Mycobacterium bovis subsp bovis AF2122/97
gucccgugcgcgcgcagcug

SEQ ID NO: 1159385 - RNA, 19 nt, Mycobacterium bovis subsp bovis AF2122/97
gucccgguguccagccacg

SEQ ID NO: 1159386 - RNA, 16 nt, Mycobacterium bovis subsp bovis AF2122/97
gucccugaagccagcg

SEQ ID NO: 1159387 - RNA, 18 nt, Mycobacterium bovis subsp bovis AF2122/97
gucccugaagccagcgca

SEQ ID NO: 1159388 - RNA, 16 nt, Mycobacterium bovis subsp bovis AF2122/97
gucccucgccaaccag

SEQ ID NO: 1159389 - RNA, 16 nt, Mycobacterium bovis subsp bovis AF2122/97
guccgaaagccgccga

SEQ ID NO: 1159390 - RNA, 21 nt, Mycobacterium bovis subsp bovis AF2122/97
guccgaaguacuggccgccgc

SEQ ID NO: 1159391 - RNA, 14 nt, Mycobacterium bovis subsp bovis AF2122/97
guccgaccagcggc

SEQ ID NO: 1159392 - RNA, 17 nt, Mycobacterium bovis subsp bovis AF2122/97
gucccgguguccagcca

SEQ ID NO: 1159393 - RNA, 21 nt, Mycobacterium bovis subsp bovis AF2122/97
gucccacguugcugaugcccu

SEQ ID NO: 1159394 - RNA, 17 nt, Mycobacterium bovis subsp bovis AF2122/97
gucccacauccaucgcc

SEQ ID NO: 1159395 - RNA, 19 nt, Mycobacterium bovis subsp bovis AF2122/97
gucccacaccuccucgagc

SEQ ID NO: 1159396 - RNA, 16 nt, Mycobacterium bovis subsp bovis AF2122/97
guccaugugcccaggu

SEQ ID NO: 1159397 - RNA, 22 nt, Mycobacterium bovis subsp bovis AF2122/97
guccauguuuugcugcaugccg

SEQ ID NO: 1159398 - RNA, 16 nt, Mycobacterium bovis subsp bovis AF2122/97
guccgcgcaccgcagg

SEQ ID NO: 1159399 - RNA, 20 nt, Mycobacterium bovis subsp bovis AF2122/97
guccgcgcgaacgucaaccg

SEQ ID NO: 1159400 - RNA, 19 nt, Mycobacterium bovis subsp bovis AF2122/97
guccgcgcguugcuggucg

SEQ ID NO: 1159401 - RNA, 17 nt, Mycobacterium bovis subsp bovis AF2122/97
guccgcgcucagcuccg

SEQ ID NO: 1159402 - RNA, 15 nt, Mycobacterium bovis subsp bovis AF2122/97
guccgcgggccgcgc

SEQ ID NO: 1159403 - RNA, 12 nt, Mycobacterium bovis subsp bovis AF2122/97
guccgcggccac

SEQ ID NO: 1159404 - RNA, 22 nt, Mycobacterium bovis subsp bovis AF2122/97
guccgcggagaacaucccccgg

SEQ ID NO: 1159405 - RNA, 20 nt, Mycobacterium bovis subsp bovis AF2122/97
guccgcggucgcagcagacc

SEQ ID NO: 1159406 - RNA, 13 nt, Mycobacterium bovis subsp bovis AF2122/97
guccgcggccacc

SEQ ID NO: 1159407 - RNA, 18 nt, Mycobacterium bovis subsp bovis AF2122/97
guccgcggguagcgguuc

SEQ ID NO: 1159408 - RNA, 20 nt, Mycobacterium bovis subsp bovis AF2122/97
guccgccggauagcaccggc

SEQ ID NO: 1159409 - RNA, 21 nt, Mycobacterium bovis subsp bovis AF2122/97
guccgccuaagcauucagcgc

SEQ ID NO: 1159410 - RNA, 20 nt, Mycobacterium bovis subsp bovis AF2122/97
guccgccguugccgaucccc

SEQ ID NO: 1159411 - RNA, 20 nt, Mycobacterium bovis subsp bovis AF2122/97
guccgagcguaaugcugcug

SEQ ID NO: 1159412 - RNA, 22 nt, Mycobacterium bovis subsp bovis AF2122/97
guccgagcguaaugcugcugca

SEQ ID NO: 1159413 - RNA, 15 nt, Mycobacterium bovis subsp bovis AF2122/97
guccgacuucuccag

SEQ ID NO: 1159414 - RNA, 18 nt, Mycobacterium bovis subsp bovis AF2122/97
guccgguauugaucgaau

SEQ ID NO: 1159415 - RNA, 21 nt, Mycobacterium bovis subsp bovis AF2122/97
guccgguagcuguggugguga

SEQ ID NO: 1159416 - RNA, 13 nt, Mycobacterium bovis subsp bovis AF2122/97
guccgggucgaau

SEQ ID NO: 1159417 - RNA, 20 nt, Mycobacterium bovis subsp bovis AF2122/97
guccggucgccaagugcagg

SEQ ID NO: 1159418 - RNA, 22 nt, Mycobacterium bovis subsp bovis AF2122/97
guccggucgccucaccggcgcg

SEQ ID NO: 1159419 - RNA, 18 nt, Mycobacterium bovis subsp bovis AF2122/97
guccggguagcggcgccg

SEQ ID NO: 1159420 - RNA, 16 nt, Mycobacterium bovis subsp bovis AF2122/97
guccgggucaccagcg

SEQ ID NO: 1159421 - RNA, 23 nt, Mycobacterium bovis subsp bovis AF2122/97
guccggggcaacgaucagguugg

SEQ ID NO: 1159422 - RNA, 23 nt, Mycobacterium bovis subsp bovis AF2122/97
guccguagugaucgcaaaggccc

SEQ ID NO: 1159423 - RNA, 19 nt, Mycobacterium bovis subsp bovis AF2122/97
guccgguggaauccaccag

SEQ ID NO: 1159424 - RNA, 16 nt, Mycobacterium bovis subsp bovis AF2122/97
guccgguggacgcaga

SEQ ID NO: 1159425 - RNA, 21 nt, Mycobacterium bovis subsp bovis AF2122/97
gucgggcagauucuucaccca

SEQ ID NO: 1159426 - RNA, 14 nt, Mycobacterium bovis subsp bovis AF2122/97
gucgggcaccgcgc

SEQ ID NO: 1159427 - RNA, 17 nt, Mycobacterium bovis subsp bovis AF2122/97
gucgggcaugcucuggc

SEQ ID NO: 1159428 - RNA, 14 nt, Mycobacterium bovis subsp bovis AF2122/97
gucgggcaugacga

SEQ ID NO: 1159429 - RNA, 14 nt, Mycobacterium bovis subsp bovis AF2122/97
gucgggacgccgcc

SEQ ID NO: 1159430 - RNA, 17 nt, Mycobacterium bovis subsp bovis AF2122/97
gucgggacgccgccccc

SEQ ID NO: 1159431 - RNA, 19 nt, Mycobacterium bovis subsp bovis AF2122/97
gucggcuuccggugccggg

SEQ ID NO: 1159432 - RNA, 20 nt, Mycobacterium bovis subsp bovis AF2122/97
gucggcuaccgccgaccgga

SEQ ID NO: 1159433 - RNA, 21 nt, Mycobacterium bovis subsp bovis AF2122/97
gucggcugauuggcccaccgc

SEQ ID NO: 1159434 - RNA, 13 nt, Mycobacterium bovis subsp bovis AF2122/97
gucggcuccaggu

SEQ ID NO: 1159435 - RNA, 17 nt, Mycobacterium bovis subsp bovis AF2122/97
gucggcuuccuccucgg

SEQ ID NO: 1159436 - RNA, 13 nt, Mycobacterium bovis subsp bovis AF2122/97
gucggcugccgcg

SEQ ID NO: 1159437 - RNA, 16 nt, Mycobacterium bovis subsp bovis AF2122/97
gucggcuggacggcgc

SEQ ID NO: 1159438 - RNA, 18 nt, Mycobacterium bovis subsp bovis AF2122/97
gucggcuggucgcugcug

SEQ ID NO: 1159439 - RNA, 22 nt, Mycobacterium bovis subsp bovis AF2122/97
gucggcugucgugccucucggg

SEQ ID NO: 1159440 - RNA, 13 nt, Mycobacterium bovis subsp bovis AF2122/97
gucgggccaggcg

SEQ ID NO: 1159441 - RNA, 22 nt, Mycobacterium bovis subsp bovis AF2122/97
gucgggcuugacccuugggcac

SEQ ID NO: 1159442 - RNA, 13 nt, Mycobacterium bovis subsp bovis AF2122/97
gucggguggcugc

SEQ ID NO: 1159443 - RNA, 20 nt, Mycobacterium bovis subsp bovis AF2122/97
gucgggucccuuguggucug

SEQ ID NO: 1159444 - RNA, 22 nt, Mycobacterium bovis subsp bovis AF2122/97
gucggguaaauauugcgcccgg

SEQ ID NO: 1159445 - RNA, 18 nt, Mycobacterium bovis subsp bovis AF2122/97
gucggguaccacgcuggc

SEQ ID NO: 1159446 - RNA, 24 nt, Mycobacterium bovis subsp bovis AF2122/97
gucggggucguugaggccggugaa

SEQ ID NO: 1159447 - RNA, 13 nt, Mycobacterium bovis subsp bovis AF2122/97
gucggggcccccg

SEQ ID NO: 1159448 - RNA, 14 nt, Mycobacterium bovis subsp bovis AF2122/97
gucggccagcagau

SEQ ID NO: 1159449 - RNA, 22 nt, Mycobacterium bovis subsp bovis AF2122/97
gucggccagcagaucagguccu

SEQ ID NO: 1159450 - RNA, 16 nt, Mycobacterium bovis subsp bovis AF2122/97
gucggccaccuggucg

SEQ ID NO: 1159451 - RNA, 15 nt, Mycobacterium bovis subsp bovis AF2122/97
gucggcccacacuag

SEQ ID NO: 1159452 - RNA, 23 nt, Mycobacterium bovis subsp bovis AF2122/97
gucggccgccuucuccggcguca

SEQ ID NO: 1159453 - RNA, 20 nt, Mycobacterium bovis subsp bovis AF2122/97
gucggccugcgccggcgcug

SEQ ID NO: 1159454 - RNA, 14 nt, Mycobacterium bovis subsp bovis AF2122/97
gucggccugcggca

SEQ ID NO: 1159455 - RNA, 21 nt, Mycobacterium bovis subsp bovis AF2122/97
gucggccuggcaggguggggc

SEQ ID NO: 1159456 - RNA, 19 nt, Mycobacterium bovis subsp bovis AF2122/97
gucggccggcucguccggg

SEQ ID NO: 1159457 - RNA, 19 nt, Mycobacterium bovis subsp bovis AF2122/97
gucggccggggccacccgc

SEQ ID NO: 1159458 - RNA, 14 nt, Mycobacterium bovis subsp bovis AF2122/97
gucggcgaccaggu

SEQ ID NO: 1159459 - RNA, 15 nt, Mycobacterium bovis subsp bovis AF2122/97
gucggcgagcucggc

SEQ ID NO: 1159460 - RNA, 20 nt, Mycobacterium bovis subsp bovis AF2122/97
gucggcgagcucggccccgc

SEQ ID NO: 1159461 - RNA, 17 nt, Mycobacterium bovis subsp bovis AF2122/97
gucggcgaugcguccgc

SEQ ID NO: 1159462 - RNA, 16 nt, Mycobacterium bovis subsp bovis AF2122/97
gucggcgauggccagc

SEQ ID NO: 1159463 - RNA, 16 nt, Mycobacterium bovis subsp bovis AF2122/97
gucggcgcgccgcaca

SEQ ID NO: 1159464 - RNA, 18 nt, Mycobacterium bovis subsp bovis AF2122/97
gucggcgccggcggccgc

SEQ ID NO: 1159465 - RNA, 20 nt, Mycobacterium bovis subsp bovis AF2122/97
gucggcgccgagcagcccgc

SEQ ID NO: 1159466 - RNA, 15 nt, Mycobacterium bovis subsp bovis AF2122/97
gucggcgcggcuguc

SEQ ID NO: 1159467 - RNA, 17 nt, Mycobacterium bovis subsp bovis AF2122/97
gucggcgcuggccgucg

SEQ ID NO: 1159468 - RNA, 11 nt, Mycobacterium bovis subsp bovis AF2122/97
gucggcggcgu

SEQ ID NO: 1159469 - RNA, 20 nt, Mycobacterium bovis subsp bovis AF2122/97
gucggcgucgagcucguccu

SEQ ID NO: 1159470 - RNA, 13 nt, Mycobacterium bovis subsp bovis AF2122/97
gucggcgugcagg

SEQ ID NO: 1159471 - RNA, 15 nt, Mycobacterium bovis subsp bovis AF2122/97
gucggcggggcgccg

SEQ ID NO: 1159472 - RNA, 17 nt, Mycobacterium bovis subsp bovis AF2122/97
gucgauguucgccgcgc

SEQ ID NO: 1159473 - RNA, 15 nt, Mycobacterium bovis subsp bovis AF2122/97
gucgauguccgugag

SEQ ID NO: 1159474 - RNA, 19 nt, Mycobacterium bovis subsp bovis AF2122/97
gucgauguccacgccgugc

SEQ ID NO: 1159475 - RNA, 16 nt, Mycobacterium bovis subsp bovis AF2122/97
gucgagcgcccacugg

SEQ ID NO: 1159476 - RNA, 14 nt, Mycobacterium bovis subsp bovis AF2122/97
gucgagcagcacca

SEQ ID NO: 1159477 - RNA, 13 nt, Mycobacterium bovis subsp bovis AF2122/97
gucgagcaggccc

SEQ ID NO: 1159478 - RNA, 13 nt, Mycobacterium bovis subsp bovis AF2122/97
gucgcgccaggcu

SEQ ID NO: 1159479 - RNA, 22 nt, Mycobacterium bovis subsp bovis AF2122/97
gucgcgcaccggaucgccgucg

SEQ ID NO: 1159480 - RNA, 18 nt, Mycobacterium bovis subsp bovis AF2122/97
gucgcgcacggcccgagc

SEQ ID NO: 1159481 - RNA, 20 nt, Mycobacterium bovis subsp bovis AF2122/97
gucggcaccauagcuggagu

SEQ ID NO: 1159482 - RNA, 22 nt, Mycobacterium bovis subsp bovis AF2122/97
gucggacagcgucucggaggcg

SEQ ID NO: 1159483 - RNA, 22 nt, Mycobacterium bovis subsp bovis AF2122/97
gucggcaaugacguacgggguc

SEQ ID NO: 1159484 - RNA, 15 nt, Mycobacterium bovis subsp bovis AF2122/97
gucggcaccagcagc

SEQ ID NO: 1159485 - RNA, 16 nt, Mycobacterium bovis subsp bovis AF2122/97
gucggcaucggagaua

SEQ ID NO: 1159486 - RNA, 13 nt, Mycobacterium bovis subsp bovis AF2122/97
gucggcaugaucu

SEQ ID NO: 1159487 - RNA, 21 nt, Mycobacterium bovis subsp bovis AF2122/97
gucgcgguaccaucaccgcgc

SEQ ID NO: 1159488 - RNA, 19 nt, Mycobacterium bovis subsp bovis AF2122/97
gucgcguugagcgcagcua

SEQ ID NO: 1159489 - RNA, 18 nt, Mycobacterium bovis subsp bovis AF2122/97
gucggaauacaacagcug

SEQ ID NO: 1159490 - RNA, 21 nt, Mycobacterium bovis subsp bovis AF2122/97
gucggaauacaacagcugggu

SEQ ID NO: 1159491 - RNA, 14 nt, Mycobacterium bovis subsp bovis AF2122/97
gucggaaugggcgc

SEQ ID NO: 1159492 - RNA, 19 nt, Mycobacterium bovis subsp bovis AF2122/97
gucggaccagcugccggcg

SEQ ID NO: 1159493 - RNA, 17 nt, Mycobacterium bovis subsp bovis AF2122/97
gucggacuccgagagaa

SEQ ID NO: 1159494 - RNA, 19 nt, Mycobacterium bovis subsp bovis AF2122/97
gucggagaacauguagguc

SEQ ID NO: 1159495 - RNA, 14 nt, Mycobacterium bovis subsp bovis AF2122/97
gucguccggccacg

SEQ ID NO: 1159496 - RNA, 23 nt, Mycobacterium bovis subsp bovis AF2122/97
gucgucgaaguuggcgaagcccg

SEQ ID NO: 1159497 - RNA, 14 nt, Mycobacterium bovis subsp bovis AF2122/97
gucgucgaccaggc

SEQ ID NO: 1159498 - RNA, 15 nt, Mycobacterium bovis subsp bovis AF2122/97
gucguccgccugcac

SEQ ID NO: 1159499 - RNA, 16 nt, Mycobacterium bovis subsp bovis AF2122/97
gucguccagggcgacg

SEQ ID NO: 1159500 - RNA, 23 nt, Mycobacterium bovis subsp bovis AF2122/97
gucgucggcgucgguggaggcgu

SEQ ID NO: 1159501 - RNA, 17 nt, Mycobacterium bovis subsp bovis AF2122/97
gucgucggcaaccaacc

SEQ ID NO: 1159502 - RNA, 13 nt, Mycobacterium bovis subsp bovis AF2122/97
gucgucggccauc

SEQ ID NO: 1159503 - RNA, 17 nt, Mycobacterium bovis subsp bovis AF2122/97
gucgucgcuugcugggu

SEQ ID NO: 1159504 - RNA, 22 nt, Mycobacterium bovis subsp bovis AF2122/97
gucgucgccggcggcggugcgc

SEQ ID NO: 1159505 - RNA, 23 nt, Mycobacterium bovis subsp bovis AF2122/97
gucgucgauuagcccacccaugg

SEQ ID NO: 1159506 - RNA, 14 nt, Mycobacterium bovis subsp bovis AF2122/97
gucgucgagcugac

SEQ ID NO: 1159507 - RNA, 12 nt, Mycobacterium bovis subsp bovis AF2122/97
gucgucguccuc

SEQ ID NO: 1159508 - RNA, 14 nt, Mycobacterium bovis subsp bovis AF2122/97
gucgucgugcaggc

SEQ ID NO: 1159509 - RNA, 17 nt, Mycobacterium bovis subsp bovis AF2122/97
gucgucguacggcucau

SEQ ID NO: 1159510 - RNA, 19 nt, Mycobacterium bovis subsp bovis AF2122/97
gucgugaucuucugccuug

SEQ ID NO: 1159511 - RNA, 17 nt, Mycobacterium bovis subsp bovis AF2122/97
gucgugagccagcuugc

SEQ ID NO: 1159512 - RNA, 15 nt, Mycobacterium bovis subsp bovis AF2122/97
gucgugaucagcagg

SEQ ID NO: 1159513 - RNA, 16 nt, Mycobacterium bovis subsp bovis AF2122/97
gucgugaucagcagga

SEQ ID NO: 1159514 - RNA, 16 nt, Mycobacterium bovis subsp bovis AF2122/97
gucgugcacggcggcc

SEQ ID NO: 1159515 - RNA, 16 nt, Mycobacterium bovis subsp bovis AF2122/97
gucgugguggccacgg

SEQ ID NO: 1159516 - RNA, 20 nt, Mycobacterium bovis subsp bovis AF2122/97
gucggucaccauggcgccgc

SEQ ID NO: 1159517 - RNA, 13 nt, Mycobacterium bovis subsp bovis AF2122/97
gucggucaccugg

SEQ ID NO: 1159518 - RNA, 12 nt, Mycobacterium bovis subsp bovis AF2122/97
gucggugaccug

SEQ ID NO: 1159519 - RNA, 15 nt, Mycobacterium bovis subsp bovis AF2122/97
gucggugaccuguuu

SEQ ID NO: 1159520 - RNA, 12 nt, Mycobacterium bovis subsp bovis AF2122/97
gucgguccacuu

SEQ ID NO: 1159521 - RNA, 23 nt, Mycobacterium bovis subsp bovis AF2122/97
gucggucggguggaucuucaccu

SEQ ID NO: 1159522 - RNA, 15 nt, Mycobacterium bovis subsp bovis AF2122/97
gucggguaggccgcc

SEQ ID NO: 1159523 - RNA, 20 nt, Mycobacterium bovis subsp bovis AF2122/97
gucgggucaaugcuggcagc

SEQ ID NO: 1159524 - RNA, 21 nt, Mycobacterium bovis subsp bovis AF2122/97
gucggguugguuggcucgcug

SEQ ID NO: 1159525 - RNA, 23 nt, Mycobacterium bovis subsp bovis AF2122/97
gucggguugguuggcucgcuggg

SEQ ID NO: 1159526 - RNA, 14 nt, Mycobacterium bovis subsp bovis AF2122/97
gucggugcgcggca

SEQ ID NO: 1159527 - RNA, 23 nt, Mycobacterium bovis subsp bovis AF2122/97
gucggugagccgugccgccagca

SEQ ID NO: 1159528 - RNA, 19 nt, Mycobacterium bovis subsp bovis AF2122/97
gucggugaggaagcggccg

SEQ ID NO: 1159529 - RNA, 20 nt, Mycobacterium bovis subsp bovis AF2122/97
gucgguuuccuccggcagca

SEQ ID NO: 1159530 - RNA, 20 nt, Mycobacterium bovis subsp bovis AF2122/97
gucgguucagccacgcagca

SEQ ID NO: 1159531 - RNA, 20 nt, Mycobacterium bovis subsp bovis AF2122/97
gucgguucggccggagccgc

SEQ ID NO: 1159532 - RNA, 21 nt, Mycobacterium bovis subsp bovis AF2122/97
gucguagaggacugcggucug

SEQ ID NO: 1159533 - RNA, 19 nt, Mycobacterium bovis subsp bovis AF2122/97
gucuccgcugaugagccgc

SEQ ID NO: 1159534 - RNA, 20 nt, Mycobacterium bovis subsp bovis AF2122/97
gucucccuugccgccauucc

SEQ ID NO: 1159535 - RNA, 19 nt, Mycobacterium bovis subsp bovis AF2122/97
gucucccagaggucgagcg

SEQ ID NO: 1159536 - RNA, 14 nt, Mycobacterium bovis subsp bovis AF2122/97
gucuccagcugggu

SEQ ID NO: 1159537 - RNA, 17 nt, Mycobacterium bovis subsp bovis AF2122/97
gucguugccgcggucgg

SEQ ID NO: 1159538 - RNA, 18 nt, Mycobacterium bovis subsp bovis AF2122/97
gucguuggcggcggucgg

SEQ ID NO: 1159539 - RNA, 22 nt, Mycobacterium bovis subsp bovis AF2122/97
gucguugccgggucaaccggug

SEQ ID NO: 1159540 - RNA, 15 nt, Mycobacterium bovis subsp bovis AF2122/97
gucguugccguccac

SEQ ID NO: 1159541 - RNA, 15 nt, Mycobacterium bovis subsp bovis AF2122/97
gucucggucagcccc

SEQ ID NO: 1159542 - RNA, 16 nt, Mycobacterium bovis subsp bovis AF2122/97
gucucggugcagcagc

SEQ ID NO: 1159543 - RNA, 21 nt, Mycobacterium bovis subsp bovis AF2122/97
gucucgcgagcguuucaccag

SEQ ID NO: 1159544 - RNA, 19 nt, Mycobacterium bovis subsp bovis AF2122/97
gucucgcagcaacggcggc

SEQ ID NO: 1159545 - RNA, 20 nt, Mycobacterium bovis subsp bovis AF2122/97
gucucgacggcgccgcccac

SEQ ID NO: 1159546 - RNA, 15 nt, Mycobacterium bovis subsp bovis AF2122/97
gucucgacggcggcc

SEQ ID NO: 1159547 - RNA, 22 nt, Mycobacterium bovis subsp bovis AF2122/97
gucuccuugagcuucucgucgg

SEQ ID NO: 1159548 - RNA, 21 nt, Mycobacterium bovis subsp bovis AF2122/97
gucuccggugcgcagccaggu

SEQ ID NO: 1159549 - RNA, 22 nt, Mycobacterium bovis subsp bovis AF2122/97
gucuccuccggaaagcucucgg

SEQ ID NO: 1159550 - RNA, 16 nt, Mycobacterium bovis subsp bovis AF2122/97
gucucgaacuccaugc

SEQ ID NO: 1159551 - RNA, 18 nt, Mycobacterium bovis subsp bovis AF2122/97
gucucgacaaagcggcug

SEQ ID NO: 1159552 - RNA, 13 nt, Mycobacterium bovis subsp bovis AF2122/97
gucucugacgaau

SEQ ID NO: 1159553 - RNA, 13 nt, Mycobacterium bovis subsp bovis AF2122/97
gucugcgccgccg

SEQ ID NO: 1159554 - RNA, 14 nt, Mycobacterium bovis subsp bovis AF2122/97
gucugcccgcccag

SEQ ID NO: 1159555 - RNA, 17 nt, Mycobacterium bovis subsp bovis AF2122/97
gucugcggaccggcgcg

SEQ ID NO: 1159556 - RNA, 13 nt, Mycobacterium bovis subsp bovis AF2122/97
gucugcucgccag

SEQ ID NO: 1159557 - RNA, 16 nt, Mycobacterium bovis subsp bovis AF2122/97
gucugcggggugagug

SEQ ID NO: 1159558 - RNA, 16 nt, Mycobacterium bovis subsp bovis AF2122/97
gucugcucgccaggca

SEQ ID NO: 1159559 - RNA, 16 nt, Mycobacterium bovis subsp bovis AF2122/97
gucugcucgcgcccgc

SEQ ID NO: 1159560 - RNA, 15 nt, Mycobacterium bovis subsp bovis AF2122/97
gucugauggcggcuc

SEQ ID NO: 1159561 - RNA, 15 nt, Mycobacterium bovis subsp bovis AF2122/97
gucugcagugcagcg

SEQ ID NO: 1159562 - RNA, 13 nt, Mycobacterium bovis subsp bovis AF2122/97
gucugacgaaucg

SEQ ID NO: 1159563 - RNA, 15 nt, Mycobacterium bovis subsp bovis AF2122/97
gucugagcgccggca

SEQ ID NO: 1159564 - RNA, 15 nt, Mycobacterium bovis subsp bovis AF2122/97
gucugacccaccgcc

SEQ ID NO: 1159565 - RNA, 20 nt, Mycobacterium bovis subsp bovis AF2122/97
gucuucaggccgcgcauggu

SEQ ID NO: 1159566 - RNA, 17 nt, Mycobacterium bovis subsp bovis AF2122/97
gucuggggacgaaacua

SEQ ID NO: 1159567 - RNA, 18 nt, Mycobacterium bovis subsp bovis AF2122/97
gucugggugagcaccugg

SEQ ID NO: 1159568 - RNA, 14 nt, Mycobacterium bovis subsp bovis AF2122/97
gucugggugcaggu

SEQ ID NO: 1159569 - RNA, 17 nt, Mycobacterium bovis subsp bovis AF2122/97
gucugggugcagguucu

SEQ ID NO: 1159570 - RNA, 23 nt, Mycobacterium bovis subsp bovis AF2122/97
gucugguugucgaucucggccag

SEQ ID NO: 1159571 - RNA, 21 nt, Mycobacterium bovis subsp bovis AF2122/97
gucuggccccaggggaggcga

SEQ ID NO: 1159572 - RNA, 14 nt, Mycobacterium bovis subsp bovis AF2122/97
gucuggcaggccag

SEQ ID NO: 1159573 - RNA, 15 nt, Mycobacterium bovis subsp bovis AF2122/97
gucuggcgaugacga

SEQ ID NO: 1159574 - RNA, 21 nt, Mycobacterium bovis subsp bovis AF2122/97
gucugcugggcacgauggcuc

SEQ ID NO: 1159575 - RNA, 16 nt, Mycobacterium bovis subsp bovis AF2122/97
gucuggacugcagccc

SEQ ID NO: 1159576 - RNA, 16 nt, Mycobacterium bovis subsp bovis AF2122/97
gucuugguuguggagg

SEQ ID NO: 1159577 - RNA, 15 nt, Mycobacterium bovis subsp bovis AF2122/97
gucuugugcugcaag

SEQ ID NO: 1159578 - RNA, 14 nt, Mycobacterium bovis subsp bovis AF2122/97
gucuuggcccggcg

SEQ ID NO: 1159579 - RNA, 19 nt, Mycobacterium bovis subsp bovis AF2122/97
gucuucgucggagucuucg

SEQ ID NO: 1159580 - RNA, 19 nt, Mycobacterium bovis subsp bovis AF2122/97
gucuucgucauggccggcc

SEQ ID NO: 1159581 - RNA, 20 nt, Mycobacterium bovis subsp bovis AF2122/97
gucuucgccgucggcgacuc

SEQ ID NO: 1159582 - RNA, 19 nt, Mycobacterium bovis subsp bovis AF2122/97
gucuuccucggccacccgc

SEQ ID NO: 1159583 - RNA, 14 nt, Mycobacterium bovis subsp bovis AF2122/97
gucuuccggugcgc

SEQ ID NO: 1159584 - RNA, 12 nt, Mycobacterium bovis subsp bovis AF2122/97
gucuuguggugg

SEQ ID NO: 1159585 - RNA, 16 nt, Mycobacterium bovis subsp bovis AF2122/97
gugaagccgagcgccc

SEQ ID NO: 1159586 - RNA, 18 nt, Mycobacterium bovis subsp bovis AF2122/97
gugaaggcaaacaccagc

SEQ ID NO: 1159587 - RNA, 22 nt, Mycobacterium bovis subsp bovis AF2122/97
gugaaggcaaacaccagcccgg

SEQ ID NO: 1159588 - RNA, 19 nt, Mycobacterium bovis subsp bovis AF2122/97
gugaaguugccggucaggc

SEQ ID NO: 1159589 - RNA, 21 nt, Mycobacterium bovis subsp bovis AF2122/97
gugacaaaucggccaucauga

SEQ ID NO: 1159590 - RNA, 18 nt, Mycobacterium bovis subsp bovis AF2122/97
gugaaugcaacuccucga

SEQ ID NO: 1159591 - RNA, 14 nt, Mycobacterium bovis subsp bovis AF2122/97
gugaauggcagcac

SEQ ID NO: 1159592 - RNA, 15 nt, Mycobacterium bovis subsp bovis AF2122/97
gugaacgccggugcg

SEQ ID NO: 1159593 - RNA, 14 nt, Mycobacterium bovis subsp bovis AF2122/97
gugaacggcaaggu

SEQ ID NO: 1159594 - RNA, 18 nt, Mycobacterium bovis subsp bovis AF2122/97
gugaacguuuccagcuga

SEQ ID NO: 1159595 - RNA, 14 nt, Mycobacterium bovis subsp bovis AF2122/97
gugaacggcgcggg

SEQ ID NO: 1159596 - RNA, 18 nt, Mycobacterium bovis subsp bovis AF2122/97
gugaacuucuccaccagc

SEQ ID NO: 1159597 - RNA, 22 nt, Mycobacterium bovis subsp bovis AF2122/97
gugaacagcagguuggcgagcu

SEQ ID NO: 1159598 - RNA, 19 nt, Mycobacterium bovis subsp bovis AF2122/97
gugaacaaaugccggugca

SEQ ID NO: 1159599 - RNA, 16 nt, Mycobacterium bovis subsp bovis AF2122/97
gugaccgccgcgccgg

SEQ ID NO: 1159600 - RNA, 23 nt, Mycobacterium bovis subsp bovis AF2122/97
gugacccgccggcgacugcagcg

SEQ ID NO: 1159601 - RNA, 15 nt, Mycobacterium bovis subsp bovis AF2122/97
gugacccucagcacc

SEQ ID NO: 1159602 - RNA, 17 nt, Mycobacterium bovis subsp bovis AF2122/97
gugacccacucggggac

SEQ ID NO: 1159603 - RNA, 21 nt, Mycobacterium bovis subsp bovis AF2122/97
gugacccccagcagggugugc

SEQ ID NO: 1159604 - RNA, 16 nt, Mycobacterium bovis subsp bovis AF2122/97
gugaccuaccuccucg

SEQ ID NO: 1159605 - RNA, 14 nt, Mycobacterium bovis subsp bovis AF2122/97
gugaccguggcggg

SEQ ID NO: 1159606 - RNA, 22 nt, Mycobacterium bovis subsp bovis AF2122/97
gugacauagaccucgccgguga

SEQ ID NO: 1159607 - RNA, 14 nt, Mycobacterium bovis subsp bovis AF2122/97
gugacaccaacacc

SEQ ID NO: 1159608 - RNA, 19 nt, Mycobacterium bovis subsp bovis AF2122/97
gugaccacgcugcugguga

SEQ ID NO: 1159609 - RNA, 18 nt, Mycobacterium bovis subsp bovis AF2122/97
gugaccagcaggccgggc

SEQ ID NO: 1159610 - RNA, 15 nt, Mycobacterium bovis subsp bovis AF2122/97
gugaccaggcggcgc

SEQ ID NO: 1159611 - RNA, 16 nt, Mycobacterium bovis subsp bovis AF2122/97
gugaccaggugccagg

SEQ ID NO: 1159612 - RNA, 15 nt, Mycobacterium bovis subsp bovis AF2122/97
gugaccacgcugcug

SEQ ID NO: 1159613 - RNA, 13 nt, Mycobacterium bovis subsp bovis AF2122/97
gugacauucugca

SEQ ID NO: 1159614 - RNA, 13 nt, Mycobacterium bovis subsp bovis AF2122/97
gugacgugguggg

SEQ ID NO: 1159615 - RNA, 21 nt, Mycobacterium bovis subsp bovis AF2122/97
gugacguagggcagcgccagg

SEQ ID NO: 1159616 - RNA, 19 nt, Mycobacterium bovis subsp bovis AF2122/97
gugacggugaauucacgau

SEQ ID NO: 1159617 - RNA, 15 nt, Mycobacterium bovis subsp bovis AF2122/97
gugacgguguuggug

SEQ ID NO: 1159618 - RNA, 14 nt, Mycobacterium bovis subsp bovis AF2122/97
gugacggcggcugu

SEQ ID NO: 1159619 - RNA, 12 nt, Mycobacterium bovis subsp bovis AF2122/97
gugacggcggcc

SEQ ID NO: 1159620 - RNA, 21 nt, Mycobacterium bovis subsp bovis AF2122/97
gugacgccacgaccgccgaua

SEQ ID NO: 1159621 - RNA, 15 nt, Mycobacterium bovis subsp bovis AF2122/97
gugacgcacagcagc

SEQ ID NO: 1159622 - RNA, 22 nt, Mycobacterium bovis subsp bovis AF2122/97
gugacgcacagcagcaccgcga

SEQ ID NO: 1159623 - RNA, 18 nt, Mycobacterium bovis subsp bovis AF2122/97
gugacuuauccggccagu

SEQ ID NO: 1159624 - RNA, 14 nt, Mycobacterium bovis subsp bovis AF2122/97
gugagaccagguuc

SEQ ID NO: 1159625 - RNA, 22 nt, Mycobacterium bovis subsp bovis AF2122/97
gugagaccagguucucggucgg

SEQ ID NO: 1159626 - RNA, 19 nt, Mycobacterium bovis subsp bovis AF2122/97
gugacugcgcgcguugcgg

SEQ ID NO: 1159627 - RNA, 15 nt, Mycobacterium bovis subsp bovis AF2122/97
gugacguugugccuu

SEQ ID NO: 1159628 - RNA, 18 nt, Mycobacterium bovis subsp bovis AF2122/97
gugacguuggcaggcagg

SEQ ID NO: 1159629 - RNA, 19 nt, Mycobacterium bovis subsp bovis AF2122/97
gugaucaaaccggcggcga

SEQ ID NO: 1159630 - RNA, 17 nt, Mycobacterium bovis subsp bovis AF2122/97
gugaucgcgguggcuuc

SEQ ID NO: 1159631 - RNA, 14 nt, Mycobacterium bovis subsp bovis AF2122/97
gugauccgguggug

SEQ ID NO: 1159632 - RNA, 17 nt, Mycobacterium bovis subsp bovis AF2122/97
gugaucggcgucaggca

SEQ ID NO: 1159633 - RNA, 13 nt, Mycobacterium bovis subsp bovis AF2122/97
gugaucgggcagc

SEQ ID NO: 1159634 - RNA, 21 nt, Mycobacterium bovis subsp bovis AF2122/97
gugaucgggcagcacgccagc

SEQ ID NO: 1159635 - RNA, 23 nt, Mycobacterium bovis subsp bovis AF2122/97
gugaucggguacccaucugcuca

SEQ ID NO: 1159636 - RNA, 23 nt, Mycobacterium bovis subsp bovis AF2122/97
gugaucgaacugggggccggcac

SEQ ID NO: 1159637 - RNA, 19 nt, Mycobacterium bovis subsp bovis AF2122/97
gugaucagcaggacgauga

SEQ ID NO: 1159638 - RNA, 13 nt, Mycobacterium bovis subsp bovis AF2122/97
gugaucaggucac

SEQ ID NO: 1159639 - RNA, 18 nt, Mycobacterium bovis subsp bovis AF2122/97
gugaucagccaccgggug

SEQ ID NO: 1159640 - RNA, 17 nt, Mycobacterium bovis subsp bovis AF2122/97
gugaucccgauggucac

SEQ ID NO: 1159641 - RNA, 14 nt, Mycobacterium bovis subsp bovis AF2122/97
gugaucccgcccaa

SEQ ID NO: 1159642 - RNA, 16 nt, Mycobacterium bovis subsp bovis AF2122/97
gugauccgagaccaug

SEQ ID NO: 1159643 - RNA, 17 nt, Mycobacterium bovis subsp bovis AF2122/97
gugauccgagaccaugc

SEQ ID NO: 1159644 - RNA, 14 nt, Mycobacterium bovis subsp bovis AF2122/97
gugagguggucagc

SEQ ID NO: 1159645 - RNA, 17 nt, Mycobacterium bovis subsp bovis AF2122/97
gugaggccgaccagcac

SEQ ID NO: 1159646 - RNA, 16 nt, Mycobacterium bovis subsp bovis AF2122/97
gugaggccccccgcgc

SEQ ID NO: 1159647 - RNA, 17 nt, Mycobacterium bovis subsp bovis AF2122/97
gugagcauggcuagggc

SEQ ID NO: 1159648 - RNA, 16 nt, Mycobacterium bovis subsp bovis AF2122/97
gugagccaugccgcuc

SEQ ID NO: 1159649 - RNA, 16 nt, Mycobacterium bovis subsp bovis AF2122/97
gugagcaccugggcgc

SEQ ID NO: 1159650 - RNA, 15 nt, Mycobacterium bovis subsp bovis AF2122/97
gugagauggcgguga

SEQ ID NO: 1159651 - RNA, 17 nt, Mycobacterium bovis subsp bovis AF2122/97
gugagcaccagcagcac

SEQ ID NO: 1159652 - RNA, 12 nt, Mycobacterium bovis subsp bovis AF2122/97
gugagcaccugg

SEQ ID NO: 1159653 - RNA, 14 nt, Mycobacterium bovis subsp bovis AF2122/97
gugagcugcggggu

SEQ ID NO: 1159654 - RNA, 14 nt, Mycobacterium bovis subsp bovis AF2122/97
gugagcucgcgcag

SEQ ID NO: 1159655 - RNA, 15 nt, Mycobacterium bovis subsp bovis AF2122/97
gugagcucggcugcu

SEQ ID NO: 1159656 - RNA, 21 nt, Mycobacterium bovis subsp bovis AF2122/97
gugagcuuagcgcaugggccu

SEQ ID NO: 1159657 - RNA, 18 nt, Mycobacterium bovis subsp bovis AF2122/97
gugagcuaugcuggcagc

SEQ ID NO: 1159658 - RNA, 11 nt, Mycobacterium bovis subsp bovis AF2122/97
gugagcgggca

SEQ ID NO: 1159659 - RNA, 13 nt, Mycobacterium bovis subsp bovis AF2122/97
gugagccuuucgu

SEQ ID NO: 1159660 - RNA, 16 nt, Mycobacterium bovis subsp bovis AF2122/97
gugccugcggguggau

SEQ ID NO: 1159661 - RNA, 19 nt, Mycobacterium bovis subsp bovis AF2122/97
gugccucgauuguggccag

SEQ ID NO: 1159662 - RNA, 21 nt, Mycobacterium bovis subsp bovis AF2122/97
gugccucggcgaugggccggu

SEQ ID NO: 1159663 - RNA, 18 nt, Mycobacterium bovis subsp bovis AF2122/97
gugccgucggcgugcagc

SEQ ID NO: 1159664 - RNA, 16 nt, Mycobacterium bovis subsp bovis AF2122/97
gugccgucgccgcccu

SEQ ID NO: 1159665 - RNA, 18 nt, Mycobacterium bovis subsp bovis AF2122/97
gugccgugaucgcuggcg

SEQ ID NO: 1159666 - RNA, 21 nt, Mycobacterium bovis subsp bovis AF2122/97
gugccgugcgaucaccuccgc

SEQ ID NO: 1159667 - RNA, 21 nt, Mycobacterium bovis subsp bovis AF2122/97
gugccgugcucacggcaggcg

SEQ ID NO: 1159668 - RNA, 13 nt, Mycobacterium bovis subsp bovis AF2122/97
gugccguggugaa

SEQ ID NO: 1159669 - RNA, 18 nt, Mycobacterium bovis subsp bovis AF2122/97
gugccguguccagcaugc

SEQ ID NO: 1159670 - RNA, 19 nt, Mycobacterium bovis subsp bovis AF2122/97
gugccguuccagcaucgag

SEQ ID NO: 1159671 - RNA, 22 nt, Mycobacterium bovis subsp bovis AF2122/97
gugccguuccagcaucgagcag

SEQ ID NO: 1159672 - RNA, 14 nt, Mycobacterium bovis subsp bovis AF2122/97
gugccguuggagcc

SEQ ID NO: 1159673 - RNA, 16 nt, Mycobacterium bovis subsp bovis AF2122/97
gugccggcgccgcccu

SEQ ID NO: 1159674 - RNA, 18 nt, Mycobacterium bovis subsp bovis AF2122/97
gugccggcgucgcuggcc

SEQ ID NO: 1159675 - RNA, 20 nt, Mycobacterium bovis subsp bovis AF2122/97
gugccggcgucgcuggccag

SEQ ID NO: 1159676 - RNA, 19 nt, Mycobacterium bovis subsp bovis AF2122/97
gugccgggcgaugcugggc

SEQ ID NO: 1159677 - RNA, 17 nt, Mycobacterium bovis subsp bovis AF2122/97
gugccggugcuccucgg

SEQ ID NO: 1159678 - RNA, 20 nt, Mycobacterium bovis subsp bovis AF2122/97
gugccggucaccucgccggc

SEQ ID NO: 1159679 - RNA, 19 nt, Mycobacterium bovis subsp bovis AF2122/97
gugccggggcugccgccgu

SEQ ID NO: 1159680 - RNA, 17 nt, Mycobacterium bovis subsp bovis AF2122/97
gugccgggguggcgcgc

SEQ ID NO: 1159681 - RNA, 19 nt, Mycobacterium bovis subsp bovis AF2122/97
gugccgggguggcgcgcca

SEQ ID NO: 1159682 - RNA, 14 nt, Mycobacterium bovis subsp bovis AF2122/97
gugccgccaccacc

SEQ ID NO: 1159683 - RNA, 13 nt, Mycobacterium bovis subsp bovis AF2122/97
gugccgccagcaa

SEQ ID NO: 1159684 - RNA, 23 nt, Mycobacterium bovis subsp bovis AF2122/97
gugccgccaucgccgccggugcc

SEQ ID NO: 1159685 - RNA, 21 nt, Mycobacterium bovis subsp bovis AF2122/97
gugccgcugcauccgcagcac

SEQ ID NO: 1159686 - RNA, 20 nt, Mycobacterium bovis subsp bovis AF2122/97
gugccggccgcacaugagcu

SEQ ID NO: 1159687 - RNA, 13 nt, Mycobacterium bovis subsp bovis AF2122/97
gugccggcagcgg

SEQ ID NO: 1159688 - RNA, 12 nt, Mycobacterium bovis subsp bovis AF2122/97
gugccgcagcag

SEQ ID NO: 1159689 - RNA, 18 nt, Mycobacterium bovis subsp bovis AF2122/97
gugccgauuggccugcca

SEQ ID NO: 1159690 - RNA, 18 nt, Mycobacterium bovis subsp bovis AF2122/97
gugccgaugccggcgagg

SEQ ID NO: 1159691 - RNA, 22 nt, Mycobacterium bovis subsp bovis AF2122/97
gugccgaugccggcgagggcca

SEQ ID NO: 1159692 - RNA, 16 nt, Mycobacterium bovis subsp bovis AF2122/97
gugccgaguuccugca

SEQ ID NO: 1159693 - RNA, 18 nt, Mycobacterium bovis subsp bovis AF2122/97
gugccagugcgcagcccg

SEQ ID NO: 1159694 - RNA, 18 nt, Mycobacterium bovis subsp bovis AF2122/97
gugcauguauuuguugua

SEQ ID NO: 1159695 - RNA, 22 nt, Mycobacterium bovis subsp bovis AF2122/97
gugccgagaauuccccagccgc

SEQ ID NO: 1159696 - RNA, 20 nt, Mycobacterium bovis subsp bovis AF2122/97
gugcccagcgcuuugaugcc

SEQ ID NO: 1159697 - RNA, 17 nt, Mycobacterium bovis subsp bovis AF2122/97
gugcccaagcaguccac

SEQ ID NO: 1159698 - RNA, 15 nt, Mycobacterium bovis subsp bovis AF2122/97
gugccaugguugaug

SEQ ID NO: 1159699 - RNA, 23 nt, Mycobacterium bovis subsp bovis AF2122/97
gugccaucgccaugauggacagc

SEQ ID NO: 1159700 - RNA, 13 nt, Mycobacterium bovis subsp bovis AF2122/97
gugcaggcggccg

SEQ ID NO: 1159701 - RNA, 15 nt, Mycobacterium bovis subsp bovis AF2122/97
gugcaggcugucaau

SEQ ID NO: 1159702 - RNA, 19 nt, Mycobacterium bovis subsp bovis AF2122/97
gugcagggcauugcggccc

SEQ ID NO: 1159703 - RNA, 15 nt, Mycobacterium bovis subsp bovis AF2122/97
gugcaggucguccau

SEQ ID NO: 1159704 - RNA, 16 nt, Mycobacterium bovis subsp bovis AF2122/97
gugcaggugaugcaug

SEQ ID NO: 1159705 - RNA, 20 nt, Mycobacterium bovis subsp bovis AF2122/97
gugcaggugcccggccaaaa

SEQ ID NO: 1159706 - RNA, 19 nt, Mycobacterium bovis subsp bovis AF2122/97
gugcagcucgauacccagg

SEQ ID NO: 1159707 - RNA, 15 nt, Mycobacterium bovis subsp bovis AF2122/97
gugcaggaccagcac

SEQ ID NO: 1159708 - RNA, 19 nt, Mycobacterium bovis subsp bovis AF2122/97
gugcaggaucacgccgccg

SEQ ID NO: 1159709 - RNA, 15 nt, Mycobacterium bovis subsp bovis AF2122/97
gugcaggcgacggcu

SEQ ID NO: 1159710 - RNA, 21 nt, Mycobacterium bovis subsp bovis AF2122/97
gugcagcuccgggugcagauc

SEQ ID NO: 1159711 - RNA, 20 nt, Mycobacterium bovis subsp bovis AF2122/97
gugcagcugcaaugacugga

SEQ ID NO: 1159712 - RNA, 21 nt, Mycobacterium bovis subsp bovis AF2122/97
gugcauaucaaccccggugca

SEQ ID NO: 1159713 - RNA, 15 nt, Mycobacterium bovis subsp bovis AF2122/97
gugcauaggccgcgu

SEQ ID NO: 1159714 - RNA, 23 nt, Mycobacterium bovis subsp bovis AF2122/97
gugcauaccgcaauggcggccuu

SEQ ID NO: 1159715 - RNA, 21 nt, Mycobacterium bovis subsp bovis AF2122/97
gugcauaccgcaauggcggcc

SEQ ID NO: 1159716 - RNA, 18 nt, Mycobacterium bovis subsp bovis AF2122/97
gugcaucgacucacggau

SEQ ID NO: 1159717 - RNA, 18 nt, Mycobacterium bovis subsp bovis AF2122/97
gugcaucgccugcgccuu

SEQ ID NO: 1159718 - RNA, 13 nt, Mycobacterium bovis subsp bovis AF2122/97
gugcacugccggg

SEQ ID NO: 1159719 - RNA, 23 nt, Mycobacterium bovis subsp bovis AF2122/97
gugcagcgcgucaaacaccucca

SEQ ID NO: 1159720 - RNA, 17 nt, Mycobacterium bovis subsp bovis AF2122/97
gugcacgaucgcgguga

SEQ ID NO: 1159721 - RNA, 22 nt, Mycobacterium bovis subsp bovis AF2122/97
gugcaaccauggcggcuccgcc

SEQ ID NO: 1159722 - RNA, 20 nt, Mycobacterium bovis subsp bovis AF2122/97
gugcacggcgaggugcucgg

SEQ ID NO: 1159723 - RNA, 19 nt, Mycobacterium bovis subsp bovis AF2122/97
gugcacggcuucggcgagc

SEQ ID NO: 1159724 - RNA, 13 nt, Mycobacterium bovis subsp bovis AF2122/97
gugcacgcgggcg

SEQ ID NO: 1159725 - RNA, 15 nt, Mycobacterium bovis subsp bovis AF2122/97
guggucugcgcggug

SEQ ID NO: 1159726 - RNA, 18 nt, Mycobacterium bovis subsp bovis AF2122/97
guggucugccaaaagggc

SEQ ID NO: 1159727 - RNA, 23 nt, Mycobacterium bovis subsp bovis AF2122/97
guggucgucccgauggcgguggg

SEQ ID NO: 1159728 - RNA, 19 nt, Mycobacterium bovis subsp bovis AF2122/97
guggucucgguaggcggug

SEQ ID NO: 1159729 - RNA, 22 nt, Mycobacterium bovis subsp bovis AF2122/97
guggucgcugcugccgcaccgg

SEQ ID NO: 1159730 - RNA, 22 nt, Mycobacterium bovis subsp bovis AF2122/97
guggucccguucgcccgcccgu

SEQ ID NO: 1159731 - RNA, 17 nt, Mycobacterium bovis subsp bovis AF2122/97
guggucgagguggggug

SEQ ID NO: 1159732 - RNA, 13 nt, Mycobacterium bovis subsp bovis AF2122/97
gugggcguggcug

SEQ ID NO: 1159733 - RNA, 13 nt, Mycobacterium bovis subsp bovis AF2122/97
gugggcguucccc

SEQ ID NO: 1159734 - RNA, 18 nt, Mycobacterium bovis subsp bovis AF2122/97
gugggcgugacgggcagg

SEQ ID NO: 1159735 - RNA, 14 nt, Mycobacterium bovis subsp bovis AF2122/97
gugggcgugacggg

SEQ ID NO: 1159736 - RNA, 20 nt, Mycobacterium bovis subsp bovis AF2122/97
gugguccuuguuguggugga

SEQ ID NO: 1159737 - RNA, 15 nt, Mycobacterium bovis subsp bovis AF2122/97
gugggcgacgaggca

SEQ ID NO: 1159738 - RNA, 13 nt, Mycobacterium bovis subsp bovis AF2122/97
gugggcgccgcaa

SEQ ID NO: 1159739 - RNA, 15 nt, Mycobacterium bovis subsp bovis AF2122/97
gugggcgccgacacc

SEQ ID NO: 1159740 - RNA, 14 nt, Mycobacterium bovis subsp bovis AF2122/97
gugggcgauggcac

SEQ ID NO: 1159741 - RNA, 19 nt, Mycobacterium bovis subsp bovis AF2122/97
gugggcgacggccaagauc

SEQ ID NO: 1159742 - RNA, 17 nt, Mycobacterium bovis subsp bovis AF2122/97
gugggcgacggcggcgu

SEQ ID NO: 1159743 - RNA, 14 nt, Mycobacterium bovis subsp bovis AF2122/97
gugggccugcccgg

SEQ ID NO: 1159744 - RNA, 16 nt, Mycobacterium bovis subsp bovis AF2122/97
gugggccuguugcugc

SEQ ID NO: 1159745 - RNA, 14 nt, Mycobacterium bovis subsp bovis AF2122/97
gugggccggcggua

SEQ ID NO: 1159746 - RNA, 14 nt, Mycobacterium bovis subsp bovis AF2122/97
gugggccccgccga

SEQ ID NO: 1159747 - RNA, 14 nt, Mycobacterium bovis subsp bovis AF2122/97
gugggccacgauga

SEQ ID NO: 1159748 - RNA, 21 nt, Mycobacterium bovis subsp bovis AF2122/97
gugggcauugcggcgcgggug

SEQ ID NO: 1159749 - RNA, 18 nt, Mycobacterium bovis subsp bovis AF2122/97
gugggacuggcgugaacg

SEQ ID NO: 1159750 - RNA, 14 nt, Mycobacterium bovis subsp bovis AF2122/97
gugggagcagccga

SEQ ID NO: 1159751 - RNA, 13 nt, Mycobacterium bovis subsp bovis AF2122/97
guggccgagccgc

SEQ ID NO: 1159752 - RNA, 20 nt, Mycobacterium bovis subsp bovis AF2122/97
guggccgcggcggucugggu

SEQ ID NO: 1159753 - RNA, 19 nt, Mycobacterium bovis subsp bovis AF2122/97
guggccgccggcgcuggcg

SEQ ID NO: 1159754 - RNA, 22 nt, Mycobacterium bovis subsp bovis AF2122/97
guggcccggcgaaagcuugggc

SEQ ID NO: 1159755 - RNA, 16 nt, Mycobacterium bovis subsp bovis AF2122/97
guggcccgggccaccg

SEQ ID NO: 1159756 - RNA, 22 nt, Mycobacterium bovis subsp bovis AF2122/97
guggccggucguuugcgccagg

SEQ ID NO: 1159757 - RNA, 19 nt, Mycobacterium bovis subsp bovis AF2122/97
guggccguuuaggccggaa

SEQ ID NO: 1159758 - RNA, 22 nt, Mycobacterium bovis subsp bovis AF2122/97
guggccgucgggugcagcacgg

SEQ ID NO: 1159759 - RNA, 14 nt, Mycobacterium bovis subsp bovis AF2122/97
guggcggcgcgcgc

SEQ ID NO: 1159760 - RNA, 20 nt, Mycobacterium bovis subsp bovis AF2122/97
guggccugaaacggcugcag

SEQ ID NO: 1159761 - RNA, 12 nt, Mycobacterium bovis subsp bovis AF2122/97
guggcggcgcug

SEQ ID NO: 1159762 - RNA, 14 nt, Mycobacterium bovis subsp bovis AF2122/97
guggcgggccggau

SEQ ID NO: 1159763 - RNA, 16 nt, Mycobacterium bovis subsp bovis AF2122/97
guggcgggucagccuu

SEQ ID NO: 1159764 - RNA, 17 nt, Mycobacterium bovis subsp bovis AF2122/97
guggccucgauguccug

SEQ ID NO: 1159765 - RNA, 12 nt, Mycobacterium bovis subsp bovis AF2122/97
guggcggugcgg

SEQ ID NO: 1159766 - RNA, 16 nt, Mycobacterium bovis subsp bovis AF2122/97
gugggacgggcgcguc

SEQ ID NO: 1159767 - RNA, 13 nt, Mycobacterium bovis subsp bovis AF2122/97
gugggacaggucg

SEQ ID NO: 1159768 - RNA, 15 nt, Mycobacterium bovis subsp bovis AF2122/97
gugggacaggucggc

SEQ ID NO: 1159769 - RNA, 14 nt, Mycobacterium bovis subsp bovis AF2122/97
gugggacaccaucu

SEQ ID NO: 1159770 - RNA, 19 nt, Mycobacterium bovis subsp bovis AF2122/97
guggcguuugaugcgggcg

SEQ ID NO: 1159771 - RNA, 16 nt, Mycobacterium bovis subsp bovis AF2122/97
guggcuaccgcaggug

SEQ ID NO: 1159772 - RNA, 14 nt, Mycobacterium bovis subsp bovis AF2122/97
guggcacccgcagu

SEQ ID NO: 1159773 - RNA, 18 nt, Mycobacterium bovis subsp bovis AF2122/97
guggauccggcagcagcc

SEQ ID NO: 1159774 - RNA, 20 nt, Mycobacterium bovis subsp bovis AF2122/97
guggaguuuccgaagcccgg

SEQ ID NO: 1159775 - RNA, 16 nt, Mycobacterium bovis subsp bovis AF2122/97
guggcagcgcggccgg

SEQ ID NO: 1159776 - RNA, 17 nt, Mycobacterium bovis subsp bovis AF2122/97
guggcagcgcggccggg

SEQ ID NO: 1159777 - RNA, 15 nt, Mycobacterium bovis subsp bovis AF2122/97
guggcagagccgccg

SEQ ID NO: 1159778 - RNA, 16 nt, Mycobacterium bovis subsp bovis AF2122/97
guggcagagccgccgu

SEQ ID NO: 1159779 - RNA, 16 nt, Mycobacterium bovis subsp bovis AF2122/97
guggcagccagcggcg

SEQ ID NO: 1159780 - RNA, 15 nt, Mycobacterium bovis subsp bovis AF2122/97
guggacgaucuggca

SEQ ID NO: 1159781 - RNA, 20 nt, Mycobacterium bovis subsp bovis AF2122/97
guggacgaucuggcagccga

SEQ ID NO: 1159782 - RNA, 17 nt, Mycobacterium bovis subsp bovis AF2122/97
guggacucgggcgcuga

SEQ ID NO: 1159783 - RNA, 22 nt, Mycobacterium bovis subsp bovis AF2122/97
guggacucgggcgcugaugcgc

SEQ ID NO: 1159784 - RNA, 16 nt, Mycobacterium bovis subsp bovis AF2122/97
guggagcucgcggcgc

SEQ ID NO: 1159785 - RNA, 16 nt, Mycobacterium bovis subsp bovis AF2122/97
guggaccggcuccggu

SEQ ID NO: 1159786 - RNA, 19 nt, Mycobacterium bovis subsp bovis AF2122/97
guggagaucacgugccggc

SEQ ID NO: 1159787 - RNA, 13 nt, Mycobacterium bovis subsp bovis AF2122/97
gugcgcagggccu

SEQ ID NO: 1159788 - RNA, 14 nt, Mycobacterium bovis subsp bovis AF2122/97
gugcgcagggccug

SEQ ID NO: 1159789 - RNA, 21 nt, Mycobacterium bovis subsp bovis AF2122/97
gugcgcauccgucguacacgc

SEQ ID NO: 1159790 - RNA, 15 nt, Mycobacterium bovis subsp bovis AF2122/97
gugcgcaaucgacac

SEQ ID NO: 1159791 - RNA, 23 nt, Mycobacterium bovis subsp bovis AF2122/97
gugcgcacugaggcucaggugcu

SEQ ID NO: 1159792 - RNA, 15 nt, Mycobacterium bovis subsp bovis AF2122/97
gugcgcaccagagug

SEQ ID NO: 1159793 - RNA, 20 nt, Mycobacterium bovis subsp bovis AF2122/97
gugcgcagaacaccaccgcc

SEQ ID NO: 1159794 - RNA, 22 nt, Mycobacterium bovis subsp bovis AF2122/97
gugcgcagacaucggagaucau

SEQ ID NO: 1159795 - RNA, 22 nt, Mycobacterium bovis subsp bovis AF2122/97
gugccuggccggugcgcaggua

SEQ ID NO: 1159796 - RNA, 20 nt, Mycobacterium bovis subsp bovis AF2122/97
gugcgauucugcgucugcuc

SEQ ID NO: 1159797 - RNA, 21 nt, Mycobacterium bovis subsp bovis AF2122/97
gugcgauuuugugucugcucg

SEQ ID NO: 1159798 - RNA, 21 nt, Mycobacterium bovis subsp bovis AF2122/97
gugcgaucgaauaacggccug

SEQ ID NO: 1159799 - RNA, 17 nt, Mycobacterium bovis subsp bovis AF2122/97
gugcgcaacccagccgc

SEQ ID NO: 1159800 - RNA, 16 nt, Mycobacterium bovis subsp bovis AF2122/97
guggaagguguuggug

SEQ ID NO: 1159801 - RNA, 19 nt, Mycobacterium bovis subsp bovis AF2122/97
guggaagguguuggugcgg

SEQ ID NO: 1159802 - RNA, 19 nt, Mycobacterium bovis subsp bovis AF2122/97
guggaagcccgucgcggcc

SEQ ID NO: 1159803 - RNA, 22 nt, Mycobacterium bovis subsp bovis AF2122/97
guggaagccgacgaccagcaga

SEQ ID NO: 1159804 - RNA, 20 nt, Mycobacterium bovis subsp bovis AF2122/97
guguccccggcugccagcgc

SEQ ID NO: 1159805 - RNA, 16 nt, Mycobacterium bovis subsp bovis AF2122/97
gugucccauggugagc

SEQ ID NO: 1159806 - RNA, 15 nt, Mycobacterium bovis subsp bovis AF2122/97
gugucgaagagcagg

SEQ ID NO: 1159807 - RNA, 20 nt, Mycobacterium bovis subsp bovis AF2122/97
gugucgacaaccgcugccgc

SEQ ID NO: 1159808 - RNA, 23 nt, Mycobacterium bovis subsp bovis AF2122/97
gugucgaccuucucgaugcugac

SEQ ID NO: 1159809 - RNA, 21 nt, Mycobacterium bovis subsp bovis AF2122/97
guguccgccggauagcaccgg

SEQ ID NO: 1159810 - RNA, 18 nt, Mycobacterium bovis subsp bovis AF2122/97
guguccucgucgagguca

SEQ ID NO: 1159811 - RNA, 21 nt, Mycobacterium bovis subsp bovis AF2122/97
gugucgcccuguucggcccga

SEQ ID NO: 1159812 - RNA, 20 nt, Mycobacterium bovis subsp bovis AF2122/97
gugucggaaugggcgccaca

SEQ ID NO: 1159813 - RNA, 16 nt, Mycobacterium bovis subsp bovis AF2122/97
gugucgggugugcagg

SEQ ID NO: 1159814 - RNA, 17 nt, Mycobacterium bovis subsp bovis AF2122/97
gugucguaacugcccgc

SEQ ID NO: 1159815 - RNA, 22 nt, Mycobacterium bovis subsp bovis AF2122/97
gugucguaggcgaugagcgugc

SEQ ID NO: 1159816 - RNA, 15 nt, Mycobacterium bovis subsp bovis AF2122/97
gugucgaucagcucc

SEQ ID NO: 1159817 - RNA, 17 nt, Mycobacterium bovis subsp bovis AF2122/97
gugucgacggucauccc

SEQ ID NO: 1159818 - RNA, 23 nt, Mycobacterium bovis subsp bovis AF2122/97
guguggcuugacgcccgggcacc

SEQ ID NO: 1159819 - RNA, 12 nt, Mycobacterium bovis subsp bovis AF2122/97
guguggcagccc

SEQ ID NO: 1159820 - RNA, 13 nt, Mycobacterium bovis subsp bovis AF2122/97
guguggcagcccc

SEQ ID NO: 1159821 - RNA, 14 nt, Mycobacterium bovis subsp bovis AF2122/97
guguggcagcccca

SEQ ID NO: 1159822 - RNA, 22 nt, Mycobacterium bovis subsp bovis AF2122/97
guguggagcucgcggcgcaggu

SEQ ID NO: 1159823 - RNA, 22 nt, Mycobacterium bovis subsp bovis AF2122/97
gugugcuucgagcaccgacacc

SEQ ID NO: 1159824 - RNA, 17 nt, Mycobacterium bovis subsp bovis AF2122/97
guguggaacauccgcac

SEQ ID NO: 1159825 - RNA, 20 nt, Mycobacterium bovis subsp bovis AF2122/97
guguggaauacgcugcuggu

SEQ ID NO: 1159826 - RNA, 17 nt, Mycobacterium bovis subsp bovis AF2122/97
gugucgucgaggucagu

SEQ ID NO: 1159827 - RNA, 15 nt, Mycobacterium bovis subsp bovis AF2122/97
gugucgugggcaccu

SEQ ID NO: 1159828 - RNA, 18 nt, Mycobacterium bovis subsp bovis AF2122/97
gugucguggucgugggug

SEQ ID NO: 1159829 - RNA, 10 nt, Mycobacterium bovis subsp bovis AF2122/97
gugugcugca

SEQ ID NO: 1159830 - RNA, 16 nt, Mycobacterium bovis subsp bovis AF2122/97
gugugcugccaccggc

SEQ ID NO: 1159831 - RNA, 15 nt, Mycobacterium bovis subsp bovis AF2122/97
gugugcugccgcaca

SEQ ID NO: 1159832 - RNA, 17 nt, Mycobacterium bovis subsp bovis AF2122/97
guggucuuggcgguggc

SEQ ID NO: 1159833 - RNA, 20 nt, Mycobacterium bovis subsp bovis AF2122/97
guguagacaggaccgguggg

SEQ ID NO: 1159834 - RNA, 20 nt, Mycobacterium bovis subsp bovis AF2122/97
guguaggccucggcagcaaa

SEQ ID NO: 1159835 - RNA, 20 nt, Mycobacterium bovis subsp bovis AF2122/97
guguaguggaagaccucgac

SEQ ID NO: 1159836 - RNA, 21 nt, Mycobacterium bovis subsp bovis AF2122/97
gugucacccaauggagccgcg

SEQ ID NO: 1159837 - RNA, 14 nt, Mycobacterium bovis subsp bovis AF2122/97
gugucaaugacacc

SEQ ID NO: 1159838 - RNA, 14 nt, Mycobacterium bovis subsp bovis AF2122/97
gugucaacgcgcgg

SEQ ID NO: 1159839 - RNA, 12 nt, Mycobacterium bovis subsp bovis AF2122/97
guguccagcaug

SEQ ID NO: 1159840 - RNA, 22 nt, Mycobacterium bovis subsp bovis AF2122/97
guguucgacgagguugccgcac

SEQ ID NO: 1159841 - RNA, 17 nt, Mycobacterium bovis subsp bovis AF2122/97
guguuccggucgcccga

SEQ ID NO: 1159842 - RNA, 15 nt, Mycobacterium bovis subsp bovis AF2122/97
guguucggagcuggg

SEQ ID NO: 1159843 - RNA, 15 nt, Mycobacterium bovis subsp bovis AF2122/97
guguucggcccgcac

SEQ ID NO: 1159844 - RNA, 15 nt, Mycobacterium bovis subsp bovis AF2122/97
guguuaggcccgcac

SEQ ID NO: 1159845 - RNA, 23 nt, Mycobacterium bovis subsp bovis AF2122/97
guuaaucaaggugaucagcagga

SEQ ID NO: 1159846 - RNA, 22 nt, Mycobacterium bovis subsp bovis AF2122/97
guuacccaucgccacacccaaa

SEQ ID NO: 1159847 - RNA, 13 nt, Mycobacterium bovis subsp bovis AF2122/97
guuacccgcagcg

SEQ ID NO: 1159848 - RNA, 21 nt, Mycobacterium bovis subsp bovis AF2122/97
guuagguggcuggcugugccg

SEQ ID NO: 1159849 - RNA, 19 nt, Mycobacterium bovis subsp bovis AF2122/97
guuaggaguggccgggcgg

SEQ ID NO: 1159850 - RNA, 19 nt, Mycobacterium bovis subsp bovis AF2122/97
guuagcgcggccagcagca

SEQ ID NO: 1159851 - RNA, 18 nt, Mycobacterium bovis subsp bovis AF2122/97
guuagccgcggcccgcgu

SEQ ID NO: 1159852 - RNA, 19 nt, Mycobacterium bovis subsp bovis AF2122/97
guuagccggguuggccggg

SEQ ID NO: 1159853 - RNA, 21 nt, Mycobacterium bovis subsp bovis AF2122/97
guucacgcgcggaucggcggc

SEQ ID NO: 1159854 - RNA, 12 nt, Mycobacterium bovis subsp bovis AF2122/97
guucacgguuga

SEQ ID NO: 1159855 - RNA, 23 nt, Mycobacterium bovis subsp bovis AF2122/97
guucaucacgccgccggagguga

SEQ ID NO: 1159856 - RNA, 11 nt, Mycobacterium bovis subsp bovis AF2122/97
guucaugaucg

SEQ ID NO: 1159857 - RNA, 14 nt, Mycobacterium bovis subsp bovis AF2122/97
guucauccacuccg

SEQ ID NO: 1159858 - RNA, 14 nt, Mycobacterium bovis subsp bovis AF2122/97
guuccagcggcacc

SEQ ID NO: 1159859 - RNA, 16 nt, Mycobacterium bovis subsp bovis AF2122/97
guuccaucacggacca

SEQ ID NO: 1159860 - RNA, 18 nt, Mycobacterium bovis subsp bovis AF2122/97
guuccauacagccgccga

SEQ ID NO: 1159861 - RNA, 18 nt, Mycobacterium bovis subsp bovis AF2122/97
guucccaccaccaccgcc

SEQ ID NO: 1159862 - RNA, 15 nt, Mycobacterium bovis subsp bovis AF2122/97
guucccacccacgcc

SEQ ID NO: 1159863 - RNA, 20 nt, Mycobacterium bovis subsp bovis AF2122/97
guuccgcaaugaccuggccg

SEQ ID NO: 1159864 - RNA, 14 nt, Mycobacterium bovis subsp bovis AF2122/97
guuccgcgcggcag

SEQ ID NO: 1159865 - RNA, 16 nt, Mycobacterium bovis subsp bovis AF2122/97
guucuccccgcuagcc

SEQ ID NO: 1159866 - RNA, 22 nt, Mycobacterium bovis subsp bovis AF2122/97
guucucaccaccagagacgauc

SEQ ID NO: 1159867 - RNA, 14 nt, Mycobacterium bovis subsp bovis AF2122/97
guucucaucgccaa

SEQ ID NO: 1159868 - RNA, 15 nt, Mycobacterium bovis subsp bovis AF2122/97
guucgggguggugga

SEQ ID NO: 1159869 - RNA, 19 nt, Mycobacterium bovis subsp bovis AF2122/97
guucggcgucguugccggg

SEQ ID NO: 1159870 - RNA, 21 nt, Mycobacterium bovis subsp bovis AF2122/97
guucggcugccgcgcgcugcc

SEQ ID NO: 1159871 - RNA, 11 nt, Mycobacterium bovis subsp bovis AF2122/97
guucggcuggc

SEQ ID NO: 1159872 - RNA, 23 nt, Mycobacterium bovis subsp bovis AF2122/97
guucggccaccaaccucaucgcg

SEQ ID NO: 1159873 - RNA, 15 nt, Mycobacterium bovis subsp bovis AF2122/97
guucggcgcugccag

SEQ ID NO: 1159874 - RNA, 15 nt, Mycobacterium bovis subsp bovis AF2122/97
guucggcgcccgcuc

SEQ ID NO: 1159875 - RNA, 14 nt, Mycobacterium bovis subsp bovis AF2122/97
guucggccauggcg

SEQ ID NO: 1159876 - RNA, 14 nt, Mycobacterium bovis subsp bovis AF2122/97
guucgaaggccacc

SEQ ID NO: 1159877 - RNA, 23 nt, Mycobacterium bovis subsp bovis AF2122/97
guucgaaggccacccgcgaagcc

SEQ ID NO: 1159878 - RNA, 16 nt, Mycobacterium bovis subsp bovis AF2122/97
guucgacugaaucaug

SEQ ID NO: 1159879 - RNA, 12 nt, Mycobacterium bovis subsp bovis AF2122/97
guuccggcuggu

SEQ ID NO: 1159880 - RNA, 16 nt, Mycobacterium bovis subsp bovis AF2122/97
guuccgggcgcgugga

SEQ ID NO: 1159881 - RNA, 16 nt, Mycobacterium bovis subsp bovis AF2122/97
guuccggcggucaaga

SEQ ID NO: 1159882 - RNA, 21 nt, Mycobacterium bovis subsp bovis AF2122/97
guuccuugagacgccggggaa

SEQ ID NO: 1159883 - RNA, 18 nt, Mycobacterium bovis subsp bovis AF2122/97
guuucgugccaugguuga

SEQ ID NO: 1159884 - RNA, 16 nt, Mycobacterium bovis subsp bovis AF2122/97
guuucauuccugguua

SEQ ID NO: 1159885 - RNA, 16 nt, Mycobacterium bovis subsp bovis AF2122/97
guuguggcacccggcu

SEQ ID NO: 1159886 - RNA, 15 nt, Mycobacterium bovis subsp bovis AF2122/97
guuguggucgaguug

SEQ ID NO: 1159887 - RNA, 13 nt, Mycobacterium bovis subsp bovis AF2122/97
guugugcguccuc

SEQ ID NO: 1159888 - RNA, 14 nt, Mycobacterium bovis subsp bovis AF2122/97
guugugcucgguga

SEQ ID NO: 1159889 - RNA, 19 nt, Mycobacterium bovis subsp bovis AF2122/97
guuguucccauagccagcc

SEQ ID NO: 1159890 - RNA, 15 nt, Mycobacterium bovis subsp bovis AF2122/97
guugugucggccugg

SEQ ID NO: 1159891 - RNA, 14 nt, Mycobacterium bovis subsp bovis AF2122/97
guuuacggcccggc

SEQ ID NO: 1159892 - RNA, 21 nt, Mycobacterium bovis subsp bovis AF2122/97
guugucgacgaagguggcgaa

SEQ ID NO: 1159893 - RNA, 13 nt, Mycobacterium bovis subsp bovis AF2122/97
guugucguccaac

SEQ ID NO: 1159894 - RNA, 17 nt, Mycobacterium bovis subsp bovis AF2122/97
guugucguugcuggugu

SEQ ID NO: 1159895 - RNA, 23 nt, Mycobacterium bovis subsp bovis AF2122/97
guuguccaggaauuccccaccgu

SEQ ID NO: 1159896 - RNA, 20 nt, Mycobacterium bovis subsp bovis AF2122/97
guugucccuauaccgcuggg

SEQ ID NO: 1159897 - RNA, 22 nt, Mycobacterium bovis subsp bovis AF2122/97
guugucccuauaccgcuggggc

SEQ ID NO: 1159898 - RNA, 23 nt, Mycobacterium bovis subsp bovis AF2122/97
guuguccgcggccaacguacauc

SEQ ID NO: 1159899 - RNA, 15 nt, Mycobacterium bovis subsp bovis AF2122/97
guucuggaaccccga

SEQ ID NO: 1159900 - RNA, 17 nt, Mycobacterium bovis subsp bovis AF2122/97
guucugcgcccacccgc

SEQ ID NO: 1159901 - RNA, 19 nt, Mycobacterium bovis subsp bovis AF2122/97
guuuggugucgaucagcuc

SEQ ID NO: 1159902 - RNA, 15 nt, Mycobacterium bovis subsp bovis AF2122/97
guuuggguuuuguuu

SEQ ID NO: 1159903 - RNA, 16 nt, Mycobacterium bovis subsp bovis AF2122/97
guuugggauccuggcc

SEQ ID NO: 1159904 - RNA, 11 nt, Mycobacterium bovis subsp bovis AF2122/97
guuuggccagu

SEQ ID NO: 1159905 - RNA, 17 nt, Mycobacterium bovis subsp bovis AF2122/97
guuuggccaguucggug

SEQ ID NO: 1159906 - RNA, 22 nt, Mycobacterium bovis subsp bovis AF2122/97
guuuggaccgcugaugaccgua

SEQ ID NO: 1159907 - RNA, 15 nt, Mycobacterium bovis subsp bovis AF2122/97
guuuguuccgugcgg

SEQ ID NO: 1159908 - RNA, 12 nt, Mycobacterium bovis subsp bovis AF2122/97
guuuguuuuguc

SEQ ID NO: 1159909 - RNA, 16 nt, Mycobacterium bovis subsp bovis AF2122/97
guuugucgcgguggug

SEQ ID NO: 1159910 - RNA, 19 nt, Mycobacterium bovis subsp bovis AF2122/97
guuugucgugucaugcuca

SEQ ID NO: 1159911 - RNA, 14 nt, Mycobacterium bovis subsp bovis AF2122/97
guuugcgaugccca

SEQ ID NO: 1159912 - RNA, 22 nt, Mycobacterium bovis subsp bovis AF2122/97
guuugccgauggaugggcugcg

SEQ ID NO: 1159913 - RNA, 13 nt, Mycobacterium bovis subsp bovis AF2122/97
guuugccggugcg

SEQ ID NO: 1159914 - RNA, 19 nt, Mycobacterium bovis subsp bovis AF2122/97
guuugcccggucuauuugc

SEQ ID NO: 1159915 - RNA, 15 nt, Mycobacterium bovis subsp bovis AF2122/97
guuugcgaagcccac

SEQ ID NO: 1159916 - RNA, 15 nt, Mycobacterium bovis subsp bovis AF2122/97
guuuucgaucuggcu

SEQ ID NO: 1159917 - RNA, 16 nt, Mycobacterium bovis subsp bovis AF2122/97
guuuucggccgccagu

SEQ ID NO: 1159918 - RNA, 20 nt, Mycobacterium bovis subsp bovis AF2122/97
guuuucagagccgggcuggc

SEQ ID NO: 1159919 - RNA, 14 nt, Mycobacterium bovis subsp bovis AF2122/97
guuuuggaagcccg

SEQ ID NO: 1159920 - RNA, 14 nt, Mycobacterium bovis subsp bovis AF2122/97
guuuugcugcaugc

SEQ ID NO: 1159921 - RNA, 14 nt, Mycobacterium bovis subsp bovis AF2122/97
uaaaaaccaccccc

SEQ ID NO: 1159922 - RNA, 15 nt, Mycobacterium bovis subsp bovis AF2122/97
uaaaaaccaccccca

SEQ ID NO: 1159923 - RNA, 17 nt, Mycobacterium bovis subsp bovis AF2122/97
uaaccggcaugccgcca

SEQ ID NO: 1159924 - RNA, 15 nt, Mycobacterium bovis subsp bovis AF2122/97
uaaccggccaugucu

SEQ ID NO: 1159925 - RNA, 12 nt, Mycobacterium bovis subsp bovis AF2122/97
uaaccggcccga

SEQ ID NO: 1159926 - RNA, 22 nt, Mycobacterium bovis subsp bovis AF2122/97
uaaccgcgaccagcuggccgua

SEQ ID NO: 1159927 - RNA, 17 nt, Mycobacterium bovis subsp bovis AF2122/97
uaaccgucgccugccga

SEQ ID NO: 1159928 - RNA, 23 nt, Mycobacterium bovis subsp bovis AF2122/97
uaacgcacccaccgaaccgaggg

SEQ ID NO: 1159929 - RNA, 14 nt, Mycobacterium bovis subsp bovis AF2122/97
uaacgagccgucca

SEQ ID NO: 1159930 - RNA, 22 nt, Mycobacterium bovis subsp bovis AF2122/97
uaacacccgagcaacggcggca

SEQ ID NO: 1159931 - RNA, 20 nt, Mycobacterium bovis subsp bovis AF2122/97
uaacccggcuccagcaccgu

SEQ ID NO: 1159932 - RNA, 11 nt, Mycobacterium bovis subsp bovis AF2122/97
uaaagaagccu

SEQ ID NO: 1159933 - RNA, 20 nt, Mycobacterium bovis subsp bovis AF2122/97
uaaaccuggcuaucgcagaa

SEQ ID NO: 1159934 - RNA, 19 nt, Mycobacterium bovis subsp bovis AF2122/97
uaaauaucggggccacuga

SEQ ID NO: 1159935 - RNA, 21 nt, Mycobacterium bovis subsp bovis AF2122/97
uauucgaagggguacccgccc

SEQ ID NO: 1159936 - RNA, 12 nt, Mycobacterium bovis subsp bovis AF2122/97
uauucggcggca

SEQ ID NO: 1159937 - RNA, 20 nt, Mycobacterium bovis subsp bovis AF2122/97
uauugagucggcugguccuc

SEQ ID NO: 1159938 - RNA, 18 nt, Mycobacterium bovis subsp bovis AF2122/97
uauugcgcccggccauga

SEQ ID NO: 1159939 - RNA, 14 nt, Mycobacterium bovis subsp bovis AF2122/97
uauugccaaagccc

SEQ ID NO: 1159940 - RNA, 14 nt, Mycobacterium bovis subsp bovis AF2122/97
ucaacuugggcccg

SEQ ID NO: 1159941 - RNA, 20 nt, Mycobacterium bovis subsp bovis AF2122/97
ucaagaucggugccagcacu

SEQ ID NO: 1159942 - RNA, 19 nt, Mycobacterium bovis subsp bovis AF2122/97
ucaagagugcucagcgcgc

SEQ ID NO: 1159943 - RNA, 15 nt, Mycobacterium bovis subsp bovis AF2122/97
ucaagccgugcugcc

SEQ ID NO: 1159944 - RNA, 13 nt, Mycobacterium bovis subsp bovis AF2122/97
ucaagcacagccc

SEQ ID NO: 1159945 - RNA, 14 nt, Mycobacterium bovis subsp bovis AF2122/97
ucaagcacagcccg

SEQ ID NO: 1159946 - RNA, 15 nt, Mycobacterium bovis subsp bovis AF2122/97
ucaacgacaccagau

SEQ ID NO: 1159947 - RNA, 18 nt, Mycobacterium bovis subsp bovis AF2122/97
ucaacgcguugcacagca

SEQ ID NO: 1159948 - RNA, 19 nt, Mycobacterium bovis subsp bovis AF2122/97
ucaacgcguugcacagcag

SEQ ID NO: 1159949 - RNA, 21 nt, Mycobacterium bovis subsp bovis AF2122/97
ucaacgccgcggucaggaugg

SEQ ID NO: 1159950 - RNA, 21 nt, Mycobacterium bovis subsp bovis AF2122/97
ucaacggaagaagcaguagcu

SEQ ID NO: 1159951 - RNA, 20 nt, Mycobacterium bovis subsp bovis AF2122/97
ucaacggcggcaacggcggc

SEQ ID NO: 1159952 - RNA, 13 nt, Mycobacterium bovis subsp bovis AF2122/97
ucaacgugaacug

SEQ ID NO: 1159953 - RNA, 13 nt, Mycobacterium bovis subsp bovis AF2122/97
ucaacuccacgcg

SEQ ID NO: 1159954 - RNA, 14 nt, Mycobacterium bovis subsp bovis AF2122/97
ucaacagggccagg

SEQ ID NO: 1159955 - RNA, 18 nt, Mycobacterium bovis subsp bovis AF2122/97
ucaacaguacccaggcgu

SEQ ID NO: 1159956 - RNA, 19 nt, Mycobacterium bovis subsp bovis AF2122/97
ucaacagcggcaagaaguu

SEQ ID NO: 1159957 - RNA, 22 nt, Mycobacterium bovis subsp bovis AF2122/97
ucaacaccagcaagugugagca

SEQ ID NO: 1159958 - RNA, 20 nt, Mycobacterium bovis subsp bovis AF2122/97
ucaacaccgccgaccuaguc

SEQ ID NO: 1159959 - RNA, 16 nt, Mycobacterium bovis subsp bovis AF2122/97
ucaacccgguccagcc

SEQ ID NO: 1159960 - RNA, 14 nt, Mycobacterium bovis subsp bovis AF2122/97
ucaaccagggugcc

SEQ ID NO: 1159961 - RNA, 13 nt, Mycobacterium bovis subsp bovis AF2122/97
ucaacauuucuga

SEQ ID NO: 1159962 - RNA, 13 nt, Mycobacterium bovis subsp bovis AF2122/97
ucaacaucggccc

SEQ ID NO: 1159963 - RNA, 17 nt, Mycobacterium bovis subsp bovis AF2122/97
ucaacauugugcucgcc

SEQ ID NO: 1159964 - RNA, 22 nt, Mycobacterium bovis subsp bovis AF2122/97
ucaacaacagccgcagccaggu

SEQ ID NO: 1159965 - RNA, 22 nt, Mycobacterium bovis subsp bovis AF2122/97
ucaacaagacgaugcuggcggc

SEQ ID NO: 1159966 - RNA, 20 nt, Mycobacterium bovis subsp bovis AF2122/97
ucaaauccuuugcugcccag

SEQ ID NO: 1159967 - RNA, 22 nt, Mycobacterium bovis subsp bovis AF2122/97
ucaaacccagcgacgcggccag

SEQ ID NO: 1159968 - RNA, 20 nt, Mycobacterium bovis subsp bovis AF2122/97
ucaaacccgaaaacccaaca

SEQ ID NO: 1159969 - RNA, 19 nt, Mycobacterium bovis subsp bovis AF2122/97
ucaaacuaccgaacagugg

SEQ ID NO: 1159970 - RNA, 23 nt, Mycobacterium bovis subsp bovis AF2122/97
ucaaaccuauccguucaauuucg

SEQ ID NO: 1159971 - RNA, 23 nt, Mycobacterium bovis subsp bovis AF2122/97
ucaaagcggugccauuguaaaau

SEQ ID NO: 1159972 - RNA, 19 nt, Mycobacterium bovis subsp bovis AF2122/97
ucaaagacccgacgccacg

SEQ ID NO: 1159973 - RNA, 19 nt, Mycobacterium bovis subsp bovis AF2122/97
ucaaaaaccacgcgucgcu

SEQ ID NO: 1159974 - RNA, 17 nt, Mycobacterium bovis subsp bovis AF2122/97
ucaagucccuucaucau

SEQ ID NO: 1159975 - RNA, 17 nt, Mycobacterium bovis subsp bovis AF2122/97
ucaaguucgccagcaac

SEQ ID NO: 1159976 - RNA, 15 nt, Mycobacterium bovis subsp bovis AF2122/97
ucaaggugcgccgcc

SEQ ID NO: 1159977 - RNA, 13 nt, Mycobacterium bovis subsp bovis AF2122/97
ucacaaacccagc

SEQ ID NO: 1159978 - RNA, 17 nt, Mycobacterium bovis subsp bovis AF2122/97
ucacaaacccagcaucg

SEQ ID NO: 1159979 - RNA, 21 nt, Mycobacterium bovis subsp bovis AF2122/97
ucaaucgucaagaacgccacg

SEQ ID NO: 1159980 - RNA, 16 nt, Mycobacterium bovis subsp bovis AF2122/97
ucaaucgcgucaucaa

SEQ ID NO: 1159981 - RNA, 17 nt, Mycobacterium bovis subsp bovis AF2122/97
ucacagcuugagcacac

SEQ ID NO: 1159982 - RNA, 18 nt, Mycobacterium bovis subsp bovis AF2122/97
ucacaggccgccuggggg

SEQ ID NO: 1159983 - RNA, 19 nt, Mycobacterium bovis subsp bovis AF2122/97
ucacaggccgccugggggu

SEQ ID NO: 1159984 - RNA, 14 nt, Mycobacterium bovis subsp bovis AF2122/97
ucacagccaccagc

SEQ ID NO: 1159985 - RNA, 15 nt, Mycobacterium bovis subsp bovis AF2122/97
ucacagccaccagcc

SEQ ID NO: 1159986 - RNA, 12 nt, Mycobacterium bovis subsp bovis AF2122/97
ucacacuggcuu

SEQ ID NO: 1159987 - RNA, 14 nt, Mycobacterium bovis subsp bovis AF2122/97
ucacacgccagccg

SEQ ID NO: 1159988 - RNA, 15 nt, Mycobacterium bovis subsp bovis AF2122/97
ucacaccccaggcac

SEQ ID NO: 1159989 - RNA, 15 nt, Mycobacterium bovis subsp bovis AF2122/97
ucacacccacaccca

SEQ ID NO: 1159990 - RNA, 22 nt, Mycobacterium bovis subsp bovis AF2122/97
ucacacccacacccagcgugcc

SEQ ID NO: 1159991 - RNA, 11 nt, Mycobacterium bovis subsp bovis AF2122/97
ucacaccagcg

SEQ ID NO: 1159992 - RNA, 13 nt, Mycobacterium bovis subsp bovis AF2122/97
ucacaagccugcc

SEQ ID NO: 1159993 - RNA, 19 nt, Mycobacterium bovis subsp bovis AF2122/97
ucacauccgacagcagccg

SEQ ID NO: 1159994 - RNA, 21 nt, Mycobacterium bovis subsp bovis AF2122/97
ucacaucggccucugaccagc

SEQ ID NO: 1159995 - RNA, 20 nt, Mycobacterium bovis subsp bovis AF2122/97
ucaccaacccguguggcacg

SEQ ID NO: 1159996 - RNA, 22 nt, Mycobacterium bovis subsp bovis AF2122/97
ucaccaaucugcgggccgguga

SEQ ID NO: 1159997 - RNA, 16 nt, Mycobacterium bovis subsp bovis AF2122/97
ucaccacaugggagcc

SEQ ID NO: 1159998 - RNA, 21 nt, Mycobacterium bovis subsp bovis AF2122/97
ucacccguguucgccacaccc

SEQ ID NO: 1159999 - RNA, 22 nt, Mycobacterium bovis subsp bovis AF2122/97
ucacccguagguaguuguccag

SEQ ID NO: 1160000 - RNA, 13 nt, Mycobacterium bovis subsp bovis AF2122/97
ucacccucccgca

SEQ ID NO: 1160001 - RNA, 16 nt, Mycobacterium bovis subsp bovis AF2122/97
ucacccugccagagau

SEQ ID NO: 1160002 - RNA, 21 nt, Mycobacterium bovis subsp bovis AF2122/97
ucaccgccagcugggcagcca

SEQ ID NO: 1160003 - RNA, 19 nt, Mycobacterium bovis subsp bovis AF2122/97
ucaccgccaccaccagggc

SEQ ID NO: 1160004 - RNA, 21 nt, Mycobacterium bovis subsp bovis AF2122/97
ucaccgcacaccugcgcggcg

SEQ ID NO: 1160005 - RNA, 22 nt, Mycobacterium bovis subsp bovis AF2122/97
ucaccgcacaccugcgcggcgu

SEQ ID NO: 1160006 - RNA, 18 nt, Mycobacterium bovis subsp bovis AF2122/97
ucaccgaucccgcggccg

SEQ ID NO: 1160007 - RNA, 22 nt, Mycobacterium bovis subsp bovis AF2122/97
ucaccgaucucgaccagcgccg

SEQ ID NO: 1160008 - RNA, 14 nt, Mycobacterium bovis subsp bovis AF2122/97
ucaccggcuggugc

SEQ ID NO: 1160009 - RNA, 17 nt, Mycobacterium bovis subsp bovis AF2122/97
ucaccguaauuucuuca

SEQ ID NO: 1160010 - RNA, 23 nt, Mycobacterium bovis subsp bovis AF2122/97
ucaccggguuggaagccgcaccg

SEQ ID NO: 1160011 - RNA, 14 nt, Mycobacterium bovis subsp bovis AF2122/97
ucaccgguucggug

SEQ ID NO: 1160012 - RNA, 23 nt, Mycobacterium bovis subsp bovis AF2122/97
ucaccguguugcacgcgggugcc

SEQ ID NO: 1160013 - RNA, 17 nt, Mycobacterium bovis subsp bovis AF2122/97
ucaccguuggccgcgcu

SEQ ID NO: 1160014 - RNA, 15 nt, Mycobacterium bovis subsp bovis AF2122/97
ucaccgccgcgaccg

SEQ ID NO: 1160015 - RNA, 18 nt, Mycobacterium bovis subsp bovis AF2122/97
ucaccgccgcgaccgccu

SEQ ID NO: 1160016 - RNA, 17 nt, Mycobacterium bovis subsp bovis AF2122/97
ucaccgccguugccgcc

SEQ ID NO: 1160017 - RNA, 14 nt, Mycobacterium bovis subsp bovis AF2122/97
ucaccgcccuugcc

SEQ ID NO: 1160018 - RNA, 22 nt, Mycobacterium bovis subsp bovis AF2122/97
ucaccgcgccagccuccaccag

SEQ ID NO: 1160019 - RNA, 17 nt, Mycobacterium bovis subsp bovis AF2122/97
ucaccgccuuugccgcc

SEQ ID NO: 1160020 - RNA, 19 nt, Mycobacterium bovis subsp bovis AF2122/97
ucaccgcgaaacccaugac

SEQ ID NO: 1160021 - RNA, 18 nt, Mycobacterium bovis subsp bovis AF2122/97
ucaccgcguagaccccaa

SEQ ID NO: 1160022 - RNA, 17 nt, Mycobacterium bovis subsp bovis AF2122/97
ucaccaucucgcaaggg

SEQ ID NO: 1160023 - RNA, 14 nt, Mycobacterium bovis subsp bovis AF2122/97
ucaccauccagccc

SEQ ID NO: 1160024 - RNA, 19 nt, Mycobacterium bovis subsp bovis AF2122/97
ucaccauccagcccauccc

SEQ ID NO: 1160025 - RNA, 22 nt, Mycobacterium bovis subsp bovis AF2122/97
ucacccagcucgcgcacccagc

SEQ ID NO: 1160026 - RNA, 19 nt, Mycobacterium bovis subsp bovis AF2122/97
ucacccagcucgcgcaccc

SEQ ID NO: 1160027 - RNA, 16 nt, Mycobacterium bovis subsp bovis AF2122/97
ucacccacccgcaccg

SEQ ID NO: 1160028 - RNA, 12 nt, Mycobacterium bovis subsp bovis AF2122/97
ucaccagcaccc

SEQ ID NO: 1160029 - RNA, 17 nt, Mycobacterium bovis subsp bovis AF2122/97
ucaccagcaacagcccg

SEQ ID NO: 1160030 - RNA, 12 nt, Mycobacterium bovis subsp bovis AF2122/97
ucaccagcggcu

SEQ ID NO: 1160031 - RNA, 21 nt, Mycobacterium bovis subsp bovis AF2122/97
ucaccacgccggucgagguga

SEQ ID NO: 1160032 - RNA, 19 nt, Mycobacterium bovis subsp bovis AF2122/97
ucaccacccgaccgccauc

SEQ ID NO: 1160033 - RNA, 21 nt, Mycobacterium bovis subsp bovis AF2122/97
ucaccaccgccgccaccaccg

SEQ ID NO: 1160034 - RNA, 16 nt, Mycobacterium bovis subsp bovis AF2122/97
ucaccacggcguugcc

SEQ ID NO: 1160035 - RNA, 19 nt, Mycobacterium bovis subsp bovis AF2122/97
ucaccacggcguugccgcc

SEQ ID NO: 1160036 - RNA, 23 nt, Mycobacterium bovis subsp bovis AF2122/97
ucacgcguacgucgguccaccca

SEQ ID NO: 1160037 - RNA, 19 nt, Mycobacterium bovis subsp bovis AF2122/97
ucacgcguuccauggcccg

SEQ ID NO: 1160038 - RNA, 13 nt, Mycobacterium bovis subsp bovis AF2122/97
ucacgcgcggauc

SEQ ID NO: 1160039 - RNA, 21 nt, Mycobacterium bovis subsp bovis AF2122/97
ucacgcgcggaucggcggccg

SEQ ID NO: 1160040 - RNA, 19 nt, Mycobacterium bovis subsp bovis AF2122/97
ucacgcugaagccgcugga

SEQ ID NO: 1160041 - RNA, 19 nt, Mycobacterium bovis subsp bovis AF2122/97
ucacggcggccccggcauu

SEQ ID NO: 1160042 - RNA, 18 nt, Mycobacterium bovis subsp bovis AF2122/97
ucacgggcuccaacaggu

SEQ ID NO: 1160043 - RNA, 13 nt, Mycobacterium bovis subsp bovis AF2122/97
ucacgccugccac

SEQ ID NO: 1160044 - RNA, 12 nt, Mycobacterium bovis subsp bovis AF2122/97
ucacgcacugau

SEQ ID NO: 1160045 - RNA, 13 nt, Mycobacterium bovis subsp bovis AF2122/97
ucacgcacccggc

SEQ ID NO: 1160046 - RNA, 12 nt, Mycobacterium bovis subsp bovis AF2122/97
ucacgcaccaca

SEQ ID NO: 1160047 - RNA, 21 nt, Mycobacterium bovis subsp bovis AF2122/97
ucacgcagcacccugcgggcc

SEQ ID NO: 1160048 - RNA, 20 nt, Mycobacterium bovis subsp bovis AF2122/97
ucaccucggugccggccgca

SEQ ID NO: 1160049 - RNA, 15 nt, Mycobacterium bovis subsp bovis AF2122/97
ucaccucgccggcgg

SEQ ID NO: 1160050 - RNA, 22 nt, Mycobacterium bovis subsp bovis AF2122/97
ucaccucggugccggccgcaca

SEQ ID NO: 1160051 - RNA, 14 nt, Mycobacterium bovis subsp bovis AF2122/97
ucaccucuuggugc

SEQ ID NO: 1160052 - RNA, 21 nt, Mycobacterium bovis subsp bovis AF2122/97
ucaccugacacgcccgcgagc

SEQ ID NO: 1160053 - RNA, 19 nt, Mycobacterium bovis subsp bovis AF2122/97
ucaccuuccucgaaaucgu

SEQ ID NO: 1160054 - RNA, 17 nt, Mycobacterium bovis subsp bovis AF2122/97
ucaccuucggccgaccg

SEQ ID NO: 1160055 - RNA, 21 nt, Mycobacterium bovis subsp bovis AF2122/97
ucaccugcaucgucgccaagc

SEQ ID NO: 1160056 - RNA, 21 nt, Mycobacterium bovis subsp bovis AF2122/97
ucaccuggcgugucgccgcca

SEQ ID NO: 1160057 - RNA, 18 nt, Mycobacterium bovis subsp bovis AF2122/97
ucaccugggccagcagcc

SEQ ID NO: 1160058 - RNA, 20 nt, Mycobacterium bovis subsp bovis AF2122/97
ucaccuugccuagccgcagc

SEQ ID NO: 1160059 - RNA, 22 nt, Mycobacterium bovis subsp bovis AF2122/97
ucacgaccugcucauccaccuc

SEQ ID NO: 1160060 - RNA, 21 nt, Mycobacterium bovis subsp bovis AF2122/97
ucacgacgccgagcagauacu

SEQ ID NO: 1160061 - RNA, 13 nt, Mycobacterium bovis subsp bovis AF2122/97
ucacugcagcgcc

SEQ ID NO: 1160062 - RNA, 18 nt, Mycobacterium bovis subsp bovis AF2122/97
ucacugugccgcugcauc

SEQ ID NO: 1160063 - RNA, 20 nt, Mycobacterium bovis subsp bovis AF2122/97
ucacugguccaacgaucagu

SEQ ID NO: 1160064 - RNA, 15 nt, Mycobacterium bovis subsp bovis AF2122/97
ucacuggugacccug

SEQ ID NO: 1160065 - RNA, 16 nt, Mycobacterium bovis subsp bovis AF2122/97
ucacuucacgccgccc

SEQ ID NO: 1160066 - RNA, 23 nt, Mycobacterium bovis subsp bovis AF2122/97
ucacuucgcguuucacgaaaccc

SEQ ID NO: 1160067 - RNA, 19 nt, Mycobacterium bovis subsp bovis AF2122/97
ucacucggauagccccgug

SEQ ID NO: 1160068 - RNA, 14 nt, Mycobacterium bovis subsp bovis AF2122/97
ucacucaccccaac

SEQ ID NO: 1160069 - RNA, 17 nt, Mycobacterium bovis subsp bovis AF2122/97
ucacucccccacacacc

SEQ ID NO: 1160070 - RNA, 14 nt, Mycobacterium bovis subsp bovis AF2122/97
ucacuacuccgguc

SEQ ID NO: 1160071 - RNA, 21 nt, Mycobacterium bovis subsp bovis AF2122/97
ucacgugguccaagacagccu

SEQ ID NO: 1160072 - RNA, 17 nt, Mycobacterium bovis subsp bovis AF2122/97
ucacguagcgagcccac

SEQ ID NO: 1160073 - RNA, 22 nt, Mycobacterium bovis subsp bovis AF2122/97
ucacguagcgaccgcggucgcu

SEQ ID NO: 1160074 - RNA, 18 nt, Mycobacterium bovis subsp bovis AF2122/97
ucagaacaccggccaggc

SEQ ID NO: 1160075 - RNA, 14 nt, Mycobacterium bovis subsp bovis AF2122/97
ucagaacgcggccu

SEQ ID NO: 1160076 - RNA, 21 nt, Mycobacterium bovis subsp bovis AF2122/97
ucagaacggcggcagcggcgu

SEQ ID NO: 1160077 - RNA, 15 nt, Mycobacterium bovis subsp bovis AF2122/97
ucagaaucaggcucg

SEQ ID NO: 1160078 - RNA, 18 nt, Mycobacterium bovis subsp bovis AF2122/97
ucagacgauucggcggcc

SEQ ID NO: 1160079 - RNA, 23 nt, Mycobacterium bovis subsp bovis AF2122/97
ucagacgccggcccaguucugca

SEQ ID NO: 1160080 - RNA, 11 nt, Mycobacterium bovis subsp bovis AF2122/97
ucagacaacaa

SEQ ID NO: 1160081 - RNA, 19 nt, Mycobacterium bovis subsp bovis AF2122/97
ucagacccagcgcggcaac

SEQ ID NO: 1160082 - RNA, 12 nt, Mycobacterium bovis subsp bovis AF2122/97
ucagauccggcc

SEQ ID NO: 1160083 - RNA, 13 nt, Mycobacterium bovis subsp bovis AF2122/97
ucagagggccgcg

SEQ ID NO: 1160084 - RNA, 22 nt, Mycobacterium bovis subsp bovis AF2122/97
ucagagcgcugguuggccugcc

SEQ ID NO: 1160085 - RNA, 12 nt, Mycobacterium bovis subsp bovis AF2122/97
ucagcagcgccg

SEQ ID NO: 1160086 - RNA, 12 nt, Mycobacterium bovis subsp bovis AF2122/97
ucagcagcuguu

SEQ ID NO: 1160087 - RNA, 22 nt, Mycobacterium bovis subsp bovis AF2122/97
ucagcaggagaucaacauccug

SEQ ID NO: 1160088 - RNA, 21 nt, Mycobacterium bovis subsp bovis AF2122/97
ucagcacggugaucagcagca

SEQ ID NO: 1160089 - RNA, 23 nt, Mycobacterium bovis subsp bovis AF2122/97
ucagcacguaacgccgcucaucc

SEQ ID NO: 1160090 - RNA, 20 nt, Mycobacterium bovis subsp bovis AF2122/97
ucagcacccaagaauucacc

SEQ ID NO: 1160091 - RNA, 18 nt, Mycobacterium bovis subsp bovis AF2122/97
ucagcacccaauacaccc

SEQ ID NO: 1160092 - RNA, 16 nt, Mycobacterium bovis subsp bovis AF2122/97
ucagcacccaccgaag

SEQ ID NO: 1160093 - RNA, 15 nt, Mycobacterium bovis subsp bovis AF2122/97
ucagcacaaacccag

SEQ ID NO: 1160094 - RNA, 19 nt, Mycobacterium bovis subsp bovis AF2122/97
ucagcaacucggccacggc

SEQ ID NO: 1160095 - RNA, 22 nt, Mycobacterium bovis subsp bovis AF2122/97
ucagcaauacggcggcgccgcc

SEQ ID NO: 1160096 - RNA, 17 nt, Mycobacterium bovis subsp bovis AF2122/97
ucagcccggcgcgaucc

SEQ ID NO: 1160097 - RNA, 18 nt, Mycobacterium bovis subsp bovis AF2122/97
ucagcccggcgcgccgag

SEQ ID NO: 1160098 - RNA, 14 nt, Mycobacterium bovis subsp bovis AF2122/97
ucagccgcgccggg

SEQ ID NO: 1160099 - RNA, 18 nt, Mycobacterium bovis subsp bovis AF2122/97
ucagccgcgccggguccg

SEQ ID NO: 1160100 - RNA, 19 nt, Mycobacterium bovis subsp bovis AF2122/97
ucagccgcgcgggucacga

SEQ ID NO: 1160101 - RNA, 22 nt, Mycobacterium bovis subsp bovis AF2122/97
ucagccgcgcgggucacgaccu

SEQ ID NO: 1160102 - RNA, 23 nt, Mycobacterium bovis subsp bovis AF2122/97
ucagccgcgcgggucacgaccug

SEQ ID NO: 1160103 - RNA, 22 nt, Mycobacterium bovis subsp bovis AF2122/97
ucagcgaccacgucaagaagaa

SEQ ID NO: 1160104 - RNA, 22 nt, Mycobacterium bovis subsp bovis AF2122/97
ucagcgaaccaccggcgccgcc

SEQ ID NO: 1160105 - RNA, 22 nt, Mycobacterium bovis subsp bovis AF2122/97
ucagccggugacaaguggugcc

SEQ ID NO: 1160106 - RNA, 12 nt, Mycobacterium bovis subsp bovis AF2122/97
ucagccguggca

SEQ ID NO: 1160107 - RNA, 12 nt, Mycobacterium bovis subsp bovis AF2122/97
ucagccaggugu

SEQ ID NO: 1160108 - RNA, 21 nt, Mycobacterium bovis subsp bovis AF2122/97
ucagcccagccaacucaggcc

SEQ ID NO: 1160109 - RNA, 13 nt, Mycobacterium bovis subsp bovis AF2122/97
ucagccaggccag

SEQ ID NO: 1160110 - RNA, 22 nt, Mycobacterium bovis subsp bovis AF2122/97
ucagccaccgcaugugggaacu

SEQ ID NO: 1160111 - RNA, 12 nt, Mycobacterium bovis subsp bovis AF2122/97
ucagccaccauc

SEQ ID NO: 1160112 - RNA, 16 nt, Mycobacterium bovis subsp bovis AF2122/97
uaugugcccggcgcga

SEQ ID NO: 1160113 - RNA, 15 nt, Mycobacterium bovis subsp bovis AF2122/97
uaugggagucccacc

SEQ ID NO: 1160114 - RNA, 14 nt, Mycobacterium bovis subsp bovis AF2122/97
uaugcgcacucuag

SEQ ID NO: 1160115 - RNA, 17 nt, Mycobacterium bovis subsp bovis AF2122/97
uaugccacaggcugcca

SEQ ID NO: 1160116 - RNA, 23 nt, Mycobacterium bovis subsp bovis AF2122/97
uaugcccacgaaccgugcugggc

SEQ ID NO: 1160117 - RNA, 18 nt, Mycobacterium bovis subsp bovis AF2122/97
uaugccaggacuggcacc

SEQ ID NO: 1160118 - RNA, 15 nt, Mycobacterium bovis subsp bovis AF2122/97
uaugcucgcuggcgc

SEQ ID NO: 1160119 - RNA, 19 nt, Mycobacterium bovis subsp bovis AF2122/97
uaucguuaucgacaccacc

SEQ ID NO: 1160120 - RNA, 15 nt, Mycobacterium bovis subsp bovis AF2122/97
uaucggcgugucucg

SEQ ID NO: 1160121 - RNA, 18 nt, Mycobacterium bovis subsp bovis AF2122/97
uaucggcuucgucaucug

SEQ ID NO: 1160122 - RNA, 17 nt, Mycobacterium bovis subsp bovis AF2122/97
uagauggugguggcccg

SEQ ID NO: 1160123 - RNA, 15 nt, Mycobacterium bovis subsp bovis AF2122/97
uagaugcgugcggca

SEQ ID NO: 1160124 - RNA, 12 nt, Mycobacterium bovis subsp bovis AF2122/97
uagcagcgcugc

SEQ ID NO: 1160125 - RNA, 22 nt, Mycobacterium bovis subsp bovis AF2122/97
uagcagcggcucggcggcgcgu

SEQ ID NO: 1160126 - RNA, 13 nt, Mycobacterium bovis subsp bovis AF2122/97
uagcagcacccgg

SEQ ID NO: 1160127 - RNA, 15 nt, Mycobacterium bovis subsp bovis AF2122/97
uagcaaagccagcgc

SEQ ID NO: 1160128 - RNA, 18 nt, Mycobacterium bovis subsp bovis AF2122/97
uagcccgaccgguccagc

SEQ ID NO: 1160129 - RNA, 15 nt, Mycobacterium bovis subsp bovis AF2122/97
uagcccggcagcacg

SEQ ID NO: 1160130 - RNA, 21 nt, Mycobacterium bovis subsp bovis AF2122/97
uagcccgccacccuuggcccg

SEQ ID NO: 1160131 - RNA, 13 nt, Mycobacterium bovis subsp bovis AF2122/97
uagcccacccggg

SEQ ID NO: 1160132 - RNA, 19 nt, Mycobacterium bovis subsp bovis AF2122/97
uagcccacccauggccucc

SEQ ID NO: 1160133 - RNA, 21 nt, Mycobacterium bovis subsp bovis AF2122/97
uagcagggugccggcgccgcc

SEQ ID NO: 1160134 - RNA, 17 nt, Mycobacterium bovis subsp bovis AF2122/97
uagcagguguaggugcc

SEQ ID NO: 1160135 - RNA, 23 nt, Mycobacterium bovis subsp bovis AF2122/97
uagcggcgcagcgugagugcagc

SEQ ID NO: 1160136 - RNA, 19 nt, Mycobacterium bovis subsp bovis AF2122/97
uagcggcgcccgccaccgg

SEQ ID NO: 1160137 - RNA, 20 nt, Mycobacterium bovis subsp bovis AF2122/97
uagcguccgagcguaaugcu

SEQ ID NO: 1160138 - RNA, 22 nt, Mycobacterium bovis subsp bovis AF2122/97
uagcuaaugcacgcccaggcga

SEQ ID NO: 1160139 - RNA, 16 nt, Mycobacterium bovis subsp bovis AF2122/97
uagcggucccgcggac

SEQ ID NO: 1160140 - RNA, 17 nt, Mycobacterium bovis subsp bovis AF2122/97
uagcggugugggaugag

SEQ ID NO: 1160141 - RNA, 19 nt, Mycobacterium bovis subsp bovis AF2122/97
uagcgguuuagccgcuugg

SEQ ID NO: 1160142 - RNA, 19 nt, Mycobacterium bovis subsp bovis AF2122/97
uagccgaagcgcccggaga

SEQ ID NO: 1160143 - RNA, 13 nt, Mycobacterium bovis subsp bovis AF2122/97
uagcgcacugccg

SEQ ID NO: 1160144 - RNA, 18 nt, Mycobacterium bovis subsp bovis AF2122/97
uagcgcacugccgggugg

SEQ ID NO: 1160145 - RNA, 21 nt, Mycobacterium bovis subsp bovis AF2122/97
uagcgcaccacacuggcagug

SEQ ID NO: 1160146 - RNA, 16 nt, Mycobacterium bovis subsp bovis AF2122/97
uagcccuccgagcaca

SEQ ID NO: 1160147 - RNA, 15 nt, Mycobacterium bovis subsp bovis AF2122/97
uagccgaaaaagacc

SEQ ID NO: 1160148 - RNA, 13 nt, Mycobacterium bovis subsp bovis AF2122/97
uagcgcggccagc

SEQ ID NO: 1160149 - RNA, 15 nt, Mycobacterium bovis subsp bovis AF2122/97
uagcgcgggccuggc

SEQ ID NO: 1160150 - RNA, 17 nt, Mycobacterium bovis subsp bovis AF2122/97
uagcgcgggccuggccc

SEQ ID NO: 1160151 - RNA, 18 nt, Mycobacterium bovis subsp bovis AF2122/97
uagcgcgggccuggccca

SEQ ID NO: 1160152 - RNA, 17 nt, Mycobacterium bovis subsp bovis AF2122/97
uagcgcgggcucacaug

SEQ ID NO: 1160153 - RNA, 14 nt, Mycobacterium bovis subsp bovis AF2122/97
uagcgcgugcugca

SEQ ID NO: 1160154 - RNA, 23 nt, Mycobacterium bovis subsp bovis AF2122/97
uaggcggccaugucagcggccug

SEQ ID NO: 1160155 - RNA, 17 nt, Mycobacterium bovis subsp bovis AF2122/97
uaggccccaccauucgc

SEQ ID NO: 1160156 - RNA, 15 nt, Mycobacterium bovis subsp bovis AF2122/97
uaggagaucagcacc

SEQ ID NO: 1160157 - RNA, 19 nt, Mycobacterium bovis subsp bovis AF2122/97
uaggacaccgucaugccgu

SEQ ID NO: 1160158 - RNA, 13 nt, Mycobacterium bovis subsp bovis AF2122/97
uaggaccaccagc

SEQ ID NO: 1160159 - RNA, 14 nt, Mycobacterium bovis subsp bovis AF2122/97
uagcuguuggccag

SEQ ID NO: 1160160 - RNA, 22 nt, Mycobacterium bovis subsp bovis AF2122/97
uagcuguuggccagccgacaac

SEQ ID NO: 1160161 - RNA, 22 nt, Mycobacterium bovis subsp bovis AF2122/97
uaguugaggccgucgaacggua

SEQ ID NO: 1160162 - RNA, 18 nt, Mycobacterium bovis subsp bovis AF2122/97
uagugcaucggcagcccc

SEQ ID NO: 1160163 - RNA, 13 nt, Mycobacterium bovis subsp bovis AF2122/97
uagugcaggugcc

SEQ ID NO: 1160164 - RNA, 23 nt, Mycobacterium bovis subsp bovis AF2122/97
uaguucagccaggccgcaaugcg

SEQ ID NO: 1160165 - RNA, 20 nt, Mycobacterium bovis subsp bovis AF2122/97
uaguuuaucggccgugaauu

SEQ ID NO: 1160166 - RNA, 16 nt, Mycobacterium bovis subsp bovis AF2122/97
uagucgcgggccaagc

SEQ ID NO: 1160167 - RNA, 20 nt, Mycobacterium bovis subsp bovis AF2122/97
uagucccucaucaccucucc

SEQ ID NO: 1160168 - RNA, 22 nt, Mycobacterium bovis subsp bovis AF2122/97
uaggucgaccacccgcagggca

SEQ ID NO: 1160169 - RNA, 17 nt, Mycobacterium bovis subsp bovis AF2122/97
uaggcuugcaaggucgc

SEQ ID NO: 1160170 - RNA, 19 nt, Mycobacterium bovis subsp bovis AF2122/97
uaggugucgggcucgcauu

SEQ ID NO: 1160171 - RNA, 16 nt, Mycobacterium bovis subsp bovis AF2122/97
uaggugcaugucgaug

SEQ ID NO: 1160172 - RNA, 20 nt, Mycobacterium bovis subsp bovis AF2122/97
uaggugacgccgccagcacc

SEQ ID NO: 1160173 - RNA, 22 nt, Mycobacterium bovis subsp bovis AF2122/97
uagguucgguagucgaugcuga

SEQ ID NO: 1160174 - RNA, 16 nt, Mycobacterium bovis subsp bovis AF2122/97
uagguugccaugccaa

SEQ ID NO: 1160175 - RNA, 20 nt, Mycobacterium bovis subsp bovis AF2122/97
uagguuuucggcggcucuag

SEQ ID NO: 1160176 - RNA, 20 nt, Mycobacterium bovis subsp bovis AF2122/97
uacgcgcgcucgcucaccgg

SEQ ID NO: 1160177 - RNA, 23 nt, Mycobacterium bovis subsp bovis AF2122/97
uacgcgcgcucgcucaccggcug

SEQ ID NO: 1160178 - RNA, 20 nt, Mycobacterium bovis subsp bovis AF2122/97
uacgcaccgaggccgccgag

SEQ ID NO: 1160179 - RNA, 20 nt, Mycobacterium bovis subsp bovis AF2122/97
uacgggcaggccgcugggcc

SEQ ID NO: 1160180 - RNA, 12 nt, Mycobacterium bovis subsp bovis AF2122/97
uacgggcaguga

SEQ ID NO: 1160181 - RNA, 15 nt, Mycobacterium bovis subsp bovis AF2122/97
uacgggcagugaaca

SEQ ID NO: 1160182 - RNA, 20 nt, Mycobacterium bovis subsp bovis AF2122/97
uacgucgaucaggucgucac

SEQ ID NO: 1160183 - RNA, 19 nt, Mycobacterium bovis subsp bovis AF2122/97
uacgaagccgccgcgacca

SEQ ID NO: 1160184 - RNA, 19 nt, Mycobacterium bovis subsp bovis AF2122/97
uacauagccggucauuuca

SEQ ID NO: 1160185 - RNA, 14 nt, Mycobacterium bovis subsp bovis AF2122/97
uaccagcggcaccg

SEQ ID NO: 1160186 - RNA, 18 nt, Mycobacterium bovis subsp bovis AF2122/97
uaccagccgccccggcuu

SEQ ID NO: 1160187 - RNA, 22 nt, Mycobacterium bovis subsp bovis AF2122/97
uaccagcaccgggaugugcggc

SEQ ID NO: 1160188 - RNA, 16 nt, Mycobacterium bovis subsp bovis AF2122/97
uaccgguccagugugu

SEQ ID NO: 1160189 - RNA, 15 nt, Mycobacterium bovis subsp bovis AF2122/97
uaccggcuggccagg

SEQ ID NO: 1160190 - RNA, 14 nt, Mycobacterium bovis subsp bovis AF2122/97
uaccgauuggcccg

SEQ ID NO: 1160191 - RNA, 14 nt, Mycobacterium bovis subsp bovis AF2122/97
uaccgccagcgcca

SEQ ID NO: 1160192 - RNA, 14 nt, Mycobacterium bovis subsp bovis AF2122/97
uaccgccgcgaccg

SEQ ID NO: 1160193 - RNA, 14 nt, Mycobacterium bovis subsp bovis AF2122/97
uaccgccgcugccg

SEQ ID NO: 1160194 - RNA, 14 nt, Mycobacterium bovis subsp bovis AF2122/97
uacccccagcaccc

SEQ ID NO: 1160195 - RNA, 16 nt, Mycobacterium bovis subsp bovis AF2122/97
uacccacgacgggccg

SEQ ID NO: 1160196 - RNA, 20 nt, Mycobacterium bovis subsp bovis AF2122/97
uaccccagccggcagcagcg

SEQ ID NO: 1160197 - RNA, 19 nt, Mycobacterium bovis subsp bovis AF2122/97
uacccaccucccgcagccg

SEQ ID NO: 1160198 - RNA, 21 nt, Mycobacterium bovis subsp bovis AF2122/97
uacccgaccagcaccagaacc

SEQ ID NO: 1160199 - RNA, 15 nt, Mycobacterium bovis subsp bovis AF2122/97
uacucagguggaagu

SEQ ID NO: 1160200 - RNA, 13 nt, Mycobacterium bovis subsp bovis AF2122/97
uacugagcuucca

SEQ ID NO: 1160201 - RNA, 21 nt, Mycobacterium bovis subsp bovis AF2122/97
uacugaggaaagucaccgucc

SEQ ID NO: 1160202 - RNA, 19 nt, Mycobacterium bovis subsp bovis AF2122/97
uacuggcguugccaccgga

SEQ ID NO: 1160203 - RNA, 21 nt, Mycobacterium bovis subsp bovis AF2122/97
uacuguucugcuggcuguggc

SEQ ID NO: 1160204 - RNA, 16 nt, Mycobacterium bovis subsp bovis AF2122/97
uacuucgcuggaaacc

SEQ ID NO: 1160205 - RNA, 10 nt, Mycobacterium bovis subsp bovis AF2122/97
uacuugaccg

SEQ ID NO: 1160206 - RNA, 14 nt, Mycobacterium bovis subsp bovis AF2122/97
uacuugagggucuu

SEQ ID NO: 1160207 - RNA, 15 nt, Mycobacterium bovis subsp bovis AF2122/97
uaacggagcggccua

SEQ ID NO: 1160208 - RNA, 17 nt, Mycobacterium bovis subsp bovis AF2122/97
uaauccgggcaaucaca

SEQ ID NO: 1160209 - RNA, 19 nt, Mycobacterium bovis subsp bovis AF2122/97
uaaugaucucggcaaggac

SEQ ID NO: 1160210 - RNA, 23 nt, Mycobacterium bovis subsp bovis AF2122/97
uacacaggaagcguugucgccca

SEQ ID NO: 1160211 - RNA, 13 nt, Mycobacterium bovis subsp bovis AF2122/97
uacaccggcugga

SEQ ID NO: 1160212 - RNA, 17 nt, Mycobacterium bovis subsp bovis AF2122/97
uacaccuccugccuuua

SEQ ID NO: 1160213 - RNA, 14 nt, Mycobacterium bovis subsp bovis AF2122/97
uacacccaacucau

SEQ ID NO: 1160214 - RNA, 15 nt, Mycobacterium bovis subsp bovis AF2122/97
uacaccgcccggccc

SEQ ID NO: 1160215 - RNA, 22 nt, Mycobacterium bovis subsp bovis AF2122/97
uacaccuuguggacccgccagg

SEQ ID NO: 1160216 - RNA, 14 nt, Mycobacterium bovis subsp bovis AF2122/97
uacagcgggauccc

SEQ ID NO: 1160217 - RNA, 22 nt, Mycobacterium bovis subsp bovis AF2122/97
uacagcgggaucccgaucguga

SEQ ID NO: 1160218 - RNA, 19 nt, Mycobacterium bovis subsp bovis AF2122/97
uacagcucggugcacggcg

SEQ ID NO: 1160219 - RNA, 21 nt, Mycobacterium bovis subsp bovis AF2122/97
uacagucgaccggacacuccu

SEQ ID NO: 1160220 - RNA, 23 nt, Mycobacterium bovis subsp bovis AF2122/97
uacagugcgcggaucaacaggcc

SEQ ID NO: 1160221 - RNA, 15 nt, Mycobacterium bovis subsp bovis AF2122/97
gcugccccccagaca

SEQ ID NO: 1160222 - RNA, 16 nt, Mycobacterium bovis subsp bovis AF2122/97
gcugccccgccgccau

SEQ ID NO: 1160223 - RNA, 16 nt, Mycobacterium bovis subsp bovis AF2122/97
gcugcccaugcggcag

SEQ ID NO: 1160224 - RNA, 21 nt, Mycobacterium bovis subsp bovis AF2122/97
gcugcccaaaaggaagaccuc

SEQ ID NO: 1160225 - RNA, 22 nt, Mycobacterium bovis subsp bovis AF2122/97
gcugccauugccugggcgaccg

SEQ ID NO: 1160226 - RNA, 15 nt, Mycobacterium bovis subsp bovis AF2122/97
gcugccauuccagau

SEQ ID NO: 1160227 - RNA, 18 nt, Mycobacterium bovis subsp bovis AF2122/97
gcugccgaagcggccacc

SEQ ID NO: 1160228 - RNA, 14 nt, Mycobacterium bovis subsp bovis AF2122/97
gcugcccgccgccc

SEQ ID NO: 1160229 - RNA, 16 nt, Mycobacterium bovis subsp bovis AF2122/97
gcugccgacuccucgu

SEQ ID NO: 1160230 - RNA, 16 nt, Mycobacterium bovis subsp bovis AF2122/97
gcugccgcacccccuc

SEQ ID NO: 1160231 - RNA, 20 nt, Mycobacterium bovis subsp bovis AF2122/97
gcugccgcaugcgcuccggc

SEQ ID NO: 1160232 - RNA, 15 nt, Mycobacterium bovis subsp bovis AF2122/97
gcugccggcccacca

SEQ ID NO: 1160233 - RNA, 20 nt, Mycobacterium bovis subsp bovis AF2122/97
gcugccgguagcacagcagc

SEQ ID NO: 1160234 - RNA, 14 nt, Mycobacterium bovis subsp bovis AF2122/97
gcugccgucggugc

SEQ ID NO: 1160235 - RNA, 14 nt, Mycobacterium bovis subsp bovis AF2122/97
gcugccgucagccg

SEQ ID NO: 1160236 - RNA, 24 nt, Mycobacterium bovis subsp bovis AF2122/97
gcugccgccuuggucgcgucggcu

SEQ ID NO: 1160237 - RNA, 19 nt, Mycobacterium bovis subsp bovis AF2122/97
gcugccggagacacccgcc

SEQ ID NO: 1160238 - RNA, 15 nt, Mycobacterium bovis subsp bovis AF2122/97
gcugccgccgccggc

SEQ ID NO: 1160239 - RNA, 20 nt, Mycobacterium bovis subsp bovis AF2122/97
gcugccgcgcggcgagagcc

SEQ ID NO: 1160240 - RNA, 20 nt, Mycobacterium bovis subsp bovis AF2122/97
gcugccgccgucgccgccgu

SEQ ID NO: 1160241 - RNA, 13 nt, Mycobacterium bovis subsp bovis AF2122/97
gcugccgcggccg

SEQ ID NO: 1160242 - RNA, 13 nt, Mycobacterium bovis subsp bovis AF2122/97
gcugccgcggcug

SEQ ID NO: 1160243 - RNA, 17 nt, Mycobacterium bovis subsp bovis AF2122/97
gcugccguugggcaccg

SEQ ID NO: 1160244 - RNA, 12 nt, Mycobacterium bovis subsp bovis AF2122/97
gcugccuucuuu

SEQ ID NO: 1160245 - RNA, 17 nt, Mycobacterium bovis subsp bovis AF2122/97
gcugcgacuggugccug

SEQ ID NO: 1160246 - RNA, 15 nt, Mycobacterium bovis subsp bovis AF2122/97
gcugcagaaaggcca

SEQ ID NO: 1160247 - RNA, 23 nt, Mycobacterium bovis subsp bovis AF2122/97
gcugcaauagccuuacgcgggug

SEQ ID NO: 1160248 - RNA, 17 nt, Mycobacterium bovis subsp bovis AF2122/97
gcugauugcgaccgcgc

SEQ ID NO: 1160249 - RNA, 15 nt, Mycobacterium bovis subsp bovis AF2122/97
gcugcagccugugga

SEQ ID NO: 1160250 - RNA, 17 nt, Mycobacterium bovis subsp bovis AF2122/97
gcugcagugccgcaccc

SEQ ID NO: 1160251 - RNA, 14 nt, Mycobacterium bovis subsp bovis AF2122/97
gcugcagguccagg

SEQ ID NO: 1160252 - RNA, 20 nt, Mycobacterium bovis subsp bovis AF2122/97
gcugcagcagacccgguggc

SEQ ID NO: 1160253 - RNA, 14 nt, Mycobacterium bovis subsp bovis AF2122/97
gcugcaggcggccg

SEQ ID NO: 1160254 - RNA, 22 nt, Mycobacterium bovis subsp bovis AF2122/97
gcugccaacgcccguguugaag

SEQ ID NO: 1160255 - RNA, 16 nt, Mycobacterium bovis subsp bovis AF2122/97
gcugccagccauggcc

SEQ ID NO: 1160256 - RNA, 15 nt, Mycobacterium bovis subsp bovis AF2122/97
gcugccagccguucc

SEQ ID NO: 1160257 - RNA, 23 nt, Mycobacterium bovis subsp bovis AF2122/97
gcugccaaggccuucagcggucg

SEQ ID NO: 1160258 - RNA, 14 nt, Mycobacterium bovis subsp bovis AF2122/97
gcugcauccgcagc

SEQ ID NO: 1160259 - RNA, 15 nt, Mycobacterium bovis subsp bovis AF2122/97
gcugcauccgcagca

SEQ ID NO: 1160260 - RNA, 22 nt, Mycobacterium bovis subsp bovis AF2122/97
gcuggauguaguuggcgaccug

SEQ ID NO: 1160261 - RNA, 18 nt, Mycobacterium bovis subsp bovis AF2122/97
gcuggauguaguuggcga

SEQ ID NO: 1160262 - RNA, 17 nt, Mycobacterium bovis subsp bovis AF2122/97
gcuggaucucguuggug

SEQ ID NO: 1160263 - RNA, 18 nt, Mycobacterium bovis subsp bovis AF2122/97
gcuggaucaacccggccu

SEQ ID NO: 1160264 - RNA, 23 nt, Mycobacterium bovis subsp bovis AF2122/97
gcuggacuccggucagcgcggcg

SEQ ID NO: 1160265 - RNA, 14 nt, Mycobacterium bovis subsp bovis AF2122/97
gcuggacccgcaug

SEQ ID NO: 1160266 - RNA, 21 nt, Mycobacterium bovis subsp bovis AF2122/97
gcuggaggcgaucugcuacca

SEQ ID NO: 1160267 - RNA, 19 nt, Mycobacterium bovis subsp bovis AF2122/97
gcuggaggcuccuggucgc

SEQ ID NO: 1160268 - RNA, 20 nt, Mycobacterium bovis subsp bovis AF2122/97
gcuggaggugaacucguuca

SEQ ID NO: 1160269 - RNA, 16 nt, Mycobacterium bovis subsp bovis AF2122/97
gcuggaguaggugugc

SEQ ID NO: 1160270 - RNA, 19 nt, Mycobacterium bovis subsp bovis AF2122/97
gcuggaguaggugugcggg

SEQ ID NO: 1160271 - RNA, 16 nt, Mycobacterium bovis subsp bovis AF2122/97
gcugcuggcgcgccug

SEQ ID NO: 1160272 - RNA, 18 nt, Mycobacterium bovis subsp bovis AF2122/97
gcugcugccguggcggca

SEQ ID NO: 1160273 - RNA, 18 nt, Mycobacterium bovis subsp bovis AF2122/97
gcuggaaaaucgggucac

SEQ ID NO: 1160274 - RNA, 23 nt, Mycobacterium bovis subsp bovis AF2122/97
gcuggaaucgaaaaggugcacca

SEQ ID NO: 1160275 - RNA, 20 nt, Mycobacterium bovis subsp bovis AF2122/97
gcugcuuggcggucugcgcc

SEQ ID NO: 1160276 - RNA, 16 nt, Mycobacterium bovis subsp bovis AF2122/97
gcugcuugcgcccggc

SEQ ID NO: 1160277 - RNA, 16 nt, Mycobacterium bovis subsp bovis AF2122/97
gcugcgcguugcugca

SEQ ID NO: 1160278 - RNA, 14 nt, Mycobacterium bovis subsp bovis AF2122/97
gcugcggcaacgag

SEQ ID NO: 1160279 - RNA, 14 nt, Mycobacterium bovis subsp bovis AF2122/97
gcugcggcaccacc

SEQ ID NO: 1160280 - RNA, 21 nt, Mycobacterium bovis subsp bovis AF2122/97
gcugcggcccacaccagcgca

SEQ ID NO: 1160281 - RNA, 12 nt, Mycobacterium bovis subsp bovis AF2122/97
gcugcggccgcg

SEQ ID NO: 1160282 - RNA, 18 nt, Mycobacterium bovis subsp bovis AF2122/97
gcugcggcuuucagcgcu

SEQ ID NO: 1160283 - RNA, 20 nt, Mycobacterium bovis subsp bovis AF2122/97
gcugcgccgucgcagccagc

SEQ ID NO: 1160284 - RNA, 19 nt, Mycobacterium bovis subsp bovis AF2122/97
gcugcgcacgucgggcccg

SEQ ID NO: 1160285 - RNA, 17 nt, Mycobacterium bovis subsp bovis AF2122/97
gcugcgcaccaaggccg

SEQ ID NO: 1160286 - RNA, 18 nt, Mycobacterium bovis subsp bovis AF2122/97
gcugcucaucgcgcccgc

SEQ ID NO: 1160287 - RNA, 22 nt, Mycobacterium bovis subsp bovis AF2122/97
gcugcucgaucaucgggagccg

SEQ ID NO: 1160288 - RNA, 14 nt, Mycobacterium bovis subsp bovis AF2122/97
gcugcuccuggaag

SEQ ID NO: 1160289 - RNA, 23 nt, Mycobacterium bovis subsp bovis AF2122/97
gcugcucggucaggcggcuggcc

SEQ ID NO: 1160290 - RNA, 17 nt, Mycobacterium bovis subsp bovis AF2122/97
gcugcucgucggcgccg

SEQ ID NO: 1160291 - RNA, 17 nt, Mycobacterium bovis subsp bovis AF2122/97
gcugcucgugagcccca

SEQ ID NO: 1160292 - RNA, 22 nt, Mycobacterium bovis subsp bovis AF2122/97
gcugcucugagcuuggucgccg

SEQ ID NO: 1160293 - RNA, 21 nt, Mycobacterium bovis subsp bovis AF2122/97
gcugcgggugauugagcucag

SEQ ID NO: 1160294 - RNA, 21 nt, Mycobacterium bovis subsp bovis AF2122/97
gcugcgggucucgccgaccuu

SEQ ID NO: 1160295 - RNA, 17 nt, Mycobacterium bovis subsp bovis AF2122/97
gcugcggugccggcccu

SEQ ID NO: 1160296 - RNA, 20 nt, Mycobacterium bovis subsp bovis AF2122/97
gcugcggucgaacaucaucg

SEQ ID NO: 1160297 - RNA, 16 nt, Mycobacterium bovis subsp bovis AF2122/97
gcugcggucgcggcug

SEQ ID NO: 1160298 - RNA, 14 nt, Mycobacterium bovis subsp bovis AF2122/97
gcugcggugggcca

SEQ ID NO: 1160299 - RNA, 13 nt, Mycobacterium bovis subsp bovis AF2122/97
gcugcguccugga

SEQ ID NO: 1160300 - RNA, 14 nt, Mycobacterium bovis subsp bovis AF2122/97
gcugcguccuggau

SEQ ID NO: 1160301 - RNA, 19 nt, Mycobacterium bovis subsp bovis AF2122/97
gcugucauccccggccagc

SEQ ID NO: 1160302 - RNA, 20 nt, Mycobacterium bovis subsp bovis AF2122/97
gcuguccaccgaggccugac

SEQ ID NO: 1160303 - RNA, 14 nt, Mycobacterium bovis subsp bovis AF2122/97
gcugucccagcccg

SEQ ID NO: 1160304 - RNA, 14 nt, Mycobacterium bovis subsp bovis AF2122/97
gcuguccccgccga

SEQ ID NO: 1160305 - RNA, 16 nt, Mycobacterium bovis subsp bovis AF2122/97
gcuguccccgccgagg

SEQ ID NO: 1160306 - RNA, 15 nt, Mycobacterium bovis subsp bovis AF2122/97
gcuguccgcgggccg

SEQ ID NO: 1160307 - RNA, 18 nt, Mycobacterium bovis subsp bovis AF2122/97
gcuguccgcgggccgcgc

SEQ ID NO: 1160308 - RNA, 18 nt, Mycobacterium bovis subsp bovis AF2122/97
gcugucgaucagcgaccc

SEQ ID NO: 1160309 - RNA, 18 nt, Mycobacterium bovis subsp bovis AF2122/97
gcugucgcgggccaccac

SEQ ID NO: 1160310 - RNA, 16 nt, Mycobacterium bovis subsp bovis AF2122/97
gcugucaagcgggcug

SEQ ID NO: 1160311 - RNA, 22 nt, Mycobacterium bovis subsp bovis AF2122/97
gcugucacguagcgagcccacg

SEQ ID NO: 1160312 - RNA, 16 nt, Mycobacterium bovis subsp bovis AF2122/97
gcugucacaagccugc

SEQ ID NO: 1160313 - RNA, 16 nt, Mycobacterium bovis subsp bovis AF2122/97
gcuguagucgcgccuc

SEQ ID NO: 1160314 - RNA, 18 nt, Mycobacterium bovis subsp bovis AF2122/97
gcuguaggucagcgcguc

SEQ ID NO: 1160315 - RNA, 16 nt, Mycobacterium bovis subsp bovis AF2122/97
gcuguaggccagcccg

SEQ ID NO: 1160316 - RNA, 24 nt, Mycobacterium bovis subsp bovis AF2122/97
gcuguacuugggauugcgggccug

SEQ ID NO: 1160317 - RNA, 22 nt, Mycobacterium bovis subsp bovis AF2122/97
gcuguacccgaccagcaccaga

SEQ ID NO: 1160318 - RNA, 18 nt, Mycobacterium bovis subsp bovis AF2122/97
gcuguaacacccggccgc

SEQ ID NO: 1160319 - RNA, 21 nt, Mycobacterium bovis subsp bovis AF2122/97
gcuguaacacccggccgccga

SEQ ID NO: 1160320 - RNA, 13 nt, Mycobacterium bovis subsp bovis AF2122/97
gcuggugugcggg

SEQ ID NO: 1160321 - RNA, 17 nt, Mycobacterium bovis subsp bovis AF2122/97
gcuggugugcgggugug

SEQ ID NO: 1160322 - RNA, 16 nt, Mycobacterium bovis subsp bovis AF2122/97
gcuggugugucccggg

SEQ ID NO: 1160323 - RNA, 14 nt, Mycobacterium bovis subsp bovis AF2122/97
gcugguggucagca

SEQ ID NO: 1160324 - RNA, 18 nt, Mycobacterium bovis subsp bovis AF2122/97
gcuggugggacgcggccg

SEQ ID NO: 1160325 - RNA, 18 nt, Mycobacterium bovis subsp bovis AF2122/97
gcuggugcgcccaucaug

SEQ ID NO: 1160326 - RNA, 15 nt, Mycobacterium bovis subsp bovis AF2122/97
gcuggugccaacugc

SEQ ID NO: 1160327 - RNA, 12 nt, Mycobacterium bovis subsp bovis AF2122/97
gcugguggcggc

SEQ ID NO: 1160328 - RNA, 13 nt, Mycobacterium bovis subsp bovis AF2122/97
gcugguggcgugc

SEQ ID NO: 1160329 - RNA, 19 nt, Mycobacterium bovis subsp bovis AF2122/97
gcuggugggggagcggccg

SEQ ID NO: 1160330 - RNA, 23 nt, Mycobacterium bovis subsp bovis AF2122/97
gcuguuggcguggaucuuggcca

SEQ ID NO: 1160331 - RNA, 14 nt, Mycobacterium bovis subsp bovis AF2122/97
gcuguugaccgugu

SEQ ID NO: 1160332 - RNA, 18 nt, Mycobacterium bovis subsp bovis AF2122/97
gcuguugcaucgccgcga

SEQ ID NO: 1160333 - RNA, 16 nt, Mycobacterium bovis subsp bovis AF2122/97
gcuguucgcgccauac

SEQ ID NO: 1160334 - RNA, 16 nt, Mycobacterium bovis subsp bovis AF2122/97
gcuguucggccauggc

SEQ ID NO: 1160335 - RNA, 17 nt, Mycobacterium bovis subsp bovis AF2122/97
gcuguucggccauggcg

SEQ ID NO: 1160336 - RNA, 20 nt, Mycobacterium bovis subsp bovis AF2122/97
gcuguucggccauggcggcg

SEQ ID NO: 1160337 - RNA, 23 nt, Mycobacterium bovis subsp bovis AF2122/97
gcugugcucacgagcaaaccaga

SEQ ID NO: 1160338 - RNA, 11 nt, Mycobacterium bovis subsp bovis AF2122/97
gcugugcucga

SEQ ID NO: 1160339 - RNA, 17 nt, Mycobacterium bovis subsp bovis AF2122/97
gcuguggcgggagaucg

SEQ ID NO: 1160340 - RNA, 13 nt, Mycobacterium bovis subsp bovis AF2122/97
gcugugcgcuggu

SEQ ID NO: 1160341 - RNA, 14 nt, Mycobacterium bovis subsp bovis AF2122/97
gcugugcgcugguc

SEQ ID NO: 1160342 - RNA, 13 nt, Mycobacterium bovis subsp bovis AF2122/97
gcugugccggcca

SEQ ID NO: 1160343 - RNA, 22 nt, Mycobacterium bovis subsp bovis AF2122/97
gcugugguaggccggugcguca

SEQ ID NO: 1160344 - RNA, 14 nt, Mycobacterium bovis subsp bovis AF2122/97
gcuguggucggugc

SEQ ID NO: 1160345 - RNA, 21 nt, Mycobacterium bovis subsp bovis AF2122/97
gcuguggucggugccagcacc

SEQ ID NO: 1160346 - RNA, 15 nt, Mycobacterium bovis subsp bovis AF2122/97
gcugugggauucggg

SEQ ID NO: 1160347 - RNA, 22 nt, Mycobacterium bovis subsp bovis AF2122/97
gcuguggugacagauccgcccc

SEQ ID NO: 1160348 - RNA, 13 nt, Mycobacterium bovis subsp bovis AF2122/97
gcugugugggagc

SEQ ID NO: 1160349 - RNA, 14 nt, Mycobacterium bovis subsp bovis AF2122/97
gcugucgggcagcu

SEQ ID NO: 1160350 - RNA, 23 nt, Mycobacterium bovis subsp bovis AF2122/97
gcugucgugauacagcucggugc

SEQ ID NO: 1160351 - RNA, 21 nt, Mycobacterium bovis subsp bovis AF2122/97
gcugugagcuuggucgccaug

SEQ ID NO: 1160352 - RNA, 13 nt, Mycobacterium bovis subsp bovis AF2122/97
gcugugccccagg

SEQ ID NO: 1160353 - RNA, 23 nt, Mycobacterium bovis subsp bovis AF2122/97
gcugugcccgaucagccguggca

SEQ ID NO: 1160354 - RNA, 14 nt, Mycobacterium bovis subsp bovis AF2122/97
gcuggcaggccggg

SEQ ID NO: 1160355 - RNA, 20 nt, Mycobacterium bovis subsp bovis AF2122/97
gcuggcagcgacuuaggcag

SEQ ID NO: 1160356 - RNA, 21 nt, Mycobacterium bovis subsp bovis AF2122/97
gcuggcagcgacuuaggcaga

SEQ ID NO: 1160357 - RNA, 20 nt, Mycobacterium bovis subsp bovis AF2122/97
gcuggcagcuccucgcgcuc

SEQ ID NO: 1160358 - RNA, 20 nt, Mycobacterium bovis subsp bovis AF2122/97
gcuggccaacuugacccggg

SEQ ID NO: 1160359 - RNA, 16 nt, Mycobacterium bovis subsp bovis AF2122/97
gcuggccagcacgccc

SEQ ID NO: 1160360 - RNA, 12 nt, Mycobacterium bovis subsp bovis AF2122/97
gcuggcccagcg

SEQ ID NO: 1160361 - RNA, 23 nt, Mycobacterium bovis subsp bovis AF2122/97
gcuggccguaacgcggaucgggc

SEQ ID NO: 1160362 - RNA, 20 nt, Mycobacterium bovis subsp bovis AF2122/97
gcuggccguauaggcccggg

SEQ ID NO: 1160363 - RNA, 16 nt, Mycobacterium bovis subsp bovis AF2122/97
gcuggccuccagcuug

SEQ ID NO: 1160364 - RNA, 20 nt, Mycobacterium bovis subsp bovis AF2122/97
gcuggccuccagcuuggcga

SEQ ID NO: 1160365 - RNA, 12 nt, Mycobacterium bovis subsp bovis AF2122/97
gcuggcccgcau

SEQ ID NO: 1160366 - RNA, 23 nt, Mycobacterium bovis subsp bovis AF2122/97
gcuggccgcggcuggugucgggc

SEQ ID NO: 1160367 - RNA, 14 nt, Mycobacterium bovis subsp bovis AF2122/97
gcuggccggcaccg

SEQ ID NO: 1160368 - RNA, 21 nt, Mycobacterium bovis subsp bovis AF2122/97
gcuggcgcucauaggccggcg

SEQ ID NO: 1160369 - RNA, 15 nt, Mycobacterium bovis subsp bovis AF2122/97
gcuggcgcgcggggu

SEQ ID NO: 1160370 - RNA, 15 nt, Mycobacterium bovis subsp bovis AF2122/97
gcuggcggccagcau

SEQ ID NO: 1160371 - RNA, 19 nt, Mycobacterium bovis subsp bovis AF2122/97
gcuggcgcccuugccggcg

SEQ ID NO: 1160372 - RNA, 17 nt, Mycobacterium bovis subsp bovis AF2122/97
gcuggcgcccccgccau

SEQ ID NO: 1160373 - RNA, 12 nt, Mycobacterium bovis subsp bovis AF2122/97
gcuggcgcccgg

SEQ ID NO: 1160374 - RNA, 15 nt, Mycobacterium bovis subsp bovis AF2122/97
gcuggcgccccaggu

SEQ ID NO: 1160375 - RNA, 20 nt, Mycobacterium bovis subsp bovis AF2122/97
gcugguauagcucacggugg

SEQ ID NO: 1160376 - RNA, 23 nt, Mycobacterium bovis subsp bovis AF2122/97
gcugguaucgagcaccccgacgu

SEQ ID NO: 1160377 - RNA, 19 nt, Mycobacterium bovis subsp bovis AF2122/97
gcuggucaacagcggcaag

SEQ ID NO: 1160378 - RNA, 23 nt, Mycobacterium bovis subsp bovis AF2122/97
gcugguccuccuucggugguggg

SEQ ID NO: 1160379 - RNA, 13 nt, Mycobacterium bovis subsp bovis AF2122/97
gcuggucagccgu

SEQ ID NO: 1160380 - RNA, 19 nt, Mycobacterium bovis subsp bovis AF2122/97
gcuggucagccgugccgug

SEQ ID NO: 1160381 - RNA, 20 nt, Mycobacterium bovis subsp bovis AF2122/97
gcuggugaucagcucaguga

SEQ ID NO: 1160382 - RNA, 13 nt, Mycobacterium bovis subsp bovis AF2122/97
gcuggugccaacu

SEQ ID NO: 1160383 - RNA, 14 nt, Mycobacterium bovis subsp bovis AF2122/97
gcuggucggcggcu

SEQ ID NO: 1160384 - RNA, 19 nt, Mycobacterium bovis subsp bovis AF2122/97
gcugggggauaccgcuggg

SEQ ID NO: 1160385 - RNA, 13 nt, Mycobacterium bovis subsp bovis AF2122/97
gcuggggccccgc

SEQ ID NO: 1160386 - RNA, 18 nt, Mycobacterium bovis subsp bovis AF2122/97
gcuggguaugcacccagg

SEQ ID NO: 1160387 - RNA, 16 nt, Mycobacterium bovis subsp bovis AF2122/97
gcuggguaugcaccca

SEQ ID NO: 1160388 - RNA, 16 nt, Mycobacterium bovis subsp bovis AF2122/97
gcuggggguaccuccc

SEQ ID NO: 1160389 - RNA, 17 nt, Mycobacterium bovis subsp bovis AF2122/97
gcugggggucaaucggg

SEQ ID NO: 1160390 - RNA, 20 nt, Mycobacterium bovis subsp bovis AF2122/97
gcuggguggccaaccaaccg

SEQ ID NO: 1160391 - RNA, 15 nt, Mycobacterium bovis subsp bovis AF2122/97
gcuggguggccccuu

SEQ ID NO: 1160392 - RNA, 18 nt, Mycobacterium bovis subsp bovis AF2122/97
gcugggcuugugggccgg

SEQ ID NO: 1160393 - RNA, 13 nt, Mycobacterium bovis subsp bovis AF2122/97
gcugggcgcgcuc

SEQ ID NO: 1160394 - RNA, 23 nt, Mycobacterium bovis subsp bovis AF2122/97
gcugggcgcgcucaucgaccggg

SEQ ID NO: 1160395 - RNA, 16 nt, Mycobacterium bovis subsp bovis AF2122/97
gcugggcgccgcgcuc

SEQ ID NO: 1160396 - RNA, 14 nt, Mycobacterium bovis subsp bovis AF2122/97
gcugggcccgccgu

SEQ ID NO: 1160397 - RNA, 12 nt, Mycobacterium bovis subsp bovis AF2122/97
gcugggccaggg

SEQ ID NO: 1160398 - RNA, 19 nt, Mycobacterium bovis subsp bovis AF2122/97
gcugggcccgagcgcgcgc

SEQ ID NO: 1160399 - RNA, 14 nt, Mycobacterium bovis subsp bovis AF2122/97
gcugggcccgccag

SEQ ID NO: 1160400 - RNA, 18 nt, Mycobacterium bovis subsp bovis AF2122/97
gcugggcccgccagccca

SEQ ID NO: 1160401 - RNA, 23 nt, Mycobacterium bovis subsp bovis AF2122/97
gcugggcccgccagcccagcacg

SEQ ID NO: 1160402 - RNA, 20 nt, Mycobacterium bovis subsp bovis AF2122/97
gcugggcaucaccgccgcgg

SEQ ID NO: 1160403 - RNA, 19 nt, Mycobacterium bovis subsp bovis AF2122/97
gcugggcagccagaucucc

SEQ ID NO: 1160404 - RNA, 19 nt, Mycobacterium bovis subsp bovis AF2122/97
gcugggcaagaucguuucc

SEQ ID NO: 1160405 - RNA, 15 nt, Mycobacterium bovis subsp bovis AF2122/97
gcugggagcggaugu

SEQ ID NO: 1160406 - RNA, 22 nt, Mycobacterium bovis subsp bovis AF2122/97
gcugggacgggcgcgucggcgu

SEQ ID NO: 1160407 - RNA, 16 nt, Mycobacterium bovis subsp bovis AF2122/97
gcuggcuugggccagc

SEQ ID NO: 1160408 - RNA, 20 nt, Mycobacterium bovis subsp bovis AF2122/97
gcuggcucaccgacaugacg

SEQ ID NO: 1160409 - RNA, 13 nt, Mycobacterium bovis subsp bovis AF2122/97
gcuggcuguggcu

SEQ ID NO: 1160410 - RNA, 20 nt, Mycobacterium bovis subsp bovis AF2122/97
gcuuaaggcccuggccgcgc

SEQ ID NO: 1160411 - RNA, 22 nt, Mycobacterium bovis subsp bovis AF2122/97
gcuuaacagcggguccuucugc

SEQ ID NO: 1160412 - RNA, 17 nt, Mycobacterium bovis subsp bovis AF2122/97
gcuuacaugcccugcgc

SEQ ID NO: 1160413 - RNA, 18 nt, Mycobacterium bovis subsp bovis AF2122/97
gcuuagcgcgggccuggc

SEQ ID NO: 1160414 - RNA, 20 nt, Mycobacterium bovis subsp bovis AF2122/97
gcuuagcgcgggccuggccc

SEQ ID NO: 1160415 - RNA, 15 nt, Mycobacterium bovis subsp bovis AF2122/97
gcuuagcggcuuggc

SEQ ID NO: 1160416 - RNA, 15 nt, Mycobacterium bovis subsp bovis AF2122/97
gcuuagcgcaugggc

SEQ ID NO: 1160417 - RNA, 18 nt, Mycobacterium bovis subsp bovis AF2122/97
gcuucaucccggagccgc

SEQ ID NO: 1160418 - RNA, 18 nt, Mycobacterium bovis subsp bovis AF2122/97
gcuucaggcgccacugcu

SEQ ID NO: 1160419 - RNA, 21 nt, Mycobacterium bovis subsp bovis AF2122/97
gcuuccaacucggcggccagc

SEQ ID NO: 1160420 - RNA, 17 nt, Mycobacterium bovis subsp bovis AF2122/97
gcuuccaacucggcggc

SEQ ID NO: 1160421 - RNA, 15 nt, Mycobacterium bovis subsp bovis AF2122/97
gcuucacagccacca

SEQ ID NO: 1160422 - RNA, 20 nt, Mycobacterium bovis subsp bovis AF2122/97
gcuucaagauuaccgaagcc

SEQ ID NO: 1160423 - RNA, 22 nt, Mycobacterium bovis subsp bovis AF2122/97
gcuucaagauuaccgaagcccg

SEQ ID NO: 1160424 - RNA, 20 nt, Mycobacterium bovis subsp bovis AF2122/97
gcuugacccacgagagcgcu

SEQ ID NO: 1160425 - RNA, 21 nt, Mycobacterium bovis subsp bovis AF2122/97
gcuugacccuugggcaccacc

SEQ ID NO: 1160426 - RNA, 21 nt, Mycobacterium bovis subsp bovis AF2122/97
gcuucugggcuuucugcaccc

SEQ ID NO: 1160427 - RNA, 22 nt, Mycobacterium bovis subsp bovis AF2122/97
gcuucugggguuggcucggcgc

SEQ ID NO: 1160428 - RNA, 22 nt, Mycobacterium bovis subsp bovis AF2122/97
gcuucuucggucaccucgaugc

SEQ ID NO: 1160429 - RNA, 20 nt, Mycobacterium bovis subsp bovis AF2122/97
gcuucuuguggauuguccga

SEQ ID NO: 1160430 - RNA, 15 nt, Mycobacterium bovis subsp bovis AF2122/97
gcuucugccugcgca

SEQ ID NO: 1160431 - RNA, 22 nt, Mycobacterium bovis subsp bovis AF2122/97
gcuucugcuacccgagccggca

SEQ ID NO: 1160432 - RNA, 16 nt, Mycobacterium bovis subsp bovis AF2122/97
gcuucuccuccagaga

SEQ ID NO: 1160433 - RNA, 20 nt, Mycobacterium bovis subsp bovis AF2122/97
gcuucucccgccacugcugg

SEQ ID NO: 1160434 - RNA, 12 nt, Mycobacterium bovis subsp bovis AF2122/97
gcuucuccucca

SEQ ID NO: 1160435 - RNA, 17 nt, Mycobacterium bovis subsp bovis AF2122/97
gcuucgucggccagcag

SEQ ID NO: 1160436 - RNA, 15 nt, Mycobacterium bovis subsp bovis AF2122/97
gcuucgucggccggc

SEQ ID NO: 1160437 - RNA, 21 nt, Mycobacterium bovis subsp bovis AF2122/97
gcuucgucggccggcacccca

SEQ ID NO: 1160438 - RNA, 21 nt, Mycobacterium bovis subsp bovis AF2122/97
gcuucgguucuguuccagaag

SEQ ID NO: 1160439 - RNA, 19 nt, Mycobacterium bovis subsp bovis AF2122/97
gcuucgcuaauacaccucc

SEQ ID NO: 1160440 - RNA, 18 nt, Mycobacterium bovis subsp bovis AF2122/97
gcuucggcggccgagcgc

SEQ ID NO: 1160441 - RNA, 23 nt, Mycobacterium bovis subsp bovis AF2122/97
gcuucggcaccgacugcugucac

SEQ ID NO: 1160442 - RNA, 17 nt, Mycobacterium bovis subsp bovis AF2122/97
gcuucgcccagagccgc

SEQ ID NO: 1160443 - RNA, 19 nt, Mycobacterium bovis subsp bovis AF2122/97
gcuucgccacaccaugauu

SEQ ID NO: 1160444 - RNA, 15 nt, Mycobacterium bovis subsp bovis AF2122/97
gcuucgaccguggug

SEQ ID NO: 1160445 - RNA, 22 nt, Mycobacterium bovis subsp bovis AF2122/97
gcuuccgcgcgcagaugagcgc

SEQ ID NO: 1160446 - RNA, 19 nt, Mycobacterium bovis subsp bovis AF2122/97
gcuuccgguccagcggccg

SEQ ID NO: 1160447 - RNA, 20 nt, Mycobacterium bovis subsp bovis AF2122/97
gcuuccgguccagcggccgc

SEQ ID NO: 1160448 - RNA, 18 nt, Mycobacterium bovis subsp bovis AF2122/97
gcuuccucgcgagcuccc

SEQ ID NO: 1160449 - RNA, 20 nt, Mycobacterium bovis subsp bovis AF2122/97
gcuuccagccacagcccggc

SEQ ID NO: 1160450 - RNA, 23 nt, Mycobacterium bovis subsp bovis AF2122/97
gcuucccuccagauaccaccgcc

SEQ ID NO: 1160451 - RNA, 21 nt, Mycobacterium bovis subsp bovis AF2122/97
gcuucccggaagcgccggccc

SEQ ID NO: 1160452 - RNA, 15 nt, Mycobacterium bovis subsp bovis AF2122/97
gcuugaucgccgagg

SEQ ID NO: 1160453 - RNA, 21 nt, Mycobacterium bovis subsp bovis AF2122/97
gcuugaucugggcugcggccg

SEQ ID NO: 1160454 - RNA, 17 nt, Mycobacterium bovis subsp bovis AF2122/97
gcuugcauugaggggcg

SEQ ID NO: 1160455 - RNA, 17 nt, Mycobacterium bovis subsp bovis AF2122/97
gcuugcaggcgaucugg

SEQ ID NO: 1160456 - RNA, 14 nt, Mycobacterium bovis subsp bovis AF2122/97
gcuugccccgccgu

SEQ ID NO: 1160457 - RNA, 13 nt, Mycobacterium bovis subsp bovis AF2122/97
gcuugccccgccu

SEQ ID NO: 1160458 - RNA, 18 nt, Mycobacterium bovis subsp bovis AF2122/97
gcuugcgaccccggcugc

SEQ ID NO: 1160459 - RNA, 15 nt, Mycobacterium bovis subsp bovis AF2122/97
gcuugcgcagcagcg

SEQ ID NO: 1160460 - RNA, 14 nt, Mycobacterium bovis subsp bovis AF2122/97
gcuugcgccgcagc

SEQ ID NO: 1160461 - RNA, 22 nt, Mycobacterium bovis subsp bovis AF2122/97
gcuugcgccgcccaugccucca

SEQ ID NO: 1160462 - RNA, 14 nt, Mycobacterium bovis subsp bovis AF2122/97
gcuugcgcggcuug

SEQ ID NO: 1160463 - RNA, 20 nt, Mycobacterium bovis subsp bovis AF2122/97
gcuugcggccgaauuccuca

SEQ ID NO: 1160464 - RNA, 14 nt, Mycobacterium bovis subsp bovis AF2122/97
gcuugcggccgcgc

SEQ ID NO: 1160465 - RNA, 22 nt, Mycobacterium bovis subsp bovis AF2122/97
gcuugcgcucguugguucagcu

SEQ ID NO: 1160466 - RNA, 13 nt, Mycobacterium bovis subsp bovis AF2122/97
gcuugcggcacaa

SEQ ID NO: 1160467 - RNA, 14 nt, Mycobacterium bovis subsp bovis AF2122/97
gcuugcggcaccca

SEQ ID NO: 1160468 - RNA, 23 nt, Mycobacterium bovis subsp bovis AF2122/97
gcuugcgggggaguagugguggg

SEQ ID NO: 1160469 - RNA, 21 nt, Mycobacterium bovis subsp bovis AF2122/97
gcuuggcaaccuguuccagcg

SEQ ID NO: 1160470 - RNA, 16 nt, Mycobacterium bovis subsp bovis AF2122/97
gcuuggaccagcgugg

SEQ ID NO: 1160471 - RNA, 19 nt, Mycobacterium bovis subsp bovis AF2122/97
gcuuggagaucgccgccgg

SEQ ID NO: 1160472 - RNA, 22 nt, Mycobacterium bovis subsp bovis AF2122/97
gcuuggugaacguuuccagcug

SEQ ID NO: 1160473 - RNA, 23 nt, Mycobacterium bovis subsp bovis AF2122/97
gcuuggugcccagcguggcuggc

SEQ ID NO: 1160474 - RNA, 19 nt, Mycobacterium bovis subsp bovis AF2122/97
gcuugguggcguggcccuc

SEQ ID NO: 1160475 - RNA, 15 nt, Mycobacterium bovis subsp bovis AF2122/97
gcuugggccaggccc

SEQ ID NO: 1160476 - RNA, 14 nt, Mycobacterium bovis subsp bovis AF2122/97
gcuugggccccuug

SEQ ID NO: 1160477 - RNA, 15 nt, Mycobacterium bovis subsp bovis AF2122/97
gcuugggccggugca

SEQ ID NO: 1160478 - RNA, 13 nt, Mycobacterium bovis subsp bovis AF2122/97
gcuugggccuggg

SEQ ID NO: 1160479 - RNA, 22 nt, Mycobacterium bovis subsp bovis AF2122/97
gcuuggcggcgaucaacucggg

SEQ ID NO: 1160480 - RNA, 23 nt, Mycobacterium bovis subsp bovis AF2122/97
gcuuggcggccagcgugucccaa

SEQ ID NO: 1160481 - RNA, 23 nt, Mycobacterium bovis subsp bovis AF2122/97
gcuuggcggucugcgccaaaauc

SEQ ID NO: 1160482 - RNA, 16 nt, Mycobacterium bovis subsp bovis AF2122/97
gcuuggcgugaccuac

SEQ ID NO: 1160483 - RNA, 18 nt, Mycobacterium bovis subsp bovis AF2122/97
gcuuggcuccacaauccu

SEQ ID NO: 1160484 - RNA, 19 nt, Mycobacterium bovis subsp bovis AF2122/97
gcuuggccagccacuccuc

SEQ ID NO: 1160485 - RNA, 23 nt, Mycobacterium bovis subsp bovis AF2122/97
gcuuggccgcgcaggcuuccagc

SEQ ID NO: 1160486 - RNA, 14 nt, Mycobacterium bovis subsp bovis AF2122/97
gcuuggccuaugcu

SEQ ID NO: 1160487 - RNA, 17 nt, Mycobacterium bovis subsp bovis AF2122/97
gcuuggccucagccacc

SEQ ID NO: 1160488 - RNA, 21 nt, Mycobacterium bovis subsp bovis AF2122/97
gcuuggcgaucucaccuggag

SEQ ID NO: 1160489 - RNA, 15 nt, Mycobacterium bovis subsp bovis AF2122/97
gcuugugacaccaca

SEQ ID NO: 1160490 - RNA, 22 nt, Mycobacterium bovis subsp bovis AF2122/97
gcuugugacaccacaucgggcc

SEQ ID NO: 1160491 - RNA, 18 nt, Mycobacterium bovis subsp bovis AF2122/97
gcuugucgguagguguca

SEQ ID NO: 1160492 - RNA, 14 nt, Mycobacterium bovis subsp bovis AF2122/97
gcuugucgagcagg

SEQ ID NO: 1160493 - RNA, 15 nt, Mycobacterium bovis subsp bovis AF2122/97
gcuugucagccgcga

SEQ ID NO: 1160494 - RNA, 20 nt, Mycobacterium bovis subsp bovis AF2122/97
gcuuuaaccgcgucaucacc

SEQ ID NO: 1160495 - RNA, 21 nt, Mycobacterium bovis subsp bovis AF2122/97
gcuuguuuuccaccagcgagc

SEQ ID NO: 1160496 - RNA, 14 nt, Mycobacterium bovis subsp bovis AF2122/97
gcuuguucaucauc

SEQ ID NO: 1160497 - RNA, 16 nt, Mycobacterium bovis subsp bovis AF2122/97
gcuuuggguccgggcg

SEQ ID NO: 1160498 - RNA, 14 nt, Mycobacterium bovis subsp bovis AF2122/97
gcuuugggcugccg

SEQ ID NO: 1160499 - RNA, 15 nt, Mycobacterium bovis subsp bovis AF2122/97
gcuuuggccgccgug

SEQ ID NO: 1160500 - RNA, 16 nt, Mycobacterium bovis subsp bovis AF2122/97
gcuuugguuagaggau

SEQ ID NO: 1160501 - RNA, 16 nt, Mycobacterium bovis subsp bovis AF2122/97
gcuuuuacgucugcuc

SEQ ID NO: 1160502 - RNA, 23 nt, Mycobacterium bovis subsp bovis AF2122/97
gcuuuuccggcguucccccacuc

SEQ ID NO: 1160503 - RNA, 18 nt, Mycobacterium bovis subsp bovis AF2122/97
gcuuucgcgugcggcugc

SEQ ID NO: 1160504 - RNA, 22 nt, Mycobacterium bovis subsp bovis AF2122/97
gcuuucgagugcagcggcgcag

SEQ ID NO: 1160505 - RNA, 22 nt, Mycobacterium bovis subsp bovis AF2122/97
gcuuucgauauagccgccggug

SEQ ID NO: 1160506 - RNA, 14 nt, Mycobacterium bovis subsp bovis AF2122/97
gcuuucgaagaacg

SEQ ID NO: 1160507 - RNA, 19 nt, Mycobacterium bovis subsp bovis AF2122/97
gcuuucugcacccgccagg

SEQ ID NO: 1160508 - RNA, 14 nt, Mycobacterium bovis subsp bovis AF2122/97
gcuuugagccgcuc

SEQ ID NO: 1160509 - RNA, 16 nt, Mycobacterium bovis subsp bovis AF2122/97
gcuuucuuggcgggcg

SEQ ID NO: 1160510 - RNA, 14 nt, Mycobacterium bovis subsp bovis AF2122/97
gcuuugcacugugg

SEQ ID NO: 1160511 - RNA, 14 nt, Mycobacterium bovis subsp bovis AF2122/97
gcuuugccaacaaa

SEQ ID NO: 1160512 - RNA, 15 nt, Mycobacterium bovis subsp bovis AF2122/97
gcuuugcacagcggc

SEQ ID NO: 1160513 - RNA, 19 nt, Mycobacterium bovis subsp bovis AF2122/97
ggaaacccggccgccgaga

SEQ ID NO: 1160514 - RNA, 14 nt, Mycobacterium bovis subsp bovis AF2122/97
ggaaacccugcacc

SEQ ID NO: 1160515 - RNA, 17 nt, Mycobacterium bovis subsp bovis AF2122/97
ggaaaccacagcgccau

SEQ ID NO: 1160516 - RNA, 15 nt, Mycobacterium bovis subsp bovis AF2122/97
ggaaacaccggcuug

SEQ ID NO: 1160517 - RNA, 17 nt, Mycobacterium bovis subsp bovis AF2122/97
ggaaaccgcugggggcg

SEQ ID NO: 1160518 - RNA, 15 nt, Mycobacterium bovis subsp bovis AF2122/97
ggaaaccggccagcc

SEQ ID NO: 1160519 - RNA, 17 nt, Mycobacterium bovis subsp bovis AF2122/97
ggaaacggagccgagcc

SEQ ID NO: 1160520 - RNA, 21 nt, Mycobacterium bovis subsp bovis AF2122/97
ggaaacggagccgagccgaua

SEQ ID NO: 1160521 - RNA, 20 nt, Mycobacterium bovis subsp bovis AF2122/97
ggaaaggcuuccgcgugcga

SEQ ID NO: 1160522 - RNA, 15 nt, Mycobacterium bovis subsp bovis AF2122/97
ggaacagccuauucc

SEQ ID NO: 1160523 - RNA, 15 nt, Mycobacterium bovis subsp bovis AF2122/97
ggaacaccaccaggc

SEQ ID NO: 1160524 - RNA, 17 nt, Mycobacterium bovis subsp bovis AF2122/97
ggaaccagcggucggcg

SEQ ID NO: 1160525 - RNA, 19 nt, Mycobacterium bovis subsp bovis AF2122/97
ggaaccaccaguaccaccg

SEQ ID NO: 1160526 - RNA, 18 nt, Mycobacterium bovis subsp bovis AF2122/97
ggaaccacucgcucagga

SEQ ID NO: 1160527 - RNA, 17 nt, Mycobacterium bovis subsp bovis AF2122/97
ggaaccagaugaacccc

SEQ ID NO: 1160528 - RNA, 14 nt, Mycobacterium bovis subsp bovis AF2122/97
ggaacccccagcug

SEQ ID NO: 1160529 - RNA, 19 nt, Mycobacterium bovis subsp bovis AF2122/97
ggaacccgagcuugggccg

SEQ ID NO: 1160530 - RNA, 20 nt, Mycobacterium bovis subsp bovis AF2122/97
ggaaccgaucggucgaucga

SEQ ID NO: 1160531 - RNA, 16 nt, Mycobacterium bovis subsp bovis AF2122/97
ggaacccagcacuggg

SEQ ID NO: 1160532 - RNA, 23 nt, Mycobacterium bovis subsp bovis AF2122/97
ggaaccgacaucccaacccauga

SEQ ID NO: 1160533 - RNA, 17 nt, Mycobacterium bovis subsp bovis AF2122/97
ggaaccgguaucgccaa

SEQ ID NO: 1160534 - RNA, 20 nt, Mycobacterium bovis subsp bovis AF2122/97
ggaacgaaugucaccccgcc

SEQ ID NO: 1160535 - RNA, 24 nt, Mycobacterium bovis subsp bovis AF2122/97
ggaacgaaugucaccccgcccagc

SEQ ID NO: 1160536 - RNA, 20 nt, Mycobacterium bovis subsp bovis AF2122/97
ggaaccuugaccgaccagcu

SEQ ID NO: 1160537 - RNA, 17 nt, Mycobacterium bovis subsp bovis AF2122/97
ggaacgagccacgccag

SEQ ID NO: 1160538 - RNA, 21 nt, Mycobacterium bovis subsp bovis AF2122/97
ggaacgaugccgccggcgggc

SEQ ID NO: 1160539 - RNA, 17 nt, Mycobacterium bovis subsp bovis AF2122/97
ggaaauugcgcaaauag

SEQ ID NO: 1160540 - RNA, 19 nt, Mycobacterium bovis subsp bovis AF2122/97
ggaacaaguagccgucguc

SEQ ID NO: 1160541 - RNA, 20 nt, Mycobacterium bovis subsp bovis AF2122/97
ggaacaacgcgcaaccagcc

SEQ ID NO: 1160542 - RNA, 16 nt, Mycobacterium bovis subsp bovis AF2122/97
ggaaaucggacgacuc

SEQ ID NO: 1160543 - RNA, 17 nt, Mycobacterium bovis subsp bovis AF2122/97
ggaacugcaugguggcg

SEQ ID NO: 1160544 - RNA, 21 nt, Mycobacterium bovis subsp bovis AF2122/97
ggaacuggaccggugccagca

SEQ ID NO: 1160545 - RNA, 13 nt, Mycobacterium bovis subsp bovis AF2122/97
ggaacgccgagca

SEQ ID NO: 1160546 - RNA, 15 nt, Mycobacterium bovis subsp bovis AF2122/97
ggaacgcuaggcgau

SEQ ID NO: 1160547 - RNA, 14 nt, Mycobacterium bovis subsp bovis AF2122/97
ggaacguccagccg

SEQ ID NO: 1160548 - RNA, 18 nt, Mycobacterium bovis subsp bovis AF2122/97
ggaacguccagccguggc

SEQ ID NO: 1160549 - RNA, 13 nt, Mycobacterium bovis subsp bovis AF2122/97
ggaacggccagga

SEQ ID NO: 1160550 - RNA, 11 nt, Mycobacterium bovis subsp bovis AF2122/97
ggaagccgacc

SEQ ID NO: 1160551 - RNA, 17 nt, Mycobacterium bovis subsp bovis AF2122/97
ggaagccgcaccgcugu

SEQ ID NO: 1160552 - RNA, 15 nt, Mycobacterium bovis subsp bovis AF2122/97
ggaaggaaccgggca

SEQ ID NO: 1160553 - RNA, 17 nt, Mycobacterium bovis subsp bovis AF2122/97
ggaagcgguugacccac

SEQ ID NO: 1160554 - RNA, 21 nt, Mycobacterium bovis subsp bovis AF2122/97
ggaagcgguugacccacagca

SEQ ID NO: 1160555 - RNA, 23 nt, Mycobacterium bovis subsp bovis AF2122/97
ggaagcgcaaugcgcgacgguca

SEQ ID NO: 1160556 - RNA, 13 nt, Mycobacterium bovis subsp bovis AF2122/97
ggaagcggcggcc

SEQ ID NO: 1160557 - RNA, 23 nt, Mycobacterium bovis subsp bovis AF2122/97
ggaagaucacgcgucgugccacu

SEQ ID NO: 1160558 - RNA, 22 nt, Mycobacterium bovis subsp bovis AF2122/97
ggaauggcgccggccggcgcgg

SEQ ID NO: 1160559 - RNA, 17 nt, Mycobacterium bovis subsp bovis AF2122/97
ggaaugggcgccacagc

SEQ ID NO: 1160560 - RNA, 21 nt, Mycobacterium bovis subsp bovis AF2122/97
ggaaucagugaagacaccagg

SEQ ID NO: 1160561 - RNA, 16 nt, Mycobacterium bovis subsp bovis AF2122/97
ggaaucccgagucugc

SEQ ID NO: 1160562 - RNA, 12 nt, Mycobacterium bovis subsp bovis AF2122/97
ggaaggagaucc

SEQ ID NO: 1160563 - RNA, 17 nt, Mycobacterium bovis subsp bovis AF2122/97
ggaaggcucaccacggu

SEQ ID NO: 1160564 - RNA, 22 nt, Mycobacterium bovis subsp bovis AF2122/97
ggaauguugcgagugagcucag

SEQ ID NO: 1160565 - RNA, 13 nt, Mycobacterium bovis subsp bovis AF2122/97
ggacacuccugca

SEQ ID NO: 1160566 - RNA, 21 nt, Mycobacterium bovis subsp bovis AF2122/97
ggacacuccugcacacaggac

SEQ ID NO: 1160567 - RNA, 20 nt, Mycobacterium bovis subsp bovis AF2122/97
ggacaccuuccccaaacuau

SEQ ID NO: 1160568 - RNA, 20 nt, Mycobacterium bovis subsp bovis AF2122/97
ggacaccaacccacccccca

SEQ ID NO: 1160569 - RNA, 18 nt, Mycobacterium bovis subsp bovis AF2122/97
ggacacauugaccaggug

SEQ ID NO: 1160570 - RNA, 19 nt, Mycobacterium bovis subsp bovis AF2122/97
ggacacagcguccgucguc

SEQ ID NO: 1160571 - RNA, 18 nt, Mycobacterium bovis subsp bovis AF2122/97
ggagacguuuugcggccc

SEQ ID NO: 1160572 - RNA, 14 nt, Mycobacterium bovis subsp bovis AF2122/97
ggagacccgggugc

SEQ ID NO: 1160573 - RNA, 19 nt, Mycobacterium bovis subsp bovis AF2122/97
ggagacaccgcaacgcgug

SEQ ID NO: 1160574 - RNA, 18 nt, Mycobacterium bovis subsp bovis AF2122/97
ggagacgaucgccaggcc

SEQ ID NO: 1160575 - RNA, 24 nt, Mycobacterium bovis subsp bovis AF2122/97
ggagaaguucgugagcgaacgggc

SEQ ID NO: 1160576 - RNA, 23 nt, Mycobacterium bovis subsp bovis AF2122/97
ggacggcauagcagccagcgucc

SEQ ID NO: 1160577 - RNA, 22 nt, Mycobacterium bovis subsp bovis AF2122/97
ggacgcugauugcgaccgcgcc

SEQ ID NO: 1160578 - RNA, 17 nt, Mycobacterium bovis subsp bovis AF2122/97
ggacgcuuggguagccu

SEQ ID NO: 1160579 - RNA, 15 nt, Mycobacterium bovis subsp bovis AF2122/97
ggacguuucagccgg

SEQ ID NO: 1160580 - RNA, 16 nt, Mycobacterium bovis subsp bovis AF2122/97
ggacguuucagccggg

SEQ ID NO: 1160581 - RNA, 18 nt, Mycobacterium bovis subsp bovis AF2122/97
ggacguuucagccgggug

SEQ ID NO: 1160582 - RNA, 18 nt, Mycobacterium bovis subsp bovis AF2122/97
ggacuaccgccggcggcg

SEQ ID NO: 1160583 - RNA, 18 nt, Mycobacterium bovis subsp bovis AF2122/97
ggacauccgggccgagcg

SEQ ID NO: 1160584 - RNA, 16 nt, Mycobacterium bovis subsp bovis AF2122/97
ggacgccgcgccggcg

SEQ ID NO: 1160585 - RNA, 12 nt, Mycobacterium bovis subsp bovis AF2122/97
ggacgcgagugc

SEQ ID NO: 1160586 - RNA, 13 nt, Mycobacterium bovis subsp bovis AF2122/97
ggacagggcggcg

SEQ ID NO: 1160587 - RNA, 22 nt, Mycobacterium bovis subsp bovis AF2122/97
ggacagggcggcaacggcggca

SEQ ID NO: 1160588 - RNA, 21 nt, Mycobacterium bovis subsp bovis AF2122/97
ggacaggucgaaugggggcug

SEQ ID NO: 1160589 - RNA, 15 nt, Mycobacterium bovis subsp bovis AF2122/97
ggacaggucgcccaa

SEQ ID NO: 1160590 - RNA, 12 nt, Mycobacterium bovis subsp bovis AF2122/97
ggacagggugcg

SEQ ID NO: 1160591 - RNA, 17 nt, Mycobacterium bovis subsp bovis AF2122/97
ggacaggucgggcagca

SEQ ID NO: 1160592 - RNA, 12 nt, Mycobacterium bovis subsp bovis AF2122/97
ggagcagggcuc

SEQ ID NO: 1160593 - RNA, 14 nt, Mycobacterium bovis subsp bovis AF2122/97
ggagcccggcggcc

SEQ ID NO: 1160594 - RNA, 16 nt, Mycobacterium bovis subsp bovis AF2122/97
ggagcccguccaggcc

SEQ ID NO: 1160595 - RNA, 16 nt, Mycobacterium bovis subsp bovis AF2122/97
ggagcccugaccgggg

SEQ ID NO: 1160596 - RNA, 19 nt, Mycobacterium bovis subsp bovis AF2122/97
ggagccgcccaagccgccg

SEQ ID NO: 1160597 - RNA, 18 nt, Mycobacterium bovis subsp bovis AF2122/97
ggagccgccggccccgcc

SEQ ID NO: 1160598 - RNA, 21 nt, Mycobacterium bovis subsp bovis AF2122/97
ggagccacugcggcauggcag

SEQ ID NO: 1160599 - RNA, 22 nt, Mycobacterium bovis subsp bovis AF2122/97
ggagcccggcauuaggccgggg

SEQ ID NO: 1160600 - RNA, 21 nt, Mycobacterium bovis subsp bovis AF2122/97
ggagcccgagcucgccgcagc

SEQ ID NO: 1160601 - RNA, 22 nt, Mycobacterium bovis subsp bovis AF2122/97
ggagccgucgcaucaggucggu

SEQ ID NO: 1160602 - RNA, 13 nt, Mycobacterium bovis subsp bovis AF2122/97
ggagccgccggcg

SEQ ID NO: 1160603 - RNA, 19 nt, Mycobacterium bovis subsp bovis AF2122/97
ggagccuccagcgcaccgg

SEQ ID NO: 1160604 - RNA, 13 nt, Mycobacterium bovis subsp bovis AF2122/97
ggagccggccacc

SEQ ID NO: 1160605 - RNA, 22 nt, Mycobacterium bovis subsp bovis AF2122/97
ggagcgugucggccggccaggu

SEQ ID NO: 1160606 - RNA, 16 nt, Mycobacterium bovis subsp bovis AF2122/97
ggagcuauucgguguc

SEQ ID NO: 1160607 - RNA, 21 nt, Mycobacterium bovis subsp bovis AF2122/97
ggagcucuugcgggcagccgc

SEQ ID NO: 1160608 - RNA, 22 nt, Mycobacterium bovis subsp bovis AF2122/97
ggagcucuugcgggcagccgcc

SEQ ID NO: 1160609 - RNA, 21 nt, Mycobacterium bovis subsp bovis AF2122/97
ggagggcgagcaacucgucca

SEQ ID NO: 1160610 - RNA, 21 nt, Mycobacterium bovis subsp bovis AF2122/97
ggaggucaaaaucagggugcc

SEQ ID NO: 1160611 - RNA, 13 nt, Mycobacterium bovis subsp bovis AF2122/97
ggaggucaaauca

SEQ ID NO: 1160612 - RNA, 17 nt, Mycobacterium bovis subsp bovis AF2122/97
ggaggcguugcacugcu

SEQ ID NO: 1160613 - RNA, 13 nt, Mycobacterium bovis subsp bovis AF2122/97
ggaguugaagaag

SEQ ID NO: 1160614 - RNA, 15 nt, Mycobacterium bovis subsp bovis AF2122/97
ggaggugcgccgcgg

SEQ ID NO: 1160615 - RNA, 20 nt, Mycobacterium bovis subsp bovis AF2122/97
ggaggugaaccccgccggca

SEQ ID NO: 1160616 - RNA, 13 nt, Mycobacterium bovis subsp bovis AF2122/97
ggaguuuccgaag

SEQ ID NO: 1160617 - RNA, 19 nt, Mycobacterium bovis subsp bovis AF2122/97
ggaguuuuucgggguggcg

SEQ ID NO: 1160618 - RNA, 12 nt, Mycobacterium bovis subsp bovis AF2122/97
ggauaacccagc

SEQ ID NO: 1160619 - RNA, 19 nt, Mycobacterium bovis subsp bovis AF2122/97
ggauaacccagcaccacaa

SEQ ID NO: 1160620 - RNA, 12 nt, Mycobacterium bovis subsp bovis AF2122/97
ggauccagcagg

SEQ ID NO: 1160621 - RNA, 12 nt, Mycobacterium bovis subsp bovis AF2122/97
ggaucccagccc

SEQ ID NO: 1160622 - RNA, 21 nt, Mycobacterium bovis subsp bovis AF2122/97
ggaucauccuucgccggcgcc

SEQ ID NO: 1160623 - RNA, 19 nt, Mycobacterium bovis subsp bovis AF2122/97
ggauccaccacgcuggccu

SEQ ID NO: 1160624 - RNA, 12 nt, Mycobacterium bovis subsp bovis AF2122/97
ggaucccgccgc

SEQ ID NO: 1160625 - RNA, 15 nt, Mycobacterium bovis subsp bovis AF2122/97
ggaucccggccgggu

SEQ ID NO: 1160626 - RNA, 13 nt, Mycobacterium bovis subsp bovis AF2122/97
ggauccggcggca

SEQ ID NO: 1160627 - RNA, 16 nt, Mycobacterium bovis subsp bovis AF2122/97
ggauccgcaccacgcc

SEQ ID NO: 1160628 - RNA, 14 nt, Mycobacterium bovis subsp bovis AF2122/97
ggaucgccugagcg

SEQ ID NO: 1160629 - RNA, 15 nt, Mycobacterium bovis subsp bovis AF2122/97
ggaucgcggcggcgu

SEQ ID NO: 1160630 - RNA, 17 nt, Mycobacterium bovis subsp bovis AF2122/97
ggaucgccaccggcgcc

SEQ ID NO: 1160631 - RNA, 13 nt, Mycobacterium bovis subsp bovis AF2122/97
ggaucgccaggcc

SEQ ID NO: 1160632 - RNA, 15 nt, Mycobacterium bovis subsp bovis AF2122/97
ggaucgcccaggcgc

SEQ ID NO: 1160633 - RNA, 19 nt, Mycobacterium bovis subsp bovis AF2122/97
ggauccgggcgugguggau

SEQ ID NO: 1160634 - RNA, 18 nt, Mycobacterium bovis subsp bovis AF2122/97
ggauccuccggguuggcg

SEQ ID NO: 1160635 - RNA, 18 nt, Mycobacterium bovis subsp bovis AF2122/97
ggaucgaagaccagcaac

SEQ ID NO: 1160636 - RNA, 15 nt, Mycobacterium bovis subsp bovis AF2122/97
ggaucgaccaugguc

SEQ ID NO: 1160637 - RNA, 19 nt, Mycobacterium bovis subsp bovis AF2122/97
ggaucgaccauggucgauu

SEQ ID NO: 1160638 - RNA, 17 nt, Mycobacterium bovis subsp bovis AF2122/97
ggaucgaccgccagcgc

SEQ ID NO: 1160639 - RNA, 22 nt, Mycobacterium bovis subsp bovis AF2122/97
ggaucgacuucgacgacacguu

SEQ ID NO: 1160640 - RNA, 15 nt, Mycobacterium bovis subsp bovis AF2122/97
ggaucagcccgcgca

SEQ ID NO: 1160641 - RNA, 17 nt, Mycobacterium bovis subsp bovis AF2122/97
ggaucagcgugucgccg

SEQ ID NO: 1160642 - RNA, 17 nt, Mycobacterium bovis subsp bovis AF2122/97
ggaucaucgccgcggcc

SEQ ID NO: 1160643 - RNA, 16 nt, Mycobacterium bovis subsp bovis AF2122/97
ggaucagaacgcggcc

SEQ ID NO: 1160644 - RNA, 14 nt, Mycobacterium bovis subsp bovis AF2122/97
ggauacccagcgcc

SEQ ID NO: 1160645 - RNA, 20 nt, Mycobacterium bovis subsp bovis AF2122/97
ggauaccgcugggucgccgu

SEQ ID NO: 1160646 - RNA, 20 nt, Mycobacterium bovis subsp bovis AF2122/97
ggauaccgucaugggcggcu

SEQ ID NO: 1160647 - RNA, 15 nt, Mycobacterium bovis subsp bovis AF2122/97
ggauaucacgacgcc

SEQ ID NO: 1160648 - RNA, 17 nt, Mycobacterium bovis subsp bovis AF2122/97
ggaugcgacagcgcugg

SEQ ID NO: 1160649 - RNA, 23 nt, Mycobacterium bovis subsp bovis AF2122/97
ggaugcgauggccgacgcugcug

SEQ ID NO: 1160650 - RNA, 19 nt, Mycobacterium bovis subsp bovis AF2122/97
ggaugcggccccaugcgcc

SEQ ID NO: 1160651 - RNA, 20 nt, Mycobacterium bovis subsp bovis AF2122/97
ggaugaauuuggugaaguga

SEQ ID NO: 1160652 - RNA, 16 nt, Mycobacterium bovis subsp bovis AF2122/97
ggaugaccaccgguuc

SEQ ID NO: 1160653 - RNA, 15 nt, Mycobacterium bovis subsp bovis AF2122/97
ggaugacgcccaggg

SEQ ID NO: 1160654 - RNA, 15 nt, Mycobacterium bovis subsp bovis AF2122/97
ggaugccggucggcg

SEQ ID NO: 1160655 - RNA, 13 nt, Mycobacterium bovis subsp bovis AF2122/97
ggaucgugccggc

SEQ ID NO: 1160656 - RNA, 14 nt, Mycobacterium bovis subsp bovis AF2122/97
ggaucgugccggcg

SEQ ID NO: 1160657 - RNA, 18 nt, Mycobacterium bovis subsp bovis AF2122/97
ggaucggcaccccacgcc

SEQ ID NO: 1160658 - RNA, 20 nt, Mycobacterium bovis subsp bovis AF2122/97
ggaucuugccgcugguggug

SEQ ID NO: 1160659 - RNA, 22 nt, Mycobacterium bovis subsp bovis AF2122/97
ggaucuagaggcggcccccggc

SEQ ID NO: 1160660 - RNA, 15 nt, Mycobacterium bovis subsp bovis AF2122/97
ggaugucgucgacca

SEQ ID NO: 1160661 - RNA, 22 nt, Mycobacterium bovis subsp bovis AF2122/97
ggaugucgacgagcaccgcgcc

SEQ ID NO: 1160662 - RNA, 19 nt, Mycobacterium bovis subsp bovis AF2122/97
ggaugucgagcguggcgac

SEQ ID NO: 1160663 - RNA, 17 nt, Mycobacterium bovis subsp bovis AF2122/97
ggaugucucggcaccac

SEQ ID NO: 1160664 - RNA, 17 nt, Mycobacterium bovis subsp bovis AF2122/97
ggaugcugucagcagcc

SEQ ID NO: 1160665 - RNA, 14 nt, Mycobacterium bovis subsp bovis AF2122/97
ggaugcucgaucca

SEQ ID NO: 1160666 - RNA, 15 nt, Mycobacterium bovis subsp bovis AF2122/97
ggaugcucgauccac

SEQ ID NO: 1160667 - RNA, 19 nt, Mycobacterium bovis subsp bovis AF2122/97
ggaugcugagcgccaggcc

SEQ ID NO: 1160668 - RNA, 18 nt, Mycobacterium bovis subsp bovis AF2122/97
ggauuccgcacccccguc

SEQ ID NO: 1160669 - RNA, 21 nt, Mycobacterium bovis subsp bovis AF2122/97
ggauucgaagccgagcuccuc

SEQ ID NO: 1160670 - RNA, 17 nt, Mycobacterium bovis subsp bovis AF2122/97
ggccgacaccgccacca

SEQ ID NO: 1160671 - RNA, 17 nt, Mycobacterium bovis subsp bovis AF2122/97
ggccgacacgccgaugc

SEQ ID NO: 1160672 - RNA, 17 nt, Mycobacterium bovis subsp bovis AF2122/97
ggccgacaacccggccg

SEQ ID NO: 1160673 - RNA, 23 nt, Mycobacterium bovis subsp bovis AF2122/97
ggccgacacgccgaugccgaacu

SEQ ID NO: 1160674 - RNA, 23 nt, Mycobacterium bovis subsp bovis AF2122/97
ggccgaacgacggguccgggcca

SEQ ID NO: 1160675 - RNA, 21 nt, Mycobacterium bovis subsp bovis AF2122/97
ggccgaagcccgaucggcggg

SEQ ID NO: 1160676 - RNA, 20 nt, Mycobacterium bovis subsp bovis AF2122/97
ggcccugcuccucgcgggcg

SEQ ID NO: 1160677 - RNA, 17 nt, Mycobacterium bovis subsp bovis AF2122/97
ggccgaacccaccacga

SEQ ID NO: 1160678 - RNA, 16 nt, Mycobacterium bovis subsp bovis AF2122/97
ggcccugccgccggcc

SEQ ID NO: 1160679 - RNA, 15 nt, Mycobacterium bovis subsp bovis AF2122/97
ggcccugagcugccg

SEQ ID NO: 1160680 - RNA, 18 nt, Mycobacterium bovis subsp bovis AF2122/97
ggcccuccacugcgagcg

SEQ ID NO: 1160681 - RNA, 19 nt, Mycobacterium bovis subsp bovis AF2122/97
ggcccuccacugcgagcgc

SEQ ID NO: 1160682 - RNA, 13 nt, Mycobacterium bovis subsp bovis AF2122/97
ggcccucgccaga

SEQ ID NO: 1160683 - RNA, 13 nt, Mycobacterium bovis subsp bovis AF2122/97
ggcccuccucggu

SEQ ID NO: 1160684 - RNA, 18 nt, Mycobacterium bovis subsp bovis AF2122/97
ggcccggacgucggcggc

SEQ ID NO: 1160685 - RNA, 21 nt, Mycobacterium bovis subsp bovis AF2122/97
ggcccgcucccugcacccagc

SEQ ID NO: 1160686 - RNA, 22 nt, Mycobacterium bovis subsp bovis AF2122/97
ggcccgcucgggguugcucgcg

SEQ ID NO: 1160687 - RNA, 14 nt, Mycobacterium bovis subsp bovis AF2122/97
ggcccggcaggacu

SEQ ID NO: 1160688 - RNA, 22 nt, Mycobacterium bovis subsp bovis AF2122/97
ggcccgcuccacggucaggcgu

SEQ ID NO: 1160689 - RNA, 14 nt, Mycobacterium bovis subsp bovis AF2122/97
ggcccgcucccugc

SEQ ID NO: 1160690 - RNA, 15 nt, Mycobacterium bovis subsp bovis AF2122/97
ggccgagcgcaccgc

SEQ ID NO: 1160691 - RNA, 22 nt, Mycobacterium bovis subsp bovis AF2122/97
ggccgagcgcaccacggcgguc

SEQ ID NO: 1160692 - RNA, 21 nt, Mycobacterium bovis subsp bovis AF2122/97
ggccgagcggagacuccagca

SEQ ID NO: 1160693 - RNA, 19 nt, Mycobacterium bovis subsp bovis AF2122/97
ggccgauacgaagccgccg

SEQ ID NO: 1160694 - RNA, 19 nt, Mycobacterium bovis subsp bovis AF2122/97
ggccgaucaccccggugga

SEQ ID NO: 1160695 - RNA, 20 nt, Mycobacterium bovis subsp bovis AF2122/97
ggccgcaacugcagguucuu

SEQ ID NO: 1160696 - RNA, 21 nt, Mycobacterium bovis subsp bovis AF2122/97
ggccgcaaucaugucagcgcu

SEQ ID NO: 1160697 - RNA, 19 nt, Mycobacterium bovis subsp bovis AF2122/97
ggcccgaucgaccgcugga

SEQ ID NO: 1160698 - RNA, 23 nt, Mycobacterium bovis subsp bovis AF2122/97
ggccccgccguuuccgccgccgc

SEQ ID NO: 1160699 - RNA, 13 nt, Mycobacterium bovis subsp bovis AF2122/97
ggccccgggaagu

SEQ ID NO: 1160700 - RNA, 14 nt, Mycobacterium bovis subsp bovis AF2122/97
ggcccgcaacgcgu

SEQ ID NO: 1160701 - RNA, 15 nt, Mycobacterium bovis subsp bovis AF2122/97
ggcccgaugaccggu

SEQ ID NO: 1160702 - RNA, 21 nt, Mycobacterium bovis subsp bovis AF2122/97
ggcccgauugaguucggcggc

SEQ ID NO: 1160703 - RNA, 19 nt, Mycobacterium bovis subsp bovis AF2122/97
ggcccgcacguuggcggcc

SEQ ID NO: 1160704 - RNA, 23 nt, Mycobacterium bovis subsp bovis AF2122/97
ggcccgcagcccgccgggcucca

SEQ ID NO: 1160705 - RNA, 15 nt, Mycobacterium bovis subsp bovis AF2122/97
ggcccgcauccgcac

SEQ ID NO: 1160706 - RNA, 14 nt, Mycobacterium bovis subsp bovis AF2122/97
ggcccgcagcgugu

SEQ ID NO: 1160707 - RNA, 20 nt, Mycobacterium bovis subsp bovis AF2122/97
ggcccgccagaacggcgucg

SEQ ID NO: 1160708 - RNA, 22 nt, Mycobacterium bovis subsp bovis AF2122/97
ggcccgccaaaaacgccccggc

SEQ ID NO: 1160709 - RNA, 20 nt, Mycobacterium bovis subsp bovis AF2122/97
ggcccgccacaacggcggcg

SEQ ID NO: 1160710 - RNA, 22 nt, Mycobacterium bovis subsp bovis AF2122/97
ggcccgccacaacggcggcgca

SEQ ID NO: 1160711 - RNA, 18 nt, Mycobacterium bovis subsp bovis AF2122/97
ggcccgccagcagggcca

SEQ ID NO: 1160712 - RNA, 13 nt, Mycobacterium bovis subsp bovis AF2122/97
ggcccgccagccc

SEQ ID NO: 1160713 - RNA, 16 nt, Mycobacterium bovis subsp bovis AF2122/97
ggcccgccagcccagc

SEQ ID NO: 1160714 - RNA, 12 nt, Mycobacterium bovis subsp bovis AF2122/97
ggccccgccagc

SEQ ID NO: 1160715 - RNA, 15 nt, Mycobacterium bovis subsp bovis AF2122/97
ggccccgccagcgcc

SEQ ID NO: 1160716 - RNA, 14 nt, Mycobacterium bovis subsp bovis AF2122/97
ggccccgaucccga

SEQ ID NO: 1160717 - RNA, 20 nt, Mycobacterium bovis subsp bovis AF2122/97
ggccccgccgaugccgccgg

SEQ ID NO: 1160718 - RNA, 13 nt, Mycobacterium bovis subsp bovis AF2122/97
ggccccgccggcc

SEQ ID NO: 1160719 - RNA, 15 nt, Mycobacterium bovis subsp bovis AF2122/97
ggccccgccggcccc

SEQ ID NO: 1160720 - RNA, 13 nt, Mycobacterium bovis subsp bovis AF2122/97
ggccccgcggagc

SEQ ID NO: 1160721 - RNA, 22 nt, Mycobacterium bovis subsp bovis AF2122/97
ggccccgcggccagcaccgggg

SEQ ID NO: 1160722 - RNA, 14 nt, Mycobacterium bovis subsp bovis AF2122/97
ggccccgcggcgcc

SEQ ID NO: 1160723 - RNA, 20 nt, Mycobacterium bovis subsp bovis AF2122/97
ggccccgcggcgccgccacg

SEQ ID NO: 1160724 - RNA, 23 nt, Mycobacterium bovis subsp bovis AF2122/97
ggccccgccgucgccgccggcuc

SEQ ID NO: 1160725 - RNA, 19 nt, Mycobacterium bovis subsp bovis AF2122/97
ggccccgccguugccgccg

SEQ ID NO: 1160726 - RNA, 21 nt, Mycobacterium bovis subsp bovis AF2122/97
ggccccgccggccccgccguc

SEQ ID NO: 1160727 - RNA, 15 nt, Mycobacterium bovis subsp bovis AF2122/97
ggccccaccggugcc

SEQ ID NO: 1160728 - RNA, 17 nt, Mycobacterium bovis subsp bovis AF2122/97
ggcccccaagaccaagu

SEQ ID NO: 1160729 - RNA, 16 nt, Mycobacterium bovis subsp bovis AF2122/97
ggcccccucggcguga

SEQ ID NO: 1160730 - RNA, 17 nt, Mycobacterium bovis subsp bovis AF2122/97
ggccccccggggccgca

SEQ ID NO: 1160731 - RNA, 20 nt, Mycobacterium bovis subsp bovis AF2122/97
ggccccgacacagcggcggg

SEQ ID NO: 1160732 - RNA, 13 nt, Mycobacterium bovis subsp bovis AF2122/97
ggcccccaguucg

SEQ ID NO: 1160733 - RNA, 13 nt, Mycobacterium bovis subsp bovis AF2122/97
ggccccccgcgcc

SEQ ID NO: 1160734 - RNA, 17 nt, Mycobacterium bovis subsp bovis AF2122/97
ggccccccgcgccugcc

SEQ ID NO: 1160735 - RNA, 19 nt, Mycobacterium bovis subsp bovis AF2122/97
ggccccccgcgccugccuc

SEQ ID NO: 1160736 - RNA, 14 nt, Mycobacterium bovis subsp bovis AF2122/97
ggcccagccgagcg

SEQ ID NO: 1160737 - RNA, 17 nt, Mycobacterium bovis subsp bovis AF2122/97
ggcccagccgagcggcg

SEQ ID NO: 1160738 - RNA, 11 nt, Mycobacterium bovis subsp bovis AF2122/97
ggcccagcgcg

SEQ ID NO: 1160739 - RNA, 18 nt, Mycobacterium bovis subsp bovis AF2122/97
ggcccagcgcgccagcuu

SEQ ID NO: 1160740 - RNA, 14 nt, Mycobacterium bovis subsp bovis AF2122/97
ggcccagcggccgc

SEQ ID NO: 1160741 - RNA, 15 nt, Mycobacterium bovis subsp bovis AF2122/97
ggcccagcggccgcg

SEQ ID NO: 1160742 - RNA, 20 nt, Mycobacterium bovis subsp bovis AF2122/97
ggcccagcaggucgucggcg

SEQ ID NO: 1160743 - RNA, 16 nt, Mycobacterium bovis subsp bovis AF2122/97
ggcccacggcagcgcc

SEQ ID NO: 1160744 - RNA, 20 nt, Mycobacterium bovis subsp bovis AF2122/97
ggcccagcaaccgcucggcg

SEQ ID NO: 1160745 - RNA, 19 nt, Mycobacterium bovis subsp bovis AF2122/97
ggcccacucucgccacgcc

SEQ ID NO: 1160746 - RNA, 22 nt, Mycobacterium bovis subsp bovis AF2122/97
ggcccagguugccuuggcggcc

SEQ ID NO: 1160747 - RNA, 21 nt, Mycobacterium bovis subsp bovis AF2122/97
ggcccaggacagcagccgccg

SEQ ID NO: 1160748 - RNA, 17 nt, Mycobacterium bovis subsp bovis AF2122/97
ggcccauaacagcuggc

SEQ ID NO: 1160749 - RNA, 22 nt, Mycobacterium bovis subsp bovis AF2122/97
ggcccaucuucggacgccagcu

SEQ ID NO: 1160750 - RNA, 22 nt, Mycobacterium bovis subsp bovis AF2122/97
ggccccaagcgugcugccgccu

SEQ ID NO: 1160751 - RNA, 20 nt, Mycobacterium bovis subsp bovis AF2122/97
ggccagcuugcggagccgcc

SEQ ID NO: 1160752 - RNA, 24 nt, Mycobacterium bovis subsp bovis AF2122/97
ggccaggaucgcuacgucgaccga

SEQ ID NO: 1160753 - RNA, 20 nt, Mycobacterium bovis subsp bovis AF2122/97
ggccaggaugaagacgcggg

SEQ ID NO: 1160754 - RNA, 20 nt, Mycobacterium bovis subsp bovis AF2122/97
ggccaggauaaguccggaca

SEQ ID NO: 1160755 - RNA, 14 nt, Mycobacterium bovis subsp bovis AF2122/97
ggccaggcccagcu

SEQ ID NO: 1160756 - RNA, 19 nt, Mycobacterium bovis subsp bovis AF2122/97
ggccaggcccucgacggcg

SEQ ID NO: 1160757 - RNA, 16 nt, Mycobacterium bovis subsp bovis AF2122/97
ggccagggcgguggcc

SEQ ID NO: 1160758 - RNA, 20 nt, Mycobacterium bovis subsp bovis AF2122/97
ggccagguaauugccgaccg

SEQ ID NO: 1160759 - RNA, 21 nt, Mycobacterium bovis subsp bovis AF2122/97
ggccagguaauugccgaccgc

SEQ ID NO: 1160760 - RNA, 13 nt, Mycobacterium bovis subsp bovis AF2122/97
ggccagcgcggcg

SEQ ID NO: 1160761 - RNA, 19 nt, Mycobacterium bovis subsp bovis AF2122/97
ggccagcgcggcgcgcggg

SEQ ID NO: 1160762 - RNA, 21 nt, Mycobacterium bovis subsp bovis AF2122/97
ggccagcgcggcgcgcggggc

SEQ ID NO: 1160763 - RNA, 21 nt, Mycobacterium bovis subsp bovis AF2122/97
ggccagcgcucaccggcgucg

SEQ ID NO: 1160764 - RNA, 13 nt, Mycobacterium bovis subsp bovis AF2122/97
ggccagcggcagc

SEQ ID NO: 1160765 - RNA, 14 nt, Mycobacterium bovis subsp bovis AF2122/97
ggccagcggcagcc

SEQ ID NO: 1160766 - RNA, 12 nt, Mycobacterium bovis subsp bovis AF2122/97
ggccagcugcgu

SEQ ID NO: 1160767 - RNA, 13 nt, Mycobacterium bovis subsp bovis AF2122/97
ggccagcgcgccc

SEQ ID NO: 1160768 - RNA, 15 nt, Mycobacterium bovis subsp bovis AF2122/97
ggccagcgcgcccgc

SEQ ID NO: 1160769 - RNA, 15 nt, Mycobacterium bovis subsp bovis AF2122/97
ggccagcgcgcgcgg

SEQ ID NO: 1160770 - RNA, 13 nt, Mycobacterium bovis subsp bovis AF2122/97
ggccagcccgagc

SEQ ID NO: 1160771 - RNA, 17 nt, Mycobacterium bovis subsp bovis AF2122/97
ggccagccagcgggcga

SEQ ID NO: 1160772 - RNA, 12 nt, Mycobacterium bovis subsp bovis AF2122/97
ggccagcccagc

SEQ ID NO: 1160773 - RNA, 15 nt, Mycobacterium bovis subsp bovis AF2122/97
ggccaggucgagcac

SEQ ID NO: 1160774 - RNA, 18 nt, Mycobacterium bovis subsp bovis AF2122/97
ggccaggucagccgcgcg

SEQ ID NO: 1160775 - RNA, 16 nt, Mycobacterium bovis subsp bovis AF2122/97
ggccaggucggccacc

SEQ ID NO: 1160776 - RNA, 16 nt, Mycobacterium bovis subsp bovis AF2122/97
ggccaguucggcggcc

SEQ ID NO: 1160777 - RNA, 21 nt, Mycobacterium bovis subsp bovis AF2122/97
ggccaguucggcggccgccgc

SEQ ID NO: 1160778 - RNA, 16 nt, Mycobacterium bovis subsp bovis AF2122/97
ggccaguucggugagc

SEQ ID NO: 1160779 - RNA, 17 nt, Mycobacterium bovis subsp bovis AF2122/97
ggccaucacggucagcu

SEQ ID NO: 1160780 - RNA, 20 nt, Mycobacterium bovis subsp bovis AF2122/97
ggccaguugguagccgcccu

SEQ ID NO: 1160781 - RNA, 21 nt, Mycobacterium bovis subsp bovis AF2122/97
ggccaugcuggucagcggcgc

SEQ ID NO: 1160782 - RNA, 18 nt, Mycobacterium bovis subsp bovis AF2122/97
ggccauggcagcgcgcug

SEQ ID NO: 1160783 - RNA, 14 nt, Mycobacterium bovis subsp bovis AF2122/97
ggccaugcucgcca

SEQ ID NO: 1160784 - RNA, 16 nt, Mycobacterium bovis subsp bovis AF2122/97
ggccauguccaccagc

SEQ ID NO: 1160785 - RNA, 15 nt, Mycobacterium bovis subsp bovis AF2122/97
ggccauggcggcgcc

SEQ ID NO: 1160786 - RNA, 17 nt, Mycobacterium bovis subsp bovis AF2122/97
ggccaugucagcggccu

SEQ ID NO: 1160787 - RNA, 20 nt, Mycobacterium bovis subsp bovis AF2122/97
ggccagagucgcccgcacac

SEQ ID NO: 1160788 - RNA, 16 nt, Mycobacterium bovis subsp bovis AF2122/97
ggccagagccgcgcgc

SEQ ID NO: 1160789 - RNA, 16 nt, Mycobacterium bovis subsp bovis AF2122/97
ggccagagucgcccgc

SEQ ID NO: 1160790 - RNA, 16 nt, Mycobacterium bovis subsp bovis AF2122/97
ggccagaucgaagcgc

SEQ ID NO: 1160791 - RNA, 16 nt, Mycobacterium bovis subsp bovis AF2122/97
ggccacggcgucggcc

SEQ ID NO: 1160792 - RNA, 19 nt, Mycobacterium bovis subsp bovis AF2122/97
ggccacggcuuugcggcgc

SEQ ID NO: 1160793 - RNA, 17 nt, Mycobacterium bovis subsp bovis AF2122/97
ggccacggggcugccgg

SEQ ID NO: 1160794 - RNA, 16 nt, Mycobacterium bovis subsp bovis AF2122/97
ggccacggggcugccg

SEQ ID NO: 1160795 - RNA, 14 nt, Mycobacterium bovis subsp bovis AF2122/97
ggccacgcccaggc

SEQ ID NO: 1160796 - RNA, 23 nt, Mycobacterium bovis subsp bovis AF2122/97
ggccacgcuucuuccgcgcgccg

SEQ ID NO: 1160797 - RNA, 20 nt, Mycobacterium bovis subsp bovis AF2122/97
ggccacggaaguaucgccgg

SEQ ID NO: 1160798 - RNA, 22 nt, Mycobacterium bovis subsp bovis AF2122/97
ggccacggaaguaucgccggcc

SEQ ID NO: 1160799 - RNA, 15 nt, Mycobacterium bovis subsp bovis AF2122/97
ggccagcagugcggu

SEQ ID NO: 1160800 - RNA, 14 nt, Mycobacterium bovis subsp bovis AF2122/97
ggccagcaggcggc

SEQ ID NO: 1160801 - RNA, 12 nt, Mycobacterium bovis subsp bovis AF2122/97
ggccagcaggua

SEQ ID NO: 1160802 - RNA, 20 nt, Mycobacterium bovis subsp bovis AF2122/97
ggccagcaucagcgccagcg

SEQ ID NO: 1160803 - RNA, 13 nt, Mycobacterium bovis subsp bovis AF2122/97
ggccagccacagc

SEQ ID NO: 1160804 - RNA, 23 nt, Mycobacterium bovis subsp bovis AF2122/97
ggccagcaggaugaugaccgcca

SEQ ID NO: 1160805 - RNA, 15 nt, Mycobacterium bovis subsp bovis AF2122/97
ggccagcaccacggc

SEQ ID NO: 1160806 - RNA, 23 nt, Mycobacterium bovis subsp bovis AF2122/97
ggccagcaccacggccagcgggu

SEQ ID NO: 1160807 - RNA, 14 nt, Mycobacterium bovis subsp bovis AF2122/97
ggccagaucgccgg

SEQ ID NO: 1160808 - RNA, 20 nt, Mycobacterium bovis subsp bovis AF2122/97
ggccagcacaccgucgacga

SEQ ID NO: 1160809 - RNA, 16 nt, Mycobacterium bovis subsp bovis AF2122/97
ggccaccgcccagugc

SEQ ID NO: 1160810 - RNA, 14 nt, Mycobacterium bovis subsp bovis AF2122/97
ggccaccggcgguc

SEQ ID NO: 1160811 - RNA, 16 nt, Mycobacterium bovis subsp bovis AF2122/97
ggccaccggcggucug

SEQ ID NO: 1160812 - RNA, 13 nt, Mycobacterium bovis subsp bovis AF2122/97
ggccaccggcguc

SEQ ID NO: 1160813 - RNA, 14 nt, Mycobacterium bovis subsp bovis AF2122/97
ggccaccggcgacc

SEQ ID NO: 1160814 - RNA, 21 nt, Mycobacterium bovis subsp bovis AF2122/97
ggccaccggcgucugcccgcc

SEQ ID NO: 1160815 - RNA, 18 nt, Mycobacterium bovis subsp bovis AF2122/97
ggccacgccagcucgccg

SEQ ID NO: 1160816 - RNA, 14 nt, Mycobacterium bovis subsp bovis AF2122/97
ggccaccgccgccg

SEQ ID NO: 1160817 - RNA, 19 nt, Mycobacterium bovis subsp bovis AF2122/97
ggccaccgccgccugcccg

SEQ ID NO: 1160818 - RNA, 13 nt, Mycobacterium bovis subsp bovis AF2122/97
ggccaccgcagac

SEQ ID NO: 1160819 - RNA, 20 nt, Mycobacterium bovis subsp bovis AF2122/97
ggccaccgaacgcggccacc

SEQ ID NO: 1160820 - RNA, 24 nt, Mycobacterium bovis subsp bovis AF2122/97
ggccacccgcaggucgcaccacag

SEQ ID NO: 1160821 - RNA, 21 nt, Mycobacterium bovis subsp bovis AF2122/97
ggccaccccgagcucaccaag

SEQ ID NO: 1160822 - RNA, 17 nt, Mycobacterium bovis subsp bovis AF2122/97
ggccaccaucgccgccg

SEQ ID NO: 1160823 - RNA, 19 nt, Mycobacterium bovis subsp bovis AF2122/97
ggccaccaguuguccggcu

SEQ ID NO: 1160824 - RNA, 19 nt, Mycobacterium bovis subsp bovis AF2122/97
ggccaccaggggaccgcgg

SEQ ID NO: 1160825 - RNA, 14 nt, Mycobacterium bovis subsp bovis AF2122/97
ggccaccagaacca

SEQ ID NO: 1160826 - RNA, 18 nt, Mycobacterium bovis subsp bovis AF2122/97
ggccaccagcgcccggcc

SEQ ID NO: 1160827 - RNA, 13 nt, Mycobacterium bovis subsp bovis AF2122/97
ggcaugucgccga

SEQ ID NO: 1160828 - RNA, 19 nt, Mycobacterium bovis subsp bovis AF2122/97
ggcauguuccuugcggccg

SEQ ID NO: 1160829 - RNA, 12 nt, Mycobacterium bovis subsp bovis AF2122/97
ggccaccacugc

SEQ ID NO: 1160830 - RNA, 21 nt, Mycobacterium bovis subsp bovis AF2122/97
ggcauuaccacuucggcgucc

SEQ ID NO: 1160831 - RNA, 21 nt, Mycobacterium bovis subsp bovis AF2122/97
ggccaccaccgcgccgucguc

SEQ ID NO: 1160832 - RNA, 14 nt, Mycobacterium bovis subsp bovis AF2122/97
ggcacgccggcggc

SEQ ID NO: 1160833 - RNA, 20 nt, Mycobacterium bovis subsp bovis AF2122/97
ggcacgccgaccgguggcac

SEQ ID NO: 1160834 - RNA, 21 nt, Mycobacterium bovis subsp bovis AF2122/97
ggcacgucgcccccggccaug

SEQ ID NO: 1160835 - RNA, 22 nt, Mycobacterium bovis subsp bovis AF2122/97
ggcacguccgaucggcgcgccg

SEQ ID NO: 1160836 - RNA, 21 nt, Mycobacterium bovis subsp bovis AF2122/97
ggcacguggcgaccggcgacc

SEQ ID NO: 1160837 - RNA, 18 nt, Mycobacterium bovis subsp bovis AF2122/97
ggcacguucagccaggcg

SEQ ID NO: 1160838 - RNA, 17 nt, Mycobacterium bovis subsp bovis AF2122/97
ggcacgcacaaguucuu

SEQ ID NO: 1160839 - RNA, 21 nt, Mycobacterium bovis subsp bovis AF2122/97
ggcacgacgccggccuggccg

SEQ ID NO: 1160840 - RNA, 16 nt, Mycobacterium bovis subsp bovis AF2122/97
ggcacgcccacagcug

SEQ ID NO: 1160841 - RNA, 14 nt, Mycobacterium bovis subsp bovis AF2122/97
ggcacgaucgccaa

SEQ ID NO: 1160842 - RNA, 17 nt, Mycobacterium bovis subsp bovis AF2122/97
ggcaccgagucuaagga

SEQ ID NO: 1160843 - RNA, 21 nt, Mycobacterium bovis subsp bovis AF2122/97
ggcaccgaucggugccggccu

SEQ ID NO: 1160844 - RNA, 13 nt, Mycobacterium bovis subsp bovis AF2122/97
ggcaccgccagcc

SEQ ID NO: 1160845 - RNA, 14 nt, Mycobacterium bovis subsp bovis AF2122/97
ggcaccgccgcccc

SEQ ID NO: 1160846 - RNA, 13 nt, Mycobacterium bovis subsp bovis AF2122/97
ggcaccgccgccc

SEQ ID NO: 1160847 - RNA, 19 nt, Mycobacterium bovis subsp bovis AF2122/97
ggcaccgccggcuccgccg

SEQ ID NO: 1160848 - RNA, 15 nt, Mycobacterium bovis subsp bovis AF2122/97
ggcaccgccggcgcc

SEQ ID NO: 1160849 - RNA, 16 nt, Mycobacterium bovis subsp bovis AF2122/97
ggcaccgccgguggcg

SEQ ID NO: 1160850 - RNA, 20 nt, Mycobacterium bovis subsp bovis AF2122/97
ggcaccgccgguggcgccgg

SEQ ID NO: 1160851 - RNA, 21 nt, Mycobacterium bovis subsp bovis AF2122/97
ggcaccgccgguggcgccggg

SEQ ID NO: 1160852 - RNA, 22 nt, Mycobacterium bovis subsp bovis AF2122/97
ggcaccgccgcccccgccggcc

SEQ ID NO: 1160853 - RNA, 19 nt, Mycobacterium bovis subsp bovis AF2122/97
ggcaccgcugccgcugccg

SEQ ID NO: 1160854 - RNA, 15 nt, Mycobacterium bovis subsp bovis AF2122/97
ggcaccgcuucaggc

SEQ ID NO: 1160855 - RNA, 16 nt, Mycobacterium bovis subsp bovis AF2122/97
ggcaccgcgcgcucca

SEQ ID NO: 1160856 - RNA, 15 nt, Mycobacterium bovis subsp bovis AF2122/97
ggcaccgcggccagc

SEQ ID NO: 1160857 - RNA, 15 nt, Mycobacterium bovis subsp bovis AF2122/97
ggcaccgcggccgcg

SEQ ID NO: 1160858 - RNA, 16 nt, Mycobacterium bovis subsp bovis AF2122/97
ggcacgaccgcucccg

SEQ ID NO: 1160859 - RNA, 17 nt, Mycobacterium bovis subsp bovis AF2122/97
ggcacgaccgcucccgg

SEQ ID NO: 1160860 - RNA, 18 nt, Mycobacterium bovis subsp bovis AF2122/97
ggcacacccaucaccgcc

SEQ ID NO: 1160861 - RNA, 21 nt, Mycobacterium bovis subsp bovis AF2122/97
ggcacacccuccacagcggcc

SEQ ID NO: 1160862 - RNA, 22 nt, Mycobacterium bovis subsp bovis AF2122/97
ggcacacggccuugccgaucag

SEQ ID NO: 1160863 - RNA, 23 nt, Mycobacterium bovis subsp bovis AF2122/97
ggcacacgaguacagaucgaggg

SEQ ID NO: 1160864 - RNA, 23 nt, Mycobacterium bovis subsp bovis AF2122/97
ggcaccaccaagcucggccagca

SEQ ID NO: 1160865 - RNA, 21 nt, Mycobacterium bovis subsp bovis AF2122/97
ggcaccacccgauuggccaac

SEQ ID NO: 1160866 - RNA, 19 nt, Mycobacterium bovis subsp bovis AF2122/97
ggcaccagcggcaccgcgg

SEQ ID NO: 1160867 - RNA, 11 nt, Mycobacterium bovis subsp bovis AF2122/97
ggcaccagguu

SEQ ID NO: 1160868 - RNA, 17 nt, Mycobacterium bovis subsp bovis AF2122/97
ggcaccagcgcgcgccg

SEQ ID NO: 1160869 - RNA, 16 nt, Mycobacterium bovis subsp bovis AF2122/97
ggcaccagcagccagc

SEQ ID NO: 1160870 - RNA, 21 nt, Mycobacterium bovis subsp bovis AF2122/97
ggcaccaauaccgcacccgcu

SEQ ID NO: 1160871 - RNA, 17 nt, Mycobacterium bovis subsp bovis AF2122/97
ggcacaugcgcguccag

SEQ ID NO: 1160872 - RNA, 19 nt, Mycobacterium bovis subsp bovis AF2122/97
ggcacauugaucgacggcc

SEQ ID NO: 1160873 - RNA, 20 nt, Mycobacterium bovis subsp bovis AF2122/97
ggcacauugaucgacggcca

SEQ ID NO: 1160874 - RNA, 22 nt, Mycobacterium bovis subsp bovis AF2122/97
ggcacauugaucgacggccagc

SEQ ID NO: 1160875 - RNA, 14 nt, Mycobacterium bovis subsp bovis AF2122/97
ggcagacccgagcg

SEQ ID NO: 1160876 - RNA, 12 nt, Mycobacterium bovis subsp bovis AF2122/97
ggcagacacgcu

SEQ ID NO: 1160877 - RNA, 18 nt, Mycobacterium bovis subsp bovis AF2122/97
ggcagacacgcugcaggc

SEQ ID NO: 1160878 - RNA, 22 nt, Mycobacterium bovis subsp bovis AF2122/97
ggcagacacgcugcaggcggcc

SEQ ID NO: 1160879 - RNA, 16 nt, Mycobacterium bovis subsp bovis AF2122/97
ggcagacaucugggug

SEQ ID NO: 1160880 - RNA, 19 nt, Mycobacterium bovis subsp bovis AF2122/97
ggcagacauggcaagucaa

SEQ ID NO: 1160881 - RNA, 13 nt, Mycobacterium bovis subsp bovis AF2122/97
ggcagagccgacu

SEQ ID NO: 1160882 - RNA, 12 nt, Mycobacterium bovis subsp bovis AF2122/97
ggcagagccgcc

SEQ ID NO: 1160883 - RNA, 20 nt, Mycobacterium bovis subsp bovis AF2122/97
ggcacuacgcagccguagcu

SEQ ID NO: 1160884 - RNA, 19 nt, Mycobacterium bovis subsp bovis AF2122/97
ggcacguugugaucgucag

SEQ ID NO: 1160885 - RNA, 19 nt, Mycobacterium bovis subsp bovis AF2122/97
ggcacgccgggcaucggcg

SEQ ID NO: 1160886 - RNA, 13 nt, Mycobacterium bovis subsp bovis AF2122/97
ggcacugcccagc

SEQ ID NO: 1160887 - RNA, 15 nt, Mycobacterium bovis subsp bovis AF2122/97
ggcacugacgcgccc

SEQ ID NO: 1160888 - RNA, 20 nt, Mycobacterium bovis subsp bovis AF2122/97
ggcacuccagcggcgggggc

SEQ ID NO: 1160889 - RNA, 21 nt, Mycobacterium bovis subsp bovis AF2122/97
ggcacucccggaguggccagu

SEQ ID NO: 1160890 - RNA, 14 nt, Mycobacterium bovis subsp bovis AF2122/97
ggcagauggucucg

SEQ ID NO: 1160891 - RNA, 18 nt, Mycobacterium bovis subsp bovis AF2122/97
ggcagauucuucacccaa

SEQ ID NO: 1160892 - RNA, 19 nt, Mycobacterium bovis subsp bovis AF2122/97
ggcagcaaaaaccagcguc

SEQ ID NO: 1160893 - RNA, 23 nt, Mycobacterium bovis subsp bovis AF2122/97
ggcagagccgccguugccgccgg

SEQ ID NO: 1160894 - RNA, 14 nt, Mycobacterium bovis subsp bovis AF2122/97
ggcagcagcgggcg

SEQ ID NO: 1160895 - RNA, 16 nt, Mycobacterium bovis subsp bovis AF2122/97
ggcagcagcgggcgcg

SEQ ID NO: 1160896 - RNA, 22 nt, Mycobacterium bovis subsp bovis AF2122/97
ggcagcagcgcaacggccagcg

SEQ ID NO: 1160897 - RNA, 19 nt, Mycobacterium bovis subsp bovis AF2122/97
ggcagcagcggugcagccc

SEQ ID NO: 1160898 - RNA, 23 nt, Mycobacterium bovis subsp bovis AF2122/97
ggcagcagcggugcagcccgccg

SEQ ID NO: 1160899 - RNA, 21 nt, Mycobacterium bovis subsp bovis AF2122/97
ggcagcagcggugcagcccgc

SEQ ID NO: 1160900 - RNA, 18 nt, Mycobacterium bovis subsp bovis AF2122/97
ggcagcaggacaccuacc

SEQ ID NO: 1160901 - RNA, 23 nt, Mycobacterium bovis subsp bovis AF2122/97
ggcagcaucuccgucggccaggc

SEQ ID NO: 1160902 - RNA, 21 nt, Mycobacterium bovis subsp bovis AF2122/97
ggcagcagcgcaacggccagc

SEQ ID NO: 1160903 - RNA, 20 nt, Mycobacterium bovis subsp bovis AF2122/97
ggcagcacggucugggucuu

SEQ ID NO: 1160904 - RNA, 11 nt, Mycobacterium bovis subsp bovis AF2122/97
ggcagcacguc

SEQ ID NO: 1160905 - RNA, 24 nt, Mycobacterium bovis subsp bovis AF2122/97
ggcagcacuuggacccggccggcc

SEQ ID NO: 1160906 - RNA, 12 nt, Mycobacterium bovis subsp bovis AF2122/97
ggcagcacaggc

SEQ ID NO: 1160907 - RNA, 15 nt, Mycobacterium bovis subsp bovis AF2122/97
ggcagcacaggcugg

SEQ ID NO: 1160908 - RNA, 18 nt, Mycobacterium bovis subsp bovis AF2122/97
ggcagccgcgccgcggcc

SEQ ID NO: 1160909 - RNA, 19 nt, Mycobacterium bovis subsp bovis AF2122/97
ggcagccgcgccgcggccc

SEQ ID NO: 1160910 - RNA, 14 nt, Mycobacterium bovis subsp bovis AF2122/97
ggcagccgcgccgc

SEQ ID NO: 1160911 - RNA, 13 nt, Mycobacterium bovis subsp bovis AF2122/97
ggcagccgcccgc

SEQ ID NO: 1160912 - RNA, 16 nt, Mycobacterium bovis subsp bovis AF2122/97
ggcagccgcccgccag

SEQ ID NO: 1160913 - RNA, 13 nt, Mycobacterium bovis subsp bovis AF2122/97
ggcagcccggcgg

SEQ ID NO: 1160914 - RNA, 22 nt, Mycobacterium bovis subsp bovis AF2122/97
ggcagcccaaagcgccagcagc

SEQ ID NO: 1160915 - RNA, 15 nt, Mycobacterium bovis subsp bovis AF2122/97
ggcagccagcggcga

SEQ ID NO: 1160916 - RNA, 14 nt, Mycobacterium bovis subsp bovis AF2122/97
ggcagccaccagcg

SEQ ID NO: 1160917 - RNA, 15 nt, Mycobacterium bovis subsp bovis AF2122/97
ggcaggccggcgucg

SEQ ID NO: 1160918 - RNA, 14 nt, Mycobacterium bovis subsp bovis AF2122/97
ggcaggcccgacgg

SEQ ID NO: 1160919 - RNA, 19 nt, Mycobacterium bovis subsp bovis AF2122/97
ggcaggcccgacggcgccc

SEQ ID NO: 1160920 - RNA, 18 nt, Mycobacterium bovis subsp bovis AF2122/97
ggcaggccuggcgagcca

SEQ ID NO: 1160921 - RNA, 12 nt, Mycobacterium bovis subsp bovis AF2122/97
ggcaggccggcu

SEQ ID NO: 1160922 - RNA, 23 nt, Mycobacterium bovis subsp bovis AF2122/97
ggcaggccggcucgccgacccgc

SEQ ID NO: 1160923 - RNA, 17 nt, Mycobacterium bovis subsp bovis AF2122/97
ggcaggccucggcgccg

SEQ ID NO: 1160924 - RNA, 19 nt, Mycobacterium bovis subsp bovis AF2122/97
ggcaggccggcgucgauca

SEQ ID NO: 1160925 - RNA, 13 nt, Mycobacterium bovis subsp bovis AF2122/97
ggcaggccgggca

SEQ ID NO: 1160926 - RNA, 14 nt, Mycobacterium bovis subsp bovis AF2122/97
ggcaggcagguugg

SEQ ID NO: 1160927 - RNA, 20 nt, Mycobacterium bovis subsp bovis AF2122/97
ggcaggagaacacauccgcu

SEQ ID NO: 1160928 - RNA, 13 nt, Mycobacterium bovis subsp bovis AF2122/97
ggcaggaucgccu

SEQ ID NO: 1160929 - RNA, 20 nt, Mycobacterium bovis subsp bovis AF2122/97
ggcaggaucgccugagcgcc

SEQ ID NO: 1160930 - RNA, 17 nt, Mycobacterium bovis subsp bovis AF2122/97
ggcaggccauccgggcu

SEQ ID NO: 1160931 - RNA, 16 nt, Mycobacterium bovis subsp bovis AF2122/97
ggcagcuuggacucau

SEQ ID NO: 1160932 - RNA, 19 nt, Mycobacterium bovis subsp bovis AF2122/97
ggcaggaaacucagguccg

SEQ ID NO: 1160933 - RNA, 18 nt, Mycobacterium bovis subsp bovis AF2122/97
ggcagcuucucgccgacg

SEQ ID NO: 1160934 - RNA, 23 nt, Mycobacterium bovis subsp bovis AF2122/97
ggcagcuugcagugccgccggcc

SEQ ID NO: 1160935 - RNA, 22 nt, Mycobacterium bovis subsp bovis AF2122/97
ggcagcucccgccacgucgccg

SEQ ID NO: 1160936 - RNA, 14 nt, Mycobacterium bovis subsp bovis AF2122/97
ggcagcuccgccgc

SEQ ID NO: 1160937 - RNA, 21 nt, Mycobacterium bovis subsp bovis AF2122/97
ggcagcuccucgcgcucgccg

SEQ ID NO: 1160938 - RNA, 22 nt, Mycobacterium bovis subsp bovis AF2122/97
ggcagcuccucgcgcucgccgg

SEQ ID NO: 1160939 - RNA, 14 nt, Mycobacterium bovis subsp bovis AF2122/97
ggcagcugggcagg

SEQ ID NO: 1160940 - RNA, 22 nt, Mycobacterium bovis subsp bovis AF2122/97
ggcagcuggucggugggcuugc

SEQ ID NO: 1160941 - RNA, 17 nt, Mycobacterium bovis subsp bovis AF2122/97
ggcagcuucaacaccgg

SEQ ID NO: 1160942 - RNA, 19 nt, Mycobacterium bovis subsp bovis AF2122/97
ggcagcgcccagaucgccg

SEQ ID NO: 1160943 - RNA, 21 nt, Mycobacterium bovis subsp bovis AF2122/97
ggcagcgcacccggucggcgg

SEQ ID NO: 1160944 - RNA, 14 nt, Mycobacterium bovis subsp bovis AF2122/97
ggcagcgcgaucga

SEQ ID NO: 1160945 - RNA, 12 nt, Mycobacterium bovis subsp bovis AF2122/97
ggcagcgcggca

SEQ ID NO: 1160946 - RNA, 16 nt, Mycobacterium bovis subsp bovis AF2122/97
ggcagcgacgccggcc

SEQ ID NO: 1160947 - RNA, 16 nt, Mycobacterium bovis subsp bovis AF2122/97
ggcagcgaccgucguc

SEQ ID NO: 1160948 - RNA, 18 nt, Mycobacterium bovis subsp bovis AF2122/97
ggcagcgaccgucgucca

SEQ ID NO: 1160949 - RNA, 19 nt, Mycobacterium bovis subsp bovis AF2122/97
ggcagccgaagcgcccguu

SEQ ID NO: 1160950 - RNA, 21 nt, Mycobacterium bovis subsp bovis AF2122/97
ggcagccggcggagaaggcga

SEQ ID NO: 1160951 - RNA, 13 nt, Mycobacterium bovis subsp bovis AF2122/97
ggcagccugcugc

SEQ ID NO: 1160952 - RNA, 16 nt, Mycobacterium bovis subsp bovis AF2122/97
ggcagccugcugcaca

SEQ ID NO: 1160953 - RNA, 20 nt, Mycobacterium bovis subsp bovis AF2122/97
ggcagcggaccgcugccugc

SEQ ID NO: 1160954 - RNA, 15 nt, Mycobacterium bovis subsp bovis AF2122/97
ggcagcgcggccggg

SEQ ID NO: 1160955 - RNA, 17 nt, Mycobacterium bovis subsp bovis AF2122/97
ggcagcgcggccgggcg

SEQ ID NO: 1160956 - RNA, 15 nt, Mycobacterium bovis subsp bovis AF2122/97
ggcagcgcggccagu

SEQ ID NO: 1160957 - RNA, 15 nt, Mycobacterium bovis subsp bovis AF2122/97
ggcagcgcggccacc

SEQ ID NO: 1160958 - RNA, 12 nt, Mycobacterium bovis subsp bovis AF2122/97
ggcagcggcggu

SEQ ID NO: 1160959 - RNA, 15 nt, Mycobacterium bovis subsp bovis AF2122/97
ggcagcggcgcgcug

SEQ ID NO: 1160960 - RNA, 22 nt, Mycobacterium bovis subsp bovis AF2122/97
ggcagcgguguagccggcgccg

SEQ ID NO: 1160961 - RNA, 13 nt, Mycobacterium bovis subsp bovis AF2122/97
ggcagcgggacug

SEQ ID NO: 1160962 - RNA, 19 nt, Mycobacterium bovis subsp bovis AF2122/97
ggcagcgggacugcggaag

SEQ ID NO: 1160963 - RNA, 14 nt, Mycobacterium bovis subsp bovis AF2122/97
ggcauggugguggc

SEQ ID NO: 1160964 - RNA, 21 nt, Mycobacterium bovis subsp bovis AF2122/97
ggcauggucaggcggccgucg

SEQ ID NO: 1160965 - RNA, 17 nt, Mycobacterium bovis subsp bovis AF2122/97
ggcaugggccggcgccg

SEQ ID NO: 1160966 - RNA, 13 nt, Mycobacterium bovis subsp bovis AF2122/97
ggcauggucaggc

SEQ ID NO: 1160967 - RNA, 15 nt, Mycobacterium bovis subsp bovis AF2122/97
ggcauggucaggcgg

SEQ ID NO: 1160968 - RNA, 22 nt, Mycobacterium bovis subsp bovis AF2122/97
ggcaugggcccugcacagcagc

SEQ ID NO: 1160969 - RNA, 20 nt, Mycobacterium bovis subsp bovis AF2122/97
ggcaugcgacagaugccggg

SEQ ID NO: 1160970 - RNA, 13 nt, Mycobacterium bovis subsp bovis AF2122/97
ggcauggcggcgu

SEQ ID NO: 1160971 - RNA, 17 nt, Mycobacterium bovis subsp bovis AF2122/97
ggcaucgagacgagcca

SEQ ID NO: 1160972 - RNA, 18 nt, Mycobacterium bovis subsp bovis AF2122/97
ggcaucgagacgagccac

SEQ ID NO: 1160973 - RNA, 17 nt, Mycobacterium bovis subsp bovis AF2122/97
ggcaucgcgagccagcu

SEQ ID NO: 1160974 - RNA, 17 nt, Mycobacterium bovis subsp bovis AF2122/97
ggcaucgcgcgcggcuc

SEQ ID NO: 1160975 - RNA, 13 nt, Mycobacterium bovis subsp bovis AF2122/97
ggcaucggcggca

SEQ ID NO: 1160976 - RNA, 20 nt, Mycobacterium bovis subsp bovis AF2122/97
ggcaucggcggcaagggugg

SEQ ID NO: 1160977 - RNA, 22 nt, Mycobacterium bovis subsp bovis AF2122/97
ggcaucggagauacgggccacc

SEQ ID NO: 1160978 - RNA, 14 nt, Mycobacterium bovis subsp bovis AF2122/97
ggcaucggccaucu

SEQ ID NO: 1160979 - RNA, 20 nt, Mycobacterium bovis subsp bovis AF2122/97
ggcaucggcggcgucuucgu

SEQ ID NO: 1160980 - RNA, 13 nt, Mycobacterium bovis subsp bovis AF2122/97
ggcaucggugcgg

SEQ ID NO: 1160981 - RNA, 14 nt, Mycobacterium bovis subsp bovis AF2122/97
ggcaucgucgccga

SEQ ID NO: 1160982 - RNA, 21 nt, Mycobacterium bovis subsp bovis AF2122/97
ggcaugcaaugcuggcggcgc

SEQ ID NO: 1160983 - RNA, 15 nt, Mycobacterium bovis subsp bovis AF2122/97
ggcaggcggccgccg

SEQ ID NO: 1160984 - RNA, 16 nt, Mycobacterium bovis subsp bovis AF2122/97
ggcaggcggccgccgg

SEQ ID NO: 1160985 - RNA, 14 nt, Mycobacterium bovis subsp bovis AF2122/97
ggcaggcggccagc

SEQ ID NO: 1160986 - RNA, 15 nt, Mycobacterium bovis subsp bovis AF2122/97
ggcaggcggccagcg

SEQ ID NO: 1160987 - RNA, 17 nt, Mycobacterium bovis subsp bovis AF2122/97
ggcaggcggugaacacc

SEQ ID NO: 1160988 - RNA, 20 nt, Mycobacterium bovis subsp bovis AF2122/97
ggcaggcuaaucagccaggc

SEQ ID NO: 1160989 - RNA, 21 nt, Mycobacterium bovis subsp bovis AF2122/97
ggcaguagcuguggcccgcgg

SEQ ID NO: 1160990 - RNA, 14 nt, Mycobacterium bovis subsp bovis AF2122/97
ggcagucccagcgc

SEQ ID NO: 1160991 - RNA, 21 nt, Mycobacterium bovis subsp bovis AF2122/97
ggcaguccaccgcgcggcgca

SEQ ID NO: 1160992 - RNA, 19 nt, Mycobacterium bovis subsp bovis AF2122/97
ggcauaccgaacagcaccu

SEQ ID NO: 1160993 - RNA, 16 nt, Mycobacterium bovis subsp bovis AF2122/97
ggcauacauccaggcu

SEQ ID NO: 1160994 - RNA, 19 nt, Mycobacterium bovis subsp bovis AF2122/97
gcgcgcagccgggcaccga

SEQ ID NO: 1160995 - RNA, 17 nt, Mycobacterium bovis subsp bovis AF2122/97
gcgcgcaggccgccgcc

SEQ ID NO: 1160996 - RNA, 17 nt, Mycobacterium bovis subsp bovis AF2122/97
gcgcgcauagggcuggu

SEQ ID NO: 1160997 - RNA, 16 nt, Mycobacterium bovis subsp bovis AF2122/97
gcgcgcccaccgggcg

SEQ ID NO: 1160998 - RNA, 19 nt, Mycobacterium bovis subsp bovis AF2122/97
gcgcgccauuggcgguggu

SEQ ID NO: 1160999 - RNA, 20 nt, Mycobacterium bovis subsp bovis AF2122/97
gcgcgcagaugagcgcggcg

SEQ ID NO: 1161000 - RNA, 18 nt, Mycobacterium bovis subsp bovis AF2122/97
gcgcgcagccgggcaccg

SEQ ID NO: 1161001 - RNA, 15 nt, Mycobacterium bovis subsp bovis AF2122/97
gcgcgcagccgggca

SEQ ID NO: 1161002 - RNA, 17 nt, Mycobacterium bovis subsp bovis AF2122/97
gcgcgaugucgccggcg

SEQ ID NO: 1161003 - RNA, 19 nt, Mycobacterium bovis subsp bovis AF2122/97
gcgcgcaacguacgcacgc

SEQ ID NO: 1161004 - RNA, 22 nt, Mycobacterium bovis subsp bovis AF2122/97
gcgcgcaacguagccagcagcg

SEQ ID NO: 1161005 - RNA, 18 nt, Mycobacterium bovis subsp bovis AF2122/97
gcgcgcaccaccgcggcg

SEQ ID NO: 1161006 - RNA, 19 nt, Mycobacterium bovis subsp bovis AF2122/97
gcgcgcaccaccgcggcgg

SEQ ID NO: 1161007 - RNA, 22 nt, Mycobacterium bovis subsp bovis AF2122/97
gcgcgaugggagcccggcggcc

SEQ ID NO: 1161008 - RNA, 22 nt, Mycobacterium bovis subsp bovis AF2122/97
gcgcgcaagugcuggccgaaga

SEQ ID NO: 1161009 - RNA, 19 nt, Mycobacterium bovis subsp bovis AF2122/97
gcgcgaucgggccggcgcg

SEQ ID NO: 1161010 - RNA, 21 nt, Mycobacterium bovis subsp bovis AF2122/97
gcgcgaucgggccggcgcggu

SEQ ID NO: 1161011 - RNA, 21 nt, Mycobacterium bovis subsp bovis AF2122/97
gcgcgaugggagcccggcggc

SEQ ID NO: 1161012 - RNA, 18 nt, Mycobacterium bovis subsp bovis AF2122/97
gcgcgaucgacgcucggc

SEQ ID NO: 1161013 - RNA, 17 nt, Mycobacterium bovis subsp bovis AF2122/97
gcgccuuggcacccucc

SEQ ID NO: 1161014 - RNA, 14 nt, Mycobacterium bovis subsp bovis AF2122/97
gcgccuuugagccc

SEQ ID NO: 1161015 - RNA, 20 nt, Mycobacterium bovis subsp bovis AF2122/97
gcgcgcccacagcccgggcg

SEQ ID NO: 1161016 - RNA, 21 nt, Mycobacterium bovis subsp bovis AF2122/97
gcgcgcccaccgggcggcggc

SEQ ID NO: 1161017 - RNA, 14 nt, Mycobacterium bovis subsp bovis AF2122/97
gcgcgccccaccgc

SEQ ID NO: 1161018 - RNA, 14 nt, Mycobacterium bovis subsp bovis AF2122/97
gcgcgcccgcggcc

SEQ ID NO: 1161019 - RNA, 18 nt, Mycobacterium bovis subsp bovis AF2122/97
gcgcgccgagcccgggcc

SEQ ID NO: 1161020 - RNA, 20 nt, Mycobacterium bovis subsp bovis AF2122/97
gcgcgccgaucacggugggc

SEQ ID NO: 1161021 - RNA, 16 nt, Mycobacterium bovis subsp bovis AF2122/97
gcgcgccgaucggcac

SEQ ID NO: 1161022 - RNA, 17 nt, Mycobacterium bovis subsp bovis AF2122/97
gcgcgccgaaggccgcc

SEQ ID NO: 1161023 - RNA, 13 nt, Mycobacterium bovis subsp bovis AF2122/97
gcgcgccggugcu

SEQ ID NO: 1161024 - RNA, 22 nt, Mycobacterium bovis subsp bovis AF2122/97
gcgcgccguagaccagcaggcc

SEQ ID NO: 1161025 - RNA, 15 nt, Mycobacterium bovis subsp bovis AF2122/97
gcgcgcgccgcagcg

SEQ ID NO: 1161026 - RNA, 20 nt, Mycobacterium bovis subsp bovis AF2122/97
gcgcgcgaccucgcuggccg

SEQ ID NO: 1161027 - RNA, 15 nt, Mycobacterium bovis subsp bovis AF2122/97
gcgcgccguucaccc

SEQ ID NO: 1161028 - RNA, 13 nt, Mycobacterium bovis subsp bovis AF2122/97
gcgcggccgcagc

SEQ ID NO: 1161029 - RNA, 14 nt, Mycobacterium bovis subsp bovis AF2122/97
gcgcggccgcagcc

SEQ ID NO: 1161030 - RNA, 13 nt, Mycobacterium bovis subsp bovis AF2122/97
gcgcggccggccg

SEQ ID NO: 1161031 - RNA, 15 nt, Mycobacterium bovis subsp bovis AF2122/97
gcgcggccggccgcu

SEQ ID NO: 1161032 - RNA, 21 nt, Mycobacterium bovis subsp bovis AF2122/97
gcgcggcccgccucggcggcg

SEQ ID NO: 1161033 - RNA, 14 nt, Mycobacterium bovis subsp bovis AF2122/97
gcgcggccgcgcug

SEQ ID NO: 1161034 - RNA, 21 nt, Mycobacterium bovis subsp bovis AF2122/97
gcgcgcggguuacccgcagcg

SEQ ID NO: 1161035 - RNA, 21 nt, Mycobacterium bovis subsp bovis AF2122/97
gcgcgcggucgagguggcggg

SEQ ID NO: 1161036 - RNA, 18 nt, Mycobacterium bovis subsp bovis AF2122/97
gcgcgcguagcgggggag

SEQ ID NO: 1161037 - RNA, 16 nt, Mycobacterium bovis subsp bovis AF2122/97
gcgcgcguagcggggg

SEQ ID NO: 1161038 - RNA, 21 nt, Mycobacterium bovis subsp bovis AF2122/97
gcgcgcucaucgaccgcggcc

SEQ ID NO: 1161039 - RNA, 13 nt, Mycobacterium bovis subsp bovis AF2122/97
gcgcgcucgcggc

SEQ ID NO: 1161040 - RNA, 16 nt, Mycobacterium bovis subsp bovis AF2122/97
gcgcgcucgcucaccg

SEQ ID NO: 1161041 - RNA, 21 nt, Mycobacterium bovis subsp bovis AF2122/97
gcgcgcucgcucaccggcugg

SEQ ID NO: 1161042 - RNA, 22 nt, Mycobacterium bovis subsp bovis AF2122/97
gcgcgcucgcucaccggcuggu

SEQ ID NO: 1161043 - RNA, 20 nt, Mycobacterium bovis subsp bovis AF2122/97
gcgcgcggcgacgacggccu

SEQ ID NO: 1161044 - RNA, 15 nt, Mycobacterium bovis subsp bovis AF2122/97
gcgcggucgaccuga

SEQ ID NO: 1161045 - RNA, 14 nt, Mycobacterium bovis subsp bovis AF2122/97
gcgcggucgcgcga

SEQ ID NO: 1161046 - RNA, 19 nt, Mycobacterium bovis subsp bovis AF2122/97
gcgcggugcccgcgaacga

SEQ ID NO: 1161047 - RNA, 17 nt, Mycobacterium bovis subsp bovis AF2122/97
gcgcggugcccugccgg

SEQ ID NO: 1161048 - RNA, 18 nt, Mycobacterium bovis subsp bovis AF2122/97
gcgcggugcccugccggc

SEQ ID NO: 1161049 - RNA, 23 nt, Mycobacterium bovis subsp bovis AF2122/97
gcgcggugcggccacucgcccga

SEQ ID NO: 1161050 - RNA, 14 nt, Mycobacterium bovis subsp bovis AF2122/97
gcgcggugccggcg

SEQ ID NO: 1161051 - RNA, 16 nt, Mycobacterium bovis subsp bovis AF2122/97
gcgcggcuugggcaga

SEQ ID NO: 1161052 - RNA, 14 nt, Mycobacterium bovis subsp bovis AF2122/97
gcgcggguggcucg

SEQ ID NO: 1161053 - RNA, 18 nt, Mycobacterium bovis subsp bovis AF2122/97
gcgcggguuacccgcagc

SEQ ID NO: 1161054 - RNA, 15 nt, Mycobacterium bovis subsp bovis AF2122/97
gcgcgguacugcgca

SEQ ID NO: 1161055 - RNA, 18 nt, Mycobacterium bovis subsp bovis AF2122/97
gcgcgguacugcgcagcg

SEQ ID NO: 1161056 - RNA, 16 nt, Mycobacterium bovis subsp bovis AF2122/97
gcgcgguagcucgucg

SEQ ID NO: 1161057 - RNA, 19 nt, Mycobacterium bovis subsp bovis AF2122/97
gcgcgguaccgcucgggcg

SEQ ID NO: 1161058 - RNA, 17 nt, Mycobacterium bovis subsp bovis AF2122/97
gcgcgguaccgguguca

SEQ ID NO: 1161059 - RNA, 16 nt, Mycobacterium bovis subsp bovis AF2122/97
gcgcgggguggcggcg

SEQ ID NO: 1161060 - RNA, 14 nt, Mycobacterium bovis subsp bovis AF2122/97
gcgcgggggugggc

SEQ ID NO: 1161061 - RNA, 16 nt, Mycobacterium bovis subsp bovis AF2122/97
gcgcggcugugcccga

SEQ ID NO: 1161062 - RNA, 20 nt, Mycobacterium bovis subsp bovis AF2122/97
gcgcggccguagugcacguc

SEQ ID NO: 1161063 - RNA, 15 nt, Mycobacterium bovis subsp bovis AF2122/97
gcgcggcggcggagg

SEQ ID NO: 1161064 - RNA, 18 nt, Mycobacterium bovis subsp bovis AF2122/97
gcgccgccggcacccgcc

SEQ ID NO: 1161065 - RNA, 20 nt, Mycobacterium bovis subsp bovis AF2122/97
gcgccgccggaagcgccggc

SEQ ID NO: 1161066 - RNA, 17 nt, Mycobacterium bovis subsp bovis AF2122/97
gcgccgccgcgagcgcc

SEQ ID NO: 1161067 - RNA, 20 nt, Mycobacterium bovis subsp bovis AF2122/97
gcgccgccgcgagcgccggc

SEQ ID NO: 1161068 - RNA, 19 nt, Mycobacterium bovis subsp bovis AF2122/97
gcgccgccgaucccgucgg

SEQ ID NO: 1161069 - RNA, 18 nt, Mycobacterium bovis subsp bovis AF2122/97
gcgccgccggcucgccgg

SEQ ID NO: 1161070 - RNA, 15 nt, Mycobacterium bovis subsp bovis AF2122/97
gcgccgccggcgccg

SEQ ID NO: 1161071 - RNA, 18 nt, Mycobacterium bovis subsp bovis AF2122/97
gcgccgccggcgccgccc

SEQ ID NO: 1161072 - RNA, 20 nt, Mycobacterium bovis subsp bovis AF2122/97
gcgccgccggcgccgcccgc

SEQ ID NO: 1161073 - RNA, 19 nt, Mycobacterium bovis subsp bovis AF2122/97
gcgccgccggcaccgccgg

SEQ ID NO: 1161074 - RNA, 14 nt, Mycobacterium bovis subsp bovis AF2122/97
gcgccgccggcgcg

SEQ ID NO: 1161075 - RNA, 19 nt, Mycobacterium bovis subsp bovis AF2122/97
gcgccgccguucccgccgg

SEQ ID NO: 1161076 - RNA, 17 nt, Mycobacterium bovis subsp bovis AF2122/97
gcgccgccggugccacc

SEQ ID NO: 1161077 - RNA, 17 nt, Mycobacterium bovis subsp bovis AF2122/97
gcgccgccguccagcgc

SEQ ID NO: 1161078 - RNA, 16 nt, Mycobacterium bovis subsp bovis AF2122/97
gcgccgcgcagcgagg

SEQ ID NO: 1161079 - RNA, 17 nt, Mycobacterium bovis subsp bovis AF2122/97
gcgccgcgcagcgagga

SEQ ID NO: 1161080 - RNA, 13 nt, Mycobacterium bovis subsp bovis AF2122/97
gcgcccaggaacu

SEQ ID NO: 1161081 - RNA, 14 nt, Mycobacterium bovis subsp bovis AF2122/97
gcgcccagcgccuc

SEQ ID NO: 1161082 - RNA, 21 nt, Mycobacterium bovis subsp bovis AF2122/97
gcgcccagcgcuagccgggcg

SEQ ID NO: 1161083 - RNA, 23 nt, Mycobacterium bovis subsp bovis AF2122/97
gcgccgcccuugccgccggcccc

SEQ ID NO: 1161084 - RNA, 21 nt, Mycobacterium bovis subsp bovis AF2122/97
gcgcccacaucgucggcgggc

SEQ ID NO: 1161085 - RNA, 24 nt, Mycobacterium bovis subsp bovis AF2122/97
gcgcccacaucgucggcgggcggc

SEQ ID NO: 1161086 - RNA, 18 nt, Mycobacterium bovis subsp bovis AF2122/97
gcgcccaccagcggcggc

SEQ ID NO: 1161087 - RNA, 14 nt, Mycobacterium bovis subsp bovis AF2122/97
gcgcccaccccggc

SEQ ID NO: 1161088 - RNA, 17 nt, Mycobacterium bovis subsp bovis AF2122/97
gcgcccaccgggcggcg

SEQ ID NO: 1161089 - RNA, 22 nt, Mycobacterium bovis subsp bovis AF2122/97
gcgcccacuggugaucuggucc

SEQ ID NO: 1161090 - RNA, 20 nt, Mycobacterium bovis subsp bovis AF2122/97
gcgcccagcacguaacccag

SEQ ID NO: 1161091 - RNA, 16 nt, Mycobacterium bovis subsp bovis AF2122/97
gcgccggcuagggccc

SEQ ID NO: 1161092 - RNA, 16 nt, Mycobacterium bovis subsp bovis AF2122/97
gcgccggcuucgggug

SEQ ID NO: 1161093 - RNA, 22 nt, Mycobacterium bovis subsp bovis AF2122/97
gcgccggcgguagucggccagc

SEQ ID NO: 1161094 - RNA, 13 nt, Mycobacterium bovis subsp bovis AF2122/97
gcgccggcggccg

SEQ ID NO: 1161095 - RNA, 14 nt, Mycobacterium bovis subsp bovis AF2122/97
gcgccggcggccgc

SEQ ID NO: 1161096 - RNA, 21 nt, Mycobacterium bovis subsp bovis AF2122/97
gcgccggcggcaaagaacagc

SEQ ID NO: 1161097 - RNA, 19 nt, Mycobacterium bovis subsp bovis AF2122/97
gcgccggagccgcccaagc

SEQ ID NO: 1161098 - RNA, 23 nt, Mycobacterium bovis subsp bovis AF2122/97
gcgccggagccgcccaagccgcc

SEQ ID NO: 1161099 - RNA, 18 nt, Mycobacterium bovis subsp bovis AF2122/97
gcgccggggacacagcgu

SEQ ID NO: 1161100 - RNA, 21 nt, Mycobacterium bovis subsp bovis AF2122/97
gcgccgcugggugaccaggaa

SEQ ID NO: 1161101 - RNA, 17 nt, Mycobacterium bovis subsp bovis AF2122/97
gcgccggaccgucuuug

SEQ ID NO: 1161102 - RNA, 16 nt, Mycobacterium bovis subsp bovis AF2122/97
gcgccggaccagcucc

SEQ ID NO: 1161103 - RNA, 17 nt, Mycobacterium bovis subsp bovis AF2122/97
gcgccggaccagcuccu

SEQ ID NO: 1161104 - RNA, 16 nt, Mycobacterium bovis subsp bovis AF2122/97
gcgccgcgccgcgccg

SEQ ID NO: 1161105 - RNA, 17 nt, Mycobacterium bovis subsp bovis AF2122/97
gcgccgcgccgauucca

SEQ ID NO: 1161106 - RNA, 15 nt, Mycobacterium bovis subsp bovis AF2122/97
gcgccgcgccguccc

SEQ ID NO: 1161107 - RNA, 15 nt, Mycobacterium bovis subsp bovis AF2122/97
gcgccgcgcggcuug

SEQ ID NO: 1161108 - RNA, 21 nt, Mycobacterium bovis subsp bovis AF2122/97
gcgccgcugacuccugcggca

SEQ ID NO: 1161109 - RNA, 19 nt, Mycobacterium bovis subsp bovis AF2122/97
gcgccgggggcgccgccgu

SEQ ID NO: 1161110 - RNA, 17 nt, Mycobacterium bovis subsp bovis AF2122/97
gcgccggggggcugcug

SEQ ID NO: 1161111 - RNA, 20 nt, Mycobacterium bovis subsp bovis AF2122/97
gcgccggggggcugcugcuc

SEQ ID NO: 1161112 - RNA, 15 nt, Mycobacterium bovis subsp bovis AF2122/97
gcgccggggcgcagg

SEQ ID NO: 1161113 - RNA, 19 nt, Mycobacterium bovis subsp bovis AF2122/97
gcgccggggggcugcugcu

SEQ ID NO: 1161114 - RNA, 19 nt, Mycobacterium bovis subsp bovis AF2122/97
gcgccuccagcaccacggc

SEQ ID NO: 1161115 - RNA, 20 nt, Mycobacterium bovis subsp bovis AF2122/97
gcgccuccagcaccacggcg

SEQ ID NO: 1161116 - RNA, 14 nt, Mycobacterium bovis subsp bovis AF2122/97
gcgccuccgggacg

SEQ ID NO: 1161117 - RNA, 15 nt, Mycobacterium bovis subsp bovis AF2122/97
gcgccuccgggacgg

SEQ ID NO: 1161118 - RNA, 19 nt, Mycobacterium bovis subsp bovis AF2122/97
gcgccuccguugcccccau

SEQ ID NO: 1161119 - RNA, 13 nt, Mycobacterium bovis subsp bovis AF2122/97
gcgccucgccggc

SEQ ID NO: 1161120 - RNA, 14 nt, Mycobacterium bovis subsp bovis AF2122/97
gcgccucgccggcc

SEQ ID NO: 1161121 - RNA, 15 nt, Mycobacterium bovis subsp bovis AF2122/97
gcgccucgcccagca

SEQ ID NO: 1161122 - RNA, 17 nt, Mycobacterium bovis subsp bovis AF2122/97
gcgccucgggaggcagc

SEQ ID NO: 1161123 - RNA, 21 nt, Mycobacterium bovis subsp bovis AF2122/97
gcgccucgggaggcagcgcga

SEQ ID NO: 1161124 - RNA, 19 nt, Mycobacterium bovis subsp bovis AF2122/97
gcgccugauaggccugagc

SEQ ID NO: 1161125 - RNA, 14 nt, Mycobacterium bovis subsp bovis AF2122/97
gcgccugacucauc

SEQ ID NO: 1161126 - RNA, 11 nt, Mycobacterium bovis subsp bovis AF2122/97
gcgccugagcg

SEQ ID NO: 1161127 - RNA, 12 nt, Mycobacterium bovis subsp bovis AF2122/97
gcgccucggugg

SEQ ID NO: 1161128 - RNA, 19 nt, Mycobacterium bovis subsp bovis AF2122/97
gcgccugccucaccgccgc

SEQ ID NO: 1161129 - RNA, 13 nt, Mycobacterium bovis subsp bovis AF2122/97
gcgccugcccggg

SEQ ID NO: 1161130 - RNA, 16 nt, Mycobacterium bovis subsp bovis AF2122/97
gcgccuggcggcgccg

SEQ ID NO: 1161131 - RNA, 21 nt, Mycobacterium bovis subsp bovis AF2122/97
gcgccuggcuggccagcugcg

SEQ ID NO: 1161132 - RNA, 16 nt, Mycobacterium bovis subsp bovis AF2122/97
gcgccuuggucgccgg

SEQ ID NO: 1161133 - RNA, 14 nt, Mycobacterium bovis subsp bovis AF2122/97
gcgccuugcgggcc

SEQ ID NO: 1161134 - RNA, 18 nt, Mycobacterium bovis subsp bovis AF2122/97
gcgccuugcgggccuggu

SEQ ID NO: 1161135 - RNA, 14 nt, Mycobacterium bovis subsp bovis AF2122/97
gcgccuucgccagc

SEQ ID NO: 1161136 - RNA, 19 nt, Mycobacterium bovis subsp bovis AF2122/97
gcgccuugauggucuccac

SEQ ID NO: 1161137 - RNA, 20 nt, Mycobacterium bovis subsp bovis AF2122/97
gcgccuugauggucuccacc

SEQ ID NO: 1161138 - RNA, 20 nt, Mycobacterium bovis subsp bovis AF2122/97
gcgccuuccaggcgggcggc

SEQ ID NO: 1161139 - RNA, 17 nt, Mycobacterium bovis subsp bovis AF2122/97
gcgccugugcgcaaggc

SEQ ID NO: 1161140 - RNA, 19 nt, Mycobacterium bovis subsp bovis AF2122/97
gcgcugagcgacugcagcg

SEQ ID NO: 1161141 - RNA, 17 nt, Mycobacterium bovis subsp bovis AF2122/97
gcgcugaucgcgcgcac

SEQ ID NO: 1161142 - RNA, 17 nt, Mycobacterium bovis subsp bovis AF2122/97
gcgcugaucggcagggu

SEQ ID NO: 1161143 - RNA, 13 nt, Mycobacterium bovis subsp bovis AF2122/97
gcgcuggaccuga

SEQ ID NO: 1161144 - RNA, 15 nt, Mycobacterium bovis subsp bovis AF2122/97
gcgcuggcgccgccg

SEQ ID NO: 1161145 - RNA, 16 nt, Mycobacterium bovis subsp bovis AF2122/97
gcgcuggcgccgccgg

SEQ ID NO: 1161146 - RNA, 15 nt, Mycobacterium bovis subsp bovis AF2122/97
gcgcuggcgggcagc

SEQ ID NO: 1161147 - RNA, 17 nt, Mycobacterium bovis subsp bovis AF2122/97
gcgcuggcgggcggcgu

SEQ ID NO: 1161148 - RNA, 18 nt, Mycobacterium bovis subsp bovis AF2122/97
gcgcuggcgggcggcgug

SEQ ID NO: 1161149 - RNA, 18 nt, Mycobacterium bovis subsp bovis AF2122/97
gcgcuggaggccaccacc

SEQ ID NO: 1161150 - RNA, 15 nt, Mycobacterium bovis subsp bovis AF2122/97
gcgcuggccagcagg

SEQ ID NO: 1161151 - RNA, 16 nt, Mycobacterium bovis subsp bovis AF2122/97
gcgcucgcucaccggc

SEQ ID NO: 1161152 - RNA, 22 nt, Mycobacterium bovis subsp bovis AF2122/97
gcgcucgcggcuucaguccggc

SEQ ID NO: 1161153 - RNA, 23 nt, Mycobacterium bovis subsp bovis AF2122/97
gcgcucgcucacgccguccggug

SEQ ID NO: 1161154 - RNA, 15 nt, Mycobacterium bovis subsp bovis AF2122/97
gcgcucggcagccgg

SEQ ID NO: 1161155 - RNA, 15 nt, Mycobacterium bovis subsp bovis AF2122/97
gcgcucggccagcau

SEQ ID NO: 1161156 - RNA, 18 nt, Mycobacterium bovis subsp bovis AF2122/97
gcgcucgcacccgcucgg

SEQ ID NO: 1161157 - RNA, 21 nt, Mycobacterium bovis subsp bovis AF2122/97
gcgcucgccgauaucugccac

SEQ ID NO: 1161158 - RNA, 20 nt, Mycobacterium bovis subsp bovis AF2122/97
gcgcguaucgcgucugggug

SEQ ID NO: 1161159 - RNA, 19 nt, Mycobacterium bovis subsp bovis AF2122/97
gcgcguagcgggcgcccuu

SEQ ID NO: 1161160 - RNA, 16 nt, Mycobacterium bovis subsp bovis AF2122/97
gcgcguagcgggggag

SEQ ID NO: 1161161 - RNA, 14 nt, Mycobacterium bovis subsp bovis AF2122/97
gcgcguagcucagc

SEQ ID NO: 1161162 - RNA, 23 nt, Mycobacterium bovis subsp bovis AF2122/97
gcgcguaauccgagcgcggcggc

SEQ ID NO: 1161163 - RNA, 19 nt, Mycobacterium bovis subsp bovis AF2122/97
gcgcgguuuucggcugccg

SEQ ID NO: 1161164 - RNA, 18 nt, Mycobacterium bovis subsp bovis AF2122/97
gcgcgguguagagcgcac

SEQ ID NO: 1161165 - RNA, 22 nt, Mycobacterium bovis subsp bovis AF2122/97
gcgcggugcccugccggcagcg

SEQ ID NO: 1161166 - RNA, 15 nt, Mycobacterium bovis subsp bovis AF2122/97
gcgcgguggucgcga

SEQ ID NO: 1161167 - RNA, 16 nt, Mycobacterium bovis subsp bovis AF2122/97
gcgcgguggggcgcgc

SEQ ID NO: 1161168 - RNA, 17 nt, Mycobacterium bovis subsp bovis AF2122/97
gcgcgguggggcgcgcc

SEQ ID NO: 1161169 - RNA, 16 nt, Mycobacterium bovis subsp bovis AF2122/97
gcgcuugaccccgccg

SEQ ID NO: 1161170 - RNA, 22 nt, Mycobacterium bovis subsp bovis AF2122/97
gcgcuugaccccgccgaacggc

SEQ ID NO: 1161171 - RNA, 15 nt, Mycobacterium bovis subsp bovis AF2122/97
gcgcuugacccgcgg

SEQ ID NO: 1161172 - RNA, 20 nt, Mycobacterium bovis subsp bovis AF2122/97
gcgcuucugcgucagccgac

SEQ ID NO: 1161173 - RNA, 17 nt, Mycobacterium bovis subsp bovis AF2122/97
gcgcuucgucggccggc

SEQ ID NO: 1161174 - RNA, 16 nt, Mycobacterium bovis subsp bovis AF2122/97
gcgcuugcgaucgccg

SEQ ID NO: 1161175 - RNA, 21 nt, Mycobacterium bovis subsp bovis AF2122/97
gcgcuugcgaccccggcugcg

SEQ ID NO: 1161176 - RNA, 19 nt, Mycobacterium bovis subsp bovis AF2122/97
gcgcuuguugaccucacgg

SEQ ID NO: 1161177 - RNA, 18 nt, Mycobacterium bovis subsp bovis AF2122/97
gcgcuggcgccggccagc

SEQ ID NO: 1161178 - RNA, 20 nt, Mycobacterium bovis subsp bovis AF2122/97
gcgcuucacagccaccagcc

SEQ ID NO: 1161179 - RNA, 15 nt, Mycobacterium bovis subsp bovis AF2122/97
gcgcugggccagggu

SEQ ID NO: 1161180 - RNA, 21 nt, Mycobacterium bovis subsp bovis AF2122/97
gcgcuggcuacccaccggccg

SEQ ID NO: 1161181 - RNA, 16 nt, Mycobacterium bovis subsp bovis AF2122/97
gcgcuuccaucgccac

SEQ ID NO: 1161182 - RNA, 16 nt, Mycobacterium bovis subsp bovis AF2122/97
gcggaaccugcucggc

SEQ ID NO: 1161183 - RNA, 19 nt, Mycobacterium bovis subsp bovis AF2122/97
gcggaacgcgucgccgacg

SEQ ID NO: 1161184 - RNA, 17 nt, Mycobacterium bovis subsp bovis AF2122/97
gcggaacaccagcaggc

SEQ ID NO: 1161185 - RNA, 20 nt, Mycobacterium bovis subsp bovis AF2122/97
gcggaacaccagcaggcggc

SEQ ID NO: 1161186 - RNA, 16 nt, Mycobacterium bovis subsp bovis AF2122/97
gcggaacaccagcagg

SEQ ID NO: 1161187 - RNA, 14 nt, Mycobacterium bovis subsp bovis AF2122/97
gcggaagcggcggc

SEQ ID NO: 1161188 - RNA, 15 nt, Mycobacterium bovis subsp bovis AF2122/97
gcggaagcggcggcc

SEQ ID NO: 1161189 - RNA, 16 nt, Mycobacterium bovis subsp bovis AF2122/97
gcggaagcggcggccc

SEQ ID NO: 1161190 - RNA, 18 nt, Mycobacterium bovis subsp bovis AF2122/97
gcggaacugggcccccaa

SEQ ID NO: 1161191 - RNA, 14 nt, Mycobacterium bovis subsp bovis AF2122/97
gcggaagaagugcu

SEQ ID NO: 1161192 - RNA, 23 nt, Mycobacterium bovis subsp bovis AF2122/97
gcggaaacccggccgccgagacg

SEQ ID NO: 1161193 - RNA, 19 nt, Mycobacterium bovis subsp bovis AF2122/97
gcggcaaacacugcggccu

SEQ ID NO: 1161194 - RNA, 15 nt, Mycobacterium bovis subsp bovis AF2122/97
gcggcaaccccgagc

SEQ ID NO: 1161195 - RNA, 18 nt, Mycobacterium bovis subsp bovis AF2122/97
gcggcaacggcggaucgg

SEQ ID NO: 1161196 - RNA, 22 nt, Mycobacterium bovis subsp bovis AF2122/97
gcggcaacggcggaucggcggc

SEQ ID NO: 1161197 - RNA, 15 nt, Mycobacterium bovis subsp bovis AF2122/97
gcggcaacggcggca

SEQ ID NO: 1161198 - RNA, 16 nt, Mycobacterium bovis subsp bovis AF2122/97
gcggcaacggcggcau

SEQ ID NO: 1161199 - RNA, 19 nt, Mycobacterium bovis subsp bovis AF2122/97
gcggcaacggcggcgacgg

SEQ ID NO: 1161200 - RNA, 18 nt, Mycobacterium bovis subsp bovis AF2122/97
gcggcaacgggggcgccg

SEQ ID NO: 1161201 - RNA, 19 nt, Mycobacterium bovis subsp bovis AF2122/97
gcggcaagcucguccggug

SEQ ID NO: 1161202 - RNA, 17 nt, Mycobacterium bovis subsp bovis AF2122/97
gcggcacccaggugucg

SEQ ID NO: 1161203 - RNA, 22 nt, Mycobacterium bovis subsp bovis AF2122/97
gcggcacccagucggcgccgcc

SEQ ID NO: 1161204 - RNA, 11 nt, Mycobacterium bovis subsp bovis AF2122/97
gcggcaccaga

SEQ ID NO: 1161205 - RNA, 13 nt, Mycobacterium bovis subsp bovis AF2122/97
gcggcacacccau

SEQ ID NO: 1161206 - RNA, 21 nt, Mycobacterium bovis subsp bovis AF2122/97
gcggcaauucgggcauggucg

SEQ ID NO: 1161207 - RNA, 14 nt, Mycobacterium bovis subsp bovis AF2122/97
gcggcaagggcggc

SEQ ID NO: 1161208 - RNA, 21 nt, Mycobacterium bovis subsp bovis AF2122/97
gcggcaaggguggggccggcg

SEQ ID NO: 1161209 - RNA, 16 nt, Mycobacterium bovis subsp bovis AF2122/97
gcggcaagggugguga

SEQ ID NO: 1161210 - RNA, 23 nt, Mycobacterium bovis subsp bovis AF2122/97
gcggcaaugaggccgucugcggu

SEQ ID NO: 1161211 - RNA, 18 nt, Mycobacterium bovis subsp bovis AF2122/97
gcggaucgaccgccagcg

SEQ ID NO: 1161212 - RNA, 19 nt, Mycobacterium bovis subsp bovis AF2122/97
gcggauagcaacggugcuc

SEQ ID NO: 1161213 - RNA, 14 nt, Mycobacterium bovis subsp bovis AF2122/97
gcggaucccgccgg

SEQ ID NO: 1161214 - RNA, 18 nt, Mycobacterium bovis subsp bovis AF2122/97
gcggauccgggcguggug

SEQ ID NO: 1161215 - RNA, 16 nt, Mycobacterium bovis subsp bovis AF2122/97
gcggaucccgaggcgc

SEQ ID NO: 1161216 - RNA, 16 nt, Mycobacterium bovis subsp bovis AF2122/97
gcggaucaggucuggc

SEQ ID NO: 1161217 - RNA, 14 nt, Mycobacterium bovis subsp bovis AF2122/97
gcggaucggcggcc

SEQ ID NO: 1161218 - RNA, 23 nt, Mycobacterium bovis subsp bovis AF2122/97
gcggauccaccacgcuggccucg

SEQ ID NO: 1161219 - RNA, 16 nt, Mycobacterium bovis subsp bovis AF2122/97
gcggaucgcgagcgcc

SEQ ID NO: 1161220 - RNA, 18 nt, Mycobacterium bovis subsp bovis AF2122/97
gcggaucgacuucgacga

SEQ ID NO: 1161221 - RNA, 15 nt, Mycobacterium bovis subsp bovis AF2122/97
gcggaucgcgcugcg

SEQ ID NO: 1161222 - RNA, 16 nt, Mycobacterium bovis subsp bovis AF2122/97
gcggaucuugguguug

SEQ ID NO: 1161223 - RNA, 17 nt, Mycobacterium bovis subsp bovis AF2122/97
gcggaucugggcggccu

SEQ ID NO: 1161224 - RNA, 20 nt, Mycobacterium bovis subsp bovis AF2122/97
gcggaucugguccaguggga

SEQ ID NO: 1161225 - RNA, 13 nt, Mycobacterium bovis subsp bovis AF2122/97
gcggaucuguucc

SEQ ID NO: 1161226 - RNA, 15 nt, Mycobacterium bovis subsp bovis AF2122/97
gcggaucguggcgcc

SEQ ID NO: 1161227 - RNA, 21 nt, Mycobacterium bovis subsp bovis AF2122/97
gcggaucucaccacccgucgg

SEQ ID NO: 1161228 - RNA, 12 nt, Mycobacterium bovis subsp bovis AF2122/97
gcggaucuggcc

SEQ ID NO: 1161229 - RNA, 14 nt, Mycobacterium bovis subsp bovis AF2122/97
gcggauggccgccu

SEQ ID NO: 1161230 - RNA, 20 nt, Mycobacterium bovis subsp bovis AF2122/97
gcggaugcaugucaaguucg

SEQ ID NO: 1161231 - RNA, 22 nt, Mycobacterium bovis subsp bovis AF2122/97
gcggauguacacuuugcccgcc

SEQ ID NO: 1161232 - RNA, 20 nt, Mycobacterium bovis subsp bovis AF2122/97
gcggauuaagucggcggccu

SEQ ID NO: 1161233 - RNA, 19 nt, Mycobacterium bovis subsp bovis AF2122/97
gcggauuaagucggcggcc

SEQ ID NO: 1161234 - RNA, 17 nt, Mycobacterium bovis subsp bovis AF2122/97
gcggaccucggcgaccu

SEQ ID NO: 1161235 - RNA, 23 nt, Mycobacterium bovis subsp bovis AF2122/97
gcggacggcguugagcaggugcc

SEQ ID NO: 1161236 - RNA, 18 nt, Mycobacterium bovis subsp bovis AF2122/97
gcggacccgcagcugcgg

SEQ ID NO: 1161237 - RNA, 20 nt, Mycobacterium bovis subsp bovis AF2122/97
gcggacccgccgugaguagg

SEQ ID NO: 1161238 - RNA, 19 nt, Mycobacterium bovis subsp bovis AF2122/97
gcggacccgcgcgucgccc

SEQ ID NO: 1161239 - RNA, 22 nt, Mycobacterium bovis subsp bovis AF2122/97
gcggacccggugacccgcuggg

SEQ ID NO: 1161240 - RNA, 24 nt, Mycobacterium bovis subsp bovis AF2122/97
gcggacccggugacccgcugggcc

SEQ ID NO: 1161241 - RNA, 23 nt, Mycobacterium bovis subsp bovis AF2122/97
gcggacccgucggcguggcugcc

SEQ ID NO: 1161242 - RNA, 18 nt, Mycobacterium bovis subsp bovis AF2122/97
gcggacccgacagccgcu

SEQ ID NO: 1161243 - RNA, 19 nt, Mycobacterium bovis subsp bovis AF2122/97
gcggacccgacagccgcug

SEQ ID NO: 1161244 - RNA, 14 nt, Mycobacterium bovis subsp bovis AF2122/97
gcggacccgcagcu

SEQ ID NO: 1161245 - RNA, 20 nt, Mycobacterium bovis subsp bovis AF2122/97
gcggaccaggccgcgcgcac

SEQ ID NO: 1161246 - RNA, 23 nt, Mycobacterium bovis subsp bovis AF2122/97
gcggacauccgggccgagcgcac

SEQ ID NO: 1161247 - RNA, 14 nt, Mycobacterium bovis subsp bovis AF2122/97
gcggacagggcggc

SEQ ID NO: 1161248 - RNA, 15 nt, Mycobacterium bovis subsp bovis AF2122/97
gcggacagggcggca

SEQ ID NO: 1161249 - RNA, 13 nt, Mycobacterium bovis subsp bovis AF2122/97
gcggacagguagu

SEQ ID NO: 1161250 - RNA, 16 nt, Mycobacterium bovis subsp bovis AF2122/97
gcggaauggaggccgc

SEQ ID NO: 1161251 - RNA, 19 nt, Mycobacterium bovis subsp bovis AF2122/97
gcggacgguguacaggucg

SEQ ID NO: 1161252 - RNA, 16 nt, Mycobacterium bovis subsp bovis AF2122/97
gcggacguggucggag

SEQ ID NO: 1161253 - RNA, 21 nt, Mycobacterium bovis subsp bovis AF2122/97
gcggacucgagucugcgcaga

SEQ ID NO: 1161254 - RNA, 15 nt, Mycobacterium bovis subsp bovis AF2122/97
gcggacucgggcagg

SEQ ID NO: 1161255 - RNA, 17 nt, Mycobacterium bovis subsp bovis AF2122/97
gcggacuuggcggucgg

SEQ ID NO: 1161256 - RNA, 16 nt, Mycobacterium bovis subsp bovis AF2122/97
gcggagaaaagcgcgc

SEQ ID NO: 1161257 - RNA, 20 nt, Mycobacterium bovis subsp bovis AF2122/97
gcggacuugcgagccguaga

SEQ ID NO: 1161258 - RNA, 17 nt, Mycobacterium bovis subsp bovis AF2122/97
gcggagccacucggccc

SEQ ID NO: 1161259 - RNA, 23 nt, Mycobacterium bovis subsp bovis AF2122/97
gcggagccgccgacucggcaccg

SEQ ID NO: 1161260 - RNA, 17 nt, Mycobacterium bovis subsp bovis AF2122/97
gcggagaacaucccccg

SEQ ID NO: 1161261 - RNA, 18 nt, Mycobacterium bovis subsp bovis AF2122/97
gcggagaacaucccccgg

SEQ ID NO: 1161262 - RNA, 17 nt, Mycobacterium bovis subsp bovis AF2122/97
gcggagaaggcgaccaa

SEQ ID NO: 1161263 - RNA, 16 nt, Mycobacterium bovis subsp bovis AF2122/97
gcggagaaggcgcggg

SEQ ID NO: 1161264 - RNA, 18 nt, Mycobacterium bovis subsp bovis AF2122/97
gcggagaaggcgcgggcg

SEQ ID NO: 1161265 - RNA, 19 nt, Mycobacterium bovis subsp bovis AF2122/97
gcggagaccccgcgcgcuu

SEQ ID NO: 1161266 - RNA, 18 nt, Mycobacterium bovis subsp bovis AF2122/97
gcggagcucacgccgggu

SEQ ID NO: 1161267 - RNA, 13 nt, Mycobacterium bovis subsp bovis AF2122/97
gcggaggcugggc

SEQ ID NO: 1161268 - RNA, 13 nt, Mycobacterium bovis subsp bovis AF2122/97
gcggaguacucca

SEQ ID NO: 1161269 - RNA, 18 nt, Mycobacterium bovis subsp bovis AF2122/97
gcggaguacuccagccgc

SEQ ID NO: 1161270 - RNA, 16 nt, Mycobacterium bovis subsp bovis AF2122/97
gcggaguagccgcagc

SEQ ID NO: 1161271 - RNA, 17 nt, Mycobacterium bovis subsp bovis AF2122/97
gcggaucagcccgcgca

SEQ ID NO: 1161272 - RNA, 21 nt, Mycobacterium bovis subsp bovis AF2122/97
gcggauagcggcaaagccggg

SEQ ID NO: 1161273 - RNA, 17 nt, Mycobacterium bovis subsp bovis AF2122/97
gcggauacuguucugcu

SEQ ID NO: 1161274 - RNA, 15 nt, Mycobacterium bovis subsp bovis AF2122/97
gcgaagccggccggg

SEQ ID NO: 1161275 - RNA, 20 nt, Mycobacterium bovis subsp bovis AF2122/97
gcgaagcccgacaugaggcu

SEQ ID NO: 1161276 - RNA, 23 nt, Mycobacterium bovis subsp bovis AF2122/97
gcgaagccgguucgcccagcagg

SEQ ID NO: 1161277 - RNA, 17 nt, Mycobacterium bovis subsp bovis AF2122/97
gcgaagcugaccagaca

SEQ ID NO: 1161278 - RNA, 12 nt, Mycobacterium bovis subsp bovis AF2122/97
gcgaagcgggcg

SEQ ID NO: 1161279 - RNA, 17 nt, Mycobacterium bovis subsp bovis AF2122/97
gcgaagcuagcgcccgc

SEQ ID NO: 1161280 - RNA, 23 nt, Mycobacterium bovis subsp bovis AF2122/97
gcgaagcuagcgcccgcgagaga

SEQ ID NO: 1161281 - RNA, 22 nt, Mycobacterium bovis subsp bovis AF2122/97
gcgaauacgaggacgacgauca

SEQ ID NO: 1161282 - RNA, 13 nt, Mycobacterium bovis subsp bovis AF2122/97
gcgaauagccacc

SEQ ID NO: 1161283 - RNA, 14 nt, Mycobacterium bovis subsp bovis AF2122/97
gcgaaccaugacca

SEQ ID NO: 1161284 - RNA, 14 nt, Mycobacterium bovis subsp bovis AF2122/97
gcgaacaucgccag

SEQ ID NO: 1161285 - RNA, 17 nt, Mycobacterium bovis subsp bovis AF2122/97
gcgaacccccgccgcgc

SEQ ID NO: 1161286 - RNA, 19 nt, Mycobacterium bovis subsp bovis AF2122/97
gcgaagaacaacaucgcca

SEQ ID NO: 1161287 - RNA, 21 nt, Mycobacterium bovis subsp bovis AF2122/97
gcgaagcaagugaauacccca

SEQ ID NO: 1161288 - RNA, 14 nt, Mycobacterium bovis subsp bovis AF2122/97
gcgaagagcccguu

SEQ ID NO: 1161289 - RNA, 15 nt, Mycobacterium bovis subsp bovis AF2122/97
gcgaacagcgggggc

SEQ ID NO: 1161290 - RNA, 18 nt, Mycobacterium bovis subsp bovis AF2122/97
gcgaaaauugcuccacca

SEQ ID NO: 1161291 - RNA, 19 nt, Mycobacterium bovis subsp bovis AF2122/97
gcgaaacaccagacacugg

SEQ ID NO: 1161292 - RNA, 20 nt, Mycobacterium bovis subsp bovis AF2122/97
gcgaaacaccggccagcggc

SEQ ID NO: 1161293 - RNA, 15 nt, Mycobacterium bovis subsp bovis AF2122/97
gcgaaacgcccgggc

SEQ ID NO: 1161294 - RNA, 20 nt, Mycobacterium bovis subsp bovis AF2122/97
gcgaaacaucucggcgcagc

SEQ ID NO: 1161295 - RNA, 15 nt, Mycobacterium bovis subsp bovis AF2122/97
gccguucgggaugca

SEQ ID NO: 1161296 - RNA, 17 nt, Mycobacterium bovis subsp bovis AF2122/97
gccguuggugccgccug

SEQ ID NO: 1161297 - RNA, 17 nt, Mycobacterium bovis subsp bovis AF2122/97
gccguucgcgucgccga

SEQ ID NO: 1161298 - RNA, 15 nt, Mycobacterium bovis subsp bovis AF2122/97
gccguugggccgcgc

SEQ ID NO: 1161299 - RNA, 20 nt, Mycobacterium bovis subsp bovis AF2122/97
gccguuguugaggaugacga

SEQ ID NO: 1161300 - RNA, 23 nt, Mycobacterium bovis subsp bovis AF2122/97
gcgaauccggcgggugccgagcu

SEQ ID NO: 1161301 - RNA, 18 nt, Mycobacterium bovis subsp bovis AF2122/97
gcgaaugcgggccuccug

SEQ ID NO: 1161302 - RNA, 22 nt, Mycobacterium bovis subsp bovis AF2122/97
gcgaauucguagggaugcggcc

SEQ ID NO: 1161303 - RNA, 22 nt, Mycobacterium bovis subsp bovis AF2122/97
gcgacagcgugccgaacaggga

SEQ ID NO: 1161304 - RNA, 15 nt, Mycobacterium bovis subsp bovis AF2122/97
gcgaauggcggacag

SEQ ID NO: 1161305 - RNA, 23 nt, Mycobacterium bovis subsp bovis AF2122/97
gcgaaugcugugccgagaugccg

SEQ ID NO: 1161306 - RNA, 22 nt, Mycobacterium bovis subsp bovis AF2122/97
gcgacaucggcccgaucaccau

SEQ ID NO: 1161307 - RNA, 18 nt, Mycobacterium bovis subsp bovis AF2122/97
gcgacaugaucugccacc

SEQ ID NO: 1161308 - RNA, 13 nt, Mycobacterium bovis subsp bovis AF2122/97
gcgacauccgcgg

SEQ ID NO: 1161309 - RNA, 22 nt, Mycobacterium bovis subsp bovis AF2122/97
gcgacauccacaccgcggcggc

SEQ ID NO: 1161310 - RNA, 23 nt, Mycobacterium bovis subsp bovis AF2122/97
gcgacaugucgaacgccccccac

SEQ ID NO: 1161311 - RNA, 17 nt, Mycobacterium bovis subsp bovis AF2122/97
gcgacauugcgagcgcc

SEQ ID NO: 1161312 - RNA, 18 nt, Mycobacterium bovis subsp bovis AF2122/97
gcgacaggccgagcagau

SEQ ID NO: 1161313 - RNA, 18 nt, Mycobacterium bovis subsp bovis AF2122/97
gcgaccgggaucggcucc

SEQ ID NO: 1161314 - RNA, 23 nt, Mycobacterium bovis subsp bovis AF2122/97
gcgaccgggaucggcuccgccgc

SEQ ID NO: 1161315 - RNA, 20 nt, Mycobacterium bovis subsp bovis AF2122/97
gcgaccggggaucggggcac

SEQ ID NO: 1161316 - RNA, 20 nt, Mycobacterium bovis subsp bovis AF2122/97
gcgaccggcguaaccggcag

SEQ ID NO: 1161317 - RNA, 21 nt, Mycobacterium bovis subsp bovis AF2122/97
gcgaccggcguaaccggcagc

SEQ ID NO: 1161318 - RNA, 14 nt, Mycobacterium bovis subsp bovis AF2122/97
gcgaccgcugaggu

SEQ ID NO: 1161319 - RNA, 15 nt, Mycobacterium bovis subsp bovis AF2122/97
gcgaccggcgagccc

SEQ ID NO: 1161320 - RNA, 20 nt, Mycobacterium bovis subsp bovis AF2122/97
gcgacgcauaaccggcgcgc

SEQ ID NO: 1161321 - RNA, 22 nt, Mycobacterium bovis subsp bovis AF2122/97
gcgacgcauaaccggcgcgccc

SEQ ID NO: 1161322 - RNA, 15 nt, Mycobacterium bovis subsp bovis AF2122/97
gcgacgccaugguca

SEQ ID NO: 1161323 - RNA, 19 nt, Mycobacterium bovis subsp bovis AF2122/97
gcgacgccauggucagaua

SEQ ID NO: 1161324 - RNA, 20 nt, Mycobacterium bovis subsp bovis AF2122/97
gcgacgcgcgagaacacccg

SEQ ID NO: 1161325 - RNA, 17 nt, Mycobacterium bovis subsp bovis AF2122/97
gcgacgcggccagcggc

SEQ ID NO: 1161326 - RNA, 18 nt, Mycobacterium bovis subsp bovis AF2122/97
gcgacgccggcccgacgg

SEQ ID NO: 1161327 - RNA, 21 nt, Mycobacterium bovis subsp bovis AF2122/97
gcgacgccgaaaaugccgccc

SEQ ID NO: 1161328 - RNA, 14 nt, Mycobacterium bovis subsp bovis AF2122/97
gcgacgccggcccg

SEQ ID NO: 1161329 - RNA, 18 nt, Mycobacterium bovis subsp bovis AF2122/97
gcgaccacgccgccggcg

SEQ ID NO: 1161330 - RNA, 14 nt, Mycobacterium bovis subsp bovis AF2122/97
gcgaccaccagcgc

SEQ ID NO: 1161331 - RNA, 15 nt, Mycobacterium bovis subsp bovis AF2122/97
gcgaccaccagcgcc

SEQ ID NO: 1161332 - RNA, 15 nt, Mycobacterium bovis subsp bovis AF2122/97
gcgaccacccccggc

SEQ ID NO: 1161333 - RNA, 13 nt, Mycobacterium bovis subsp bovis AF2122/97
gcgaccaccaccg

SEQ ID NO: 1161334 - RNA, 21 nt, Mycobacterium bovis subsp bovis AF2122/97
gcgaccgaugaucucacccag

SEQ ID NO: 1161335 - RNA, 12 nt, Mycobacterium bovis subsp bovis AF2122/97
gcgaccgccauu

SEQ ID NO: 1161336 - RNA, 17 nt, Mycobacterium bovis subsp bovis AF2122/97
gcgaccgccugcgcggc

SEQ ID NO: 1161337 - RNA, 18 nt, Mycobacterium bovis subsp bovis AF2122/97
gcgaccgcggccccgccg

SEQ ID NO: 1161338 - RNA, 22 nt, Mycobacterium bovis subsp bovis AF2122/97
gcgaccgcgcucaccggggccg

SEQ ID NO: 1161339 - RNA, 19 nt, Mycobacterium bovis subsp bovis AF2122/97
gcgaguagcugacccgcgg

SEQ ID NO: 1161340 - RNA, 18 nt, Mycobacterium bovis subsp bovis AF2122/97
gcgaggugccgggguggc

SEQ ID NO: 1161341 - RNA, 14 nt, Mycobacterium bovis subsp bovis AF2122/97
gcgagguucagccu

SEQ ID NO: 1161342 - RNA, 23 nt, Mycobacterium bovis subsp bovis AF2122/97
gcgagcggaauggaggccgccga

SEQ ID NO: 1161343 - RNA, 20 nt, Mycobacterium bovis subsp bovis AF2122/97
gcgagcucggccccgccgcc

SEQ ID NO: 1161344 - RNA, 16 nt, Mycobacterium bovis subsp bovis AF2122/97
gcgagcguuuggacgg

SEQ ID NO: 1161345 - RNA, 16 nt, Mycobacterium bovis subsp bovis AF2122/97
gcgagcuggcguuccc

SEQ ID NO: 1161346 - RNA, 23 nt, Mycobacterium bovis subsp bovis AF2122/97
gcgagucgucccagucccgcguc

SEQ ID NO: 1161347 - RNA, 23 nt, Mycobacterium bovis subsp bovis AF2122/97
gcgagugcgugaucuggccgaag

SEQ ID NO: 1161348 - RNA, 21 nt, Mycobacterium bovis subsp bovis AF2122/97
gcgagugucuuagccagcagc

SEQ ID NO: 1161349 - RNA, 14 nt, Mycobacterium bovis subsp bovis AF2122/97
gcgagucccggcgg

SEQ ID NO: 1161350 - RNA, 21 nt, Mycobacterium bovis subsp bovis AF2122/97
gcgaguccucgagugccgccg

SEQ ID NO: 1161351 - RNA, 15 nt, Mycobacterium bovis subsp bovis AF2122/97
gcgagucgcgcuugg

SEQ ID NO: 1161352 - RNA, 19 nt, Mycobacterium bovis subsp bovis AF2122/97
gcgagucgaacccgcgagc

SEQ ID NO: 1161353 - RNA, 22 nt, Mycobacterium bovis subsp bovis AF2122/97
gcgaguuggccguggcgaauga

SEQ ID NO: 1161354 - RNA, 19 nt, Mycobacterium bovis subsp bovis AF2122/97
gcgaguuucugcucgaccg

SEQ ID NO: 1161355 - RNA, 18 nt, Mycobacterium bovis subsp bovis AF2122/97
gcgaucaccguuuggucc

SEQ ID NO: 1161356 - RNA, 16 nt, Mycobacterium bovis subsp bovis AF2122/97
gcgaucgucagccagc

SEQ ID NO: 1161357 - RNA, 21 nt, Mycobacterium bovis subsp bovis AF2122/97
gcgaucaccgagucgacggcc

SEQ ID NO: 1161358 - RNA, 13 nt, Mycobacterium bovis subsp bovis AF2122/97
gcgaugccguuca

SEQ ID NO: 1161359 - RNA, 17 nt, Mycobacterium bovis subsp bovis AF2122/97
gcgaugcgccaggcuga

SEQ ID NO: 1161360 - RNA, 23 nt, Mycobacterium bovis subsp bovis AF2122/97
gcgaucuuguccaggguggucag

SEQ ID NO: 1161361 - RNA, 15 nt, Mycobacterium bovis subsp bovis AF2122/97
gcgaucucgacggcc

SEQ ID NO: 1161362 - RNA, 18 nt, Mycobacterium bovis subsp bovis AF2122/97
gcgaucucaccuggagcu

SEQ ID NO: 1161363 - RNA, 13 nt, Mycobacterium bovis subsp bovis AF2122/97
gcgaucugcagcg

SEQ ID NO: 1161364 - RNA, 22 nt, Mycobacterium bovis subsp bovis AF2122/97
gcgaucugggcuuucagcaccg

SEQ ID NO: 1161365 - RNA, 15 nt, Mycobacterium bovis subsp bovis AF2122/97
gcgaucugcucgccc

SEQ ID NO: 1161366 - RNA, 15 nt, Mycobacterium bovis subsp bovis AF2122/97
gcgacggcgacguga

SEQ ID NO: 1161367 - RNA, 22 nt, Mycobacterium bovis subsp bovis AF2122/97
gcgacggccaagaucggcgccc

SEQ ID NO: 1161368 - RNA, 12 nt, Mycobacterium bovis subsp bovis AF2122/97
gcgacggcgccc

SEQ ID NO: 1161369 - RNA, 23 nt, Mycobacterium bovis subsp bovis AF2122/97
gcgacggcggagucgcgcagggc

SEQ ID NO: 1161370 - RNA, 18 nt, Mycobacterium bovis subsp bovis AF2122/97
gcgacggcggcacgggcg

SEQ ID NO: 1161371 - RNA, 13 nt, Mycobacterium bovis subsp bovis AF2122/97
gcgacggccggga

SEQ ID NO: 1161372 - RNA, 23 nt, Mycobacterium bovis subsp bovis AF2122/97
gcgacggucaaggugcgccgcca

SEQ ID NO: 1161373 - RNA, 15 nt, Mycobacterium bovis subsp bovis AF2122/97
gcgacgcucgcugca

SEQ ID NO: 1161374 - RNA, 17 nt, Mycobacterium bovis subsp bovis AF2122/97
gcgacgcucgcugcagc

SEQ ID NO: 1161375 - RNA, 21 nt, Mycobacterium bovis subsp bovis AF2122/97
gcgacgcucgcugcagcaggg

SEQ ID NO: 1161376 - RNA, 20 nt, Mycobacterium bovis subsp bovis AF2122/97
gcgacgcuaggacggcugcc

SEQ ID NO: 1161377 - RNA, 16 nt, Mycobacterium bovis subsp bovis AF2122/97
gcgacgcuaccgccgg

SEQ ID NO: 1161378 - RNA, 18 nt, Mycobacterium bovis subsp bovis AF2122/97
gcgacguccaccagccgg

SEQ ID NO: 1161379 - RNA, 20 nt, Mycobacterium bovis subsp bovis AF2122/97
gcgacgucucgcaugcucac

SEQ ID NO: 1161380 - RNA, 19 nt, Mycobacterium bovis subsp bovis AF2122/97
gcgacgucugccaggcgca

SEQ ID NO: 1161381 - RNA, 15 nt, Mycobacterium bovis subsp bovis AF2122/97
gcgacggugccaccg

SEQ ID NO: 1161382 - RNA, 20 nt, Mycobacterium bovis subsp bovis AF2122/97
gcgacgguucccagcuuccg

SEQ ID NO: 1161383 - RNA, 19 nt, Mycobacterium bovis subsp bovis AF2122/97
gcgacgucaggguauccac

SEQ ID NO: 1161384 - RNA, 22 nt, Mycobacterium bovis subsp bovis AF2122/97
gcgacguauuucgcccccugga

SEQ ID NO: 1161385 - RNA, 18 nt, Mycobacterium bovis subsp bovis AF2122/97
gcgacgucaaacgcaaag

SEQ ID NO: 1161386 - RNA, 16 nt, Mycobacterium bovis subsp bovis AF2122/97
gcgacuccaccccacc

SEQ ID NO: 1161387 - RNA, 16 nt, Mycobacterium bovis subsp bovis AF2122/97
gcgacuaccaucgccg

SEQ ID NO: 1161388 - RNA, 21 nt, Mycobacterium bovis subsp bovis AF2122/97
gcgacuacggccucgcugggc

SEQ ID NO: 1161389 - RNA, 22 nt, Mycobacterium bovis subsp bovis AF2122/97
gcgacuagacgccgccgcugcc

SEQ ID NO: 1161390 - RNA, 16 nt, Mycobacterium bovis subsp bovis AF2122/97
gcgacgucgacaauca

SEQ ID NO: 1161391 - RNA, 19 nt, Mycobacterium bovis subsp bovis AF2122/97
gcgacgugaaugguggugu

SEQ ID NO: 1161392 - RNA, 12 nt, Mycobacterium bovis subsp bovis AF2122/97
gcgagccaacuc

SEQ ID NO: 1161393 - RNA, 14 nt, Mycobacterium bovis subsp bovis AF2122/97
gcgagcgcggccug

SEQ ID NO: 1161394 - RNA, 12 nt, Mycobacterium bovis subsp bovis AF2122/97
gcgagcgcgcca

SEQ ID NO: 1161395 - RNA, 15 nt, Mycobacterium bovis subsp bovis AF2122/97
gcgagcgcgccggcc

SEQ ID NO: 1161396 - RNA, 20 nt, Mycobacterium bovis subsp bovis AF2122/97
gcgagcaccaccccagcggc

SEQ ID NO: 1161397 - RNA, 21 nt, Mycobacterium bovis subsp bovis AF2122/97
gcgagcaccaccccagcggcc

SEQ ID NO: 1161398 - RNA, 22 nt, Mycobacterium bovis subsp bovis AF2122/97
gcgagcaccaccccagcggcca

SEQ ID NO: 1161399 - RNA, 15 nt, Mycobacterium bovis subsp bovis AF2122/97
gcgagcagacgcaga

SEQ ID NO: 1161400 - RNA, 17 nt, Mycobacterium bovis subsp bovis AF2122/97
gcgagcagacgccgcgu

SEQ ID NO: 1161401 - RNA, 17 nt, Mycobacterium bovis subsp bovis AF2122/97
gcgagcacgucggggug

SEQ ID NO: 1161402 - RNA, 15 nt, Mycobacterium bovis subsp bovis AF2122/97
gcgagcagacgcgga

SEQ ID NO: 1161403 - RNA, 23 nt, Mycobacterium bovis subsp bovis AF2122/97
gcgagcagggcgucgaccgcggc

SEQ ID NO: 1161404 - RNA, 19 nt, Mycobacterium bovis subsp bovis AF2122/97
gcgagcauaccgccgcugc

SEQ ID NO: 1161405 - RNA, 13 nt, Mycobacterium bovis subsp bovis AF2122/97
gcgagcaccaccc

SEQ ID NO: 1161406 - RNA, 23 nt, Mycobacterium bovis subsp bovis AF2122/97
gcgagaccucucugcgccaggcg

SEQ ID NO: 1161407 - RNA, 13 nt, Mycobacterium bovis subsp bovis AF2122/97
gcgagacgcucca

SEQ ID NO: 1161408 - RNA, 20 nt, Mycobacterium bovis subsp bovis AF2122/97
gcgagaaggugcugcgcggg

SEQ ID NO: 1161409 - RNA, 19 nt, Mycobacterium bovis subsp bovis AF2122/97
gcgagaagucgcagcgagg

SEQ ID NO: 1161410 - RNA, 16 nt, Mycobacterium bovis subsp bovis AF2122/97
gcgagaaggugcugcg

SEQ ID NO: 1161411 - RNA, 12 nt, Mycobacterium bovis subsp bovis AF2122/97
gcgacucggugc

SEQ ID NO: 1161412 - RNA, 13 nt, Mycobacterium bovis subsp bovis AF2122/97
gcgacucgccggc

SEQ ID NO: 1161413 - RNA, 21 nt, Mycobacterium bovis subsp bovis AF2122/97
gcgacucgccggcgaauccgc

SEQ ID NO: 1161414 - RNA, 15 nt, Mycobacterium bovis subsp bovis AF2122/97
gcgacuuucugcgcg

SEQ ID NO: 1161415 - RNA, 17 nt, Mycobacterium bovis subsp bovis AF2122/97
gcgcaguuuggcggcgc

SEQ ID NO: 1161416 - RNA, 19 nt, Mycobacterium bovis subsp bovis AF2122/97
gcgcaguuuggcggcgcgc

SEQ ID NO: 1161417 - RNA, 13 nt, Mycobacterium bovis subsp bovis AF2122/97
gcgcaucaccacu

SEQ ID NO: 1161418 - RNA, 17 nt, Mycobacterium bovis subsp bovis AF2122/97
gcgcaggugcugggcga

SEQ ID NO: 1161419 - RNA, 16 nt, Mycobacterium bovis subsp bovis AF2122/97
gcgcaguagccgacca

SEQ ID NO: 1161420 - RNA, 20 nt, Mycobacterium bovis subsp bovis AF2122/97
gcgcagcgauucgccuagcg

SEQ ID NO: 1161421 - RNA, 15 nt, Mycobacterium bovis subsp bovis AF2122/97
gcgcagcgcaaacau

SEQ ID NO: 1161422 - RNA, 21 nt, Mycobacterium bovis subsp bovis AF2122/97
gcgcagcgaaucuccaaguag

SEQ ID NO: 1161423 - RNA, 15 nt, Mycobacterium bovis subsp bovis AF2122/97
gcgcagccugcagcg

SEQ ID NO: 1161424 - RNA, 13 nt, Mycobacterium bovis subsp bovis AF2122/97
gcgcagcgccucc

SEQ ID NO: 1161425 - RNA, 19 nt, Mycobacterium bovis subsp bovis AF2122/97
gcgcagcgccgccaccccg

SEQ ID NO: 1161426 - RNA, 14 nt, Mycobacterium bovis subsp bovis AF2122/97
gcgcagccggcccg

SEQ ID NO: 1161427 - RNA, 21 nt, Mycobacterium bovis subsp bovis AF2122/97
gcgcagccgggucuacagcgu

SEQ ID NO: 1161428 - RNA, 17 nt, Mycobacterium bovis subsp bovis AF2122/97
gcgcagccugccgauga

SEQ ID NO: 1161429 - RNA, 16 nt, Mycobacterium bovis subsp bovis AF2122/97
gcgcagaucguccacc

SEQ ID NO: 1161430 - RNA, 19 nt, Mycobacterium bovis subsp bovis AF2122/97
gcgcagaugagcgcggcga

SEQ ID NO: 1161431 - RNA, 23 nt, Mycobacterium bovis subsp bovis AF2122/97
gcgcagggcgacauugcgagcgc

SEQ ID NO: 1161432 - RNA, 15 nt, Mycobacterium bovis subsp bovis AF2122/97
gcgcagggaucgcag

SEQ ID NO: 1161433 - RNA, 14 nt, Mycobacterium bovis subsp bovis AF2122/97
gcgcagggccugga

SEQ ID NO: 1161434 - RNA, 21 nt, Mycobacterium bovis subsp bovis AF2122/97
gcgcaggcuuccagccacagc

SEQ ID NO: 1161435 - RNA, 13 nt, Mycobacterium bovis subsp bovis AF2122/97
gcgcaggggcggc

SEQ ID NO: 1161436 - RNA, 14 nt, Mycobacterium bovis subsp bovis AF2122/97
gcgcaggggcggcg

SEQ ID NO: 1161437 - RNA, 23 nt, Mycobacterium bovis subsp bovis AF2122/97
gcgcaacuucgacuugagaaacc

SEQ ID NO: 1161438 - RNA, 19 nt, Mycobacterium bovis subsp bovis AF2122/97
gcgcaacuucuucagcagc

SEQ ID NO: 1161439 - RNA, 18 nt, Mycobacterium bovis subsp bovis AF2122/97
gcgcaagaaugccgccga

SEQ ID NO: 1161440 - RNA, 17 nt, Mycobacterium bovis subsp bovis AF2122/97
gcgcaagcgccgcgcuu

SEQ ID NO: 1161441 - RNA, 14 nt, Mycobacterium bovis subsp bovis AF2122/97
gcgaugcguccgcc

SEQ ID NO: 1161442 - RNA, 19 nt, Mycobacterium bovis subsp bovis AF2122/97
gcgaugcguccgcccagcc

SEQ ID NO: 1161443 - RNA, 22 nt, Mycobacterium bovis subsp bovis AF2122/97
gcgaugcucaaugugccgccgg

SEQ ID NO: 1161444 - RNA, 19 nt, Mycobacterium bovis subsp bovis AF2122/97
gcgcaacuaucgcaccucc

SEQ ID NO: 1161445 - RNA, 16 nt, Mycobacterium bovis subsp bovis AF2122/97
gcgcacagcgagcaca

SEQ ID NO: 1161446 - RNA, 18 nt, Mycobacterium bovis subsp bovis AF2122/97
gcgcaccaccgcggcggc

SEQ ID NO: 1161447 - RNA, 14 nt, Mycobacterium bovis subsp bovis AF2122/97
gcgcaccaccgagc

SEQ ID NO: 1161448 - RNA, 13 nt, Mycobacterium bovis subsp bovis AF2122/97
gcgcaccagcaca

SEQ ID NO: 1161449 - RNA, 16 nt, Mycobacterium bovis subsp bovis AF2122/97
gcgcaccaucgcggcc

SEQ ID NO: 1161450 - RNA, 18 nt, Mycobacterium bovis subsp bovis AF2122/97
gcgcaccaucgcggccgc

SEQ ID NO: 1161451 - RNA, 22 nt, Mycobacterium bovis subsp bovis AF2122/97
gcgcacccagcccagccguucg

SEQ ID NO: 1161452 - RNA, 15 nt, Mycobacterium bovis subsp bovis AF2122/97
gcgcacccgcggguc

SEQ ID NO: 1161453 - RNA, 22 nt, Mycobacterium bovis subsp bovis AF2122/97
gcgcaccggcuggcccagcgac

SEQ ID NO: 1161454 - RNA, 23 nt, Mycobacterium bovis subsp bovis AF2122/97
gcgcaccgguauguucggcaaug

SEQ ID NO: 1161455 - RNA, 15 nt, Mycobacterium bovis subsp bovis AF2122/97
gcgcacccggucggc

SEQ ID NO: 1161456 - RNA, 17 nt, Mycobacterium bovis subsp bovis AF2122/97
gcgcacucuagccgggu

SEQ ID NO: 1161457 - RNA, 21 nt, Mycobacterium bovis subsp bovis AF2122/97
gcgcacgaaaccgcagcgcga

SEQ ID NO: 1161458 - RNA, 17 nt, Mycobacterium bovis subsp bovis AF2122/97
gcgcacgaaaccgcagc

SEQ ID NO: 1161459 - RNA, 15 nt, Mycobacterium bovis subsp bovis AF2122/97
gcgcacgauagccac

SEQ ID NO: 1161460 - RNA, 19 nt, Mycobacterium bovis subsp bovis AF2122/97
gcgcacuugcguggcguug

SEQ ID NO: 1161461 - RNA, 16 nt, Mycobacterium bovis subsp bovis AF2122/97
gcgcagacucgccacc

SEQ ID NO: 1161462 - RNA, 22 nt, Mycobacterium bovis subsp bovis AF2122/97
gcgccaccucccacgccgccgu

SEQ ID NO: 1161463 - RNA, 16 nt, Mycobacterium bovis subsp bovis AF2122/97
gcgccaccguggugga

SEQ ID NO: 1161464 - RNA, 20 nt, Mycobacterium bovis subsp bovis AF2122/97
gcgccacggcagcgcccaga

SEQ ID NO: 1161465 - RNA, 17 nt, Mycobacterium bovis subsp bovis AF2122/97
gcgccacggcagcgccc

SEQ ID NO: 1161466 - RNA, 13 nt, Mycobacterium bovis subsp bovis AF2122/97
gcgccagcuccgu

SEQ ID NO: 1161467 - RNA, 16 nt, Mycobacterium bovis subsp bovis AF2122/97
gcgccagcucggcggc

SEQ ID NO: 1161468 - RNA, 19 nt, Mycobacterium bovis subsp bovis AF2122/97
gcgccagcucggcggcagc

SEQ ID NO: 1161469 - RNA, 22 nt, Mycobacterium bovis subsp bovis AF2122/97
gcgccagcucggcggcagcggc

SEQ ID NO: 1161470 - RNA, 18 nt, Mycobacterium bovis subsp bovis AF2122/97
gcgccaugaagccgggcg

SEQ ID NO: 1161471 - RNA, 17 nt, Mycobacterium bovis subsp bovis AF2122/97
gcgccauccccgccggc

SEQ ID NO: 1161472 - RNA, 20 nt, Mycobacterium bovis subsp bovis AF2122/97
gcgccaucgggucacccccg

SEQ ID NO: 1161473 - RNA, 21 nt, Mycobacterium bovis subsp bovis AF2122/97
gcgccaucgggucacccccgg

SEQ ID NO: 1161474 - RNA, 18 nt, Mycobacterium bovis subsp bovis AF2122/97
gcgccaucgaugcgguga

SEQ ID NO: 1161475 - RNA, 21 nt, Mycobacterium bovis subsp bovis AF2122/97
gcgccauauugauuccgaccc

SEQ ID NO: 1161476 - RNA, 19 nt, Mycobacterium bovis subsp bovis AF2122/97
gcgccaguucgcggcugcg

SEQ ID NO: 1161477 - RNA, 21 nt, Mycobacterium bovis subsp bovis AF2122/97
gcgccauaauauugccgccuc

SEQ ID NO: 1161478 - RNA, 17 nt, Mycobacterium bovis subsp bovis AF2122/97
gcgccaggagcgcggcc

SEQ ID NO: 1161479 - RNA, 22 nt, Mycobacterium bovis subsp bovis AF2122/97
gcgccaggagcgcggcccgccu

SEQ ID NO: 1161480 - RNA, 21 nt, Mycobacterium bovis subsp bovis AF2122/97
gcgccaggccgcacagcacca

SEQ ID NO: 1161481 - RNA, 15 nt, Mycobacterium bovis subsp bovis AF2122/97
gcgccaguggccacc

SEQ ID NO: 1161482 - RNA, 23 nt, Mycobacterium bovis subsp bovis AF2122/97
gcgccaacucgagaguggccucg

SEQ ID NO: 1161483 - RNA, 17 nt, Mycobacterium bovis subsp bovis AF2122/97
gcgccaacagaugccac

SEQ ID NO: 1161484 - RNA, 20 nt, Mycobacterium bovis subsp bovis AF2122/97
gcgccaaacccggcgggccc

SEQ ID NO: 1161485 - RNA, 15 nt, Mycobacterium bovis subsp bovis AF2122/97
gcgccaaacaccccg

SEQ ID NO: 1161486 - RNA, 21 nt, Mycobacterium bovis subsp bovis AF2122/97
gcgcauuuguugcugcugccg

SEQ ID NO: 1161487 - RNA, 13 nt, Mycobacterium bovis subsp bovis AF2122/97
gcgccacagcagc

SEQ ID NO: 1161488 - RNA, 14 nt, Mycobacterium bovis subsp bovis AF2122/97
gcgccacagcagcg

SEQ ID NO: 1161489 - RNA, 17 nt, Mycobacterium bovis subsp bovis AF2122/97
gcgccaccggcaccgcc

SEQ ID NO: 1161490 - RNA, 23 nt, Mycobacterium bovis subsp bovis AF2122/97
gcgccacccgcggugccugcagc

SEQ ID NO: 1161491 - RNA, 20 nt, Mycobacterium bovis subsp bovis AF2122/97
gcgccacccgcgucaguccu

SEQ ID NO: 1161492 - RNA, 17 nt, Mycobacterium bovis subsp bovis AF2122/97
gcgccacccgguccggc

SEQ ID NO: 1161493 - RNA, 20 nt, Mycobacterium bovis subsp bovis AF2122/97
gcgccacauacaccggccgg

SEQ ID NO: 1161494 - RNA, 18 nt, Mycobacterium bovis subsp bovis AF2122/97
gcgcauucgccgggcggc

SEQ ID NO: 1161495 - RNA, 21 nt, Mycobacterium bovis subsp bovis AF2122/97
gcgcaugugaaagacaacccg

SEQ ID NO: 1161496 - RNA, 19 nt, Mycobacterium bovis subsp bovis AF2122/97
gcgcauguuaugagcgcuc

SEQ ID NO: 1161497 - RNA, 21 nt, Mycobacterium bovis subsp bovis AF2122/97
gcgcauugccgacgcgcggcc

SEQ ID NO: 1161498 - RNA, 16 nt, Mycobacterium bovis subsp bovis AF2122/97
gcgcaucgccuccucg

SEQ ID NO: 1161499 - RNA, 17 nt, Mycobacterium bovis subsp bovis AF2122/97
gcgcaucgccuccucga

SEQ ID NO: 1161500 - RNA, 14 nt, Mycobacterium bovis subsp bovis AF2122/97
gcgcaucgcacggg

SEQ ID NO: 1161501 - RNA, 16 nt, Mycobacterium bovis subsp bovis AF2122/97
gcgcaucgcacgggcc

SEQ ID NO: 1161502 - RNA, 17 nt, Mycobacterium bovis subsp bovis AF2122/97
gcgcaucgagcaccucc

SEQ ID NO: 1161503 - RNA, 17 nt, Mycobacterium bovis subsp bovis AF2122/97
gcgcaucggccagcagc

SEQ ID NO: 1161504 - RNA, 18 nt, Mycobacterium bovis subsp bovis AF2122/97
gcgcaucgccgacagcgc

SEQ ID NO: 1161505 - RNA, 17 nt, Mycobacterium bovis subsp bovis AF2122/97
gcgcaucgccgcuggcc

SEQ ID NO: 1161506 - RNA, 15 nt, Mycobacterium bovis subsp bovis AF2122/97
gcgcaucugcucggc

SEQ ID NO: 1161507 - RNA, 16 nt, Mycobacterium bovis subsp bovis AF2122/97
gcuaucccaggggcac

SEQ ID NO: 1161508 - RNA, 19 nt, Mycobacterium bovis subsp bovis AF2122/97
gcuauccgcgggaaguucg

SEQ ID NO: 1161509 - RNA, 17 nt, Mycobacterium bovis subsp bovis AF2122/97
gcuaucgguucagcugc

SEQ ID NO: 1161510 - RNA, 18 nt, Mycobacterium bovis subsp bovis AF2122/97
gcuaucgguucagcugcg

SEQ ID NO: 1161511 - RNA, 22 nt, Mycobacterium bovis subsp bovis AF2122/97
gcuauccaggccgucaggcgug

SEQ ID NO: 1161512 - RNA, 20 nt, Mycobacterium bovis subsp bovis AF2122/97
gcuagcugaugccuggucgc

SEQ ID NO: 1161513 - RNA, 22 nt, Mycobacterium bovis subsp bovis AF2122/97
gcguuuauaccucgccgcccug

SEQ ID NO: 1161514 - RNA, 21 nt, Mycobacterium bovis subsp bovis AF2122/97
gcguuuaucagcaagagccgc

SEQ ID NO: 1161515 - RNA, 16 nt, Mycobacterium bovis subsp bovis AF2122/97
gcguugugcccgccgg

SEQ ID NO: 1161516 - RNA, 12 nt, Mycobacterium bovis subsp bovis AF2122/97
gcguuguugacc

SEQ ID NO: 1161517 - RNA, 18 nt, Mycobacterium bovis subsp bovis AF2122/97
gcuagccguucggcugcc

SEQ ID NO: 1161518 - RNA, 15 nt, Mycobacterium bovis subsp bovis AF2122/97
gcuagcgccgccagu

SEQ ID NO: 1161519 - RNA, 21 nt, Mycobacterium bovis subsp bovis AF2122/97
gcuagcgcuugcgaccccggc

SEQ ID NO: 1161520 - RNA, 13 nt, Mycobacterium bovis subsp bovis AF2122/97
gcuagcccggcag

SEQ ID NO: 1161521 - RNA, 16 nt, Mycobacterium bovis subsp bovis AF2122/97
gcuagagccaguuucu

SEQ ID NO: 1161522 - RNA, 16 nt, Mycobacterium bovis subsp bovis AF2122/97
gcuauugggugcagug

SEQ ID NO: 1161523 - RNA, 20 nt, Mycobacterium bovis subsp bovis AF2122/97
gcuauucggcggcauguuca

SEQ ID NO: 1161524 - RNA, 18 nt, Mycobacterium bovis subsp bovis AF2122/97
gcuaugcuggcagcucgg

SEQ ID NO: 1161525 - RNA, 15 nt, Mycobacterium bovis subsp bovis AF2122/97
gcucacgaucacccg

SEQ ID NO: 1161526 - RNA, 14 nt, Mycobacterium bovis subsp bovis AF2122/97
gcucaccggggucg

SEQ ID NO: 1161527 - RNA, 16 nt, Mycobacterium bovis subsp bovis AF2122/97
gcucaccucaugaucu

SEQ ID NO: 1161528 - RNA, 21 nt, Mycobacterium bovis subsp bovis AF2122/97
gcucaccucaugaucucacca

SEQ ID NO: 1161529 - RNA, 22 nt, Mycobacterium bovis subsp bovis AF2122/97
gcucacgccggguguggcuuga

SEQ ID NO: 1161530 - RNA, 15 nt, Mycobacterium bovis subsp bovis AF2122/97
gcucacggacgcugg

SEQ ID NO: 1161531 - RNA, 13 nt, Mycobacterium bovis subsp bovis AF2122/97
gcucaccggggcc

SEQ ID NO: 1161532 - RNA, 17 nt, Mycobacterium bovis subsp bovis AF2122/97
gcuccggcggcagcggc

SEQ ID NO: 1161533 - RNA, 13 nt, Mycobacterium bovis subsp bovis AF2122/97
gcuccggccggcc

SEQ ID NO: 1161534 - RNA, 19 nt, Mycobacterium bovis subsp bovis AF2122/97
gcuccgcgccgccccgcuc

SEQ ID NO: 1161535 - RNA, 23 nt, Mycobacterium bovis subsp bovis AF2122/97
gcuccgcggcgagcuccgaugcc

SEQ ID NO: 1161536 - RNA, 15 nt, Mycobacterium bovis subsp bovis AF2122/97
gcuccgcggcgcagc

SEQ ID NO: 1161537 - RNA, 20 nt, Mycobacterium bovis subsp bovis AF2122/97
gcuccgcggcgcagcacggc

SEQ ID NO: 1161538 - RNA, 16 nt, Mycobacterium bovis subsp bovis AF2122/97
gcuccgccgucgccgc

SEQ ID NO: 1161539 - RNA, 19 nt, Mycobacterium bovis subsp bovis AF2122/97
gcuccgccugccgcugguc

SEQ ID NO: 1161540 - RNA, 23 nt, Mycobacterium bovis subsp bovis AF2122/97
gcuccgccggguuggcgccggcc

SEQ ID NO: 1161541 - RNA, 14 nt, Mycobacterium bovis subsp bovis AF2122/97
gcuccgccgucgcc

SEQ ID NO: 1161542 - RNA, 12 nt, Mycobacterium bovis subsp bovis AF2122/97
gcuccgccgccg

SEQ ID NO: 1161543 - RNA, 13 nt, Mycobacterium bovis subsp bovis AF2122/97
gcuccgccgccga

SEQ ID NO: 1161544 - RNA, 18 nt, Mycobacterium bovis subsp bovis AF2122/97
gcucccuacgagcccacg

SEQ ID NO: 1161545 - RNA, 22 nt, Mycobacterium bovis subsp bovis AF2122/97
gcucccguacgccggcgguggc

SEQ ID NO: 1161546 - RNA, 14 nt, Mycobacterium bovis subsp bovis AF2122/97
gcucccgugcuggc

SEQ ID NO: 1161547 - RNA, 22 nt, Mycobacterium bovis subsp bovis AF2122/97
gcucccgugcuggcgccgaagu

SEQ ID NO: 1161548 - RNA, 16 nt, Mycobacterium bovis subsp bovis AF2122/97
gcucccgggcggcggc

SEQ ID NO: 1161549 - RNA, 18 nt, Mycobacterium bovis subsp bovis AF2122/97
gcucccgggcggcggccu

SEQ ID NO: 1161550 - RNA, 14 nt, Mycobacterium bovis subsp bovis AF2122/97
gcucccgggggcac

SEQ ID NO: 1161551 - RNA, 23 nt, Mycobacterium bovis subsp bovis AF2122/97
gcucccggagcacaauccagaca

SEQ ID NO: 1161552 - RNA, 20 nt, Mycobacterium bovis subsp bovis AF2122/97
gcucccgccacgucgccggc

SEQ ID NO: 1161553 - RNA, 21 nt, Mycobacterium bovis subsp bovis AF2122/97
gcucccccgccaaccccaaca

SEQ ID NO: 1161554 - RNA, 21 nt, Mycobacterium bovis subsp bovis AF2122/97
gcucccccgcuacgcgcgcuc

SEQ ID NO: 1161555 - RNA, 22 nt, Mycobacterium bovis subsp bovis AF2122/97
gcucgccaggcaagccagcacu

SEQ ID NO: 1161556 - RNA, 22 nt, Mycobacterium bovis subsp bovis AF2122/97
gcucgaucgcguucugcaccag

SEQ ID NO: 1161557 - RNA, 14 nt, Mycobacterium bovis subsp bovis AF2122/97
gcucgauacccagg

SEQ ID NO: 1161558 - RNA, 15 nt, Mycobacterium bovis subsp bovis AF2122/97
gcucgagguggucuc

SEQ ID NO: 1161559 - RNA, 19 nt, Mycobacterium bovis subsp bovis AF2122/97
gcucgaggcccgggugcua

SEQ ID NO: 1161560 - RNA, 21 nt, Mycobacterium bovis subsp bovis AF2122/97
gcucgaggaccaccuggucgc

SEQ ID NO: 1161561 - RNA, 17 nt, Mycobacterium bovis subsp bovis AF2122/97
gcucgccaggccuaggc

SEQ ID NO: 1161562 - RNA, 15 nt, Mycobacterium bovis subsp bovis AF2122/97
gcucgccccauguca

SEQ ID NO: 1161563 - RNA, 16 nt, Mycobacterium bovis subsp bovis AF2122/97
gcucgcccgccgccac

SEQ ID NO: 1161564 - RNA, 23 nt, Mycobacterium bovis subsp bovis AF2122/97
gcucgccgagcagacacagaauc

SEQ ID NO: 1161565 - RNA, 16 nt, Mycobacterium bovis subsp bovis AF2122/97
gcucgccgaccagcuu

SEQ ID NO: 1161566 - RNA, 12 nt, Mycobacterium bovis subsp bovis AF2122/97
gcucgccgaccc

SEQ ID NO: 1161567 - RNA, 16 nt, Mycobacterium bovis subsp bovis AF2122/97
gcucgccgacccgccg

SEQ ID NO: 1161568 - RNA, 17 nt, Mycobacterium bovis subsp bovis AF2122/97
gcucgccgacccgccgc

SEQ ID NO: 1161569 - RNA, 18 nt, Mycobacterium bovis subsp bovis AF2122/97
gcucgcccuauacgcaac

SEQ ID NO: 1161570 - RNA, 22 nt, Mycobacterium bovis subsp bovis AF2122/97
gcucgcccuaaccuaggcgcuc

SEQ ID NO: 1161571 - RNA, 15 nt, Mycobacterium bovis subsp bovis AF2122/97
gcucgccgaccagcu

SEQ ID NO: 1161572 - RNA, 24 nt, Mycobacterium bovis subsp bovis AF2122/97
gcuccugcucgucgagccgaccgc

SEQ ID NO: 1161573 - RNA, 22 nt, Mycobacterium bovis subsp bovis AF2122/97
gcuccuggucgccgugggccug

SEQ ID NO: 1161574 - RNA, 17 nt, Mycobacterium bovis subsp bovis AF2122/97
gcuccuguaacugcucc

SEQ ID NO: 1161575 - RNA, 16 nt, Mycobacterium bovis subsp bovis AF2122/97
gcucgagcagcgcgcc

SEQ ID NO: 1161576 - RNA, 22 nt, Mycobacterium bovis subsp bovis AF2122/97
gcucgagagcaugguccagcac

SEQ ID NO: 1161577 - RNA, 15 nt, Mycobacterium bovis subsp bovis AF2122/97
gcucgacgaggccac

SEQ ID NO: 1161578 - RNA, 16 nt, Mycobacterium bovis subsp bovis AF2122/97
gcucgacgcccgccac

SEQ ID NO: 1161579 - RNA, 18 nt, Mycobacterium bovis subsp bovis AF2122/97
gcuccuugaggucaccca

SEQ ID NO: 1161580 - RNA, 15 nt, Mycobacterium bovis subsp bovis AF2122/97
gcuccagcucggcca

SEQ ID NO: 1161581 - RNA, 17 nt, Mycobacterium bovis subsp bovis AF2122/97
gcuccagcucggcgggc

SEQ ID NO: 1161582 - RNA, 20 nt, Mycobacterium bovis subsp bovis AF2122/97
gcuccaccgggcccgccggc

SEQ ID NO: 1161583 - RNA, 18 nt, Mycobacterium bovis subsp bovis AF2122/97
gcuccacauaguccgaac

SEQ ID NO: 1161584 - RNA, 13 nt, Mycobacterium bovis subsp bovis AF2122/97
gcuccaccccuag

SEQ ID NO: 1161585 - RNA, 12 nt, Mycobacterium bovis subsp bovis AF2122/97
gcucccacggca

SEQ ID NO: 1161586 - RNA, 22 nt, Mycobacterium bovis subsp bovis AF2122/97
gcuccaggucgacauaggccac

SEQ ID NO: 1161587 - RNA, 16 nt, Mycobacterium bovis subsp bovis AF2122/97
gcuccaggcgcgccgc

SEQ ID NO: 1161588 - RNA, 22 nt, Mycobacterium bovis subsp bovis AF2122/97
gcuccagcugagcggccggcau

SEQ ID NO: 1161589 - RNA, 19 nt, Mycobacterium bovis subsp bovis AF2122/97
gcucaucuguaaccuccuc

SEQ ID NO: 1161590 - RNA, 21 nt, Mycobacterium bovis subsp bovis AF2122/97
gcucaucuguaaccuccucga

SEQ ID NO: 1161591 - RNA, 17 nt, Mycobacterium bovis subsp bovis AF2122/97
gcucauggcauuuccug

SEQ ID NO: 1161592 - RNA, 12 nt, Mycobacterium bovis subsp bovis AF2122/97
gcucacggcggc

SEQ ID NO: 1161593 - RNA, 17 nt, Mycobacterium bovis subsp bovis AF2122/97
gcucacuacccgcaacg

SEQ ID NO: 1161594 - RNA, 19 nt, Mycobacterium bovis subsp bovis AF2122/97
gcucacuacccgcaacgag

SEQ ID NO: 1161595 - RNA, 13 nt, Mycobacterium bovis subsp bovis AF2122/97
gcucacggcggcg

SEQ ID NO: 1161596 - RNA, 20 nt, Mycobacterium bovis subsp bovis AF2122/97
gcucagccguccgggcggcc

SEQ ID NO: 1161597 - RNA, 22 nt, Mycobacterium bovis subsp bovis AF2122/97
gcucagccguccgggcggccuc

SEQ ID NO: 1161598 - RNA, 17 nt, Mycobacterium bovis subsp bovis AF2122/97
gcucagcgaugcggccc

SEQ ID NO: 1161599 - RNA, 14 nt, Mycobacterium bovis subsp bovis AF2122/97
gcucagcgcggccc

SEQ ID NO: 1161600 - RNA, 17 nt, Mycobacterium bovis subsp bovis AF2122/97
gcucagcgcggccccga

SEQ ID NO: 1161601 - RNA, 23 nt, Mycobacterium bovis subsp bovis AF2122/97
gcucagcgcgcgccgcuggguga

SEQ ID NO: 1161602 - RNA, 13 nt, Mycobacterium bovis subsp bovis AF2122/97
gcucagcgguggc

SEQ ID NO: 1161603 - RNA, 17 nt, Mycobacterium bovis subsp bovis AF2122/97
gcucagcgugcgcuggc

SEQ ID NO: 1161604 - RNA, 18 nt, Mycobacterium bovis subsp bovis AF2122/97
gcugacgugucggcugcu

SEQ ID NO: 1161605 - RNA, 14 nt, Mycobacterium bovis subsp bovis AF2122/97
gcugagcacgcgga

SEQ ID NO: 1161606 - RNA, 16 nt, Mycobacterium bovis subsp bovis AF2122/97
gcugagcaaguccugc

SEQ ID NO: 1161607 - RNA, 17 nt, Mycobacterium bovis subsp bovis AF2122/97
gcugagcaaguccugca

SEQ ID NO: 1161608 - RNA, 17 nt, Mycobacterium bovis subsp bovis AF2122/97
gcugagcagcgccgcgu

SEQ ID NO: 1161609 - RNA, 14 nt, Mycobacterium bovis subsp bovis AF2122/97
gcugagcgccaggc

SEQ ID NO: 1161610 - RNA, 16 nt, Mycobacterium bovis subsp bovis AF2122/97
gcugagcccgccgcga

SEQ ID NO: 1161611 - RNA, 13 nt, Mycobacterium bovis subsp bovis AF2122/97
gcugagcggacuc

SEQ ID NO: 1161612 - RNA, 14 nt, Mycobacterium bovis subsp bovis AF2122/97
gcugagcugcucgc

SEQ ID NO: 1161613 - RNA, 15 nt, Mycobacterium bovis subsp bovis AF2122/97
gcugagcugcucgcc

SEQ ID NO: 1161614 - RNA, 17 nt, Mycobacterium bovis subsp bovis AF2122/97
gcugaggaagcggcggc

SEQ ID NO: 1161615 - RNA, 17 nt, Mycobacterium bovis subsp bovis AF2122/97
gcugaguccccaggugg

SEQ ID NO: 1161616 - RNA, 19 nt, Mycobacterium bovis subsp bovis AF2122/97
gcugaguccccaggugggc

SEQ ID NO: 1161617 - RNA, 20 nt, Mycobacterium bovis subsp bovis AF2122/97
gcugaugcgcugggccaggg

SEQ ID NO: 1161618 - RNA, 15 nt, Mycobacterium bovis subsp bovis AF2122/97
gcugauggugcugcg

SEQ ID NO: 1161619 - RNA, 14 nt, Mycobacterium bovis subsp bovis AF2122/97
gcugaugucgccgg

SEQ ID NO: 1161620 - RNA, 14 nt, Mycobacterium bovis subsp bovis AF2122/97
gcugauccaaguac

SEQ ID NO: 1161621 - RNA, 21 nt, Mycobacterium bovis subsp bovis AF2122/97
gcugaucagcaugcggccaug

SEQ ID NO: 1161622 - RNA, 12 nt, Mycobacterium bovis subsp bovis AF2122/97
gcugaucaacag

SEQ ID NO: 1161623 - RNA, 20 nt, Mycobacterium bovis subsp bovis AF2122/97
gcugaguccccaggugggca

SEQ ID NO: 1161624 - RNA, 23 nt, Mycobacterium bovis subsp bovis AF2122/97
gcugaguccccaggugggcagca

SEQ ID NO: 1161625 - RNA, 15 nt, Mycobacterium bovis subsp bovis AF2122/97
gcugaccgaagagcu

SEQ ID NO: 1161626 - RNA, 16 nt, Mycobacterium bovis subsp bovis AF2122/97
gcugaccggggcgccc

SEQ ID NO: 1161627 - RNA, 16 nt, Mycobacterium bovis subsp bovis AF2122/97
gcugaccguggcgccg

SEQ ID NO: 1161628 - RNA, 15 nt, Mycobacterium bovis subsp bovis AF2122/97
gcugacgaguugaug

SEQ ID NO: 1161629 - RNA, 15 nt, Mycobacterium bovis subsp bovis AF2122/97
gcugacgcccuccug

SEQ ID NO: 1161630 - RNA, 22 nt, Mycobacterium bovis subsp bovis AF2122/97
gcugaccagcguccagccgccc

SEQ ID NO: 1161631 - RNA, 21 nt, Mycobacterium bovis subsp bovis AF2122/97
gcugaccaucacacccaucac

SEQ ID NO: 1161632 - RNA, 21 nt, Mycobacterium bovis subsp bovis AF2122/97
gcugaccgacccggaccuggg

SEQ ID NO: 1161633 - RNA, 20 nt, Mycobacterium bovis subsp bovis AF2122/97
gcugaaucaccccggcggcc

SEQ ID NO: 1161634 - RNA, 14 nt, Mycobacterium bovis subsp bovis AF2122/97
gcugaauuggcgcc

SEQ ID NO: 1161635 - RNA, 14 nt, Mycobacterium bovis subsp bovis AF2122/97
gcugaaggacggca

SEQ ID NO: 1161636 - RNA, 23 nt, Mycobacterium bovis subsp bovis AF2122/97
gcugaacagacggcucagcgugc

SEQ ID NO: 1161637 - RNA, 19 nt, Mycobacterium bovis subsp bovis AF2122/97
gcugaacaccgugggcgga

SEQ ID NO: 1161638 - RNA, 19 nt, Mycobacterium bovis subsp bovis AF2122/97
gcugaagccgcuggaaguc

SEQ ID NO: 1161639 - RNA, 17 nt, Mycobacterium bovis subsp bovis AF2122/97
gcugaagaucaacaggc

SEQ ID NO: 1161640 - RNA, 20 nt, Mycobacterium bovis subsp bovis AF2122/97
gcugaagaucaacaggcguc

SEQ ID NO: 1161641 - RNA, 20 nt, Mycobacterium bovis subsp bovis AF2122/97
gcucgucggcgccggcggcc

SEQ ID NO: 1161642 - RNA, 23 nt, Mycobacterium bovis subsp bovis AF2122/97
gcucgucggcgauggccagcacg

SEQ ID NO: 1161643 - RNA, 14 nt, Mycobacterium bovis subsp bovis AF2122/97
gcucgucgcggccc

SEQ ID NO: 1161644 - RNA, 22 nt, Mycobacterium bovis subsp bovis AF2122/97
gcucgucgcggcccgcgaauac

SEQ ID NO: 1161645 - RNA, 14 nt, Mycobacterium bovis subsp bovis AF2122/97
gcucgucgccggug

SEQ ID NO: 1161646 - RNA, 13 nt, Mycobacterium bovis subsp bovis AF2122/97
gcucgucgagcug

SEQ ID NO: 1161647 - RNA, 12 nt, Mycobacterium bovis subsp bovis AF2122/97
gcucguccagca

SEQ ID NO: 1161648 - RNA, 21 nt, Mycobacterium bovis subsp bovis AF2122/97
gcucgucacgugucccgcaug

SEQ ID NO: 1161649 - RNA, 16 nt, Mycobacterium bovis subsp bovis AF2122/97
gcucgucgaacauggc

SEQ ID NO: 1161650 - RNA, 18 nt, Mycobacterium bovis subsp bovis AF2122/97
gcucgucgaacauggcac

SEQ ID NO: 1161651 - RNA, 12 nt, Mycobacterium bovis subsp bovis AF2122/97
gcucgccggcca

SEQ ID NO: 1161652 - RNA, 21 nt, Mycobacterium bovis subsp bovis AF2122/97
gcucguguuguugaagcccga

SEQ ID NO: 1161653 - RNA, 19 nt, Mycobacterium bovis subsp bovis AF2122/97
gcucguuagcggcgggcac

SEQ ID NO: 1161654 - RNA, 18 nt, Mycobacterium bovis subsp bovis AF2122/97
gcucgucuuggcggcggu

SEQ ID NO: 1161655 - RNA, 15 nt, Mycobacterium bovis subsp bovis AF2122/97
gcucgucuugggccg

SEQ ID NO: 1161656 - RNA, 17 nt, Mycobacterium bovis subsp bovis AF2122/97
gcucgucgucgauccag

SEQ ID NO: 1161657 - RNA, 20 nt, Mycobacterium bovis subsp bovis AF2122/97
gcucgucgucgauccagccc

SEQ ID NO: 1161658 - RNA, 18 nt, Mycobacterium bovis subsp bovis AF2122/97
gcucguuugcgagcaggg

SEQ ID NO: 1161659 - RNA, 18 nt, Mycobacterium bovis subsp bovis AF2122/97
gcucucgaguccaggcag

SEQ ID NO: 1161660 - RNA, 20 nt, Mycobacterium bovis subsp bovis AF2122/97
gcucucgaguccaggcagcu

SEQ ID NO: 1161661 - RNA, 15 nt, Mycobacterium bovis subsp bovis AF2122/97
gcucuccauggccga

SEQ ID NO: 1161662 - RNA, 16 nt, Mycobacterium bovis subsp bovis AF2122/97
gcucucggcacccggc

SEQ ID NO: 1161663 - RNA, 18 nt, Mycobacterium bovis subsp bovis AF2122/97
gcucucggucaguuccuc

SEQ ID NO: 1161664 - RNA, 18 nt, Mycobacterium bovis subsp bovis AF2122/97
gcucucggucugcaugcg

SEQ ID NO: 1161665 - RNA, 14 nt, Mycobacterium bovis subsp bovis AF2122/97
gcucuugcgggcag

SEQ ID NO: 1161666 - RNA, 18 nt, Mycobacterium bovis subsp bovis AF2122/97
gcucuuugagugccgcgu

SEQ ID NO: 1161667 - RNA, 18 nt, Mycobacterium bovis subsp bovis AF2122/97
gcucugcgaccucgccgg

SEQ ID NO: 1161668 - RNA, 15 nt, Mycobacterium bovis subsp bovis AF2122/97
gcucugcugccagcc

SEQ ID NO: 1161669 - RNA, 20 nt, Mycobacterium bovis subsp bovis AF2122/97
gcucucuucgcgcgcugggc

SEQ ID NO: 1161670 - RNA, 19 nt, Mycobacterium bovis subsp bovis AF2122/97
gcucuggucgucgaacggc

SEQ ID NO: 1161671 - RNA, 17 nt, Mycobacterium bovis subsp bovis AF2122/97
gcgucggcgcccagcuc

SEQ ID NO: 1161672 - RNA, 18 nt, Mycobacterium bovis subsp bovis AF2122/97
gcgucggcgcccagcucg

SEQ ID NO: 1161673 - RNA, 16 nt, Mycobacterium bovis subsp bovis AF2122/97
gcgucggugagcgcgu

SEQ ID NO: 1161674 - RNA, 21 nt, Mycobacterium bovis subsp bovis AF2122/97
gcgucgugccacuuccacggc

SEQ ID NO: 1161675 - RNA, 21 nt, Mycobacterium bovis subsp bovis AF2122/97
gcgucgucggcgggcugcagu

SEQ ID NO: 1161676 - RNA, 20 nt, Mycobacterium bovis subsp bovis AF2122/97
gcgucguaaccgucgccugc

SEQ ID NO: 1161677 - RNA, 14 nt, Mycobacterium bovis subsp bovis AF2122/97
gcgucgucgacggc

SEQ ID NO: 1161678 - RNA, 16 nt, Mycobacterium bovis subsp bovis AF2122/97
gcgucgccgccgggca

SEQ ID NO: 1161679 - RNA, 14 nt, Mycobacterium bovis subsp bovis AF2122/97
gcgucgccgccauu

SEQ ID NO: 1161680 - RNA, 15 nt, Mycobacterium bovis subsp bovis AF2122/97
gcgucgccggcaccg

SEQ ID NO: 1161681 - RNA, 21 nt, Mycobacterium bovis subsp bovis AF2122/97
gcgucgccggccccgccggcg

SEQ ID NO: 1161682 - RNA, 13 nt, Mycobacterium bovis subsp bovis AF2122/97
gcgucggccaccg

SEQ ID NO: 1161683 - RNA, 17 nt, Mycobacterium bovis subsp bovis AF2122/97
gcgugacguaccacggc

SEQ ID NO: 1161684 - RNA, 16 nt, Mycobacterium bovis subsp bovis AF2122/97
gcgugacgaccagccc

SEQ ID NO: 1161685 - RNA, 19 nt, Mycobacterium bovis subsp bovis AF2122/97
gcgugacgaccagccccgc

SEQ ID NO: 1161686 - RNA, 13 nt, Mycobacterium bovis subsp bovis AF2122/97
gcgugccgcagcg

SEQ ID NO: 1161687 - RNA, 15 nt, Mycobacterium bovis subsp bovis AF2122/97
gcgugacccgacaug

SEQ ID NO: 1161688 - RNA, 22 nt, Mycobacterium bovis subsp bovis AF2122/97
gcgucgucgguaaugccgggcc

SEQ ID NO: 1161689 - RNA, 15 nt, Mycobacterium bovis subsp bovis AF2122/97
gcgucguggggaccg

SEQ ID NO: 1161690 - RNA, 19 nt, Mycobacterium bovis subsp bovis AF2122/97
gcgucguucggagcccuga

SEQ ID NO: 1161691 - RNA, 18 nt, Mycobacterium bovis subsp bovis AF2122/97
gcgugcgaugcagcgcgc

SEQ ID NO: 1161692 - RNA, 21 nt, Mycobacterium bovis subsp bovis AF2122/97
gcgugcgauucugcgucugcu

SEQ ID NO: 1161693 - RNA, 13 nt, Mycobacterium bovis subsp bovis AF2122/97
gcgugcgcaaggc

SEQ ID NO: 1161694 - RNA, 15 nt, Mycobacterium bovis subsp bovis AF2122/97
gcgugcgggggacgg

SEQ ID NO: 1161695 - RNA, 23 nt, Mycobacterium bovis subsp bovis AF2122/97
gcguggcaguacaccggcgugcu

SEQ ID NO: 1161696 - RNA, 13 nt, Mycobacterium bovis subsp bovis AF2122/97
gcgugcggcugcc

SEQ ID NO: 1161697 - RNA, 15 nt, Mycobacterium bovis subsp bovis AF2122/97
gcgugcgcgucggug

SEQ ID NO: 1161698 - RNA, 17 nt, Mycobacterium bovis subsp bovis AF2122/97
gcguggccgccggcgcu

SEQ ID NO: 1161699 - RNA, 14 nt, Mycobacterium bovis subsp bovis AF2122/97
gcguggccgccggc

SEQ ID NO: 1161700 - RNA, 20 nt, Mycobacterium bovis subsp bovis AF2122/97
gcguggcggggccgcgccuu

SEQ ID NO: 1161701 - RNA, 16 nt, Mycobacterium bovis subsp bovis AF2122/97
gcguggcguugguggu

SEQ ID NO: 1161702 - RNA, 22 nt, Mycobacterium bovis subsp bovis AF2122/97
gcgugucguugccagggcgggc

SEQ ID NO: 1161703 - RNA, 18 nt, Mycobacterium bovis subsp bovis AF2122/97
gcgugucgaugcgggcug

SEQ ID NO: 1161704 - RNA, 19 nt, Mycobacterium bovis subsp bovis AF2122/97
gcguguccuuugccaccuc

SEQ ID NO: 1161705 - RNA, 15 nt, Mycobacterium bovis subsp bovis AF2122/97
gcguguggagcucgc

SEQ ID NO: 1161706 - RNA, 12 nt, Mycobacterium bovis subsp bovis AF2122/97
gcgugugcucgu

SEQ ID NO: 1161707 - RNA, 17 nt, Mycobacterium bovis subsp bovis AF2122/97
gcgugggcaccccgcgg

SEQ ID NO: 1161708 - RNA, 18 nt, Mycobacterium bovis subsp bovis AF2122/97
gcguugguggucugccaa

SEQ ID NO: 1161709 - RNA, 18 nt, Mycobacterium bovis subsp bovis AF2122/97
gcguugucggcuggacgg

SEQ ID NO: 1161710 - RNA, 16 nt, Mycobacterium bovis subsp bovis AF2122/97
gcguuggccauggcca

SEQ ID NO: 1161711 - RNA, 13 nt, Mycobacterium bovis subsp bovis AF2122/97
gcguuggcccgcc

SEQ ID NO: 1161712 - RNA, 15 nt, Mycobacterium bovis subsp bovis AF2122/97
gcguuggccagcagg

SEQ ID NO: 1161713 - RNA, 15 nt, Mycobacterium bovis subsp bovis AF2122/97
gcguuggcggcaagg

SEQ ID NO: 1161714 - RNA, 19 nt, Mycobacterium bovis subsp bovis AF2122/97
gcguuggcggcaagggugg

SEQ ID NO: 1161715 - RNA, 12 nt, Mycobacterium bovis subsp bovis AF2122/97
gcguuggcggcg

SEQ ID NO: 1161716 - RNA, 16 nt, Mycobacterium bovis subsp bovis AF2122/97
gcguugccgaaacccg

SEQ ID NO: 1161717 - RNA, 17 nt, Mycobacterium bovis subsp bovis AF2122/97
gcguucccacuggaggu

SEQ ID NO: 1161718 - RNA, 22 nt, Mycobacterium bovis subsp bovis AF2122/97
gcguugccaagauccuugauca

SEQ ID NO: 1161719 - RNA, 14 nt, Mycobacterium bovis subsp bovis AF2122/97
gcguugcacugcug

SEQ ID NO: 1161720 - RNA, 21 nt, Mycobacterium bovis subsp bovis AF2122/97
gcguucaccacgaucgcgagc

SEQ ID NO: 1161721 - RNA, 23 nt, Mycobacterium bovis subsp bovis AF2122/97
gcguucagugauucggccugagc

SEQ ID NO: 1161722 - RNA, 19 nt, Mycobacterium bovis subsp bovis AF2122/97
gcguucaggaugccaggac

SEQ ID NO: 1161723 - RNA, 22 nt, Mycobacterium bovis subsp bovis AF2122/97
gcguucagguguugacgccaac

SEQ ID NO: 1161724 - RNA, 16 nt, Mycobacterium bovis subsp bovis AF2122/97
gcguccgcccagccgc

SEQ ID NO: 1161725 - RNA, 18 nt, Mycobacterium bovis subsp bovis AF2122/97
gcguccgcgaucugcagc

SEQ ID NO: 1161726 - RNA, 16 nt, Mycobacterium bovis subsp bovis AF2122/97
gcgucccggcggucag

SEQ ID NO: 1161727 - RNA, 20 nt, Mycobacterium bovis subsp bovis AF2122/97
gcgucccggcggucagcggc

SEQ ID NO: 1161728 - RNA, 14 nt, Mycobacterium bovis subsp bovis AF2122/97
gcgucccgccgcac

SEQ ID NO: 1161729 - RNA, 15 nt, Mycobacterium bovis subsp bovis AF2122/97
gcguccccaugcagc

SEQ ID NO: 1161730 - RNA, 14 nt, Mycobacterium bovis subsp bovis AF2122/97
gcguccccagcgcc

SEQ ID NO: 1161731 - RNA, 17 nt, Mycobacterium bovis subsp bovis AF2122/97
gcguccccagcgccacc

SEQ ID NO: 1161732 - RNA, 16 nt, Mycobacterium bovis subsp bovis AF2122/97
gcguccaggugcgccg

SEQ ID NO: 1161733 - RNA, 14 nt, Mycobacterium bovis subsp bovis AF2122/97
gcguccaucgccac

SEQ ID NO: 1161734 - RNA, 16 nt, Mycobacterium bovis subsp bovis AF2122/97
gcguccaucgcgcgcc

SEQ ID NO: 1161735 - RNA, 14 nt, Mycobacterium bovis subsp bovis AF2122/97
gcguccaucaccag

SEQ ID NO: 1161736 - RNA, 14 nt, Mycobacterium bovis subsp bovis AF2122/97
gcguccauccgcag

SEQ ID NO: 1161737 - RNA, 21 nt, Mycobacterium bovis subsp bovis AF2122/97
gcguccacccacgaucagcag

SEQ ID NO: 1161738 - RNA, 19 nt, Mycobacterium bovis subsp bovis AF2122/97
gcguccaccugcuccgcug

SEQ ID NO: 1161739 - RNA, 19 nt, Mycobacterium bovis subsp bovis AF2122/97
gcguccaaggcgcgcuggg

SEQ ID NO: 1161740 - RNA, 15 nt, Mycobacterium bovis subsp bovis AF2122/97
gcguccaaggcgcug

SEQ ID NO: 1161741 - RNA, 20 nt, Mycobacterium bovis subsp bovis AF2122/97
gcguccaacccaggguggcg

SEQ ID NO: 1161742 - RNA, 23 nt, Mycobacterium bovis subsp bovis AF2122/97
gcgucgaaaagccgugcaccagc

SEQ ID NO: 1161743 - RNA, 16 nt, Mycobacterium bovis subsp bovis AF2122/97
gcguccuugggcgucg

SEQ ID NO: 1161744 - RNA, 19 nt, Mycobacterium bovis subsp bovis AF2122/97
gcgucgaacugggcgcccg

SEQ ID NO: 1161745 - RNA, 16 nt, Mycobacterium bovis subsp bovis AF2122/97
gcgucgacaacacgcc

SEQ ID NO: 1161746 - RNA, 16 nt, Mycobacterium bovis subsp bovis AF2122/97
gcguccuugcgcagca

SEQ ID NO: 1161747 - RNA, 13 nt, Mycobacterium bovis subsp bovis AF2122/97
gcgucgaacacgu

SEQ ID NO: 1161748 - RNA, 15 nt, Mycobacterium bovis subsp bovis AF2122/97
gcguccucgccgcac

SEQ ID NO: 1161749 - RNA, 13 nt, Mycobacterium bovis subsp bovis AF2122/97
gcguccggugcug

SEQ ID NO: 1161750 - RNA, 15 nt, Mycobacterium bovis subsp bovis AF2122/97
gcguccggugcuggu

SEQ ID NO: 1161751 - RNA, 16 nt, Mycobacterium bovis subsp bovis AF2122/97
gcguccgggcagccgc

SEQ ID NO: 1161752 - RNA, 16 nt, Mycobacterium bovis subsp bovis AF2122/97
gcgucgacccagaaca

SEQ ID NO: 1161753 - RNA, 19 nt, Mycobacterium bovis subsp bovis AF2122/97
gcgucgacgucagcaccau

SEQ ID NO: 1161754 - RNA, 20 nt, Mycobacterium bovis subsp bovis AF2122/97
gcgucgaagaccgccuccac

SEQ ID NO: 1161755 - RNA, 16 nt, Mycobacterium bovis subsp bovis AF2122/97
gcgucgagggagcgcc

SEQ ID NO: 1161756 - RNA, 15 nt, Mycobacterium bovis subsp bovis AF2122/97
gcgucgagcgccggc

SEQ ID NO: 1161757 - RNA, 21 nt, Mycobacterium bovis subsp bovis AF2122/97
gcgucgagcgacccccagcgc

SEQ ID NO: 1161758 - RNA, 13 nt, Mycobacterium bovis subsp bovis AF2122/97
gcgucgccaggcc

SEQ ID NO: 1161759 - RNA, 20 nt, Mycobacterium bovis subsp bovis AF2122/97
gcgucgcaacccggccugga

SEQ ID NO: 1161760 - RNA, 15 nt, Mycobacterium bovis subsp bovis AF2122/97
gcgucgcacgcgcgc

SEQ ID NO: 1161761 - RNA, 16 nt, Mycobacterium bovis subsp bovis AF2122/97
gcgucgcacgcgcgca

SEQ ID NO: 1161762 - RNA, 15 nt, Mycobacterium bovis subsp bovis AF2122/97
gcgucaccgccggug

SEQ ID NO: 1161763 - RNA, 20 nt, Mycobacterium bovis subsp bovis AF2122/97
gcgucaagcacacuggccac

SEQ ID NO: 1161764 - RNA, 15 nt, Mycobacterium bovis subsp bovis AF2122/97
gcgucaacgcuguug

SEQ ID NO: 1161765 - RNA, 19 nt, Mycobacterium bovis subsp bovis AF2122/97
gcgucaaacaccuccagga

SEQ ID NO: 1161766 - RNA, 20 nt, Mycobacterium bovis subsp bovis AF2122/97
gcgucacauccgacagcagc

SEQ ID NO: 1161767 - RNA, 18 nt, Mycobacterium bovis subsp bovis AF2122/97
gcgucaagggcuggguca

SEQ ID NO: 1161768 - RNA, 15 nt, Mycobacterium bovis subsp bovis AF2122/97
gcgucagcggcgagc

SEQ ID NO: 1161769 - RNA, 21 nt, Mycobacterium bovis subsp bovis AF2122/97
gcgucagccgcaccccgcccg

SEQ ID NO: 1161770 - RNA, 20 nt, Mycobacterium bovis subsp bovis AF2122/97
gcgucagcgccuuguggcac

SEQ ID NO: 1161771 - RNA, 13 nt, Mycobacterium bovis subsp bovis AF2122/97
gcgucaggccagc

SEQ ID NO: 1161772 - RNA, 22 nt, Mycobacterium bovis subsp bovis AF2122/97
gcgucaggcccucgggugucac

SEQ ID NO: 1161773 - RNA, 16 nt, Mycobacterium bovis subsp bovis AF2122/97
gcgucagugcagaaga

SEQ ID NO: 1161774 - RNA, 15 nt, Mycobacterium bovis subsp bovis AF2122/97
gcgucaucgcgggug

SEQ ID NO: 1161775 - RNA, 16 nt, Mycobacterium bovis subsp bovis AF2122/97
gcggugccggcccugc

SEQ ID NO: 1161776 - RNA, 13 nt, Mycobacterium bovis subsp bovis AF2122/97
gcguagcaggucg

SEQ ID NO: 1161777 - RNA, 22 nt, Mycobacterium bovis subsp bovis AF2122/97
gcggugccaccagugagcccgc

SEQ ID NO: 1161778 - RNA, 18 nt, Mycobacterium bovis subsp bovis AF2122/97
gcggugccgacggugggc

SEQ ID NO: 1161779 - RNA, 13 nt, Mycobacterium bovis subsp bovis AF2122/97
gcggugcccagca

SEQ ID NO: 1161780 - RNA, 16 nt, Mycobacterium bovis subsp bovis AF2122/97
gcggugcccagcagcg

SEQ ID NO: 1161781 - RNA, 16 nt, Mycobacterium bovis subsp bovis AF2122/97
gcggugaucggggucg

SEQ ID NO: 1161782 - RNA, 16 nt, Mycobacterium bovis subsp bovis AF2122/97
gcggugaugguggcaa

SEQ ID NO: 1161783 - RNA, 23 nt, Mycobacterium bovis subsp bovis AF2122/97
gcggugauugcaagcgggcaccg

SEQ ID NO: 1161784 - RNA, 13 nt, Mycobacterium bovis subsp bovis AF2122/97
gcguaggccagcg

SEQ ID NO: 1161785 - RNA, 17 nt, Mycobacterium bovis subsp bovis AF2122/97
gcguagcgaccucgccg

SEQ ID NO: 1161786 - RNA, 22 nt, Mycobacterium bovis subsp bovis AF2122/97
gcguagcgaccucgccgcggcg

SEQ ID NO: 1161787 - RNA, 17 nt, Mycobacterium bovis subsp bovis AF2122/97
gcguagguggccagcgc

SEQ ID NO: 1161788 - RNA, 12 nt, Mycobacterium bovis subsp bovis AF2122/97
gcguagggccag

SEQ ID NO: 1161789 - RNA, 15 nt, Mycobacterium bovis subsp bovis AF2122/97
gcguagggccagcgc

SEQ ID NO: 1161790 - RNA, 18 nt, Mycobacterium bovis subsp bovis AF2122/97
gcguauucggcaucgccg

SEQ ID NO: 1161791 - RNA, 21 nt, Mycobacterium bovis subsp bovis AF2122/97
gcggcaccucauugccguucu

SEQ ID NO: 1161792 - RNA, 16 nt, Mycobacterium bovis subsp bovis AF2122/97
gcggcaccgcgccggc

SEQ ID NO: 1161793 - RNA, 10 nt, Mycobacterium bovis subsp bovis AF2122/97
gcggcaccuu

SEQ ID NO: 1161794 - RNA, 15 nt, Mycobacterium bovis subsp bovis AF2122/97
gcggcacgcuccagc

SEQ ID NO: 1161795 - RNA, 23 nt, Mycobacterium bovis subsp bovis AF2122/97
gcggcacggaugcgauggccgac

SEQ ID NO: 1161796 - RNA, 16 nt, Mycobacterium bovis subsp bovis AF2122/97
gcggcacgaucgccaa

SEQ ID NO: 1161797 - RNA, 16 nt, Mycobacterium bovis subsp bovis AF2122/97
gcggcacgaucggcag

SEQ ID NO: 1161798 - RNA, 14 nt, Mycobacterium bovis subsp bovis AF2122/97
gcggcacgggcggc

SEQ ID NO: 1161799 - RNA, 16 nt, Mycobacterium bovis subsp bovis AF2122/97
gcggcacgggcggcca

SEQ ID NO: 1161800 - RNA, 18 nt, Mycobacterium bovis subsp bovis AF2122/97
gcggcacgggcggccaug

SEQ ID NO: 1161801 - RNA, 21 nt, Mycobacterium bovis subsp bovis AF2122/97
gcggcacgggcggccauggca

SEQ ID NO: 1161802 - RNA, 15 nt, Mycobacterium bovis subsp bovis AF2122/97
gcggcgcacaacccg

SEQ ID NO: 1161803 - RNA, 11 nt, Mycobacterium bovis subsp bovis AF2122/97
gcggcgcccgg

SEQ ID NO: 1161804 - RNA, 14 nt, Mycobacterium bovis subsp bovis AF2122/97
gcggcgccgccauc

SEQ ID NO: 1161805 - RNA, 18 nt, Mycobacterium bovis subsp bovis AF2122/97
gcggcgccgcagaucacc

SEQ ID NO: 1161806 - RNA, 16 nt, Mycobacterium bovis subsp bovis AF2122/97
gcggcgccggugguac

SEQ ID NO: 1161807 - RNA, 13 nt, Mycobacterium bovis subsp bovis AF2122/97
gcggcgcccagga

SEQ ID NO: 1161808 - RNA, 16 nt, Mycobacterium bovis subsp bovis AF2122/97
gcggcgcccaggaacu

SEQ ID NO: 1161809 - RNA, 20 nt, Mycobacterium bovis subsp bovis AF2122/97
gcggcggcaucucgcaccgc

SEQ ID NO: 1161810 - RNA, 22 nt, Mycobacterium bovis subsp bovis AF2122/97
gcggcggcaucucgcaccgcgc

SEQ ID NO: 1161811 - RNA, 22 nt, Mycobacterium bovis subsp bovis AF2122/97
gcggcgccggggggcugcugcu

SEQ ID NO: 1161812 - RNA, 13 nt, Mycobacterium bovis subsp bovis AF2122/97
gcggcggcagcgg

SEQ ID NO: 1161813 - RNA, 16 nt, Mycobacterium bovis subsp bovis AF2122/97
gcggcggcagcggcga

SEQ ID NO: 1161814 - RNA, 17 nt, Mycobacterium bovis subsp bovis AF2122/97
gcggcggccgcagcggc

SEQ ID NO: 1161815 - RNA, 22 nt, Mycobacterium bovis subsp bovis AF2122/97
gcggcgccgucgucagcgggua

SEQ ID NO: 1161816 - RNA, 12 nt, Mycobacterium bovis subsp bovis AF2122/97
gcggcgccguug

SEQ ID NO: 1161817 - RNA, 13 nt, Mycobacterium bovis subsp bovis AF2122/97
gcggcgccuccgc

SEQ ID NO: 1161818 - RNA, 12 nt, Mycobacterium bovis subsp bovis AF2122/97
gcggcgccgucg

SEQ ID NO: 1161819 - RNA, 19 nt, Mycobacterium bovis subsp bovis AF2122/97
gcggcgccuuccacggagu

SEQ ID NO: 1161820 - RNA, 21 nt, Mycobacterium bovis subsp bovis AF2122/97
gcggcggauggcgucgaccac

SEQ ID NO: 1161821 - RNA, 12 nt, Mycobacterium bovis subsp bovis AF2122/97
gcggcgggggcg

SEQ ID NO: 1161822 - RNA, 18 nt, Mycobacterium bovis subsp bovis AF2122/97
gcggcgggggcggcggcu

SEQ ID NO: 1161823 - RNA, 22 nt, Mycobacterium bovis subsp bovis AF2122/97
gcggcggggguucgcucuggug

SEQ ID NO: 1161824 - RNA, 14 nt, Mycobacterium bovis subsp bovis AF2122/97
gcggcggucggcug

SEQ ID NO: 1161825 - RNA, 22 nt, Mycobacterium bovis subsp bovis AF2122/97
gcggcgguaugccacaggcugc

SEQ ID NO: 1161826 - RNA, 13 nt, Mycobacterium bovis subsp bovis AF2122/97
gcggcggucgagc

SEQ ID NO: 1161827 - RNA, 15 nt, Mycobacterium bovis subsp bovis AF2122/97
gcggcggucgagcuc

SEQ ID NO: 1161828 - RNA, 14 nt, Mycobacterium bovis subsp bovis AF2122/97
gcggcggucucguc

SEQ ID NO: 1161829 - RNA, 20 nt, Mycobacterium bovis subsp bovis AF2122/97
gcggcggucucgucaaccug

SEQ ID NO: 1161830 - RNA, 14 nt, Mycobacterium bovis subsp bovis AF2122/97
gcggcggugcgccc

SEQ ID NO: 1161831 - RNA, 17 nt, Mycobacterium bovis subsp bovis AF2122/97
gcggcguuaccaccguc

SEQ ID NO: 1161832 - RNA, 19 nt, Mycobacterium bovis subsp bovis AF2122/97
gcggcguucgaugccacau

SEQ ID NO: 1161833 - RNA, 19 nt, Mycobacterium bovis subsp bovis AF2122/97
gcggcguuggugcagucgg

SEQ ID NO: 1161834 - RNA, 16 nt, Mycobacterium bovis subsp bovis AF2122/97
gcggcguugagcuggc

SEQ ID NO: 1161835 - RNA, 18 nt, Mycobacterium bovis subsp bovis AF2122/97
gcggcuacaucggcggcg

SEQ ID NO: 1161836 - RNA, 16 nt, Mycobacterium bovis subsp bovis AF2122/97
gcggcuaccgagauca

SEQ ID NO: 1161837 - RNA, 20 nt, Mycobacterium bovis subsp bovis AF2122/97
gcggcguuucccggguccug

SEQ ID NO: 1161838 - RNA, 15 nt, Mycobacterium bovis subsp bovis AF2122/97
gcggcguccagcagc

SEQ ID NO: 1161839 - RNA, 16 nt, Mycobacterium bovis subsp bovis AF2122/97
gcggcguccagcagcg

SEQ ID NO: 1161840 - RNA, 12 nt, Mycobacterium bovis subsp bovis AF2122/97
gcggcguccauc

SEQ ID NO: 1161841 - RNA, 19 nt, Mycobacterium bovis subsp bovis AF2122/97
gcggcguccaucgcgcgcc

SEQ ID NO: 1161842 - RNA, 18 nt, Mycobacterium bovis subsp bovis AF2122/97
gcggcgucggugagcgcg

SEQ ID NO: 1161843 - RNA, 13 nt, Mycobacterium bovis subsp bovis AF2122/97
gcggcgucguucg

SEQ ID NO: 1161844 - RNA, 17 nt, Mycobacterium bovis subsp bovis AF2122/97
gcggcgucguucgagac

SEQ ID NO: 1161845 - RNA, 20 nt, Mycobacterium bovis subsp bovis AF2122/97
gcggcgucggugagcgcguc

SEQ ID NO: 1161846 - RNA, 17 nt, Mycobacterium bovis subsp bovis AF2122/97
gcggcgucggucgggug

SEQ ID NO: 1161847 - RNA, 14 nt, Mycobacterium bovis subsp bovis AF2122/97
gcggcgucgacggc

SEQ ID NO: 1161848 - RNA, 16 nt, Mycobacterium bovis subsp bovis AF2122/97
gcggcugggcggucgg

SEQ ID NO: 1161849 - RNA, 22 nt, Mycobacterium bovis subsp bovis AF2122/97
gcggcuggggccccgcgccggc

SEQ ID NO: 1161850 - RNA, 22 nt, Mycobacterium bovis subsp bovis AF2122/97
gcggcugguguccagccaggcg

SEQ ID NO: 1161851 - RNA, 18 nt, Mycobacterium bovis subsp bovis AF2122/97
gcggcugucacgccugcc

SEQ ID NO: 1161852 - RNA, 23 nt, Mycobacterium bovis subsp bovis AF2122/97
gcggcuggcccgcaugccggcgc

SEQ ID NO: 1161853 - RNA, 18 nt, Mycobacterium bovis subsp bovis AF2122/97
gcggcuugucgccccaug

SEQ ID NO: 1161854 - RNA, 16 nt, Mycobacterium bovis subsp bovis AF2122/97
gcgggaacacaccgca

SEQ ID NO: 1161855 - RNA, 19 nt, Mycobacterium bovis subsp bovis AF2122/97
gcggcucgcguagguggca

SEQ ID NO: 1161856 - RNA, 14 nt, Mycobacterium bovis subsp bovis AF2122/97
gcggcucgccggcg

SEQ ID NO: 1161857 - RNA, 12 nt, Mycobacterium bovis subsp bovis AF2122/97
gcggcucgccgg

SEQ ID NO: 1161858 - RNA, 19 nt, Mycobacterium bovis subsp bovis AF2122/97
gcggcuccgaucucuggug

SEQ ID NO: 1161859 - RNA, 15 nt, Mycobacterium bovis subsp bovis AF2122/97
gcggcuccgcccggc

SEQ ID NO: 1161860 - RNA, 16 nt, Mycobacterium bovis subsp bovis AF2122/97
gcggcugcugcgcggu

SEQ ID NO: 1161861 - RNA, 20 nt, Mycobacterium bovis subsp bovis AF2122/97
gcggcuccaccgggcccgcc

SEQ ID NO: 1161862 - RNA, 18 nt, Mycobacterium bovis subsp bovis AF2122/97
gcggcucaaucuccuccg

SEQ ID NO: 1161863 - RNA, 16 nt, Mycobacterium bovis subsp bovis AF2122/97
gcggcuaggccagcac

SEQ ID NO: 1161864 - RNA, 22 nt, Mycobacterium bovis subsp bovis AF2122/97
gcggcucaaccucuggcggcgg

SEQ ID NO: 1161865 - RNA, 19 nt, Mycobacterium bovis subsp bovis AF2122/97
gcgggcgccuuccaggcgg

SEQ ID NO: 1161866 - RNA, 17 nt, Mycobacterium bovis subsp bovis AF2122/97
gcgggcgccgcuaggug

SEQ ID NO: 1161867 - RNA, 17 nt, Mycobacterium bovis subsp bovis AF2122/97
gcgggcgcccuugagcc

SEQ ID NO: 1161868 - RNA, 21 nt, Mycobacterium bovis subsp bovis AF2122/97
gcgggcgccuuggucgccgcc

SEQ ID NO: 1161869 - RNA, 22 nt, Mycobacterium bovis subsp bovis AF2122/97
gcgggcgcuugccggggugugc

SEQ ID NO: 1161870 - RNA, 18 nt, Mycobacterium bovis subsp bovis AF2122/97
gcgggcggaucgccgggg

SEQ ID NO: 1161871 - RNA, 13 nt, Mycobacterium bovis subsp bovis AF2122/97
gcgggcggcaccg

SEQ ID NO: 1161872 - RNA, 13 nt, Mycobacterium bovis subsp bovis AF2122/97
gcgggcgugugca

SEQ ID NO: 1161873 - RNA, 16 nt, Mycobacterium bovis subsp bovis AF2122/97
gcgggcgugccgacca

SEQ ID NO: 1161874 - RNA, 14 nt, Mycobacterium bovis subsp bovis AF2122/97
gcgggcggugggca

SEQ ID NO: 1161875 - RNA, 13 nt, Mycobacterium bovis subsp bovis AF2122/97
gcgggcggugggc

SEQ ID NO: 1161876 - RNA, 14 nt, Mycobacterium bovis subsp bovis AF2122/97
gcgggcucgcccgc

SEQ ID NO: 1161877 - RNA, 12 nt, Mycobacterium bovis subsp bovis AF2122/97
gcgggggcggcg

SEQ ID NO: 1161878 - RNA, 13 nt, Mycobacterium bovis subsp bovis AF2122/97
gcgggcuccccgg

SEQ ID NO: 1161879 - RNA, 14 nt, Mycobacterium bovis subsp bovis AF2122/97
gcggggugcucagc

SEQ ID NO: 1161880 - RNA, 19 nt, Mycobacterium bovis subsp bovis AF2122/97
gcggggugagggggugguc

SEQ ID NO: 1161881 - RNA, 13 nt, Mycobacterium bovis subsp bovis AF2122/97
gcgggguggguga

SEQ ID NO: 1161882 - RNA, 20 nt, Mycobacterium bovis subsp bovis AF2122/97
gcgggguggcggcgcugcgc

SEQ ID NO: 1161883 - RNA, 22 nt, Mycobacterium bovis subsp bovis AF2122/97
gcggggguggaaucagggucug

SEQ ID NO: 1161884 - RNA, 12 nt, Mycobacterium bovis subsp bovis AF2122/97
gcgggggugggc

SEQ ID NO: 1161885 - RNA, 21 nt, Mycobacterium bovis subsp bovis AF2122/97
gcgggggcuuaugcgucugcu

SEQ ID NO: 1161886 - RNA, 19 nt, Mycobacterium bovis subsp bovis AF2122/97
gcgggacaaaaucagcagc

SEQ ID NO: 1161887 - RNA, 22 nt, Mycobacterium bovis subsp bovis AF2122/97
gcgggaacgaucgaugaccuuu

SEQ ID NO: 1161888 - RNA, 20 nt, Mycobacterium bovis subsp bovis AF2122/97
gcgggaacgaugccgccggc

SEQ ID NO: 1161889 - RNA, 16 nt, Mycobacterium bovis subsp bovis AF2122/97
gcgggaacgcggcggc

SEQ ID NO: 1161890 - RNA, 19 nt, Mycobacterium bovis subsp bovis AF2122/97
gcgggaaguucgucgguug

SEQ ID NO: 1161891 - RNA, 16 nt, Mycobacterium bovis subsp bovis AF2122/97
gcgggacuugucgggg

SEQ ID NO: 1161892 - RNA, 22 nt, Mycobacterium bovis subsp bovis AF2122/97
gcgggacacgucgcgccaggcg

SEQ ID NO: 1161893 - RNA, 16 nt, Mycobacterium bovis subsp bovis AF2122/97
gcgggacaaccgggcg

SEQ ID NO: 1161894 - RNA, 14 nt, Mycobacterium bovis subsp bovis AF2122/97
gcgggacaccaccg

SEQ ID NO: 1161895 - RNA, 19 nt, Mycobacterium bovis subsp bovis AF2122/97
gcgggacagauggcggccg

SEQ ID NO: 1161896 - RNA, 20 nt, Mycobacterium bovis subsp bovis AF2122/97
gcgggacauccagugcggug

SEQ ID NO: 1161897 - RNA, 23 nt, Mycobacterium bovis subsp bovis AF2122/97
gcgggccgagaucacgccgggcg

SEQ ID NO: 1161898 - RNA, 21 nt, Mycobacterium bovis subsp bovis AF2122/97
gcgggccgaacacaccgggcg

SEQ ID NO: 1161899 - RNA, 23 nt, Mycobacterium bovis subsp bovis AF2122/97
gcgggcccucuaugcgggcagcg

SEQ ID NO: 1161900 - RNA, 17 nt, Mycobacterium bovis subsp bovis AF2122/97
gcgggcccgcgcggcgg

SEQ ID NO: 1161901 - RNA, 20 nt, Mycobacterium bovis subsp bovis AF2122/97
gcgggagguacccccagcac

SEQ ID NO: 1161902 - RNA, 15 nt, Mycobacterium bovis subsp bovis AF2122/97
gcgggcccgccggcc

SEQ ID NO: 1161903 - RNA, 20 nt, Mycobacterium bovis subsp bovis AF2122/97
gcgggcccgccggccccgcc

SEQ ID NO: 1161904 - RNA, 16 nt, Mycobacterium bovis subsp bovis AF2122/97
gcgggcccgcgcggcg

SEQ ID NO: 1161905 - RNA, 14 nt, Mycobacterium bovis subsp bovis AF2122/97
gcgggccuccugcu

SEQ ID NO: 1161906 - RNA, 22 nt, Mycobacterium bovis subsp bovis AF2122/97
gcgggccguagaucccgaagcg

SEQ ID NO: 1161907 - RNA, 21 nt, Mycobacterium bovis subsp bovis AF2122/97
gcgggccgcgucgaacugggc

SEQ ID NO: 1161908 - RNA, 14 nt, Mycobacterium bovis subsp bovis AF2122/97
gcgggccgccgcaa

SEQ ID NO: 1161909 - RNA, 11 nt, Mycobacterium bovis subsp bovis AF2122/97
gcgggccgcga

SEQ ID NO: 1161910 - RNA, 15 nt, Mycobacterium bovis subsp bovis AF2122/97
gcgggccggucgugc

SEQ ID NO: 1161911 - RNA, 16 nt, Mycobacterium bovis subsp bovis AF2122/97
gcgggugaugcaguga

SEQ ID NO: 1161912 - RNA, 18 nt, Mycobacterium bovis subsp bovis AF2122/97
gcgggugaucugggcggu

SEQ ID NO: 1161913 - RNA, 21 nt, Mycobacterium bovis subsp bovis AF2122/97
gcgggucuuggcgaucuccag

SEQ ID NO: 1161914 - RNA, 22 nt, Mycobacterium bovis subsp bovis AF2122/97
gcgggugaccaggcggcgcggg

SEQ ID NO: 1161915 - RNA, 14 nt, Mycobacterium bovis subsp bovis AF2122/97
gcggguaggugacg

SEQ ID NO: 1161916 - RNA, 12 nt, Mycobacterium bovis subsp bovis AF2122/97
gcgggugcuggu

SEQ ID NO: 1161917 - RNA, 22 nt, Mycobacterium bovis subsp bovis AF2122/97
gcgggugcuggucaacagcggc

SEQ ID NO: 1161918 - RNA, 23 nt, Mycobacterium bovis subsp bovis AF2122/97
gcgggugcuggucaacagcggca

SEQ ID NO: 1161919 - RNA, 12 nt, Mycobacterium bovis subsp bovis AF2122/97
gcgggugccagc

SEQ ID NO: 1161920 - RNA, 15 nt, Mycobacterium bovis subsp bovis AF2122/97
gcgggugccagcccg

SEQ ID NO: 1161921 - RNA, 17 nt, Mycobacterium bovis subsp bovis AF2122/97
gcgggugccgagcuggc

SEQ ID NO: 1161922 - RNA, 17 nt, Mycobacterium bovis subsp bovis AF2122/97
gcgguaccuagccgcag

SEQ ID NO: 1161923 - RNA, 18 nt, Mycobacterium bovis subsp bovis AF2122/97
gcgguaccuagccgcaga

SEQ ID NO: 1161924 - RNA, 18 nt, Mycobacterium bovis subsp bovis AF2122/97
gcgguacgccggucggug

SEQ ID NO: 1161925 - RNA, 23 nt, Mycobacterium bovis subsp bovis AF2122/97
gcgguaccaucaccgcgccagcc

SEQ ID NO: 1161926 - RNA, 16 nt, Mycobacterium bovis subsp bovis AF2122/97
gcgguaccgcucgggc

SEQ ID NO: 1161927 - RNA, 18 nt, Mycobacterium bovis subsp bovis AF2122/97
gcgguaccggaaucggcg

SEQ ID NO: 1161928 - RNA, 15 nt, Mycobacterium bovis subsp bovis AF2122/97
gcgguaagggcgggc

SEQ ID NO: 1161929 - RNA, 19 nt, Mycobacterium bovis subsp bovis AF2122/97
gcggguuuucucgccguug

SEQ ID NO: 1161930 - RNA, 15 nt, Mycobacterium bovis subsp bovis AF2122/97
gcggguggcagcggc

SEQ ID NO: 1161931 - RNA, 13 nt, Mycobacterium bovis subsp bovis AF2122/97
gcggguggccggg

SEQ ID NO: 1161932 - RNA, 14 nt, Mycobacterium bovis subsp bovis AF2122/97
gcgguaaagccccg

SEQ ID NO: 1161933 - RNA, 20 nt, Mycobacterium bovis subsp bovis AF2122/97
gcggguuugccgggcgcugg

SEQ ID NO: 1161934 - RNA, 19 nt, Mycobacterium bovis subsp bovis AF2122/97
gcgguaaccacgcggauca

SEQ ID NO: 1161935 - RNA, 16 nt, Mycobacterium bovis subsp bovis AF2122/97
gcggugacggcggcaa

SEQ ID NO: 1161936 - RNA, 19 nt, Mycobacterium bovis subsp bovis AF2122/97
gcggugaauccgugcaggg

SEQ ID NO: 1161937 - RNA, 20 nt, Mycobacterium bovis subsp bovis AF2122/97
gcggugaacaccgccucugc

SEQ ID NO: 1161938 - RNA, 21 nt, Mycobacterium bovis subsp bovis AF2122/97
gcggugaacuucuccaccagc

SEQ ID NO: 1161939 - RNA, 23 nt, Mycobacterium bovis subsp bovis AF2122/97
gcggucuuuuugggcuugcccca

SEQ ID NO: 1161940 - RNA, 14 nt, Mycobacterium bovis subsp bovis AF2122/97
gcggucuugccgca

SEQ ID NO: 1161941 - RNA, 21 nt, Mycobacterium bovis subsp bovis AF2122/97
gcggucucggcgucgaccagu

SEQ ID NO: 1161942 - RNA, 19 nt, Mycobacterium bovis subsp bovis AF2122/97
gcggucgugaucagcagga

SEQ ID NO: 1161943 - RNA, 18 nt, Mycobacterium bovis subsp bovis AF2122/97
gcggucgagguggcgggc

SEQ ID NO: 1161944 - RNA, 17 nt, Mycobacterium bovis subsp bovis AF2122/97
gcggucgagccacccac

SEQ ID NO: 1161945 - RNA, 14 nt, Mycobacterium bovis subsp bovis AF2122/97
gcggucgagauguc

SEQ ID NO: 1161946 - RNA, 17 nt, Mycobacterium bovis subsp bovis AF2122/97
gcggucccacggccggc

SEQ ID NO: 1161947 - RNA, 13 nt, Mycobacterium bovis subsp bovis AF2122/97
gcgguccagaaug

SEQ ID NO: 1161948 - RNA, 23 nt, Mycobacterium bovis subsp bovis AF2122/97
gcgguccagacaucagugcgccg

SEQ ID NO: 1161949 - RNA, 15 nt, Mycobacterium bovis subsp bovis AF2122/97
gcgguccaggccggc

SEQ ID NO: 1161950 - RNA, 22 nt, Mycobacterium bovis subsp bovis AF2122/97
gcgguccaccggcccucgccag

SEQ ID NO: 1161951 - RNA, 17 nt, Mycobacterium bovis subsp bovis AF2122/97
gcgguagcucauugccg

SEQ ID NO: 1161952 - RNA, 23 nt, Mycobacterium bovis subsp bovis AF2122/97
gcgguaguugcaguacuagcagc

SEQ ID NO: 1161953 - RNA, 16 nt, Mycobacterium bovis subsp bovis AF2122/97
gcgguagucggccagc

SEQ ID NO: 1161954 - RNA, 21 nt, Mycobacterium bovis subsp bovis AF2122/97
gcgguagcuuccgcgacgcuc

SEQ ID NO: 1161955 - RNA, 20 nt, Mycobacterium bovis subsp bovis AF2122/97
gcgguaggcuugcaaggucg

SEQ ID NO: 1161956 - RNA, 21 nt, Mycobacterium bovis subsp bovis AF2122/97
gcgguaggcuugcaaggucgc

SEQ ID NO: 1161957 - RNA, 22 nt, Mycobacterium bovis subsp bovis AF2122/97
gcaugaccccgucagcgggcag

SEQ ID NO: 1161958 - RNA, 19 nt, Mycobacterium bovis subsp bovis AF2122/97
gcaugacauacagcgggcg

SEQ ID NO: 1161959 - RNA, 23 nt, Mycobacterium bovis subsp bovis AF2122/97
gcaugaagugaaaguucaugcca

SEQ ID NO: 1161960 - RNA, 16 nt, Mycobacterium bovis subsp bovis AF2122/97
gcaucugucgcgcggc

SEQ ID NO: 1161961 - RNA, 15 nt, Mycobacterium bovis subsp bovis AF2122/97
gcaucuuuggcggcc

SEQ ID NO: 1161962 - RNA, 18 nt, Mycobacterium bovis subsp bovis AF2122/97
gcaucuuuggcggccgca

SEQ ID NO: 1161963 - RNA, 21 nt, Mycobacterium bovis subsp bovis AF2122/97
gcaugcacgucaucggcuggc

SEQ ID NO: 1161964 - RNA, 22 nt, Mycobacterium bovis subsp bovis AF2122/97
gcaugccagccacgaacugauc

SEQ ID NO: 1161965 - RNA, 14 nt, Mycobacterium bovis subsp bovis AF2122/97
gcaugccacacacu

SEQ ID NO: 1161966 - RNA, 19 nt, Mycobacterium bovis subsp bovis AF2122/97
gcaugccacacacugccgg

SEQ ID NO: 1161967 - RNA, 15 nt, Mycobacterium bovis subsp bovis AF2122/97
gcaugauccgcuggg

SEQ ID NO: 1161968 - RNA, 21 nt, Mycobacterium bovis subsp bovis AF2122/97
gcaugccggucuucgcgggac

SEQ ID NO: 1161969 - RNA, 22 nt, Mycobacterium bovis subsp bovis AF2122/97
gcaugcgcagaaacgccgagcg

SEQ ID NO: 1161970 - RNA, 20 nt, Mycobacterium bovis subsp bovis AF2122/97
gcaugcccagaaaaccgccg

SEQ ID NO: 1161971 - RNA, 12 nt, Mycobacterium bovis subsp bovis AF2122/97
gcaugcccagcg

SEQ ID NO: 1161972 - RNA, 14 nt, Mycobacterium bovis subsp bovis AF2122/97
gcaugcccgccauc

SEQ ID NO: 1161973 - RNA, 13 nt, Mycobacterium bovis subsp bovis AF2122/97
gcaugccgcccgc

SEQ ID NO: 1161974 - RNA, 16 nt, Mycobacterium bovis subsp bovis AF2122/97
gcaugccgcccgcgcc

SEQ ID NO: 1161975 - RNA, 23 nt, Mycobacterium bovis subsp bovis AF2122/97
gcaugccgcccgcuccugcucgu

SEQ ID NO: 1161976 - RNA, 12 nt, Mycobacterium bovis subsp bovis AF2122/97
gcaugcccugga

SEQ ID NO: 1161977 - RNA, 18 nt, Mycobacterium bovis subsp bovis AF2122/97
gcaucggucagcgcggca

SEQ ID NO: 1161978 - RNA, 22 nt, Mycobacterium bovis subsp bovis AF2122/97
gcaucggcggcaacggcggauc

SEQ ID NO: 1161979 - RNA, 17 nt, Mycobacterium bovis subsp bovis AF2122/97
gcaucggugccacggca

SEQ ID NO: 1161980 - RNA, 15 nt, Mycobacterium bovis subsp bovis AF2122/97
gcaucggugguaaca

SEQ ID NO: 1161981 - RNA, 18 nt, Mycobacterium bovis subsp bovis AF2122/97
gcaucggugcagcccgcc

SEQ ID NO: 1161982 - RNA, 14 nt, Mycobacterium bovis subsp bovis AF2122/97
gcaucggcaaggcg

SEQ ID NO: 1161983 - RNA, 18 nt, Mycobacterium bovis subsp bovis AF2122/97
gcaucggcaaggcggauc

SEQ ID NO: 1161984 - RNA, 19 nt, Mycobacterium bovis subsp bovis AF2122/97
gcaucggcggggcccacac

SEQ ID NO: 1161985 - RNA, 13 nt, Mycobacterium bovis subsp bovis AF2122/97
gcaucggccccca

SEQ ID NO: 1161986 - RNA, 16 nt, Mycobacterium bovis subsp bovis AF2122/97
gcaucgcgagccagcu

SEQ ID NO: 1161987 - RNA, 20 nt, Mycobacterium bovis subsp bovis AF2122/97
gcaucgcgauuccggcggcc

SEQ ID NO: 1161988 - RNA, 17 nt, Mycobacterium bovis subsp bovis AF2122/97
gcaucgccgacagcgcc

SEQ ID NO: 1161989 - RNA, 14 nt, Mycobacterium bovis subsp bovis AF2122/97
gcaucgcaccaggu

SEQ ID NO: 1161990 - RNA, 22 nt, Mycobacterium bovis subsp bovis AF2122/97
gcaucgccaccaucaccgccuu

SEQ ID NO: 1161991 - RNA, 19 nt, Mycobacterium bovis subsp bovis AF2122/97
gcaucuccucgccugcccg

SEQ ID NO: 1161992 - RNA, 21 nt, Mycobacterium bovis subsp bovis AF2122/97
gcaucucgacaucggccagcu

SEQ ID NO: 1161993 - RNA, 21 nt, Mycobacterium bovis subsp bovis AF2122/97
gcaucuggggguagccgccgg

SEQ ID NO: 1161994 - RNA, 22 nt, Mycobacterium bovis subsp bovis AF2122/97
gcaucuggggguagccgccggc

SEQ ID NO: 1161995 - RNA, 15 nt, Mycobacterium bovis subsp bovis AF2122/97
gcaucgucgccgagc

SEQ ID NO: 1161996 - RNA, 22 nt, Mycobacterium bovis subsp bovis AF2122/97
gcaucgucgaaagccuggaaaa

SEQ ID NO: 1161997 - RNA, 14 nt, Mycobacterium bovis subsp bovis AF2122/97
gcaucgucgagcca

SEQ ID NO: 1161998 - RNA, 19 nt, Mycobacterium bovis subsp bovis AF2122/97
gcaucgucgccaagcccag

SEQ ID NO: 1161999 - RNA, 20 nt, Mycobacterium bovis subsp bovis AF2122/97
gcaucuccgucggccaggcc

SEQ ID NO: 1162000 - RNA, 22 nt, Mycobacterium bovis subsp bovis AF2122/97
gcaucuccgucggccaggccac

SEQ ID NO: 1162001 - RNA, 15 nt, Mycobacterium bovis subsp bovis AF2122/97
gcaugcguuggggca

SEQ ID NO: 1162002 - RNA, 20 nt, Mycobacterium bovis subsp bovis AF2122/97
gcaugcuaggcaugccacac

SEQ ID NO: 1162003 - RNA, 15 nt, Mycobacterium bovis subsp bovis AF2122/97
gcauggacaacagcu

SEQ ID NO: 1162004 - RNA, 12 nt, Mycobacterium bovis subsp bovis AF2122/97
gcauggccuggg

SEQ ID NO: 1162005 - RNA, 15 nt, Mycobacterium bovis subsp bovis AF2122/97
gcauggcccuggcga

SEQ ID NO: 1162006 - RNA, 13 nt, Mycobacterium bovis subsp bovis AF2122/97
gcauggcagcggc

SEQ ID NO: 1162007 - RNA, 22 nt, Mycobacterium bovis subsp bovis AF2122/97
gcaugggcccugcacagcagcg

SEQ ID NO: 1162008 - RNA, 16 nt, Mycobacterium bovis subsp bovis AF2122/97
gcaugggucgugcagg

SEQ ID NO: 1162009 - RNA, 14 nt, Mycobacterium bovis subsp bovis AF2122/97
gcauggugguggcc

SEQ ID NO: 1162010 - RNA, 19 nt, Mycobacterium bovis subsp bovis AF2122/97
gcauguccauguuuugcug

SEQ ID NO: 1162011 - RNA, 18 nt, Mycobacterium bovis subsp bovis AF2122/97
gcaugucgcggacccgcg

SEQ ID NO: 1162012 - RNA, 20 nt, Mycobacterium bovis subsp bovis AF2122/97
gcaugucucgggcgcgggug

SEQ ID NO: 1162013 - RNA, 24 nt, Mycobacterium bovis subsp bovis AF2122/97
gcaugugaaagacaacccgcucgg

SEQ ID NO: 1162014 - RNA, 20 nt, Mycobacterium bovis subsp bovis AF2122/97
gcauguugcaggcgcagcug

SEQ ID NO: 1162015 - RNA, 15 nt, Mycobacterium bovis subsp bovis AF2122/97
gcauguuccuugcgg

SEQ ID NO: 1162016 - RNA, 24 nt, Mycobacterium bovis subsp bovis AF2122/97
gcauuccguaggccacagcccggc

SEQ ID NO: 1162017 - RNA, 19 nt, Mycobacterium bovis subsp bovis AF2122/97
gcauucccgcucgcaggcc

SEQ ID NO: 1162018 - RNA, 15 nt, Mycobacterium bovis subsp bovis AF2122/97
gcauucaccaaaccg

SEQ ID NO: 1162019 - RNA, 12 nt, Mycobacterium bovis subsp bovis AF2122/97
gcauugagcugg

SEQ ID NO: 1162020 - RNA, 15 nt, Mycobacterium bovis subsp bovis AF2122/97
gcauugaagaagccc

SEQ ID NO: 1162021 - RNA, 16 nt, Mycobacterium bovis subsp bovis AF2122/97
gcauugaagaagcccg

SEQ ID NO: 1162022 - RNA, 16 nt, Mycobacterium bovis subsp bovis AF2122/97
gcauugaagaauggac

SEQ ID NO: 1162023 - RNA, 22 nt, Mycobacterium bovis subsp bovis AF2122/97
gcauucguggagccggccguga

SEQ ID NO: 1162024 - RNA, 16 nt, Mycobacterium bovis subsp bovis AF2122/97
gcauugcggcccgcga

SEQ ID NO: 1162025 - RNA, 20 nt, Mycobacterium bovis subsp bovis AF2122/97
gcauuggugaguagauugcu

SEQ ID NO: 1162026 - RNA, 13 nt, Mycobacterium bovis subsp bovis AF2122/97
gccaagccgcggc

SEQ ID NO: 1162027 - RNA, 19 nt, Mycobacterium bovis subsp bovis AF2122/97
gccaagccgcggcuaggcc

SEQ ID NO: 1162028 - RNA, 18 nt, Mycobacterium bovis subsp bovis AF2122/97
gccaagcgacucgccggc

SEQ ID NO: 1162029 - RNA, 16 nt, Mycobacterium bovis subsp bovis AF2122/97
gccaagaccagaagcc

SEQ ID NO: 1162030 - RNA, 18 nt, Mycobacterium bovis subsp bovis AF2122/97
gccaagaaugugggcgac

SEQ ID NO: 1162031 - RNA, 15 nt, Mycobacterium bovis subsp bovis AF2122/97
gccaacucccgcggu

SEQ ID NO: 1162032 - RNA, 17 nt, Mycobacterium bovis subsp bovis AF2122/97
gccaacgugacgccggc

SEQ ID NO: 1162033 - RNA, 15 nt, Mycobacterium bovis subsp bovis AF2122/97
gccaacuccagcacc

SEQ ID NO: 1162034 - RNA, 21 nt, Mycobacterium bovis subsp bovis AF2122/97
gccaacuccagcacccgcugc

SEQ ID NO: 1162035 - RNA, 18 nt, Mycobacterium bovis subsp bovis AF2122/97
gccaacgugacgccggcc

SEQ ID NO: 1162036 - RNA, 21 nt, Mycobacterium bovis subsp bovis AF2122/97
gccaacugggccgagcgcgcc

SEQ ID NO: 1162037 - RNA, 19 nt, Mycobacterium bovis subsp bovis AF2122/97
gccaacucguccaacugaa

SEQ ID NO: 1162038 - RNA, 14 nt, Mycobacterium bovis subsp bovis AF2122/97
gccaacgagcgcgc

SEQ ID NO: 1162039 - RNA, 17 nt, Mycobacterium bovis subsp bovis AF2122/97
gccaacggcuccgggcg

SEQ ID NO: 1162040 - RNA, 15 nt, Mycobacterium bovis subsp bovis AF2122/97
gccaacgggcugccc

SEQ ID NO: 1162041 - RNA, 19 nt, Mycobacterium bovis subsp bovis AF2122/97
gccaacggcacccugcggc

SEQ ID NO: 1162042 - RNA, 14 nt, Mycobacterium bovis subsp bovis AF2122/97
gccaaccgcgugcg

SEQ ID NO: 1162043 - RNA, 12 nt, Mycobacterium bovis subsp bovis AF2122/97
gccaacccgggc

SEQ ID NO: 1162044 - RNA, 17 nt, Mycobacterium bovis subsp bovis AF2122/97
gccaaccugaagccagc

SEQ ID NO: 1162045 - RNA, 21 nt, Mycobacterium bovis subsp bovis AF2122/97
gccaacgaaccgcucagcgca

SEQ ID NO: 1162046 - RNA, 22 nt, Mycobacterium bovis subsp bovis AF2122/97
gccaaccguccggggccgcggc

SEQ ID NO: 1162047 - RNA, 14 nt, Mycobacterium bovis subsp bovis AF2122/97
gccaacccugcggc

SEQ ID NO: 1162048 - RNA, 12 nt, Mycobacterium bovis subsp bovis AF2122/97
gccaacaucucc

SEQ ID NO: 1162049 - RNA, 14 nt, Mycobacterium bovis subsp bovis AF2122/97
gccaaccaaccggu

SEQ ID NO: 1162050 - RNA, 17 nt, Mycobacterium bovis subsp bovis AF2122/97
gccaaccaaccggucac

SEQ ID NO: 1162051 - RNA, 15 nt, Mycobacterium bovis subsp bovis AF2122/97
gccaacagguccacc

SEQ ID NO: 1162052 - RNA, 22 nt, Mycobacterium bovis subsp bovis AF2122/97
gccaacaccggcgaucaccguu

SEQ ID NO: 1162053 - RNA, 11 nt, Mycobacterium bovis subsp bovis AF2122/97
gccaacaccuc

SEQ ID NO: 1162054 - RNA, 14 nt, Mycobacterium bovis subsp bovis AF2122/97
gccaacagaugcca

SEQ ID NO: 1162055 - RNA, 19 nt, Mycobacterium bovis subsp bovis AF2122/97
gccaacagaugccacccag

SEQ ID NO: 1162056 - RNA, 16 nt, Mycobacterium bovis subsp bovis AF2122/97
gccaacaccaaccagu

SEQ ID NO: 1162057 - RNA, 15 nt, Mycobacterium bovis subsp bovis AF2122/97
gccaacaccgccagc

SEQ ID NO: 1162058 - RNA, 12 nt, Mycobacterium bovis subsp bovis AF2122/97
gccaaagcccac

SEQ ID NO: 1162059 - RNA, 16 nt, Mycobacterium bovis subsp bovis AF2122/97
gccaaaauccgcccac

SEQ ID NO: 1162060 - RNA, 15 nt, Mycobacterium bovis subsp bovis AF2122/97
gccaaaagggcggca

SEQ ID NO: 1162061 - RNA, 11 nt, Mycobacterium bovis subsp bovis AF2122/97
gccaaaagggc

SEQ ID NO: 1162062 - RNA, 15 nt, Mycobacterium bovis subsp bovis AF2122/97
gccaaaacgagcaga

SEQ ID NO: 1162063 - RNA, 23 nt, Mycobacterium bovis subsp bovis AF2122/97
gccaaacccaugucggcgcgccg

SEQ ID NO: 1162064 - RNA, 24 nt, Mycobacterium bovis subsp bovis AF2122/97
gccaaacccggcgggcccgccggc

SEQ ID NO: 1162065 - RNA, 12 nt, Mycobacterium bovis subsp bovis AF2122/97
gccaaaccuggg

SEQ ID NO: 1162066 - RNA, 17 nt, Mycobacterium bovis subsp bovis AF2122/97
gccaaaaacgccccggc

SEQ ID NO: 1162067 - RNA, 13 nt, Mycobacterium bovis subsp bovis AF2122/97
gcauuucggaucu

SEQ ID NO: 1162068 - RNA, 21 nt, Mycobacterium bovis subsp bovis AF2122/97
gcauuuguugcugcugccgug

SEQ ID NO: 1162069 - RNA, 19 nt, Mycobacterium bovis subsp bovis AF2122/97
gccaccccgcgcgccagcu

SEQ ID NO: 1162070 - RNA, 23 nt, Mycobacterium bovis subsp bovis AF2122/97
gccaccccgcgcgccagcucggc

SEQ ID NO: 1162071 - RNA, 19 nt, Mycobacterium bovis subsp bovis AF2122/97
gccaccccgcguaugccag

SEQ ID NO: 1162072 - RNA, 22 nt, Mycobacterium bovis subsp bovis AF2122/97
gccaccccgcguaugccaggac

SEQ ID NO: 1162073 - RNA, 16 nt, Mycobacterium bovis subsp bovis AF2122/97
gccacccgacaacgcu

SEQ ID NO: 1162074 - RNA, 18 nt, Mycobacterium bovis subsp bovis AF2122/97
gccacccgcgcuccaaca

SEQ ID NO: 1162075 - RNA, 19 nt, Mycobacterium bovis subsp bovis AF2122/97
gccacccgcgaagccgcca

SEQ ID NO: 1162076 - RNA, 12 nt, Mycobacterium bovis subsp bovis AF2122/97
gccaccccgcgc

SEQ ID NO: 1162077 - RNA, 21 nt, Mycobacterium bovis subsp bovis AF2122/97
gccacccggacauagccgcgc

SEQ ID NO: 1162078 - RNA, 15 nt, Mycobacterium bovis subsp bovis AF2122/97
gccacccggccaggu

SEQ ID NO: 1162079 - RNA, 13 nt, Mycobacterium bovis subsp bovis AF2122/97
gccacccggccgc

SEQ ID NO: 1162080 - RNA, 15 nt, Mycobacterium bovis subsp bovis AF2122/97
gccacccggccgcgc

SEQ ID NO: 1162081 - RNA, 20 nt, Mycobacterium bovis subsp bovis AF2122/97
gccaccgcgacggcaggcuc

SEQ ID NO: 1162082 - RNA, 20 nt, Mycobacterium bovis subsp bovis AF2122/97
gccacccuuggcccggugca

SEQ ID NO: 1162083 - RNA, 17 nt, Mycobacterium bovis subsp bovis AF2122/97
gccaccgaaauugcccu

SEQ ID NO: 1162084 - RNA, 17 nt, Mycobacterium bovis subsp bovis AF2122/97
gccaccgaacgcggcca

SEQ ID NO: 1162085 - RNA, 17 nt, Mycobacterium bovis subsp bovis AF2122/97
gccacccuugccgccgg

SEQ ID NO: 1162086 - RNA, 20 nt, Mycobacterium bovis subsp bovis AF2122/97
gccaccgaagccgccgggug

SEQ ID NO: 1162087 - RNA, 16 nt, Mycobacterium bovis subsp bovis AF2122/97
gccaccgcggccgcgg

SEQ ID NO: 1162088 - RNA, 16 nt, Mycobacterium bovis subsp bovis AF2122/97
gccaccgcggucagcu

SEQ ID NO: 1162089 - RNA, 16 nt, Mycobacterium bovis subsp bovis AF2122/97
gccaccgcgggcggca

SEQ ID NO: 1162090 - RNA, 21 nt, Mycobacterium bovis subsp bovis AF2122/97
gccaccgcggccugacgcugc

SEQ ID NO: 1162091 - RNA, 13 nt, Mycobacterium bovis subsp bovis AF2122/97
gccaccaucgccg

SEQ ID NO: 1162092 - RNA, 16 nt, Mycobacterium bovis subsp bovis AF2122/97
gccaccaucgccgccg

SEQ ID NO: 1162093 - RNA, 14 nt, Mycobacterium bovis subsp bovis AF2122/97
gccaccaucuggau

SEQ ID NO: 1162094 - RNA, 14 nt, Mycobacterium bovis subsp bovis AF2122/97
gccaccaccagggc

SEQ ID NO: 1162095 - RNA, 16 nt, Mycobacterium bovis subsp bovis AF2122/97
gccaccaccagggcaa

SEQ ID NO: 1162096 - RNA, 21 nt, Mycobacterium bovis subsp bovis AF2122/97
gccaccacccaacagcccacc

SEQ ID NO: 1162097 - RNA, 15 nt, Mycobacterium bovis subsp bovis AF2122/97
gccaccacccaggcc

SEQ ID NO: 1162098 - RNA, 23 nt, Mycobacterium bovis subsp bovis AF2122/97
gccacccccaaccgccggccagc

SEQ ID NO: 1162099 - RNA, 16 nt, Mycobacterium bovis subsp bovis AF2122/97
gccaccccgagcucac

SEQ ID NO: 1162100 - RNA, 18 nt, Mycobacterium bovis subsp bovis AF2122/97
gccacccagggccuuccc

SEQ ID NO: 1162101 - RNA, 14 nt, Mycobacterium bovis subsp bovis AF2122/97
gccacccaacagcg

SEQ ID NO: 1162102 - RNA, 16 nt, Mycobacterium bovis subsp bovis AF2122/97
gccacccaacagcgcu

SEQ ID NO: 1162103 - RNA, 13 nt, Mycobacterium bovis subsp bovis AF2122/97
gccacccagaaug

SEQ ID NO: 1162104 - RNA, 16 nt, Mycobacterium bovis subsp bovis AF2122/97
gccaccaaauccgcaa

SEQ ID NO: 1162105 - RNA, 18 nt, Mycobacterium bovis subsp bovis AF2122/97
gccaccaaauccgcaagg

SEQ ID NO: 1162106 - RNA, 13 nt, Mycobacterium bovis subsp bovis AF2122/97
gccaccaacaccg

SEQ ID NO: 1162107 - RNA, 22 nt, Mycobacterium bovis subsp bovis AF2122/97
gccacagcucgccgugaccagg

SEQ ID NO: 1162108 - RNA, 13 nt, Mycobacterium bovis subsp bovis AF2122/97
gccacauuucacc

SEQ ID NO: 1162109 - RNA, 19 nt, Mycobacterium bovis subsp bovis AF2122/97
gccacaccgccgccaagcu

SEQ ID NO: 1162110 - RNA, 17 nt, Mycobacterium bovis subsp bovis AF2122/97
gccacagcccggcggcg

SEQ ID NO: 1162111 - RNA, 13 nt, Mycobacterium bovis subsp bovis AF2122/97
gccacagcaacgu

SEQ ID NO: 1162112 - RNA, 19 nt, Mycobacterium bovis subsp bovis AF2122/97
gccacacggggccgccagc

SEQ ID NO: 1162113 - RNA, 20 nt, Mycobacterium bovis subsp bovis AF2122/97
gccacacggggccgccagcu

SEQ ID NO: 1162114 - RNA, 16 nt, Mycobacterium bovis subsp bovis AF2122/97
gccacaccggggcggc

SEQ ID NO: 1162115 - RNA, 19 nt, Mycobacterium bovis subsp bovis AF2122/97
gccacaccgucacgccacc

SEQ ID NO: 1162116 - RNA, 22 nt, Mycobacterium bovis subsp bovis AF2122/97
gccacaccaugauugccaggac

SEQ ID NO: 1162117 - RNA, 22 nt, Mycobacterium bovis subsp bovis AF2122/97
gccacacccggcgugagcuccg

SEQ ID NO: 1162118 - RNA, 15 nt, Mycobacterium bovis subsp bovis AF2122/97
gccaagguugucgcu

SEQ ID NO: 1162119 - RNA, 18 nt, Mycobacterium bovis subsp bovis AF2122/97
gccaagugcagggcugcu

SEQ ID NO: 1162120 - RNA, 16 nt, Mycobacterium bovis subsp bovis AF2122/97
gccaagcucggccacc

SEQ ID NO: 1162121 - RNA, 19 nt, Mycobacterium bovis subsp bovis AF2122/97
gccaagcucggcccagcgc

SEQ ID NO: 1162122 - RNA, 17 nt, Mycobacterium bovis subsp bovis AF2122/97
gccaagggccccuccgg

SEQ ID NO: 1162123 - RNA, 14 nt, Mycobacterium bovis subsp bovis AF2122/97
gccaauagaagcac

SEQ ID NO: 1162124 - RNA, 12 nt, Mycobacterium bovis subsp bovis AF2122/97
gccaaucauggu

SEQ ID NO: 1162125 - RNA, 18 nt, Mycobacterium bovis subsp bovis AF2122/97
gccaaucgccgucagcac

SEQ ID NO: 1162126 - RNA, 23 nt, Mycobacterium bovis subsp bovis AF2122/97
gccacaaccucgucgucaucgag

SEQ ID NO: 1162127 - RNA, 14 nt, Mycobacterium bovis subsp bovis AF2122/97
gccacaacggcggc

SEQ ID NO: 1162128 - RNA, 16 nt, Mycobacterium bovis subsp bovis AF2122/97
gccacaacggcggcgc

SEQ ID NO: 1162129 - RNA, 12 nt, Mycobacterium bovis subsp bovis AF2122/97
gccaauggccug

SEQ ID NO: 1162130 - RNA, 15 nt, Mycobacterium bovis subsp bovis AF2122/97
gccaaugcugcaggu

SEQ ID NO: 1162131 - RNA, 19 nt, Mycobacterium bovis subsp bovis AF2122/97
gccaaugacuuggccagca

SEQ ID NO: 1162132 - RNA, 22 nt, Mycobacterium bovis subsp bovis AF2122/97
gccaaugcccuuggccagcagg

SEQ ID NO: 1162133 - RNA, 17 nt, Mycobacterium bovis subsp bovis AF2122/97
gccaaugccgcggaggc

SEQ ID NO: 1162134 - RNA, 23 nt, Mycobacterium bovis subsp bovis AF2122/97
gccaaugacgucggaccagcugc

SEQ ID NO: 1162135 - RNA, 13 nt, Mycobacterium bovis subsp bovis AF2122/97
gccagccccgcgc

SEQ ID NO: 1162136 - RNA, 15 nt, Mycobacterium bovis subsp bovis AF2122/97
gccagccccgcgccc

SEQ ID NO: 1162137 - RNA, 14 nt, Mycobacterium bovis subsp bovis AF2122/97
gccagcccguccgg

SEQ ID NO: 1162138 - RNA, 20 nt, Mycobacterium bovis subsp bovis AF2122/97
gccagccgacaacuguccug

SEQ ID NO: 1162139 - RNA, 16 nt, Mycobacterium bovis subsp bovis AF2122/97
gccagccgacgcggcg

SEQ ID NO: 1162140 - RNA, 14 nt, Mycobacterium bovis subsp bovis AF2122/97
gccagcccagccgc

SEQ ID NO: 1162141 - RNA, 15 nt, Mycobacterium bovis subsp bovis AF2122/97
gccagcccagccggg

SEQ ID NO: 1162142 - RNA, 16 nt, Mycobacterium bovis subsp bovis AF2122/97
gccagcccaggguguc

SEQ ID NO: 1162143 - RNA, 17 nt, Mycobacterium bovis subsp bovis AF2122/97
gccagcccagggugucc

SEQ ID NO: 1162144 - RNA, 12 nt, Mycobacterium bovis subsp bovis AF2122/97
gccagcccagca

SEQ ID NO: 1162145 - RNA, 15 nt, Mycobacterium bovis subsp bovis AF2122/97
gccagcccagcaggu

SEQ ID NO: 1162146 - RNA, 15 nt, Mycobacterium bovis subsp bovis AF2122/97
gccagccagcgggcg

SEQ ID NO: 1162147 - RNA, 17 nt, Mycobacterium bovis subsp bovis AF2122/97
gccagcaugucgggccg

SEQ ID NO: 1162148 - RNA, 19 nt, Mycobacterium bovis subsp bovis AF2122/97
gccagcauuagccaggccc

SEQ ID NO: 1162149 - RNA, 21 nt, Mycobacterium bovis subsp bovis AF2122/97
gccagccaaccguccggggcc

SEQ ID NO: 1162150 - RNA, 16 nt, Mycobacterium bovis subsp bovis AF2122/97
gccagccacuccucgg

SEQ ID NO: 1162151 - RNA, 21 nt, Mycobacterium bovis subsp bovis AF2122/97
gccagcagcgcgggaucugag

SEQ ID NO: 1162152 - RNA, 15 nt, Mycobacterium bovis subsp bovis AF2122/97
gccagcagcggcgag

SEQ ID NO: 1162153 - RNA, 17 nt, Mycobacterium bovis subsp bovis AF2122/97
gccagcagcgacuccag

SEQ ID NO: 1162154 - RNA, 18 nt, Mycobacterium bovis subsp bovis AF2122/97
gccagcaccucggccagc

SEQ ID NO: 1162155 - RNA, 21 nt, Mycobacterium bovis subsp bovis AF2122/97
gccagcaccuagucgcggccg

SEQ ID NO: 1162156 - RNA, 23 nt, Mycobacterium bovis subsp bovis AF2122/97
gccagcagccacccgacaacgcu

SEQ ID NO: 1162157 - RNA, 17 nt, Mycobacterium bovis subsp bovis AF2122/97
gccagcacccugaugug

SEQ ID NO: 1162158 - RNA, 17 nt, Mycobacterium bovis subsp bovis AF2122/97
gccagcacccgcagccg

SEQ ID NO: 1162159 - RNA, 13 nt, Mycobacterium bovis subsp bovis AF2122/97
gccagcaccgggg

SEQ ID NO: 1162160 - RNA, 17 nt, Mycobacterium bovis subsp bovis AF2122/97
gccagcaccggggacag

SEQ ID NO: 1162161 - RNA, 14 nt, Mycobacterium bovis subsp bovis AF2122/97
gccagcaucgugug

SEQ ID NO: 1162162 - RNA, 12 nt, Mycobacterium bovis subsp bovis AF2122/97
gccagcaugaca

SEQ ID NO: 1162163 - RNA, 13 nt, Mycobacterium bovis subsp bovis AF2122/97
gccagcaucauca

SEQ ID NO: 1162164 - RNA, 17 nt, Mycobacterium bovis subsp bovis AF2122/97
gccagcagcggcgagcc

SEQ ID NO: 1162165 - RNA, 14 nt, Mycobacterium bovis subsp bovis AF2122/97
gccagcagcggcuc

SEQ ID NO: 1162166 - RNA, 18 nt, Mycobacterium bovis subsp bovis AF2122/97
gccagcaucagcccggcg

SEQ ID NO: 1162167 - RNA, 22 nt, Mycobacterium bovis subsp bovis AF2122/97
gccagcaucagcgccagcgagc

SEQ ID NO: 1162168 - RNA, 23 nt, Mycobacterium bovis subsp bovis AF2122/97
gccaccggcgccaccggcgccgc

SEQ ID NO: 1162169 - RNA, 20 nt, Mycobacterium bovis subsp bovis AF2122/97
gccacugccguugccgccgg

SEQ ID NO: 1162170 - RNA, 18 nt, Mycobacterium bovis subsp bovis AF2122/97
gccaccggaauccuggcc

SEQ ID NO: 1162171 - RNA, 20 nt, Mycobacterium bovis subsp bovis AF2122/97
gccaccggcaccgccugcgc

SEQ ID NO: 1162172 - RNA, 18 nt, Mycobacterium bovis subsp bovis AF2122/97
gccacugcggcauggcag

SEQ ID NO: 1162173 - RNA, 14 nt, Mycobacterium bovis subsp bovis AF2122/97
gccacuggccgguu

SEQ ID NO: 1162174 - RNA, 22 nt, Mycobacterium bovis subsp bovis AF2122/97
gccacuggccgguucgcccgag

SEQ ID NO: 1162175 - RNA, 18 nt, Mycobacterium bovis subsp bovis AF2122/97
gccacuguugaagaagcc

SEQ ID NO: 1162176 - RNA, 14 nt, Mycobacterium bovis subsp bovis AF2122/97
gccagaaacccggc

SEQ ID NO: 1162177 - RNA, 22 nt, Mycobacterium bovis subsp bovis AF2122/97
gccagaaaccccaaacaacccc

SEQ ID NO: 1162178 - RNA, 21 nt, Mycobacterium bovis subsp bovis AF2122/97
gccagcaagacgaugacagac

SEQ ID NO: 1162179 - RNA, 14 nt, Mycobacterium bovis subsp bovis AF2122/97
gccagcaccagcgu

SEQ ID NO: 1162180 - RNA, 18 nt, Mycobacterium bovis subsp bovis AF2122/97
gccagcaaugcccgcacc

SEQ ID NO: 1162181 - RNA, 13 nt, Mycobacterium bovis subsp bovis AF2122/97
gccagcaccacgg

SEQ ID NO: 1162182 - RNA, 15 nt, Mycobacterium bovis subsp bovis AF2122/97
gccagcaccacggcc

SEQ ID NO: 1162183 - RNA, 13 nt, Mycobacterium bovis subsp bovis AF2122/97
gccagcaccaccg

SEQ ID NO: 1162184 - RNA, 13 nt, Mycobacterium bovis subsp bovis AF2122/97
gccagagccgcgc

SEQ ID NO: 1162185 - RNA, 17 nt, Mycobacterium bovis subsp bovis AF2122/97
gccagacggugcagcuc

SEQ ID NO: 1162186 - RNA, 12 nt, Mycobacterium bovis subsp bovis AF2122/97
gccagcugggca

SEQ ID NO: 1162187 - RNA, 14 nt, Mycobacterium bovis subsp bovis AF2122/97
gccagcugcgcagc

SEQ ID NO: 1162188 - RNA, 16 nt, Mycobacterium bovis subsp bovis AF2122/97
gccagcugcgcagcgc

SEQ ID NO: 1162189 - RNA, 18 nt, Mycobacterium bovis subsp bovis AF2122/97
gccagcuguucgagccgc

SEQ ID NO: 1162190 - RNA, 15 nt, Mycobacterium bovis subsp bovis AF2122/97
gccaggagcgcggcc

SEQ ID NO: 1162191 - RNA, 16 nt, Mycobacterium bovis subsp bovis AF2122/97
gccaggagcgcggccc

SEQ ID NO: 1162192 - RNA, 18 nt, Mycobacterium bovis subsp bovis AF2122/97
gccaggagcgcggcccgc

SEQ ID NO: 1162193 - RNA, 14 nt, Mycobacterium bovis subsp bovis AF2122/97
gccaggaucgcggc

SEQ ID NO: 1162194 - RNA, 22 nt, Mycobacterium bovis subsp bovis AF2122/97
gccaggaugaagacgcgggucu

SEQ ID NO: 1162195 - RNA, 20 nt, Mycobacterium bovis subsp bovis AF2122/97
gccaggaugaauuuggugaa

SEQ ID NO: 1162196 - RNA, 23 nt, Mycobacterium bovis subsp bovis AF2122/97
gccaggaucgaucguagcuccuu

SEQ ID NO: 1162197 - RNA, 12 nt, Mycobacterium bovis subsp bovis AF2122/97
gccaggcgcgcu

SEQ ID NO: 1162198 - RNA, 14 nt, Mycobacterium bovis subsp bovis AF2122/97
gccaggcgcagcug

SEQ ID NO: 1162199 - RNA, 16 nt, Mycobacterium bovis subsp bovis AF2122/97
gccaggccgcacagca

SEQ ID NO: 1162200 - RNA, 17 nt, Mycobacterium bovis subsp bovis AF2122/97
gccaggggacccggggc

SEQ ID NO: 1162201 - RNA, 15 nt, Mycobacterium bovis subsp bovis AF2122/97
gccagggcgggcguc

SEQ ID NO: 1162202 - RNA, 23 nt, Mycobacterium bovis subsp bovis AF2122/97
gccaggcuugcggcacccagucg

SEQ ID NO: 1162203 - RNA, 12 nt, Mycobacterium bovis subsp bovis AF2122/97
gccaggcggccg

SEQ ID NO: 1162204 - RNA, 21 nt, Mycobacterium bovis subsp bovis AF2122/97
gccaggcucgauguccucgag

SEQ ID NO: 1162205 - RNA, 20 nt, Mycobacterium bovis subsp bovis AF2122/97
gccagguguucgccggagac

SEQ ID NO: 1162206 - RNA, 14 nt, Mycobacterium bovis subsp bovis AF2122/97
gccagguggcgagc

SEQ ID NO: 1162207 - RNA, 15 nt, Mycobacterium bovis subsp bovis AF2122/97
gccaggugcaggcuu

SEQ ID NO: 1162208 - RNA, 19 nt, Mycobacterium bovis subsp bovis AF2122/97
gccaggugcccaagcaguc

SEQ ID NO: 1162209 - RNA, 16 nt, Mycobacterium bovis subsp bovis AF2122/97
gccaggggcgcagcgc

SEQ ID NO: 1162210 - RNA, 20 nt, Mycobacterium bovis subsp bovis AF2122/97
gccagggucacaaacccagc

SEQ ID NO: 1162211 - RNA, 23 nt, Mycobacterium bovis subsp bovis AF2122/97
gccagggucacaaacccagcauc

SEQ ID NO: 1162212 - RNA, 17 nt, Mycobacterium bovis subsp bovis AF2122/97
gccagggugcccucggc

SEQ ID NO: 1162213 - RNA, 18 nt, Mycobacterium bovis subsp bovis AF2122/97
gccagggugcccucggcc

SEQ ID NO: 1162214 - RNA, 18 nt, Mycobacterium bovis subsp bovis AF2122/97
gccaggggacccggggcc

SEQ ID NO: 1162215 - RNA, 12 nt, Mycobacterium bovis subsp bovis AF2122/97
gccagcgccggc

SEQ ID NO: 1162216 - RNA, 20 nt, Mycobacterium bovis subsp bovis AF2122/97
gccagcgagcauaccgccgc

SEQ ID NO: 1162217 - RNA, 12 nt, Mycobacterium bovis subsp bovis AF2122/97
gccagcgagcgc

SEQ ID NO: 1162218 - RNA, 22 nt, Mycobacterium bovis subsp bovis AF2122/97
gccagcgacgcggucaucgagc

SEQ ID NO: 1162219 - RNA, 15 nt, Mycobacterium bovis subsp bovis AF2122/97
gccagcgcccgcagg

SEQ ID NO: 1162220 - RNA, 11 nt, Mycobacterium bovis subsp bovis AF2122/97
gccagccgcgc

SEQ ID NO: 1162221 - RNA, 15 nt, Mycobacterium bovis subsp bovis AF2122/97
gccagccgcgagccg

SEQ ID NO: 1162222 - RNA, 23 nt, Mycobacterium bovis subsp bovis AF2122/97
gccagccgcucacccggucgcac

SEQ ID NO: 1162223 - RNA, 23 nt, Mycobacterium bovis subsp bovis AF2122/97
gccagccuggccaucgagggcau

SEQ ID NO: 1162224 - RNA, 18 nt, Mycobacterium bovis subsp bovis AF2122/97
gccagcgaauggggcagc

SEQ ID NO: 1162225 - RNA, 19 nt, Mycobacterium bovis subsp bovis AF2122/97
gccagcgaauggggcagcu

SEQ ID NO: 1162226 - RNA, 14 nt, Mycobacterium bovis subsp bovis AF2122/97
gccagccugugcug

SEQ ID NO: 1162227 - RNA, 20 nt, Mycobacterium bovis subsp bovis AF2122/97
gccagccugcuggccgcggc

SEQ ID NO: 1162228 - RNA, 16 nt, Mycobacterium bovis subsp bovis AF2122/97
gccagcgccgccggcg

SEQ ID NO: 1162229 - RNA, 20 nt, Mycobacterium bovis subsp bovis AF2122/97
gccagcggcaauggccagca

SEQ ID NO: 1162230 - RNA, 23 nt, Mycobacterium bovis subsp bovis AF2122/97
gccagcggcaauggccagcacca

SEQ ID NO: 1162231 - RNA, 10 nt, Mycobacterium bovis subsp bovis AF2122/97
gccagcggca

SEQ ID NO: 1162232 - RNA, 17 nt, Mycobacterium bovis subsp bovis AF2122/97
gccagcggcccgucacc

SEQ ID NO: 1162233 - RNA, 19 nt, Mycobacterium bovis subsp bovis AF2122/97
gccagcggccgcuccaccu

SEQ ID NO: 1162234 - RNA, 15 nt, Mycobacterium bovis subsp bovis AF2122/97
gccagcggccgggcg

SEQ ID NO: 1162235 - RNA, 18 nt, Mycobacterium bovis subsp bovis AF2122/97
gccagcggccgggcggcc

SEQ ID NO: 1162236 - RNA, 17 nt, Mycobacterium bovis subsp bovis AF2122/97
gccagcggcagcggcgu

SEQ ID NO: 1162237 - RNA, 17 nt, Mycobacterium bovis subsp bovis AF2122/97
gccagcugcagcagacc

SEQ ID NO: 1162238 - RNA, 17 nt, Mycobacterium bovis subsp bovis AF2122/97
gccagcucaaccacaug

SEQ ID NO: 1162239 - RNA, 22 nt, Mycobacterium bovis subsp bovis AF2122/97
gccagcucacggacgcugggcg

SEQ ID NO: 1162240 - RNA, 20 nt, Mycobacterium bovis subsp bovis AF2122/97
gccagcugacacccgcagcu

SEQ ID NO: 1162241 - RNA, 18 nt, Mycobacterium bovis subsp bovis AF2122/97
gccagcguuaggucgccg

SEQ ID NO: 1162242 - RNA, 20 nt, Mycobacterium bovis subsp bovis AF2122/97
gccagcguuaggucgccggc

SEQ ID NO: 1162243 - RNA, 21 nt, Mycobacterium bovis subsp bovis AF2122/97
gcccagcagguuccacggcca

SEQ ID NO: 1162244 - RNA, 13 nt, Mycobacterium bovis subsp bovis AF2122/97
gcccagaugucuu

SEQ ID NO: 1162245 - RNA, 14 nt, Mycobacterium bovis subsp bovis AF2122/97
gcccagauagagcu

SEQ ID NO: 1162246 - RNA, 17 nt, Mycobacterium bovis subsp bovis AF2122/97
gcccagauccagcaacg

SEQ ID NO: 1162247 - RNA, 14 nt, Mycobacterium bovis subsp bovis AF2122/97
gcccagcgccucca

SEQ ID NO: 1162248 - RNA, 17 nt, Mycobacterium bovis subsp bovis AF2122/97
gcccagcgccuccagca

SEQ ID NO: 1162249 - RNA, 20 nt, Mycobacterium bovis subsp bovis AF2122/97
gcccagcgccuccagcacca

SEQ ID NO: 1162250 - RNA, 22 nt, Mycobacterium bovis subsp bovis AF2122/97
gcccagcgcccgcgcggccacu

SEQ ID NO: 1162251 - RNA, 19 nt, Mycobacterium bovis subsp bovis AF2122/97
gcccagcgcccccagcagc

SEQ ID NO: 1162252 - RNA, 13 nt, Mycobacterium bovis subsp bovis AF2122/97
gcccagccaacuc

SEQ ID NO: 1162253 - RNA, 21 nt, Mycobacterium bovis subsp bovis AF2122/97
gcccagccacugacggcuucc

SEQ ID NO: 1162254 - RNA, 16 nt, Mycobacterium bovis subsp bovis AF2122/97
gcccacggcaccacca

SEQ ID NO: 1162255 - RNA, 23 nt, Mycobacterium bovis subsp bovis AF2122/97
gcccacggcgaccacgccgccgg

SEQ ID NO: 1162256 - RNA, 13 nt, Mycobacterium bovis subsp bovis AF2122/97
gcccacgcugccc

SEQ ID NO: 1162257 - RNA, 20 nt, Mycobacterium bovis subsp bovis AF2122/97
gcccacgcacagcaacgccc

SEQ ID NO: 1162258 - RNA, 17 nt, Mycobacterium bovis subsp bovis AF2122/97
gcccaccuccugguuga

SEQ ID NO: 1162259 - RNA, 21 nt, Mycobacterium bovis subsp bovis AF2122/97
gcccaccucgaucgcgccguc

SEQ ID NO: 1162260 - RNA, 13 nt, Mycobacterium bovis subsp bovis AF2122/97
gcccaccuccugg

SEQ ID NO: 1162261 - RNA, 22 nt, Mycobacterium bovis subsp bovis AF2122/97
gcccaccgccugggcggccagc

SEQ ID NO: 1162262 - RNA, 23 nt, Mycobacterium bovis subsp bovis AF2122/97
gcccaccgccugggcggccagca

SEQ ID NO: 1162263 - RNA, 14 nt, Mycobacterium bovis subsp bovis AF2122/97
gcccaccggcgccg

SEQ ID NO: 1162264 - RNA, 17 nt, Mycobacterium bovis subsp bovis AF2122/97
gcccaccggcgccgccg

SEQ ID NO: 1162265 - RNA, 15 nt, Mycobacterium bovis subsp bovis AF2122/97
gcccaccggcuagcu

SEQ ID NO: 1162266 - RNA, 17 nt, Mycobacterium bovis subsp bovis AF2122/97
gcccaccggcuagcugu

SEQ ID NO: 1162267 - RNA, 18 nt, Mycobacterium bovis subsp bovis AF2122/97
gcccaccggucgccgcga

SEQ ID NO: 1162268 - RNA, 19 nt, Mycobacterium bovis subsp bovis AF2122/97
gcccaccggugccgcccgc

SEQ ID NO: 1162269 - RNA, 22 nt, Mycobacterium bovis subsp bovis AF2122/97
gcccaccgcaacgcuucggcag

SEQ ID NO: 1162270 - RNA, 16 nt, Mycobacterium bovis subsp bovis AF2122/97
gcccacccgggugggc

SEQ ID NO: 1162271 - RNA, 20 nt, Mycobacterium bovis subsp bovis AF2122/97
gcccacccgggugggccagu

SEQ ID NO: 1162272 - RNA, 23 nt, Mycobacterium bovis subsp bovis AF2122/97
gcccaccagcgcagccgaucguc

SEQ ID NO: 1162273 - RNA, 21 nt, Mycobacterium bovis subsp bovis AF2122/97
gcccaccacgcgacgcggggc

SEQ ID NO: 1162274 - RNA, 18 nt, Mycobacterium bovis subsp bovis AF2122/97
gcccacccgcgccuaccc

SEQ ID NO: 1162275 - RNA, 17 nt, Mycobacterium bovis subsp bovis AF2122/97
gcccaacgucgccaggu

SEQ ID NO: 1162276 - RNA, 18 nt, Mycobacterium bovis subsp bovis AF2122/97
gcccaacagcaacccgcc

SEQ ID NO: 1162277 - RNA, 20 nt, Mycobacterium bovis subsp bovis AF2122/97
gcccaacagcaacccgccgu

SEQ ID NO: 1162278 - RNA, 16 nt, Mycobacterium bovis subsp bovis AF2122/97
gcccaacaccgccaga

SEQ ID NO: 1162279 - RNA, 17 nt, Mycobacterium bovis subsp bovis AF2122/97
gcccaaaaggaagaccu

SEQ ID NO: 1162280 - RNA, 21 nt, Mycobacterium bovis subsp bovis AF2122/97
gcccaaaggcuguaacacccg

SEQ ID NO: 1162281 - RNA, 18 nt, Mycobacterium bovis subsp bovis AF2122/97
gcccaaagcgccagcagc

SEQ ID NO: 1162282 - RNA, 15 nt, Mycobacterium bovis subsp bovis AF2122/97
gccauuguugggccg

SEQ ID NO: 1162283 - RNA, 19 nt, Mycobacterium bovis subsp bovis AF2122/97
gccauuucgucgucgcuga

SEQ ID NO: 1162284 - RNA, 21 nt, Mycobacterium bovis subsp bovis AF2122/97
gcccaccacgaacacguucgg

SEQ ID NO: 1162285 - RNA, 23 nt, Mycobacterium bovis subsp bovis AF2122/97
gcccaccaccgacagcacccggc

SEQ ID NO: 1162286 - RNA, 15 nt, Mycobacterium bovis subsp bovis AF2122/97
gcccacaugcucagg

SEQ ID NO: 1162287 - RNA, 22 nt, Mycobacterium bovis subsp bovis AF2122/97
gcccacaucgucggcgggcggc

SEQ ID NO: 1162288 - RNA, 21 nt, Mycobacterium bovis subsp bovis AF2122/97
gcccacacggucgucgcgagc

SEQ ID NO: 1162289 - RNA, 21 nt, Mycobacterium bovis subsp bovis AF2122/97
gcccacaggggcagcgcggcc

SEQ ID NO: 1162290 - RNA, 22 nt, Mycobacterium bovis subsp bovis AF2122/97
gcccacaggggcagcgcggcca

SEQ ID NO: 1162291 - RNA, 21 nt, Mycobacterium bovis subsp bovis AF2122/97
gcccacaccagcgcagcauug

SEQ ID NO: 1162292 - RNA, 19 nt, Mycobacterium bovis subsp bovis AF2122/97
gcccacaaugacucggccg

SEQ ID NO: 1162293 - RNA, 14 nt, Mycobacterium bovis subsp bovis AF2122/97
gcccacaccagcgc

SEQ ID NO: 1162294 - RNA, 17 nt, Mycobacterium bovis subsp bovis AF2122/97
gcccaauugcgccgagc

SEQ ID NO: 1162295 - RNA, 16 nt, Mycobacterium bovis subsp bovis AF2122/97
gcccacaaagauccgg

SEQ ID NO: 1162296 - RNA, 22 nt, Mycobacterium bovis subsp bovis AF2122/97
gcccaauccgcaacagcucggc

SEQ ID NO: 1162297 - RNA, 19 nt, Mycobacterium bovis subsp bovis AF2122/97
gcccaagaucucgcgggcc

SEQ ID NO: 1162298 - RNA, 19 nt, Mycobacterium bovis subsp bovis AF2122/97
gcccaagcaguccacgagc

SEQ ID NO: 1162299 - RNA, 15 nt, Mycobacterium bovis subsp bovis AF2122/97
gcccaagccgccggc

SEQ ID NO: 1162300 - RNA, 19 nt, Mycobacterium bovis subsp bovis AF2122/97
gccaugguugaugugcagg

SEQ ID NO: 1162301 - RNA, 17 nt, Mycobacterium bovis subsp bovis AF2122/97
gccaugucagcggccug

SEQ ID NO: 1162302 - RNA, 21 nt, Mycobacterium bovis subsp bovis AF2122/97
gccaugucuccgacauuggcc

SEQ ID NO: 1162303 - RNA, 20 nt, Mycobacterium bovis subsp bovis AF2122/97
gccaugucuccgacauuggc

SEQ ID NO: 1162304 - RNA, 23 nt, Mycobacterium bovis subsp bovis AF2122/97
gccauguugaaaaggcgcuggcg

SEQ ID NO: 1162305 - RNA, 15 nt, Mycobacterium bovis subsp bovis AF2122/97
gccauuccagccggu

SEQ ID NO: 1162306 - RNA, 17 nt, Mycobacterium bovis subsp bovis AF2122/97
gccauggguagccgccc

SEQ ID NO: 1162307 - RNA, 13 nt, Mycobacterium bovis subsp bovis AF2122/97
gccauggugagug

SEQ ID NO: 1162308 - RNA, 11 nt, Mycobacterium bovis subsp bovis AF2122/97
gccauggucag

SEQ ID NO: 1162309 - RNA, 14 nt, Mycobacterium bovis subsp bovis AF2122/97
gccauggucagaua

SEQ ID NO: 1162310 - RNA, 19 nt, Mycobacterium bovis subsp bovis AF2122/97
gccauggcagcgccgcagc

SEQ ID NO: 1162311 - RNA, 19 nt, Mycobacterium bovis subsp bovis AF2122/97
gccauggacgccaugguga

SEQ ID NO: 1162312 - RNA, 18 nt, Mycobacterium bovis subsp bovis AF2122/97
gccaugcuggucagcggc

SEQ ID NO: 1162313 - RNA, 16 nt, Mycobacterium bovis subsp bovis AF2122/97
gccaugcuggucagcg

SEQ ID NO: 1162314 - RNA, 22 nt, Mycobacterium bovis subsp bovis AF2122/97
gccaugaagccgggcgcuugca

SEQ ID NO: 1162315 - RNA, 21 nt, Mycobacterium bovis subsp bovis AF2122/97
gccaguaugcggugcccgccc

SEQ ID NO: 1162316 - RNA, 16 nt, Mycobacterium bovis subsp bovis AF2122/97
gccagguuuugccgcg

SEQ ID NO: 1162317 - RNA, 20 nt, Mycobacterium bovis subsp bovis AF2122/97
gccaucacgacucccccggc

SEQ ID NO: 1162318 - RNA, 16 nt, Mycobacterium bovis subsp bovis AF2122/97
gccaucagaccaauga

SEQ ID NO: 1162319 - RNA, 18 nt, Mycobacterium bovis subsp bovis AF2122/97
gccaucacaucggccucu

SEQ ID NO: 1162320 - RNA, 21 nt, Mycobacterium bovis subsp bovis AF2122/97
gccaucaacaaggggcagcac

SEQ ID NO: 1162321 - RNA, 19 nt, Mycobacterium bovis subsp bovis AF2122/97
gccaucaacaaggggcagc

SEQ ID NO: 1162322 - RNA, 20 nt, Mycobacterium bovis subsp bovis AF2122/97
gccaucaacaaggggcagca

SEQ ID NO: 1162323 - RNA, 19 nt, Mycobacterium bovis subsp bovis AF2122/97
gccaguccgaaagccgccg

SEQ ID NO: 1162324 - RNA, 15 nt, Mycobacterium bovis subsp bovis AF2122/97
gccagucccggcgca

SEQ ID NO: 1162325 - RNA, 23 nt, Mycobacterium bovis subsp bovis AF2122/97
gccaguccagcgcgccacccagc

SEQ ID NO: 1162326 - RNA, 13 nt, Mycobacterium bovis subsp bovis AF2122/97
gccagucccacug

SEQ ID NO: 1162327 - RNA, 14 nt, Mycobacterium bovis subsp bovis AF2122/97
gccauccaccgcag

SEQ ID NO: 1162328 - RNA, 18 nt, Mycobacterium bovis subsp bovis AF2122/97
gccaucaucgcuuggccu

SEQ ID NO: 1162329 - RNA, 15 nt, Mycobacterium bovis subsp bovis AF2122/97
gccaucauggcggcc

SEQ ID NO: 1162330 - RNA, 16 nt, Mycobacterium bovis subsp bovis AF2122/97
gccaucauggcggccc

SEQ ID NO: 1162331 - RNA, 19 nt, Mycobacterium bovis subsp bovis AF2122/97
gccaucagcccggcgcgcc

SEQ ID NO: 1162332 - RNA, 22 nt, Mycobacterium bovis subsp bovis AF2122/97
gccauccucgaguuuggccagu

SEQ ID NO: 1162333 - RNA, 18 nt, Mycobacterium bovis subsp bovis AF2122/97
gccauccuucggggugaa

SEQ ID NO: 1162334 - RNA, 22 nt, Mycobacterium bovis subsp bovis AF2122/97
gccaucgaccguccgggucacc

SEQ ID NO: 1162335 - RNA, 19 nt, Mycobacterium bovis subsp bovis AF2122/97
gccaucguuucacccgggc

SEQ ID NO: 1162336 - RNA, 17 nt, Mycobacterium bovis subsp bovis AF2122/97
gccaucucuugcaaccu

SEQ ID NO: 1162337 - RNA, 17 nt, Mycobacterium bovis subsp bovis AF2122/97
gccaucgucgaagaccu

SEQ ID NO: 1162338 - RNA, 17 nt, Mycobacterium bovis subsp bovis AF2122/97
gccaucgucggaaugcu

SEQ ID NO: 1162339 - RNA, 18 nt, Mycobacterium bovis subsp bovis AF2122/97
gccaucgucggaaugcug

SEQ ID NO: 1162340 - RNA, 14 nt, Mycobacterium bovis subsp bovis AF2122/97
gcccgcccaccucg

SEQ ID NO: 1162341 - RNA, 13 nt, Mycobacterium bovis subsp bovis AF2122/97
gcccgccccgcgc

SEQ ID NO: 1162342 - RNA, 12 nt, Mycobacterium bovis subsp bovis AF2122/97
gcccgccggccc

SEQ ID NO: 1162343 - RNA, 13 nt, Mycobacterium bovis subsp bovis AF2122/97
gcccgccggccca

SEQ ID NO: 1162344 - RNA, 14 nt, Mycobacterium bovis subsp bovis AF2122/97
gcccgccggccucu

SEQ ID NO: 1162345 - RNA, 16 nt, Mycobacterium bovis subsp bovis AF2122/97
gcccgccggcgcgagc

SEQ ID NO: 1162346 - RNA, 18 nt, Mycobacterium bovis subsp bovis AF2122/97
gcccgccggcgcgagccg

SEQ ID NO: 1162347 - RNA, 17 nt, Mycobacterium bovis subsp bovis AF2122/97
gcccgccgucuuggccc

SEQ ID NO: 1162348 - RNA, 18 nt, Mycobacterium bovis subsp bovis AF2122/97
gcccgccgucuuggcccg

SEQ ID NO: 1162349 - RNA, 22 nt, Mycobacterium bovis subsp bovis AF2122/97
gcccgccguuacggagggcacg

SEQ ID NO: 1162350 - RNA, 18 nt, Mycobacterium bovis subsp bovis AF2122/97
gcccgccguccggcgccc

SEQ ID NO: 1162351 - RNA, 17 nt, Mycobacterium bovis subsp bovis AF2122/97
gcccgccaucagcccgg

SEQ ID NO: 1162352 - RNA, 22 nt, Mycobacterium bovis subsp bovis AF2122/97
gcccgccauccgauggcccggc

SEQ ID NO: 1162353 - RNA, 13 nt, Mycobacterium bovis subsp bovis AF2122/97
gcccgccaggaac

SEQ ID NO: 1162354 - RNA, 16 nt, Mycobacterium bovis subsp bovis AF2122/97
gcccgaugccgugccc

SEQ ID NO: 1162355 - RNA, 18 nt, Mycobacterium bovis subsp bovis AF2122/97
gcccgaugguacccgcgc

SEQ ID NO: 1162356 - RNA, 15 nt, Mycobacterium bovis subsp bovis AF2122/97
gcccgauggugccga

SEQ ID NO: 1162357 - RNA, 19 nt, Mycobacterium bovis subsp bovis AF2122/97
gcccgauucagcgccccau

SEQ ID NO: 1162358 - RNA, 12 nt, Mycobacterium bovis subsp bovis AF2122/97
gcccgcgcggcg

SEQ ID NO: 1162359 - RNA, 14 nt, Mycobacterium bovis subsp bovis AF2122/97
gcccgcgcggcggu

SEQ ID NO: 1162360 - RNA, 17 nt, Mycobacterium bovis subsp bovis AF2122/97
gcccgcgggcgguaauc

SEQ ID NO: 1162361 - RNA, 19 nt, Mycobacterium bovis subsp bovis AF2122/97
gcccgcggccguggugguc

SEQ ID NO: 1162362 - RNA, 13 nt, Mycobacterium bovis subsp bovis AF2122/97
gcccgcgcugccg

SEQ ID NO: 1162363 - RNA, 20 nt, Mycobacterium bovis subsp bovis AF2122/97
gcccgcgcugccgacuccuc

SEQ ID NO: 1162364 - RNA, 21 nt, Mycobacterium bovis subsp bovis AF2122/97
gcccggcaaaggauuucaccg

SEQ ID NO: 1162365 - RNA, 20 nt, Mycobacterium bovis subsp bovis AF2122/97
gcccggaggguucggacggc

SEQ ID NO: 1162366 - RNA, 13 nt, Mycobacterium bovis subsp bovis AF2122/97
gcccggcaccccu

SEQ ID NO: 1162367 - RNA, 13 nt, Mycobacterium bovis subsp bovis AF2122/97
gcccggacaggcu

SEQ ID NO: 1162368 - RNA, 19 nt, Mycobacterium bovis subsp bovis AF2122/97
gcccggacaugcgggcagc

SEQ ID NO: 1162369 - RNA, 22 nt, Mycobacterium bovis subsp bovis AF2122/97
gcccggaaccggcgugcagcac

SEQ ID NO: 1162370 - RNA, 21 nt, Mycobacterium bovis subsp bovis AF2122/97
gcccggacaugcgggcagcac

SEQ ID NO: 1162371 - RNA, 17 nt, Mycobacterium bovis subsp bovis AF2122/97
gcccggacgauggcguc

SEQ ID NO: 1162372 - RNA, 16 nt, Mycobacterium bovis subsp bovis AF2122/97
gccccuccgggcgcac

SEQ ID NO: 1162373 - RNA, 14 nt, Mycobacterium bovis subsp bovis AF2122/97
gccccuccgcgccg

SEQ ID NO: 1162374 - RNA, 20 nt, Mycobacterium bovis subsp bovis AF2122/97
gccccguccgauuucccagc

SEQ ID NO: 1162375 - RNA, 16 nt, Mycobacterium bovis subsp bovis AF2122/97
gccccgguggcaggga

SEQ ID NO: 1162376 - RNA, 18 nt, Mycobacterium bovis subsp bovis AF2122/97
gccccguucgccaggccg

SEQ ID NO: 1162377 - RNA, 15 nt, Mycobacterium bovis subsp bovis AF2122/97
gccccguugucgggg

SEQ ID NO: 1162378 - RNA, 15 nt, Mycobacterium bovis subsp bovis AF2122/97
gcccaggcauggccu

SEQ ID NO: 1162379 - RNA, 16 nt, Mycobacterium bovis subsp bovis AF2122/97
gcccaggcauggccug

SEQ ID NO: 1162380 - RNA, 17 nt, Mycobacterium bovis subsp bovis AF2122/97
gcccaggacagcagccg

SEQ ID NO: 1162381 - RNA, 18 nt, Mycobacterium bovis subsp bovis AF2122/97
gcccaggacagcagccgc

SEQ ID NO: 1162382 - RNA, 20 nt, Mycobacterium bovis subsp bovis AF2122/97
gcccaggacagcagccgccg

SEQ ID NO: 1162383 - RNA, 22 nt, Mycobacterium bovis subsp bovis AF2122/97
gcccaggacagcagccgccggc

SEQ ID NO: 1162384 - RNA, 13 nt, Mycobacterium bovis subsp bovis AF2122/97
gcccagcgcgcgc

SEQ ID NO: 1162385 - RNA, 22 nt, Mycobacterium bovis subsp bovis AF2122/97
gcccgagugugaaucgcacgac

SEQ ID NO: 1162386 - RNA, 12 nt, Mycobacterium bovis subsp bovis AF2122/97
gcccgaguugaa

SEQ ID NO: 1162387 - RNA, 18 nt, Mycobacterium bovis subsp bovis AF2122/97
gcccgaguugaagaagcc

SEQ ID NO: 1162388 - RNA, 16 nt, Mycobacterium bovis subsp bovis AF2122/97
gcccgaguugaaggug

SEQ ID NO: 1162389 - RNA, 22 nt, Mycobacterium bovis subsp bovis AF2122/97
gcccgaaggcggcuccaccggg

SEQ ID NO: 1162390 - RNA, 20 nt, Mycobacterium bovis subsp bovis AF2122/97
gcccgagcgcuugaccccgc

SEQ ID NO: 1162391 - RNA, 20 nt, Mycobacterium bovis subsp bovis AF2122/97
gcccgauccggaucccacca

SEQ ID NO: 1162392 - RNA, 18 nt, Mycobacterium bovis subsp bovis AF2122/97
gcccgaucaccauccagc

SEQ ID NO: 1162393 - RNA, 17 nt, Mycobacterium bovis subsp bovis AF2122/97
gcccgaucaccagcccc

SEQ ID NO: 1162394 - RNA, 14 nt, Mycobacterium bovis subsp bovis AF2122/97
gcccgauagaucgc

SEQ ID NO: 1162395 - RNA, 19 nt, Mycobacterium bovis subsp bovis AF2122/97
gcccgaguuggcgaagccc

SEQ ID NO: 1162396 - RNA, 23 nt, Mycobacterium bovis subsp bovis AF2122/97
gcccgaguuguggacgcccgagu

SEQ ID NO: 1162397 - RNA, 22 nt, Mycobacterium bovis subsp bovis AF2122/97
gcccgaguuguucgugccggcg

SEQ ID NO: 1162398 - RNA, 19 nt, Mycobacterium bovis subsp bovis AF2122/97
gcccgaguuguugcugccc

SEQ ID NO: 1162399 - RNA, 14 nt, Mycobacterium bovis subsp bovis AF2122/97
gcccgaacuucugg

SEQ ID NO: 1162400 - RNA, 22 nt, Mycobacterium bovis subsp bovis AF2122/97
gcccgaagacggggugguggug

SEQ ID NO: 1162401 - RNA, 17 nt, Mycobacterium bovis subsp bovis AF2122/97
gccccuuuugccgcagc

SEQ ID NO: 1162402 - RNA, 18 nt, Mycobacterium bovis subsp bovis AF2122/97
gccccuugaccgcugccc

SEQ ID NO: 1162403 - RNA, 19 nt, Mycobacterium bovis subsp bovis AF2122/97
gccccuugaccgcugccca

SEQ ID NO: 1162404 - RNA, 17 nt, Mycobacterium bovis subsp bovis AF2122/97
gccccugaaggccagcc

SEQ ID NO: 1162405 - RNA, 18 nt, Mycobacterium bovis subsp bovis AF2122/97
gccccugaaggccagcca

SEQ ID NO: 1162406 - RNA, 15 nt, Mycobacterium bovis subsp bovis AF2122/97
gcccggugcagcagu

SEQ ID NO: 1162407 - RNA, 15 nt, Mycobacterium bovis subsp bovis AF2122/97
gcccggugauggugc

SEQ ID NO: 1162408 - RNA, 22 nt, Mycobacterium bovis subsp bovis AF2122/97
gcccggucuauuugccugccgc

SEQ ID NO: 1162409 - RNA, 21 nt, Mycobacterium bovis subsp bovis AF2122/97
gcccggucucgacggcggccg

SEQ ID NO: 1162410 - RNA, 23 nt, Mycobacterium bovis subsp bovis AF2122/97
gcccggucucgacggcggccgcg

SEQ ID NO: 1162411 - RNA, 18 nt, Mycobacterium bovis subsp bovis AF2122/97
gcccgguacgccgcgccg

SEQ ID NO: 1162412 - RNA, 23 nt, Mycobacterium bovis subsp bovis AF2122/97
gcccgggcauccuucaccagcug

SEQ ID NO: 1162413 - RNA, 23 nt, Mycobacterium bovis subsp bovis AF2122/97
gcccgggcagccccuccgcgccg

SEQ ID NO: 1162414 - RNA, 13 nt, Mycobacterium bovis subsp bovis AF2122/97
gcccgggcagcac

SEQ ID NO: 1162415 - RNA, 14 nt, Mycobacterium bovis subsp bovis AF2122/97
gcccgggcagcccc

SEQ ID NO: 1162416 - RNA, 20 nt, Mycobacterium bovis subsp bovis AF2122/97
gcccgguaucgucccggcga

SEQ ID NO: 1162417 - RNA, 22 nt, Mycobacterium bovis subsp bovis AF2122/97
gcccggucauggucagcagaau

SEQ ID NO: 1162418 - RNA, 13 nt, Mycobacterium bovis subsp bovis AF2122/97
gcccgucgggccg

SEQ ID NO: 1162419 - RNA, 15 nt, Mycobacterium bovis subsp bovis AF2122/97
gcccgugacugguga

SEQ ID NO: 1162420 - RNA, 16 nt, Mycobacterium bovis subsp bovis AF2122/97
gcccgugacuggugaa

SEQ ID NO: 1162421 - RNA, 21 nt, Mycobacterium bovis subsp bovis AF2122/97
gcccguaauugcagguggugu

SEQ ID NO: 1162422 - RNA, 18 nt, Mycobacterium bovis subsp bovis AF2122/97
gcccgguucagcgcuggc

SEQ ID NO: 1162423 - RNA, 23 nt, Mycobacterium bovis subsp bovis AF2122/97
gcccgguguucaucacgccgccg

SEQ ID NO: 1162424 - RNA, 14 nt, Mycobacterium bovis subsp bovis AF2122/97
gcccgguggcggcu

SEQ ID NO: 1162425 - RNA, 13 nt, Mycobacterium bovis subsp bovis AF2122/97
gcccgguggugcu

SEQ ID NO: 1162426 - RNA, 19 nt, Mycobacterium bovis subsp bovis AF2122/97
gcccggugugcugcacggc

SEQ ID NO: 1162427 - RNA, 20 nt, Mycobacterium bovis subsp bovis AF2122/97
gcccggcgcgauccccgcgc

SEQ ID NO: 1162428 - RNA, 22 nt, Mycobacterium bovis subsp bovis AF2122/97
gcccggcgcuagcgccgcgcuu

SEQ ID NO: 1162429 - RNA, 14 nt, Mycobacterium bovis subsp bovis AF2122/97
gcccggcucggugc

SEQ ID NO: 1162430 - RNA, 12 nt, Mycobacterium bovis subsp bovis AF2122/97
gcccgggcaccg

SEQ ID NO: 1162431 - RNA, 15 nt, Mycobacterium bovis subsp bovis AF2122/97
gcccggccagccgca

SEQ ID NO: 1162432 - RNA, 22 nt, Mycobacterium bovis subsp bovis AF2122/97
gcccggcgaacaggcgaccggg

SEQ ID NO: 1162433 - RNA, 22 nt, Mycobacterium bovis subsp bovis AF2122/97
gcccggcgcaagcgccgcgcuu

SEQ ID NO: 1162434 - RNA, 14 nt, Mycobacterium bovis subsp bovis AF2122/97
gcccggcaggacuu

SEQ ID NO: 1162435 - RNA, 15 nt, Mycobacterium bovis subsp bovis AF2122/97
gcccucaacggcggc

SEQ ID NO: 1162436 - RNA, 16 nt, Mycobacterium bovis subsp bovis AF2122/97
gcccucgacgccgcgc

SEQ ID NO: 1162437 - RNA, 19 nt, Mycobacterium bovis subsp bovis AF2122/97
gcccucgacgccgcgcagc

SEQ ID NO: 1162438 - RNA, 23 nt, Mycobacterium bovis subsp bovis AF2122/97
gcccucgacgccgcgcagccggc

SEQ ID NO: 1162439 - RNA, 21 nt, Mycobacterium bovis subsp bovis AF2122/97
gcccucaacgaucgcgccguc

SEQ ID NO: 1162440 - RNA, 18 nt, Mycobacterium bovis subsp bovis AF2122/97
gcccucggccgccugacg

SEQ ID NO: 1162441 - RNA, 21 nt, Mycobacterium bovis subsp bovis AF2122/97
gcccucgcuaauugcggccgc

SEQ ID NO: 1162442 - RNA, 15 nt, Mycobacterium bovis subsp bovis AF2122/97
gcccucgauggccag

SEQ ID NO: 1162443 - RNA, 14 nt, Mycobacterium bovis subsp bovis AF2122/97
gcccgugccgcccu

SEQ ID NO: 1162444 - RNA, 15 nt, Mycobacterium bovis subsp bovis AF2122/97
gcccgugccacagcu

SEQ ID NO: 1162445 - RNA, 20 nt, Mycobacterium bovis subsp bovis AF2122/97
gcccgugggugcgucugggc

SEQ ID NO: 1162446 - RNA, 18 nt, Mycobacterium bovis subsp bovis AF2122/97
gcccgugcggcucgccgg

SEQ ID NO: 1162447 - RNA, 21 nt, Mycobacterium bovis subsp bovis AF2122/97
gcccuauacgcaacaggccaa

SEQ ID NO: 1162448 - RNA, 17 nt, Mycobacterium bovis subsp bovis AF2122/97
gcccuacgcagcgcggc

SEQ ID NO: 1162449 - RNA, 16 nt, Mycobacterium bovis subsp bovis AF2122/97
gcccuagccggcgcgc

SEQ ID NO: 1162450 - RNA, 20 nt, Mycobacterium bovis subsp bovis AF2122/97
gcccugccccggacuccaaa

SEQ ID NO: 1162451 - RNA, 14 nt, Mycobacterium bovis subsp bovis AF2122/97
gcccugcacagcag

SEQ ID NO: 1162452 - RNA, 22 nt, Mycobacterium bovis subsp bovis AF2122/97
gcccugcuugcaggcgaucugg

SEQ ID NO: 1162453 - RNA, 18 nt, Mycobacterium bovis subsp bovis AF2122/97
gcccuggaaugccgccac

SEQ ID NO: 1162454 - RNA, 16 nt, Mycobacterium bovis subsp bovis AF2122/97
gcccugauugaagccc

SEQ ID NO: 1162455 - RNA, 18 nt, Mycobacterium bovis subsp bovis AF2122/97
gcccugauugaagccccc

SEQ ID NO: 1162456 - RNA, 19 nt, Mycobacterium bovis subsp bovis AF2122/97
gcccugagaacacguucgg

SEQ ID NO: 1162457 - RNA, 11 nt, Mycobacterium bovis subsp bovis AF2122/97
gcccugguugg

SEQ ID NO: 1162458 - RNA, 17 nt, Mycobacterium bovis subsp bovis AF2122/97
gcccuggugugccgcgu

SEQ ID NO: 1162459 - RNA, 15 nt, Mycobacterium bovis subsp bovis AF2122/97
gcccuggccgccggc

SEQ ID NO: 1162460 - RNA, 23 nt, Mycobacterium bovis subsp bovis AF2122/97
gcccuggccgccggccccgccgu

SEQ ID NO: 1162461 - RNA, 16 nt, Mycobacterium bovis subsp bovis AF2122/97
gcccuggccgcgccgg

SEQ ID NO: 1162462 - RNA, 22 nt, Mycobacterium bovis subsp bovis AF2122/97
gcccuggacauaccggcccggg

SEQ ID NO: 1162463 - RNA, 23 nt, Mycobacterium bovis subsp bovis AF2122/97
gcccuggcaacgacacgccgcuc

SEQ ID NO: 1162464 - RNA, 18 nt, Mycobacterium bovis subsp bovis AF2122/97
gcccuggccgcccagacc

SEQ ID NO: 1162465 - RNA, 15 nt, Mycobacterium bovis subsp bovis AF2122/97
gcccuggccacccag

SEQ ID NO: 1162466 - RNA, 23 nt, Mycobacterium bovis subsp bovis AF2122/97
gccgaccgaccgcacgaccagcu

SEQ ID NO: 1162467 - RNA, 19 nt, Mycobacterium bovis subsp bovis AF2122/97
gccgacccgccgcgcccgg

SEQ ID NO: 1162468 - RNA, 12 nt, Mycobacterium bovis subsp bovis AF2122/97
gccgacccgcgc

SEQ ID NO: 1162469 - RNA, 15 nt, Mycobacterium bovis subsp bovis AF2122/97
gccgacccgcgcgcc

SEQ ID NO: 1162470 - RNA, 21 nt, Mycobacterium bovis subsp bovis AF2122/97
gccgaccggcccgcauccgca

SEQ ID NO: 1162471 - RNA, 23 nt, Mycobacterium bovis subsp bovis AF2122/97
gccgaccggcccgcauccgcacc

SEQ ID NO: 1162472 - RNA, 13 nt, Mycobacterium bovis subsp bovis AF2122/97
gccgacccgccgc

SEQ ID NO: 1162473 - RNA, 20 nt, Mycobacterium bovis subsp bovis AF2122/97
gccgaccaucucaccgggcc

SEQ ID NO: 1162474 - RNA, 22 nt, Mycobacterium bovis subsp bovis AF2122/97
gccgaccaucucaccgggcccg

SEQ ID NO: 1162475 - RNA, 19 nt, Mycobacterium bovis subsp bovis AF2122/97
gccgaccagcgcgcugcgc

SEQ ID NO: 1162476 - RNA, 22 nt, Mycobacterium bovis subsp bovis AF2122/97
gccgaccagagcuucgccgcgc

SEQ ID NO: 1162477 - RNA, 14 nt, Mycobacterium bovis subsp bovis AF2122/97
gccgaccagcaccc

SEQ ID NO: 1162478 - RNA, 15 nt, Mycobacterium bovis subsp bovis AF2122/97
gccgaccaccgccgg

SEQ ID NO: 1162479 - RNA, 13 nt, Mycobacterium bovis subsp bovis AF2122/97
gccgacaucggcg

SEQ ID NO: 1162480 - RNA, 16 nt, Mycobacterium bovis subsp bovis AF2122/97
gccgacauugcugcuc

SEQ ID NO: 1162481 - RNA, 16 nt, Mycobacterium bovis subsp bovis AF2122/97
gccgacaccgccacca

SEQ ID NO: 1162482 - RNA, 15 nt, Mycobacterium bovis subsp bovis AF2122/97
gccgacaccaccggc

SEQ ID NO: 1162483 - RNA, 22 nt, Mycobacterium bovis subsp bovis AF2122/97
gccgacaccaccggcgccgccg

SEQ ID NO: 1162484 - RNA, 19 nt, Mycobacterium bovis subsp bovis AF2122/97
gccgaagaacucaaagacc

SEQ ID NO: 1162485 - RNA, 12 nt, Mycobacterium bovis subsp bovis AF2122/97
gccgaagcccga

SEQ ID NO: 1162486 - RNA, 13 nt, Mycobacterium bovis subsp bovis AF2122/97
gccgaagccuugc

SEQ ID NO: 1162487 - RNA, 13 nt, Mycobacterium bovis subsp bovis AF2122/97
gccgaagcgggcc

SEQ ID NO: 1162488 - RNA, 14 nt, Mycobacterium bovis subsp bovis AF2122/97
gccgaagcggccac

SEQ ID NO: 1162489 - RNA, 15 nt, Mycobacterium bovis subsp bovis AF2122/97
gccgaagcggccacc

SEQ ID NO: 1162490 - RNA, 14 nt, Mycobacterium bovis subsp bovis AF2122/97
gccgaagcgcccgu

SEQ ID NO: 1162491 - RNA, 15 nt, Mycobacterium bovis subsp bovis AF2122/97
gccgaacgacagcag

SEQ ID NO: 1162492 - RNA, 18 nt, Mycobacterium bovis subsp bovis AF2122/97
gccgaacccgguguugag

SEQ ID NO: 1162493 - RNA, 22 nt, Mycobacterium bovis subsp bovis AF2122/97
gccgaacgugcaaccauggcgg

SEQ ID NO: 1162494 - RNA, 17 nt, Mycobacterium bovis subsp bovis AF2122/97
gccgaaucgcugaccgc

SEQ ID NO: 1162495 - RNA, 21 nt, Mycobacterium bovis subsp bovis AF2122/97
gccgaauaccgguggcagccu

SEQ ID NO: 1162496 - RNA, 13 nt, Mycobacterium bovis subsp bovis AF2122/97
gccgacaaaagcc

SEQ ID NO: 1162497 - RNA, 15 nt, Mycobacterium bovis subsp bovis AF2122/97
gccgacaagucaaga

SEQ ID NO: 1162498 - RNA, 21 nt, Mycobacterium bovis subsp bovis AF2122/97
gccgacaacccggccgggccu

SEQ ID NO: 1162499 - RNA, 12 nt, Mycobacterium bovis subsp bovis AF2122/97
gccgacaacccc

SEQ ID NO: 1162500 - RNA, 16 nt, Mycobacterium bovis subsp bovis AF2122/97
gccgacaaccccgcca

SEQ ID NO: 1162501 - RNA, 19 nt, Mycobacterium bovis subsp bovis AF2122/97
gccgacaaccccgccagga

SEQ ID NO: 1162502 - RNA, 14 nt, Mycobacterium bovis subsp bovis AF2122/97
gccgaaggccuuau

SEQ ID NO: 1162503 - RNA, 20 nt, Mycobacterium bovis subsp bovis AF2122/97
gccgaaguagacggugguga

SEQ ID NO: 1162504 - RNA, 15 nt, Mycobacterium bovis subsp bovis AF2122/97
gccgaaggcggggga

SEQ ID NO: 1162505 - RNA, 21 nt, Mycobacterium bovis subsp bovis AF2122/97
gccgaaggauuuggagcuuuu

SEQ ID NO: 1162506 - RNA, 16 nt, Mycobacterium bovis subsp bovis AF2122/97
gccgaaguggagcccc

SEQ ID NO: 1162507 - RNA, 20 nt, Mycobacterium bovis subsp bovis AF2122/97
gccgaauaccgguggcagcc

SEQ ID NO: 1162508 - RNA, 20 nt, Mycobacterium bovis subsp bovis AF2122/97
gccgaacagggaggucgccg

SEQ ID NO: 1162509 - RNA, 20 nt, Mycobacterium bovis subsp bovis AF2122/97
gccgaacagcaggccuccaa

SEQ ID NO: 1162510 - RNA, 23 nt, Mycobacterium bovis subsp bovis AF2122/97
gccgaacagcugcccgccagcgc

SEQ ID NO: 1162511 - RNA, 18 nt, Mycobacterium bovis subsp bovis AF2122/97
gccgaacagcgaaccgcc

SEQ ID NO: 1162512 - RNA, 16 nt, Mycobacterium bovis subsp bovis AF2122/97
gccgaaccggcaccag

SEQ ID NO: 1162513 - RNA, 20 nt, Mycobacterium bovis subsp bovis AF2122/97
gccgaacagugcggucccga

SEQ ID NO: 1162514 - RNA, 22 nt, Mycobacterium bovis subsp bovis AF2122/97
gccgaacagugcggucccgacc

SEQ ID NO: 1162515 - RNA, 19 nt, Mycobacterium bovis subsp bovis AF2122/97
gccgaacaguucggcgagc

SEQ ID NO: 1162516 - RNA, 18 nt, Mycobacterium bovis subsp bovis AF2122/97
gccgaaccacgcgcccgc

SEQ ID NO: 1162517 - RNA, 20 nt, Mycobacterium bovis subsp bovis AF2122/97
gccgaacaccgucagcgucu

SEQ ID NO: 1162518 - RNA, 13 nt, Mycobacterium bovis subsp bovis AF2122/97
gccgaacacaccg

SEQ ID NO: 1162519 - RNA, 20 nt, Mycobacterium bovis subsp bovis AF2122/97
gccgaaaucggccagcuucc

SEQ ID NO: 1162520 - RNA, 19 nt, Mycobacterium bovis subsp bovis AF2122/97
gccgaaacuucgcccgggc

SEQ ID NO: 1162521 - RNA, 15 nt, Mycobacterium bovis subsp bovis AF2122/97
gccgaaagccaggcg

SEQ ID NO: 1162522 - RNA, 22 nt, Mycobacterium bovis subsp bovis AF2122/97
gccgaaacucaccagcaccccg

SEQ ID NO: 1162523 - RNA, 16 nt, Mycobacterium bovis subsp bovis AF2122/97
gccgaaaaugccgccc

SEQ ID NO: 1162524 - RNA, 15 nt, Mycobacterium bovis subsp bovis AF2122/97
gccgaaacauugccc

SEQ ID NO: 1162525 - RNA, 16 nt, Mycobacterium bovis subsp bovis AF2122/97
gccgaaaagggcgaca

SEQ ID NO: 1162526 - RNA, 22 nt, Mycobacterium bovis subsp bovis AF2122/97
gccgaaaaagaccgacagcggc

SEQ ID NO: 1162527 - RNA, 17 nt, Mycobacterium bovis subsp bovis AF2122/97
gcccuucagcacgguga

SEQ ID NO: 1162528 - RNA, 13 nt, Mycobacterium bovis subsp bovis AF2122/97
gcccuguucuccg

SEQ ID NO: 1162529 - RNA, 17 nt, Mycobacterium bovis subsp bovis AF2122/97
gcccuuagggucgccgc

SEQ ID NO: 1162530 - RNA, 14 nt, Mycobacterium bovis subsp bovis AF2122/97
gcccuuggccagca

SEQ ID NO: 1162531 - RNA, 16 nt, Mycobacterium bovis subsp bovis AF2122/97
gcccuuggccagcagg

SEQ ID NO: 1162532 - RNA, 18 nt, Mycobacterium bovis subsp bovis AF2122/97
gcccuugggacugcggac

SEQ ID NO: 1162533 - RNA, 12 nt, Mycobacterium bovis subsp bovis AF2122/97
gcccuugccgcc

SEQ ID NO: 1162534 - RNA, 16 nt, Mycobacterium bovis subsp bovis AF2122/97
gcccuugccgccgagg

SEQ ID NO: 1162535 - RNA, 20 nt, Mycobacterium bovis subsp bovis AF2122/97
gcccuugccgccggccccgc

SEQ ID NO: 1162536 - RNA, 23 nt, Mycobacterium bovis subsp bovis AF2122/97
gcccuugccgccggccccgccgu

SEQ ID NO: 1162537 - RNA, 18 nt, Mycobacterium bovis subsp bovis AF2122/97
gcccuugccuuguuccag

SEQ ID NO: 1162538 - RNA, 19 nt, Mycobacterium bovis subsp bovis AF2122/97
gcccuugccgccuuggccc

SEQ ID NO: 1162539 - RNA, 19 nt, Mycobacterium bovis subsp bovis AF2122/97
gccgaggucgaacgcccgc

SEQ ID NO: 1162540 - RNA, 19 nt, Mycobacterium bovis subsp bovis AF2122/97
gccgaggguagacggggcg

SEQ ID NO: 1162541 - RNA, 23 nt, Mycobacterium bovis subsp bovis AF2122/97
gccgaggguagacggggcgagca

SEQ ID NO: 1162542 - RNA, 13 nt, Mycobacterium bovis subsp bovis AF2122/97
gccgagcgcccgc

SEQ ID NO: 1162543 - RNA, 11 nt, Mycobacterium bovis subsp bovis AF2122/97
gccgagcgcgc

SEQ ID NO: 1162544 - RNA, 16 nt, Mycobacterium bovis subsp bovis AF2122/97
gccgagcuccuccacc

SEQ ID NO: 1162545 - RNA, 14 nt, Mycobacterium bovis subsp bovis AF2122/97
gccgagcgugcgcu

SEQ ID NO: 1162546 - RNA, 14 nt, Mycobacterium bovis subsp bovis AF2122/97
gccgagcuccucca

SEQ ID NO: 1162547 - RNA, 18 nt, Mycobacterium bovis subsp bovis AF2122/97
gccgaggaccagaggcgc

SEQ ID NO: 1162548 - RNA, 19 nt, Mycobacterium bovis subsp bovis AF2122/97
gccgagcuggcgaccuggu

SEQ ID NO: 1162549 - RNA, 19 nt, Mycobacterium bovis subsp bovis AF2122/97
gccgagcugguaaacgggu

SEQ ID NO: 1162550 - RNA, 17 nt, Mycobacterium bovis subsp bovis AF2122/97
gccgagcuucagcgcgc

SEQ ID NO: 1162551 - RNA, 18 nt, Mycobacterium bovis subsp bovis AF2122/97
gccgagcuucagcgcgcu

SEQ ID NO: 1162552 - RNA, 18 nt, Mycobacterium bovis subsp bovis AF2122/97
gccgagcuugucgagcag

SEQ ID NO: 1162553 - RNA, 20 nt, Mycobacterium bovis subsp bovis AF2122/97
gccgaggcaaccgacacugg

SEQ ID NO: 1162554 - RNA, 15 nt, Mycobacterium bovis subsp bovis AF2122/97
gccgaggacgccggc

SEQ ID NO: 1162555 - RNA, 22 nt, Mycobacterium bovis subsp bovis AF2122/97
gccgaggacgccggcgccgcca

SEQ ID NO: 1162556 - RNA, 22 nt, Mycobacterium bovis subsp bovis AF2122/97
gccgaggacuggaaagcagcag

SEQ ID NO: 1162557 - RNA, 13 nt, Mycobacterium bovis subsp bovis AF2122/97
gccgaggccgccg

SEQ ID NO: 1162558 - RNA, 18 nt, Mycobacterium bovis subsp bovis AF2122/97
gccgaggccgcugccagg

SEQ ID NO: 1162559 - RNA, 15 nt, Mycobacterium bovis subsp bovis AF2122/97
gccgaucagcuggcu

SEQ ID NO: 1162560 - RNA, 15 nt, Mycobacterium bovis subsp bovis AF2122/97
gccgaguaccagccc

SEQ ID NO: 1162561 - RNA, 16 nt, Mycobacterium bovis subsp bovis AF2122/97
gccgaguaccagccca

SEQ ID NO: 1162562 - RNA, 13 nt, Mycobacterium bovis subsp bovis AF2122/97
gccgaucgcccgc

SEQ ID NO: 1162563 - RNA, 15 nt, Mycobacterium bovis subsp bovis AF2122/97
gccgaucgacacccg

SEQ ID NO: 1162564 - RNA, 15 nt, Mycobacterium bovis subsp bovis AF2122/97
gccgaucccaccggc

SEQ ID NO: 1162565 - RNA, 15 nt, Mycobacterium bovis subsp bovis AF2122/97
gccgauccagcaggc

SEQ ID NO: 1162566 - RNA, 11 nt, Mycobacterium bovis subsp bovis AF2122/97
gccgcaaccau

SEQ ID NO: 1162567 - RNA, 14 nt, Mycobacterium bovis subsp bovis AF2122/97
gccgcaaccggcga

SEQ ID NO: 1162568 - RNA, 17 nt, Mycobacterium bovis subsp bovis AF2122/97
gccgauguuggcagggc

SEQ ID NO: 1162569 - RNA, 13 nt, Mycobacterium bovis subsp bovis AF2122/97
gccgagcaggucg

SEQ ID NO: 1162570 - RNA, 16 nt, Mycobacterium bovis subsp bovis AF2122/97
gccgagcaggucggca

SEQ ID NO: 1162571 - RNA, 11 nt, Mycobacterium bovis subsp bovis AF2122/97
gccgagcagcu

SEQ ID NO: 1162572 - RNA, 13 nt, Mycobacterium bovis subsp bovis AF2122/97
gccgagcccgggc

SEQ ID NO: 1162573 - RNA, 19 nt, Mycobacterium bovis subsp bovis AF2122/97
gccgagcccgggccguacg

SEQ ID NO: 1162574 - RNA, 15 nt, Mycobacterium bovis subsp bovis AF2122/97
gccgagcccggugcu

SEQ ID NO: 1162575 - RNA, 17 nt, Mycobacterium bovis subsp bovis AF2122/97
gccgagccagcacccgc

SEQ ID NO: 1162576 - RNA, 17 nt, Mycobacterium bovis subsp bovis AF2122/97
gccgagcgaccguccca

SEQ ID NO: 1162577 - RNA, 21 nt, Mycobacterium bovis subsp bovis AF2122/97
gccgagccgauauaccagggc

SEQ ID NO: 1162578 - RNA, 16 nt, Mycobacterium bovis subsp bovis AF2122/97
gccgagcgcaaggucg

SEQ ID NO: 1162579 - RNA, 22 nt, Mycobacterium bovis subsp bovis AF2122/97
gccgagcgcacuggggaggcca

SEQ ID NO: 1162580 - RNA, 11 nt, Mycobacterium bovis subsp bovis AF2122/97
gccgagcgcga

SEQ ID NO: 1162581 - RNA, 16 nt, Mycobacterium bovis subsp bovis AF2122/97
gccgagcagacgcaga

SEQ ID NO: 1162582 - RNA, 16 nt, Mycobacterium bovis subsp bovis AF2122/97
gccgagcagacgcgga

SEQ ID NO: 1162583 - RNA, 18 nt, Mycobacterium bovis subsp bovis AF2122/97
gccgagaucacgccgggc

SEQ ID NO: 1162584 - RNA, 19 nt, Mycobacterium bovis subsp bovis AF2122/97
gccgagagcagccagccac

SEQ ID NO: 1162585 - RNA, 23 nt, Mycobacterium bovis subsp bovis AF2122/97
gccgacuuugagucguuggacgg

SEQ ID NO: 1162586 - RNA, 20 nt, Mycobacterium bovis subsp bovis AF2122/97
gccgagaauuccccagccgc

SEQ ID NO: 1162587 - RNA, 19 nt, Mycobacterium bovis subsp bovis AF2122/97
gccgagaccgccgcugccg

SEQ ID NO: 1162588 - RNA, 17 nt, Mycobacterium bovis subsp bovis AF2122/97
gccgacuucgucaacca

SEQ ID NO: 1162589 - RNA, 23 nt, Mycobacterium bovis subsp bovis AF2122/97
gccgacuugauuucgaucgcggc

SEQ ID NO: 1162590 - RNA, 22 nt, Mycobacterium bovis subsp bovis AF2122/97
gccgacuuccgcgucgccggcc

SEQ ID NO: 1162591 - RNA, 20 nt, Mycobacterium bovis subsp bovis AF2122/97
gccgaccucguucgucacca

SEQ ID NO: 1162592 - RNA, 12 nt, Mycobacterium bovis subsp bovis AF2122/97
gccgaccucgag

SEQ ID NO: 1162593 - RNA, 14 nt, Mycobacterium bovis subsp bovis AF2122/97
gccgaccgggcucu

SEQ ID NO: 1162594 - RNA, 18 nt, Mycobacterium bovis subsp bovis AF2122/97
gccgaccgggcucuggcc

SEQ ID NO: 1162595 - RNA, 16 nt, Mycobacterium bovis subsp bovis AF2122/97
gccgaccggguugaug

SEQ ID NO: 1162596 - RNA, 19 nt, Mycobacterium bovis subsp bovis AF2122/97
gccgaccuuuugcggcaag

SEQ ID NO: 1162597 - RNA, 20 nt, Mycobacterium bovis subsp bovis AF2122/97
gccgaccuuuugcggcaagc

SEQ ID NO: 1162598 - RNA, 22 nt, Mycobacterium bovis subsp bovis AF2122/97
gccgaccugcgcgacggcgcug

SEQ ID NO: 1162599 - RNA, 16 nt, Mycobacterium bovis subsp bovis AF2122/97
gccgacgaggggcgcg

SEQ ID NO: 1162600 - RNA, 16 nt, Mycobacterium bovis subsp bovis AF2122/97
gccgacgagacggcag

SEQ ID NO: 1162601 - RNA, 19 nt, Mycobacterium bovis subsp bovis AF2122/97
gccgacgaucgacgccgcc

SEQ ID NO: 1162602 - RNA, 13 nt, Mycobacterium bovis subsp bovis AF2122/97
gccgacgcgcggc

SEQ ID NO: 1162603 - RNA, 19 nt, Mycobacterium bovis subsp bovis AF2122/97
gccgacgccggugccggcc

SEQ ID NO: 1162604 - RNA, 16 nt, Mycobacterium bovis subsp bovis AF2122/97
gccgacgccgccggcc

SEQ ID NO: 1162605 - RNA, 17 nt, Mycobacterium bovis subsp bovis AF2122/97
gccgacgggacaacccg

SEQ ID NO: 1162606 - RNA, 17 nt, Mycobacterium bovis subsp bovis AF2122/97
gccgacggugcaagccc

SEQ ID NO: 1162607 - RNA, 18 nt, Mycobacterium bovis subsp bovis AF2122/97
gccgacguauagaccagg

SEQ ID NO: 1162608 - RNA, 19 nt, Mycobacterium bovis subsp bovis AF2122/97
gccgacguauagaccaggu

SEQ ID NO: 1162609 - RNA, 17 nt, Mycobacterium bovis subsp bovis AF2122/97
gccgacgcgcggccagc

SEQ ID NO: 1162610 - RNA, 14 nt, Mycobacterium bovis subsp bovis AF2122/97
gccgacggccagca

SEQ ID NO: 1162611 - RNA, 16 nt, Mycobacterium bovis subsp bovis AF2122/97
gccgacuccccgccgg

SEQ ID NO: 1162612 - RNA, 19 nt, Mycobacterium bovis subsp bovis AF2122/97
gccgacuaucggccgccgg

SEQ ID NO: 1162613 - RNA, 16 nt, Mycobacterium bovis subsp bovis AF2122/97
gccgacucaucggccg

SEQ ID NO: 1162614 - RNA, 19 nt, Mycobacterium bovis subsp bovis AF2122/97
gccgacucggcaccgcggc

SEQ ID NO: 1162615 - RNA, 22 nt, Mycobacterium bovis subsp bovis AF2122/97
gccgacgucgacgccggccagc

SEQ ID NO: 1162616 - RNA, 14 nt, Mycobacterium bovis subsp bovis AF2122/97
gccgacgucgccgg

SEQ ID NO: 1162617 - RNA, 14 nt, Mycobacterium bovis subsp bovis AF2122/97
gccgacguugggga

SEQ ID NO: 1162618 - RNA, 22 nt, Mycobacterium bovis subsp bovis AF2122/97
gccgacuaguccgagggcgucg

SEQ ID NO: 1162619 - RNA, 12 nt, Mycobacterium bovis subsp bovis AF2122/97
gccgcgcggcga

SEQ ID NO: 1162620 - RNA, 19 nt, Mycobacterium bovis subsp bovis AF2122/97
gccgcgcggacccagcacc

SEQ ID NO: 1162621 - RNA, 22 nt, Mycobacterium bovis subsp bovis AF2122/97
gccgcgcgccaucgccuccagc

SEQ ID NO: 1162622 - RNA, 20 nt, Mycobacterium bovis subsp bovis AF2122/97
gccgcgcgcugccgcugcgc

SEQ ID NO: 1162623 - RNA, 17 nt, Mycobacterium bovis subsp bovis AF2122/97
gccgcgccgcgccgccu

SEQ ID NO: 1162624 - RNA, 13 nt, Mycobacterium bovis subsp bovis AF2122/97
gccgcgccgcggc

SEQ ID NO: 1162625 - RNA, 16 nt, Mycobacterium bovis subsp bovis AF2122/97
gccgcgccgcggcccg

SEQ ID NO: 1162626 - RNA, 14 nt, Mycobacterium bovis subsp bovis AF2122/97
gccgcgccggcggc

SEQ ID NO: 1162627 - RNA, 15 nt, Mycobacterium bovis subsp bovis AF2122/97
gccgcgccggcggcc

SEQ ID NO: 1162628 - RNA, 13 nt, Mycobacterium bovis subsp bovis AF2122/97
gccgcgccgaccu

SEQ ID NO: 1162629 - RNA, 19 nt, Mycobacterium bovis subsp bovis AF2122/97
gccgcgccccagacgcgca

SEQ ID NO: 1162630 - RNA, 13 nt, Mycobacterium bovis subsp bovis AF2122/97
gccgcgcccggcg

SEQ ID NO: 1162631 - RNA, 20 nt, Mycobacterium bovis subsp bovis AF2122/97
gccgccggugccgccugcgc

SEQ ID NO: 1162632 - RNA, 16 nt, Mycobacterium bovis subsp bovis AF2122/97
gccgccggugucgggc

SEQ ID NO: 1162633 - RNA, 14 nt, Mycobacterium bovis subsp bovis AF2122/97
gccgccgguguugc

SEQ ID NO: 1162634 - RNA, 16 nt, Mycobacterium bovis subsp bovis AF2122/97
gccgccgguuccgccg

SEQ ID NO: 1162635 - RNA, 18 nt, Mycobacterium bovis subsp bovis AF2122/97
gccgccgguuccgccggc

SEQ ID NO: 1162636 - RNA, 19 nt, Mycobacterium bovis subsp bovis AF2122/97
gccgccgguuccgccggcc

SEQ ID NO: 1162637 - RNA, 20 nt, Mycobacterium bovis subsp bovis AF2122/97
gccgccgguuccgccggccc

SEQ ID NO: 1162638 - RNA, 22 nt, Mycobacterium bovis subsp bovis AF2122/97
gccgccgguuccgccggcccca

SEQ ID NO: 1162639 - RNA, 16 nt, Mycobacterium bovis subsp bovis AF2122/97
gccgccggugccaccc

SEQ ID NO: 1162640 - RNA, 20 nt, Mycobacterium bovis subsp bovis AF2122/97
gccgccggucaucccaagcg

SEQ ID NO: 1162641 - RNA, 18 nt, Mycobacterium bovis subsp bovis AF2122/97
gccgccggccccgccagc

SEQ ID NO: 1162642 - RNA, 16 nt, Mycobacterium bovis subsp bovis AF2122/97
gccgccggugccgcca

SEQ ID NO: 1162643 - RNA, 17 nt, Mycobacterium bovis subsp bovis AF2122/97
gccgccggugccgccau

SEQ ID NO: 1162644 - RNA, 16 nt, Mycobacterium bovis subsp bovis AF2122/97
gccgccggugccgccg

SEQ ID NO: 1162645 - RNA, 17 nt, Mycobacterium bovis subsp bovis AF2122/97
gccgccggugccgccgc

SEQ ID NO: 1162646 - RNA, 18 nt, Mycobacterium bovis subsp bovis AF2122/97
gccgccggguuuauccag

SEQ ID NO: 1162647 - RNA, 12 nt, Mycobacterium bovis subsp bovis AF2122/97
gccgccuucuug

SEQ ID NO: 1162648 - RNA, 22 nt, Mycobacterium bovis subsp bovis AF2122/97
gccgccuucuucucggcgagcu

SEQ ID NO: 1162649 - RNA, 17 nt, Mycobacterium bovis subsp bovis AF2122/97
gccgccugucccgccgg

SEQ ID NO: 1162650 - RNA, 14 nt, Mycobacterium bovis subsp bovis AF2122/97
gccgccugucgggc

SEQ ID NO: 1162651 - RNA, 17 nt, Mycobacterium bovis subsp bovis AF2122/97
gccgccugcgccgccag

SEQ ID NO: 1162652 - RNA, 18 nt, Mycobacterium bovis subsp bovis AF2122/97
gccgccugcuccucggcc

SEQ ID NO: 1162653 - RNA, 18 nt, Mycobacterium bovis subsp bovis AF2122/97
gccgcgaucgggcccagc

SEQ ID NO: 1162654 - RNA, 22 nt, Mycobacterium bovis subsp bovis AF2122/97
gccgcgaucggugcgggcgccg

SEQ ID NO: 1162655 - RNA, 17 nt, Mycobacterium bovis subsp bovis AF2122/97
gccgcgaucccggccgu

SEQ ID NO: 1162656 - RNA, 23 nt, Mycobacterium bovis subsp bovis AF2122/97
gccgcgaugugguggacgccaug

SEQ ID NO: 1162657 - RNA, 18 nt, Mycobacterium bovis subsp bovis AF2122/97
gccgcgaugagcggcgcg

SEQ ID NO: 1162658 - RNA, 23 nt, Mycobacterium bovis subsp bovis AF2122/97
gccgcgaaauuacuucggccaca

SEQ ID NO: 1162659 - RNA, 13 nt, Mycobacterium bovis subsp bovis AF2122/97
gccgcgaggaugc

SEQ ID NO: 1162660 - RNA, 17 nt, Mycobacterium bovis subsp bovis AF2122/97
gccgcgaaacccugaaa

SEQ ID NO: 1162661 - RNA, 16 nt, Mycobacterium bovis subsp bovis AF2122/97
gccgccgcggccacca

SEQ ID NO: 1162662 - RNA, 13 nt, Mycobacterium bovis subsp bovis AF2122/97
gccgccgcgggcg

SEQ ID NO: 1162663 - RNA, 17 nt, Mycobacterium bovis subsp bovis AF2122/97
gccgccgcgggcgccgg

SEQ ID NO: 1162664 - RNA, 12 nt, Mycobacterium bovis subsp bovis AF2122/97
gccgccgcggcg

SEQ ID NO: 1162665 - RNA, 13 nt, Mycobacterium bovis subsp bovis AF2122/97
gccgccgcggcca

SEQ ID NO: 1162666 - RNA, 21 nt, Mycobacterium bovis subsp bovis AF2122/97
gccgccgcgcguucggcgcug

SEQ ID NO: 1162667 - RNA, 14 nt, Mycobacterium bovis subsp bovis AF2122/97
gccgccgccugcuc

SEQ ID NO: 1162668 - RNA, 14 nt, Mycobacterium bovis subsp bovis AF2122/97
gccgccgccugugc

SEQ ID NO: 1162669 - RNA, 19 nt, Mycobacterium bovis subsp bovis AF2122/97
gccgccgccugugcgcggu

SEQ ID NO: 1162670 - RNA, 17 nt, Mycobacterium bovis subsp bovis AF2122/97
gccgccgcgagcgccgg

SEQ ID NO: 1162671 - RNA, 15 nt, Mycobacterium bovis subsp bovis AF2122/97
gccgccgccgccggc

SEQ ID NO: 1162672 - RNA, 16 nt, Mycobacterium bovis subsp bovis AF2122/97
gccgccgccggcgccg

SEQ ID NO: 1162673 - RNA, 18 nt, Mycobacterium bovis subsp bovis AF2122/97
gccgccgaugccaccgcu

SEQ ID NO: 1162674 - RNA, 15 nt, Mycobacterium bovis subsp bovis AF2122/97
gccgccggccccgcc

SEQ ID NO: 1162675 - RNA, 11 nt, Mycobacterium bovis subsp bovis AF2122/97
gccgccggcca

SEQ ID NO: 1162676 - RNA, 16 nt, Mycobacterium bovis subsp bovis AF2122/97
gccgccggccgccagc

SEQ ID NO: 1162677 - RNA, 15 nt, Mycobacterium bovis subsp bovis AF2122/97
gccgccggccgcgca

SEQ ID NO: 1162678 - RNA, 15 nt, Mycobacterium bovis subsp bovis AF2122/97
gccgccggaucgccg

SEQ ID NO: 1162679 - RNA, 12 nt, Mycobacterium bovis subsp bovis AF2122/97
gccgccggaggu

SEQ ID NO: 1162680 - RNA, 21 nt, Mycobacterium bovis subsp bovis AF2122/97
gccgccggcacccgccgugcc

SEQ ID NO: 1162681 - RNA, 13 nt, Mycobacterium bovis subsp bovis AF2122/97
gccgccggcaccg

SEQ ID NO: 1162682 - RNA, 20 nt, Mycobacterium bovis subsp bovis AF2122/97
gccgccggcaccgccggcgc

SEQ ID NO: 1162683 - RNA, 17 nt, Mycobacterium bovis subsp bovis AF2122/97
gccgccgcuacccccga

SEQ ID NO: 1162684 - RNA, 16 nt, Mycobacterium bovis subsp bovis AF2122/97
gccgccgcugccgccc

SEQ ID NO: 1162685 - RNA, 17 nt, Mycobacterium bovis subsp bovis AF2122/97
gccgccgcugccgcccu

SEQ ID NO: 1162686 - RNA, 16 nt, Mycobacterium bovis subsp bovis AF2122/97
gccgccgcugccgccu

SEQ ID NO: 1162687 - RNA, 14 nt, Mycobacterium bovis subsp bovis AF2122/97
gccgccgacaggga

SEQ ID NO: 1162688 - RNA, 18 nt, Mycobacterium bovis subsp bovis AF2122/97
gccgccgacaccaccggc

SEQ ID NO: 1162689 - RNA, 22 nt, Mycobacterium bovis subsp bovis AF2122/97
gccgccgacaccaccggcgccg

SEQ ID NO: 1162690 - RNA, 23 nt, Mycobacterium bovis subsp bovis AF2122/97
gccgccgacaccaccggcgccgc

SEQ ID NO: 1162691 - RNA, 11 nt, Mycobacterium bovis subsp bovis AF2122/97
gccgccgacuu

SEQ ID NO: 1162692 - RNA, 19 nt, Mycobacterium bovis subsp bovis AF2122/97
gccgccgacgccgccggcg

SEQ ID NO: 1162693 - RNA, 16 nt, Mycobacterium bovis subsp bovis AF2122/97
gccgccgagggcgccg

SEQ ID NO: 1162694 - RNA, 23 nt, Mycobacterium bovis subsp bovis AF2122/97
gccgccgaggucgguucggccgg

SEQ ID NO: 1162695 - RNA, 23 nt, Mycobacterium bovis subsp bovis AF2122/97
gccgccgaggacacauugaccag

SEQ ID NO: 1162696 - RNA, 15 nt, Mycobacterium bovis subsp bovis AF2122/97
gccgccgagcuggcg

SEQ ID NO: 1162697 - RNA, 18 nt, Mycobacterium bovis subsp bovis AF2122/97
gccgccgagcuggcgcgc

SEQ ID NO: 1162698 - RNA, 14 nt, Mycobacterium bovis subsp bovis AF2122/97
gccgccgaucugcu

SEQ ID NO: 1162699 - RNA, 18 nt, Mycobacterium bovis subsp bovis AF2122/97
gccgccgauaccgccggc

SEQ ID NO: 1162700 - RNA, 19 nt, Mycobacterium bovis subsp bovis AF2122/97
gccgccgauaccgccggcc

SEQ ID NO: 1162701 - RNA, 19 nt, Mycobacterium bovis subsp bovis AF2122/97
gccgcccuugccgccggcc

SEQ ID NO: 1162702 - RNA, 12 nt, Mycobacterium bovis subsp bovis AF2122/97
gccgcacacucu

SEQ ID NO: 1162703 - RNA, 16 nt, Mycobacterium bovis subsp bovis AF2122/97
gccgcccuugccgccg

SEQ ID NO: 1162704 - RNA, 16 nt, Mycobacterium bovis subsp bovis AF2122/97
gccgcacaucugcggg

SEQ ID NO: 1162705 - RNA, 21 nt, Mycobacterium bovis subsp bovis AF2122/97
gccgcccuugauguccgcgac

SEQ ID NO: 1162706 - RNA, 12 nt, Mycobacterium bovis subsp bovis AF2122/97
gccgcccuugcc

SEQ ID NO: 1162707 - RNA, 15 nt, Mycobacterium bovis subsp bovis AF2122/97
gccgccgaacagcug

SEQ ID NO: 1162708 - RNA, 17 nt, Mycobacterium bovis subsp bovis AF2122/97
gccgccgaaacucacca

SEQ ID NO: 1162709 - RNA, 18 nt, Mycobacterium bovis subsp bovis AF2122/97
gccgccgaaacucaccag

SEQ ID NO: 1162710 - RNA, 19 nt, Mycobacterium bovis subsp bovis AF2122/97
gccgccgaaacucaccagc

SEQ ID NO: 1162711 - RNA, 22 nt, Mycobacterium bovis subsp bovis AF2122/97
gccgccgaaacucaccagcacc

SEQ ID NO: 1162712 - RNA, 15 nt, Mycobacterium bovis subsp bovis AF2122/97
gccgcacaaacgggc

SEQ ID NO: 1162713 - RNA, 22 nt, Mycobacterium bovis subsp bovis AF2122/97
gccgcacaaacgggcgugggcc

SEQ ID NO: 1162714 - RNA, 12 nt, Mycobacterium bovis subsp bovis AF2122/97
gccgcggccacc

SEQ ID NO: 1162715 - RNA, 23 nt, Mycobacterium bovis subsp bovis AF2122/97
gccgcggcccacucucgccacgc

SEQ ID NO: 1162716 - RNA, 13 nt, Mycobacterium bovis subsp bovis AF2122/97
gccgcggccgccg

SEQ ID NO: 1162717 - RNA, 18 nt, Mycobacterium bovis subsp bovis AF2122/97
gccgcggccggcgcucgc

SEQ ID NO: 1162718 - RNA, 11 nt, Mycobacterium bovis subsp bovis AF2122/97
gccgcggcgga

SEQ ID NO: 1162719 - RNA, 18 nt, Mycobacterium bovis subsp bovis AF2122/97
gccgcguagguggccagc

SEQ ID NO: 1162720 - RNA, 15 nt, Mycobacterium bovis subsp bovis AF2122/97
gccgcggcggccagc

SEQ ID NO: 1162721 - RNA, 12 nt, Mycobacterium bovis subsp bovis AF2122/97
gccgcggcggca

SEQ ID NO: 1162722 - RNA, 16 nt, Mycobacterium bovis subsp bovis AF2122/97
gccgcggcgcccggcg

SEQ ID NO: 1162723 - RNA, 12 nt, Mycobacterium bovis subsp bovis AF2122/97
gccgcggcgcca

SEQ ID NO: 1162724 - RNA, 19 nt, Mycobacterium bovis subsp bovis AF2122/97
gccgcggaggcggccagcc

SEQ ID NO: 1162725 - RNA, 20 nt, Mycobacterium bovis subsp bovis AF2122/97
gccgcggagaaggcgcgggc

SEQ ID NO: 1162726 - RNA, 19 nt, Mycobacterium bovis subsp bovis AF2122/97
gccgcgcuugcgaucgccg

SEQ ID NO: 1162727 - RNA, 15 nt, Mycobacterium bovis subsp bovis AF2122/97
gccgcgcuugcgauc

SEQ ID NO: 1162728 - RNA, 22 nt, Mycobacterium bovis subsp bovis AF2122/97
gccgcgugacguaccacggcga

SEQ ID NO: 1162729 - RNA, 21 nt, Mycobacterium bovis subsp bovis AF2122/97
gccgcgucuuggugcgcguca

SEQ ID NO: 1162730 - RNA, 21 nt, Mycobacterium bovis subsp bovis AF2122/97
gccgcgucucggugcagcagc

SEQ ID NO: 1162731 - RNA, 23 nt, Mycobacterium bovis subsp bovis AF2122/97
gccgcgucgaacugggcgcccgc

SEQ ID NO: 1162732 - RNA, 13 nt, Mycobacterium bovis subsp bovis AF2122/97
gccgcucaccccg

SEQ ID NO: 1162733 - RNA, 14 nt, Mycobacterium bovis subsp bovis AF2122/97
gccgcguggcuggc

SEQ ID NO: 1162734 - RNA, 16 nt, Mycobacterium bovis subsp bovis AF2122/97
gccgcgugccgcccgc

SEQ ID NO: 1162735 - RNA, 15 nt, Mycobacterium bovis subsp bovis AF2122/97
gccgcugcauccgca

SEQ ID NO: 1162736 - RNA, 22 nt, Mycobacterium bovis subsp bovis AF2122/97
gccgcugcauacaaccccgcgc

SEQ ID NO: 1162737 - RNA, 18 nt, Mycobacterium bovis subsp bovis AF2122/97
gccgcugccaugcgggug

SEQ ID NO: 1162738 - RNA, 21 nt, Mycobacterium bovis subsp bovis AF2122/97
gccgcugccgcccuugccgcc

SEQ ID NO: 1162739 - RNA, 19 nt, Mycobacterium bovis subsp bovis AF2122/97
gccgcugccgguggcggcg

SEQ ID NO: 1162740 - RNA, 20 nt, Mycobacterium bovis subsp bovis AF2122/97
gccgcugccgguggcggcgg

SEQ ID NO: 1162741 - RNA, 13 nt, Mycobacterium bovis subsp bovis AF2122/97
gccgcugccuugg

SEQ ID NO: 1162742 - RNA, 13 nt, Mycobacterium bovis subsp bovis AF2122/97
gccgcuccaugac

SEQ ID NO: 1162743 - RNA, 23 nt, Mycobacterium bovis subsp bovis AF2122/97
gccgcuccacguacgcggcugcg

SEQ ID NO: 1162744 - RNA, 14 nt, Mycobacterium bovis subsp bovis AF2122/97
gccgcucauccagc

SEQ ID NO: 1162745 - RNA, 18 nt, Mycobacterium bovis subsp bovis AF2122/97
gccgcucaucgaucccgu

SEQ ID NO: 1162746 - RNA, 21 nt, Mycobacterium bovis subsp bovis AF2122/97
gccgcuccacguacgcggcug

SEQ ID NO: 1162747 - RNA, 16 nt, Mycobacterium bovis subsp bovis AF2122/97
gccgcugcgccgucgc

SEQ ID NO: 1162748 - RNA, 20 nt, Mycobacterium bovis subsp bovis AF2122/97
gccgcugccuuggcgcggca

SEQ ID NO: 1162749 - RNA, 17 nt, Mycobacterium bovis subsp bovis AF2122/97
gccgcugcgccagguca

SEQ ID NO: 1162750 - RNA, 18 nt, Mycobacterium bovis subsp bovis AF2122/97
gccgcuguugaucgacac

SEQ ID NO: 1162751 - RNA, 21 nt, Mycobacterium bovis subsp bovis AF2122/97
gccgcuucggcggucagcggc

SEQ ID NO: 1162752 - RNA, 15 nt, Mycobacterium bovis subsp bovis AF2122/97
gccggacaaccuggg

SEQ ID NO: 1162753 - RNA, 19 nt, Mycobacterium bovis subsp bovis AF2122/97
gccggacaaccuggggcca

SEQ ID NO: 1162754 - RNA, 17 nt, Mycobacterium bovis subsp bovis AF2122/97
gccggacuaccgccggc

SEQ ID NO: 1162755 - RNA, 18 nt, Mycobacterium bovis subsp bovis AF2122/97
gccggacuaccgccggcg

SEQ ID NO: 1162756 - RNA, 14 nt, Mycobacterium bovis subsp bovis AF2122/97
gccggacugccgca

SEQ ID NO: 1162757 - RNA, 17 nt, Mycobacterium bovis subsp bovis AF2122/97
gccggacugccgcagga

SEQ ID NO: 1162758 - RNA, 14 nt, Mycobacterium bovis subsp bovis AF2122/97
gccggacugcggcc

SEQ ID NO: 1162759 - RNA, 21 nt, Mycobacterium bovis subsp bovis AF2122/97
gccgcuuggccgcugccuucu

SEQ ID NO: 1162760 - RNA, 20 nt, Mycobacterium bovis subsp bovis AF2122/97
gccggaacgagcggccgcgc

SEQ ID NO: 1162761 - RNA, 14 nt, Mycobacterium bovis subsp bovis AF2122/97
gccggaacugcgca

SEQ ID NO: 1162762 - RNA, 16 nt, Mycobacterium bovis subsp bovis AF2122/97
gccggaauacccgcug

SEQ ID NO: 1162763 - RNA, 21 nt, Mycobacterium bovis subsp bovis AF2122/97
gccggaauacccggcccauug

SEQ ID NO: 1162764 - RNA, 13 nt, Mycobacterium bovis subsp bovis AF2122/97
gccggcaccguga

SEQ ID NO: 1162765 - RNA, 20 nt, Mycobacterium bovis subsp bovis AF2122/97
gccggcacgggcggggacgg

SEQ ID NO: 1162766 - RNA, 12 nt, Mycobacterium bovis subsp bovis AF2122/97
gccggcagcagc

SEQ ID NO: 1162767 - RNA, 21 nt, Mycobacterium bovis subsp bovis AF2122/97
gccggcagcaucggcaccccg

SEQ ID NO: 1162768 - RNA, 14 nt, Mycobacterium bovis subsp bovis AF2122/97
gccggcagcgcccc

SEQ ID NO: 1162769 - RNA, 15 nt, Mycobacterium bovis subsp bovis AF2122/97
gccggcaccgccggc

SEQ ID NO: 1162770 - RNA, 14 nt, Mycobacterium bovis subsp bovis AF2122/97
gccggcaccggaug

SEQ ID NO: 1162771 - RNA, 15 nt, Mycobacterium bovis subsp bovis AF2122/97
gccggcaccgcagcg

SEQ ID NO: 1162772 - RNA, 21 nt, Mycobacterium bovis subsp bovis AF2122/97
gccggcaccgccagugcccgc

SEQ ID NO: 1162773 - RNA, 17 nt, Mycobacterium bovis subsp bovis AF2122/97
gccggcaccgccgcccc

SEQ ID NO: 1162774 - RNA, 20 nt, Mycobacterium bovis subsp bovis AF2122/97
gccggcaccgccgcccccgc

SEQ ID NO: 1162775 - RNA, 17 nt, Mycobacterium bovis subsp bovis AF2122/97
gccggauucgcccgggc

SEQ ID NO: 1162776 - RNA, 23 nt, Mycobacterium bovis subsp bovis AF2122/97
gccggauucgcccgggcguuggg

SEQ ID NO: 1162777 - RNA, 16 nt, Mycobacterium bovis subsp bovis AF2122/97
gccggauucggcugcc

SEQ ID NO: 1162778 - RNA, 20 nt, Mycobacterium bovis subsp bovis AF2122/97
gccggcacccgucgggugcu

SEQ ID NO: 1162779 - RNA, 21 nt, Mycobacterium bovis subsp bovis AF2122/97
gccggaugucgacgagcaccg

SEQ ID NO: 1162780 - RNA, 21 nt, Mycobacterium bovis subsp bovis AF2122/97
gccggagccgccggccccgcc

SEQ ID NO: 1162781 - RNA, 15 nt, Mycobacterium bovis subsp bovis AF2122/97
gccggaugcgcuucc

SEQ ID NO: 1162782 - RNA, 18 nt, Mycobacterium bovis subsp bovis AF2122/97
gccggauggucggccacg

SEQ ID NO: 1162783 - RNA, 17 nt, Mycobacterium bovis subsp bovis AF2122/97
gccggagaucuugcgca

SEQ ID NO: 1162784 - RNA, 14 nt, Mycobacterium bovis subsp bovis AF2122/97
gccggagaguagga

SEQ ID NO: 1162785 - RNA, 14 nt, Mycobacterium bovis subsp bovis AF2122/97
gccggagacacccg

SEQ ID NO: 1162786 - RNA, 17 nt, Mycobacterium bovis subsp bovis AF2122/97
gccgguccccucggugc

SEQ ID NO: 1162787 - RNA, 13 nt, Mycobacterium bovis subsp bovis AF2122/97
gccgguccccgcc

SEQ ID NO: 1162788 - RNA, 16 nt, Mycobacterium bovis subsp bovis AF2122/97
gccgguccccgccggc

SEQ ID NO: 1162789 - RNA, 17 nt, Mycobacterium bovis subsp bovis AF2122/97
gccgguccccgccggcg

SEQ ID NO: 1162790 - RNA, 17 nt, Mycobacterium bovis subsp bovis AF2122/97
gccgguccucgucggcg

SEQ ID NO: 1162791 - RNA, 18 nt, Mycobacterium bovis subsp bovis AF2122/97
gccggucaguauggcgac

SEQ ID NO: 1162792 - RNA, 13 nt, Mycobacterium bovis subsp bovis AF2122/97
gccgguccagcag

SEQ ID NO: 1162793 - RNA, 14 nt, Mycobacterium bovis subsp bovis AF2122/97
gccgguccagaccc

SEQ ID NO: 1162794 - RNA, 19 nt, Mycobacterium bovis subsp bovis AF2122/97
gccggucaccucgccggcg

SEQ ID NO: 1162795 - RNA, 14 nt, Mycobacterium bovis subsp bovis AF2122/97
gccggucaggccgc

SEQ ID NO: 1162796 - RNA, 15 nt, Mycobacterium bovis subsp bovis AF2122/97
gccggucaggccgcc

SEQ ID NO: 1162797 - RNA, 16 nt, Mycobacterium bovis subsp bovis AF2122/97
gccggucaggccgccg

SEQ ID NO: 1162798 - RNA, 22 nt, Mycobacterium bovis subsp bovis AF2122/97
gccggucagcaauacggcggcg

SEQ ID NO: 1162799 - RNA, 13 nt, Mycobacterium bovis subsp bovis AF2122/97
gccgggcguccgc

SEQ ID NO: 1162800 - RNA, 17 nt, Mycobacterium bovis subsp bovis AF2122/97
gccgggaccgccccggc

SEQ ID NO: 1162801 - RNA, 18 nt, Mycobacterium bovis subsp bovis AF2122/97
gccgguaggcggccagcg

SEQ ID NO: 1162802 - RNA, 17 nt, Mycobacterium bovis subsp bovis AF2122/97
gccgguaggcggccagc

SEQ ID NO: 1162803 - RNA, 15 nt, Mycobacterium bovis subsp bovis AF2122/97
gccgguagcacagca

SEQ ID NO: 1162804 - RNA, 17 nt, Mycobacterium bovis subsp bovis AF2122/97
gccgguagcacagcagc

SEQ ID NO: 1162805 - RNA, 17 nt, Mycobacterium bovis subsp bovis AF2122/97
gccgguaccgggacgaa

SEQ ID NO: 1162806 - RNA, 15 nt, Mycobacterium bovis subsp bovis AF2122/97
gccggucgaggugac

SEQ ID NO: 1162807 - RNA, 14 nt, Mycobacterium bovis subsp bovis AF2122/97
gccggucgagacgc

SEQ ID NO: 1162808 - RNA, 14 nt, Mycobacterium bovis subsp bovis AF2122/97
gccggucgcauggu

SEQ ID NO: 1162809 - RNA, 17 nt, Mycobacterium bovis subsp bovis AF2122/97
gccggucgcauggucga

SEQ ID NO: 1162810 - RNA, 13 nt, Mycobacterium bovis subsp bovis AF2122/97
gccggucgggcag

SEQ ID NO: 1162811 - RNA, 14 nt, Mycobacterium bovis subsp bovis AF2122/97
gccggucgggcaga

SEQ ID NO: 1162812 - RNA, 19 nt, Mycobacterium bovis subsp bovis AF2122/97
gccggucggugagccgugc

SEQ ID NO: 1162813 - RNA, 12 nt, Mycobacterium bovis subsp bovis AF2122/97
gccggucgccga

SEQ ID NO: 1162814 - RNA, 16 nt, Mycobacterium bovis subsp bovis AF2122/97
gccggugaccgcgaug

SEQ ID NO: 1162815 - RNA, 14 nt, Mycobacterium bovis subsp bovis AF2122/97
gccggugagcgagc

SEQ ID NO: 1162816 - RNA, 16 nt, Mycobacterium bovis subsp bovis AF2122/97
gccggugagcgagcgc

SEQ ID NO: 1162817 - RNA, 14 nt, Mycobacterium bovis subsp bovis AF2122/97
gccggugacucaga

SEQ ID NO: 1162818 - RNA, 17 nt, Mycobacterium bovis subsp bovis AF2122/97
gccggugaucggcggca

SEQ ID NO: 1162819 - RNA, 15 nt, Mycobacterium bovis subsp bovis AF2122/97
gccggugacgacguc

SEQ ID NO: 1162820 - RNA, 18 nt, Mycobacterium bovis subsp bovis AF2122/97
gccggugauguccgcaca

SEQ ID NO: 1162821 - RNA, 21 nt, Mycobacterium bovis subsp bovis AF2122/97
gccggugccgccaucgccgcc

SEQ ID NO: 1162822 - RNA, 15 nt, Mycobacterium bovis subsp bovis AF2122/97
gccggugccgccauc

SEQ ID NO: 1162823 - RNA, 14 nt, Mycobacterium bovis subsp bovis AF2122/97
gccggugccgccgc

SEQ ID NO: 1162824 - RNA, 23 nt, Mycobacterium bovis subsp bovis AF2122/97
gccggugccgccgccugcuccuc

SEQ ID NO: 1162825 - RNA, 16 nt, Mycobacterium bovis subsp bovis AF2122/97
gccggugccgccgcgg

SEQ ID NO: 1162826 - RNA, 18 nt, Mycobacterium bovis subsp bovis AF2122/97
gccggugcccgggcguca

SEQ ID NO: 1162827 - RNA, 12 nt, Mycobacterium bovis subsp bovis AF2122/97
gccggugccacc

SEQ ID NO: 1162828 - RNA, 13 nt, Mycobacterium bovis subsp bovis AF2122/97
gccggugccaccg

SEQ ID NO: 1162829 - RNA, 16 nt, Mycobacterium bovis subsp bovis AF2122/97
gccggugcgcaccagc

SEQ ID NO: 1162830 - RNA, 18 nt, Mycobacterium bovis subsp bovis AF2122/97
gccggugccgccuccgcc

SEQ ID NO: 1162831 - RNA, 15 nt, Mycobacterium bovis subsp bovis AF2122/97
gccggugcgguggug

SEQ ID NO: 1162832 - RNA, 14 nt, Mycobacterium bovis subsp bovis AF2122/97
gccggugcgcugga

SEQ ID NO: 1162833 - RNA, 23 nt, Mycobacterium bovis subsp bovis AF2122/97
gccgguggcacccgcgucgagug

SEQ ID NO: 1162834 - RNA, 20 nt, Mycobacterium bovis subsp bovis AF2122/97
gccggccaccaccgcgccgu

SEQ ID NO: 1162835 - RNA, 20 nt, Mycobacterium bovis subsp bovis AF2122/97
gccggccaauggccugcagc

SEQ ID NO: 1162836 - RNA, 17 nt, Mycobacterium bovis subsp bovis AF2122/97
gccggccaccagccggu

SEQ ID NO: 1162837 - RNA, 13 nt, Mycobacterium bovis subsp bovis AF2122/97
gccggccagcggc

SEQ ID NO: 1162838 - RNA, 16 nt, Mycobacterium bovis subsp bovis AF2122/97
gccggcgccgccggcg

SEQ ID NO: 1162839 - RNA, 14 nt, Mycobacterium bovis subsp bovis AF2122/97
gccggcgccgcccu

SEQ ID NO: 1162840 - RNA, 14 nt, Mycobacterium bovis subsp bovis AF2122/97
gccggcgccgccgu

SEQ ID NO: 1162841 - RNA, 16 nt, Mycobacterium bovis subsp bovis AF2122/97
gccggcgccgccgucg

SEQ ID NO: 1162842 - RNA, 17 nt, Mycobacterium bovis subsp bovis AF2122/97
gccggcgccgccgugcg

SEQ ID NO: 1162843 - RNA, 17 nt, Mycobacterium bovis subsp bovis AF2122/97
gccggcgccggcgcguc

SEQ ID NO: 1162844 - RNA, 20 nt, Mycobacterium bovis subsp bovis AF2122/97
gccggcgccuuggucgccgc

SEQ ID NO: 1162845 - RNA, 18 nt, Mycobacterium bovis subsp bovis AF2122/97
gccggcgcgcaccccggc

SEQ ID NO: 1162846 - RNA, 12 nt, Mycobacterium bovis subsp bovis AF2122/97
gccggcgcgccg

SEQ ID NO: 1162847 - RNA, 18 nt, Mycobacterium bovis subsp bovis AF2122/97
gccggcggccgcccagau

SEQ ID NO: 1162848 - RNA, 13 nt, Mycobacterium bovis subsp bovis AF2122/97
gccggcggcggcc

SEQ ID NO: 1162849 - RNA, 21 nt, Mycobacterium bovis subsp bovis AF2122/97
gccggcggcggccgcagcggc

SEQ ID NO: 1162850 - RNA, 23 nt, Mycobacterium bovis subsp bovis AF2122/97
gccggcggcucgggugcgcccgg

SEQ ID NO: 1162851 - RNA, 20 nt, Mycobacterium bovis subsp bovis AF2122/97
gccggcggcggcgcucggcc

SEQ ID NO: 1162852 - RNA, 14 nt, Mycobacterium bovis subsp bovis AF2122/97
gccggcggcggugc

SEQ ID NO: 1162853 - RNA, 19 nt, Mycobacterium bovis subsp bovis AF2122/97
gccggcgugcacucccuua

SEQ ID NO: 1162854 - RNA, 16 nt, Mycobacterium bovis subsp bovis AF2122/97
gccggcgucggcgccc

SEQ ID NO: 1162855 - RNA, 16 nt, Mycobacterium bovis subsp bovis AF2122/97
gccggcgugcgcgaga

SEQ ID NO: 1162856 - RNA, 16 nt, Mycobacterium bovis subsp bovis AF2122/97
gccggcguugccgccg

SEQ ID NO: 1162857 - RNA, 18 nt, Mycobacterium bovis subsp bovis AF2122/97
gccggcuaccgcgcuccc

SEQ ID NO: 1162858 - RNA, 22 nt, Mycobacterium bovis subsp bovis AF2122/97
gccggcuagggcccuggcggcc

SEQ ID NO: 1162859 - RNA, 23 nt, Mycobacterium bovis subsp bovis AF2122/97
gccggcuagggcccuggcggccc

SEQ ID NO: 1162860 - RNA, 21 nt, Mycobacterium bovis subsp bovis AF2122/97
gccggcgguagucggccagcu

SEQ ID NO: 1162861 - RNA, 16 nt, Mycobacterium bovis subsp bovis AF2122/97
gccggcgggcucgccc

SEQ ID NO: 1162862 - RNA, 16 nt, Mycobacterium bovis subsp bovis AF2122/97
gccggcgggccugccc

SEQ ID NO: 1162863 - RNA, 23 nt, Mycobacterium bovis subsp bovis AF2122/97
gccggcgggcgagugucagcaga

SEQ ID NO: 1162864 - RNA, 22 nt, Mycobacterium bovis subsp bovis AF2122/97
gccggcggcggugguaccggcg

SEQ ID NO: 1162865 - RNA, 14 nt, Mycobacterium bovis subsp bovis AF2122/97
gccggcggucgggc

SEQ ID NO: 1162866 - RNA, 17 nt, Mycobacterium bovis subsp bovis AF2122/97
gccggcggucgggcccg

SEQ ID NO: 1162867 - RNA, 21 nt, Mycobacterium bovis subsp bovis AF2122/97
gccggcgucagccccgacugc

SEQ ID NO: 1162868 - RNA, 23 nt, Mycobacterium bovis subsp bovis AF2122/97
gccggcguacuucgacagcggcg

SEQ ID NO: 1162869 - RNA, 21 nt, Mycobacterium bovis subsp bovis AF2122/97
gccgggcgccgugccccgggc

SEQ ID NO: 1162870 - RNA, 15 nt, Mycobacterium bovis subsp bovis AF2122/97
gccgggcgcgccggc

SEQ ID NO: 1162871 - RNA, 19 nt, Mycobacterium bovis subsp bovis AF2122/97
gccgggaucgccguccagc

SEQ ID NO: 1162872 - RNA, 22 nt, Mycobacterium bovis subsp bovis AF2122/97
gccgggauaacccagcaccaca

SEQ ID NO: 1162873 - RNA, 15 nt, Mycobacterium bovis subsp bovis AF2122/97
gccggcuuugagccg

SEQ ID NO: 1162874 - RNA, 20 nt, Mycobacterium bovis subsp bovis AF2122/97
gccgggaaacaccggcuugg

SEQ ID NO: 1162875 - RNA, 12 nt, Mycobacterium bovis subsp bovis AF2122/97
gccgggaagccg

SEQ ID NO: 1162876 - RNA, 17 nt, Mycobacterium bovis subsp bovis AF2122/97
gccgucggcgacuccuc

SEQ ID NO: 1162877 - RNA, 22 nt, Mycobacterium bovis subsp bovis AF2122/97
gccgucggcgagcagacgccgc

SEQ ID NO: 1162878 - RNA, 16 nt, Mycobacterium bovis subsp bovis AF2122/97
gccgucggcgaugaag

SEQ ID NO: 1162879 - RNA, 17 nt, Mycobacterium bovis subsp bovis AF2122/97
gccgucgccguuggguu

SEQ ID NO: 1162880 - RNA, 15 nt, Mycobacterium bovis subsp bovis AF2122/97
gccgucgccaccauc

SEQ ID NO: 1162881 - RNA, 16 nt, Mycobacterium bovis subsp bovis AF2122/97
gccgucgccaccggua

SEQ ID NO: 1162882 - RNA, 14 nt, Mycobacterium bovis subsp bovis AF2122/97
gccgucgcccagcg

SEQ ID NO: 1162883 - RNA, 14 nt, Mycobacterium bovis subsp bovis AF2122/97
gccgucgcaccaga

SEQ ID NO: 1162884 - RNA, 18 nt, Mycobacterium bovis subsp bovis AF2122/97
gccgucgaugaccagcac

SEQ ID NO: 1162885 - RNA, 19 nt, Mycobacterium bovis subsp bovis AF2122/97
gccgucgacgucgauggug

SEQ ID NO: 1162886 - RNA, 16 nt, Mycobacterium bovis subsp bovis AF2122/97
gccgucgacgcauggg

SEQ ID NO: 1162887 - RNA, 18 nt, Mycobacterium bovis subsp bovis AF2122/97
gccgucgacgcggccggc

SEQ ID NO: 1162888 - RNA, 17 nt, Mycobacterium bovis subsp bovis AF2122/97
gccgucgacgcgguccu

SEQ ID NO: 1162889 - RNA, 15 nt, Mycobacterium bovis subsp bovis AF2122/97
gccgucgacgcaugg

SEQ ID NO: 1162890 - RNA, 18 nt, Mycobacterium bovis subsp bovis AF2122/97
gccgucgagcagccgagc

SEQ ID NO: 1162891 - RNA, 20 nt, Mycobacterium bovis subsp bovis AF2122/97
gccguccgguggaccgccga

SEQ ID NO: 1162892 - RNA, 14 nt, Mycobacterium bovis subsp bovis AF2122/97
gccguccucccaca

SEQ ID NO: 1162893 - RNA, 16 nt, Mycobacterium bovis subsp bovis AF2122/97
gccguccggcgcccac

SEQ ID NO: 1162894 - RNA, 16 nt, Mycobacterium bovis subsp bovis AF2122/97
gccguccgggcggccu

SEQ ID NO: 1162895 - RNA, 17 nt, Mycobacterium bovis subsp bovis AF2122/97
gccguccucccacaggu

SEQ ID NO: 1162896 - RNA, 21 nt, Mycobacterium bovis subsp bovis AF2122/97
gccgucccgaaacgccggguu

SEQ ID NO: 1162897 - RNA, 15 nt, Mycobacterium bovis subsp bovis AF2122/97
gccgucccgcgagca

SEQ ID NO: 1162898 - RNA, 22 nt, Mycobacterium bovis subsp bovis AF2122/97
gccgucccgcgagcagcccggc

SEQ ID NO: 1162899 - RNA, 21 nt, Mycobacterium bovis subsp bovis AF2122/97
gccguccccgccgucgccacc

SEQ ID NO: 1162900 - RNA, 19 nt, Mycobacterium bovis subsp bovis AF2122/97
gccgugaguucacguucgg

SEQ ID NO: 1162901 - RNA, 22 nt, Mycobacterium bovis subsp bovis AF2122/97
gccgugcugaacuccgccgcga

SEQ ID NO: 1162902 - RNA, 21 nt, Mycobacterium bovis subsp bovis AF2122/97
gccgucugacagcauccuucg

SEQ ID NO: 1162903 - RNA, 18 nt, Mycobacterium bovis subsp bovis AF2122/97
gccgucuucgccgccacc

SEQ ID NO: 1162904 - RNA, 21 nt, Mycobacterium bovis subsp bovis AF2122/97
gccgucuucgccgccaccggc

SEQ ID NO: 1162905 - RNA, 14 nt, Mycobacterium bovis subsp bovis AF2122/97
gccgugaccaggug

SEQ ID NO: 1162906 - RNA, 17 nt, Mycobacterium bovis subsp bovis AF2122/97
gccgugaccaggugcca

SEQ ID NO: 1162907 - RNA, 16 nt, Mycobacterium bovis subsp bovis AF2122/97
gccgugacccucagca

SEQ ID NO: 1162908 - RNA, 23 nt, Mycobacterium bovis subsp bovis AF2122/97
gccgugacgauucgagcaacugc

SEQ ID NO: 1162909 - RNA, 20 nt, Mycobacterium bovis subsp bovis AF2122/97
gccguggcaucgccuccagg

SEQ ID NO: 1162910 - RNA, 14 nt, Mycobacterium bovis subsp bovis AF2122/97
gccguggcccgcuc

SEQ ID NO: 1162911 - RNA, 16 nt, Mycobacterium bovis subsp bovis AF2122/97
gccguggccgcacugc

SEQ ID NO: 1162912 - RNA, 18 nt, Mycobacterium bovis subsp bovis AF2122/97
gccgugcugcccaucccg

SEQ ID NO: 1162913 - RNA, 18 nt, Mycobacterium bovis subsp bovis AF2122/97
gccguggauacgcacggc

SEQ ID NO: 1162914 - RNA, 16 nt, Mycobacterium bovis subsp bovis AF2122/97
gccguucacccuggug

SEQ ID NO: 1162915 - RNA, 14 nt, Mycobacterium bovis subsp bovis AF2122/97
gccguggcacccgc

SEQ ID NO: 1162916 - RNA, 15 nt, Mycobacterium bovis subsp bovis AF2122/97
gccguucccgccggc

SEQ ID NO: 1162917 - RNA, 16 nt, Mycobacterium bovis subsp bovis AF2122/97
gccgguucgcccagca

SEQ ID NO: 1162918 - RNA, 16 nt, Mycobacterium bovis subsp bovis AF2122/97
gccgguucgcccgagg

SEQ ID NO: 1162919 - RNA, 17 nt, Mycobacterium bovis subsp bovis AF2122/97
gccgguucccuuguucc

SEQ ID NO: 1162920 - RNA, 15 nt, Mycobacterium bovis subsp bovis AF2122/97
gccgguuccgccggc

SEQ ID NO: 1162921 - RNA, 18 nt, Mycobacterium bovis subsp bovis AF2122/97
gccgguuccgccggcccc

SEQ ID NO: 1162922 - RNA, 22 nt, Mycobacterium bovis subsp bovis AF2122/97
gccgguguuuccgaaacccgcc

SEQ ID NO: 1162923 - RNA, 19 nt, Mycobacterium bovis subsp bovis AF2122/97
gccggugugcccgccugga

SEQ ID NO: 1162924 - RNA, 21 nt, Mycobacterium bovis subsp bovis AF2122/97
gccgguguuagugaggcccga

SEQ ID NO: 1162925 - RNA, 13 nt, Mycobacterium bovis subsp bovis AF2122/97
gccgguggcggcg

SEQ ID NO: 1162926 - RNA, 16 nt, Mycobacterium bovis subsp bovis AF2122/97
gccgguggcggcggcg

SEQ ID NO: 1162927 - RNA, 14 nt, Mycobacterium bovis subsp bovis AF2122/97
gccgguggcguggg

SEQ ID NO: 1162928 - RNA, 21 nt, Mycobacterium bovis subsp bovis AF2122/97
gccggugucucccuugccgcc

SEQ ID NO: 1162929 - RNA, 20 nt, Mycobacterium bovis subsp bovis AF2122/97
gccgguggugccggcgccgc

SEQ ID NO: 1162930 - RNA, 16 nt, Mycobacterium bovis subsp bovis AF2122/97
gccggugguaccggcg

SEQ ID NO: 1162931 - RNA, 16 nt, Mycobacterium bovis subsp bovis AF2122/97
gccgguugcggcugcg

SEQ ID NO: 1162932 - RNA, 17 nt, Mycobacterium bovis subsp bovis AF2122/97
gccgguuggccagccac

SEQ ID NO: 1162933 - RNA, 14 nt, Mycobacterium bovis subsp bovis AF2122/97
gccgguuggccagu

SEQ ID NO: 1162934 - RNA, 19 nt, Mycobacterium bovis subsp bovis AF2122/97
gccgguuggccagugacuc

SEQ ID NO: 1162935 - RNA, 16 nt, Mycobacterium bovis subsp bovis AF2122/97
gccgguugucgcagcg

SEQ ID NO: 1162936 - RNA, 18 nt, Mycobacterium bovis subsp bovis AF2122/97
gccgguuugggggcuucu

SEQ ID NO: 1162937 - RNA, 23 nt, Mycobacterium bovis subsp bovis AF2122/97
gccguacaaccacccacccgcac

SEQ ID NO: 1162938 - RNA, 21 nt, Mycobacterium bovis subsp bovis AF2122/97
gccguacagcgcaaagcccuc

SEQ ID NO: 1162939 - RNA, 15 nt, Mycobacterium bovis subsp bovis AF2122/97
gccguaacagccggc

SEQ ID NO: 1162940 - RNA, 16 nt, Mycobacterium bovis subsp bovis AF2122/97
gccguacguucaccac

SEQ ID NO: 1162941 - RNA, 15 nt, Mycobacterium bovis subsp bovis AF2122/97
gccguagaccagcag

SEQ ID NO: 1162942 - RNA, 21 nt, Mycobacterium bovis subsp bovis AF2122/97
gccguagccgaucaacagggc

SEQ ID NO: 1162943 - RNA, 16 nt, Mycobacterium bovis subsp bovis AF2122/97
gccgucaacgauggug

SEQ ID NO: 1162944 - RNA, 20 nt, Mycobacterium bovis subsp bovis AF2122/97
gccguaugccgccaaccgcg

SEQ ID NO: 1162945 - RNA, 17 nt, Mycobacterium bovis subsp bovis AF2122/97
gccgucauagcaggccu

SEQ ID NO: 1162946 - RNA, 20 nt, Mycobacterium bovis subsp bovis AF2122/97
gccgucagcacaaacccagu

SEQ ID NO: 1162947 - RNA, 18 nt, Mycobacterium bovis subsp bovis AF2122/97
gccgucaccgcccuugcc

SEQ ID NO: 1162948 - RNA, 15 nt, Mycobacterium bovis subsp bovis AF2122/97
gccgucagcaccgcu

SEQ ID NO: 1162949 - RNA, 14 nt, Mycobacterium bovis subsp bovis AF2122/97
gccguccagcaaua

SEQ ID NO: 1162950 - RNA, 18 nt, Mycobacterium bovis subsp bovis AF2122/97
gaguccacaaguaccgca

SEQ ID NO: 1162951 - RNA, 13 nt, Mycobacterium bovis subsp bovis AF2122/97
gagucgcccgcac

SEQ ID NO: 1162952 - RNA, 15 nt, Mycobacterium bovis subsp bovis AF2122/97
gagucgcccgcacac

SEQ ID NO: 1162953 - RNA, 23 nt, Mycobacterium bovis subsp bovis AF2122/97
gagucgugccgccgcaugguggg

SEQ ID NO: 1162954 - RNA, 15 nt, Mycobacterium bovis subsp bovis AF2122/97
gagucgggggccgcg

SEQ ID NO: 1162955 - RNA, 22 nt, Mycobacterium bovis subsp bovis AF2122/97
gagucgguucagccacgcagca

SEQ ID NO: 1162956 - RNA, 16 nt, Mycobacterium bovis subsp bovis AF2122/97
gagugccggcgugcgc

SEQ ID NO: 1162957 - RNA, 19 nt, Mycobacterium bovis subsp bovis AF2122/97
gagugcggacuucgccgcc

SEQ ID NO: 1162958 - RNA, 22 nt, Mycobacterium bovis subsp bovis AF2122/97
gagugcggacuucgccgcccgc

SEQ ID NO: 1162959 - RNA, 13 nt, Mycobacterium bovis subsp bovis AF2122/97
gagugccaguccg

SEQ ID NO: 1162960 - RNA, 15 nt, Mycobacterium bovis subsp bovis AF2122/97
gagucucgucgggua

SEQ ID NO: 1162961 - RNA, 22 nt, Mycobacterium bovis subsp bovis AF2122/97
gagucucgucggguaccacgcu

SEQ ID NO: 1162962 - RNA, 20 nt, Mycobacterium bovis subsp bovis AF2122/97
gaguauuggucgguggggua

SEQ ID NO: 1162963 - RNA, 22 nt, Mycobacterium bovis subsp bovis AF2122/97
gaauuuggugaagccguagacg

SEQ ID NO: 1162964 - RNA, 16 nt, Mycobacterium bovis subsp bovis AF2122/97
gaauuuggugaaguga

SEQ ID NO: 1162965 - RNA, 22 nt, Mycobacterium bovis subsp bovis AF2122/97
gaguucgguugcccccagggcc

SEQ ID NO: 1162966 - RNA, 17 nt, Mycobacterium bovis subsp bovis AF2122/97
gaguucggccaccaacc

SEQ ID NO: 1162967 - RNA, 14 nt, Mycobacterium bovis subsp bovis AF2122/97
gaguucggccgcgg

SEQ ID NO: 1162968 - RNA, 22 nt, Mycobacterium bovis subsp bovis AF2122/97
gaguuccggucgacuccagcac

SEQ ID NO: 1162969 - RNA, 19 nt, Mycobacterium bovis subsp bovis AF2122/97
gaguucacguucggcgcug

SEQ ID NO: 1162970 - RNA, 18 nt, Mycobacterium bovis subsp bovis AF2122/97
gauacggccaccaggugc

SEQ ID NO: 1162971 - RNA, 23 nt, Mycobacterium bovis subsp bovis AF2122/97
gauagaugcgugcggcagugcca

SEQ ID NO: 1162972 - RNA, 15 nt, Mycobacterium bovis subsp bovis AF2122/97
gauacauuucccagu

SEQ ID NO: 1162973 - RNA, 13 nt, Mycobacterium bovis subsp bovis AF2122/97
gauacgagcugua

SEQ ID NO: 1162974 - RNA, 14 nt, Mycobacterium bovis subsp bovis AF2122/97
gauacagucgaccg

SEQ ID NO: 1162975 - RNA, 16 nt, Mycobacterium bovis subsp bovis AF2122/97
gauaauucaacagcac

SEQ ID NO: 1162976 - RNA, 19 nt, Mycobacterium bovis subsp bovis AF2122/97
gauaaccgcgaccagcugg

SEQ ID NO: 1162977 - RNA, 16 nt, Mycobacterium bovis subsp bovis AF2122/97
gaucagcuccuccgac

SEQ ID NO: 1162978 - RNA, 19 nt, Mycobacterium bovis subsp bovis AF2122/97
gaucagcguauuggacgcu

SEQ ID NO: 1162979 - RNA, 16 nt, Mycobacterium bovis subsp bovis AF2122/97
gaucagggucagcgcc

SEQ ID NO: 1162980 - RNA, 15 nt, Mycobacterium bovis subsp bovis AF2122/97
gaucaggccccacac

SEQ ID NO: 1162981 - RNA, 17 nt, Mycobacterium bovis subsp bovis AF2122/97
gaucaggccgaugacga

SEQ ID NO: 1162982 - RNA, 19 nt, Mycobacterium bovis subsp bovis AF2122/97
gaucaggccuugggauagg

SEQ ID NO: 1162983 - RNA, 14 nt, Mycobacterium bovis subsp bovis AF2122/97
gaucaggguggcgc

SEQ ID NO: 1162984 - RNA, 15 nt, Mycobacterium bovis subsp bovis AF2122/97
gaucaggucuucgau

SEQ ID NO: 1162985 - RNA, 17 nt, Mycobacterium bovis subsp bovis AF2122/97
gaucaggucgucacgcc

SEQ ID NO: 1162986 - RNA, 21 nt, Mycobacterium bovis subsp bovis AF2122/97
gaucauguccaucgcgcggcu

SEQ ID NO: 1162987 - RNA, 22 nt, Mycobacterium bovis subsp bovis AF2122/97
gaucagcgaggaauuccgcuac

SEQ ID NO: 1162988 - RNA, 18 nt, Mycobacterium bovis subsp bovis AF2122/97
gaucagcgaguagccgcu

SEQ ID NO: 1162989 - RNA, 20 nt, Mycobacterium bovis subsp bovis AF2122/97
gaucagccgggugcgcaccc

SEQ ID NO: 1162990 - RNA, 16 nt, Mycobacterium bovis subsp bovis AF2122/97
gaucagcgcggcgccc

SEQ ID NO: 1162991 - RNA, 14 nt, Mycobacterium bovis subsp bovis AF2122/97
gaucagcccgcgca

SEQ ID NO: 1162992 - RNA, 15 nt, Mycobacterium bovis subsp bovis AF2122/97
gaucagcccgcgcag

SEQ ID NO: 1162993 - RNA, 14 nt, Mycobacterium bovis subsp bovis AF2122/97
gaucagcagccgcc

SEQ ID NO: 1162994 - RNA, 20 nt, Mycobacterium bovis subsp bovis AF2122/97
gaucagcaggaucggcagca

SEQ ID NO: 1162995 - RNA, 22 nt, Mycobacterium bovis subsp bovis AF2122/97
gaucagcaggaucggcagcaga

SEQ ID NO: 1162996 - RNA, 14 nt, Mycobacterium bovis subsp bovis AF2122/97
gaucaaccccccgg

SEQ ID NO: 1162997 - RNA, 22 nt, Mycobacterium bovis subsp bovis AF2122/97
gaucaacccggccuucuccauc

SEQ ID NO: 1162998 - RNA, 16 nt, Mycobacterium bovis subsp bovis AF2122/97
gaucaagaaggccagc

SEQ ID NO: 1162999 - RNA, 19 nt, Mycobacterium bovis subsp bovis AF2122/97
gaucaagaaggccagcgcg

SEQ ID NO: 1163000 - RNA, 20 nt, Mycobacterium bovis subsp bovis AF2122/97
gauaugacggcagaccaugg

SEQ ID NO: 1163001 - RNA, 12 nt, Mycobacterium bovis subsp bovis AF2122/97
gauauugccauc

SEQ ID NO: 1163002 - RNA, 14 nt, Mycobacterium bovis subsp bovis AF2122/97
gauauugccugcca

SEQ ID NO: 1163003 - RNA, 21 nt, Mycobacterium bovis subsp bovis AF2122/97
gauauccgugaauggcagcac

SEQ ID NO: 1163004 - RNA, 19 nt, Mycobacterium bovis subsp bovis AF2122/97
gauagcaacgaagccggcg

SEQ ID NO: 1163005 - RNA, 15 nt, Mycobacterium bovis subsp bovis AF2122/97
gauagcaucugauga

SEQ ID NO: 1163006 - RNA, 22 nt, Mycobacterium bovis subsp bovis AF2122/97
gauagcaacggugcucuucgau

SEQ ID NO: 1163007 - RNA, 21 nt, Mycobacterium bovis subsp bovis AF2122/97
gauaucgccgagaaccagcga

SEQ ID NO: 1163008 - RNA, 16 nt, Mycobacterium bovis subsp bovis AF2122/97
gauaucuauggaugac

SEQ ID NO: 1163009 - RNA, 15 nt, Mycobacterium bovis subsp bovis AF2122/97
gauaucgucggugca

SEQ ID NO: 1163010 - RNA, 15 nt, Mycobacterium bovis subsp bovis AF2122/97
gauccucgcccgcac

SEQ ID NO: 1163011 - RNA, 21 nt, Mycobacterium bovis subsp bovis AF2122/97
gauccgucgcguugagcgcag

SEQ ID NO: 1163012 - RNA, 15 nt, Mycobacterium bovis subsp bovis AF2122/97
gauccgugucgcaga

SEQ ID NO: 1163013 - RNA, 13 nt, Mycobacterium bovis subsp bovis AF2122/97
gauccggguggcg

SEQ ID NO: 1163014 - RNA, 13 nt, Mycobacterium bovis subsp bovis AF2122/97
gauccgguggugg

SEQ ID NO: 1163015 - RNA, 18 nt, Mycobacterium bovis subsp bovis AF2122/97
gauccggucggccaggcc

SEQ ID NO: 1163016 - RNA, 16 nt, Mycobacterium bovis subsp bovis AF2122/97
gauccggucgggggcg

SEQ ID NO: 1163017 - RNA, 13 nt, Mycobacterium bovis subsp bovis AF2122/97
gauccggcggcag

SEQ ID NO: 1163018 - RNA, 18 nt, Mycobacterium bovis subsp bovis AF2122/97
gauccggcaauugugcug

SEQ ID NO: 1163019 - RNA, 19 nt, Mycobacterium bovis subsp bovis AF2122/97
gauccggcagcagccggcg

SEQ ID NO: 1163020 - RNA, 16 nt, Mycobacterium bovis subsp bovis AF2122/97
gaucgaccauggucga

SEQ ID NO: 1163021 - RNA, 15 nt, Mycobacterium bovis subsp bovis AF2122/97
gauccugcccaccau

SEQ ID NO: 1163022 - RNA, 17 nt, Mycobacterium bovis subsp bovis AF2122/97
gauccuggccacuccca

SEQ ID NO: 1163023 - RNA, 18 nt, Mycobacterium bovis subsp bovis AF2122/97
gaucccgugguggcgcca

SEQ ID NO: 1163024 - RNA, 16 nt, Mycobacterium bovis subsp bovis AF2122/97
gaucccugugccagca

SEQ ID NO: 1163025 - RNA, 17 nt, Mycobacterium bovis subsp bovis AF2122/97
gauccgaagagccagca

SEQ ID NO: 1163026 - RNA, 21 nt, Mycobacterium bovis subsp bovis AF2122/97
gaucccggucuuuaauccagc

SEQ ID NO: 1163027 - RNA, 16 nt, Mycobacterium bovis subsp bovis AF2122/97
gaucccggccagcucc

SEQ ID NO: 1163028 - RNA, 16 nt, Mycobacterium bovis subsp bovis AF2122/97
gaucccgaucgcgcug

SEQ ID NO: 1163029 - RNA, 20 nt, Mycobacterium bovis subsp bovis AF2122/97
gauccgcggcguuccccgag

SEQ ID NO: 1163030 - RNA, 16 nt, Mycobacterium bovis subsp bovis AF2122/97
gauccgcuagccccga

SEQ ID NO: 1163031 - RNA, 18 nt, Mycobacterium bovis subsp bovis AF2122/97
gauccgcugcgccgaggc

SEQ ID NO: 1163032 - RNA, 20 nt, Mycobacterium bovis subsp bovis AF2122/97
gauccgcugcgccgaggcau

SEQ ID NO: 1163033 - RNA, 20 nt, Mycobacterium bovis subsp bovis AF2122/97
gauccgauuggcgaucuugc

SEQ ID NO: 1163034 - RNA, 18 nt, Mycobacterium bovis subsp bovis AF2122/97
gauccgaagagccagcaa

SEQ ID NO: 1163035 - RNA, 13 nt, Mycobacterium bovis subsp bovis AF2122/97
gaucccgcccaag

SEQ ID NO: 1163036 - RNA, 17 nt, Mycobacterium bovis subsp bovis AF2122/97
gauccagcccaugcgcc

SEQ ID NO: 1163037 - RNA, 18 nt, Mycobacterium bovis subsp bovis AF2122/97
gauccagcccaugcgcca

SEQ ID NO: 1163038 - RNA, 19 nt, Mycobacterium bovis subsp bovis AF2122/97
gauccagcccgacgcccga

SEQ ID NO: 1163039 - RNA, 20 nt, Mycobacterium bovis subsp bovis AF2122/97
gauccagcccaugcgccacg

SEQ ID NO: 1163040 - RNA, 22 nt, Mycobacterium bovis subsp bovis AF2122/97
gauccacggcgaugcagccaca

SEQ ID NO: 1163041 - RNA, 15 nt, Mycobacterium bovis subsp bovis AF2122/97
gauccacccagugcc

SEQ ID NO: 1163042 - RNA, 15 nt, Mycobacterium bovis subsp bovis AF2122/97
gauccacgccagagc

SEQ ID NO: 1163043 - RNA, 20 nt, Mycobacterium bovis subsp bovis AF2122/97
gauccacauggugaccaugg

SEQ ID NO: 1163044 - RNA, 15 nt, Mycobacterium bovis subsp bovis AF2122/97
gauccaccagaucca

SEQ ID NO: 1163045 - RNA, 14 nt, Mycobacterium bovis subsp bovis AF2122/97
gaucggccaccauc

SEQ ID NO: 1163046 - RNA, 20 nt, Mycobacterium bovis subsp bovis AF2122/97
gaucggccacgucccagaga

SEQ ID NO: 1163047 - RNA, 11 nt, Mycobacterium bovis subsp bovis AF2122/97
gaucggcacua

SEQ ID NO: 1163048 - RNA, 15 nt, Mycobacterium bovis subsp bovis AF2122/97
gaucggcaggccgcu

SEQ ID NO: 1163049 - RNA, 15 nt, Mycobacterium bovis subsp bovis AF2122/97
gaucggcgccgcaua

SEQ ID NO: 1163050 - RNA, 18 nt, Mycobacterium bovis subsp bovis AF2122/97
gaucggcggaccgcagcg

SEQ ID NO: 1163051 - RNA, 15 nt, Mycobacterium bovis subsp bovis AF2122/97
gaucggcggccggca

SEQ ID NO: 1163052 - RNA, 13 nt, Mycobacterium bovis subsp bovis AF2122/97
gaucggcgcggcc

SEQ ID NO: 1163053 - RNA, 21 nt, Mycobacterium bovis subsp bovis AF2122/97
gaucggcgcggccguagugca

SEQ ID NO: 1163054 - RNA, 19 nt, Mycobacterium bovis subsp bovis AF2122/97
gaucggcuaccuaacccgc

SEQ ID NO: 1163055 - RNA, 12 nt, Mycobacterium bovis subsp bovis AF2122/97
gaucggcucacg

SEQ ID NO: 1163056 - RNA, 22 nt, Mycobacterium bovis subsp bovis AF2122/97
gaucggucuuggcgauccaggc

SEQ ID NO: 1163057 - RNA, 15 nt, Mycobacterium bovis subsp bovis AF2122/97
gaucggguggcgggu

SEQ ID NO: 1163058 - RNA, 16 nt, Mycobacterium bovis subsp bovis AF2122/97
gaucggguggcggguc

SEQ ID NO: 1163059 - RNA, 21 nt, Mycobacterium bovis subsp bovis AF2122/97
gaucgggucguuggcggcggu

SEQ ID NO: 1163060 - RNA, 17 nt, Mycobacterium bovis subsp bovis AF2122/97
gaucggauggcggccac

SEQ ID NO: 1163061 - RNA, 20 nt, Mycobacterium bovis subsp bovis AF2122/97
gaucgcugcgaagccgagca

SEQ ID NO: 1163062 - RNA, 15 nt, Mycobacterium bovis subsp bovis AF2122/97
gaucgcgguccgagc

SEQ ID NO: 1163063 - RNA, 13 nt, Mycobacterium bovis subsp bovis AF2122/97
gaucgcggcggcc

SEQ ID NO: 1163064 - RNA, 20 nt, Mycobacterium bovis subsp bovis AF2122/97
gaucgcuccgcggcgcagca

SEQ ID NO: 1163065 - RNA, 21 nt, Mycobacterium bovis subsp bovis AF2122/97
gaucgcuccgcggcgcagcac

SEQ ID NO: 1163066 - RNA, 17 nt, Mycobacterium bovis subsp bovis AF2122/97
gaucgcgugccacagca

SEQ ID NO: 1163067 - RNA, 18 nt, Mycobacterium bovis subsp bovis AF2122/97
gaucgagagccgaccggg

SEQ ID NO: 1163068 - RNA, 20 nt, Mycobacterium bovis subsp bovis AF2122/97
gaucgagcagggugaccagg

SEQ ID NO: 1163069 - RNA, 19 nt, Mycobacterium bovis subsp bovis AF2122/97
gaucgcgagcgagccaacu

SEQ ID NO: 1163070 - RNA, 21 nt, Mycobacterium bovis subsp bovis AF2122/97
gaucgcgaacaucgccagcgc

SEQ ID NO: 1163071 - RNA, 15 nt, Mycobacterium bovis subsp bovis AF2122/97
gaucgcgaacuucca

SEQ ID NO: 1163072 - RNA, 15 nt, Mycobacterium bovis subsp bovis AF2122/97
gaucgccguccagca

SEQ ID NO: 1163073 - RNA, 23 nt, Mycobacterium bovis subsp bovis AF2122/97
gaucgccggcuucgcccagagcc

SEQ ID NO: 1163074 - RNA, 12 nt, Mycobacterium bovis subsp bovis AF2122/97
gaucgccgagca

SEQ ID NO: 1163075 - RNA, 21 nt, Mycobacterium bovis subsp bovis AF2122/97
gaucgccucggacacggcagc

SEQ ID NO: 1163076 - RNA, 15 nt, Mycobacterium bovis subsp bovis AF2122/97
gaucgccgaggcagc

SEQ ID NO: 1163077 - RNA, 23 nt, Mycobacterium bovis subsp bovis AF2122/97
gaucgcccgaguugaagaagccg

SEQ ID NO: 1163078 - RNA, 15 nt, Mycobacterium bovis subsp bovis AF2122/97
gaugacuagccugcu

SEQ ID NO: 1163079 - RNA, 19 nt, Mycobacterium bovis subsp bovis AF2122/97
gaugaccagggucugcuca

SEQ ID NO: 1163080 - RNA, 21 nt, Mycobacterium bovis subsp bovis AF2122/97
gaugaauucauguggcgcggg

SEQ ID NO: 1163081 - RNA, 14 nt, Mycobacterium bovis subsp bovis AF2122/97
gaucgugccgggac

SEQ ID NO: 1163082 - RNA, 21 nt, Mycobacterium bovis subsp bovis AF2122/97
gaugacaggcuuggcaugcgg

SEQ ID NO: 1163083 - RNA, 19 nt, Mycobacterium bovis subsp bovis AF2122/97
gaucgucgacccaccaugu

SEQ ID NO: 1163084 - RNA, 20 nt, Mycobacterium bovis subsp bovis AF2122/97
gaucgucgugcacggcggcc

SEQ ID NO: 1163085 - RNA, 15 nt, Mycobacterium bovis subsp bovis AF2122/97
gaucgguggcggcac

SEQ ID NO: 1163086 - RNA, 21 nt, Mycobacterium bovis subsp bovis AF2122/97
gaucgguuucugcggccccga

SEQ ID NO: 1163087 - RNA, 14 nt, Mycobacterium bovis subsp bovis AF2122/97
gaucguccggccgg

SEQ ID NO: 1163088 - RNA, 22 nt, Mycobacterium bovis subsp bovis AF2122/97
gaugaucgcgaacaucgccagc

SEQ ID NO: 1163089 - RNA, 19 nt, Mycobacterium bovis subsp bovis AF2122/97
gaugaucgguucgggacgc

SEQ ID NO: 1163090 - RNA, 19 nt, Mycobacterium bovis subsp bovis AF2122/97
gaugaucuugccgcggcgc

SEQ ID NO: 1163091 - RNA, 14 nt, Mycobacterium bovis subsp bovis AF2122/97
gaugaucagcgagg

SEQ ID NO: 1163092 - RNA, 15 nt, Mycobacterium bovis subsp bovis AF2122/97
gaugagccgcagaug

SEQ ID NO: 1163093 - RNA, 19 nt, Mycobacterium bovis subsp bovis AF2122/97
gaugagcaugcccagcgca

SEQ ID NO: 1163094 - RNA, 15 nt, Mycobacterium bovis subsp bovis AF2122/97
gaugagcgcuucugc

SEQ ID NO: 1163095 - RNA, 17 nt, Mycobacterium bovis subsp bovis AF2122/97
gaugcagggcccgcaac

SEQ ID NO: 1163096 - RNA, 16 nt, Mycobacterium bovis subsp bovis AF2122/97
gaugaugacggcggcc

SEQ ID NO: 1163097 - RNA, 14 nt, Mycobacterium bovis subsp bovis AF2122/97
gaugaugccggcgu

SEQ ID NO: 1163098 - RNA, 13 nt, Mycobacterium bovis subsp bovis AF2122/97
gaugcaucggugc

SEQ ID NO: 1163099 - RNA, 16 nt, Mycobacterium bovis subsp bovis AF2122/97
gaugcgaaacaucucg

SEQ ID NO: 1163100 - RNA, 22 nt, Mycobacterium bovis subsp bovis AF2122/97
gaugcgacgaaccucggcggga

SEQ ID NO: 1163101 - RNA, 18 nt, Mycobacterium bovis subsp bovis AF2122/97
gaugcgacagcgcugggc

SEQ ID NO: 1163102 - RNA, 22 nt, Mycobacterium bovis subsp bovis AF2122/97
gaugcgcacucccggcucggcc

SEQ ID NO: 1163103 - RNA, 18 nt, Mycobacterium bovis subsp bovis AF2122/97
gaugcgcaccagcggcug

SEQ ID NO: 1163104 - RNA, 22 nt, Mycobacterium bovis subsp bovis AF2122/97
gaugcgggccgccaggcggccg

SEQ ID NO: 1163105 - RNA, 13 nt, Mycobacterium bovis subsp bovis AF2122/97
gaugcgggcggca

SEQ ID NO: 1163106 - RNA, 14 nt, Mycobacterium bovis subsp bovis AF2122/97
gaugcgggcuguga

SEQ ID NO: 1163107 - RNA, 17 nt, Mycobacterium bovis subsp bovis AF2122/97
gaugcgccaggcugaag

SEQ ID NO: 1163108 - RNA, 14 nt, Mycobacterium bovis subsp bovis AF2122/97
gaugccacccaaca

SEQ ID NO: 1163109 - RNA, 17 nt, Mycobacterium bovis subsp bovis AF2122/97
gaugccacccaacagcg

SEQ ID NO: 1163110 - RNA, 19 nt, Mycobacterium bovis subsp bovis AF2122/97
gaugccacccagaugcagc

SEQ ID NO: 1163111 - RNA, 19 nt, Mycobacterium bovis subsp bovis AF2122/97
gaugcccggcaucgcgauc

SEQ ID NO: 1163112 - RNA, 21 nt, Mycobacterium bovis subsp bovis AF2122/97
gaugcccucgauggccaggcu

SEQ ID NO: 1163113 - RNA, 23 nt, Mycobacterium bovis subsp bovis AF2122/97
gaugccgaacuccgcggaaccca

SEQ ID NO: 1163114 - RNA, 20 nt, Mycobacterium bovis subsp bovis AF2122/97
gaugccgccgaagaggagaa

SEQ ID NO: 1163115 - RNA, 14 nt, Mycobacterium bovis subsp bovis AF2122/97
gaugccgccggccc

SEQ ID NO: 1163116 - RNA, 23 nt, Mycobacterium bovis subsp bovis AF2122/97
gaugcuggcaaaguaucgcagca

SEQ ID NO: 1163117 - RNA, 12 nt, Mycobacterium bovis subsp bovis AF2122/97
gaugcggugcgg

SEQ ID NO: 1163118 - RNA, 18 nt, Mycobacterium bovis subsp bovis AF2122/97
gaugcggugcggaucaga

SEQ ID NO: 1163119 - RNA, 17 nt, Mycobacterium bovis subsp bovis AF2122/97
gauggaccgcacugaca

SEQ ID NO: 1163120 - RNA, 14 nt, Mycobacterium bovis subsp bovis AF2122/97
gauggacagcugcg

SEQ ID NO: 1163121 - RNA, 12 nt, Mycobacterium bovis subsp bovis AF2122/97
gauggcaccacc

SEQ ID NO: 1163122 - RNA, 17 nt, Mycobacterium bovis subsp bovis AF2122/97
gauggcaaacgcaccca

SEQ ID NO: 1163123 - RNA, 14 nt, Mycobacterium bovis subsp bovis AF2122/97
gaugggcagccgcc

SEQ ID NO: 1163124 - RNA, 21 nt, Mycobacterium bovis subsp bovis AF2122/97
gaugggcgaauugcaggacgc

SEQ ID NO: 1163125 - RNA, 20 nt, Mycobacterium bovis subsp bovis AF2122/97
gaugggcccagcggccgcga

SEQ ID NO: 1163126 - RNA, 19 nt, Mycobacterium bovis subsp bovis AF2122/97
gauggucaaugcgcuggcg

SEQ ID NO: 1163127 - RNA, 19 nt, Mycobacterium bovis subsp bovis AF2122/97
gauggucaccgucugcacc

SEQ ID NO: 1163128 - RNA, 14 nt, Mycobacterium bovis subsp bovis AF2122/97
gaugguacucaggu

SEQ ID NO: 1163129 - RNA, 17 nt, Mycobacterium bovis subsp bovis AF2122/97
gauggcgcugcaccgua

SEQ ID NO: 1163130 - RNA, 21 nt, Mycobacterium bovis subsp bovis AF2122/97
gauggcggaaguucuccucgu

SEQ ID NO: 1163131 - RNA, 15 nt, Mycobacterium bovis subsp bovis AF2122/97
gaugggagcccggcg

SEQ ID NO: 1163132 - RNA, 15 nt, Mycobacterium bovis subsp bovis AF2122/97
gauggcggcgcguuc

SEQ ID NO: 1163133 - RNA, 14 nt, Mycobacterium bovis subsp bovis AF2122/97
gauggcgcccugcg

SEQ ID NO: 1163134 - RNA, 15 nt, Mycobacterium bovis subsp bovis AF2122/97
gauggcgauggcagg

SEQ ID NO: 1163135 - RNA, 20 nt, Mycobacterium bovis subsp bovis AF2122/97
gauggcgauggcaggggcga

SEQ ID NO: 1163136 - RNA, 13 nt, Mycobacterium bovis subsp bovis AF2122/97
gauggcaggggcg

SEQ ID NO: 1163137 - RNA, 17 nt, Mycobacterium bovis subsp bovis AF2122/97
gauguaguccucggugg

SEQ ID NO: 1163138 - RNA, 23 nt, Mycobacterium bovis subsp bovis AF2122/97
gauguaaccguagcccugcucag

SEQ ID NO: 1163139 - RNA, 16 nt, Mycobacterium bovis subsp bovis AF2122/97
gaugguggucaccacc

SEQ ID NO: 1163140 - RNA, 18 nt, Mycobacterium bovis subsp bovis AF2122/97
gauggugccgacccgccg

SEQ ID NO: 1163141 - RNA, 14 nt, Mycobacterium bovis subsp bovis AF2122/97
gauggugccgaccc

SEQ ID NO: 1163142 - RNA, 21 nt, Mycobacterium bovis subsp bovis AF2122/97
gauggucgugaucuucugccu

SEQ ID NO: 1163143 - RNA, 17 nt, Mycobacterium bovis subsp bovis AF2122/97
gauggugaccagcaggc

SEQ ID NO: 1163144 - RNA, 16 nt, Mycobacterium bovis subsp bovis AF2122/97
gauggugugcagcagc

SEQ ID NO: 1163145 - RNA, 17 nt, Mycobacterium bovis subsp bovis AF2122/97
gaugguggucaccacca

SEQ ID NO: 1163146 - RNA, 17 nt, Mycobacterium bovis subsp bovis AF2122/97
gaugguggugccgaccu

SEQ ID NO: 1163147 - RNA, 21 nt, Mycobacterium bovis subsp bovis AF2122/97
gauuacggccagugucagcac

SEQ ID NO: 1163148 - RNA, 16 nt, Mycobacterium bovis subsp bovis AF2122/97
gauuaagucggcggcc

SEQ ID NO: 1163149 - RNA, 21 nt, Mycobacterium bovis subsp bovis AF2122/97
gauuaucgcgcgcaaccgcuc

SEQ ID NO: 1163150 - RNA, 15 nt, Mycobacterium bovis subsp bovis AF2122/97
gaugucgagguagug

SEQ ID NO: 1163151 - RNA, 23 nt, Mycobacterium bovis subsp bovis AF2122/97
gaugucgauggggacggcggcga

SEQ ID NO: 1163152 - RNA, 14 nt, Mycobacterium bovis subsp bovis AF2122/97
gaugucgaagucgu

SEQ ID NO: 1163153 - RNA, 14 nt, Mycobacterium bovis subsp bovis AF2122/97
gauguccucgaugc

SEQ ID NO: 1163154 - RNA, 19 nt, Mycobacterium bovis subsp bovis AF2122/97
gauguccucgaugcgggcg

SEQ ID NO: 1163155 - RNA, 16 nt, Mycobacterium bovis subsp bovis AF2122/97
gaugucgcccaaccga

SEQ ID NO: 1163156 - RNA, 20 nt, Mycobacterium bovis subsp bovis AF2122/97
gauguccccggcggcagcau

SEQ ID NO: 1163157 - RNA, 13 nt, Mycobacterium bovis subsp bovis AF2122/97
gauguccgcagca

SEQ ID NO: 1163158 - RNA, 14 nt, Mycobacterium bovis subsp bovis AF2122/97
gauguccgcagcac

SEQ ID NO: 1163159 - RNA, 15 nt, Mycobacterium bovis subsp bovis AF2122/97
gauguccgcagcacc

SEQ ID NO: 1163160 - RNA, 17 nt, Mycobacterium bovis subsp bovis AF2122/97
gauguccgacgcaccaa

SEQ ID NO: 1163161 - RNA, 18 nt, Mycobacterium bovis subsp bovis AF2122/97
gauguccgcggccaccac

SEQ ID NO: 1163162 - RNA, 19 nt, Mycobacterium bovis subsp bovis AF2122/97
gauucugggcuucaucggc

SEQ ID NO: 1163163 - RNA, 16 nt, Mycobacterium bovis subsp bovis AF2122/97
gauugaagcuggccac

SEQ ID NO: 1163164 - RNA, 18 nt, Mycobacterium bovis subsp bovis AF2122/97
gauuauucgcgguagccg

SEQ ID NO: 1163165 - RNA, 15 nt, Mycobacterium bovis subsp bovis AF2122/97
gauugcgaagggcac

SEQ ID NO: 1163166 - RNA, 15 nt, Mycobacterium bovis subsp bovis AF2122/97
gauugcgggccugca

SEQ ID NO: 1163167 - RNA, 17 nt, Mycobacterium bovis subsp bovis AF2122/97
gauugcguucaucaucc

SEQ ID NO: 1163168 - RNA, 23 nt, Mycobacterium bovis subsp bovis AF2122/97
gauuguuuuccuugcgguaggcg

SEQ ID NO: 1163169 - RNA, 16 nt, Mycobacterium bovis subsp bovis AF2122/97
gauugugcagcgaaau

SEQ ID NO: 1163170 - RNA, 23 nt, Mycobacterium bovis subsp bovis AF2122/97
gauugugucccauggugagcugu

SEQ ID NO: 1163171 - RNA, 16 nt, Mycobacterium bovis subsp bovis AF2122/97
gauuuugugucugcuc

SEQ ID NO: 1163172 - RNA, 14 nt, Mycobacterium bovis subsp bovis AF2122/97
gauuuuggcugcag

SEQ ID NO: 1163173 - RNA, 20 nt, Mycobacterium bovis subsp bovis AF2122/97
gauuucuuuaaaccccuggc

SEQ ID NO: 1163174 - RNA, 20 nt, Mycobacterium bovis subsp bovis AF2122/97
gauuuauugagucggcuggu

SEQ ID NO: 1163175 - RNA, 22 nt, Mycobacterium bovis subsp bovis AF2122/97
gauuugccccguugagcagcac

SEQ ID NO: 1163176 - RNA, 22 nt, Mycobacterium bovis subsp bovis AF2122/97
gcaaacgcacccaucgugcuga

SEQ ID NO: 1163177 - RNA, 22 nt, Mycobacterium bovis subsp bovis AF2122/97
gcaaacuccagcuugccgaccu

SEQ ID NO: 1163178 - RNA, 13 nt, Mycobacterium bovis subsp bovis AF2122/97
gcaaaccccggac

SEQ ID NO: 1163179 - RNA, 20 nt, Mycobacterium bovis subsp bovis AF2122/97
gcaaaccacccgcaacacau

SEQ ID NO: 1163180 - RNA, 16 nt, Mycobacterium bovis subsp bovis AF2122/97
gcaaacauccacccgc

SEQ ID NO: 1163181 - RNA, 18 nt, Mycobacterium bovis subsp bovis AF2122/97
gcaaaagugcgaguagga

SEQ ID NO: 1163182 - RNA, 17 nt, Mycobacterium bovis subsp bovis AF2122/97
gcaaaggaugaugaaca

SEQ ID NO: 1163183 - RNA, 23 nt, Mycobacterium bovis subsp bovis AF2122/97
gcaaaggaugaugaacagacgcc

SEQ ID NO: 1163184 - RNA, 16 nt, Mycobacterium bovis subsp bovis AF2122/97
gcaaagcccuccucga

SEQ ID NO: 1163185 - RNA, 16 nt, Mycobacterium bovis subsp bovis AF2122/97
gcaaagucggugucac

SEQ ID NO: 1163186 - RNA, 12 nt, Mycobacterium bovis subsp bovis AF2122/97
gcaaaggcgcuc

SEQ ID NO: 1163187 - RNA, 18 nt, Mycobacterium bovis subsp bovis AF2122/97
gcaaaucggugcgauccu

SEQ ID NO: 1163188 - RNA, 22 nt, Mycobacterium bovis subsp bovis AF2122/97
gcagcaucuccgucggccaggc

SEQ ID NO: 1163189 - RNA, 23 nt, Mycobacterium bovis subsp bovis AF2122/97
gcagcaucuccgucggccaggcc

SEQ ID NO: 1163190 - RNA, 18 nt, Mycobacterium bovis subsp bovis AF2122/97
gcagcaucggcgacagga

SEQ ID NO: 1163191 - RNA, 16 nt, Mycobacterium bovis subsp bovis AF2122/97
gcagcaucgucgccac

SEQ ID NO: 1163192 - RNA, 18 nt, Mycobacterium bovis subsp bovis AF2122/97
gcagcaucgucgccacga

SEQ ID NO: 1163193 - RNA, 23 nt, Mycobacterium bovis subsp bovis AF2122/97
gcagccaaaaacgcugccgccgu

SEQ ID NO: 1163194 - RNA, 20 nt, Mycobacterium bovis subsp bovis AF2122/97
gcagcauggugcggcggcgu

SEQ ID NO: 1163195 - RNA, 17 nt, Mycobacterium bovis subsp bovis AF2122/97
gcagcccgucggcgccg

SEQ ID NO: 1163196 - RNA, 19 nt, Mycobacterium bovis subsp bovis AF2122/97
gcagcccgugacuggugaa

SEQ ID NO: 1163197 - RNA, 16 nt, Mycobacterium bovis subsp bovis AF2122/97
gcagcccggugugcug

SEQ ID NO: 1163198 - RNA, 21 nt, Mycobacterium bovis subsp bovis AF2122/97
gcagcccugcgcagccgccuc

SEQ ID NO: 1163199 - RNA, 21 nt, Mycobacterium bovis subsp bovis AF2122/97
gcagccgaaguggcgccuugg

SEQ ID NO: 1163200 - RNA, 13 nt, Mycobacterium bovis subsp bovis AF2122/97
gcagccgcgcggu

SEQ ID NO: 1163201 - RNA, 16 nt, Mycobacterium bovis subsp bovis AF2122/97
gcagcccgggcagccc

SEQ ID NO: 1163202 - RNA, 20 nt, Mycobacterium bovis subsp bovis AF2122/97
gcagcccgggcagccccucc

SEQ ID NO: 1163203 - RNA, 15 nt, Mycobacterium bovis subsp bovis AF2122/97
gcagcccgccgggcu

SEQ ID NO: 1163204 - RNA, 19 nt, Mycobacterium bovis subsp bovis AF2122/97
gcagcccgcacccacuuuc

SEQ ID NO: 1163205 - RNA, 19 nt, Mycobacterium bovis subsp bovis AF2122/97
gcagcgccaacgcccccau

SEQ ID NO: 1163206 - RNA, 14 nt, Mycobacterium bovis subsp bovis AF2122/97
gcagcgccagcagc

SEQ ID NO: 1163207 - RNA, 16 nt, Mycobacterium bovis subsp bovis AF2122/97
gcagcgcccccgcugc

SEQ ID NO: 1163208 - RNA, 22 nt, Mycobacterium bovis subsp bovis AF2122/97
gcagcgcccuuggacgcgauga

SEQ ID NO: 1163209 - RNA, 12 nt, Mycobacterium bovis subsp bovis AF2122/97
gcagcgccgcca

SEQ ID NO: 1163210 - RNA, 15 nt, Mycobacterium bovis subsp bovis AF2122/97
gcagcgccggcaccg

SEQ ID NO: 1163211 - RNA, 13 nt, Mycobacterium bovis subsp bovis AF2122/97
gcagcgccgcgcg

SEQ ID NO: 1163212 - RNA, 16 nt, Mycobacterium bovis subsp bovis AF2122/97
gcagcgccucgauccg

SEQ ID NO: 1163213 - RNA, 13 nt, Mycobacterium bovis subsp bovis AF2122/97
gcagcgccggucg

SEQ ID NO: 1163214 - RNA, 23 nt, Mycobacterium bovis subsp bovis AF2122/97
gcagcgcaaugcaucgcggcggc

SEQ ID NO: 1163215 - RNA, 21 nt, Mycobacterium bovis subsp bovis AF2122/97
gcagcgaucuugguggccuca

SEQ ID NO: 1163216 - RNA, 17 nt, Mycobacterium bovis subsp bovis AF2122/97
gcagccgggcaccaccc

SEQ ID NO: 1163217 - RNA, 19 nt, Mycobacterium bovis subsp bovis AF2122/97
gcagcgcaacggccagcgc

SEQ ID NO: 1163218 - RNA, 20 nt, Mycobacterium bovis subsp bovis AF2122/97
gcagcgcaacggccagcgcu

SEQ ID NO: 1163219 - RNA, 20 nt, Mycobacterium bovis subsp bovis AF2122/97
gcagccgggcggcagcggcu

SEQ ID NO: 1163220 - RNA, 14 nt, Mycobacterium bovis subsp bovis AF2122/97
gcagccggcgggcc

SEQ ID NO: 1163221 - RNA, 15 nt, Mycobacterium bovis subsp bovis AF2122/97
gcagccggcggagaa

SEQ ID NO: 1163222 - RNA, 19 nt, Mycobacterium bovis subsp bovis AF2122/97
gcagcagauugaugucagg

SEQ ID NO: 1163223 - RNA, 14 nt, Mycobacterium bovis subsp bovis AF2122/97
gcagcagcccgggc

SEQ ID NO: 1163224 - RNA, 21 nt, Mycobacterium bovis subsp bovis AF2122/97
gcagcaccagcgccuugacca

SEQ ID NO: 1163225 - RNA, 17 nt, Mycobacterium bovis subsp bovis AF2122/97
gcagcacccgcgccagu

SEQ ID NO: 1163226 - RNA, 16 nt, Mycobacterium bovis subsp bovis AF2122/97
gcagcacccccucggc

SEQ ID NO: 1163227 - RNA, 17 nt, Mycobacterium bovis subsp bovis AF2122/97
gcagcaccgcacggagg

SEQ ID NO: 1163228 - RNA, 13 nt, Mycobacterium bovis subsp bovis AF2122/97
gcagcacccgggc

SEQ ID NO: 1163229 - RNA, 13 nt, Mycobacterium bovis subsp bovis AF2122/97
gcagcagccggcg

SEQ ID NO: 1163230 - RNA, 19 nt, Mycobacterium bovis subsp bovis AF2122/97
gcagcagcgccgcguggcu

SEQ ID NO: 1163231 - RNA, 16 nt, Mycobacterium bovis subsp bovis AF2122/97
gcagcagcgcgcggau

SEQ ID NO: 1163232 - RNA, 16 nt, Mycobacterium bovis subsp bovis AF2122/97
gcagcaggugagccag

SEQ ID NO: 1163233 - RNA, 17 nt, Mycobacterium bovis subsp bovis AF2122/97
gcagcacauccugcagc

SEQ ID NO: 1163234 - RNA, 23 nt, Mycobacterium bovis subsp bovis AF2122/97
gcagcacauccugcagcucgggc

SEQ ID NO: 1163235 - RNA, 20 nt, Mycobacterium bovis subsp bovis AF2122/97
gcagcaaaacccgagccugg

SEQ ID NO: 1163236 - RNA, 20 nt, Mycobacterium bovis subsp bovis AF2122/97
gcacuguugcguagcgcgcu

SEQ ID NO: 1163237 - RNA, 12 nt, Mycobacterium bovis subsp bovis AF2122/97
gcacuggccccg

SEQ ID NO: 1163238 - RNA, 13 nt, Mycobacterium bovis subsp bovis AF2122/97
gcacuggccccgg

SEQ ID NO: 1163239 - RNA, 21 nt, Mycobacterium bovis subsp bovis AF2122/97
gcacugguugggcgagaccgc

SEQ ID NO: 1163240 - RNA, 23 nt, Mycobacterium bovis subsp bovis AF2122/97
gcacugucgagguggucgacccg

SEQ ID NO: 1163241 - RNA, 22 nt, Mycobacterium bovis subsp bovis AF2122/97
gcacuggggucugauggcggcu

SEQ ID NO: 1163242 - RNA, 23 nt, Mycobacterium bovis subsp bovis AF2122/97
gcacugggugcgucgacccagcu

SEQ ID NO: 1163243 - RNA, 20 nt, Mycobacterium bovis subsp bovis AF2122/97
gcagcgcggccacccgcgac

SEQ ID NO: 1163244 - RNA, 20 nt, Mycobacterium bovis subsp bovis AF2122/97
gcagcgcggcuggggccccg

SEQ ID NO: 1163245 - RNA, 15 nt, Mycobacterium bovis subsp bovis AF2122/97
gcagcgcgggaucug

SEQ ID NO: 1163246 - RNA, 14 nt, Mycobacterium bovis subsp bovis AF2122/97
gcagcggcggaagg

SEQ ID NO: 1163247 - RNA, 20 nt, Mycobacterium bovis subsp bovis AF2122/97
gcagcggcgaagucuuucuc

SEQ ID NO: 1163248 - RNA, 12 nt, Mycobacterium bovis subsp bovis AF2122/97
gcagcggccagc

SEQ ID NO: 1163249 - RNA, 23 nt, Mycobacterium bovis subsp bovis AF2122/97
gcagcggccagcccagccgggag

SEQ ID NO: 1163250 - RNA, 18 nt, Mycobacterium bovis subsp bovis AF2122/97
gcagcggaccgcugccug

SEQ ID NO: 1163251 - RNA, 16 nt, Mycobacterium bovis subsp bovis AF2122/97
gcagcgcugcgaugga

SEQ ID NO: 1163252 - RNA, 12 nt, Mycobacterium bovis subsp bovis AF2122/97
gcagcgcuggcu

SEQ ID NO: 1163253 - RNA, 21 nt, Mycobacterium bovis subsp bovis AF2122/97
gcagcgucggugccaccacgc

SEQ ID NO: 1163254 - RNA, 13 nt, Mycobacterium bovis subsp bovis AF2122/97
gcagcgucuccuu

SEQ ID NO: 1163255 - RNA, 21 nt, Mycobacterium bovis subsp bovis AF2122/97
gcagcgguugaugcggccgcg

SEQ ID NO: 1163256 - RNA, 19 nt, Mycobacterium bovis subsp bovis AF2122/97
gcagcggguuugccgggcg

SEQ ID NO: 1163257 - RNA, 18 nt, Mycobacterium bovis subsp bovis AF2122/97
gcagcgggucgccgggcc

SEQ ID NO: 1163258 - RNA, 17 nt, Mycobacterium bovis subsp bovis AF2122/97
gcagcggugcagcccgc

SEQ ID NO: 1163259 - RNA, 14 nt, Mycobacterium bovis subsp bovis AF2122/97
gcagcgugagugca

SEQ ID NO: 1163260 - RNA, 14 nt, Mycobacterium bovis subsp bovis AF2122/97
gcagcugcccggcg

SEQ ID NO: 1163261 - RNA, 17 nt, Mycobacterium bovis subsp bovis AF2122/97
gcagcugccgcaccccc

SEQ ID NO: 1163262 - RNA, 22 nt, Mycobacterium bovis subsp bovis AF2122/97
gcagcugaaaauaggccgggca

SEQ ID NO: 1163263 - RNA, 13 nt, Mycobacterium bovis subsp bovis AF2122/97
gcagcugcaauag

SEQ ID NO: 1163264 - RNA, 14 nt, Mycobacterium bovis subsp bovis AF2122/97
gcagcugcucgguc

SEQ ID NO: 1163265 - RNA, 22 nt, Mycobacterium bovis subsp bovis AF2122/97
gcagcugcucggucaggcggcu

SEQ ID NO: 1163266 - RNA, 21 nt, Mycobacterium bovis subsp bovis AF2122/97
gcaggcgucccagccgaucac

SEQ ID NO: 1163267 - RNA, 21 nt, Mycobacterium bovis subsp bovis AF2122/97
gcaggcgugcuugaccgccug

SEQ ID NO: 1163268 - RNA, 23 nt, Mycobacterium bovis subsp bovis AF2122/97
gcaggcgugcuugaccgccugga

SEQ ID NO: 1163269 - RNA, 19 nt, Mycobacterium bovis subsp bovis AF2122/97
gcaggcuaaucagccaggc

SEQ ID NO: 1163270 - RNA, 17 nt, Mycobacterium bovis subsp bovis AF2122/97
gcaggcgaugcgccagg

SEQ ID NO: 1163271 - RNA, 17 nt, Mycobacterium bovis subsp bovis AF2122/97
gcaggcgcaagguggca

SEQ ID NO: 1163272 - RNA, 15 nt, Mycobacterium bovis subsp bovis AF2122/97
gcaggccuccaagcc

SEQ ID NO: 1163273 - RNA, 19 nt, Mycobacterium bovis subsp bovis AF2122/97
gcaggccucggcgccgccc

SEQ ID NO: 1163274 - RNA, 13 nt, Mycobacterium bovis subsp bovis AF2122/97
gcaggccuggcga

SEQ ID NO: 1163275 - RNA, 14 nt, Mycobacterium bovis subsp bovis AF2122/97
gcaggcgagcaguc

SEQ ID NO: 1163276 - RNA, 15 nt, Mycobacterium bovis subsp bovis AF2122/97
gcaggcgacggcucu

SEQ ID NO: 1163277 - RNA, 12 nt, Mycobacterium bovis subsp bovis AF2122/97
gcaggcccaccc

SEQ ID NO: 1163278 - RNA, 18 nt, Mycobacterium bovis subsp bovis AF2122/97
gcaggccccacuggugca

SEQ ID NO: 1163279 - RNA, 23 nt, Mycobacterium bovis subsp bovis AF2122/97
gcaggccagggucagcucgguga

SEQ ID NO: 1163280 - RNA, 18 nt, Mycobacterium bovis subsp bovis AF2122/97
gcaggcauggcgccguug

SEQ ID NO: 1163281 - RNA, 10 nt, Mycobacterium bovis subsp bovis AF2122/97
gcaggcaggu

SEQ ID NO: 1163282 - RNA, 23 nt, Mycobacterium bovis subsp bovis AF2122/97
gcaggcagugagggucccacggc

SEQ ID NO: 1163283 - RNA, 22 nt, Mycobacterium bovis subsp bovis AF2122/97
gcaggcagguuggccaccgccc

SEQ ID NO: 1163284 - RNA, 19 nt, Mycobacterium bovis subsp bovis AF2122/97
gcagcugccgcacccccuc

SEQ ID NO: 1163285 - RNA, 15 nt, Mycobacterium bovis subsp bovis AF2122/97
gcagcuuggccagcc

SEQ ID NO: 1163286 - RNA, 16 nt, Mycobacterium bovis subsp bovis AF2122/97
gcagcuuggccagcca

SEQ ID NO: 1163287 - RNA, 18 nt, Mycobacterium bovis subsp bovis AF2122/97
gcagcuuggccagccacu

SEQ ID NO: 1163288 - RNA, 20 nt, Mycobacterium bovis subsp bovis AF2122/97
gcaggaaaaccccggccacc

SEQ ID NO: 1163289 - RNA, 19 nt, Mycobacterium bovis subsp bovis AF2122/97
gcagcuuguuuuccaccag

SEQ ID NO: 1163290 - RNA, 20 nt, Mycobacterium bovis subsp bovis AF2122/97
gcagcuuuaaucguggcacu

SEQ ID NO: 1163291 - RNA, 18 nt, Mycobacterium bovis subsp bovis AF2122/97
gcagugccgcacccagac

SEQ ID NO: 1163292 - RNA, 15 nt, Mycobacterium bovis subsp bovis AF2122/97
gcagugcaggcggcc

SEQ ID NO: 1163293 - RNA, 15 nt, Mycobacterium bovis subsp bovis AF2122/97
gcaguuucaccuugc

SEQ ID NO: 1163294 - RNA, 17 nt, Mycobacterium bovis subsp bovis AF2122/97
gcaguggcagcccgucg

SEQ ID NO: 1163295 - RNA, 19 nt, Mycobacterium bovis subsp bovis AF2122/97
gcauacgcccacuccagca

SEQ ID NO: 1163296 - RNA, 14 nt, Mycobacterium bovis subsp bovis AF2122/97
gcauacgcggcuuu

SEQ ID NO: 1163297 - RNA, 15 nt, Mycobacterium bovis subsp bovis AF2122/97
gcauauccgcaggcc

SEQ ID NO: 1163298 - RNA, 13 nt, Mycobacterium bovis subsp bovis AF2122/97
gcaggugccaccu

SEQ ID NO: 1163299 - RNA, 19 nt, Mycobacterium bovis subsp bovis AF2122/97
gcaggugaacaacagcgcu

SEQ ID NO: 1163300 - RNA, 15 nt, Mycobacterium bovis subsp bovis AF2122/97
gcaggugacauguug

SEQ ID NO: 1163301 - RNA, 16 nt, Mycobacterium bovis subsp bovis AF2122/97
gcaggugacgaucagg

SEQ ID NO: 1163302 - RNA, 17 nt, Mycobacterium bovis subsp bovis AF2122/97
gcagguuggucaccacc

SEQ ID NO: 1163303 - RNA, 20 nt, Mycobacterium bovis subsp bovis AF2122/97
gcagguuggucaccaccugg

SEQ ID NO: 1163304 - RNA, 20 nt, Mycobacterium bovis subsp bovis AF2122/97
gcagggcauugcggcccgcg

SEQ ID NO: 1163305 - RNA, 19 nt, Mycobacterium bovis subsp bovis AF2122/97
gcagggcauugcggcccgc

SEQ ID NO: 1163306 - RNA, 21 nt, Mycobacterium bovis subsp bovis AF2122/97
gcagggaauagcggcgcccgc

SEQ ID NO: 1163307 - RNA, 22 nt, Mycobacterium bovis subsp bovis AF2122/97
gcagggaucaccccggccggcu

SEQ ID NO: 1163308 - RNA, 14 nt, Mycobacterium bovis subsp bovis AF2122/97
gcaguagcuguggc

SEQ ID NO: 1163309 - RNA, 13 nt, Mycobacterium bovis subsp bovis AF2122/97
gcaguagcugcuc

SEQ ID NO: 1163310 - RNA, 22 nt, Mycobacterium bovis subsp bovis AF2122/97
gcaguagcugcucaucgcgccc

SEQ ID NO: 1163311 - RNA, 23 nt, Mycobacterium bovis subsp bovis AF2122/97
gcaguagaucggaucgaagucca

SEQ ID NO: 1163312 - RNA, 13 nt, Mycobacterium bovis subsp bovis AF2122/97
gcaguagccgacc

SEQ ID NO: 1163313 - RNA, 19 nt, Mycobacterium bovis subsp bovis AF2122/97
gcagucgauuucggcggcg

SEQ ID NO: 1163314 - RNA, 13 nt, Mycobacterium bovis subsp bovis AF2122/97
gcagucgcggcag

SEQ ID NO: 1163315 - RNA, 14 nt, Mycobacterium bovis subsp bovis AF2122/97
gcagucgggcagcg

SEQ ID NO: 1163316 - RNA, 20 nt, Mycobacterium bovis subsp bovis AF2122/97
gcagucccaguucguuggug

SEQ ID NO: 1163317 - RNA, 17 nt, Mycobacterium bovis subsp bovis AF2122/97
gcagucauguccauagc

SEQ ID NO: 1163318 - RNA, 14 nt, Mycobacterium bovis subsp bovis AF2122/97
gcagucaacucccg

SEQ ID NO: 1163319 - RNA, 21 nt, Mycobacterium bovis subsp bovis AF2122/97
gcagucaggccuagcgcggcg

SEQ ID NO: 1163320 - RNA, 12 nt, Mycobacterium bovis subsp bovis AF2122/97
gcaucagggucg

SEQ ID NO: 1163321 - RNA, 16 nt, Mycobacterium bovis subsp bovis AF2122/97
gcaucagcgccagcga

SEQ ID NO: 1163322 - RNA, 14 nt, Mycobacterium bovis subsp bovis AF2122/97
gcaucagcggcgcc

SEQ ID NO: 1163323 - RNA, 20 nt, Mycobacterium bovis subsp bovis AF2122/97
gcaucagauucgcgcuggcc

SEQ ID NO: 1163324 - RNA, 16 nt, Mycobacterium bovis subsp bovis AF2122/97
gcauauccgcaggccc

SEQ ID NO: 1163325 - RNA, 19 nt, Mycobacterium bovis subsp bovis AF2122/97
gcauccgguucgccgccgu

SEQ ID NO: 1163326 - RNA, 16 nt, Mycobacterium bovis subsp bovis AF2122/97
gcaucgacgaacccca

SEQ ID NO: 1163327 - RNA, 17 nt, Mycobacterium bovis subsp bovis AF2122/97
gcaucgacguagcgaag

SEQ ID NO: 1163328 - RNA, 23 nt, Mycobacterium bovis subsp bovis AF2122/97
gcaucgauaauggccgaguccgg

SEQ ID NO: 1163329 - RNA, 17 nt, Mycobacterium bovis subsp bovis AF2122/97
gcaucgagcagcccggg

SEQ ID NO: 1163330 - RNA, 21 nt, Mycobacterium bovis subsp bovis AF2122/97
gcaucgagcaguggccgccgg

SEQ ID NO: 1163331 - RNA, 22 nt, Mycobacterium bovis subsp bovis AF2122/97
gcaucgaauuccagccagccgc

SEQ ID NO: 1163332 - RNA, 20 nt, Mycobacterium bovis subsp bovis AF2122/97
gcaucgaacuucgauucugg

SEQ ID NO: 1163333 - RNA, 22 nt, Mycobacterium bovis subsp bovis AF2122/97
gcaucgaacuucgauucuggcc

SEQ ID NO: 1163334 - RNA, 15 nt, Mycobacterium bovis subsp bovis AF2122/97
gcauccgccccgccc

SEQ ID NO: 1163335 - RNA, 19 nt, Mycobacterium bovis subsp bovis AF2122/97
gcauccagaaguaggcgac

SEQ ID NO: 1163336 - RNA, 17 nt, Mycobacterium bovis subsp bovis AF2122/97
gcauccaaaaucgccug

SEQ ID NO: 1163337 - RNA, 15 nt, Mycobacterium bovis subsp bovis AF2122/97
gcauccagcgcgcgc

SEQ ID NO: 1163338 - RNA, 22 nt, Mycobacterium bovis subsp bovis AF2122/97
gcaaugucggcagggcccccag

SEQ ID NO: 1163339 - RNA, 13 nt, Mycobacterium bovis subsp bovis AF2122/97
gcaauggcggccu

SEQ ID NO: 1163340 - RNA, 14 nt, Mycobacterium bovis subsp bovis AF2122/97
gcaauggcggccuu

SEQ ID NO: 1163341 - RNA, 16 nt, Mycobacterium bovis subsp bovis AF2122/97
gcaaugguucgugcac

SEQ ID NO: 1163342 - RNA, 20 nt, Mycobacterium bovis subsp bovis AF2122/97
gcaauuggcguagcaaccca

SEQ ID NO: 1163343 - RNA, 19 nt, Mycobacterium bovis subsp bovis AF2122/97
gcaauuccguuaggcucca

SEQ ID NO: 1163344 - RNA, 18 nt, Mycobacterium bovis subsp bovis AF2122/97
gcacaauacggucagcag

SEQ ID NO: 1163345 - RNA, 20 nt, Mycobacterium bovis subsp bovis AF2122/97
gcacaauacggucagcagac

SEQ ID NO: 1163346 - RNA, 21 nt, Mycobacterium bovis subsp bovis AF2122/97
gcacaauacggucagcagacu

SEQ ID NO: 1163347 - RNA, 17 nt, Mycobacterium bovis subsp bovis AF2122/97
gcacaaguucuucgaca

SEQ ID NO: 1163348 - RNA, 17 nt, Mycobacterium bovis subsp bovis AF2122/97
gcacaauacggucagca

SEQ ID NO: 1163349 - RNA, 20 nt, Mycobacterium bovis subsp bovis AF2122/97
gcaauugcucguagcccagg

SEQ ID NO: 1163350 - RNA, 19 nt, Mycobacterium bovis subsp bovis AF2122/97
gcacacgucgggaguaagg

SEQ ID NO: 1163351 - RNA, 20 nt, Mycobacterium bovis subsp bovis AF2122/97
gcacacuccuagccaacgag

SEQ ID NO: 1163352 - RNA, 14 nt, Mycobacterium bovis subsp bovis AF2122/97
gcacaccaacaccg

SEQ ID NO: 1163353 - RNA, 12 nt, Mycobacterium bovis subsp bovis AF2122/97
gcacacagaccg

SEQ ID NO: 1163354 - RNA, 22 nt, Mycobacterium bovis subsp bovis AF2122/97
gcacacagaggucggucagcca

SEQ ID NO: 1163355 - RNA, 15 nt, Mycobacterium bovis subsp bovis AF2122/97
gcacagugcggcccc

SEQ ID NO: 1163356 - RNA, 18 nt, Mycobacterium bovis subsp bovis AF2122/97
gcaccaccggccccaccg

SEQ ID NO: 1163357 - RNA, 19 nt, Mycobacterium bovis subsp bovis AF2122/97
gcaccacccuugccgauga

SEQ ID NO: 1163358 - RNA, 15 nt, Mycobacterium bovis subsp bovis AF2122/97
gcaccaccgcgaccu

SEQ ID NO: 1163359 - RNA, 14 nt, Mycobacterium bovis subsp bovis AF2122/97
gcaccacggccagc

SEQ ID NO: 1163360 - RNA, 23 nt, Mycobacterium bovis subsp bovis AF2122/97
gcaccacgucgaccaauaccagu

SEQ ID NO: 1163361 - RNA, 22 nt, Mycobacterium bovis subsp bovis AF2122/97
gcaccacggcggccaccugcug

SEQ ID NO: 1163362 - RNA, 17 nt, Mycobacterium bovis subsp bovis AF2122/97
gcaccacgagcagccga

SEQ ID NO: 1163363 - RNA, 21 nt, Mycobacterium bovis subsp bovis AF2122/97
gcaccaccccgaggccgaccu

SEQ ID NO: 1163364 - RNA, 16 nt, Mycobacterium bovis subsp bovis AF2122/97
gcaccaccugggcggc

SEQ ID NO: 1163365 - RNA, 13 nt, Mycobacterium bovis subsp bovis AF2122/97
gcaccaaccaccg

SEQ ID NO: 1163366 - RNA, 16 nt, Mycobacterium bovis subsp bovis AF2122/97
gcaccaacaccagcgc

SEQ ID NO: 1163367 - RNA, 15 nt, Mycobacterium bovis subsp bovis AF2122/97
gcaccaaggccgccu

SEQ ID NO: 1163368 - RNA, 15 nt, Mycobacterium bovis subsp bovis AF2122/97
gcaccaagacgccac

SEQ ID NO: 1163369 - RNA, 21 nt, Mycobacterium bovis subsp bovis AF2122/97
gcacauucugcagcgucuccu

SEQ ID NO: 1163370 - RNA, 21 nt, Mycobacterium bovis subsp bovis AF2122/97
gcacauugguguccaccaccg

SEQ ID NO: 1163371 - RNA, 19 nt, Mycobacterium bovis subsp bovis AF2122/97
gcaagccggacagaucaac

SEQ ID NO: 1163372 - RNA, 15 nt, Mycobacterium bovis subsp bovis AF2122/97
gcaagccgccggugc

SEQ ID NO: 1163373 - RNA, 13 nt, Mycobacterium bovis subsp bovis AF2122/97
gcaagcagcgcga

SEQ ID NO: 1163374 - RNA, 22 nt, Mycobacterium bovis subsp bovis AF2122/97
gcaagcccaaaaagaccgccgc

SEQ ID NO: 1163375 - RNA, 16 nt, Mycobacterium bovis subsp bovis AF2122/97
gcaagguugccaacgc

SEQ ID NO: 1163376 - RNA, 21 nt, Mycobacterium bovis subsp bovis AF2122/97
gcaagguugccaacgccuuga

SEQ ID NO: 1163377 - RNA, 22 nt, Mycobacterium bovis subsp bovis AF2122/97
gcaaggucgcugcuugcgggcu

SEQ ID NO: 1163378 - RNA, 17 nt, Mycobacterium bovis subsp bovis AF2122/97
gcaaggguuugcgggcg

SEQ ID NO: 1163379 - RNA, 18 nt, Mycobacterium bovis subsp bovis AF2122/97
gcaaggguggggccggcg

SEQ ID NO: 1163380 - RNA, 12 nt, Mycobacterium bovis subsp bovis AF2122/97
gcaagcggaugu

SEQ ID NO: 1163381 - RNA, 13 nt, Mycobacterium bovis subsp bovis AF2122/97
gcaagcaaauucu

SEQ ID NO: 1163382 - RNA, 21 nt, Mycobacterium bovis subsp bovis AF2122/97
gcaagauuauggcgagcgcgc

SEQ ID NO: 1163383 - RNA, 14 nt, Mycobacterium bovis subsp bovis AF2122/97
gcaagaacccggua

SEQ ID NO: 1163384 - RNA, 23 nt, Mycobacterium bovis subsp bovis AF2122/97
gcaacuucuucagcagcggcgga

SEQ ID NO: 1163385 - RNA, 15 nt, Mycobacterium bovis subsp bovis AF2122/97
gcaaugcuuccagca

SEQ ID NO: 1163386 - RNA, 12 nt, Mycobacterium bovis subsp bovis AF2122/97
gcaauggccagc

SEQ ID NO: 1163387 - RNA, 13 nt, Mycobacterium bovis subsp bovis AF2122/97
gcaaucacaucaa

SEQ ID NO: 1163388 - RNA, 14 nt, Mycobacterium bovis subsp bovis AF2122/97
gcaaucucccgaau

SEQ ID NO: 1163389 - RNA, 20 nt, Mycobacterium bovis subsp bovis AF2122/97
gcaauaucuuuagcgcgugc

SEQ ID NO: 1163390 - RNA, 19 nt, Mycobacterium bovis subsp bovis AF2122/97
gcaauauccuccagcaggu

SEQ ID NO: 1163391 - RNA, 22 nt, Mycobacterium bovis subsp bovis AF2122/97
gcaagugucuccggcaacagca

SEQ ID NO: 1163392 - RNA, 14 nt, Mycobacterium bovis subsp bovis AF2122/97
gcaauagaccgcag

SEQ ID NO: 1163393 - RNA, 15 nt, Mycobacterium bovis subsp bovis AF2122/97
gcaagucauccaggu

SEQ ID NO: 1163394 - RNA, 16 nt, Mycobacterium bovis subsp bovis AF2122/97
gcaaguccugcagcug

SEQ ID NO: 1163395 - RNA, 19 nt, Mycobacterium bovis subsp bovis AF2122/97
gcaagucgacgccgcagcg

SEQ ID NO: 1163396 - RNA, 20 nt, Mycobacterium bovis subsp bovis AF2122/97
gcaagucgcccagccgagcg

SEQ ID NO: 1163397 - RNA, 14 nt, Mycobacterium bovis subsp bovis AF2122/97
gcacccugcgggcc

SEQ ID NO: 1163398 - RNA, 15 nt, Mycobacterium bovis subsp bovis AF2122/97
gcacccugcgggccg

SEQ ID NO: 1163399 - RNA, 16 nt, Mycobacterium bovis subsp bovis AF2122/97
gcacccugcgugcggc

SEQ ID NO: 1163400 - RNA, 12 nt, Mycobacterium bovis subsp bovis AF2122/97
gcaccgaugccg

SEQ ID NO: 1163401 - RNA, 21 nt, Mycobacterium bovis subsp bovis AF2122/97
gcaccgaugccgaagcccccg

SEQ ID NO: 1163402 - RNA, 23 nt, Mycobacterium bovis subsp bovis AF2122/97
gcaccgaugccgaagcccccgac

SEQ ID NO: 1163403 - RNA, 15 nt, Mycobacterium bovis subsp bovis AF2122/97
gcaccgauggcgcac

SEQ ID NO: 1163404 - RNA, 22 nt, Mycobacterium bovis subsp bovis AF2122/97
gcaccgccacccugaccaacau

SEQ ID NO: 1163405 - RNA, 12 nt, Mycobacterium bovis subsp bovis AF2122/97
gcaccgccaggu

SEQ ID NO: 1163406 - RNA, 15 nt, Mycobacterium bovis subsp bovis AF2122/97
gcaccgccagccacc

SEQ ID NO: 1163407 - RNA, 17 nt, Mycobacterium bovis subsp bovis AF2122/97
gcaccgauggcgcaccg

SEQ ID NO: 1163408 - RNA, 19 nt, Mycobacterium bovis subsp bovis AF2122/97
gcaccgauuccuugaugcc

SEQ ID NO: 1163409 - RNA, 22 nt, Mycobacterium bovis subsp bovis AF2122/97
gcaccgcauuguugaagaaagc

SEQ ID NO: 1163410 - RNA, 16 nt, Mycobacterium bovis subsp bovis AF2122/97
gcaccgccgguggcgc

SEQ ID NO: 1163411 - RNA, 21 nt, Mycobacterium bovis subsp bovis AF2122/97
gcaccggccgaaggcgcugcc

SEQ ID NO: 1163412 - RNA, 15 nt, Mycobacterium bovis subsp bovis AF2122/97
gcaccgccggcgcca

SEQ ID NO: 1163413 - RNA, 16 nt, Mycobacterium bovis subsp bovis AF2122/97
gcaccgccggcgccac

SEQ ID NO: 1163414 - RNA, 17 nt, Mycobacterium bovis subsp bovis AF2122/97
gcaccgccggcgccacc

SEQ ID NO: 1163415 - RNA, 19 nt, Mycobacterium bovis subsp bovis AF2122/97
gcaccgccggcgcccaggc

SEQ ID NO: 1163416 - RNA, 20 nt, Mycobacterium bovis subsp bovis AF2122/97
gcaccgccggcgcccaggcc

SEQ ID NO: 1163417 - RNA, 22 nt, Mycobacterium bovis subsp bovis AF2122/97
gcaccggccgugccgccgacac

SEQ ID NO: 1163418 - RNA, 16 nt, Mycobacterium bovis subsp bovis AF2122/97
gcaccgccgcccccgc

SEQ ID NO: 1163419 - RNA, 21 nt, Mycobacterium bovis subsp bovis AF2122/97
gcaccgccgcccccgccggcc

SEQ ID NO: 1163420 - RNA, 16 nt, Mycobacterium bovis subsp bovis AF2122/97
gcaccgccgcgccggc

SEQ ID NO: 1163421 - RNA, 22 nt, Mycobacterium bovis subsp bovis AF2122/97
gcaccgccggcaauaccgccag

SEQ ID NO: 1163422 - RNA, 22 nt, Mycobacterium bovis subsp bovis AF2122/97
gcaccgccgcccccgccggccg

SEQ ID NO: 1163423 - RNA, 20 nt, Mycobacterium bovis subsp bovis AF2122/97
gcaccgccgcgccggcggcc

SEQ ID NO: 1163424 - RNA, 23 nt, Mycobacterium bovis subsp bovis AF2122/97
gcaccgccgcgccggcggccacc

SEQ ID NO: 1163425 - RNA, 23 nt, Mycobacterium bovis subsp bovis AF2122/97
gcaccgcccccgucggccuuggg

SEQ ID NO: 1163426 - RNA, 15 nt, Mycobacterium bovis subsp bovis AF2122/97
gcaccgccccgccgu

SEQ ID NO: 1163427 - RNA, 15 nt, Mycobacterium bovis subsp bovis AF2122/97
gcaccagggcgcaac

SEQ ID NO: 1163428 - RNA, 19 nt, Mycobacterium bovis subsp bovis AF2122/97
gcacccggcuucgccgcgc

SEQ ID NO: 1163429 - RNA, 21 nt, Mycobacterium bovis subsp bovis AF2122/97
gcacccggcuucgccgcgcuu

SEQ ID NO: 1163430 - RNA, 19 nt, Mycobacterium bovis subsp bovis AF2122/97
gcacccggugagaagaagc

SEQ ID NO: 1163431 - RNA, 22 nt, Mycobacterium bovis subsp bovis AF2122/97
gcacccgggugcgcucuucucc

SEQ ID NO: 1163432 - RNA, 19 nt, Mycobacterium bovis subsp bovis AF2122/97
gcacccggggugcccggcc

SEQ ID NO: 1163433 - RNA, 14 nt, Mycobacterium bovis subsp bovis AF2122/97
gcaccagggccucg

SEQ ID NO: 1163434 - RNA, 23 nt, Mycobacterium bovis subsp bovis AF2122/97
gcacccggggugcccggccgcca

SEQ ID NO: 1163435 - RNA, 13 nt, Mycobacterium bovis subsp bovis AF2122/97
gcacccucaggca

SEQ ID NO: 1163436 - RNA, 23 nt, Mycobacterium bovis subsp bovis AF2122/97
gcacccucaggcaaucgcgggcg

SEQ ID NO: 1163437 - RNA, 21 nt, Mycobacterium bovis subsp bovis AF2122/97
gcacccguucgugagcggcca

SEQ ID NO: 1163438 - RNA, 19 nt, Mycobacterium bovis subsp bovis AF2122/97
gcaccagcugucgggcagc

SEQ ID NO: 1163439 - RNA, 22 nt, Mycobacterium bovis subsp bovis AF2122/97
gcaccagaaaugguucgcacac

SEQ ID NO: 1163440 - RNA, 16 nt, Mycobacterium bovis subsp bovis AF2122/97
gcaccagaucagguga

SEQ ID NO: 1163441 - RNA, 13 nt, Mycobacterium bovis subsp bovis AF2122/97
gcaccagaucagg

SEQ ID NO: 1163442 - RNA, 23 nt, Mycobacterium bovis subsp bovis AF2122/97
gcacgcccucgacgcgcucgggc

SEQ ID NO: 1163443 - RNA, 15 nt, Mycobacterium bovis subsp bovis AF2122/97
gcacgcccaggcgac

SEQ ID NO: 1163444 - RNA, 18 nt, Mycobacterium bovis subsp bovis AF2122/97
gcacgccacuggacucuu

SEQ ID NO: 1163445 - RNA, 16 nt, Mycobacterium bovis subsp bovis AF2122/97
gcacgagugcggcgac

SEQ ID NO: 1163446 - RNA, 21 nt, Mycobacterium bovis subsp bovis AF2122/97
gcacgacugugcgccgcagcc

SEQ ID NO: 1163447 - RNA, 20 nt, Mycobacterium bovis subsp bovis AF2122/97
gcacgacgcgacacgccggc

SEQ ID NO: 1163448 - RNA, 16 nt, Mycobacterium bovis subsp bovis AF2122/97
gcacgacccgcugguc

SEQ ID NO: 1163449 - RNA, 13 nt, Mycobacterium bovis subsp bovis AF2122/97
gcacgaccagcug

SEQ ID NO: 1163450 - RNA, 15 nt, Mycobacterium bovis subsp bovis AF2122/97
gcacgaccagcugag

SEQ ID NO: 1163451 - RNA, 15 nt, Mycobacterium bovis subsp bovis AF2122/97
gcacgacgccggccu

SEQ ID NO: 1163452 - RNA, 14 nt, Mycobacterium bovis subsp bovis AF2122/97
gcacgaccugguua

SEQ ID NO: 1163453 - RNA, 14 nt, Mycobacterium bovis subsp bovis AF2122/97
gcaccuucuccacc

SEQ ID NO: 1163454 - RNA, 21 nt, Mycobacterium bovis subsp bovis AF2122/97
gcaccuuggccggccccgccc

SEQ ID NO: 1163455 - RNA, 17 nt, Mycobacterium bovis subsp bovis AF2122/97
gcaccggcugcggggcg

SEQ ID NO: 1163456 - RNA, 22 nt, Mycobacterium bovis subsp bovis AF2122/97
gcaccggcggucugcagugcag

SEQ ID NO: 1163457 - RNA, 20 nt, Mycobacterium bovis subsp bovis AF2122/97
gcaccggcgucggcgcggcc

SEQ ID NO: 1163458 - RNA, 17 nt, Mycobacterium bovis subsp bovis AF2122/97
gcaccggcuggcccagc

SEQ ID NO: 1163459 - RNA, 14 nt, Mycobacterium bovis subsp bovis AF2122/97
gcaccgggcucaga

SEQ ID NO: 1163460 - RNA, 15 nt, Mycobacterium bovis subsp bovis AF2122/97
gcaccggggcugccc

SEQ ID NO: 1163461 - RNA, 20 nt, Mycobacterium bovis subsp bovis AF2122/97
gcaccggggcugcccgcgga

SEQ ID NO: 1163462 - RNA, 20 nt, Mycobacterium bovis subsp bovis AF2122/97
gcaccggguugagccgccgc

SEQ ID NO: 1163463 - RNA, 19 nt, Mycobacterium bovis subsp bovis AF2122/97
gcaccggucuuggugcucu

SEQ ID NO: 1163464 - RNA, 19 nt, Mycobacterium bovis subsp bovis AF2122/97
gcaccggugcccaccaccg

SEQ ID NO: 1163465 - RNA, 21 nt, Mycobacterium bovis subsp bovis AF2122/97
gcaccguagagcaugccgccc

SEQ ID NO: 1163466 - RNA, 17 nt, Mycobacterium bovis subsp bovis AF2122/97
gcaccguagccgcugca

SEQ ID NO: 1163467 - RNA, 20 nt, Mycobacterium bovis subsp bovis AF2122/97
gcaccgguuuucgccggcuc

SEQ ID NO: 1163468 - RNA, 14 nt, Mycobacterium bovis subsp bovis AF2122/97
gcaccgucccagug

SEQ ID NO: 1163469 - RNA, 18 nt, Mycobacterium bovis subsp bovis AF2122/97
gcaccucgaaggcccgcu

SEQ ID NO: 1163470 - RNA, 13 nt, Mycobacterium bovis subsp bovis AF2122/97
gcaccuccguaac

SEQ ID NO: 1163471 - RNA, 14 nt, Mycobacterium bovis subsp bovis AF2122/97
gcaccuccgacggc

SEQ ID NO: 1163472 - RNA, 15 nt, Mycobacterium bovis subsp bovis AF2122/97
gcaccuccagcacca

SEQ ID NO: 1163473 - RNA, 17 nt, Mycobacterium bovis subsp bovis AF2122/97
gcaccgucucgcaccgc

SEQ ID NO: 1163474 - RNA, 17 nt, Mycobacterium bovis subsp bovis AF2122/97
gcaccgugccgacgccc

SEQ ID NO: 1163475 - RNA, 23 nt, Mycobacterium bovis subsp bovis AF2122/97
gcaccgugacccugauggggccu

SEQ ID NO: 1163476 - RNA, 15 nt, Mycobacterium bovis subsp bovis AF2122/97
gcaccgugccgacgc

SEQ ID NO: 1163477 - RNA, 14 nt, Mycobacterium bovis subsp bovis AF2122/97
gcaccucgcccucc

SEQ ID NO: 1163478 - RNA, 23 nt, Mycobacterium bovis subsp bovis AF2122/97
gcaccucgucccagcgguagccg

SEQ ID NO: 1163479 - RNA, 13 nt, Mycobacterium bovis subsp bovis AF2122/97
gcacggcacccac

SEQ ID NO: 1163480 - RNA, 19 nt, Mycobacterium bovis subsp bovis AF2122/97
gcacggcagacacgcugca

SEQ ID NO: 1163481 - RNA, 23 nt, Mycobacterium bovis subsp bovis AF2122/97
gcacggccaugaucacaccgcug

SEQ ID NO: 1163482 - RNA, 12 nt, Mycobacterium bovis subsp bovis AF2122/97
gcacggccgggu

SEQ ID NO: 1163483 - RNA, 14 nt, Mycobacterium bovis subsp bovis AF2122/97
gcacggccgggucg

SEQ ID NO: 1163484 - RNA, 14 nt, Mycobacterium bovis subsp bovis AF2122/97
gcacggccgggacg

SEQ ID NO: 1163485 - RNA, 13 nt, Mycobacterium bovis subsp bovis AF2122/97
gcacggccgagca

SEQ ID NO: 1163486 - RNA, 17 nt, Mycobacterium bovis subsp bovis AF2122/97
gcacggaaggcccggcg

SEQ ID NO: 1163487 - RNA, 22 nt, Mycobacterium bovis subsp bovis AF2122/97
gcacggaaggcccggcgcggcc

SEQ ID NO: 1163488 - RNA, 20 nt, Mycobacterium bovis subsp bovis AF2122/97
gcacggaccaucgccaggcc

SEQ ID NO: 1163489 - RNA, 20 nt, Mycobacterium bovis subsp bovis AF2122/97
gcacggaaguacuccaccca

SEQ ID NO: 1163490 - RNA, 14 nt, Mycobacterium bovis subsp bovis AF2122/97
gcacggagccgccg

SEQ ID NO: 1163491 - RNA, 17 nt, Mycobacterium bovis subsp bovis AF2122/97
gcacggagccgccggcg

SEQ ID NO: 1163492 - RNA, 18 nt, Mycobacterium bovis subsp bovis AF2122/97
gcacggcaaccagcgagc

SEQ ID NO: 1163493 - RNA, 19 nt, Mycobacterium bovis subsp bovis AF2122/97
gcacggcaaccagcgagcc

SEQ ID NO: 1163494 - RNA, 14 nt, Mycobacterium bovis subsp bovis AF2122/97
gcacgcuggcgggc

SEQ ID NO: 1163495 - RNA, 19 nt, Mycobacterium bovis subsp bovis AF2122/97
gcacgcugaguccccaggu

SEQ ID NO: 1163496 - RNA, 23 nt, Mycobacterium bovis subsp bovis AF2122/97
gcacgcugaguccccaggugggc

SEQ ID NO: 1163497 - RNA, 15 nt, Mycobacterium bovis subsp bovis AF2122/97
gcacgccgccggccg

SEQ ID NO: 1163498 - RNA, 17 nt, Mycobacterium bovis subsp bovis AF2122/97
gcacgccggcaugccag

SEQ ID NO: 1163499 - RNA, 19 nt, Mycobacterium bovis subsp bovis AF2122/97
gcacgcucggcggggaccg

SEQ ID NO: 1163500 - RNA, 18 nt, Mycobacterium bovis subsp bovis AF2122/97
gcacgcucugcgccacag

SEQ ID NO: 1163501 - RNA, 15 nt, Mycobacterium bovis subsp bovis AF2122/97
gcacgcuagccgaca

SEQ ID NO: 1163502 - RNA, 18 nt, Mycobacterium bovis subsp bovis AF2122/97
gcacgcuagccgacagcu

SEQ ID NO: 1163503 - RNA, 18 nt, Mycobacterium bovis subsp bovis AF2122/97
gcacgucaucggcuggcc

SEQ ID NO: 1163504 - RNA, 22 nt, Mycobacterium bovis subsp bovis AF2122/97
gcacgucggcccauaacagcug

SEQ ID NO: 1163505 - RNA, 23 nt, Mycobacterium bovis subsp bovis AF2122/97
gcacgucggcccauaacagcugg

SEQ ID NO: 1163506 - RNA, 19 nt, Mycobacterium bovis subsp bovis AF2122/97
gcacgucgaccucggcaac

SEQ ID NO: 1163507 - RNA, 18 nt, Mycobacterium bovis subsp bovis AF2122/97
gcacguagacggugucac

SEQ ID NO: 1163508 - RNA, 14 nt, Mycobacterium bovis subsp bovis AF2122/97
gcacgguggcaaug

SEQ ID NO: 1163509 - RNA, 14 nt, Mycobacterium bovis subsp bovis AF2122/97
gcacguaacccagu

SEQ ID NO: 1163510 - RNA, 14 nt, Mycobacterium bovis subsp bovis AF2122/97
gcacgguuggcgcu

SEQ ID NO: 1163511 - RNA, 16 nt, Mycobacterium bovis subsp bovis AF2122/97
gcacgguuggcgcuca

SEQ ID NO: 1163512 - RNA, 19 nt, Mycobacterium bovis subsp bovis AF2122/97
gcacgguguacgcccgcuc

SEQ ID NO: 1163513 - RNA, 17 nt, Mycobacterium bovis subsp bovis AF2122/97
gcacgguugccgucagg

SEQ ID NO: 1163514 - RNA, 15 nt, Mycobacterium bovis subsp bovis AF2122/97
gcacggugaugagga

SEQ ID NO: 1163515 - RNA, 13 nt, Mycobacterium bovis subsp bovis AF2122/97
gcacgguggcuuc

SEQ ID NO: 1163516 - RNA, 19 nt, Mycobacterium bovis subsp bovis AF2122/97
gcacggguagcguccaggu

SEQ ID NO: 1163517 - RNA, 15 nt, Mycobacterium bovis subsp bovis AF2122/97
gcacggcgacgccag

SEQ ID NO: 1163518 - RNA, 15 nt, Mycobacterium bovis subsp bovis AF2122/97
gcacggcgcggcgga

SEQ ID NO: 1163519 - RNA, 15 nt, Mycobacterium bovis subsp bovis AF2122/97
gcacggcggccacgu

SEQ ID NO: 1163520 - RNA, 17 nt, Mycobacterium bovis subsp bovis AF2122/97
gcacggcgucggccacc

SEQ ID NO: 1163521 - RNA, 12 nt, Mycobacterium bovis subsp bovis AF2122/97
gcacgggcggcc

SEQ ID NO: 1163522 - RNA, 15 nt, Mycobacterium bovis subsp bovis AF2122/97
gcacgggcggccaug

SEQ ID NO: 1163523 - RNA, 18 nt, Mycobacterium bovis subsp bovis AF2122/97
gcacgggcggccauggca

SEQ ID NO: 1163524 - RNA, 14 nt, Mycobacterium bovis subsp bovis AF2122/97
gcacuggcccccac

SEQ ID NO: 1163525 - RNA, 15 nt, Mycobacterium bovis subsp bovis AF2122/97
gcacugcggcagcga

SEQ ID NO: 1163526 - RNA, 17 nt, Mycobacterium bovis subsp bovis AF2122/97
gcacugcgccggccggc

SEQ ID NO: 1163527 - RNA, 14 nt, Mycobacterium bovis subsp bovis AF2122/97
gcacugcgaacccu

SEQ ID NO: 1163528 - RNA, 16 nt, Mycobacterium bovis subsp bovis AF2122/97
gcacugcgaacccugc

SEQ ID NO: 1163529 - RNA, 19 nt, Mycobacterium bovis subsp bovis AF2122/97
gcacugcgaacccugcgca

SEQ ID NO: 1163530 - RNA, 17 nt, Mycobacterium bovis subsp bovis AF2122/97
gcacugcccagcagacc

SEQ ID NO: 1163531 - RNA, 12 nt, Mycobacterium bovis subsp bovis AF2122/97
gcacugccggca

SEQ ID NO: 1163532 - RNA, 16 nt, Mycobacterium bovis subsp bovis AF2122/97
gcacugccgggugggc

SEQ ID NO: 1163533 - RNA, 12 nt, Mycobacterium bovis subsp bovis AF2122/97
gcacucgaccag

SEQ ID NO: 1163534 - RNA, 19 nt, Mycobacterium bovis subsp bovis AF2122/97
gcacucgggauucggcagc

SEQ ID NO: 1163535 - RNA, 18 nt, Mycobacterium bovis subsp bovis AF2122/97
gcacuccggagcccacac

SEQ ID NO: 1163536 - RNA, 19 nt, Mycobacterium bovis subsp bovis AF2122/97
gcacuccaagucacagcuc

SEQ ID NO: 1163537 - RNA, 17 nt, Mycobacterium bovis subsp bovis AF2122/97
gcacucccggaguggcc

SEQ ID NO: 1163538 - RNA, 20 nt, Mycobacterium bovis subsp bovis AF2122/97
gcacucccggcucggccagc

SEQ ID NO: 1163539 - RNA, 13 nt, Mycobacterium bovis subsp bovis AF2122/97
gcacuccagcggc

SEQ ID NO: 1163540 - RNA, 16 nt, Mycobacterium bovis subsp bovis AF2122/97
gcacugaccgcggcug

SEQ ID NO: 1163541 - RNA, 23 nt, Mycobacterium bovis subsp bovis AF2122/97
gcacuaccccacaagcgauggca

SEQ ID NO: 1163542 - RNA, 23 nt, Mycobacterium bovis subsp bovis AF2122/97
gcacuagcgagccggcgccgggu

SEQ ID NO: 1163543 - RNA, 17 nt, Mycobacterium bovis subsp bovis AF2122/97
gcacucaugaugccgga

SEQ ID NO: 1163544 - RNA, 23 nt, Mycobacterium bovis subsp bovis AF2122/97
gcacucaugaugccggacgccau

SEQ ID NO: 1163545 - RNA, 17 nt, Mycobacterium bovis subsp bovis AF2122/97
gcacuccaccgcuggcc

SEQ ID NO: 1163546 - RNA, 14 nt, Mycobacterium bovis subsp bovis AF2122/97
gcacgucuugcugc

SEQ ID NO: 1163547 - RNA, 19 nt, Mycobacterium bovis subsp bovis AF2122/97
gcacgucuugcugcacgcu

SEQ ID NO: 1163548 - RNA, 15 nt, Mycobacterium bovis subsp bovis AF2122/97
gcacguggccacggc

SEQ ID NO: 1163549 - RNA, 16 nt, Mycobacterium bovis subsp bovis AF2122/97
gcacguggccacggca

SEQ ID NO: 1163550 - RNA, 13 nt, Mycobacterium bovis subsp bovis AF2122/97
gcacguggcgacc

SEQ ID NO: 1163551 - RNA, 15 nt, Mycobacterium bovis subsp bovis AF2122/97
gcacguucaccgcgc

SEQ ID NO: 1163552 - RNA, 21 nt, Mycobacterium bovis subsp bovis AF2122/97
gcacguucagccaggcgugca

SEQ ID NO: 1163553 - RNA, 21 nt, Mycobacterium bovis subsp bovis AF2122/97
gcacguugauccgcgcaacuu

SEQ ID NO: 1163554 - RNA, 15 nt, Mycobacterium bovis subsp bovis AF2122/97
gcacguugauucggg

SEQ ID NO: 1163555 - RNA, 19 nt, Mycobacterium bovis subsp bovis AF2122/97
cuuugucgcggagucugcu

SEQ ID NO: 1163556 - RNA, 16 nt, Mycobacterium bovis subsp bovis AF2122/97
cuuugucgccuucuug

SEQ ID NO: 1163557 - RNA, 16 nt, Mycobacterium bovis subsp bovis AF2122/97
cuuuugauugaccaac

SEQ ID NO: 1163558 - RNA, 15 nt, Mycobacterium bovis subsp bovis AF2122/97
cuuuuugcgucuguu

SEQ ID NO: 1163559 - RNA, 23 nt, Mycobacterium bovis subsp bovis AF2122/97
gaaaacccggucggcgaaaggcc

SEQ ID NO: 1163560 - RNA, 21 nt, Mycobacterium bovis subsp bovis AF2122/97
gaaaaccgucgcagaaaccau

SEQ ID NO: 1163561 - RNA, 20 nt, Mycobacterium bovis subsp bovis AF2122/97
gaaaaagaccgacagcggca

SEQ ID NO: 1163562 - RNA, 23 nt, Mycobacterium bovis subsp bovis AF2122/97
gaaaaguuggcuugcgcgcaggu

SEQ ID NO: 1163563 - RNA, 23 nt, Mycobacterium bovis subsp bovis AF2122/97
gaaaauugacccccuagaccggg

SEQ ID NO: 1163564 - RNA, 17 nt, Mycobacterium bovis subsp bovis AF2122/97
gaaacaagcaagcgugu

SEQ ID NO: 1163565 - RNA, 22 nt, Mycobacterium bovis subsp bovis AF2122/97
gaaacaacgucgccgcggcggc

SEQ ID NO: 1163566 - RNA, 17 nt, Mycobacterium bovis subsp bovis AF2122/97
gaaaaugauagcggcgc

SEQ ID NO: 1163567 - RNA, 15 nt, Mycobacterium bovis subsp bovis AF2122/97
gaaaaugccgcccag

SEQ ID NO: 1163568 - RNA, 15 nt, Mycobacterium bovis subsp bovis AF2122/97
gaaaccgcagucgcg

SEQ ID NO: 1163569 - RNA, 18 nt, Mycobacterium bovis subsp bovis AF2122/97
gaaaccucuucgggugca

SEQ ID NO: 1163570 - RNA, 15 nt, Mycobacterium bovis subsp bovis AF2122/97
gaaacccggccagcu

SEQ ID NO: 1163571 - RNA, 20 nt, Mycobacterium bovis subsp bovis AF2122/97
gaaacccugcacccgacccg

SEQ ID NO: 1163572 - RNA, 15 nt, Mycobacterium bovis subsp bovis AF2122/97
gaaacgaauccgcca

SEQ ID NO: 1163573 - RNA, 14 nt, Mycobacterium bovis subsp bovis AF2122/97
gaaacgagccggug

SEQ ID NO: 1163574 - RNA, 22 nt, Mycobacterium bovis subsp bovis AF2122/97
gaaacgccaggggacccggggc

SEQ ID NO: 1163575 - RNA, 19 nt, Mycobacterium bovis subsp bovis AF2122/97
gaaacgcccgggcggcguc

SEQ ID NO: 1163576 - RNA, 20 nt, Mycobacterium bovis subsp bovis AF2122/97
gaaacgccggguucgccgga

SEQ ID NO: 1163577 - RNA, 15 nt, Mycobacterium bovis subsp bovis AF2122/97
gaaaccaucgccagc

SEQ ID NO: 1163578 - RNA, 16 nt, Mycobacterium bovis subsp bovis AF2122/97
gaaaccaucgccagcc

SEQ ID NO: 1163579 - RNA, 23 nt, Mycobacterium bovis subsp bovis AF2122/97
gaaaccaugccgccgaagccgcg

SEQ ID NO: 1163580 - RNA, 12 nt, Mycobacterium bovis subsp bovis AF2122/97
gaaaccacugga

SEQ ID NO: 1163581 - RNA, 18 nt, Mycobacterium bovis subsp bovis AF2122/97
gaaacagucgaccgaggc

SEQ ID NO: 1163582 - RNA, 17 nt, Mycobacterium bovis subsp bovis AF2122/97
gaaacagguaagcagcc

SEQ ID NO: 1163583 - RNA, 21 nt, Mycobacterium bovis subsp bovis AF2122/97
gaaacagguaagcagccagca

SEQ ID NO: 1163584 - RNA, 14 nt, Mycobacterium bovis subsp bovis AF2122/97
gaaacagcauggcg

SEQ ID NO: 1163585 - RNA, 15 nt, Mycobacterium bovis subsp bovis AF2122/97
gaaacagcuugcugc

SEQ ID NO: 1163586 - RNA, 17 nt, Mycobacterium bovis subsp bovis AF2122/97
gaaacucacccgagcca

SEQ ID NO: 1163587 - RNA, 18 nt, Mycobacterium bovis subsp bovis AF2122/97
gaaacucaccagcacccc

SEQ ID NO: 1163588 - RNA, 21 nt, Mycobacterium bovis subsp bovis AF2122/97
gaaacgcgaugguggccgcca

SEQ ID NO: 1163589 - RNA, 18 nt, Mycobacterium bovis subsp bovis AF2122/97
gaaacgguacgccgccgc

SEQ ID NO: 1163590 - RNA, 17 nt, Mycobacterium bovis subsp bovis AF2122/97
gaaacguaugacgccca

SEQ ID NO: 1163591 - RNA, 18 nt, Mycobacterium bovis subsp bovis AF2122/97
gaaacguaugacgcccac

SEQ ID NO: 1163592 - RNA, 17 nt, Mycobacterium bovis subsp bovis AF2122/97
gaaacguccuugaacgu

SEQ ID NO: 1163593 - RNA, 22 nt, Mycobacterium bovis subsp bovis AF2122/97
gaaacugcucggauccggccag

SEQ ID NO: 1163594 - RNA, 22 nt, Mycobacterium bovis subsp bovis AF2122/97
gaaacuggggguuguucaacuc

SEQ ID NO: 1163595 - RNA, 21 nt, Mycobacterium bovis subsp bovis AF2122/97
gaaaguuguaucgcagcauca

SEQ ID NO: 1163596 - RNA, 22 nt, Mycobacterium bovis subsp bovis AF2122/97
gaaaguguggaauggaccagcg

SEQ ID NO: 1163597 - RNA, 22 nt, Mycobacterium bovis subsp bovis AF2122/97
gaaauaucucggugacgaugaa

SEQ ID NO: 1163598 - RNA, 15 nt, Mycobacterium bovis subsp bovis AF2122/97
gaaauagcgagcguu

SEQ ID NO: 1163599 - RNA, 21 nt, Mycobacterium bovis subsp bovis AF2122/97
gaaaggucucuucggagauac

SEQ ID NO: 1163600 - RNA, 17 nt, Mycobacterium bovis subsp bovis AF2122/97
gaaaguagcgugcgaca

SEQ ID NO: 1163601 - RNA, 12 nt, Mycobacterium bovis subsp bovis AF2122/97
gaaagccaggcg

SEQ ID NO: 1163602 - RNA, 17 nt, Mycobacterium bovis subsp bovis AF2122/97
gaaagcgccgaaacagc

SEQ ID NO: 1163603 - RNA, 17 nt, Mycobacterium bovis subsp bovis AF2122/97
gaaagcguaaggccgga

SEQ ID NO: 1163604 - RNA, 17 nt, Mycobacterium bovis subsp bovis AF2122/97
gaaagcgucgagcugau

SEQ ID NO: 1163605 - RNA, 17 nt, Mycobacterium bovis subsp bovis AF2122/97
gaaagcaccgaugcuga

SEQ ID NO: 1163606 - RNA, 21 nt, Mycobacterium bovis subsp bovis AF2122/97
gaaaucgucggguaccagcac

SEQ ID NO: 1163607 - RNA, 14 nt, Mycobacterium bovis subsp bovis AF2122/97
gaaaucggccagcu

SEQ ID NO: 1163608 - RNA, 16 nt, Mycobacterium bovis subsp bovis AF2122/97
gaaaugaggucuuugc

SEQ ID NO: 1163609 - RNA, 23 nt, Mycobacterium bovis subsp bovis AF2122/97
gaaaugguucgcacaccuccucg

SEQ ID NO: 1163610 - RNA, 14 nt, Mycobacterium bovis subsp bovis AF2122/97
gaacaaaugccggu

SEQ ID NO: 1163611 - RNA, 18 nt, Mycobacterium bovis subsp bovis AF2122/97
gaaauugaugaucugcag

SEQ ID NO: 1163612 - RNA, 14 nt, Mycobacterium bovis subsp bovis AF2122/97
gaaauugccgccgc

SEQ ID NO: 1163613 - RNA, 16 nt, Mycobacterium bovis subsp bovis AF2122/97
gaaauucucgcccuga

SEQ ID NO: 1163614 - RNA, 14 nt, Mycobacterium bovis subsp bovis AF2122/97
gaaauugagccggc

SEQ ID NO: 1163615 - RNA, 18 nt, Mycobacterium bovis subsp bovis AF2122/97
gaaauuccgggccuggcc

SEQ ID NO: 1163616 - RNA, 15 nt, Mycobacterium bovis subsp bovis AF2122/97
gaacagccgagccag

SEQ ID NO: 1163617 - RNA, 19 nt, Mycobacterium bovis subsp bovis AF2122/97
gaacagcaccgaacccgcc

SEQ ID NO: 1163618 - RNA, 13 nt, Mycobacterium bovis subsp bovis AF2122/97
gaacagcaccgcc

SEQ ID NO: 1163619 - RNA, 21 nt, Mycobacterium bovis subsp bovis AF2122/97
gaacagcacauaugugcccgg

SEQ ID NO: 1163620 - RNA, 17 nt, Mycobacterium bovis subsp bovis AF2122/97
gaacaccuugggcagcu

SEQ ID NO: 1163621 - RNA, 12 nt, Mycobacterium bovis subsp bovis AF2122/97
gaacagacgccc

SEQ ID NO: 1163622 - RNA, 20 nt, Mycobacterium bovis subsp bovis AF2122/97
gaacaacgcgacgaagcaga

SEQ ID NO: 1163623 - RNA, 16 nt, Mycobacterium bovis subsp bovis AF2122/97
gaacaacggcgcggca

SEQ ID NO: 1163624 - RNA, 18 nt, Mycobacterium bovis subsp bovis AF2122/97
gaacaccagauggcucuc

SEQ ID NO: 1163625 - RNA, 15 nt, Mycobacterium bovis subsp bovis AF2122/97
gaacaccacaccgag

SEQ ID NO: 1163626 - RNA, 21 nt, Mycobacterium bovis subsp bovis AF2122/97
gaacacauccgcuugcggggc

SEQ ID NO: 1163627 - RNA, 13 nt, Mycobacterium bovis subsp bovis AF2122/97
gaacaccagcgcg

SEQ ID NO: 1163628 - RNA, 16 nt, Mycobacterium bovis subsp bovis AF2122/97
gaacaccagcgcgccg

SEQ ID NO: 1163629 - RNA, 22 nt, Mycobacterium bovis subsp bovis AF2122/97
gaacaccagcaggaagaagccg

SEQ ID NO: 1163630 - RNA, 15 nt, Mycobacterium bovis subsp bovis AF2122/97
gaacaccgcccggcc

SEQ ID NO: 1163631 - RNA, 15 nt, Mycobacterium bovis subsp bovis AF2122/97
gaacaccggccaggc

SEQ ID NO: 1163632 - RNA, 13 nt, Mycobacterium bovis subsp bovis AF2122/97
gaacaggccggcc

SEQ ID NO: 1163633 - RNA, 20 nt, Mycobacterium bovis subsp bovis AF2122/97
gaacaggcaaaguacgcccu

SEQ ID NO: 1163634 - RNA, 11 nt, Mycobacterium bovis subsp bovis AF2122/97
gaacagcugga

SEQ ID NO: 1163635 - RNA, 16 nt, Mycobacterium bovis subsp bovis AF2122/97
gaacagcgaaccggcu

SEQ ID NO: 1163636 - RNA, 23 nt, Mycobacterium bovis subsp bovis AF2122/97
gaacagcgcgucggagccgggca

SEQ ID NO: 1163637 - RNA, 14 nt, Mycobacterium bovis subsp bovis AF2122/97
gaacagcggcagcu

SEQ ID NO: 1163638 - RNA, 20 nt, Mycobacterium bovis subsp bovis AF2122/97
gaacagcgggggcagcgcga

SEQ ID NO: 1163639 - RNA, 19 nt, Mycobacterium bovis subsp bovis AF2122/97
gaacagcgguccagccacc

SEQ ID NO: 1163640 - RNA, 20 nt, Mycobacterium bovis subsp bovis AF2122/97
gaacagucgcagccaggcac

SEQ ID NO: 1163641 - RNA, 14 nt, Mycobacterium bovis subsp bovis AF2122/97
gaacagucgcagcc

SEQ ID NO: 1163642 - RNA, 17 nt, Mycobacterium bovis subsp bovis AF2122/97
gaacagggaggucgccg

SEQ ID NO: 1163643 - RNA, 19 nt, Mycobacterium bovis subsp bovis AF2122/97
gaacaucgccagcgccggc

SEQ ID NO: 1163644 - RNA, 21 nt, Mycobacterium bovis subsp bovis AF2122/97
gaacauccgccgcccccgccc

SEQ ID NO: 1163645 - RNA, 24 nt, Mycobacterium bovis subsp bovis AF2122/97
gaacauggccagcaucagcgccag

SEQ ID NO: 1163646 - RNA, 19 nt, Mycobacterium bovis subsp bovis AF2122/97
gaauacgcgccgccggcuc

SEQ ID NO: 1163647 - RNA, 16 nt, Mycobacterium bovis subsp bovis AF2122/97
gaauacgaccgucgcg

SEQ ID NO: 1163648 - RNA, 22 nt, Mycobacterium bovis subsp bovis AF2122/97
gaauacugaucuuggcccgggc

SEQ ID NO: 1163649 - RNA, 17 nt, Mycobacterium bovis subsp bovis AF2122/97
gaauaccgguggcagcc

SEQ ID NO: 1163650 - RNA, 13 nt, Mycobacterium bovis subsp bovis AF2122/97
gaauacccgcggg

SEQ ID NO: 1163651 - RNA, 19 nt, Mycobacterium bovis subsp bovis AF2122/97
gaauaccacaccgugacca

SEQ ID NO: 1163652 - RNA, 21 nt, Mycobacterium bovis subsp bovis AF2122/97
gaauacaccugcuggaagccg

SEQ ID NO: 1163653 - RNA, 15 nt, Mycobacterium bovis subsp bovis AF2122/97
gaaggcguggguguc

SEQ ID NO: 1163654 - RNA, 22 nt, Mycobacterium bovis subsp bovis AF2122/97
gaaggcugucaguucccgcuug

SEQ ID NO: 1163655 - RNA, 22 nt, Mycobacterium bovis subsp bovis AF2122/97
gaaggccgcgcgcagggcgucg

SEQ ID NO: 1163656 - RNA, 16 nt, Mycobacterium bovis subsp bovis AF2122/97
gaaggguauccgugug

SEQ ID NO: 1163657 - RNA, 20 nt, Mycobacterium bovis subsp bovis AF2122/97
gaaggucuggccugccccag

SEQ ID NO: 1163658 - RNA, 17 nt, Mycobacterium bovis subsp bovis AF2122/97
gaaggucuggccugccc

SEQ ID NO: 1163659 - RNA, 17 nt, Mycobacterium bovis subsp bovis AF2122/97
gaaggucagcagggccg

SEQ ID NO: 1163660 - RNA, 17 nt, Mycobacterium bovis subsp bovis AF2122/97
gaaggugcugcgcgggu

SEQ ID NO: 1163661 - RNA, 15 nt, Mycobacterium bovis subsp bovis AF2122/97
gaagguguccuccag

SEQ ID NO: 1163662 - RNA, 14 nt, Mycobacterium bovis subsp bovis AF2122/97
gaaguaggcggcga

SEQ ID NO: 1163663 - RNA, 15 nt, Mycobacterium bovis subsp bovis AF2122/97
gaaguacaucugccg

SEQ ID NO: 1163664 - RNA, 20 nt, Mycobacterium bovis subsp bovis AF2122/97
gaaguagguuuucggcggcu

SEQ ID NO: 1163665 - RNA, 13 nt, Mycobacterium bovis subsp bovis AF2122/97
gaaguacacggcg

SEQ ID NO: 1163666 - RNA, 14 nt, Mycobacterium bovis subsp bovis AF2122/97
gaaguacacggcgg

SEQ ID NO: 1163667 - RNA, 21 nt, Mycobacterium bovis subsp bovis AF2122/97
gaaguacgcgacgggccgcga

SEQ ID NO: 1163668 - RNA, 15 nt, Mycobacterium bovis subsp bovis AF2122/97
gaaguaauagcuguu

SEQ ID NO: 1163669 - RNA, 16 nt, Mycobacterium bovis subsp bovis AF2122/97
gaaguaauagcuguug

SEQ ID NO: 1163670 - RNA, 18 nt, Mycobacterium bovis subsp bovis AF2122/97
gaaguggcgucagugcag

SEQ ID NO: 1163671 - RNA, 15 nt, Mycobacterium bovis subsp bovis AF2122/97
gaagugcgcgcugga

SEQ ID NO: 1163672 - RNA, 15 nt, Mycobacterium bovis subsp bovis AF2122/97
gaagucgacucgcca

SEQ ID NO: 1163673 - RNA, 16 nt, Mycobacterium bovis subsp bovis AF2122/97
gaagucgacucgccac

SEQ ID NO: 1163674 - RNA, 15 nt, Mycobacterium bovis subsp bovis AF2122/97
gaagucgcagcgagg

SEQ ID NO: 1163675 - RNA, 17 nt, Mycobacterium bovis subsp bovis AF2122/97
gaagucgcccaguccca

SEQ ID NO: 1163676 - RNA, 14 nt, Mycobacterium bovis subsp bovis AF2122/97
gaaguccagcuggc

SEQ ID NO: 1163677 - RNA, 17 nt, Mycobacterium bovis subsp bovis AF2122/97
gaaguccacgcaccacg

SEQ ID NO: 1163678 - RNA, 18 nt, Mycobacterium bovis subsp bovis AF2122/97
gaaguugccggucaggca

SEQ ID NO: 1163679 - RNA, 13 nt, Mycobacterium bovis subsp bovis AF2122/97
gaaguugaucuug

SEQ ID NO: 1163680 - RNA, 16 nt, Mycobacterium bovis subsp bovis AF2122/97
gaaguugaagaagcca

SEQ ID NO: 1163681 - RNA, 21 nt, Mycobacterium bovis subsp bovis AF2122/97
gaaguucgucgguugccacgc

SEQ ID NO: 1163682 - RNA, 15 nt, Mycobacterium bovis subsp bovis AF2122/97
gaaguugaagaagcc

SEQ ID NO: 1163683 - RNA, 13 nt, Mycobacterium bovis subsp bovis AF2122/97
gaaguugaagaag

SEQ ID NO: 1163684 - RNA, 13 nt, Mycobacterium bovis subsp bovis AF2122/97
gaaguuccagccg

SEQ ID NO: 1163685 - RNA, 22 nt, Mycobacterium bovis subsp bovis AF2122/97
gaaguucgucgguugccacgcc

SEQ ID NO: 1163686 - RNA, 21 nt, Mycobacterium bovis subsp bovis AF2122/97
gaaguucuccucgugcagcac

SEQ ID NO: 1163687 - RNA, 14 nt, Mycobacterium bovis subsp bovis AF2122/97
gaaguucucggugc

SEQ ID NO: 1163688 - RNA, 16 nt, Mycobacterium bovis subsp bovis AF2122/97
gaaguuuuggaagccc

SEQ ID NO: 1163689 - RNA, 13 nt, Mycobacterium bovis subsp bovis AF2122/97
gaaucgaagcccg

SEQ ID NO: 1163690 - RNA, 15 nt, Mycobacterium bovis subsp bovis AF2122/97
gaauccccccugucg

SEQ ID NO: 1163691 - RNA, 16 nt, Mycobacterium bovis subsp bovis AF2122/97
gaauccaggagcccca

SEQ ID NO: 1163692 - RNA, 16 nt, Mycobacterium bovis subsp bovis AF2122/97
gaaucccucggccgca

SEQ ID NO: 1163693 - RNA, 20 nt, Mycobacterium bovis subsp bovis AF2122/97
gaaucccucggccgcaggcu

SEQ ID NO: 1163694 - RNA, 23 nt, Mycobacterium bovis subsp bovis AF2122/97
gaaucccccggacggcaggcugg

SEQ ID NO: 1163695 - RNA, 13 nt, Mycobacterium bovis subsp bovis AF2122/97
gaaucccaucggg

SEQ ID NO: 1163696 - RNA, 21 nt, Mycobacterium bovis subsp bovis AF2122/97
gaaucccgagucugcgagcag

SEQ ID NO: 1163697 - RNA, 18 nt, Mycobacterium bovis subsp bovis AF2122/97
gaaucacccacucgccga

SEQ ID NO: 1163698 - RNA, 17 nt, Mycobacterium bovis subsp bovis AF2122/97
gaaucaccccggcggcc

SEQ ID NO: 1163699 - RNA, 16 nt, Mycobacterium bovis subsp bovis AF2122/97
gaauccaccagccggu

SEQ ID NO: 1163700 - RNA, 21 nt, Mycobacterium bovis subsp bovis AF2122/97
gaauccaccagccgguagccg

SEQ ID NO: 1163701 - RNA, 22 nt, Mycobacterium bovis subsp bovis AF2122/97
gaauccaccagccgguagccgg

SEQ ID NO: 1163702 - RNA, 15 nt, Mycobacterium bovis subsp bovis AF2122/97
gaaucaggcucgccg

SEQ ID NO: 1163703 - RNA, 17 nt, Mycobacterium bovis subsp bovis AF2122/97
gaaucagggucugcgcc

SEQ ID NO: 1163704 - RNA, 15 nt, Mycobacterium bovis subsp bovis AF2122/97
gaaucagugaagaca

SEQ ID NO: 1163705 - RNA, 13 nt, Mycobacterium bovis subsp bovis AF2122/97
gaaucagcagcag

SEQ ID NO: 1163706 - RNA, 21 nt, Mycobacterium bovis subsp bovis AF2122/97
gaaucagcagcagcgugacca

SEQ ID NO: 1163707 - RNA, 21 nt, Mycobacterium bovis subsp bovis AF2122/97
gaaucgcgucgagcgccggcc

SEQ ID NO: 1163708 - RNA, 18 nt, Mycobacterium bovis subsp bovis AF2122/97
gaaucgcggagccaggac

SEQ ID NO: 1163709 - RNA, 21 nt, Mycobacterium bovis subsp bovis AF2122/97
gaaucgcgagcuuggccggca

SEQ ID NO: 1163710 - RNA, 16 nt, Mycobacterium bovis subsp bovis AF2122/97
gaaucgcgcuucaggc

SEQ ID NO: 1163711 - RNA, 15 nt, Mycobacterium bovis subsp bovis AF2122/97
gaaucgcccaucgca

SEQ ID NO: 1163712 - RNA, 11 nt, Mycobacterium bovis subsp bovis AF2122/97
gaaucgcccgg

SEQ ID NO: 1163713 - RNA, 13 nt, Mycobacterium bovis subsp bovis AF2122/97
gaaucgggauagc

SEQ ID NO: 1163714 - RNA, 17 nt, Mycobacterium bovis subsp bovis AF2122/97
gaaucgucggcgcggcu

SEQ ID NO: 1163715 - RNA, 19 nt, Mycobacterium bovis subsp bovis AF2122/97
gaaucggcaccgugcgggg

SEQ ID NO: 1163716 - RNA, 16 nt, Mycobacterium bovis subsp bovis AF2122/97
gaaucggcaguugaac

SEQ ID NO: 1163717 - RNA, 19 nt, Mycobacterium bovis subsp bovis AF2122/97
gaaucggcggaugaugcaa

SEQ ID NO: 1163718 - RNA, 16 nt, Mycobacterium bovis subsp bovis AF2122/97
gaaucgcugccgccga

SEQ ID NO: 1163719 - RNA, 14 nt, Mycobacterium bovis subsp bovis AF2122/97
gaaucgcuggugaa

SEQ ID NO: 1163720 - RNA, 22 nt, Mycobacterium bovis subsp bovis AF2122/97
gaaucugaaaaagcaucaaagc

SEQ ID NO: 1163721 - RNA, 15 nt, Mycobacterium bovis subsp bovis AF2122/97
gaaucucgcccccag

SEQ ID NO: 1163722 - RNA, 20 nt, Mycobacterium bovis subsp bovis AF2122/97
gaaucuccgccgugaguuca

SEQ ID NO: 1163723 - RNA, 23 nt, Mycobacterium bovis subsp bovis AF2122/97
gaaucuucugagacugccgccgc

SEQ ID NO: 1163724 - RNA, 17 nt, Mycobacterium bovis subsp bovis AF2122/97
gaaugaucggcguccuu

SEQ ID NO: 1163725 - RNA, 20 nt, Mycobacterium bovis subsp bovis AF2122/97
gaaugaccuugcccugcgug

SEQ ID NO: 1163726 - RNA, 17 nt, Mycobacterium bovis subsp bovis AF2122/97
gaaugaccuugcccugc

SEQ ID NO: 1163727 - RNA, 16 nt, Mycobacterium bovis subsp bovis AF2122/97
gaauggccgccgcagc

SEQ ID NO: 1163728 - RNA, 14 nt, Mycobacterium bovis subsp bovis AF2122/97
gaauggcgccggcc

SEQ ID NO: 1163729 - RNA, 19 nt, Mycobacterium bovis subsp bovis AF2122/97
gaauggcgccggccggcgc

SEQ ID NO: 1163730 - RNA, 12 nt, Mycobacterium bovis subsp bovis AF2122/97
gaauggucagcg

SEQ ID NO: 1163731 - RNA, 17 nt, Mycobacterium bovis subsp bovis AF2122/97
gaauguugccgccgcgg

SEQ ID NO: 1163732 - RNA, 20 nt, Mycobacterium bovis subsp bovis AF2122/97
gaauguugccgccgcggcgc

SEQ ID NO: 1163733 - RNA, 21 nt, Mycobacterium bovis subsp bovis AF2122/97
gaauguugcgaucugcggcgc

SEQ ID NO: 1163734 - RNA, 16 nt, Mycobacterium bovis subsp bovis AF2122/97
gaaugucuuuggucgc

SEQ ID NO: 1163735 - RNA, 18 nt, Mycobacterium bovis subsp bovis AF2122/97
gaaugucuccaguagccg

SEQ ID NO: 1163736 - RNA, 19 nt, Mycobacterium bovis subsp bovis AF2122/97
gaauuaaagccaccagaau

SEQ ID NO: 1163737 - RNA, 20 nt, Mycobacterium bovis subsp bovis AF2122/97
gaauuaaagccaccagaauc

SEQ ID NO: 1163738 - RNA, 16 nt, Mycobacterium bovis subsp bovis AF2122/97
gaaugcaacuccucga

SEQ ID NO: 1163739 - RNA, 16 nt, Mycobacterium bovis subsp bovis AF2122/97
gaauggcagcacgacc

SEQ ID NO: 1163740 - RNA, 16 nt, Mycobacterium bovis subsp bovis AF2122/97
gaaugcugggcccgcc

SEQ ID NO: 1163741 - RNA, 23 nt, Mycobacterium bovis subsp bovis AF2122/97
gaaugcuggggccuggucccacc

SEQ ID NO: 1163742 - RNA, 19 nt, Mycobacterium bovis subsp bovis AF2122/97
gaauucgccauagcgggcg

SEQ ID NO: 1163743 - RNA, 14 nt, Mycobacterium bovis subsp bovis AF2122/97
gaauucggccggcg

SEQ ID NO: 1163744 - RNA, 15 nt, Mycobacterium bovis subsp bovis AF2122/97
gaauucacgaugcuc

SEQ ID NO: 1163745 - RNA, 14 nt, Mycobacterium bovis subsp bovis AF2122/97
gaauucaccacucc

SEQ ID NO: 1163746 - RNA, 22 nt, Mycobacterium bovis subsp bovis AF2122/97
gaauuccggcggagcgggccag

SEQ ID NO: 1163747 - RNA, 20 nt, Mycobacterium bovis subsp bovis AF2122/97
gaauucauccauuucauuca

SEQ ID NO: 1163748 - RNA, 22 nt, Mycobacterium bovis subsp bovis AF2122/97
gaauuccagccagccgcccuga

SEQ ID NO: 1163749 - RNA, 20 nt, Mycobacterium bovis subsp bovis AF2122/97
gaauuaguuucguccccaga

SEQ ID NO: 1163750 - RNA, 13 nt, Mycobacterium bovis subsp bovis AF2122/97
gaacccagcacug

SEQ ID NO: 1163751 - RNA, 17 nt, Mycobacterium bovis subsp bovis AF2122/97
gaacccacgcaugcacg

SEQ ID NO: 1163752 - RNA, 14 nt, Mycobacterium bovis subsp bovis AF2122/97
gaacccacugcccg

SEQ ID NO: 1163753 - RNA, 19 nt, Mycobacterium bovis subsp bovis AF2122/97
gaaccccgcgcggugcccu

SEQ ID NO: 1163754 - RNA, 12 nt, Mycobacterium bovis subsp bovis AF2122/97
gaacccccgccg

SEQ ID NO: 1163755 - RNA, 17 nt, Mycobacterium bovis subsp bovis AF2122/97
gaacccccagcugcagg

SEQ ID NO: 1163756 - RNA, 18 nt, Mycobacterium bovis subsp bovis AF2122/97
gaacccccagcugcaggg

SEQ ID NO: 1163757 - RNA, 16 nt, Mycobacterium bovis subsp bovis AF2122/97
gaaccaugaccaccaa

SEQ ID NO: 1163758 - RNA, 12 nt, Mycobacterium bovis subsp bovis AF2122/97
gaaccaccaccg

SEQ ID NO: 1163759 - RNA, 14 nt, Mycobacterium bovis subsp bovis AF2122/97
gaaccacggcagcc

SEQ ID NO: 1163760 - RNA, 15 nt, Mycobacterium bovis subsp bovis AF2122/97
gaaccacggcaggca

SEQ ID NO: 1163761 - RNA, 21 nt, Mycobacterium bovis subsp bovis AF2122/97
gaaccacucggugauguaggg

SEQ ID NO: 1163762 - RNA, 21 nt, Mycobacterium bovis subsp bovis AF2122/97
gaaccagucgaagaagacccg

SEQ ID NO: 1163763 - RNA, 20 nt, Mycobacterium bovis subsp bovis AF2122/97
gaaccagcuugcgccgcagc

SEQ ID NO: 1163764 - RNA, 15 nt, Mycobacterium bovis subsp bovis AF2122/97
gaaccagcggucggc

SEQ ID NO: 1163765 - RNA, 23 nt, Mycobacterium bovis subsp bovis AF2122/97
gaaccagcguaucggccggcaga

SEQ ID NO: 1163766 - RNA, 13 nt, Mycobacterium bovis subsp bovis AF2122/97
gaaccgcgcggcg

SEQ ID NO: 1163767 - RNA, 11 nt, Mycobacterium bovis subsp bovis AF2122/97
gaaccgcccgc

SEQ ID NO: 1163768 - RNA, 17 nt, Mycobacterium bovis subsp bovis AF2122/97
gaaccgccggcaccgcc

SEQ ID NO: 1163769 - RNA, 19 nt, Mycobacterium bovis subsp bovis AF2122/97
gaaccgccggcugcgccag

SEQ ID NO: 1163770 - RNA, 18 nt, Mycobacterium bovis subsp bovis AF2122/97
gaaccgcucagcgcagca

SEQ ID NO: 1163771 - RNA, 20 nt, Mycobacterium bovis subsp bovis AF2122/97
gaaccgcguuaugccaggcg

SEQ ID NO: 1163772 - RNA, 16 nt, Mycobacterium bovis subsp bovis AF2122/97
gaaccgcucagcgcag

SEQ ID NO: 1163773 - RNA, 13 nt, Mycobacterium bovis subsp bovis AF2122/97
gaaccggcugggc

SEQ ID NO: 1163774 - RNA, 18 nt, Mycobacterium bovis subsp bovis AF2122/97
gaaccggcgugcagcacu

SEQ ID NO: 1163775 - RNA, 18 nt, Mycobacterium bovis subsp bovis AF2122/97
gaaccggcugggcgccac

SEQ ID NO: 1163776 - RNA, 20 nt, Mycobacterium bovis subsp bovis AF2122/97
gaaccggcugggcgccacca

SEQ ID NO: 1163777 - RNA, 22 nt, Mycobacterium bovis subsp bovis AF2122/97
gaaccggccgcgacgacacgcc

SEQ ID NO: 1163778 - RNA, 23 nt, Mycobacterium bovis subsp bovis AF2122/97
gaaccgggucacuccggcggcuu

SEQ ID NO: 1163779 - RNA, 16 nt, Mycobacterium bovis subsp bovis AF2122/97
gaaccgggcaaaucaa

SEQ ID NO: 1163780 - RNA, 17 nt, Mycobacterium bovis subsp bovis AF2122/97
gaaccgggcaaaucaag

SEQ ID NO: 1163781 - RNA, 19 nt, Mycobacterium bovis subsp bovis AF2122/97
gaacccgaucgucgagccg

SEQ ID NO: 1163782 - RNA, 16 nt, Mycobacterium bovis subsp bovis AF2122/97
gaacccgagccgccgu

SEQ ID NO: 1163783 - RNA, 23 nt, Mycobacterium bovis subsp bovis AF2122/97
gaacccgauaacaaggccgccgc

SEQ ID NO: 1163784 - RNA, 17 nt, Mycobacterium bovis subsp bovis AF2122/97
gaacccucagccgcgcc

SEQ ID NO: 1163785 - RNA, 23 nt, Mycobacterium bovis subsp bovis AF2122/97
gaacgcgagcaacaccagggccu

SEQ ID NO: 1163786 - RNA, 18 nt, Mycobacterium bovis subsp bovis AF2122/97
gaacgcgaucgaccuugg

SEQ ID NO: 1163787 - RNA, 13 nt, Mycobacterium bovis subsp bovis AF2122/97
gaacgccugcugg

SEQ ID NO: 1163788 - RNA, 15 nt, Mycobacterium bovis subsp bovis AF2122/97
gaacgccugcuggua

SEQ ID NO: 1163789 - RNA, 13 nt, Mycobacterium bovis subsp bovis AF2122/97
gaacgccgucaga

SEQ ID NO: 1163790 - RNA, 16 nt, Mycobacterium bovis subsp bovis AF2122/97
gaacgccucaggggcg

SEQ ID NO: 1163791 - RNA, 16 nt, Mycobacterium bovis subsp bovis AF2122/97
gaacgccucgccggcc

SEQ ID NO: 1163792 - RNA, 23 nt, Mycobacterium bovis subsp bovis AF2122/97
gaacgccucgccggccaccagcc

SEQ ID NO: 1163793 - RNA, 18 nt, Mycobacterium bovis subsp bovis AF2122/97
gaacgccggugcgcugga

SEQ ID NO: 1163794 - RNA, 14 nt, Mycobacterium bovis subsp bovis AF2122/97
gaacgccgccagca

SEQ ID NO: 1163795 - RNA, 16 nt, Mycobacterium bovis subsp bovis AF2122/97
gaacgccaccaccucc

SEQ ID NO: 1163796 - RNA, 14 nt, Mycobacterium bovis subsp bovis AF2122/97
gaacgccaccccca

SEQ ID NO: 1163797 - RNA, 14 nt, Mycobacterium bovis subsp bovis AF2122/97
gaacgcaucggucc

SEQ ID NO: 1163798 - RNA, 15 nt, Mycobacterium bovis subsp bovis AF2122/97
gaacgaugccgccgg

SEQ ID NO: 1163799 - RNA, 22 nt, Mycobacterium bovis subsp bovis AF2122/97
gaacgaugccggcaagccugcg

SEQ ID NO: 1163800 - RNA, 17 nt, Mycobacterium bovis subsp bovis AF2122/97
gaaccgguacaaccccc

SEQ ID NO: 1163801 - RNA, 16 nt, Mycobacterium bovis subsp bovis AF2122/97
gaaccgguaucgccaa

SEQ ID NO: 1163802 - RNA, 17 nt, Mycobacterium bovis subsp bovis AF2122/97
gaaccguucgacccagc

SEQ ID NO: 1163803 - RNA, 20 nt, Mycobacterium bovis subsp bovis AF2122/97
gaaccguucgcucagggugu

SEQ ID NO: 1163804 - RNA, 19 nt, Mycobacterium bovis subsp bovis AF2122/97
gaaccucaccugacacgcc

SEQ ID NO: 1163805 - RNA, 15 nt, Mycobacterium bovis subsp bovis AF2122/97
gaaccugauccgcua

SEQ ID NO: 1163806 - RNA, 21 nt, Mycobacterium bovis subsp bovis AF2122/97
gaaccucacagcuugagcaca

SEQ ID NO: 1163807 - RNA, 16 nt, Mycobacterium bovis subsp bovis AF2122/97
gaaccugcggcagcgg

SEQ ID NO: 1163808 - RNA, 15 nt, Mycobacterium bovis subsp bovis AF2122/97
gaacgacaccgcuug

SEQ ID NO: 1163809 - RNA, 20 nt, Mycobacterium bovis subsp bovis AF2122/97
gaacgaaagucuccggaacc

SEQ ID NO: 1163810 - RNA, 15 nt, Mycobacterium bovis subsp bovis AF2122/97
gaacgacauccggcc

SEQ ID NO: 1163811 - RNA, 12 nt, Mycobacterium bovis subsp bovis AF2122/97
gaacggcagcac

SEQ ID NO: 1163812 - RNA, 13 nt, Mycobacterium bovis subsp bovis AF2122/97
gaacggcucggcc

SEQ ID NO: 1163813 - RNA, 16 nt, Mycobacterium bovis subsp bovis AF2122/97
gaacggcucggccgga

SEQ ID NO: 1163814 - RNA, 22 nt, Mycobacterium bovis subsp bovis AF2122/97
gaacggcuugcgauuggcuggg

SEQ ID NO: 1163815 - RNA, 22 nt, Mycobacterium bovis subsp bovis AF2122/97
gaacggauucccgcccagcagc

SEQ ID NO: 1163816 - RNA, 19 nt, Mycobacterium bovis subsp bovis AF2122/97
gaacgguucggccggggcg

SEQ ID NO: 1163817 - RNA, 18 nt, Mycobacterium bovis subsp bovis AF2122/97
gaacgcgcgcagccgggc

SEQ ID NO: 1163818 - RNA, 19 nt, Mycobacterium bovis subsp bovis AF2122/97
gaacgcggcgaaugccagu

SEQ ID NO: 1163819 - RNA, 15 nt, Mycobacterium bovis subsp bovis AF2122/97
gaacgcguagagccg

SEQ ID NO: 1163820 - RNA, 20 nt, Mycobacterium bovis subsp bovis AF2122/97
gaacgcgucguagcgcucgu

SEQ ID NO: 1163821 - RNA, 14 nt, Mycobacterium bovis subsp bovis AF2122/97
gaacgcuccaggcc

SEQ ID NO: 1163822 - RNA, 22 nt, Mycobacterium bovis subsp bovis AF2122/97
gaacgcugaggaagcggcggca

SEQ ID NO: 1163823 - RNA, 20 nt, Mycobacterium bovis subsp bovis AF2122/97
gaacgcuuuccggcgguggu

SEQ ID NO: 1163824 - RNA, 13 nt, Mycobacterium bovis subsp bovis AF2122/97
gaacgcuuccagc

SEQ ID NO: 1163825 - RNA, 19 nt, Mycobacterium bovis subsp bovis AF2122/97
gaacggugcacagcaguga

SEQ ID NO: 1163826 - RNA, 23 nt, Mycobacterium bovis subsp bovis AF2122/97
gaacgugcaaccacggcggcauc

SEQ ID NO: 1163827 - RNA, 22 nt, Mycobacterium bovis subsp bovis AF2122/97
gaacguccagccguggcggcgg

SEQ ID NO: 1163828 - RNA, 23 nt, Mycobacterium bovis subsp bovis AF2122/97
gaacguccagccguggcggcggg

SEQ ID NO: 1163829 - RNA, 16 nt, Mycobacterium bovis subsp bovis AF2122/97
gaacgugccuuccucg

SEQ ID NO: 1163830 - RNA, 14 nt, Mycobacterium bovis subsp bovis AF2122/97
gaacgugucgggug

SEQ ID NO: 1163831 - RNA, 22 nt, Mycobacterium bovis subsp bovis AF2122/97
gaacguuuucgucaccccacca

SEQ ID NO: 1163832 - RNA, 17 nt, Mycobacterium bovis subsp bovis AF2122/97
gaacucaacaccagcaa

SEQ ID NO: 1163833 - RNA, 14 nt, Mycobacterium bovis subsp bovis AF2122/97
gaacucggccgggc

SEQ ID NO: 1163834 - RNA, 15 nt, Mycobacterium bovis subsp bovis AF2122/97
gaacucgucgcugcc

SEQ ID NO: 1163835 - RNA, 17 nt, Mycobacterium bovis subsp bovis AF2122/97
gaacucggugcccccac

SEQ ID NO: 1163836 - RNA, 19 nt, Mycobacterium bovis subsp bovis AF2122/97
gaacucguugaagaauccg

SEQ ID NO: 1163837 - RNA, 20 nt, Mycobacterium bovis subsp bovis AF2122/97
gaacucguugagcagcugga

SEQ ID NO: 1163838 - RNA, 20 nt, Mycobacterium bovis subsp bovis AF2122/97
gaacucuggauucuucagcg

SEQ ID NO: 1163839 - RNA, 19 nt, Mycobacterium bovis subsp bovis AF2122/97
gaacugaugaaccacggca

SEQ ID NO: 1163840 - RNA, 23 nt, Mycobacterium bovis subsp bovis AF2122/97
gaacugaugaaccacggcaggca

SEQ ID NO: 1163841 - RNA, 16 nt, Mycobacterium bovis subsp bovis AF2122/97
gaacucgcgggcgacc

SEQ ID NO: 1163842 - RNA, 17 nt, Mycobacterium bovis subsp bovis AF2122/97
gaacucgcguaucccgu

SEQ ID NO: 1163843 - RNA, 14 nt, Mycobacterium bovis subsp bovis AF2122/97
gaacucgcccaggg

SEQ ID NO: 1163844 - RNA, 18 nt, Mycobacterium bovis subsp bovis AF2122/97
gaacuccgggaccaggcc

SEQ ID NO: 1163845 - RNA, 16 nt, Mycobacterium bovis subsp bovis AF2122/97
gaacucgaccaccgcc

SEQ ID NO: 1163846 - RNA, 15 nt, Mycobacterium bovis subsp bovis AF2122/97
gaacucaccgccaug

SEQ ID NO: 1163847 - RNA, 16 nt, Mycobacterium bovis subsp bovis AF2122/97
gaacugggggccggca

SEQ ID NO: 1163848 - RNA, 21 nt, Mycobacterium bovis subsp bovis AF2122/97
gaacugugcggcagcccccgg

SEQ ID NO: 1163849 - RNA, 20 nt, Mycobacterium bovis subsp bovis AF2122/97
gaacuucgauucuggccgga

SEQ ID NO: 1163850 - RNA, 13 nt, Mycobacterium bovis subsp bovis AF2122/97
gaacugggccuca

SEQ ID NO: 1163851 - RNA, 18 nt, Mycobacterium bovis subsp bovis AF2122/97
gaacugggcgcccgcggu

SEQ ID NO: 1163852 - RNA, 12 nt, Mycobacterium bovis subsp bovis AF2122/97
gaacuggcuggu

SEQ ID NO: 1163853 - RNA, 21 nt, Mycobacterium bovis subsp bovis AF2122/97
gaacuggacaagcuccucgcg

SEQ ID NO: 1163854 - RNA, 18 nt, Mycobacterium bovis subsp bovis AF2122/97
gaacuggaccacagccgc

SEQ ID NO: 1163855 - RNA, 18 nt, Mycobacterium bovis subsp bovis AF2122/97
gaacugcaucauggccgu

SEQ ID NO: 1163856 - RNA, 20 nt, Mycobacterium bovis subsp bovis AF2122/97
gaacugcaucauggccguga

SEQ ID NO: 1163857 - RNA, 16 nt, Mycobacterium bovis subsp bovis AF2122/97
gaagcuggcgugcagc

SEQ ID NO: 1163858 - RNA, 19 nt, Mycobacterium bovis subsp bovis AF2122/97
gaagcuguagaccuggccg

SEQ ID NO: 1163859 - RNA, 17 nt, Mycobacterium bovis subsp bovis AF2122/97
gaagcuguaggcgacca

SEQ ID NO: 1163860 - RNA, 16 nt, Mycobacterium bovis subsp bovis AF2122/97
gaagcucgaccgcccg

SEQ ID NO: 1163861 - RNA, 20 nt, Mycobacterium bovis subsp bovis AF2122/97
gaagcugagcaccugagccu

SEQ ID NO: 1163862 - RNA, 22 nt, Mycobacterium bovis subsp bovis AF2122/97
gaagcgguggccucccacggcg

SEQ ID NO: 1163863 - RNA, 22 nt, Mycobacterium bovis subsp bovis AF2122/97
gaagcgggauugccgagaacac

SEQ ID NO: 1163864 - RNA, 19 nt, Mycobacterium bovis subsp bovis AF2122/97
gaagcgggcgaugccgaug

SEQ ID NO: 1163865 - RNA, 13 nt, Mycobacterium bovis subsp bovis AF2122/97
gaagcggcugcug

SEQ ID NO: 1163866 - RNA, 19 nt, Mycobacterium bovis subsp bovis AF2122/97
gaagcggcgacuacccagc

SEQ ID NO: 1163867 - RNA, 14 nt, Mycobacterium bovis subsp bovis AF2122/97
gaagcuagagccag

SEQ ID NO: 1163868 - RNA, 19 nt, Mycobacterium bovis subsp bovis AF2122/97
gaagcguugcacugcuggu

SEQ ID NO: 1163869 - RNA, 20 nt, Mycobacterium bovis subsp bovis AF2122/97
gaagcgucuggucagccgcg

SEQ ID NO: 1163870 - RNA, 17 nt, Mycobacterium bovis subsp bovis AF2122/97
gaagcgugcgccgacuu

SEQ ID NO: 1163871 - RNA, 20 nt, Mycobacterium bovis subsp bovis AF2122/97
gaaggauucgaagccgagcu

SEQ ID NO: 1163872 - RNA, 15 nt, Mycobacterium bovis subsp bovis AF2122/97
gaaggcaaacaccag

SEQ ID NO: 1163873 - RNA, 16 nt, Mycobacterium bovis subsp bovis AF2122/97
gaaggcaaacaccagc

SEQ ID NO: 1163874 - RNA, 22 nt, Mycobacterium bovis subsp bovis AF2122/97
gaaggaugcggccccaugcgcc

SEQ ID NO: 1163875 - RNA, 18 nt, Mycobacterium bovis subsp bovis AF2122/97
gaaggaucagcgcacugg

SEQ ID NO: 1163876 - RNA, 23 nt, Mycobacterium bovis subsp bovis AF2122/97
gaaggaucagcgcacuggccgcu

SEQ ID NO: 1163877 - RNA, 20 nt, Mycobacterium bovis subsp bovis AF2122/97
gaaggagaucccccaggcga

SEQ ID NO: 1163878 - RNA, 17 nt, Mycobacterium bovis subsp bovis AF2122/97
gaaggccgcgcgcaggg

SEQ ID NO: 1163879 - RNA, 15 nt, Mycobacterium bovis subsp bovis AF2122/97
gaaggccgcaccgcc

SEQ ID NO: 1163880 - RNA, 23 nt, Mycobacterium bovis subsp bovis AF2122/97
gaaggagauccuuaucgcucucg

SEQ ID NO: 1163881 - RNA, 19 nt, Mycobacterium bovis subsp bovis AF2122/97
gaagcuuaggugugguucc

SEQ ID NO: 1163882 - RNA, 17 nt, Mycobacterium bovis subsp bovis AF2122/97
gaagcgccggccgaucg

SEQ ID NO: 1163883 - RNA, 13 nt, Mycobacterium bovis subsp bovis AF2122/97
gaagcggccaccg

SEQ ID NO: 1163884 - RNA, 18 nt, Mycobacterium bovis subsp bovis AF2122/97
gaagcgcucggcagccgg

SEQ ID NO: 1163885 - RNA, 20 nt, Mycobacterium bovis subsp bovis AF2122/97
gaagcgcucggcagccggcu

SEQ ID NO: 1163886 - RNA, 16 nt, Mycobacterium bovis subsp bovis AF2122/97
gaagccuugcagcgcc

SEQ ID NO: 1163887 - RNA, 19 nt, Mycobacterium bovis subsp bovis AF2122/97
gaagccuugcagcgccccc

SEQ ID NO: 1163888 - RNA, 20 nt, Mycobacterium bovis subsp bovis AF2122/97
gaagccguugacuugugcca

SEQ ID NO: 1163889 - RNA, 18 nt, Mycobacterium bovis subsp bovis AF2122/97
gaagccguuugcgcuggc

SEQ ID NO: 1163890 - RNA, 22 nt, Mycobacterium bovis subsp bovis AF2122/97
gaagcccagcaccaccacccga

SEQ ID NO: 1163891 - RNA, 18 nt, Mycobacterium bovis subsp bovis AF2122/97
gaagccagaucagccgcc

SEQ ID NO: 1163892 - RNA, 17 nt, Mycobacterium bovis subsp bovis AF2122/97
gaagcccggggcgcucg

SEQ ID NO: 1163893 - RNA, 19 nt, Mycobacterium bovis subsp bovis AF2122/97
gaagccccgguggcaggga

SEQ ID NO: 1163894 - RNA, 18 nt, Mycobacterium bovis subsp bovis AF2122/97
gaagccgacgaccagcag

SEQ ID NO: 1163895 - RNA, 17 nt, Mycobacterium bovis subsp bovis AF2122/97
gaagccgagaccacgcg

SEQ ID NO: 1163896 - RNA, 13 nt, Mycobacterium bovis subsp bovis AF2122/97
gaagccgagcauc

SEQ ID NO: 1163897 - RNA, 12 nt, Mycobacterium bovis subsp bovis AF2122/97
gaagccgcgcug

SEQ ID NO: 1163898 - RNA, 14 nt, Mycobacterium bovis subsp bovis AF2122/97
gaagccgcaccgcu

SEQ ID NO: 1163899 - RNA, 17 nt, Mycobacterium bovis subsp bovis AF2122/97
gaagccgcaucuggcug

SEQ ID NO: 1163900 - RNA, 18 nt, Mycobacterium bovis subsp bovis AF2122/97
gaagccgcaucuggcugu

SEQ ID NO: 1163901 - RNA, 12 nt, Mycobacterium bovis subsp bovis AF2122/97
gaagaaaccgca

SEQ ID NO: 1163902 - RNA, 15 nt, Mycobacterium bovis subsp bovis AF2122/97
gaagaagccgaagca

SEQ ID NO: 1163903 - RNA, 15 nt, Mycobacterium bovis subsp bovis AF2122/97
gaagaaaacgaaccc

SEQ ID NO: 1163904 - RNA, 19 nt, Mycobacterium bovis subsp bovis AF2122/97
gaacuuguugaccuccucc

SEQ ID NO: 1163905 - RNA, 23 nt, Mycobacterium bovis subsp bovis AF2122/97
gaacuugcggaccuggcggcggu

SEQ ID NO: 1163906 - RNA, 16 nt, Mycobacterium bovis subsp bovis AF2122/97
gaagaccgccuccacc

SEQ ID NO: 1163907 - RNA, 19 nt, Mycobacterium bovis subsp bovis AF2122/97
gaagaccgccuccaccgcc

SEQ ID NO: 1163908 - RNA, 21 nt, Mycobacterium bovis subsp bovis AF2122/97
gaagaccgccuccaccgccgc

SEQ ID NO: 1163909 - RNA, 12 nt, Mycobacterium bovis subsp bovis AF2122/97
gaagaccagcaa

SEQ ID NO: 1163910 - RNA, 16 nt, Mycobacterium bovis subsp bovis AF2122/97
gaagaccaccgcccac

SEQ ID NO: 1163911 - RNA, 23 nt, Mycobacterium bovis subsp bovis AF2122/97
gaagaccaccgcccacagcaacg

SEQ ID NO: 1163912 - RNA, 17 nt, Mycobacterium bovis subsp bovis AF2122/97
gaagacaccaggcccgg

SEQ ID NO: 1163913 - RNA, 23 nt, Mycobacterium bovis subsp bovis AF2122/97
gaagacggccaccggggucaccu

SEQ ID NO: 1163914 - RNA, 14 nt, Mycobacterium bovis subsp bovis AF2122/97
gaagacggccaccg

SEQ ID NO: 1163915 - RNA, 20 nt, Mycobacterium bovis subsp bovis AF2122/97
gaagaaguacaucugccggu

SEQ ID NO: 1163916 - RNA, 20 nt, Mycobacterium bovis subsp bovis AF2122/97
gaagaauaaggagaaccaaa

SEQ ID NO: 1163917 - RNA, 23 nt, Mycobacterium bovis subsp bovis AF2122/97
gaagaauggacugaacaccaaau

SEQ ID NO: 1163918 - RNA, 19 nt, Mycobacterium bovis subsp bovis AF2122/97
gaagaugucuuccugcgcc

SEQ ID NO: 1163919 - RNA, 20 nt, Mycobacterium bovis subsp bovis AF2122/97
gaagaugccugcuagcagca

SEQ ID NO: 1163920 - RNA, 21 nt, Mycobacterium bovis subsp bovis AF2122/97
gaagaugccugcuagcagcag

SEQ ID NO: 1163921 - RNA, 22 nt, Mycobacterium bovis subsp bovis AF2122/97
gaagaugucuuccugcgccggu

SEQ ID NO: 1163922 - RNA, 18 nt, Mycobacterium bovis subsp bovis AF2122/97
gaagcagggauucuggau

SEQ ID NO: 1163923 - RNA, 22 nt, Mycobacterium bovis subsp bovis AF2122/97
gaagcaggugauguucagcgcc

SEQ ID NO: 1163924 - RNA, 13 nt, Mycobacterium bovis subsp bovis AF2122/97
gaagcaccucccg

SEQ ID NO: 1163925 - RNA, 12 nt, Mycobacterium bovis subsp bovis AF2122/97
gaagcacacugu

SEQ ID NO: 1163926 - RNA, 19 nt, Mycobacterium bovis subsp bovis AF2122/97
gaagcacacuguucccaca

SEQ ID NO: 1163927 - RNA, 16 nt, Mycobacterium bovis subsp bovis AF2122/97
gaagagggcgccgcgc

SEQ ID NO: 1163928 - RNA, 21 nt, Mycobacterium bovis subsp bovis AF2122/97
gaagauccagcgcaccggcgu

SEQ ID NO: 1163929 - RNA, 20 nt, Mycobacterium bovis subsp bovis AF2122/97
gaagaucgcgugccacagca

SEQ ID NO: 1163930 - RNA, 20 nt, Mycobacterium bovis subsp bovis AF2122/97
cuucucggcgggucaggcca

SEQ ID NO: 1163931 - RNA, 22 nt, Mycobacterium bovis subsp bovis AF2122/97
cuucucgucggugcgcgcggcg

SEQ ID NO: 1163932 - RNA, 22 nt, Mycobacterium bovis subsp bovis AF2122/97
cuucucgcggaccucggcgacc

SEQ ID NO: 1163933 - RNA, 14 nt, Mycobacterium bovis subsp bovis AF2122/97
cuucucgcggacgg

SEQ ID NO: 1163934 - RNA, 15 nt, Mycobacterium bovis subsp bovis AF2122/97
cuucucgagccgccg

SEQ ID NO: 1163935 - RNA, 19 nt, Mycobacterium bovis subsp bovis AF2122/97
cuucuccccgaucagcacc

SEQ ID NO: 1163936 - RNA, 22 nt, Mycobacterium bovis subsp bovis AF2122/97
cuucgcggugugcggcagcccg

SEQ ID NO: 1163937 - RNA, 20 nt, Mycobacterium bovis subsp bovis AF2122/97
cuucgcggugugcggcagcc

SEQ ID NO: 1163938 - RNA, 21 nt, Mycobacterium bovis subsp bovis AF2122/97
cuucgcggugugcggcagccc

SEQ ID NO: 1163939 - RNA, 15 nt, Mycobacterium bovis subsp bovis AF2122/97
cuucugcgucugcuc

SEQ ID NO: 1163940 - RNA, 14 nt, Mycobacterium bovis subsp bovis AF2122/97
cuucugccaucaac

SEQ ID NO: 1163941 - RNA, 13 nt, Mycobacterium bovis subsp bovis AF2122/97
cuucugccgggag

SEQ ID NO: 1163942 - RNA, 22 nt, Mycobacterium bovis subsp bovis AF2122/97
cuucugccgggagacgcugcgc

SEQ ID NO: 1163943 - RNA, 17 nt, Mycobacterium bovis subsp bovis AF2122/97
cuucugcuacccgagcc

SEQ ID NO: 1163944 - RNA, 15 nt, Mycobacterium bovis subsp bovis AF2122/97
cuucugccugcgcac

SEQ ID NO: 1163945 - RNA, 14 nt, Mycobacterium bovis subsp bovis AF2122/97
cuucugagacugcc

SEQ ID NO: 1163946 - RNA, 19 nt, Mycobacterium bovis subsp bovis AF2122/97
cuucugcacgaacgccugc

SEQ ID NO: 1163947 - RNA, 21 nt, Mycobacterium bovis subsp bovis AF2122/97
cuucugcacgaacgccugcuc

SEQ ID NO: 1163948 - RNA, 18 nt, Mycobacterium bovis subsp bovis AF2122/97
cuucugagacugccgccg

SEQ ID NO: 1163949 - RNA, 19 nt, Mycobacterium bovis subsp bovis AF2122/97
cuucuuggcggccuuuguc

SEQ ID NO: 1163950 - RNA, 18 nt, Mycobacterium bovis subsp bovis AF2122/97
cuucuuggcugcacuggc

SEQ ID NO: 1163951 - RNA, 19 nt, Mycobacterium bovis subsp bovis AF2122/97
cuucuuggcaggugccuuc

SEQ ID NO: 1163952 - RNA, 19 nt, Mycobacterium bovis subsp bovis AF2122/97
cuucuucggacagcagccg

SEQ ID NO: 1163953 - RNA, 16 nt, Mycobacterium bovis subsp bovis AF2122/97
cuucuucgcuaccuuc

SEQ ID NO: 1163954 - RNA, 17 nt, Mycobacterium bovis subsp bovis AF2122/97
cuucuucgcuaccuucu

SEQ ID NO: 1163955 - RNA, 21 nt, Mycobacterium bovis subsp bovis AF2122/97
cuucuucgcuaccuucuuggc

SEQ ID NO: 1163956 - RNA, 14 nt, Mycobacterium bovis subsp bovis AF2122/97
cuucuucacuggcg

SEQ ID NO: 1163957 - RNA, 15 nt, Mycobacterium bovis subsp bovis AF2122/97
cuucugguccagcac

SEQ ID NO: 1163958 - RNA, 18 nt, Mycobacterium bovis subsp bovis AF2122/97
cuucuggcaggugaacug

SEQ ID NO: 1163959 - RNA, 20 nt, Mycobacterium bovis subsp bovis AF2122/97
cuucuucaccgccuugguca

SEQ ID NO: 1163960 - RNA, 14 nt, Mycobacterium bovis subsp bovis AF2122/97
cuugcgccgcagcg

SEQ ID NO: 1163961 - RNA, 14 nt, Mycobacterium bovis subsp bovis AF2122/97
cuugcgcccggccu

SEQ ID NO: 1163962 - RNA, 23 nt, Mycobacterium bovis subsp bovis AF2122/97
cuugcgcccggccugcuggucac

SEQ ID NO: 1163963 - RNA, 22 nt, Mycobacterium bovis subsp bovis AF2122/97
cuugcgccgcccaugccuccag

SEQ ID NO: 1163964 - RNA, 23 nt, Mycobacterium bovis subsp bovis AF2122/97
cuugcgccggaugacaccgaccg

SEQ ID NO: 1163965 - RNA, 21 nt, Mycobacterium bovis subsp bovis AF2122/97
cuugcgcgcaggugcugggcg

SEQ ID NO: 1163966 - RNA, 11 nt, Mycobacterium bovis subsp bovis AF2122/97
cuugcgcggcu

SEQ ID NO: 1163967 - RNA, 16 nt, Mycobacterium bovis subsp bovis AF2122/97
cuugcgcggcuugggc

SEQ ID NO: 1163968 - RNA, 17 nt, Mycobacterium bovis subsp bovis AF2122/97
cuugcaggcgucccagc

SEQ ID NO: 1163969 - RNA, 12 nt, Mycobacterium bovis subsp bovis AF2122/97
cuugcagcgccc

SEQ ID NO: 1163970 - RNA, 18 nt, Mycobacterium bovis subsp bovis AF2122/97
cuugcaggcgucccagcc

SEQ ID NO: 1163971 - RNA, 23 nt, Mycobacterium bovis subsp bovis AF2122/97
cuugccgucgcugacgcccuccu

SEQ ID NO: 1163972 - RNA, 15 nt, Mycobacterium bovis subsp bovis AF2122/97
cuugcucagccggcc

SEQ ID NO: 1163973 - RNA, 23 nt, Mycobacterium bovis subsp bovis AF2122/97
cuugcucgacgaucugcagcacu

SEQ ID NO: 1163974 - RNA, 16 nt, Mycobacterium bovis subsp bovis AF2122/97
cuugcucguccagguc

SEQ ID NO: 1163975 - RNA, 16 nt, Mycobacterium bovis subsp bovis AF2122/97
cuugcgggcucucggc

SEQ ID NO: 1163976 - RNA, 22 nt, Mycobacterium bovis subsp bovis AF2122/97
cuugcggcacaacagaauucga

SEQ ID NO: 1163977 - RNA, 18 nt, Mycobacterium bovis subsp bovis AF2122/97
cuugcgggcagccgcccg

SEQ ID NO: 1163978 - RNA, 19 nt, Mycobacterium bovis subsp bovis AF2122/97
cuugcgucgcggacggugc

SEQ ID NO: 1163979 - RNA, 20 nt, Mycobacterium bovis subsp bovis AF2122/97
cuugcgguucggacacacag

SEQ ID NO: 1163980 - RNA, 21 nt, Mycobacterium bovis subsp bovis AF2122/97
cuugagccgggcaaccagcag

SEQ ID NO: 1163981 - RNA, 20 nt, Mycobacterium bovis subsp bovis AF2122/97
cuugagcucgcugaucaggu

SEQ ID NO: 1163982 - RNA, 22 nt, Mycobacterium bovis subsp bovis AF2122/97
cuugaaauugagccggcccugc

SEQ ID NO: 1163983 - RNA, 14 nt, Mycobacterium bovis subsp bovis AF2122/97
cuugaggucaccca

SEQ ID NO: 1163984 - RNA, 16 nt, Mycobacterium bovis subsp bovis AF2122/97
cuugauggucuccacc

SEQ ID NO: 1163985 - RNA, 18 nt, Mycobacterium bovis subsp bovis AF2122/97
cuugcacucggcgcccuc

SEQ ID NO: 1163986 - RNA, 18 nt, Mycobacterium bovis subsp bovis AF2122/97
cuuguugacgaacccacc

SEQ ID NO: 1163987 - RNA, 13 nt, Mycobacterium bovis subsp bovis AF2122/97
cuuguuccagcgc

SEQ ID NO: 1163988 - RNA, 24 nt, Mycobacterium bovis subsp bovis AF2122/97
cuuguuggcgaagucgucgagguc

SEQ ID NO: 1163989 - RNA, 13 nt, Mycobacterium bovis subsp bovis AF2122/97
cuuguuguggugg

SEQ ID NO: 1163990 - RNA, 14 nt, Mycobacterium bovis subsp bovis AF2122/97
cuuuaaaccccugg

SEQ ID NO: 1163991 - RNA, 18 nt, Mycobacterium bovis subsp bovis AF2122/97
cuuguggugagcggaauc

SEQ ID NO: 1163992 - RNA, 23 nt, Mycobacterium bovis subsp bovis AF2122/97
cuugugucaacaggaccuaucgc

SEQ ID NO: 1163993 - RNA, 15 nt, Mycobacterium bovis subsp bovis AF2122/97
cuuguggacccgcca

SEQ ID NO: 1163994 - RNA, 14 nt, Mycobacterium bovis subsp bovis AF2122/97
cuuguggaaaucgg

SEQ ID NO: 1163995 - RNA, 14 nt, Mycobacterium bovis subsp bovis AF2122/97
cuugugcagaucag

SEQ ID NO: 1163996 - RNA, 20 nt, Mycobacterium bovis subsp bovis AF2122/97
cuugugcagaucagcguccc

SEQ ID NO: 1163997 - RNA, 18 nt, Mycobacterium bovis subsp bovis AF2122/97
cuuguccaucacauccac

SEQ ID NO: 1163998 - RNA, 24 nt, Mycobacterium bovis subsp bovis AF2122/97
cuuguccaucacauccacgcacuc

SEQ ID NO: 1163999 - RNA, 14 nt, Mycobacterium bovis subsp bovis AF2122/97
cuuguccagggugg

SEQ ID NO: 1164000 - RNA, 14 nt, Mycobacterium bovis subsp bovis AF2122/97
cuuguccggcccgu

SEQ ID NO: 1164001 - RNA, 17 nt, Mycobacterium bovis subsp bovis AF2122/97
cuuguccgggccccacg

SEQ ID NO: 1164002 - RNA, 14 nt, Mycobacterium bovis subsp bovis AF2122/97
cuuguccucacaug

SEQ ID NO: 1164003 - RNA, 14 nt, Mycobacterium bovis subsp bovis AF2122/97
cuuggacagcagca

SEQ ID NO: 1164004 - RNA, 15 nt, Mycobacterium bovis subsp bovis AF2122/97
cuuggacucggcggg

SEQ ID NO: 1164005 - RNA, 16 nt, Mycobacterium bovis subsp bovis AF2122/97
cuuggacccugcgccg

SEQ ID NO: 1164006 - RNA, 18 nt, Mycobacterium bovis subsp bovis AF2122/97
cuuggacccugcgccgcc

SEQ ID NO: 1164007 - RNA, 20 nt, Mycobacterium bovis subsp bovis AF2122/97
cuuggaaggcgcgcgcccgg

SEQ ID NO: 1164008 - RNA, 19 nt, Mycobacterium bovis subsp bovis AF2122/97
cuuggacugucccaccagg

SEQ ID NO: 1164009 - RNA, 17 nt, Mycobacterium bovis subsp bovis AF2122/97
cuuguaaacgaagaacu

SEQ ID NO: 1164010 - RNA, 20 nt, Mycobacterium bovis subsp bovis AF2122/97
cuuucacaagccccgcgcgu

SEQ ID NO: 1164011 - RNA, 22 nt, Mycobacterium bovis subsp bovis AF2122/97
cuuucggcagacccgagcgcuc

SEQ ID NO: 1164012 - RNA, 20 nt, Mycobacterium bovis subsp bovis AF2122/97
cuucauucgugggaaccacc

SEQ ID NO: 1164013 - RNA, 23 nt, Mycobacterium bovis subsp bovis AF2122/97
cuuccgcgacgcucgcugcagca

SEQ ID NO: 1164014 - RNA, 23 nt, Mycobacterium bovis subsp bovis AF2122/97
cuucccagccgacgccuuccagc

SEQ ID NO: 1164015 - RNA, 19 nt, Mycobacterium bovis subsp bovis AF2122/97
cuucccaggauccggcugc

SEQ ID NO: 1164016 - RNA, 24 nt, Mycobacterium bovis subsp bovis AF2122/97
cuucccaggauccggcugcggauc

SEQ ID NO: 1164017 - RNA, 13 nt, Mycobacterium bovis subsp bovis AF2122/97
cuuccaucgccac

SEQ ID NO: 1164018 - RNA, 14 nt, Mycobacterium bovis subsp bovis AF2122/97
cuuccugaggguuu

SEQ ID NO: 1164019 - RNA, 22 nt, Mycobacterium bovis subsp bovis AF2122/97
cuuccugaggguuuccaagucg

SEQ ID NO: 1164020 - RNA, 21 nt, Mycobacterium bovis subsp bovis AF2122/97
cuuccugauuucaacggucaa

SEQ ID NO: 1164021 - RNA, 23 nt, Mycobacterium bovis subsp bovis AF2122/97
cuuccggauucggacucgccgac

SEQ ID NO: 1164022 - RNA, 23 nt, Mycobacterium bovis subsp bovis AF2122/97
cuuccucggcaaaccaagcgcgc

SEQ ID NO: 1164023 - RNA, 15 nt, Mycobacterium bovis subsp bovis AF2122/97
cuuccucggccaccc

SEQ ID NO: 1164024 - RNA, 19 nt, Mycobacterium bovis subsp bovis AF2122/97
cuuccgggcagcugggcag

SEQ ID NO: 1164025 - RNA, 15 nt, Mycobacterium bovis subsp bovis AF2122/97
cuuccggcguggccc

SEQ ID NO: 1164026 - RNA, 16 nt, Mycobacterium bovis subsp bovis AF2122/97
cuuccucggccacccg

SEQ ID NO: 1164027 - RNA, 23 nt, Mycobacterium bovis subsp bovis AF2122/97
cuucgccggcgccagcagaucuc

SEQ ID NO: 1164028 - RNA, 16 nt, Mycobacterium bovis subsp bovis AF2122/97
cuucgccggcgccagc

SEQ ID NO: 1164029 - RNA, 20 nt, Mycobacterium bovis subsp bovis AF2122/97
cuucgccgcccgcagggccg

SEQ ID NO: 1164030 - RNA, 19 nt, Mycobacterium bovis subsp bovis AF2122/97
cuucgccgucggcgacucc

SEQ ID NO: 1164031 - RNA, 16 nt, Mycobacterium bovis subsp bovis AF2122/97
cuucgcgcgcugggcg

SEQ ID NO: 1164032 - RNA, 21 nt, Mycobacterium bovis subsp bovis AF2122/97
cuucgcgcuguacugccccag

SEQ ID NO: 1164033 - RNA, 19 nt, Mycobacterium bovis subsp bovis AF2122/97
cuucgcggauguccaggag

SEQ ID NO: 1164034 - RNA, 18 nt, Mycobacterium bovis subsp bovis AF2122/97
cuucgcgcagccggucag

SEQ ID NO: 1164035 - RNA, 15 nt, Mycobacterium bovis subsp bovis AF2122/97
cuucgccgcccgcag

SEQ ID NO: 1164036 - RNA, 16 nt, Mycobacterium bovis subsp bovis AF2122/97
cuucgccgaagcgccg

SEQ ID NO: 1164037 - RNA, 15 nt, Mycobacterium bovis subsp bovis AF2122/97
cuucgcccgggccgc

SEQ ID NO: 1164038 - RNA, 16 nt, Mycobacterium bovis subsp bovis AF2122/97
cuucgcccgggccgcg

SEQ ID NO: 1164039 - RNA, 18 nt, Mycobacterium bovis subsp bovis AF2122/97
cuucgccaacugcggcag

SEQ ID NO: 1164040 - RNA, 19 nt, Mycobacterium bovis subsp bovis AF2122/97
cuucgccaacugcggcagg

SEQ ID NO: 1164041 - RNA, 15 nt, Mycobacterium bovis subsp bovis AF2122/97
cuucaguccggcccc

SEQ ID NO: 1164042 - RNA, 14 nt, Mycobacterium bovis subsp bovis AF2122/97
cuucagguagcggc

SEQ ID NO: 1164043 - RNA, 16 nt, Mycobacterium bovis subsp bovis AF2122/97
cuucaggcaccggaug

SEQ ID NO: 1164044 - RNA, 15 nt, Mycobacterium bovis subsp bovis AF2122/97
cuucaggcgccacug

SEQ ID NO: 1164045 - RNA, 16 nt, Mycobacterium bovis subsp bovis AF2122/97
cuucaggcgccacugc

SEQ ID NO: 1164046 - RNA, 17 nt, Mycobacterium bovis subsp bovis AF2122/97
cuucaggcgccacugcu

SEQ ID NO: 1164047 - RNA, 15 nt, Mycobacterium bovis subsp bovis AF2122/97
cuucaggccgcgcau

SEQ ID NO: 1164048 - RNA, 13 nt, Mycobacterium bovis subsp bovis AF2122/97
cuucagcgcggca

SEQ ID NO: 1164049 - RNA, 19 nt, Mycobacterium bovis subsp bovis AF2122/97
cuucagcggccgguacacg

SEQ ID NO: 1164050 - RNA, 16 nt, Mycobacterium bovis subsp bovis AF2122/97
cuucaugccggacugc

SEQ ID NO: 1164051 - RNA, 21 nt, Mycobacterium bovis subsp bovis AF2122/97
cuucagcacgcgggagaucuc

SEQ ID NO: 1164052 - RNA, 13 nt, Mycobacterium bovis subsp bovis AF2122/97
cuucagcaggccc

SEQ ID NO: 1164053 - RNA, 18 nt, Mycobacterium bovis subsp bovis AF2122/97
cuucacgggccguccagg

SEQ ID NO: 1164054 - RNA, 20 nt, Mycobacterium bovis subsp bovis AF2122/97
cuucacgccgccccugcgcg

SEQ ID NO: 1164055 - RNA, 15 nt, Mycobacterium bovis subsp bovis AF2122/97
cuuauguguccgcuc

SEQ ID NO: 1164056 - RNA, 13 nt, Mycobacterium bovis subsp bovis AF2122/97
cuucaccacgccg

SEQ ID NO: 1164057 - RNA, 19 nt, Mycobacterium bovis subsp bovis AF2122/97
cuguuggcgaaggccgcaa

SEQ ID NO: 1164058 - RNA, 20 nt, Mycobacterium bovis subsp bovis AF2122/97
cuguuggugccgccaccacc

SEQ ID NO: 1164059 - RNA, 18 nt, Mycobacterium bovis subsp bovis AF2122/97
cuguugcaucgccgcgau

SEQ ID NO: 1164060 - RNA, 13 nt, Mycobacterium bovis subsp bovis AF2122/97
cuguugccccucc

SEQ ID NO: 1164061 - RNA, 18 nt, Mycobacterium bovis subsp bovis AF2122/97
cuguugaucugcccuguu

SEQ ID NO: 1164062 - RNA, 20 nt, Mycobacterium bovis subsp bovis AF2122/97
cugucuggucggcuacggcc

SEQ ID NO: 1164063 - RNA, 12 nt, Mycobacterium bovis subsp bovis AF2122/97
cugucucggugc

SEQ ID NO: 1164064 - RNA, 15 nt, Mycobacterium bovis subsp bovis AF2122/97
cuguugaacggccgc

SEQ ID NO: 1164065 - RNA, 16 nt, Mycobacterium bovis subsp bovis AF2122/97
cuguugaagaagcccg

SEQ ID NO: 1164066 - RNA, 17 nt, Mycobacterium bovis subsp bovis AF2122/97
cuguugaagaagcccga

SEQ ID NO: 1164067 - RNA, 20 nt, Mycobacterium bovis subsp bovis AF2122/97
cuguugaagaagcccgaaga

SEQ ID NO: 1164068 - RNA, 23 nt, Mycobacterium bovis subsp bovis AF2122/97
cuguugaagaggcgcaccuccug

SEQ ID NO: 1164069 - RNA, 21 nt, Mycobacterium bovis subsp bovis AF2122/97
cuguucggccaacccgggccg

SEQ ID NO: 1164070 - RNA, 22 nt, Mycobacterium bovis subsp bovis AF2122/97
cuguucggccauggcggcgccg

SEQ ID NO: 1164071 - RNA, 21 nt, Mycobacterium bovis subsp bovis AF2122/97
cuguucggcggcugccagcgc

SEQ ID NO: 1164072 - RNA, 20 nt, Mycobacterium bovis subsp bovis AF2122/97
cuguucucgccgaagcccgg

SEQ ID NO: 1164073 - RNA, 19 nt, Mycobacterium bovis subsp bovis AF2122/97
cuguucugcuggcuguggc

SEQ ID NO: 1164074 - RNA, 22 nt, Mycobacterium bovis subsp bovis AF2122/97
cuuaaacgggcucuucgcagcg

SEQ ID NO: 1164075 - RNA, 15 nt, Mycobacterium bovis subsp bovis AF2122/97
cuuacacgccuggcu

SEQ ID NO: 1164076 - RNA, 18 nt, Mycobacterium bovis subsp bovis AF2122/97
cuuauccggccagugaca

SEQ ID NO: 1164077 - RNA, 20 nt, Mycobacterium bovis subsp bovis AF2122/97
cuuagccauuuccuuggcgc

SEQ ID NO: 1164078 - RNA, 14 nt, Mycobacterium bovis subsp bovis AF2122/97
cuggaaccccgagc

SEQ ID NO: 1164079 - RNA, 13 nt, Mycobacterium bovis subsp bovis AF2122/97
cuggaaagcagca

SEQ ID NO: 1164080 - RNA, 16 nt, Mycobacterium bovis subsp bovis AF2122/97
cuggaaagggccgccg

SEQ ID NO: 1164081 - RNA, 14 nt, Mycobacterium bovis subsp bovis AF2122/97
cuggaaguaguccc

SEQ ID NO: 1164082 - RNA, 20 nt, Mycobacterium bovis subsp bovis AF2122/97
cuggaaggcgggcaguugac

SEQ ID NO: 1164083 - RNA, 13 nt, Mycobacterium bovis subsp bovis AF2122/97
cuggaagccgucu

SEQ ID NO: 1164084 - RNA, 20 nt, Mycobacterium bovis subsp bovis AF2122/97
cuggacauaccggcccgggu

SEQ ID NO: 1164085 - RNA, 15 nt, Mycobacterium bovis subsp bovis AF2122/97
cuggacccgcccagg

SEQ ID NO: 1164086 - RNA, 19 nt, Mycobacterium bovis subsp bovis AF2122/97
cuggaccacucgccggcgg

SEQ ID NO: 1164087 - RNA, 13 nt, Mycobacterium bovis subsp bovis AF2122/97
cuggaccgcggug

SEQ ID NO: 1164088 - RNA, 11 nt, Mycobacterium bovis subsp bovis AF2122/97
cuggaccuccg

SEQ ID NO: 1164089 - RNA, 22 nt, Mycobacterium bovis subsp bovis AF2122/97
cuggacgccgccggagaucuug

SEQ ID NO: 1164090 - RNA, 16 nt, Mycobacterium bovis subsp bovis AF2122/97
cuggagcagccacgau

SEQ ID NO: 1164091 - RNA, 21 nt, Mycobacterium bovis subsp bovis AF2122/97
cuggacgggguacugcggcuc

SEQ ID NO: 1164092 - RNA, 19 nt, Mycobacterium bovis subsp bovis AF2122/97
cuggacuccggucagcgcg

SEQ ID NO: 1164093 - RNA, 18 nt, Mycobacterium bovis subsp bovis AF2122/97
cuggacucuucagcuacc

SEQ ID NO: 1164094 - RNA, 18 nt, Mycobacterium bovis subsp bovis AF2122/97
cuggagaacucugcgaga

SEQ ID NO: 1164095 - RNA, 19 nt, Mycobacterium bovis subsp bovis AF2122/97
cugcuugacuccgcgcgcu

SEQ ID NO: 1164096 - RNA, 20 nt, Mycobacterium bovis subsp bovis AF2122/97
cugcuuggucgcccagccac

SEQ ID NO: 1164097 - RNA, 14 nt, Mycobacterium bovis subsp bovis AF2122/97
cuggaaaacccagg

SEQ ID NO: 1164098 - RNA, 20 nt, Mycobacterium bovis subsp bovis AF2122/97
cugcuuugccuuagcccggc

SEQ ID NO: 1164099 - RNA, 17 nt, Mycobacterium bovis subsp bovis AF2122/97
cugcucagcgcggcccc

SEQ ID NO: 1164100 - RNA, 14 nt, Mycobacterium bovis subsp bovis AF2122/97
cugcuacucugcaa

SEQ ID NO: 1164101 - RNA, 16 nt, Mycobacterium bovis subsp bovis AF2122/97
cugcuaguggucugcu

SEQ ID NO: 1164102 - RNA, 20 nt, Mycobacterium bovis subsp bovis AF2122/97
cugcuagccagucggccacc

SEQ ID NO: 1164103 - RNA, 23 nt, Mycobacterium bovis subsp bovis AF2122/97
cugcuagcagcagcccgacagug

SEQ ID NO: 1164104 - RNA, 17 nt, Mycobacterium bovis subsp bovis AF2122/97
cuggcgccggugccgcc

SEQ ID NO: 1164105 - RNA, 21 nt, Mycobacterium bovis subsp bovis AF2122/97
cuggcgaucucuaccagccgc

SEQ ID NO: 1164106 - RNA, 17 nt, Mycobacterium bovis subsp bovis AF2122/97
cuggcgauacagcgaca

SEQ ID NO: 1164107 - RNA, 17 nt, Mycobacterium bovis subsp bovis AF2122/97
cuggcgaucgcgacgau

SEQ ID NO: 1164108 - RNA, 19 nt, Mycobacterium bovis subsp bovis AF2122/97
cuggcgaucucuaccagcc

SEQ ID NO: 1164109 - RNA, 12 nt, Mycobacterium bovis subsp bovis AF2122/97
cuggccuccagc

SEQ ID NO: 1164110 - RNA, 18 nt, Mycobacterium bovis subsp bovis AF2122/97
cuggccucggggaucgca

SEQ ID NO: 1164111 - RNA, 18 nt, Mycobacterium bovis subsp bovis AF2122/97
cuggcccgccacgauguc

SEQ ID NO: 1164112 - RNA, 21 nt, Mycobacterium bovis subsp bovis AF2122/97
cuggccccgguggugcugccg

SEQ ID NO: 1164113 - RNA, 22 nt, Mycobacterium bovis subsp bovis AF2122/97
cuggcccggacaugcgggcagc

SEQ ID NO: 1164114 - RNA, 13 nt, Mycobacterium bovis subsp bovis AF2122/97
cuggcggcccggg

SEQ ID NO: 1164115 - RNA, 17 nt, Mycobacterium bovis subsp bovis AF2122/97
cuggcggccucgccggc

SEQ ID NO: 1164116 - RNA, 18 nt, Mycobacterium bovis subsp bovis AF2122/97
cuggcggccucgccggcg

SEQ ID NO: 1164117 - RNA, 14 nt, Mycobacterium bovis subsp bovis AF2122/97
cuggcggcgccgca

SEQ ID NO: 1164118 - RNA, 11 nt, Mycobacterium bovis subsp bovis AF2122/97
cuggcggaugg

SEQ ID NO: 1164119 - RNA, 18 nt, Mycobacterium bovis subsp bovis AF2122/97
cuggcggauggccgccuu

SEQ ID NO: 1164120 - RNA, 18 nt, Mycobacterium bovis subsp bovis AF2122/97
cuggcgcuuugggcugcc

SEQ ID NO: 1164121 - RNA, 19 nt, Mycobacterium bovis subsp bovis AF2122/97
cuggcgcugcuggcagacc

SEQ ID NO: 1164122 - RNA, 20 nt, Mycobacterium bovis subsp bovis AF2122/97
cuggcgcucauaggccggcg

SEQ ID NO: 1164123 - RNA, 21 nt, Mycobacterium bovis subsp bovis AF2122/97
cuggcgcgccugugccaccgc

SEQ ID NO: 1164124 - RNA, 15 nt, Mycobacterium bovis subsp bovis AF2122/97
cuggcaucccgggca

SEQ ID NO: 1164125 - RNA, 13 nt, Mycobacterium bovis subsp bovis AF2122/97
cuggcauaucccu

SEQ ID NO: 1164126 - RNA, 16 nt, Mycobacterium bovis subsp bovis AF2122/97
cuggcaggccagcaug

SEQ ID NO: 1164127 - RNA, 21 nt, Mycobacterium bovis subsp bovis AF2122/97
cuggcagugugggggucaggg

SEQ ID NO: 1164128 - RNA, 22 nt, Mycobacterium bovis subsp bovis AF2122/97
cuggcagugugggggucagggg

SEQ ID NO: 1164129 - RNA, 21 nt, Mycobacterium bovis subsp bovis AF2122/97
cuggccaacuugacccgggga

SEQ ID NO: 1164130 - RNA, 14 nt, Mycobacterium bovis subsp bovis AF2122/97
cuggccacaaucgc

SEQ ID NO: 1164131 - RNA, 19 nt, Mycobacterium bovis subsp bovis AF2122/97
cuggccacacucagcaccc

SEQ ID NO: 1164132 - RNA, 20 nt, Mycobacterium bovis subsp bovis AF2122/97
cuggccccgccagcggcagc

SEQ ID NO: 1164133 - RNA, 24 nt, Mycobacterium bovis subsp bovis AF2122/97
cuggccccgccagcggcagcggcg

SEQ ID NO: 1164134 - RNA, 17 nt, Mycobacterium bovis subsp bovis AF2122/97
cuggccccgccagcggc

SEQ ID NO: 1164135 - RNA, 21 nt, Mycobacterium bovis subsp bovis AF2122/97
cuggccacgauccgcgguagc

SEQ ID NO: 1164136 - RNA, 19 nt, Mycobacterium bovis subsp bovis AF2122/97
cuggcccaucuugaccaau

SEQ ID NO: 1164137 - RNA, 13 nt, Mycobacterium bovis subsp bovis AF2122/97
cuggcccaauugc

SEQ ID NO: 1164138 - RNA, 21 nt, Mycobacterium bovis subsp bovis AF2122/97
cuggcccacgccgcaucggcg

SEQ ID NO: 1164139 - RNA, 14 nt, Mycobacterium bovis subsp bovis AF2122/97
cuggagugaggcug

SEQ ID NO: 1164140 - RNA, 17 nt, Mycobacterium bovis subsp bovis AF2122/97
cuggaggcuccuggucg

SEQ ID NO: 1164141 - RNA, 21 nt, Mycobacterium bovis subsp bovis AF2122/97
cuggaggugaacucguucagc

SEQ ID NO: 1164142 - RNA, 22 nt, Mycobacterium bovis subsp bovis AF2122/97
cuggaggugaacucguucagcg

SEQ ID NO: 1164143 - RNA, 19 nt, Mycobacterium bovis subsp bovis AF2122/97
cuggauacccagcgcccgg

SEQ ID NO: 1164144 - RNA, 17 nt, Mycobacterium bovis subsp bovis AF2122/97
cuggcacacuccugcac

SEQ ID NO: 1164145 - RNA, 17 nt, Mycobacterium bovis subsp bovis AF2122/97
cuggcaccucccgggcg

SEQ ID NO: 1164146 - RNA, 18 nt, Mycobacterium bovis subsp bovis AF2122/97
cuggcaccucccgggcga

SEQ ID NO: 1164147 - RNA, 19 nt, Mycobacterium bovis subsp bovis AF2122/97
cugguccaggcccuggcca

SEQ ID NO: 1164148 - RNA, 14 nt, Mycobacterium bovis subsp bovis AF2122/97
cugguccagcaccg

SEQ ID NO: 1164149 - RNA, 19 nt, Mycobacterium bovis subsp bovis AF2122/97
cugguccagccggugacgu

SEQ ID NO: 1164150 - RNA, 12 nt, Mycobacterium bovis subsp bovis AF2122/97
cuggucaacagc

SEQ ID NO: 1164151 - RNA, 15 nt, Mycobacterium bovis subsp bovis AF2122/97
cuggucaagacccgc

SEQ ID NO: 1164152 - RNA, 21 nt, Mycobacterium bovis subsp bovis AF2122/97
cuggucaccaucaccggugcg

SEQ ID NO: 1164153 - RNA, 13 nt, Mycobacterium bovis subsp bovis AF2122/97
cugguagcgcacc

SEQ ID NO: 1164154 - RNA, 20 nt, Mycobacterium bovis subsp bovis AF2122/97
cugguauucaugcccguccu

SEQ ID NO: 1164155 - RNA, 21 nt, Mycobacterium bovis subsp bovis AF2122/97
cuggucgucgaacggcagccc

SEQ ID NO: 1164156 - RNA, 23 nt, Mycobacterium bovis subsp bovis AF2122/97
cuggucgucgaacggcagcccgg

SEQ ID NO: 1164157 - RNA, 13 nt, Mycobacterium bovis subsp bovis AF2122/97
cuggucggugggc

SEQ ID NO: 1164158 - RNA, 16 nt, Mycobacterium bovis subsp bovis AF2122/97
cuggucgcgcagcucc

SEQ ID NO: 1164159 - RNA, 19 nt, Mycobacterium bovis subsp bovis AF2122/97
cuggucgccgugggccugu

SEQ ID NO: 1164160 - RNA, 14 nt, Mycobacterium bovis subsp bovis AF2122/97
cuggucgcggcgcu

SEQ ID NO: 1164161 - RNA, 14 nt, Mycobacterium bovis subsp bovis AF2122/97
cuggucgcaauggu

SEQ ID NO: 1164162 - RNA, 21 nt, Mycobacterium bovis subsp bovis AF2122/97
cuggucgccaacgccagcacc

SEQ ID NO: 1164163 - RNA, 15 nt, Mycobacterium bovis subsp bovis AF2122/97
cuggucgcugcugcg

SEQ ID NO: 1164164 - RNA, 18 nt, Mycobacterium bovis subsp bovis AF2122/97
cuggucgcguccacccac

SEQ ID NO: 1164165 - RNA, 16 nt, Mycobacterium bovis subsp bovis AF2122/97
cuggucgaccaucggu

SEQ ID NO: 1164166 - RNA, 19 nt, Mycobacterium bovis subsp bovis AF2122/97
cuggucgagcacgcugcug

SEQ ID NO: 1164167 - RNA, 19 nt, Mycobacterium bovis subsp bovis AF2122/97
cuggugaucugcugggcaa

SEQ ID NO: 1164168 - RNA, 21 nt, Mycobacterium bovis subsp bovis AF2122/97
cuggugcccgacccgccgaug

SEQ ID NO: 1164169 - RNA, 19 nt, Mycobacterium bovis subsp bovis AF2122/97
cuggugaucagcucaguga

SEQ ID NO: 1164170 - RNA, 15 nt, Mycobacterium bovis subsp bovis AF2122/97
cuggucuugacucca

SEQ ID NO: 1164171 - RNA, 22 nt, Mycobacterium bovis subsp bovis AF2122/97
cugggcgcgaccccaggcgcuc

SEQ ID NO: 1164172 - RNA, 14 nt, Mycobacterium bovis subsp bovis AF2122/97
cugggcgccaccau

SEQ ID NO: 1164173 - RNA, 15 nt, Mycobacterium bovis subsp bovis AF2122/97
cugggcgagacggcg

SEQ ID NO: 1164174 - RNA, 22 nt, Mycobacterium bovis subsp bovis AF2122/97
cuggcgucgaugccggcugccg

SEQ ID NO: 1164175 - RNA, 14 nt, Mycobacterium bovis subsp bovis AF2122/97
cugggccugcggca

SEQ ID NO: 1164176 - RNA, 19 nt, Mycobacterium bovis subsp bovis AF2122/97
cuggcggggaucagcgagu

SEQ ID NO: 1164177 - RNA, 15 nt, Mycobacterium bovis subsp bovis AF2122/97
cuggcggugccggcg

SEQ ID NO: 1164178 - RNA, 22 nt, Mycobacterium bovis subsp bovis AF2122/97
cuggcggcugcagccgaccgaa

SEQ ID NO: 1164179 - RNA, 16 nt, Mycobacterium bovis subsp bovis AF2122/97
cuggcguagugcagcu

SEQ ID NO: 1164180 - RNA, 20 nt, Mycobacterium bovis subsp bovis AF2122/97
cuggcguagugcucgccggc

SEQ ID NO: 1164181 - RNA, 15 nt, Mycobacterium bovis subsp bovis AF2122/97
cugggugcgcgaagg

SEQ ID NO: 1164182 - RNA, 15 nt, Mycobacterium bovis subsp bovis AF2122/97
cugggugccgcagcu

SEQ ID NO: 1164183 - RNA, 16 nt, Mycobacterium bovis subsp bovis AF2122/97
cuggggcgccaccacc

SEQ ID NO: 1164184 - RNA, 16 nt, Mycobacterium bovis subsp bovis AF2122/97
cuggguccacgcgcuc

SEQ ID NO: 1164185 - RNA, 19 nt, Mycobacterium bovis subsp bovis AF2122/97
cuggggcggauaugaugau

SEQ ID NO: 1164186 - RNA, 24 nt, Mycobacterium bovis subsp bovis AF2122/97
cuggguccacgcgcucggugccgc

SEQ ID NO: 1164187 - RNA, 22 nt, Mycobacterium bovis subsp bovis AF2122/97
cuggggauaaacugccgcggca

SEQ ID NO: 1164188 - RNA, 15 nt, Mycobacterium bovis subsp bovis AF2122/97
cugggcuugugggcc

SEQ ID NO: 1164189 - RNA, 12 nt, Mycobacterium bovis subsp bovis AF2122/97
cuggggccacca

SEQ ID NO: 1164190 - RNA, 21 nt, Mycobacterium bovis subsp bovis AF2122/97
cuggggaugcgauggcccggg

SEQ ID NO: 1164191 - RNA, 17 nt, Mycobacterium bovis subsp bovis AF2122/97
cuggggcagccgggcgu

SEQ ID NO: 1164192 - RNA, 19 nt, Mycobacterium bovis subsp bovis AF2122/97
cuguagggccggugacuca

SEQ ID NO: 1164193 - RNA, 19 nt, Mycobacterium bovis subsp bovis AF2122/97
cuguagucccucaucaccu

SEQ ID NO: 1164194 - RNA, 22 nt, Mycobacterium bovis subsp bovis AF2122/97
cuguagucccucaucaccucuc

SEQ ID NO: 1164195 - RNA, 17 nt, Mycobacterium bovis subsp bovis AF2122/97
cuguacccgaccagcac

SEQ ID NO: 1164196 - RNA, 19 nt, Mycobacterium bovis subsp bovis AF2122/97
cuguaacacccggccgccg

SEQ ID NO: 1164197 - RNA, 15 nt, Mycobacterium bovis subsp bovis AF2122/97
cugucggcuuccucc

SEQ ID NO: 1164198 - RNA, 17 nt, Mycobacterium bovis subsp bovis AF2122/97
cugucggcuuccuccuc

SEQ ID NO: 1164199 - RNA, 18 nt, Mycobacterium bovis subsp bovis AF2122/97
cugucggcuuccuccucg

SEQ ID NO: 1164200 - RNA, 22 nt, Mycobacterium bovis subsp bovis AF2122/97
cugucgcgccgguggucagguu

SEQ ID NO: 1164201 - RNA, 14 nt, Mycobacterium bovis subsp bovis AF2122/97
cugucgcgggccac

SEQ ID NO: 1164202 - RNA, 17 nt, Mycobacterium bovis subsp bovis AF2122/97
cugucccagcccggccc

SEQ ID NO: 1164203 - RNA, 15 nt, Mycobacterium bovis subsp bovis AF2122/97
cugucccgccggccc

SEQ ID NO: 1164204 - RNA, 16 nt, Mycobacterium bovis subsp bovis AF2122/97
cugucccgccggcccc

SEQ ID NO: 1164205 - RNA, 23 nt, Mycobacterium bovis subsp bovis AF2122/97
cugucgcccucgaucgccacgac

SEQ ID NO: 1164206 - RNA, 16 nt, Mycobacterium bovis subsp bovis AF2122/97
cugucaccccugggcg

SEQ ID NO: 1164207 - RNA, 14 nt, Mycobacterium bovis subsp bovis AF2122/97
cugucacgccugcc

SEQ ID NO: 1164208 - RNA, 19 nt, Mycobacterium bovis subsp bovis AF2122/97
cugccgaucaauggcaacg

SEQ ID NO: 1164209 - RNA, 17 nt, Mycobacterium bovis subsp bovis AF2122/97
cugccgaccagcgcgcu

SEQ ID NO: 1164210 - RNA, 20 nt, Mycobacterium bovis subsp bovis AF2122/97
cugccgaaguugaagaagcc

SEQ ID NO: 1164211 - RNA, 21 nt, Mycobacterium bovis subsp bovis AF2122/97
cugccgaaguugaagaagcca

SEQ ID NO: 1164212 - RNA, 17 nt, Mycobacterium bovis subsp bovis AF2122/97
cugccgaaacgccgacc

SEQ ID NO: 1164213 - RNA, 18 nt, Mycobacterium bovis subsp bovis AF2122/97
cugccgaagcggccaccg

SEQ ID NO: 1164214 - RNA, 17 nt, Mycobacterium bovis subsp bovis AF2122/97
cugcccgggcugccgcc

SEQ ID NO: 1164215 - RNA, 22 nt, Mycobacterium bovis subsp bovis AF2122/97
cugccggccggcgggccugccc

SEQ ID NO: 1164216 - RNA, 14 nt, Mycobacterium bovis subsp bovis AF2122/97
cugccggcgccgcc

SEQ ID NO: 1164217 - RNA, 16 nt, Mycobacterium bovis subsp bovis AF2122/97
cugccggccggcgggc

SEQ ID NO: 1164218 - RNA, 20 nt, Mycobacterium bovis subsp bovis AF2122/97
cugccggccggcgggccugc

SEQ ID NO: 1164219 - RNA, 21 nt, Mycobacterium bovis subsp bovis AF2122/97
cugccgcuguucggucuugcc

SEQ ID NO: 1164220 - RNA, 18 nt, Mycobacterium bovis subsp bovis AF2122/97
cugccggacuaccgccgg

SEQ ID NO: 1164221 - RNA, 23 nt, Mycobacterium bovis subsp bovis AF2122/97
cugccgcugccgaagcggccacc

SEQ ID NO: 1164222 - RNA, 21 nt, Mycobacterium bovis subsp bovis AF2122/97
cugccgcgggcagcguguaac

SEQ ID NO: 1164223 - RNA, 22 nt, Mycobacterium bovis subsp bovis AF2122/97
cugccgcguagaacccaggccg

SEQ ID NO: 1164224 - RNA, 20 nt, Mycobacterium bovis subsp bovis AF2122/97
cugccgcucgaccccgcgcu

SEQ ID NO: 1164225 - RNA, 21 nt, Mycobacterium bovis subsp bovis AF2122/97
cugccggugucucccuugccg

SEQ ID NO: 1164226 - RNA, 17 nt, Mycobacterium bovis subsp bovis AF2122/97
cugccgguagcacagca

SEQ ID NO: 1164227 - RNA, 20 nt, Mycobacterium bovis subsp bovis AF2122/97
cugccggugugcggcguacu

SEQ ID NO: 1164228 - RNA, 19 nt, Mycobacterium bovis subsp bovis AF2122/97
cugccgggugggcaagcug

SEQ ID NO: 1164229 - RNA, 19 nt, Mycobacterium bovis subsp bovis AF2122/97
cugccguugauucggccgc

SEQ ID NO: 1164230 - RNA, 16 nt, Mycobacterium bovis subsp bovis AF2122/97
cugccguucggggcgc

SEQ ID NO: 1164231 - RNA, 16 nt, Mycobacterium bovis subsp bovis AF2122/97
cugccguugggcaccg

SEQ ID NO: 1164232 - RNA, 15 nt, Mycobacterium bovis subsp bovis AF2122/97
cugccucagaccgga

SEQ ID NO: 1164233 - RNA, 16 nt, Mycobacterium bovis subsp bovis AF2122/97
cugccucaccgccgcu

SEQ ID NO: 1164234 - RNA, 14 nt, Mycobacterium bovis subsp bovis AF2122/97
cugcccaucccggc

SEQ ID NO: 1164235 - RNA, 16 nt, Mycobacterium bovis subsp bovis AF2122/97
cugcccaugcggcagg

SEQ ID NO: 1164236 - RNA, 13 nt, Mycobacterium bovis subsp bovis AF2122/97
cugcccgcggcgg

SEQ ID NO: 1164237 - RNA, 21 nt, Mycobacterium bovis subsp bovis AF2122/97
cugcccgcgcggccaaucagc

SEQ ID NO: 1164238 - RNA, 19 nt, Mycobacterium bovis subsp bovis AF2122/97
cugcccggcccgcucagcc

SEQ ID NO: 1164239 - RNA, 17 nt, Mycobacterium bovis subsp bovis AF2122/97
cugcccggcaaccugga

SEQ ID NO: 1164240 - RNA, 22 nt, Mycobacterium bovis subsp bovis AF2122/97
cugcccagcgguugccgucugc

SEQ ID NO: 1164241 - RNA, 20 nt, Mycobacterium bovis subsp bovis AF2122/97
cugcccaggcaaaccgauca

SEQ ID NO: 1164242 - RNA, 18 nt, Mycobacterium bovis subsp bovis AF2122/97
cugcccaucacacccggu

SEQ ID NO: 1164243 - RNA, 15 nt, Mycobacterium bovis subsp bovis AF2122/97
cugcccaguauaauu

SEQ ID NO: 1164244 - RNA, 14 nt, Mycobacterium bovis subsp bovis AF2122/97
cugccaugcgggug

SEQ ID NO: 1164245 - RNA, 15 nt, Mycobacterium bovis subsp bovis AF2122/97
cugcccagcaccacc

SEQ ID NO: 1164246 - RNA, 15 nt, Mycobacterium bovis subsp bovis AF2122/97
cugccaucacgcgcu

SEQ ID NO: 1164247 - RNA, 19 nt, Mycobacterium bovis subsp bovis AF2122/97
cugccaucccgaucccggc

SEQ ID NO: 1164248 - RNA, 20 nt, Mycobacterium bovis subsp bovis AF2122/97
cugccaguucuuggcgaccu

SEQ ID NO: 1164249 - RNA, 23 nt, Mycobacterium bovis subsp bovis AF2122/97
cugccacuuggacgaacacaccg

SEQ ID NO: 1164250 - RNA, 15 nt, Mycobacterium bovis subsp bovis AF2122/97
cugccagaaugggcg

SEQ ID NO: 1164251 - RNA, 19 nt, Mycobacterium bovis subsp bovis AF2122/97
cugccagagaucagcaccc

SEQ ID NO: 1164252 - RNA, 17 nt, Mycobacterium bovis subsp bovis AF2122/97
cugccaccgugugcacg

SEQ ID NO: 1164253 - RNA, 21 nt, Mycobacterium bovis subsp bovis AF2122/97
cugccacccagcacgcgcgcg

SEQ ID NO: 1164254 - RNA, 13 nt, Mycobacterium bovis subsp bovis AF2122/97
cugccaccagaca

SEQ ID NO: 1164255 - RNA, 19 nt, Mycobacterium bovis subsp bovis AF2122/97
cugccaccagacaacgccg

SEQ ID NO: 1164256 - RNA, 18 nt, Mycobacterium bovis subsp bovis AF2122/97
cugcgcgcccaccgggcg

SEQ ID NO: 1164257 - RNA, 21 nt, Mycobacterium bovis subsp bovis AF2122/97
cugcgcgaugcccacgcacag

SEQ ID NO: 1164258 - RNA, 20 nt, Mycobacterium bovis subsp bovis AF2122/97
cugcgcgauggccguugcca

SEQ ID NO: 1164259 - RNA, 23 nt, Mycobacterium bovis subsp bovis AF2122/97
cugcgcgccguucacccuggugg

SEQ ID NO: 1164260 - RNA, 14 nt, Mycobacterium bovis subsp bovis AF2122/97
cugcgcgcggccgc

SEQ ID NO: 1164261 - RNA, 21 nt, Mycobacterium bovis subsp bovis AF2122/97
cugcgcgcggcggccgcggcu

SEQ ID NO: 1164262 - RNA, 16 nt, Mycobacterium bovis subsp bovis AF2122/97
cugcgcggccaccuca

SEQ ID NO: 1164263 - RNA, 14 nt, Mycobacterium bovis subsp bovis AF2122/97
cugcgcggcugccg

SEQ ID NO: 1164264 - RNA, 22 nt, Mycobacterium bovis subsp bovis AF2122/97
cugcgcgggucguagaccuucu

SEQ ID NO: 1164265 - RNA, 22 nt, Mycobacterium bovis subsp bovis AF2122/97
cugcgcgugcucgacgcgcauc

SEQ ID NO: 1164266 - RNA, 18 nt, Mycobacterium bovis subsp bovis AF2122/97
cugcgccuuggucgccgg

SEQ ID NO: 1164267 - RNA, 16 nt, Mycobacterium bovis subsp bovis AF2122/97
cugcgccuucgccagc

SEQ ID NO: 1164268 - RNA, 18 nt, Mycobacterium bovis subsp bovis AF2122/97
cugcgccuugaagcggug

SEQ ID NO: 1164269 - RNA, 16 nt, Mycobacterium bovis subsp bovis AF2122/97
cugcgcgaagccacca

SEQ ID NO: 1164270 - RNA, 20 nt, Mycobacterium bovis subsp bovis AF2122/97
cugcgccgcccgcgccaccg

SEQ ID NO: 1164271 - RNA, 18 nt, Mycobacterium bovis subsp bovis AF2122/97
cugcgcgacgacauuggu

SEQ ID NO: 1164272 - RNA, 18 nt, Mycobacterium bovis subsp bovis AF2122/97
cugcgcccguccgcgcgc

SEQ ID NO: 1164273 - RNA, 16 nt, Mycobacterium bovis subsp bovis AF2122/97
cugcgcccggaccacu

SEQ ID NO: 1164274 - RNA, 12 nt, Mycobacterium bovis subsp bovis AF2122/97
cugcgccgaccc

SEQ ID NO: 1164275 - RNA, 18 nt, Mycobacterium bovis subsp bovis AF2122/97
cugcgccgacccgcgcgc

SEQ ID NO: 1164276 - RNA, 19 nt, Mycobacterium bovis subsp bovis AF2122/97
cugcgccgacccgcgcgcc

SEQ ID NO: 1164277 - RNA, 16 nt, Mycobacterium bovis subsp bovis AF2122/97
cugcgccgauacguga

SEQ ID NO: 1164278 - RNA, 20 nt, Mycobacterium bovis subsp bovis AF2122/97
cugcgccgaacgcuccaggc

SEQ ID NO: 1164279 - RNA, 15 nt, Mycobacterium bovis subsp bovis AF2122/97
cugcgccgccacagc

SEQ ID NO: 1164280 - RNA, 16 nt, Mycobacterium bovis subsp bovis AF2122/97
cugcgccgccagcgcc

SEQ ID NO: 1164281 - RNA, 15 nt, Mycobacterium bovis subsp bovis AF2122/97
cugcgcagccgccuc

SEQ ID NO: 1164282 - RNA, 15 nt, Mycobacterium bovis subsp bovis AF2122/97
cugcgcaucggucca

SEQ ID NO: 1164283 - RNA, 19 nt, Mycobacterium bovis subsp bovis AF2122/97
cugcgcaucgguccaaagc

SEQ ID NO: 1164284 - RNA, 21 nt, Mycobacterium bovis subsp bovis AF2122/97
cugcgccaaaauccgcccacc

SEQ ID NO: 1164285 - RNA, 15 nt, Mycobacterium bovis subsp bovis AF2122/97
cugcgcccauagcug

SEQ ID NO: 1164286 - RNA, 21 nt, Mycobacterium bovis subsp bovis AF2122/97
cugccuggccgggaccgcccc

SEQ ID NO: 1164287 - RNA, 18 nt, Mycobacterium bovis subsp bovis AF2122/97
cugccuggccgggaccgc

SEQ ID NO: 1164288 - RNA, 20 nt, Mycobacterium bovis subsp bovis AF2122/97
cugcggauagugguugcggc

SEQ ID NO: 1164289 - RNA, 22 nt, Mycobacterium bovis subsp bovis AF2122/97
cugcggauagugguugcggccg

SEQ ID NO: 1164290 - RNA, 20 nt, Mycobacterium bovis subsp bovis AF2122/97
cugcggauacagccgccgcc

SEQ ID NO: 1164291 - RNA, 18 nt, Mycobacterium bovis subsp bovis AF2122/97
cugcggaccggcgcgcuc

SEQ ID NO: 1164292 - RNA, 14 nt, Mycobacterium bovis subsp bovis AF2122/97
cugcggaagccacc

SEQ ID NO: 1164293 - RNA, 19 nt, Mycobacterium bovis subsp bovis AF2122/97
cugcggaggcgaccccggc

SEQ ID NO: 1164294 - RNA, 15 nt, Mycobacterium bovis subsp bovis AF2122/97
cugcggaggcgggug

SEQ ID NO: 1164295 - RNA, 14 nt, Mycobacterium bovis subsp bovis AF2122/97
cugcgggccgagau

SEQ ID NO: 1164296 - RNA, 12 nt, Mycobacterium bovis subsp bovis AF2122/97
cugcgggccggc

SEQ ID NO: 1164297 - RNA, 19 nt, Mycobacterium bovis subsp bovis AF2122/97
cugcgggcgggucugggug

SEQ ID NO: 1164298 - RNA, 22 nt, Mycobacterium bovis subsp bovis AF2122/97
cugcgggucgugccccggcgcg

SEQ ID NO: 1164299 - RNA, 16 nt, Mycobacterium bovis subsp bovis AF2122/97
cugcgggucagcgccg

SEQ ID NO: 1164300 - RNA, 21 nt, Mycobacterium bovis subsp bovis AF2122/97
cugcggggcgauccccagcac

SEQ ID NO: 1164301 - RNA, 20 nt, Mycobacterium bovis subsp bovis AF2122/97
cugcggggguacgucaccgg

SEQ ID NO: 1164302 - RNA, 17 nt, Mycobacterium bovis subsp bovis AF2122/97
cugcggucaauguggcg

SEQ ID NO: 1164303 - RNA, 17 nt, Mycobacterium bovis subsp bovis AF2122/97
cugcgguccgcugccau

SEQ ID NO: 1164304 - RNA, 19 nt, Mycobacterium bovis subsp bovis AF2122/97
cugcggucgaacaucaucg

SEQ ID NO: 1164305 - RNA, 13 nt, Mycobacterium bovis subsp bovis AF2122/97
cugcgugggccug

SEQ ID NO: 1164306 - RNA, 15 nt, Mycobacterium bovis subsp bovis AF2122/97
cugcggugcgggcuu

SEQ ID NO: 1164307 - RNA, 18 nt, Mycobacterium bovis subsp bovis AF2122/97
cugaucgcgauccacccg

SEQ ID NO: 1164308 - RNA, 22 nt, Mycobacterium bovis subsp bovis AF2122/97
cugauccgccugccgacggcau

SEQ ID NO: 1164309 - RNA, 17 nt, Mycobacterium bovis subsp bovis AF2122/97
cugaucccggccaggcc

SEQ ID NO: 1164310 - RNA, 15 nt, Mycobacterium bovis subsp bovis AF2122/97
cugaucaaggcgcuc

SEQ ID NO: 1164311 - RNA, 18 nt, Mycobacterium bovis subsp bovis AF2122/97
cugaucaagugccagcgu

SEQ ID NO: 1164312 - RNA, 17 nt, Mycobacterium bovis subsp bovis AF2122/97
cugaggcuuccagcucg

SEQ ID NO: 1164313 - RNA, 23 nt, Mycobacterium bovis subsp bovis AF2122/97
cugagggcggaaaaucggcuggc

SEQ ID NO: 1164314 - RNA, 22 nt, Mycobacterium bovis subsp bovis AF2122/97
cugagguaggacucacgcagcg

SEQ ID NO: 1164315 - RNA, 17 nt, Mycobacterium bovis subsp bovis AF2122/97
cugaguuuaugcccggc

SEQ ID NO: 1164316 - RNA, 18 nt, Mycobacterium bovis subsp bovis AF2122/97
cugaguugcgggcuuuga

SEQ ID NO: 1164317 - RNA, 19 nt, Mycobacterium bovis subsp bovis AF2122/97
cugagucgguucagccacg

SEQ ID NO: 1164318 - RNA, 18 nt, Mycobacterium bovis subsp bovis AF2122/97
cugaguccccaggugggc

SEQ ID NO: 1164319 - RNA, 22 nt, Mycobacterium bovis subsp bovis AF2122/97
cugaguccccaggugggcagca

SEQ ID NO: 1164320 - RNA, 23 nt, Mycobacterium bovis subsp bovis AF2122/97
cugaguccccaggugggcagcag

SEQ ID NO: 1164321 - RNA, 16 nt, Mycobacterium bovis subsp bovis AF2122/97
cugaguggcgaguggc

SEQ ID NO: 1164322 - RNA, 16 nt, Mycobacterium bovis subsp bovis AF2122/97
cugagcuggcagcucc

SEQ ID NO: 1164323 - RNA, 22 nt, Mycobacterium bovis subsp bovis AF2122/97
cugagcugcucgccggccaacu

SEQ ID NO: 1164324 - RNA, 12 nt, Mycobacterium bovis subsp bovis AF2122/97
cugagcugccga

SEQ ID NO: 1164325 - RNA, 15 nt, Mycobacterium bovis subsp bovis AF2122/97
cugagcugccgagcg

SEQ ID NO: 1164326 - RNA, 12 nt, Mycobacterium bovis subsp bovis AF2122/97
cugaggcaccuc

SEQ ID NO: 1164327 - RNA, 15 nt, Mycobacterium bovis subsp bovis AF2122/97
cugaucggcgcggcc

SEQ ID NO: 1164328 - RNA, 19 nt, Mycobacterium bovis subsp bovis AF2122/97
cugaucugcgcaaccgagc

SEQ ID NO: 1164329 - RNA, 14 nt, Mycobacterium bovis subsp bovis AF2122/97
cugaucugcguugc

SEQ ID NO: 1164330 - RNA, 18 nt, Mycobacterium bovis subsp bovis AF2122/97
cugaucuuggcccgggcc

SEQ ID NO: 1164331 - RNA, 16 nt, Mycobacterium bovis subsp bovis AF2122/97
cugaucuggggcacca

SEQ ID NO: 1164332 - RNA, 19 nt, Mycobacterium bovis subsp bovis AF2122/97
cugaugugaguccagccgg

SEQ ID NO: 1164333 - RNA, 19 nt, Mycobacterium bovis subsp bovis AF2122/97
cugauugagguagaccugg

SEQ ID NO: 1164334 - RNA, 21 nt, Mycobacterium bovis subsp bovis AF2122/97
cugauuguguuccaccagcgc

SEQ ID NO: 1164335 - RNA, 19 nt, Mycobacterium bovis subsp bovis AF2122/97
cugcaacgucacucccugg

SEQ ID NO: 1164336 - RNA, 21 nt, Mycobacterium bovis subsp bovis AF2122/97
cugcaaggaauuccggcugcu

SEQ ID NO: 1164337 - RNA, 18 nt, Mycobacterium bovis subsp bovis AF2122/97
cugcaacucuucccauuu

SEQ ID NO: 1164338 - RNA, 18 nt, Mycobacterium bovis subsp bovis AF2122/97
cugcaagaaccacugcau

SEQ ID NO: 1164339 - RNA, 21 nt, Mycobacterium bovis subsp bovis AF2122/97
cugauuucuuuaaaccccugg

SEQ ID NO: 1164340 - RNA, 21 nt, Mycobacterium bovis subsp bovis AF2122/97
cugcagguuaggguccagguc

SEQ ID NO: 1164341 - RNA, 16 nt, Mycobacterium bovis subsp bovis AF2122/97
cugcagguccagggug

SEQ ID NO: 1164342 - RNA, 21 nt, Mycobacterium bovis subsp bovis AF2122/97
cugcaguguuuuugcagacuc

SEQ ID NO: 1164343 - RNA, 13 nt, Mycobacterium bovis subsp bovis AF2122/97
cugcagucagcuc

SEQ ID NO: 1164344 - RNA, 23 nt, Mycobacterium bovis subsp bovis AF2122/97
cugcagugacucgaucaccauga

SEQ ID NO: 1164345 - RNA, 20 nt, Mycobacterium bovis subsp bovis AF2122/97
cugcaggcggccgagcuggu

SEQ ID NO: 1164346 - RNA, 16 nt, Mycobacterium bovis subsp bovis AF2122/97
cugcaggcggccuugc

SEQ ID NO: 1164347 - RNA, 21 nt, Mycobacterium bovis subsp bovis AF2122/97
cugcaggcugucgagucgguc

SEQ ID NO: 1164348 - RNA, 14 nt, Mycobacterium bovis subsp bovis AF2122/97
cugcagggcgugau

SEQ ID NO: 1164349 - RNA, 15 nt, Mycobacterium bovis subsp bovis AF2122/97
cugcagggccuggcc

SEQ ID NO: 1164350 - RNA, 20 nt, Mycobacterium bovis subsp bovis AF2122/97
cugcagggccuggccacacu

SEQ ID NO: 1164351 - RNA, 18 nt, Mycobacterium bovis subsp bovis AF2122/97
cugcagauaggacccagc

SEQ ID NO: 1164352 - RNA, 22 nt, Mycobacterium bovis subsp bovis AF2122/97
cugcagaucguagugcgcgcca

SEQ ID NO: 1164353 - RNA, 13 nt, Mycobacterium bovis subsp bovis AF2122/97
cugcagacgcccc

SEQ ID NO: 1164354 - RNA, 15 nt, Mycobacterium bovis subsp bovis AF2122/97
cugcagacgguccgc

SEQ ID NO: 1164355 - RNA, 18 nt, Mycobacterium bovis subsp bovis AF2122/97
cugcacgugacccugggg

SEQ ID NO: 1164356 - RNA, 16 nt, Mycobacterium bovis subsp bovis AF2122/97
cugcacugcgcgugcu

SEQ ID NO: 1164357 - RNA, 23 nt, Mycobacterium bovis subsp bovis AF2122/97
cugcacuugaaauugagccggcc

SEQ ID NO: 1164358 - RNA, 21 nt, Mycobacterium bovis subsp bovis AF2122/97
cugcacggagccgccggcggu

SEQ ID NO: 1164359 - RNA, 23 nt, Mycobacterium bovis subsp bovis AF2122/97
cuccagcgaaccgacccggccgc

SEQ ID NO: 1164360 - RNA, 17 nt, Mycobacterium bovis subsp bovis AF2122/97
cuccagcgcaccgguga

SEQ ID NO: 1164361 - RNA, 15 nt, Mycobacterium bovis subsp bovis AF2122/97
cuccagccgcaacac

SEQ ID NO: 1164362 - RNA, 15 nt, Mycobacterium bovis subsp bovis AF2122/97
cuccagcgcccgguc

SEQ ID NO: 1164363 - RNA, 18 nt, Mycobacterium bovis subsp bovis AF2122/97
cuccagcgcgcgccgcag

SEQ ID NO: 1164364 - RNA, 14 nt, Mycobacterium bovis subsp bovis AF2122/97
cuccaggcgccacc

SEQ ID NO: 1164365 - RNA, 14 nt, Mycobacterium bovis subsp bovis AF2122/97
cuccaguggcgcca

SEQ ID NO: 1164366 - RNA, 15 nt, Mycobacterium bovis subsp bovis AF2122/97
cuccagugcggccuu

SEQ ID NO: 1164367 - RNA, 20 nt, Mycobacterium bovis subsp bovis AF2122/97
cuccagugcggccuuggcga

SEQ ID NO: 1164368 - RNA, 12 nt, Mycobacterium bovis subsp bovis AF2122/97
cuccagggcccu

SEQ ID NO: 1164369 - RNA, 22 nt, Mycobacterium bovis subsp bovis AF2122/97
cuccaggcugaaaccuugcggc

SEQ ID NO: 1164370 - RNA, 15 nt, Mycobacterium bovis subsp bovis AF2122/97
cuccagguuccaggu

SEQ ID NO: 1164371 - RNA, 15 nt, Mycobacterium bovis subsp bovis AF2122/97
cuccaucaccacacc

SEQ ID NO: 1164372 - RNA, 13 nt, Mycobacterium bovis subsp bovis AF2122/97
cuccagcagcccg

SEQ ID NO: 1164373 - RNA, 17 nt, Mycobacterium bovis subsp bovis AF2122/97
cuccagcacccggucga

SEQ ID NO: 1164374 - RNA, 16 nt, Mycobacterium bovis subsp bovis AF2122/97
cuccagcaccacggcg

SEQ ID NO: 1164375 - RNA, 22 nt, Mycobacterium bovis subsp bovis AF2122/97
cuccagcaccacggcgcgcgcg

SEQ ID NO: 1164376 - RNA, 17 nt, Mycobacterium bovis subsp bovis AF2122/97
cuccagauaccaccgcc

SEQ ID NO: 1164377 - RNA, 17 nt, Mycobacterium bovis subsp bovis AF2122/97
cuccagauacaggaaca

SEQ ID NO: 1164378 - RNA, 16 nt, Mycobacterium bovis subsp bovis AF2122/97
cuccagcaaggccagc

SEQ ID NO: 1164379 - RNA, 18 nt, Mycobacterium bovis subsp bovis AF2122/97
cuccagcaaggccagcac

SEQ ID NO: 1164380 - RNA, 17 nt, Mycobacterium bovis subsp bovis AF2122/97
cuccagagacagcgcca

SEQ ID NO: 1164381 - RNA, 15 nt, Mycobacterium bovis subsp bovis AF2122/97
cuccacgcccuggcg

SEQ ID NO: 1164382 - RNA, 16 nt, Mycobacterium bovis subsp bovis AF2122/97
cuccacgcuggcgccc

SEQ ID NO: 1164383 - RNA, 11 nt, Mycobacterium bovis subsp bovis AF2122/97
cuccaccuucu

SEQ ID NO: 1164384 - RNA, 23 nt, Mycobacterium bovis subsp bovis AF2122/97
cuccaccuucugguccagcaccg

SEQ ID NO: 1164385 - RNA, 15 nt, Mycobacterium bovis subsp bovis AF2122/97
cuccacugaccaggu

SEQ ID NO: 1164386 - RNA, 18 nt, Mycobacterium bovis subsp bovis AF2122/97
cuccaccgggcccgccgg

SEQ ID NO: 1164387 - RNA, 23 nt, Mycobacterium bovis subsp bovis AF2122/97
cuccaccgggcccgccggccccg

SEQ ID NO: 1164388 - RNA, 13 nt, Mycobacterium bovis subsp bovis AF2122/97
cuccaccgggccc

SEQ ID NO: 1164389 - RNA, 20 nt, Mycobacterium bovis subsp bovis AF2122/97
cuccgccagaauugccggcg

SEQ ID NO: 1164390 - RNA, 21 nt, Mycobacterium bovis subsp bovis AF2122/97
cuccgccgagcagacgcagaa

SEQ ID NO: 1164391 - RNA, 17 nt, Mycobacterium bovis subsp bovis AF2122/97
cuccgccgaggaaacca

SEQ ID NO: 1164392 - RNA, 20 nt, Mycobacterium bovis subsp bovis AF2122/97
cuccgccgaggaaaccacca

SEQ ID NO: 1164393 - RNA, 14 nt, Mycobacterium bovis subsp bovis AF2122/97
cuccgccgcgggcu

SEQ ID NO: 1164394 - RNA, 21 nt, Mycobacterium bovis subsp bovis AF2122/97
cuccgccgcgggcuccccggc

SEQ ID NO: 1164395 - RNA, 23 nt, Mycobacterium bovis subsp bovis AF2122/97
cuccggcgcuccacugaccaggu

SEQ ID NO: 1164396 - RNA, 16 nt, Mycobacterium bovis subsp bovis AF2122/97
cuccggcccugccgcc

SEQ ID NO: 1164397 - RNA, 21 nt, Mycobacterium bovis subsp bovis AF2122/97
cuccggcccugccgccggccc

SEQ ID NO: 1164398 - RNA, 20 nt, Mycobacterium bovis subsp bovis AF2122/97
cuccggcgacgaucucgccg

SEQ ID NO: 1164399 - RNA, 16 nt, Mycobacterium bovis subsp bovis AF2122/97
cuccggcgcaccuggg

SEQ ID NO: 1164400 - RNA, 21 nt, Mycobacterium bovis subsp bovis AF2122/97
cuccggcgcaccugggcugcc

SEQ ID NO: 1164401 - RNA, 20 nt, Mycobacterium bovis subsp bovis AF2122/97
cuccggcggcagcggcgccg

SEQ ID NO: 1164402 - RNA, 16 nt, Mycobacterium bovis subsp bovis AF2122/97
cuccgggaugaagcuc

SEQ ID NO: 1164403 - RNA, 19 nt, Mycobacterium bovis subsp bovis AF2122/97
cuccgggcgcaccaagacg

SEQ ID NO: 1164404 - RNA, 16 nt, Mycobacterium bovis subsp bovis AF2122/97
cuccggccgcacgccu

SEQ ID NO: 1164405 - RNA, 23 nt, Mycobacterium bovis subsp bovis AF2122/97
cuccucgaugaggcgcagcgcca

SEQ ID NO: 1164406 - RNA, 20 nt, Mycobacterium bovis subsp bovis AF2122/97
cuccucggcguggcaguaca

SEQ ID NO: 1164407 - RNA, 21 nt, Mycobacterium bovis subsp bovis AF2122/97
cuccucgauagcggcgccuga

SEQ ID NO: 1164408 - RNA, 17 nt, Mycobacterium bovis subsp bovis AF2122/97
cuccucgaccgcggccu

SEQ ID NO: 1164409 - RNA, 18 nt, Mycobacterium bovis subsp bovis AF2122/97
cuccucgaccguggcggc

SEQ ID NO: 1164410 - RNA, 22 nt, Mycobacterium bovis subsp bovis AF2122/97
cuccucgaccguggcggccucc

SEQ ID NO: 1164411 - RNA, 22 nt, Mycobacterium bovis subsp bovis AF2122/97
cuccucgaaggcuucgcuggcu

SEQ ID NO: 1164412 - RNA, 16 nt, Mycobacterium bovis subsp bovis AF2122/97
cuccucgaccagagcc

SEQ ID NO: 1164413 - RNA, 23 nt, Mycobacterium bovis subsp bovis AF2122/97
cuccuccuugagccgggcaacca

SEQ ID NO: 1164414 - RNA, 20 nt, Mycobacterium bovis subsp bovis AF2122/97
cuccgggucgaugucggggc

SEQ ID NO: 1164415 - RNA, 15 nt, Mycobacterium bovis subsp bovis AF2122/97
cuccguuuggcugcc

SEQ ID NO: 1164416 - RNA, 16 nt, Mycobacterium bovis subsp bovis AF2122/97
cuccguuuggcugccg

SEQ ID NO: 1164417 - RNA, 23 nt, Mycobacterium bovis subsp bovis AF2122/97
cuccgguaucggcgaccagcugu

SEQ ID NO: 1164418 - RNA, 20 nt, Mycobacterium bovis subsp bovis AF2122/97
cucccgcgcuuggcuccaca

SEQ ID NO: 1164419 - RNA, 13 nt, Mycobacterium bovis subsp bovis AF2122/97
cucccgcgccggc

SEQ ID NO: 1164420 - RNA, 16 nt, Mycobacterium bovis subsp bovis AF2122/97
cucccgccacugcugg

SEQ ID NO: 1164421 - RNA, 15 nt, Mycobacterium bovis subsp bovis AF2122/97
cucccgagccacaaa

SEQ ID NO: 1164422 - RNA, 17 nt, Mycobacterium bovis subsp bovis AF2122/97
cucccgaaaagcgccuc

SEQ ID NO: 1164423 - RNA, 14 nt, Mycobacterium bovis subsp bovis AF2122/97
cucccgaccgccga

SEQ ID NO: 1164424 - RNA, 22 nt, Mycobacterium bovis subsp bovis AF2122/97
cucccgcaacauuuucgcccgc

SEQ ID NO: 1164425 - RNA, 12 nt, Mycobacterium bovis subsp bovis AF2122/97
cucccccacaca

SEQ ID NO: 1164426 - RNA, 17 nt, Mycobacterium bovis subsp bovis AF2122/97
cuccccgaccgcgcccg

SEQ ID NO: 1164427 - RNA, 15 nt, Mycobacterium bovis subsp bovis AF2122/97
cucccuggggccguc

SEQ ID NO: 1164428 - RNA, 18 nt, Mycobacterium bovis subsp bovis AF2122/97
cuccgauuccgaacuggu

SEQ ID NO: 1164429 - RNA, 20 nt, Mycobacterium bovis subsp bovis AF2122/97
cucccauucccaacacagcc

SEQ ID NO: 1164430 - RNA, 14 nt, Mycobacterium bovis subsp bovis AF2122/97
cuccccagagcugg

SEQ ID NO: 1164431 - RNA, 15 nt, Mycobacterium bovis subsp bovis AF2122/97
cucccagaacgccgu

SEQ ID NO: 1164432 - RNA, 18 nt, Mycobacterium bovis subsp bovis AF2122/97
cucccaggccgccgccag

SEQ ID NO: 1164433 - RNA, 20 nt, Mycobacterium bovis subsp bovis AF2122/97
cucccagggcucggcggccc

SEQ ID NO: 1164434 - RNA, 22 nt, Mycobacterium bovis subsp bovis AF2122/97
cucccagggcucggcggcccgg

SEQ ID NO: 1164435 - RNA, 18 nt, Mycobacterium bovis subsp bovis AF2122/97
cuccauugccggauuugu

SEQ ID NO: 1164436 - RNA, 18 nt, Mycobacterium bovis subsp bovis AF2122/97
cuccauggccugauucca

SEQ ID NO: 1164437 - RNA, 22 nt, Mycobacterium bovis subsp bovis AF2122/97
cuccauggcauugcuccgguug

SEQ ID NO: 1164438 - RNA, 15 nt, Mycobacterium bovis subsp bovis AF2122/97
cucggccgccagccc

SEQ ID NO: 1164439 - RNA, 13 nt, Mycobacterium bovis subsp bovis AF2122/97
cucggcccggccc

SEQ ID NO: 1164440 - RNA, 18 nt, Mycobacterium bovis subsp bovis AF2122/97
cucggccgaggaccagag

SEQ ID NO: 1164441 - RNA, 15 nt, Mycobacterium bovis subsp bovis AF2122/97
cucggccgcaccagc

SEQ ID NO: 1164442 - RNA, 17 nt, Mycobacterium bovis subsp bovis AF2122/97
cucggccgcaggcuugc

SEQ ID NO: 1164443 - RNA, 13 nt, Mycobacterium bovis subsp bovis AF2122/97
cucggccggcggc

SEQ ID NO: 1164444 - RNA, 14 nt, Mycobacterium bovis subsp bovis AF2122/97
cucggcgcccagcu

SEQ ID NO: 1164445 - RNA, 13 nt, Mycobacterium bovis subsp bovis AF2122/97
cucggcgcagcac

SEQ ID NO: 1164446 - RNA, 22 nt, Mycobacterium bovis subsp bovis AF2122/97
cucggcgcagcacauccugcag

SEQ ID NO: 1164447 - RNA, 15 nt, Mycobacterium bovis subsp bovis AF2122/97
cucggcgcagccggu

SEQ ID NO: 1164448 - RNA, 16 nt, Mycobacterium bovis subsp bovis AF2122/97
cucggccccgccgccg

SEQ ID NO: 1164449 - RNA, 18 nt, Mycobacterium bovis subsp bovis AF2122/97
cucggcccagcgcgccag

SEQ ID NO: 1164450 - RNA, 17 nt, Mycobacterium bovis subsp bovis AF2122/97
cucggccauagcgccgc

SEQ ID NO: 1164451 - RNA, 13 nt, Mycobacterium bovis subsp bovis AF2122/97
cucggccaggaug

SEQ ID NO: 1164452 - RNA, 16 nt, Mycobacterium bovis subsp bovis AF2122/97
cucggaucgccaggcc

SEQ ID NO: 1164453 - RNA, 17 nt, Mycobacterium bovis subsp bovis AF2122/97
cucggaucggcucgcca

SEQ ID NO: 1164454 - RNA, 20 nt, Mycobacterium bovis subsp bovis AF2122/97
cucggaccagacccacgaug

SEQ ID NO: 1164455 - RNA, 15 nt, Mycobacterium bovis subsp bovis AF2122/97
cucggaguugagcug

SEQ ID NO: 1164456 - RNA, 18 nt, Mycobacterium bovis subsp bovis AF2122/97
cucggaccagacccacga

SEQ ID NO: 1164457 - RNA, 20 nt, Mycobacterium bovis subsp bovis AF2122/97
cucgcuuagcgucgcugccc

SEQ ID NO: 1164458 - RNA, 18 nt, Mycobacterium bovis subsp bovis AF2122/97
cucgcuguugaagccgcc

SEQ ID NO: 1164459 - RNA, 19 nt, Mycobacterium bovis subsp bovis AF2122/97
cucgcuguugaagccgccc

SEQ ID NO: 1164460 - RNA, 20 nt, Mycobacterium bovis subsp bovis AF2122/97
cucgcuguugaagccgcccg

SEQ ID NO: 1164461 - RNA, 17 nt, Mycobacterium bovis subsp bovis AF2122/97
cucgcugggcucauggc

SEQ ID NO: 1164462 - RNA, 15 nt, Mycobacterium bovis subsp bovis AF2122/97
cucggcggagaaaag

SEQ ID NO: 1164463 - RNA, 17 nt, Mycobacterium bovis subsp bovis AF2122/97
cucggcguacucgugca

SEQ ID NO: 1164464 - RNA, 16 nt, Mycobacterium bovis subsp bovis AF2122/97
cucggcguugccgccg

SEQ ID NO: 1164465 - RNA, 14 nt, Mycobacterium bovis subsp bovis AF2122/97
cucggcggaagacc

SEQ ID NO: 1164466 - RNA, 17 nt, Mycobacterium bovis subsp bovis AF2122/97
cucgggcaggccccacu

SEQ ID NO: 1164467 - RNA, 18 nt, Mycobacterium bovis subsp bovis AF2122/97
cucgggacugcgcggcuu

SEQ ID NO: 1164468 - RNA, 16 nt, Mycobacterium bovis subsp bovis AF2122/97
cucgggcaggccccac

SEQ ID NO: 1164469 - RNA, 21 nt, Mycobacterium bovis subsp bovis AF2122/97
cucgguccaauuccagcucac

SEQ ID NO: 1164470 - RNA, 17 nt, Mycobacterium bovis subsp bovis AF2122/97
cucggucagcgucaggu

SEQ ID NO: 1164471 - RNA, 18 nt, Mycobacterium bovis subsp bovis AF2122/97
cucggucagcgucaggug

SEQ ID NO: 1164472 - RNA, 16 nt, Mycobacterium bovis subsp bovis AF2122/97
cucggucagccccaug

SEQ ID NO: 1164473 - RNA, 22 nt, Mycobacterium bovis subsp bovis AF2122/97
cucgggcaccuggucggccgca

SEQ ID NO: 1164474 - RNA, 19 nt, Mycobacterium bovis subsp bovis AF2122/97
cucgggcagcgucacccug

SEQ ID NO: 1164475 - RNA, 19 nt, Mycobacterium bovis subsp bovis AF2122/97
cucggugaaguggcgcacc

SEQ ID NO: 1164476 - RNA, 23 nt, Mycobacterium bovis subsp bovis AF2122/97
cucggugaaguggcgcaccaccu

SEQ ID NO: 1164477 - RNA, 14 nt, Mycobacterium bovis subsp bovis AF2122/97
cucggucugcaugc

SEQ ID NO: 1164478 - RNA, 17 nt, Mycobacterium bovis subsp bovis AF2122/97
cucggugaacgccgccc

SEQ ID NO: 1164479 - RNA, 19 nt, Mycobacterium bovis subsp bovis AF2122/97
cucggugaccaggccggcc

SEQ ID NO: 1164480 - RNA, 22 nt, Mycobacterium bovis subsp bovis AF2122/97
cucggugaccaggccggcccgc

SEQ ID NO: 1164481 - RNA, 14 nt, Mycobacterium bovis subsp bovis AF2122/97
cucggucggcagcu

SEQ ID NO: 1164482 - RNA, 17 nt, Mycobacterium bovis subsp bovis AF2122/97
cucggucggcagcucca

SEQ ID NO: 1164483 - RNA, 14 nt, Mycobacterium bovis subsp bovis AF2122/97
cucggucgccaccg

SEQ ID NO: 1164484 - RNA, 20 nt, Mycobacterium bovis subsp bovis AF2122/97
cucggucccguugccgccca

SEQ ID NO: 1164485 - RNA, 22 nt, Mycobacterium bovis subsp bovis AF2122/97
cucgugcaggaccagcaccgcc

SEQ ID NO: 1164486 - RNA, 13 nt, Mycobacterium bovis subsp bovis AF2122/97
cucgugcagcacu

SEQ ID NO: 1164487 - RNA, 18 nt, Mycobacterium bovis subsp bovis AF2122/97
cucgugcaggaccagcac

SEQ ID NO: 1164488 - RNA, 21 nt, Mycobacterium bovis subsp bovis AF2122/97
cucguggauggccgccaggcg

SEQ ID NO: 1164489 - RNA, 19 nt, Mycobacterium bovis subsp bovis AF2122/97
cucgugcgugggcgcggcg

SEQ ID NO: 1164490 - RNA, 23 nt, Mycobacterium bovis subsp bovis AF2122/97
cucgugcgugggcgcggcgccag

SEQ ID NO: 1164491 - RNA, 15 nt, Mycobacterium bovis subsp bovis AF2122/97
cucguggaucugccu

SEQ ID NO: 1164492 - RNA, 17 nt, Mycobacterium bovis subsp bovis AF2122/97
cucguggaucugccucu

SEQ ID NO: 1164493 - RNA, 16 nt, Mycobacterium bovis subsp bovis AF2122/97
cucguggauggccgcc

SEQ ID NO: 1164494 - RNA, 15 nt, Mycobacterium bovis subsp bovis AF2122/97
cucuacucgcggccg

SEQ ID NO: 1164495 - RNA, 17 nt, Mycobacterium bovis subsp bovis AF2122/97
cucggugaucaccauga

SEQ ID NO: 1164496 - RNA, 23 nt, Mycobacterium bovis subsp bovis AF2122/97
cucgguucggagucacgcagccg

SEQ ID NO: 1164497 - RNA, 18 nt, Mycobacterium bovis subsp bovis AF2122/97
cucgguuugcguccuggu

SEQ ID NO: 1164498 - RNA, 22 nt, Mycobacterium bovis subsp bovis AF2122/97
cucgguuugggaauccgcaucu

SEQ ID NO: 1164499 - RNA, 16 nt, Mycobacterium bovis subsp bovis AF2122/97
cucgguuagcugcucu

SEQ ID NO: 1164500 - RNA, 13 nt, Mycobacterium bovis subsp bovis AF2122/97
cucguacccggcc

SEQ ID NO: 1164501 - RNA, 18 nt, Mycobacterium bovis subsp bovis AF2122/97
cucguccaggucggccgc

SEQ ID NO: 1164502 - RNA, 22 nt, Mycobacterium bovis subsp bovis AF2122/97
cucguccaggucggccgccucg

SEQ ID NO: 1164503 - RNA, 18 nt, Mycobacterium bovis subsp bovis AF2122/97
cucgucgaggucagcucc

SEQ ID NO: 1164504 - RNA, 20 nt, Mycobacterium bovis subsp bovis AF2122/97
cucgucgaugucguuggcca

SEQ ID NO: 1164505 - RNA, 22 nt, Mycobacterium bovis subsp bovis AF2122/97
cucgucgaugucguuggccacc

SEQ ID NO: 1164506 - RNA, 21 nt, Mycobacterium bovis subsp bovis AF2122/97
cucguccggugcgaucccacc

SEQ ID NO: 1164507 - RNA, 16 nt, Mycobacterium bovis subsp bovis AF2122/97
cucguccuggaaccaa

SEQ ID NO: 1164508 - RNA, 23 nt, Mycobacterium bovis subsp bovis AF2122/97
cucguccugacgguacagcucca

SEQ ID NO: 1164509 - RNA, 16 nt, Mycobacterium bovis subsp bovis AF2122/97
cucguccggugcgauc

SEQ ID NO: 1164510 - RNA, 15 nt, Mycobacterium bovis subsp bovis AF2122/97
cucgucgcaucacca

SEQ ID NO: 1164511 - RNA, 16 nt, Mycobacterium bovis subsp bovis AF2122/97
cucgucgccgguggca

SEQ ID NO: 1164512 - RNA, 21 nt, Mycobacterium bovis subsp bovis AF2122/97
cucgugcacgcacagcccgau

SEQ ID NO: 1164513 - RNA, 16 nt, Mycobacterium bovis subsp bovis AF2122/97
cucgacggcgccgccc

SEQ ID NO: 1164514 - RNA, 16 nt, Mycobacterium bovis subsp bovis AF2122/97
cucgacguacagcgcg

SEQ ID NO: 1164515 - RNA, 15 nt, Mycobacterium bovis subsp bovis AF2122/97
cucgagaguggccuc

SEQ ID NO: 1164516 - RNA, 20 nt, Mycobacterium bovis subsp bovis AF2122/97
cucgaccaggaacggcucgg

SEQ ID NO: 1164517 - RNA, 18 nt, Mycobacterium bovis subsp bovis AF2122/97
cucgacggcccgccgucc

SEQ ID NO: 1164518 - RNA, 16 nt, Mycobacterium bovis subsp bovis AF2122/97
cucgaccagacgcugc

SEQ ID NO: 1164519 - RNA, 20 nt, Mycobacterium bovis subsp bovis AF2122/97
cucgaccaccgccggcccgc

SEQ ID NO: 1164520 - RNA, 22 nt, Mycobacterium bovis subsp bovis AF2122/97
cucgaccagcgccgauaccagc

SEQ ID NO: 1164521 - RNA, 15 nt, Mycobacterium bovis subsp bovis AF2122/97
cucgaccagagccgc

SEQ ID NO: 1164522 - RNA, 18 nt, Mycobacterium bovis subsp bovis AF2122/97
cucgacaucggccagcuu

SEQ ID NO: 1164523 - RNA, 16 nt, Mycobacterium bovis subsp bovis AF2122/97
cuccugcagcccgggc

SEQ ID NO: 1164524 - RNA, 12 nt, Mycobacterium bovis subsp bovis AF2122/97
cuccugcacaca

SEQ ID NO: 1164525 - RNA, 16 nt, Mycobacterium bovis subsp bovis AF2122/97
cuccugcacacaggac

SEQ ID NO: 1164526 - RNA, 15 nt, Mycobacterium bovis subsp bovis AF2122/97
cuccugaguugcggu

SEQ ID NO: 1164527 - RNA, 15 nt, Mycobacterium bovis subsp bovis AF2122/97
cucgacagugcugcc

SEQ ID NO: 1164528 - RNA, 16 nt, Mycobacterium bovis subsp bovis AF2122/97
cucgacacgccgugcg

SEQ ID NO: 1164529 - RNA, 22 nt, Mycobacterium bovis subsp bovis AF2122/97
cucgacacccagccgcagcccg

SEQ ID NO: 1164530 - RNA, 14 nt, Mycobacterium bovis subsp bovis AF2122/97
cucgacacugcagu

SEQ ID NO: 1164531 - RNA, 18 nt, Mycobacterium bovis subsp bovis AF2122/97
cucgacaaagcggcugcc

SEQ ID NO: 1164532 - RNA, 16 nt, Mycobacterium bovis subsp bovis AF2122/97
cucgaucagcgccgga

SEQ ID NO: 1164533 - RNA, 15 nt, Mycobacterium bovis subsp bovis AF2122/97
cucgaugcgggcgcc

SEQ ID NO: 1164534 - RNA, 24 nt, Mycobacterium bovis subsp bovis AF2122/97
cucgaucagguuggugcucagcgg

SEQ ID NO: 1164535 - RNA, 16 nt, Mycobacterium bovis subsp bovis AF2122/97
cucgaguugcgcggca

SEQ ID NO: 1164536 - RNA, 23 nt, Mycobacterium bovis subsp bovis AF2122/97
cucgauauaacccggcuccagca

SEQ ID NO: 1164537 - RNA, 18 nt, Mycobacterium bovis subsp bovis AF2122/97
cucgagguguagcccucc

SEQ ID NO: 1164538 - RNA, 20 nt, Mycobacterium bovis subsp bovis AF2122/97
cucgaggucgagcgccgcgg

SEQ ID NO: 1164539 - RNA, 13 nt, Mycobacterium bovis subsp bovis AF2122/97
cucgauggccagg

SEQ ID NO: 1164540 - RNA, 14 nt, Mycobacterium bovis subsp bovis AF2122/97
cucgauggccuugu

SEQ ID NO: 1164541 - RNA, 16 nt, Mycobacterium bovis subsp bovis AF2122/97
cucgauggcggccacc

SEQ ID NO: 1164542 - RNA, 17 nt, Mycobacterium bovis subsp bovis AF2122/97
cucgauggcggccacca

SEQ ID NO: 1164543 - RNA, 19 nt, Mycobacterium bovis subsp bovis AF2122/97
cucgauggcggccaccagc

SEQ ID NO: 1164544 - RNA, 14 nt, Mycobacterium bovis subsp bovis AF2122/97
cucgaugucagcgg

SEQ ID NO: 1164545 - RNA, 16 nt, Mycobacterium bovis subsp bovis AF2122/97
cucgaugucagcggcc

SEQ ID NO: 1164546 - RNA, 18 nt, Mycobacterium bovis subsp bovis AF2122/97
cucgauguacagcgggau

SEQ ID NO: 1164547 - RNA, 17 nt, Mycobacterium bovis subsp bovis AF2122/97
cucgauuaucgcgcgca

SEQ ID NO: 1164548 - RNA, 20 nt, Mycobacterium bovis subsp bovis AF2122/97
cucgccacacucccgcgccc

SEQ ID NO: 1164549 - RNA, 15 nt, Mycobacterium bovis subsp bovis AF2122/97
cucgcgcgcugggcg

SEQ ID NO: 1164550 - RNA, 20 nt, Mycobacterium bovis subsp bovis AF2122/97
cucgccgucauagcaggccu

SEQ ID NO: 1164551 - RNA, 17 nt, Mycobacterium bovis subsp bovis AF2122/97
cucgccguaagcaccag

SEQ ID NO: 1164552 - RNA, 21 nt, Mycobacterium bovis subsp bovis AF2122/97
cucgccguaagcaccagccag

SEQ ID NO: 1164553 - RNA, 23 nt, Mycobacterium bovis subsp bovis AF2122/97
cucgccgguaggcggccagcgcg

SEQ ID NO: 1164554 - RNA, 14 nt, Mycobacterium bovis subsp bovis AF2122/97
cucgccggugagcc

SEQ ID NO: 1164555 - RNA, 18 nt, Mycobacterium bovis subsp bovis AF2122/97
cucgccgguguccuuggc

SEQ ID NO: 1164556 - RNA, 19 nt, Mycobacterium bovis subsp bovis AF2122/97
cucgccgguaggcggccag

SEQ ID NO: 1164557 - RNA, 16 nt, Mycobacterium bovis subsp bovis AF2122/97
cucgccggcggcccgc

SEQ ID NO: 1164558 - RNA, 14 nt, Mycobacterium bovis subsp bovis AF2122/97
cucgccgggcagcu

SEQ ID NO: 1164559 - RNA, 20 nt, Mycobacterium bovis subsp bovis AF2122/97
cucgccgggccacguccugc

SEQ ID NO: 1164560 - RNA, 20 nt, Mycobacterium bovis subsp bovis AF2122/97
cucgccggcggacgcccggc

SEQ ID NO: 1164561 - RNA, 23 nt, Mycobacterium bovis subsp bovis AF2122/97
cucgccggcgcgcagccgggcca

SEQ ID NO: 1164562 - RNA, 14 nt, Mycobacterium bovis subsp bovis AF2122/97
cucgccggcacgca

SEQ ID NO: 1164563 - RNA, 16 nt, Mycobacterium bovis subsp bovis AF2122/97
cucgccggccaccagc

SEQ ID NO: 1164564 - RNA, 16 nt, Mycobacterium bovis subsp bovis AF2122/97
cucgccggccacccgc

SEQ ID NO: 1164565 - RNA, 22 nt, Mycobacterium bovis subsp bovis AF2122/97
cucgccggaucguucgcgugcc

SEQ ID NO: 1164566 - RNA, 14 nt, Mycobacterium bovis subsp bovis AF2122/97
cucgcccagcgagc

SEQ ID NO: 1164567 - RNA, 14 nt, Mycobacterium bovis subsp bovis AF2122/97
cucgcccaagcgca

SEQ ID NO: 1164568 - RNA, 11 nt, Mycobacterium bovis subsp bovis AF2122/97
cucgccagagu

SEQ ID NO: 1164569 - RNA, 19 nt, Mycobacterium bovis subsp bovis AF2122/97
cucgccagagucggagacc

SEQ ID NO: 1164570 - RNA, 23 nt, Mycobacterium bovis subsp bovis AF2122/97
cucgcggugcggcaacagcgcca

SEQ ID NO: 1164571 - RNA, 18 nt, Mycobacterium bovis subsp bovis AF2122/97
cucgcggcgcggccgcag

SEQ ID NO: 1164572 - RNA, 20 nt, Mycobacterium bovis subsp bovis AF2122/97
cucgcguagggccagcgccu

SEQ ID NO: 1164573 - RNA, 16 nt, Mycobacterium bovis subsp bovis AF2122/97
cucgcggugggcuucc

SEQ ID NO: 1164574 - RNA, 15 nt, Mycobacterium bovis subsp bovis AF2122/97
cucgcuaacucccca

SEQ ID NO: 1164575 - RNA, 14 nt, Mycobacterium bovis subsp bovis AF2122/97
cucgcguggccgcc

SEQ ID NO: 1164576 - RNA, 12 nt, Mycobacterium bovis subsp bovis AF2122/97
cucgcucaccgg

SEQ ID NO: 1164577 - RNA, 14 nt, Mycobacterium bovis subsp bovis AF2122/97
cucgcucaccggcu

SEQ ID NO: 1164578 - RNA, 21 nt, Mycobacterium bovis subsp bovis AF2122/97
cucgcucaccggcuggugcca

SEQ ID NO: 1164579 - RNA, 16 nt, Mycobacterium bovis subsp bovis AF2122/97
cucgcucugcgcggcu

SEQ ID NO: 1164580 - RNA, 13 nt, Mycobacterium bovis subsp bovis AF2122/97
cuaccuccgccac

SEQ ID NO: 1164581 - RNA, 17 nt, Mycobacterium bovis subsp bovis AF2122/97
cuaccugcacccaggca

SEQ ID NO: 1164582 - RNA, 17 nt, Mycobacterium bovis subsp bovis AF2122/97
cuaccggugguagcggc

SEQ ID NO: 1164583 - RNA, 16 nt, Mycobacterium bovis subsp bovis AF2122/97
cuaccgucaguagcca

SEQ ID NO: 1164584 - RNA, 19 nt, Mycobacterium bovis subsp bovis AF2122/97
cuaccgucaguagccacgc

SEQ ID NO: 1164585 - RNA, 16 nt, Mycobacterium bovis subsp bovis AF2122/97
cuaccgugcuggcacc

SEQ ID NO: 1164586 - RNA, 23 nt, Mycobacterium bovis subsp bovis AF2122/97
cuaccggcuuggcgggaccguga

SEQ ID NO: 1164587 - RNA, 12 nt, Mycobacterium bovis subsp bovis AF2122/97
cuaccggcccga

SEQ ID NO: 1164588 - RNA, 23 nt, Mycobacterium bovis subsp bovis AF2122/97
cuaccggccuuuccagcaccccg

SEQ ID NO: 1164589 - RNA, 23 nt, Mycobacterium bovis subsp bovis AF2122/97
cuaccgccggcggcggccgcagc

SEQ ID NO: 1164590 - RNA, 12 nt, Mycobacterium bovis subsp bovis AF2122/97
cuacgggccgcg

SEQ ID NO: 1164591 - RNA, 16 nt, Mycobacterium bovis subsp bovis AF2122/97
cuacggccuggccacc

SEQ ID NO: 1164592 - RNA, 15 nt, Mycobacterium bovis subsp bovis AF2122/97
cuacgcgcgcucgcu

SEQ ID NO: 1164593 - RNA, 23 nt, Mycobacterium bovis subsp bovis AF2122/97
cuacgcggccgaggucacccggu

SEQ ID NO: 1164594 - RNA, 16 nt, Mycobacterium bovis subsp bovis AF2122/97
cuacgccccacugccg

SEQ ID NO: 1164595 - RNA, 17 nt, Mycobacterium bovis subsp bovis AF2122/97
cuacgccccacugccgu

SEQ ID NO: 1164596 - RNA, 20 nt, Mycobacterium bovis subsp bovis AF2122/97
cuacgcagccguagcugggc

SEQ ID NO: 1164597 - RNA, 12 nt, Mycobacterium bovis subsp bovis AF2122/97
cuaccuucuugg

SEQ ID NO: 1164598 - RNA, 22 nt, Mycobacterium bovis subsp bovis AF2122/97
cuaccuuagcgccguugccgcc

SEQ ID NO: 1164599 - RNA, 18 nt, Mycobacterium bovis subsp bovis AF2122/97
cuagcagggugccggcgc

SEQ ID NO: 1164600 - RNA, 21 nt, Mycobacterium bovis subsp bovis AF2122/97
cuagcagggugccggcgccgc

SEQ ID NO: 1164601 - RNA, 18 nt, Mycobacterium bovis subsp bovis AF2122/97
cuagcagguacucgcccc

SEQ ID NO: 1164602 - RNA, 16 nt, Mycobacterium bovis subsp bovis AF2122/97
cuagcagcgcugcgau

SEQ ID NO: 1164603 - RNA, 16 nt, Mycobacterium bovis subsp bovis AF2122/97
cuagcagagacaugcc

SEQ ID NO: 1164604 - RNA, 16 nt, Mycobacterium bovis subsp bovis AF2122/97
cuagcgccaaauccgg

SEQ ID NO: 1164605 - RNA, 19 nt, Mycobacterium bovis subsp bovis AF2122/97
cuagcgagcgcacaccggc

SEQ ID NO: 1164606 - RNA, 17 nt, Mycobacterium bovis subsp bovis AF2122/97
cuagcgccccuggcacc

SEQ ID NO: 1164607 - RNA, 23 nt, Mycobacterium bovis subsp bovis AF2122/97
cuagcgccucgccggccacccgc

SEQ ID NO: 1164608 - RNA, 16 nt, Mycobacterium bovis subsp bovis AF2122/97
cuagcgcggcgacgau

SEQ ID NO: 1164609 - RNA, 17 nt, Mycobacterium bovis subsp bovis AF2122/97
cuagcgcgggcucggug

SEQ ID NO: 1164610 - RNA, 19 nt, Mycobacterium bovis subsp bovis AF2122/97
cuagccgggcgcgccggcc

SEQ ID NO: 1164611 - RNA, 13 nt, Mycobacterium bovis subsp bovis AF2122/97
cuagcccaccacu

SEQ ID NO: 1164612 - RNA, 22 nt, Mycobacterium bovis subsp bovis AF2122/97
cuagccccugaaggccagccaa

SEQ ID NO: 1164613 - RNA, 16 nt, Mycobacterium bovis subsp bovis AF2122/97
cuagcccggcagcacg

SEQ ID NO: 1164614 - RNA, 19 nt, Mycobacterium bovis subsp bovis AF2122/97
cuagcccguuguccagaac

SEQ ID NO: 1164615 - RNA, 17 nt, Mycobacterium bovis subsp bovis AF2122/97
cuagcccucagcuagcg

SEQ ID NO: 1164616 - RNA, 22 nt, Mycobacterium bovis subsp bovis AF2122/97
cuagccaccaggcggucagguc

SEQ ID NO: 1164617 - RNA, 16 nt, Mycobacterium bovis subsp bovis AF2122/97
cuacuaggcccagcac

SEQ ID NO: 1164618 - RNA, 14 nt, Mycobacterium bovis subsp bovis AF2122/97
cuaggccaaacccc

SEQ ID NO: 1164619 - RNA, 12 nt, Mycobacterium bovis subsp bovis AF2122/97
cuaggccaagcc

SEQ ID NO: 1164620 - RNA, 13 nt, Mycobacterium bovis subsp bovis AF2122/97
cuaggcaugccac

SEQ ID NO: 1164621 - RNA, 20 nt, Mycobacterium bovis subsp bovis AF2122/97
cuagcgcuugcgaccccggc

SEQ ID NO: 1164622 - RNA, 20 nt, Mycobacterium bovis subsp bovis AF2122/97
cuaggaucggauggcggcca

SEQ ID NO: 1164623 - RNA, 20 nt, Mycobacterium bovis subsp bovis AF2122/97
cuaggaccgcgguggccaga

SEQ ID NO: 1164624 - RNA, 17 nt, Mycobacterium bovis subsp bovis AF2122/97
cuaggacgccgcccucu

SEQ ID NO: 1164625 - RNA, 22 nt, Mycobacterium bovis subsp bovis AF2122/97
cuaggacggcugccgucagccg

SEQ ID NO: 1164626 - RNA, 18 nt, Mycobacterium bovis subsp bovis AF2122/97
cuauacgcaacaggccaa

SEQ ID NO: 1164627 - RNA, 15 nt, Mycobacterium bovis subsp bovis AF2122/97
cuauaccgcuggggc

SEQ ID NO: 1164628 - RNA, 17 nt, Mycobacterium bovis subsp bovis AF2122/97
cuaucgcagaacggacc

SEQ ID NO: 1164629 - RNA, 14 nt, Mycobacterium bovis subsp bovis AF2122/97
cuaucgccgcgcgu

SEQ ID NO: 1164630 - RNA, 15 nt, Mycobacterium bovis subsp bovis AF2122/97
cuaucucgcucgacg

SEQ ID NO: 1164631 - RNA, 22 nt, Mycobacterium bovis subsp bovis AF2122/97
cuauccuugguuagccgcggcc

SEQ ID NO: 1164632 - RNA, 23 nt, Mycobacterium bovis subsp bovis AF2122/97
cuauccuugguuagccgcggccc

SEQ ID NO: 1164633 - RNA, 17 nt, Mycobacterium bovis subsp bovis AF2122/97
cuauggcaagcggccgc

SEQ ID NO: 1164634 - RNA, 15 nt, Mycobacterium bovis subsp bovis AF2122/97
cuaugcuggcagcuc

SEQ ID NO: 1164635 - RNA, 16 nt, Mycobacterium bovis subsp bovis AF2122/97
cuaugcguccaggcga

SEQ ID NO: 1164636 - RNA, 21 nt, Mycobacterium bovis subsp bovis AF2122/97
cuauggaugaccgaaccuggu

SEQ ID NO: 1164637 - RNA, 19 nt, Mycobacterium bovis subsp bovis AF2122/97
cucaaccugaaccggccgc

SEQ ID NO: 1164638 - RNA, 15 nt, Mycobacterium bovis subsp bovis AF2122/97
cucaaggacgcaccg

SEQ ID NO: 1164639 - RNA, 19 nt, Mycobacterium bovis subsp bovis AF2122/97
cucaaggacgcaccgccag

SEQ ID NO: 1164640 - RNA, 18 nt, Mycobacterium bovis subsp bovis AF2122/97
cucaacccgugcgacuuc

SEQ ID NO: 1164641 - RNA, 19 nt, Mycobacterium bovis subsp bovis AF2122/97
cucaaccagcagacgccgu

SEQ ID NO: 1164642 - RNA, 13 nt, Mycobacterium bovis subsp bovis AF2122/97
cucaagucucccg

SEQ ID NO: 1164643 - RNA, 18 nt, Mycobacterium bovis subsp bovis AF2122/97
cucaaggcuucggcggcc

SEQ ID NO: 1164644 - RNA, 15 nt, Mycobacterium bovis subsp bovis AF2122/97
cucacaugcccggac

SEQ ID NO: 1164645 - RNA, 12 nt, Mycobacterium bovis subsp bovis AF2122/97
cucaccagucag

SEQ ID NO: 1164646 - RNA, 12 nt, Mycobacterium bovis subsp bovis AF2122/97
cucaccagcucc

SEQ ID NO: 1164647 - RNA, 21 nt, Mycobacterium bovis subsp bovis AF2122/97
cucaccaugggacacaaucca

SEQ ID NO: 1164648 - RNA, 13 nt, Mycobacterium bovis subsp bovis AF2122/97
cucacccacauga

SEQ ID NO: 1164649 - RNA, 22 nt, Mycobacterium bovis subsp bovis AF2122/97
cucacccagcugggucccgcug

SEQ ID NO: 1164650 - RNA, 13 nt, Mycobacterium bovis subsp bovis AF2122/97
cucaccgccgcua

SEQ ID NO: 1164651 - RNA, 21 nt, Mycobacterium bovis subsp bovis AF2122/97
cucaccaaucugcgggccggu

SEQ ID NO: 1164652 - RNA, 12 nt, Mycobacterium bovis subsp bovis AF2122/97
cucaccaccaga

SEQ ID NO: 1164653 - RNA, 18 nt, Mycobacterium bovis subsp bovis AF2122/97
cucaccacccgcacucca

SEQ ID NO: 1164654 - RNA, 13 nt, Mycobacterium bovis subsp bovis AF2122/97
cucaauuccaugc

SEQ ID NO: 1164655 - RNA, 15 nt, Mycobacterium bovis subsp bovis AF2122/97
cucagguucagcuug

SEQ ID NO: 1164656 - RNA, 17 nt, Mycobacterium bovis subsp bovis AF2122/97
cucaggucaccggccgc

SEQ ID NO: 1164657 - RNA, 15 nt, Mycobacterium bovis subsp bovis AF2122/97
cucaggucgcagacc

SEQ ID NO: 1164658 - RNA, 17 nt, Mycobacterium bovis subsp bovis AF2122/97
cucagggugcgccgcag

SEQ ID NO: 1164659 - RNA, 14 nt, Mycobacterium bovis subsp bovis AF2122/97
cucagucacgcacu

SEQ ID NO: 1164660 - RNA, 14 nt, Mycobacterium bovis subsp bovis AF2122/97
cucaucaccucucc

SEQ ID NO: 1164661 - RNA, 16 nt, Mycobacterium bovis subsp bovis AF2122/97
cucauccgccgggcca

SEQ ID NO: 1164662 - RNA, 23 nt, Mycobacterium bovis subsp bovis AF2122/97
cucaucgaucacacguccgcgca

SEQ ID NO: 1164663 - RNA, 22 nt, Mycobacterium bovis subsp bovis AF2122/97
cucaucgaagcuucggccuucu

SEQ ID NO: 1164664 - RNA, 13 nt, Mycobacterium bovis subsp bovis AF2122/97
cucaucgccgcua

SEQ ID NO: 1164665 - RNA, 17 nt, Mycobacterium bovis subsp bovis AF2122/97
cucaucgcgcacgcccu

SEQ ID NO: 1164666 - RNA, 20 nt, Mycobacterium bovis subsp bovis AF2122/97
cucaucggacagcgccuggc

SEQ ID NO: 1164667 - RNA, 21 nt, Mycobacterium bovis subsp bovis AF2122/97
cucaucggacagcgccuggcc

SEQ ID NO: 1164668 - RNA, 18 nt, Mycobacterium bovis subsp bovis AF2122/97
cucaucggcaaacuccug

SEQ ID NO: 1164669 - RNA, 19 nt, Mycobacterium bovis subsp bovis AF2122/97
cucaucguggggaucgacc

SEQ ID NO: 1164670 - RNA, 20 nt, Mycobacterium bovis subsp bovis AF2122/97
cucaugggcgccaucccgcc

SEQ ID NO: 1164671 - RNA, 19 nt, Mycobacterium bovis subsp bovis AF2122/97
cucaucuguaaccuccucg

SEQ ID NO: 1164672 - RNA, 16 nt, Mycobacterium bovis subsp bovis AF2122/97
cucauuaacgccaucu

SEQ ID NO: 1164673 - RNA, 19 nt, Mycobacterium bovis subsp bovis AF2122/97
cucaccggcgucguaggag

SEQ ID NO: 1164674 - RNA, 13 nt, Mycobacterium bovis subsp bovis AF2122/97
cucaccggcuggu

SEQ ID NO: 1164675 - RNA, 16 nt, Mycobacterium bovis subsp bovis AF2122/97
cucaccggcuggugcc

SEQ ID NO: 1164676 - RNA, 16 nt, Mycobacterium bovis subsp bovis AF2122/97
cucaccucaugaucuc

SEQ ID NO: 1164677 - RNA, 23 nt, Mycobacterium bovis subsp bovis AF2122/97
cucagccaucucuugcaaccugg

SEQ ID NO: 1164678 - RNA, 18 nt, Mycobacterium bovis subsp bovis AF2122/97
cucagccgcgccgggucc

SEQ ID NO: 1164679 - RNA, 14 nt, Mycobacterium bovis subsp bovis AF2122/97
cucagcaccgcugg

SEQ ID NO: 1164680 - RNA, 13 nt, Mycobacterium bovis subsp bovis AF2122/97
cucagcugcucgu

SEQ ID NO: 1164681 - RNA, 18 nt, Mycobacterium bovis subsp bovis AF2122/97
cucaggaucccgguggca

SEQ ID NO: 1164682 - RNA, 15 nt, Mycobacterium bovis subsp bovis AF2122/97
cguggccucgauguc

SEQ ID NO: 1164683 - RNA, 20 nt, Mycobacterium bovis subsp bovis AF2122/97
cguggccugaaacggcugca

SEQ ID NO: 1164684 - RNA, 15 nt, Mycobacterium bovis subsp bovis AF2122/97
cguggcgaccacgau

SEQ ID NO: 1164685 - RNA, 17 nt, Mycobacterium bovis subsp bovis AF2122/97
cguggccaauccggcgg

SEQ ID NO: 1164686 - RNA, 18 nt, Mycobacterium bovis subsp bovis AF2122/97
cguggccgcgaucccggc

SEQ ID NO: 1164687 - RNA, 14 nt, Mycobacterium bovis subsp bovis AF2122/97
cguggccggaccca

SEQ ID NO: 1164688 - RNA, 22 nt, Mycobacterium bovis subsp bovis AF2122/97
cguggcccgcucccugcaccca

SEQ ID NO: 1164689 - RNA, 18 nt, Mycobacterium bovis subsp bovis AF2122/97
cguggcuucacccaaccc

SEQ ID NO: 1164690 - RNA, 22 nt, Mycobacterium bovis subsp bovis AF2122/97
cguggcuucacccaaccccgcc

SEQ ID NO: 1164691 - RNA, 18 nt, Mycobacterium bovis subsp bovis AF2122/97
cguggcuggcaccucccg

SEQ ID NO: 1164692 - RNA, 16 nt, Mycobacterium bovis subsp bovis AF2122/97
cguggcgucgguggca

SEQ ID NO: 1164693 - RNA, 16 nt, Mycobacterium bovis subsp bovis AF2122/97
cguggcguugccgccu

SEQ ID NO: 1164694 - RNA, 13 nt, Mycobacterium bovis subsp bovis AF2122/97
cguggcgcgccgc

SEQ ID NO: 1164695 - RNA, 16 nt, Mycobacterium bovis subsp bovis AF2122/97
cguggcgcgccgcauc

SEQ ID NO: 1164696 - RNA, 12 nt, Mycobacterium bovis subsp bovis AF2122/97
cguggcggccuc

SEQ ID NO: 1164697 - RNA, 16 nt, Mycobacterium bovis subsp bovis AF2122/97
cguggcggccuccucc

SEQ ID NO: 1164698 - RNA, 13 nt, Mycobacterium bovis subsp bovis AF2122/97
cguggcggcgcgc

SEQ ID NO: 1164699 - RNA, 23 nt, Mycobacterium bovis subsp bovis AF2122/97
cguggucccucggggggaucucg

SEQ ID NO: 1164700 - RNA, 16 nt, Mycobacterium bovis subsp bovis AF2122/97
cguggucggccacccc

SEQ ID NO: 1164701 - RNA, 14 nt, Mycobacterium bovis subsp bovis AF2122/97
cguggucggccucg

SEQ ID NO: 1164702 - RNA, 18 nt, Mycobacterium bovis subsp bovis AF2122/97
cguggucaccccuucgcc

SEQ ID NO: 1164703 - RNA, 21 nt, Mycobacterium bovis subsp bovis AF2122/97
cgugguguaucgacggcggcc

SEQ ID NO: 1164704 - RNA, 17 nt, Mycobacterium bovis subsp bovis AF2122/97
cguggugcugaccgcgc

SEQ ID NO: 1164705 - RNA, 22 nt, Mycobacterium bovis subsp bovis AF2122/97
cgugguggacgaccgcgcggca

SEQ ID NO: 1164706 - RNA, 17 nt, Mycobacterium bovis subsp bovis AF2122/97
cguggguccaacccgcg

SEQ ID NO: 1164707 - RNA, 21 nt, Mycobacterium bovis subsp bovis AF2122/97
cguggguguugaugggcagcc

SEQ ID NO: 1164708 - RNA, 22 nt, Mycobacterium bovis subsp bovis AF2122/97
cgugguaaccauauggcccgcg

SEQ ID NO: 1164709 - RNA, 18 nt, Mycobacterium bovis subsp bovis AF2122/97
cguggggccgccaccagc

SEQ ID NO: 1164710 - RNA, 20 nt, Mycobacterium bovis subsp bovis AF2122/97
cgugggcgugcaggcugguu

SEQ ID NO: 1164711 - RNA, 16 nt, Mycobacterium bovis subsp bovis AF2122/97
cgugggcgcggcgcca

SEQ ID NO: 1164712 - RNA, 13 nt, Mycobacterium bovis subsp bovis AF2122/97
cgugggccacgau

SEQ ID NO: 1164713 - RNA, 23 nt, Mycobacterium bovis subsp bovis AF2122/97
cgugggagguggcgcggggccgc

SEQ ID NO: 1164714 - RNA, 21 nt, Mycobacterium bovis subsp bovis AF2122/97
cgugcuuaacacaugcaaguc

SEQ ID NO: 1164715 - RNA, 13 nt, Mycobacterium bovis subsp bovis AF2122/97
cgugcuuccauuc

SEQ ID NO: 1164716 - RNA, 17 nt, Mycobacterium bovis subsp bovis AF2122/97
cgugcuggugggccgga

SEQ ID NO: 1164717 - RNA, 17 nt, Mycobacterium bovis subsp bovis AF2122/97
cguggacaucgggcggc

SEQ ID NO: 1164718 - RNA, 14 nt, Mycobacterium bovis subsp bovis AF2122/97
cgugcucgacgcgc

SEQ ID NO: 1164719 - RNA, 23 nt, Mycobacterium bovis subsp bovis AF2122/97
cgugcugccguauccaggcgugc

SEQ ID NO: 1164720 - RNA, 14 nt, Mycobacterium bovis subsp bovis AF2122/97
cgugcuggaacagg

SEQ ID NO: 1164721 - RNA, 21 nt, Mycobacterium bovis subsp bovis AF2122/97
cgugcugccgauagcgcggca

SEQ ID NO: 1164722 - RNA, 19 nt, Mycobacterium bovis subsp bovis AF2122/97
cguggagcgcaaguugagc

SEQ ID NO: 1164723 - RNA, 17 nt, Mycobacterium bovis subsp bovis AF2122/97
cguggacaagcacagcg

SEQ ID NO: 1164724 - RNA, 16 nt, Mycobacterium bovis subsp bovis AF2122/97
cguggaucggcagccc

SEQ ID NO: 1164725 - RNA, 16 nt, Mycobacterium bovis subsp bovis AF2122/97
cguggaucugccucuc

SEQ ID NO: 1164726 - RNA, 20 nt, Mycobacterium bovis subsp bovis AF2122/97
cguggauggccgccaggcgc

SEQ ID NO: 1164727 - RNA, 15 nt, Mycobacterium bovis subsp bovis AF2122/97
cguggcaacgagcag

SEQ ID NO: 1164728 - RNA, 23 nt, Mycobacterium bovis subsp bovis AF2122/97
cguggcagucgcacggugccgcc

SEQ ID NO: 1164729 - RNA, 16 nt, Mycobacterium bovis subsp bovis AF2122/97
cguggcaucgccucca

SEQ ID NO: 1164730 - RNA, 17 nt, Mycobacterium bovis subsp bovis AF2122/97
cguggcaccgacagcag

SEQ ID NO: 1164731 - RNA, 16 nt, Mycobacterium bovis subsp bovis AF2122/97
cguggcacugacgcgc

SEQ ID NO: 1164732 - RNA, 23 nt, Mycobacterium bovis subsp bovis AF2122/97
cguggaggacuacuaggccccug

SEQ ID NO: 1164733 - RNA, 20 nt, Mycobacterium bovis subsp bovis AF2122/97
cguggaucuuggccagcagc

SEQ ID NO: 1164734 - RNA, 19 nt, Mycobacterium bovis subsp bovis AF2122/97
cgugcgccggggacacagc

SEQ ID NO: 1164735 - RNA, 13 nt, Mycobacterium bovis subsp bovis AF2122/97
cgugcgcgcgcag

SEQ ID NO: 1164736 - RNA, 14 nt, Mycobacterium bovis subsp bovis AF2122/97
cgugcgcgcgcagc

SEQ ID NO: 1164737 - RNA, 22 nt, Mycobacterium bovis subsp bovis AF2122/97
cgugcgcgcgcagcugacguca

SEQ ID NO: 1164738 - RNA, 22 nt, Mycobacterium bovis subsp bovis AF2122/97
cgugcgcuuggucgaccgccga

SEQ ID NO: 1164739 - RNA, 20 nt, Mycobacterium bovis subsp bovis AF2122/97
cgugcgacgauaucgggagc

SEQ ID NO: 1164740 - RNA, 17 nt, Mycobacterium bovis subsp bovis AF2122/97
cgugccuugaucugagc

SEQ ID NO: 1164741 - RNA, 21 nt, Mycobacterium bovis subsp bovis AF2122/97
cgugccuugaucugagcgcgg

SEQ ID NO: 1164742 - RNA, 18 nt, Mycobacterium bovis subsp bovis AF2122/97
cgugcgaucaccuccgcg

SEQ ID NO: 1164743 - RNA, 18 nt, Mycobacterium bovis subsp bovis AF2122/97
cgugcgaugcagcgcgcc

SEQ ID NO: 1164744 - RNA, 24 nt, Mycobacterium bovis subsp bovis AF2122/97
cgugcgauucacacucgggcggcu

SEQ ID NO: 1164745 - RNA, 13 nt, Mycobacterium bovis subsp bovis AF2122/97
cgugcgcaucccg

SEQ ID NO: 1164746 - RNA, 22 nt, Mycobacterium bovis subsp bovis AF2122/97
cgugcgauuuugugucugcucg

SEQ ID NO: 1164747 - RNA, 18 nt, Mycobacterium bovis subsp bovis AF2122/97
cgugcgcacugaggcuca

SEQ ID NO: 1164748 - RNA, 18 nt, Mycobacterium bovis subsp bovis AF2122/97
cgugcggcacucccuggg

SEQ ID NO: 1164749 - RNA, 14 nt, Mycobacterium bovis subsp bovis AF2122/97
cgugcgggcgggcg

SEQ ID NO: 1164750 - RNA, 15 nt, Mycobacterium bovis subsp bovis AF2122/97
cgugcgucggcccgg

SEQ ID NO: 1164751 - RNA, 19 nt, Mycobacterium bovis subsp bovis AF2122/97
cgugcgguggcgcgcagcg

SEQ ID NO: 1164752 - RNA, 15 nt, Mycobacterium bovis subsp bovis AF2122/97
cgugcuccugcccga

SEQ ID NO: 1164753 - RNA, 14 nt, Mycobacterium bovis subsp bovis AF2122/97
cgugcuccugcccg

SEQ ID NO: 1164754 - RNA, 16 nt, Mycobacterium bovis subsp bovis AF2122/97
cgugugugcgccuccg

SEQ ID NO: 1164755 - RNA, 16 nt, Mycobacterium bovis subsp bovis AF2122/97
cgugugccacggggca

SEQ ID NO: 1164756 - RNA, 19 nt, Mycobacterium bovis subsp bovis AF2122/97
cgugucccaagccugccga

SEQ ID NO: 1164757 - RNA, 23 nt, Mycobacterium bovis subsp bovis AF2122/97
cgugucgcgucgcaggauuccca

SEQ ID NO: 1164758 - RNA, 23 nt, Mycobacterium bovis subsp bovis AF2122/97
cgugucggccggccagguguuga

SEQ ID NO: 1164759 - RNA, 14 nt, Mycobacterium bovis subsp bovis AF2122/97
cgugucuccuuguc

SEQ ID NO: 1164760 - RNA, 22 nt, Mycobacterium bovis subsp bovis AF2122/97
cgugugagggccggguggccac

SEQ ID NO: 1164761 - RNA, 16 nt, Mycobacterium bovis subsp bovis AF2122/97
cgugguuguaccagcc

SEQ ID NO: 1164762 - RNA, 12 nt, Mycobacterium bovis subsp bovis AF2122/97
cgugguuccggc

SEQ ID NO: 1164763 - RNA, 17 nt, Mycobacterium bovis subsp bovis AF2122/97
cgugguuccggcgugca

SEQ ID NO: 1164764 - RNA, 17 nt, Mycobacterium bovis subsp bovis AF2122/97
cguguaaccccaggcgc

SEQ ID NO: 1164765 - RNA, 21 nt, Mycobacterium bovis subsp bovis AF2122/97
cguguaaccccaggcgcugcc

SEQ ID NO: 1164766 - RNA, 13 nt, Mycobacterium bovis subsp bovis AF2122/97
cguguccagcaug

SEQ ID NO: 1164767 - RNA, 22 nt, Mycobacterium bovis subsp bovis AF2122/97
cguguccagcaugcccgccauc

SEQ ID NO: 1164768 - RNA, 21 nt, Mycobacterium bovis subsp bovis AF2122/97
cguguagccugcggcggucau

SEQ ID NO: 1164769 - RNA, 20 nt, Mycobacterium bovis subsp bovis AF2122/97
cguguaacgccgacuccccc

SEQ ID NO: 1164770 - RNA, 15 nt, Mycobacterium bovis subsp bovis AF2122/97
cguguaccuccucga

SEQ ID NO: 1164771 - RNA, 14 nt, Mycobacterium bovis subsp bovis AF2122/97
cguguugaagaagc

SEQ ID NO: 1164772 - RNA, 15 nt, Mycobacterium bovis subsp bovis AF2122/97
cguuaccgacgccgg

SEQ ID NO: 1164773 - RNA, 18 nt, Mycobacterium bovis subsp bovis AF2122/97
cguuacgcucgcgggcca

SEQ ID NO: 1164774 - RNA, 21 nt, Mycobacterium bovis subsp bovis AF2122/97
cguuagaguaggccaccacug

SEQ ID NO: 1164775 - RNA, 19 nt, Mycobacterium bovis subsp bovis AF2122/97
cguuagcguagcccgaguu

SEQ ID NO: 1164776 - RNA, 17 nt, Mycobacterium bovis subsp bovis AF2122/97
cguuagcuuagcugccg

SEQ ID NO: 1164777 - RNA, 13 nt, Mycobacterium bovis subsp bovis AF2122/97
cguucaaggucuc

SEQ ID NO: 1164778 - RNA, 18 nt, Mycobacterium bovis subsp bovis AF2122/97
cguucaaggucuccagac

SEQ ID NO: 1164779 - RNA, 22 nt, Mycobacterium bovis subsp bovis AF2122/97
cguucaacaugaguggcaaucc

SEQ ID NO: 1164780 - RNA, 18 nt, Mycobacterium bovis subsp bovis AF2122/97
cguucaacaccgccgacc

SEQ ID NO: 1164781 - RNA, 19 nt, Mycobacterium bovis subsp bovis AF2122/97
cguuccagcacacccagau

SEQ ID NO: 1164782 - RNA, 18 nt, Mycobacterium bovis subsp bovis AF2122/97
cguucagcgaccaaugca

SEQ ID NO: 1164783 - RNA, 14 nt, Mycobacterium bovis subsp bovis AF2122/97
cguucacuggucuc

SEQ ID NO: 1164784 - RNA, 15 nt, Mycobacterium bovis subsp bovis AF2122/97
cguucaccgcgcgcu

SEQ ID NO: 1164785 - RNA, 12 nt, Mycobacterium bovis subsp bovis AF2122/97
cguucgccgccc

SEQ ID NO: 1164786 - RNA, 22 nt, Mycobacterium bovis subsp bovis AF2122/97
cguucccacgguucugccggaa

SEQ ID NO: 1164787 - RNA, 19 nt, Mycobacterium bovis subsp bovis AF2122/97
cguuccaucacggaccagg

SEQ ID NO: 1164788 - RNA, 15 nt, Mycobacterium bovis subsp bovis AF2122/97
cuaacggcagccacc

SEQ ID NO: 1164789 - RNA, 22 nt, Mycobacterium bovis subsp bovis AF2122/97
cuaaguccccgcuuggcgagcc

SEQ ID NO: 1164790 - RNA, 14 nt, Mycobacterium bovis subsp bovis AF2122/97
cuaacaacaccacc

SEQ ID NO: 1164791 - RNA, 16 nt, Mycobacterium bovis subsp bovis AF2122/97
cuaacaacaccaccag

SEQ ID NO: 1164792 - RNA, 19 nt, Mycobacterium bovis subsp bovis AF2122/97
cuaacaacaccaccagcac

SEQ ID NO: 1164793 - RNA, 12 nt, Mycobacterium bovis subsp bovis AF2122/97
cguuuggacggg

SEQ ID NO: 1164794 - RNA, 17 nt, Mycobacterium bovis subsp bovis AF2122/97
cguuugguuuucccggc

SEQ ID NO: 1164795 - RNA, 14 nt, Mycobacterium bovis subsp bovis AF2122/97
cguuugccggccga

SEQ ID NO: 1164796 - RNA, 15 nt, Mycobacterium bovis subsp bovis AF2122/97
cguuugcgaagccca

SEQ ID NO: 1164797 - RNA, 16 nt, Mycobacterium bovis subsp bovis AF2122/97
cguuucgccggcgcgc

SEQ ID NO: 1164798 - RNA, 22 nt, Mycobacterium bovis subsp bovis AF2122/97
cguuucgcgaugugcgccaccu

SEQ ID NO: 1164799 - RNA, 12 nt, Mycobacterium bovis subsp bovis AF2122/97
cguuucgcuguc

SEQ ID NO: 1164800 - RNA, 18 nt, Mycobacterium bovis subsp bovis AF2122/97
cuaaaccagccaccacca

SEQ ID NO: 1164801 - RNA, 23 nt, Mycobacterium bovis subsp bovis AF2122/97
cguuggccgagcagggccggcac

SEQ ID NO: 1164802 - RNA, 14 nt, Mycobacterium bovis subsp bovis AF2122/97
cguuggccagcagg

SEQ ID NO: 1164803 - RNA, 16 nt, Mycobacterium bovis subsp bovis AF2122/97
cguuggcgaccaccgc

SEQ ID NO: 1164804 - RNA, 16 nt, Mycobacterium bovis subsp bovis AF2122/97
cguuggcgccaccagu

SEQ ID NO: 1164805 - RNA, 21 nt, Mycobacterium bovis subsp bovis AF2122/97
cguuggaugaagucgucggca

SEQ ID NO: 1164806 - RNA, 15 nt, Mycobacterium bovis subsp bovis AF2122/97
cguuggacggcaccg

SEQ ID NO: 1164807 - RNA, 15 nt, Mycobacterium bovis subsp bovis AF2122/97
cguucggcgacgcgc

SEQ ID NO: 1164808 - RNA, 19 nt, Mycobacterium bovis subsp bovis AF2122/97
cguucggcgacgcgccggu

SEQ ID NO: 1164809 - RNA, 18 nt, Mycobacterium bovis subsp bovis AF2122/97
cguucggcacaaccaacg

SEQ ID NO: 1164810 - RNA, 20 nt, Mycobacterium bovis subsp bovis AF2122/97
cguucugacggcuugcguga

SEQ ID NO: 1164811 - RNA, 15 nt, Mycobacterium bovis subsp bovis AF2122/97
cguucggcgcccgcu

SEQ ID NO: 1164812 - RNA, 22 nt, Mycobacterium bovis subsp bovis AF2122/97
cguucgcgggugcgcugcagcg

SEQ ID NO: 1164813 - RNA, 19 nt, Mycobacterium bovis subsp bovis AF2122/97
cguucgcgucacaccagcg

SEQ ID NO: 1164814 - RNA, 17 nt, Mycobacterium bovis subsp bovis AF2122/97
cguucgcgugccagcgc

SEQ ID NO: 1164815 - RNA, 22 nt, Mycobacterium bovis subsp bovis AF2122/97
cguucgcgggcgucccgcauac

SEQ ID NO: 1164816 - RNA, 18 nt, Mycobacterium bovis subsp bovis AF2122/97
cguucgcugguccuuguc

SEQ ID NO: 1164817 - RNA, 17 nt, Mycobacterium bovis subsp bovis AF2122/97
cguucuugcggguuuuc

SEQ ID NO: 1164818 - RNA, 16 nt, Mycobacterium bovis subsp bovis AF2122/97
cguucuucagccaggg

SEQ ID NO: 1164819 - RNA, 18 nt, Mycobacterium bovis subsp bovis AF2122/97
cguuucccuggccgccgc

SEQ ID NO: 1164820 - RNA, 17 nt, Mycobacterium bovis subsp bovis AF2122/97
cguuggugaggcccccc

SEQ ID NO: 1164821 - RNA, 18 nt, Mycobacterium bovis subsp bovis AF2122/97
cguugggccaccggcgcc

SEQ ID NO: 1164822 - RNA, 14 nt, Mycobacterium bovis subsp bovis AF2122/97
cguugggccgcgcc

SEQ ID NO: 1164823 - RNA, 17 nt, Mycobacterium bovis subsp bovis AF2122/97
cguuggcgugcaccgca

SEQ ID NO: 1164824 - RNA, 16 nt, Mycobacterium bovis subsp bovis AF2122/97
cguuggcucgagccgc

SEQ ID NO: 1164825 - RNA, 14 nt, Mycobacterium bovis subsp bovis AF2122/97
cguugggaaacauc

SEQ ID NO: 1164826 - RNA, 17 nt, Mycobacterium bovis subsp bovis AF2122/97
cguugggaucccagcgc

SEQ ID NO: 1164827 - RNA, 20 nt, Mycobacterium bovis subsp bovis AF2122/97
cguugggaucgcgcagcgcc

SEQ ID NO: 1164828 - RNA, 20 nt, Mycobacterium bovis subsp bovis AF2122/97
cguuguaugcguuacgccgc

SEQ ID NO: 1164829 - RNA, 18 nt, Mycobacterium bovis subsp bovis AF2122/97
cguccagcagcucggggc

SEQ ID NO: 1164830 - RNA, 19 nt, Mycobacterium bovis subsp bovis AF2122/97
cguccagcccagauccagc

SEQ ID NO: 1164831 - RNA, 23 nt, Mycobacterium bovis subsp bovis AF2122/97
cguccagcccagauccagcaacg

SEQ ID NO: 1164832 - RNA, 16 nt, Mycobacterium bovis subsp bovis AF2122/97
cguccagccguggcgg

SEQ ID NO: 1164833 - RNA, 18 nt, Mycobacterium bovis subsp bovis AF2122/97
cguccagcgccgcggccc

SEQ ID NO: 1164834 - RNA, 22 nt, Mycobacterium bovis subsp bovis AF2122/97
cguccagggcgacgagaucugc

SEQ ID NO: 1164835 - RNA, 17 nt, Mycobacterium bovis subsp bovis AF2122/97
cguccacgacagcagag

SEQ ID NO: 1164836 - RNA, 18 nt, Mycobacterium bovis subsp bovis AF2122/97
cguccacgcugaccaacg

SEQ ID NO: 1164837 - RNA, 19 nt, Mycobacterium bovis subsp bovis AF2122/97
cguccagaccguagcggcc

SEQ ID NO: 1164838 - RNA, 19 nt, Mycobacterium bovis subsp bovis AF2122/97
cguccagacgccacugcca

SEQ ID NO: 1164839 - RNA, 21 nt, Mycobacterium bovis subsp bovis AF2122/97
cguccagacgccacugccagc

SEQ ID NO: 1164840 - RNA, 13 nt, Mycobacterium bovis subsp bovis AF2122/97
cguacugaucuuc

SEQ ID NO: 1164841 - RNA, 18 nt, Mycobacterium bovis subsp bovis AF2122/97
cguacucggcgcgcagcg

SEQ ID NO: 1164842 - RNA, 18 nt, Mycobacterium bovis subsp bovis AF2122/97
cguacucggcggccacca

SEQ ID NO: 1164843 - RNA, 15 nt, Mycobacterium bovis subsp bovis AF2122/97
cgucccggcgaccgg

SEQ ID NO: 1164844 - RNA, 22 nt, Mycobacterium bovis subsp bovis AF2122/97
cgucccggcgaccggguccggc

SEQ ID NO: 1164845 - RNA, 16 nt, Mycobacterium bovis subsp bovis AF2122/97
cgucccgcucgagcag

SEQ ID NO: 1164846 - RNA, 17 nt, Mycobacterium bovis subsp bovis AF2122/97
cgucccgcucgagcagc

SEQ ID NO: 1164847 - RNA, 14 nt, Mycobacterium bovis subsp bovis AF2122/97
cgucccgagcccgu

SEQ ID NO: 1164848 - RNA, 15 nt, Mycobacterium bovis subsp bovis AF2122/97
cguccccgacgucag

SEQ ID NO: 1164849 - RNA, 20 nt, Mycobacterium bovis subsp bovis AF2122/97
cguccccgucgcuggccggc

SEQ ID NO: 1164850 - RNA, 22 nt, Mycobacterium bovis subsp bovis AF2122/97
cguccccgucgcuggccggcac

SEQ ID NO: 1164851 - RNA, 12 nt, Mycobacterium bovis subsp bovis AF2122/97
cguccccgcagc

SEQ ID NO: 1164852 - RNA, 13 nt, Mycobacterium bovis subsp bovis AF2122/97
cguccccagaccg

SEQ ID NO: 1164853 - RNA, 19 nt, Mycobacterium bovis subsp bovis AF2122/97
cguccccagaccggcggcu

SEQ ID NO: 1164854 - RNA, 19 nt, Mycobacterium bovis subsp bovis AF2122/97
cguccaucgcgcgccgacc

SEQ ID NO: 1164855 - RNA, 10 nt, Mycobacterium bovis subsp bovis AF2122/97
cguccaucag

SEQ ID NO: 1164856 - RNA, 18 nt, Mycobacterium bovis subsp bovis AF2122/97
cguccaucccggcgccgc

SEQ ID NO: 1164857 - RNA, 13 nt, Mycobacterium bovis subsp bovis AF2122/97
cgucccagcgccg

SEQ ID NO: 1164858 - RNA, 20 nt, Mycobacterium bovis subsp bovis AF2122/97
cgucccagcgguagccgagc

SEQ ID NO: 1164859 - RNA, 23 nt, Mycobacterium bovis subsp bovis AF2122/97
cgucccagcgguagccgagcucg

SEQ ID NO: 1164860 - RNA, 14 nt, Mycobacterium bovis subsp bovis AF2122/97
cgucccaggacucc

SEQ ID NO: 1164861 - RNA, 13 nt, Mycobacterium bovis subsp bovis AF2122/97
cgucccaccagcc

SEQ ID NO: 1164862 - RNA, 15 nt, Mycobacterium bovis subsp bovis AF2122/97
cgucccaccagccga

SEQ ID NO: 1164863 - RNA, 18 nt, Mycobacterium bovis subsp bovis AF2122/97
cguccggggccgcggccc

SEQ ID NO: 1164864 - RNA, 18 nt, Mycobacterium bovis subsp bovis AF2122/97
cguccgggcggccucccg

SEQ ID NO: 1164865 - RNA, 18 nt, Mycobacterium bovis subsp bovis AF2122/97
cguccggucgccucaccg

SEQ ID NO: 1164866 - RNA, 20 nt, Mycobacterium bovis subsp bovis AF2122/97
cguccggucgccucaccggc

SEQ ID NO: 1164867 - RNA, 18 nt, Mycobacterium bovis subsp bovis AF2122/97
cguccgguggaccgccga

SEQ ID NO: 1164868 - RNA, 17 nt, Mycobacterium bovis subsp bovis AF2122/97
cguccggccacgguccg

SEQ ID NO: 1164869 - RNA, 20 nt, Mycobacterium bovis subsp bovis AF2122/97
cguccggccgggcccuccac

SEQ ID NO: 1164870 - RNA, 21 nt, Mycobacterium bovis subsp bovis AF2122/97
cguccgcugcagguccagggu

SEQ ID NO: 1164871 - RNA, 13 nt, Mycobacterium bovis subsp bovis AF2122/97
cguccgccggcga

SEQ ID NO: 1164872 - RNA, 16 nt, Mycobacterium bovis subsp bovis AF2122/97
cguccgcgccgagccc

SEQ ID NO: 1164873 - RNA, 12 nt, Mycobacterium bovis subsp bovis AF2122/97
cguccgcccagc

SEQ ID NO: 1164874 - RNA, 14 nt, Mycobacterium bovis subsp bovis AF2122/97
cguccgcccagcac

SEQ ID NO: 1164875 - RNA, 21 nt, Mycobacterium bovis subsp bovis AF2122/97
cguccgcccagccgcagcacc

SEQ ID NO: 1164876 - RNA, 15 nt, Mycobacterium bovis subsp bovis AF2122/97
cguccgcccagcacc

SEQ ID NO: 1164877 - RNA, 14 nt, Mycobacterium bovis subsp bovis AF2122/97
cguccgacggcgga

SEQ ID NO: 1164878 - RNA, 13 nt, Mycobacterium bovis subsp bovis AF2122/97
cguccgcaacagg

SEQ ID NO: 1164879 - RNA, 15 nt, Mycobacterium bovis subsp bovis AF2122/97
cgucgaacagcaccg

SEQ ID NO: 1164880 - RNA, 17 nt, Mycobacterium bovis subsp bovis AF2122/97
cgucgaagaccgccucc

SEQ ID NO: 1164881 - RNA, 17 nt, Mycobacterium bovis subsp bovis AF2122/97
cguccuugcgcagcacc

SEQ ID NO: 1164882 - RNA, 15 nt, Mycobacterium bovis subsp bovis AF2122/97
cguccuuuccaggag

SEQ ID NO: 1164883 - RNA, 13 nt, Mycobacterium bovis subsp bovis AF2122/97
cgucgacacggug

SEQ ID NO: 1164884 - RNA, 13 nt, Mycobacterium bovis subsp bovis AF2122/97
cgucgaccaggcc

SEQ ID NO: 1164885 - RNA, 14 nt, Mycobacterium bovis subsp bovis AF2122/97
cgucgaccaggcca

SEQ ID NO: 1164886 - RNA, 24 nt, Mycobacterium bovis subsp bovis AF2122/97
cgucgaaucuucugagacugccgc

SEQ ID NO: 1164887 - RNA, 14 nt, Mycobacterium bovis subsp bovis AF2122/97
cgucgaauuccggc

SEQ ID NO: 1164888 - RNA, 19 nt, Mycobacterium bovis subsp bovis AF2122/97
cgucgacaacgaucgcgcg

SEQ ID NO: 1164889 - RNA, 22 nt, Mycobacterium bovis subsp bovis AF2122/97
cgucgacaacgaucgcgcgagc

SEQ ID NO: 1164890 - RNA, 21 nt, Mycobacterium bovis subsp bovis AF2122/97
cgucgacaaucaguagcagcg

SEQ ID NO: 1164891 - RNA, 18 nt, Mycobacterium bovis subsp bovis AF2122/97
cguccugccaguccgcag

SEQ ID NO: 1164892 - RNA, 16 nt, Mycobacterium bovis subsp bovis AF2122/97
cguccucgccgcacgc

SEQ ID NO: 1164893 - RNA, 17 nt, Mycobacterium bovis subsp bovis AF2122/97
cguccucgaagaacugg

SEQ ID NO: 1164894 - RNA, 13 nt, Mycobacterium bovis subsp bovis AF2122/97
cguccucgcugga

SEQ ID NO: 1164895 - RNA, 16 nt, Mycobacterium bovis subsp bovis AF2122/97
cguccucgucuucguc

SEQ ID NO: 1164896 - RNA, 21 nt, Mycobacterium bovis subsp bovis AF2122/97
cguccucagccgugcccaggc

SEQ ID NO: 1164897 - RNA, 14 nt, Mycobacterium bovis subsp bovis AF2122/97
cguccgucggcgcu

SEQ ID NO: 1164898 - RNA, 14 nt, Mycobacterium bovis subsp bovis AF2122/97
cgucggcgaccagg

SEQ ID NO: 1164899 - RNA, 19 nt, Mycobacterium bovis subsp bovis AF2122/97
cgucggcgagcucggcccc

SEQ ID NO: 1164900 - RNA, 14 nt, Mycobacterium bovis subsp bovis AF2122/97
cgucggcgaaggug

SEQ ID NO: 1164901 - RNA, 14 nt, Mycobacterium bovis subsp bovis AF2122/97
cgucggccggcacc

SEQ ID NO: 1164902 - RNA, 20 nt, Mycobacterium bovis subsp bovis AF2122/97
cgucggcgagcagacgccgc

SEQ ID NO: 1164903 - RNA, 18 nt, Mycobacterium bovis subsp bovis AF2122/97
cgucggcgauggccagca

SEQ ID NO: 1164904 - RNA, 13 nt, Mycobacterium bovis subsp bovis AF2122/97
cgucggcgcggcc

SEQ ID NO: 1164905 - RNA, 12 nt, Mycobacterium bovis subsp bovis AF2122/97
cgucggccugga

SEQ ID NO: 1164906 - RNA, 16 nt, Mycobacterium bovis subsp bovis AF2122/97
cgucggccgacaccgc

SEQ ID NO: 1164907 - RNA, 20 nt, Mycobacterium bovis subsp bovis AF2122/97
cgucggccgacaccgccacc

SEQ ID NO: 1164908 - RNA, 16 nt, Mycobacterium bovis subsp bovis AF2122/97
cgucggcauugcgcag

SEQ ID NO: 1164909 - RNA, 22 nt, Mycobacterium bovis subsp bovis AF2122/97
cgucggcaccgguuuucgccgg

SEQ ID NO: 1164910 - RNA, 20 nt, Mycobacterium bovis subsp bovis AF2122/97
cgucggcaugggccggcgcc

SEQ ID NO: 1164911 - RNA, 13 nt, Mycobacterium bovis subsp bovis AF2122/97
cgucggccagcag

SEQ ID NO: 1164912 - RNA, 14 nt, Mycobacterium bovis subsp bovis AF2122/97
cgucggccagcaga

SEQ ID NO: 1164913 - RNA, 14 nt, Mycobacterium bovis subsp bovis AF2122/97
cgucggccagcagc

SEQ ID NO: 1164914 - RNA, 24 nt, Mycobacterium bovis subsp bovis AF2122/97
cgucggccacccgguccaccgacc

SEQ ID NO: 1164915 - RNA, 17 nt, Mycobacterium bovis subsp bovis AF2122/97
cgucggccagcagcaau

SEQ ID NO: 1164916 - RNA, 22 nt, Mycobacterium bovis subsp bovis AF2122/97
cgucggcaaagaaggcgacccg

SEQ ID NO: 1164917 - RNA, 16 nt, Mycobacterium bovis subsp bovis AF2122/97
cgucgcggguccaggc

SEQ ID NO: 1164918 - RNA, 18 nt, Mycobacterium bovis subsp bovis AF2122/97
cgucgcugcccgcgcggc

SEQ ID NO: 1164919 - RNA, 20 nt, Mycobacterium bovis subsp bovis AF2122/97
cgucgcuucggcaccgacug

SEQ ID NO: 1164920 - RNA, 13 nt, Mycobacterium bovis subsp bovis AF2122/97
cgucgcuugcugg

SEQ ID NO: 1164921 - RNA, 21 nt, Mycobacterium bovis subsp bovis AF2122/97
cgucgcuuggaucgucgcugu

SEQ ID NO: 1164922 - RNA, 12 nt, Mycobacterium bovis subsp bovis AF2122/97
cgucggagccgg

SEQ ID NO: 1164923 - RNA, 21 nt, Mycobacterium bovis subsp bovis AF2122/97
cgucggaauacaacagcuggg

SEQ ID NO: 1164924 - RNA, 19 nt, Mycobacterium bovis subsp bovis AF2122/97
cgucgcggccgagacggcg

SEQ ID NO: 1164925 - RNA, 23 nt, Mycobacterium bovis subsp bovis AF2122/97
cgucgcggaucagcccgcgcagc

SEQ ID NO: 1164926 - RNA, 21 nt, Mycobacterium bovis subsp bovis AF2122/97
cgucgcggccacggucagcca

SEQ ID NO: 1164927 - RNA, 15 nt, Mycobacterium bovis subsp bovis AF2122/97
cgucgcggccagcag

SEQ ID NO: 1164928 - RNA, 19 nt, Mycobacterium bovis subsp bovis AF2122/97
cgucgcggaguagccgcag

SEQ ID NO: 1164929 - RNA, 15 nt, Mycobacterium bovis subsp bovis AF2122/97
cgucgcgcugccggc

SEQ ID NO: 1164930 - RNA, 18 nt, Mycobacterium bovis subsp bovis AF2122/97
cgucgcgucgccaggccc

SEQ ID NO: 1164931 - RNA, 23 nt, Mycobacterium bovis subsp bovis AF2122/97
cgucgcggccggcggccgcccag

SEQ ID NO: 1164932 - RNA, 20 nt, Mycobacterium bovis subsp bovis AF2122/97
cgucgcggguaaccggcucc

SEQ ID NO: 1164933 - RNA, 17 nt, Mycobacterium bovis subsp bovis AF2122/97
cgucgcuagggugagcc

SEQ ID NO: 1164934 - RNA, 15 nt, Mycobacterium bovis subsp bovis AF2122/97
cgucgcugagcagcg

SEQ ID NO: 1164935 - RNA, 16 nt, Mycobacterium bovis subsp bovis AF2122/97
cgucgcugagcagcgc

SEQ ID NO: 1164936 - RNA, 18 nt, Mycobacterium bovis subsp bovis AF2122/97
cgucgcgauugccgcggu

SEQ ID NO: 1164937 - RNA, 21 nt, Mycobacterium bovis subsp bovis AF2122/97
cgucgccggucaggccgccgc

SEQ ID NO: 1164938 - RNA, 14 nt, Mycobacterium bovis subsp bovis AF2122/97
cgucgccgguggca

SEQ ID NO: 1164939 - RNA, 22 nt, Mycobacterium bovis subsp bovis AF2122/97
cgucgccguacaaccacccacc

SEQ ID NO: 1164940 - RNA, 20 nt, Mycobacterium bovis subsp bovis AF2122/97
cgucgccgucggugccgccg

SEQ ID NO: 1164941 - RNA, 13 nt, Mycobacterium bovis subsp bovis AF2122/97
cgucgccggcggc

SEQ ID NO: 1164942 - RNA, 14 nt, Mycobacterium bovis subsp bovis AF2122/97
cgucgccggcggcg

SEQ ID NO: 1164943 - RNA, 22 nt, Mycobacterium bovis subsp bovis AF2122/97
cgucgaccgaacccgacgucgc

SEQ ID NO: 1164944 - RNA, 15 nt, Mycobacterium bovis subsp bovis AF2122/97
cgucgaccgcggccc

SEQ ID NO: 1164945 - RNA, 12 nt, Mycobacterium bovis subsp bovis AF2122/97
cgucgaccucgc

SEQ ID NO: 1164946 - RNA, 14 nt, Mycobacterium bovis subsp bovis AF2122/97
cgucgaccggcggg

SEQ ID NO: 1164947 - RNA, 15 nt, Mycobacterium bovis subsp bovis AF2122/97
cgucgaccggcggga

SEQ ID NO: 1164948 - RNA, 12 nt, Mycobacterium bovis subsp bovis AF2122/97
cgucgacgccga

SEQ ID NO: 1164949 - RNA, 22 nt, Mycobacterium bovis subsp bovis AF2122/97
cgucgacggccuggggcagccg

SEQ ID NO: 1164950 - RNA, 20 nt, Mycobacterium bovis subsp bovis AF2122/97
cgucgacggcgauggcgcgc

SEQ ID NO: 1164951 - RNA, 19 nt, Mycobacterium bovis subsp bovis AF2122/97
cgucgagcgcggugccgcc

SEQ ID NO: 1164952 - RNA, 21 nt, Mycobacterium bovis subsp bovis AF2122/97
cgucgagcgcggugccgccac

SEQ ID NO: 1164953 - RNA, 12 nt, Mycobacterium bovis subsp bovis AF2122/97
cgucgagcgcgu

SEQ ID NO: 1164954 - RNA, 14 nt, Mycobacterium bovis subsp bovis AF2122/97
cgucgagccgccag

SEQ ID NO: 1164955 - RNA, 14 nt, Mycobacterium bovis subsp bovis AF2122/97
cgucgagcgcgcca

SEQ ID NO: 1164956 - RNA, 12 nt, Mycobacterium bovis subsp bovis AF2122/97
cgucgagcgcgg

SEQ ID NO: 1164957 - RNA, 17 nt, Mycobacterium bovis subsp bovis AF2122/97
cgucgagcgccggccgc

SEQ ID NO: 1164958 - RNA, 15 nt, Mycobacterium bovis subsp bovis AF2122/97
cgucgagcaccuugg

SEQ ID NO: 1164959 - RNA, 18 nt, Mycobacterium bovis subsp bovis AF2122/97
cgucgagcauccacccau

SEQ ID NO: 1164960 - RNA, 18 nt, Mycobacterium bovis subsp bovis AF2122/97
cgucgacuucagcggccg

SEQ ID NO: 1164961 - RNA, 21 nt, Mycobacterium bovis subsp bovis AF2122/97
cgucgagauagccgacgucgc

SEQ ID NO: 1164962 - RNA, 15 nt, Mycobacterium bovis subsp bovis AF2122/97
cgucgagcagcacca

SEQ ID NO: 1164963 - RNA, 15 nt, Mycobacterium bovis subsp bovis AF2122/97
cgucgagcagccgcg

SEQ ID NO: 1164964 - RNA, 15 nt, Mycobacterium bovis subsp bovis AF2122/97
cgucgagcagcgcca

SEQ ID NO: 1164965 - RNA, 16 nt, Mycobacterium bovis subsp bovis AF2122/97
cgucgagguucucccg

SEQ ID NO: 1164966 - RNA, 16 nt, Mycobacterium bovis subsp bovis AF2122/97
cgucgaggucagcucc

SEQ ID NO: 1164967 - RNA, 14 nt, Mycobacterium bovis subsp bovis AF2122/97
cgucgaggcugacc

SEQ ID NO: 1164968 - RNA, 24 nt, Mycobacterium bovis subsp bovis AF2122/97
cgucgaguagguaacgcgcacgcu

SEQ ID NO: 1164969 - RNA, 16 nt, Mycobacterium bovis subsp bovis AF2122/97
cgucgaguagugcagg

SEQ ID NO: 1164970 - RNA, 22 nt, Mycobacterium bovis subsp bovis AF2122/97
cgucgaguagugcaggugcccg

SEQ ID NO: 1164971 - RNA, 22 nt, Mycobacterium bovis subsp bovis AF2122/97
cgucgaguccaggccggcagcu

SEQ ID NO: 1164972 - RNA, 15 nt, Mycobacterium bovis subsp bovis AF2122/97
cgucgcccagggugu

SEQ ID NO: 1164973 - RNA, 16 nt, Mycobacterium bovis subsp bovis AF2122/97
cgucgccgccauugcc

SEQ ID NO: 1164974 - RNA, 15 nt, Mycobacterium bovis subsp bovis AF2122/97
cgucgccgcccuggc

SEQ ID NO: 1164975 - RNA, 11 nt, Mycobacterium bovis subsp bovis AF2122/97
cgucgccgccg

SEQ ID NO: 1164976 - RNA, 17 nt, Mycobacterium bovis subsp bovis AF2122/97
cgucgccgccgggcagu

SEQ ID NO: 1164977 - RNA, 16 nt, Mycobacterium bovis subsp bovis AF2122/97
cgucgccgccgguccc

SEQ ID NO: 1164978 - RNA, 18 nt, Mycobacterium bovis subsp bovis AF2122/97
cgucgccgccggcgccgc

SEQ ID NO: 1164979 - RNA, 19 nt, Mycobacterium bovis subsp bovis AF2122/97
cgucgccgccggcuccggc

SEQ ID NO: 1164980 - RNA, 15 nt, Mycobacterium bovis subsp bovis AF2122/97
cgucgccgcggcggc

SEQ ID NO: 1164981 - RNA, 20 nt, Mycobacterium bovis subsp bovis AF2122/97
cgucgccgccguugccgccg

SEQ ID NO: 1164982 - RNA, 19 nt, Mycobacterium bovis subsp bovis AF2122/97
cgucgccggauagcgcagc

SEQ ID NO: 1164983 - RNA, 13 nt, Mycobacterium bovis subsp bovis AF2122/97
cgucgccggcccc

SEQ ID NO: 1164984 - RNA, 17 nt, Mycobacterium bovis subsp bovis AF2122/97
cgucgccagggccgccg

SEQ ID NO: 1164985 - RNA, 14 nt, Mycobacterium bovis subsp bovis AF2122/97
cgucgccagggccu

SEQ ID NO: 1164986 - RNA, 17 nt, Mycobacterium bovis subsp bovis AF2122/97
cgucgccagggccuugg

SEQ ID NO: 1164987 - RNA, 14 nt, Mycobacterium bovis subsp bovis AF2122/97
cgucgaugucgucg

SEQ ID NO: 1164988 - RNA, 17 nt, Mycobacterium bovis subsp bovis AF2122/97
cgucgauggucuccgga

SEQ ID NO: 1164989 - RNA, 17 nt, Mycobacterium bovis subsp bovis AF2122/97
cgucgauggugcggccc

SEQ ID NO: 1164990 - RNA, 19 nt, Mycobacterium bovis subsp bovis AF2122/97
cgucgauguauccgaugcg

SEQ ID NO: 1164991 - RNA, 15 nt, Mycobacterium bovis subsp bovis AF2122/97
cgucgaugucauccg

SEQ ID NO: 1164992 - RNA, 19 nt, Mycobacterium bovis subsp bovis AF2122/97
cgucgcaaacuucgcgcac

SEQ ID NO: 1164993 - RNA, 21 nt, Mycobacterium bovis subsp bovis AF2122/97
cgucgcaauaugccacagacc

SEQ ID NO: 1164994 - RNA, 14 nt, Mycobacterium bovis subsp bovis AF2122/97
cgucgcaacggccc

SEQ ID NO: 1164995 - RNA, 12 nt, Mycobacterium bovis subsp bovis AF2122/97
cgucgccaccga

SEQ ID NO: 1164996 - RNA, 15 nt, Mycobacterium bovis subsp bovis AF2122/97
cgucgcaucaccagg

SEQ ID NO: 1164997 - RNA, 14 nt, Mycobacterium bovis subsp bovis AF2122/97
cgucgcacgcgcgc

SEQ ID NO: 1164998 - RNA, 13 nt, Mycobacterium bovis subsp bovis AF2122/97
cgucgcagugcaa

SEQ ID NO: 1164999 - RNA, 16 nt, Mycobacterium bovis subsp bovis AF2122/97
cgugcccgccaccggc

SEQ ID NO: 1165000 - RNA, 23 nt, Mycobacterium bovis subsp bovis AF2122/97
cgugccgaacgccagaccgccga

SEQ ID NO: 1165001 - RNA, 20 nt, Mycobacterium bovis subsp bovis AF2122/97
cgugccagcaggggacgggc

SEQ ID NO: 1165002 - RNA, 22 nt, Mycobacterium bovis subsp bovis AF2122/97
cgugccagcaggggacgggcgg

SEQ ID NO: 1165003 - RNA, 18 nt, Mycobacterium bovis subsp bovis AF2122/97
cgugccagcacacgccua

SEQ ID NO: 1165004 - RNA, 12 nt, Mycobacterium bovis subsp bovis AF2122/97
cgugccgccagc

SEQ ID NO: 1165005 - RNA, 18 nt, Mycobacterium bovis subsp bovis AF2122/97
cgugccgcccgccucugu

SEQ ID NO: 1165006 - RNA, 20 nt, Mycobacterium bovis subsp bovis AF2122/97
cgugccgcggcgacggugag

SEQ ID NO: 1165007 - RNA, 14 nt, Mycobacterium bovis subsp bovis AF2122/97
cgugccgagcgugc

SEQ ID NO: 1165008 - RNA, 18 nt, Mycobacterium bovis subsp bovis AF2122/97
cgugccgaugccggcgag

SEQ ID NO: 1165009 - RNA, 15 nt, Mycobacterium bovis subsp bovis AF2122/97
cgugcccgguguuca

SEQ ID NO: 1165010 - RNA, 14 nt, Mycobacterium bovis subsp bovis AF2122/97
cgugccgggaccgg

SEQ ID NO: 1165011 - RNA, 17 nt, Mycobacterium bovis subsp bovis AF2122/97
cgugccucucgggggcc

SEQ ID NO: 1165012 - RNA, 18 nt, Mycobacterium bovis subsp bovis AF2122/97
cgugcagcggcgggcgau

SEQ ID NO: 1165013 - RNA, 16 nt, Mycobacterium bovis subsp bovis AF2122/97
cgugcaggaacaccca

SEQ ID NO: 1165014 - RNA, 19 nt, Mycobacterium bovis subsp bovis AF2122/97
cgugcaggaacacccauac

SEQ ID NO: 1165015 - RNA, 20 nt, Mycobacterium bovis subsp bovis AF2122/97
cgugcagggcauugcggccc

SEQ ID NO: 1165016 - RNA, 14 nt, Mycobacterium bovis subsp bovis AF2122/97
cgugcacaggucag

SEQ ID NO: 1165017 - RNA, 15 nt, Mycobacterium bovis subsp bovis AF2122/97
cgugcaaccacggcg

SEQ ID NO: 1165018 - RNA, 22 nt, Mycobacterium bovis subsp bovis AF2122/97
cgugcacgcacagcccgaugcc

SEQ ID NO: 1165019 - RNA, 15 nt, Mycobacterium bovis subsp bovis AF2122/97
cgugcaccagcucac

SEQ ID NO: 1165020 - RNA, 18 nt, Mycobacterium bovis subsp bovis AF2122/97
cgugcaccucgucccagc

SEQ ID NO: 1165021 - RNA, 20 nt, Mycobacterium bovis subsp bovis AF2122/97
cgugcaccucgucccagcgg

SEQ ID NO: 1165022 - RNA, 20 nt, Mycobacterium bovis subsp bovis AF2122/97
cgugauguggucggacagcg

SEQ ID NO: 1165023 - RNA, 21 nt, Mycobacterium bovis subsp bovis AF2122/97
cgugaucgcgguccaacagcg

SEQ ID NO: 1165024 - RNA, 14 nt, Mycobacterium bovis subsp bovis AF2122/97
cgugaucaggucac

SEQ ID NO: 1165025 - RNA, 19 nt, Mycobacterium bovis subsp bovis AF2122/97
cgugaucaggucacccagc

SEQ ID NO: 1165026 - RNA, 20 nt, Mycobacterium bovis subsp bovis AF2122/97
cgugauaucagagggccgcg

SEQ ID NO: 1165027 - RNA, 15 nt, Mycobacterium bovis subsp bovis AF2122/97
cgugagugcagcacg

SEQ ID NO: 1165028 - RNA, 21 nt, Mycobacterium bovis subsp bovis AF2122/97
cgugaggucccggcugggauc

SEQ ID NO: 1165029 - RNA, 14 nt, Mycobacterium bovis subsp bovis AF2122/97
cgugagccagcuug

SEQ ID NO: 1165030 - RNA, 13 nt, Mycobacterium bovis subsp bovis AF2122/97
cgugagcaccagc

SEQ ID NO: 1165031 - RNA, 17 nt, Mycobacterium bovis subsp bovis AF2122/97
cgugagcaccagcagca

SEQ ID NO: 1165032 - RNA, 16 nt, Mycobacterium bovis subsp bovis AF2122/97
cgugagccaugccgcu

SEQ ID NO: 1165033 - RNA, 13 nt, Mycobacterium bovis subsp bovis AF2122/97
cgugagccccagc

SEQ ID NO: 1165034 - RNA, 14 nt, Mycobacterium bovis subsp bovis AF2122/97
cgugagccggaccg

SEQ ID NO: 1165035 - RNA, 16 nt, Mycobacterium bovis subsp bovis AF2122/97
cgugagacugggcgcu

SEQ ID NO: 1165036 - RNA, 15 nt, Mycobacterium bovis subsp bovis AF2122/97
cgugagcggccaggu

SEQ ID NO: 1165037 - RNA, 21 nt, Mycobacterium bovis subsp bovis AF2122/97
cgugaacggcgcgggccacca

SEQ ID NO: 1165038 - RNA, 19 nt, Mycobacterium bovis subsp bovis AF2122/97
cgugaccaccgccgacagg

SEQ ID NO: 1165039 - RNA, 15 nt, Mycobacterium bovis subsp bovis AF2122/97
cgugaauggcagcac

SEQ ID NO: 1165040 - RNA, 17 nt, Mycobacterium bovis subsp bovis AF2122/97
cgugacguaccacggcg

SEQ ID NO: 1165041 - RNA, 19 nt, Mycobacterium bovis subsp bovis AF2122/97
cgugacguaccacggcgau

SEQ ID NO: 1165042 - RNA, 20 nt, Mycobacterium bovis subsp bovis AF2122/97
cgugacguagggcagcgcca

SEQ ID NO: 1165043 - RNA, 21 nt, Mycobacterium bovis subsp bovis AF2122/97
cgugacguagggcagcgccag

SEQ ID NO: 1165044 - RNA, 21 nt, Mycobacterium bovis subsp bovis AF2122/97
cgugacguaucgccgcgggcg

SEQ ID NO: 1165045 - RNA, 12 nt, Mycobacterium bovis subsp bovis AF2122/97
cgugagaggcca

SEQ ID NO: 1165046 - RNA, 15 nt, Mycobacterium bovis subsp bovis AF2122/97
cgugagaccuagcag

SEQ ID NO: 1165047 - RNA, 19 nt, Mycobacterium bovis subsp bovis AF2122/97
cgugacgaguucgcugacc

SEQ ID NO: 1165048 - RNA, 13 nt, Mycobacterium bovis subsp bovis AF2122/97
cgugacgaccagc

SEQ ID NO: 1165049 - RNA, 17 nt, Mycobacterium bovis subsp bovis AF2122/97
cgugaccgagccgcgau

SEQ ID NO: 1165050 - RNA, 20 nt, Mycobacterium bovis subsp bovis AF2122/97
cgugacccucagcaccgcug

SEQ ID NO: 1165051 - RNA, 14 nt, Mycobacterium bovis subsp bovis AF2122/97
cgugacccuggggu

SEQ ID NO: 1165052 - RNA, 20 nt, Mycobacterium bovis subsp bovis AF2122/97
cgucggucucaugcacccgg

SEQ ID NO: 1165053 - RNA, 23 nt, Mycobacterium bovis subsp bovis AF2122/97
cgucgggugcagcacggcgccgc

SEQ ID NO: 1165054 - RNA, 15 nt, Mycobacterium bovis subsp bovis AF2122/97
cgucggugccgccgc

SEQ ID NO: 1165055 - RNA, 18 nt, Mycobacterium bovis subsp bovis AF2122/97
cgucggugucgaugcuga

SEQ ID NO: 1165056 - RNA, 21 nt, Mycobacterium bovis subsp bovis AF2122/97
cgucgguguuccgccgcgcua

SEQ ID NO: 1165057 - RNA, 16 nt, Mycobacterium bovis subsp bovis AF2122/97
cgucgucagguggcca

SEQ ID NO: 1165058 - RNA, 15 nt, Mycobacterium bovis subsp bovis AF2122/97
cgucguaguccaggc

SEQ ID NO: 1165059 - RNA, 14 nt, Mycobacterium bovis subsp bovis AF2122/97
cgucgucagccagg

SEQ ID NO: 1165060 - RNA, 15 nt, Mycobacterium bovis subsp bovis AF2122/97
cgucguaugcgguga

SEQ ID NO: 1165061 - RNA, 17 nt, Mycobacterium bovis subsp bovis AF2122/97
cgucguacucggcggcc

SEQ ID NO: 1165062 - RNA, 17 nt, Mycobacterium bovis subsp bovis AF2122/97
cgucgggacgccgcccc

SEQ ID NO: 1165063 - RNA, 23 nt, Mycobacterium bovis subsp bovis AF2122/97
cgucgggcaccgccaaaaacgcc

SEQ ID NO: 1165064 - RNA, 13 nt, Mycobacterium bovis subsp bovis AF2122/97
cgucgggcagcag

SEQ ID NO: 1165065 - RNA, 21 nt, Mycobacterium bovis subsp bovis AF2122/97
cgucgggcgucccggcgguca

SEQ ID NO: 1165066 - RNA, 19 nt, Mycobacterium bovis subsp bovis AF2122/97
cgucggcgggcugcaguga

SEQ ID NO: 1165067 - RNA, 19 nt, Mycobacterium bovis subsp bovis AF2122/97
cgucggcggcgaccgccag

SEQ ID NO: 1165068 - RNA, 18 nt, Mycobacterium bovis subsp bovis AF2122/97
cgucggcguacagcgccu

SEQ ID NO: 1165069 - RNA, 16 nt, Mycobacterium bovis subsp bovis AF2122/97
cgucggcgugacgucg

SEQ ID NO: 1165070 - RNA, 18 nt, Mycobacterium bovis subsp bovis AF2122/97
cgucucgagcgcgccgcg

SEQ ID NO: 1165071 - RNA, 22 nt, Mycobacterium bovis subsp bovis AF2122/97
cgucucgacaguggcgacggac

SEQ ID NO: 1165072 - RNA, 17 nt, Mycobacterium bovis subsp bovis AF2122/97
cgucuccuugagcuucu

SEQ ID NO: 1165073 - RNA, 13 nt, Mycobacterium bovis subsp bovis AF2122/97
cgucuccggcgcc

SEQ ID NO: 1165074 - RNA, 18 nt, Mycobacterium bovis subsp bovis AF2122/97
cgucuccggcgccaccgc

SEQ ID NO: 1165075 - RNA, 16 nt, Mycobacterium bovis subsp bovis AF2122/97
cgucguugaggaagcc

SEQ ID NO: 1165076 - RNA, 19 nt, Mycobacterium bovis subsp bovis AF2122/97
cgucguugaggaagcccga

SEQ ID NO: 1165077 - RNA, 18 nt, Mycobacterium bovis subsp bovis AF2122/97
cgucguugcccgacccgc

SEQ ID NO: 1165078 - RNA, 18 nt, Mycobacterium bovis subsp bovis AF2122/97
cgucuaccccgagccuug

SEQ ID NO: 1165079 - RNA, 18 nt, Mycobacterium bovis subsp bovis AF2122/97
cgucgucgucgacggccu

SEQ ID NO: 1165080 - RNA, 18 nt, Mycobacterium bovis subsp bovis AF2122/97
cgucgucguuucgccagc

SEQ ID NO: 1165081 - RNA, 18 nt, Mycobacterium bovis subsp bovis AF2122/97
cgucguccgacgggccgu

SEQ ID NO: 1165082 - RNA, 17 nt, Mycobacterium bovis subsp bovis AF2122/97
cgucgucgacacgguga

SEQ ID NO: 1165083 - RNA, 14 nt, Mycobacterium bovis subsp bovis AF2122/97
cgucgucgacgaca

SEQ ID NO: 1165084 - RNA, 22 nt, Mycobacterium bovis subsp bovis AF2122/97
cgucgucggcaaccaaccgcgc

SEQ ID NO: 1165085 - RNA, 23 nt, Mycobacterium bovis subsp bovis AF2122/97
cgucgucgccgccgaaaaccucg

SEQ ID NO: 1165086 - RNA, 13 nt, Mycobacterium bovis subsp bovis AF2122/97
cgucgugauguca

SEQ ID NO: 1165087 - RNA, 14 nt, Mycobacterium bovis subsp bovis AF2122/97
cgucgugccaccgu

SEQ ID NO: 1165088 - RNA, 15 nt, Mycobacterium bovis subsp bovis AF2122/97
cgucguggaucuucg

SEQ ID NO: 1165089 - RNA, 21 nt, Mycobacterium bovis subsp bovis AF2122/97
cgucguggcgcucggcgagca

SEQ ID NO: 1165090 - RNA, 13 nt, Mycobacterium bovis subsp bovis AF2122/97
cgucguggggacc

SEQ ID NO: 1165091 - RNA, 16 nt, Mycobacterium bovis subsp bovis AF2122/97
cgucguuaagacggcg

SEQ ID NO: 1165092 - RNA, 17 nt, Mycobacterium bovis subsp bovis AF2122/97
cgucguuaagacggcga

SEQ ID NO: 1165093 - RNA, 18 nt, Mycobacterium bovis subsp bovis AF2122/97
cgucucggugcagcagcg

SEQ ID NO: 1165094 - RNA, 14 nt, Mycobacterium bovis subsp bovis AF2122/97
cgucugccaggcgc

SEQ ID NO: 1165095 - RNA, 17 nt, Mycobacterium bovis subsp bovis AF2122/97
cgucugccaggcgcagc

SEQ ID NO: 1165096 - RNA, 15 nt, Mycobacterium bovis subsp bovis AF2122/97
cgucugcccgcccag

SEQ ID NO: 1165097 - RNA, 18 nt, Mycobacterium bovis subsp bovis AF2122/97
cgucugcggggugaguga

SEQ ID NO: 1165098 - RNA, 20 nt, Mycobacterium bovis subsp bovis AF2122/97
cgucugcggaccggcgcgcu

SEQ ID NO: 1165099 - RNA, 16 nt, Mycobacterium bovis subsp bovis AF2122/97
cgucugcggaccggcg

SEQ ID NO: 1165100 - RNA, 16 nt, Mycobacterium bovis subsp bovis AF2122/97
cgucugcccgcccagc

SEQ ID NO: 1165101 - RNA, 14 nt, Mycobacterium bovis subsp bovis AF2122/97
cgucugcucgccag

SEQ ID NO: 1165102 - RNA, 21 nt, Mycobacterium bovis subsp bovis AF2122/97
cgucugcucgccagccggccu

SEQ ID NO: 1165103 - RNA, 11 nt, Mycobacterium bovis subsp bovis AF2122/97
cgucugcucgc

SEQ ID NO: 1165104 - RNA, 15 nt, Mycobacterium bovis subsp bovis AF2122/97
cgucugcucggcgga

SEQ ID NO: 1165105 - RNA, 14 nt, Mycobacterium bovis subsp bovis AF2122/97
cgucuggccgucgc

SEQ ID NO: 1165106 - RNA, 15 nt, Mycobacterium bovis subsp bovis AF2122/97
cgucuggucagccgc

SEQ ID NO: 1165107 - RNA, 20 nt, Mycobacterium bovis subsp bovis AF2122/97
cgucugcucgccagcggggc

SEQ ID NO: 1165108 - RNA, 23 nt, Mycobacterium bovis subsp bovis AF2122/97
cgucuugauguaaugcgggcgca

SEQ ID NO: 1165109 - RNA, 18 nt, Mycobacterium bovis subsp bovis AF2122/97
cgucuucggucgcggccu

SEQ ID NO: 1165110 - RNA, 22 nt, Mycobacterium bovis subsp bovis AF2122/97
cgucuucgucggagucuucguc

SEQ ID NO: 1165111 - RNA, 21 nt, Mycobacterium bovis subsp bovis AF2122/97
cgucuuaccugaagccgcgcu

SEQ ID NO: 1165112 - RNA, 23 nt, Mycobacterium bovis subsp bovis AF2122/97
cgucuugggccgggaugaagcca

SEQ ID NO: 1165113 - RNA, 19 nt, Mycobacterium bovis subsp bovis AF2122/97
cgcgccggcugccacacag

SEQ ID NO: 1165114 - RNA, 17 nt, Mycobacterium bovis subsp bovis AF2122/97
cgcgccguaacagccgg

SEQ ID NO: 1165115 - RNA, 13 nt, Mycobacterium bovis subsp bovis AF2122/97
cgcgccguggcgu

SEQ ID NO: 1165116 - RNA, 13 nt, Mycobacterium bovis subsp bovis AF2122/97
cgcgccguucacc

SEQ ID NO: 1165117 - RNA, 16 nt, Mycobacterium bovis subsp bovis AF2122/97
cgcgccguugccgccc

SEQ ID NO: 1165118 - RNA, 19 nt, Mycobacterium bovis subsp bovis AF2122/97
cgcgccgucgucgcgcagu

SEQ ID NO: 1165119 - RNA, 17 nt, Mycobacterium bovis subsp bovis AF2122/97
cgcgccuaugggccugc

SEQ ID NO: 1165120 - RNA, 20 nt, Mycobacterium bovis subsp bovis AF2122/97
cgccagaucucgcgcgcggc

SEQ ID NO: 1165121 - RNA, 20 nt, Mycobacterium bovis subsp bovis AF2122/97
cgccagaugaugccacccuc

SEQ ID NO: 1165122 - RNA, 21 nt, Mycobacterium bovis subsp bovis AF2122/97
cgccagagucggagacccguc

SEQ ID NO: 1165123 - RNA, 21 nt, Mycobacterium bovis subsp bovis AF2122/97
cgccagcaaugcccgcaccgc

SEQ ID NO: 1165124 - RNA, 17 nt, Mycobacterium bovis subsp bovis AF2122/97
cgcgccuuugagcccgc

SEQ ID NO: 1165125 - RNA, 13 nt, Mycobacterium bovis subsp bovis AF2122/97
cgcgcgaccuggu

SEQ ID NO: 1165126 - RNA, 21 nt, Mycobacterium bovis subsp bovis AF2122/97
cgcgccuuggcacccuccgcc

SEQ ID NO: 1165127 - RNA, 19 nt, Mycobacterium bovis subsp bovis AF2122/97
cgcgccugccucaccgccg

SEQ ID NO: 1165128 - RNA, 14 nt, Mycobacterium bovis subsp bovis AF2122/97
cgcgccugcccggg

SEQ ID NO: 1165129 - RNA, 13 nt, Mycobacterium bovis subsp bovis AF2122/97
cgcgcgccgcagc

SEQ ID NO: 1165130 - RNA, 20 nt, Mycobacterium bovis subsp bovis AF2122/97
cgcgcgcgauggacaacaag

SEQ ID NO: 1165131 - RNA, 13 nt, Mycobacterium bovis subsp bovis AF2122/97
cgcgcgcacggcg

SEQ ID NO: 1165132 - RNA, 22 nt, Mycobacterium bovis subsp bovis AF2122/97
cgcgcgcacggcgucggccacc

SEQ ID NO: 1165133 - RNA, 15 nt, Mycobacterium bovis subsp bovis AF2122/97
cgcgcggguggcggc

SEQ ID NO: 1165134 - RNA, 19 nt, Mycobacterium bovis subsp bovis AF2122/97
cgcgcgggguggcggcgcu

SEQ ID NO: 1165135 - RNA, 16 nt, Mycobacterium bovis subsp bovis AF2122/97
cgcgcggggccucgcg

SEQ ID NO: 1165136 - RNA, 14 nt, Mycobacterium bovis subsp bovis AF2122/97
cgcgcggcgccgca

SEQ ID NO: 1165137 - RNA, 14 nt, Mycobacterium bovis subsp bovis AF2122/97
cgcgcgcugggccc

SEQ ID NO: 1165138 - RNA, 14 nt, Mycobacterium bovis subsp bovis AF2122/97
cgcgcgcugggcgc

SEQ ID NO: 1165139 - RNA, 18 nt, Mycobacterium bovis subsp bovis AF2122/97
cgcgcgcugggcgcgcuc

SEQ ID NO: 1165140 - RNA, 19 nt, Mycobacterium bovis subsp bovis AF2122/97
cgcgcgcugggcgcgcuca

SEQ ID NO: 1165141 - RNA, 14 nt, Mycobacterium bovis subsp bovis AF2122/97
cgcgcggaccagag

SEQ ID NO: 1165142 - RNA, 20 nt, Mycobacterium bovis subsp bovis AF2122/97
cgcgcggaucggcggccgcg

SEQ ID NO: 1165143 - RNA, 14 nt, Mycobacterium bovis subsp bovis AF2122/97
cgcgcggccgcgcu

SEQ ID NO: 1165144 - RNA, 17 nt, Mycobacterium bovis subsp bovis AF2122/97
cgcgcggccagcccacu

SEQ ID NO: 1165145 - RNA, 13 nt, Mycobacterium bovis subsp bovis AF2122/97
cgcgcucgcgcaa

SEQ ID NO: 1165146 - RNA, 16 nt, Mycobacterium bovis subsp bovis AF2122/97
cgcgcucgcucaccgg

SEQ ID NO: 1165147 - RNA, 17 nt, Mycobacterium bovis subsp bovis AF2122/97
cgcgcucgcucaccggc

SEQ ID NO: 1165148 - RNA, 17 nt, Mycobacterium bovis subsp bovis AF2122/97
cgcgcucggugccgccc

SEQ ID NO: 1165149 - RNA, 13 nt, Mycobacterium bovis subsp bovis AF2122/97
cgcgcugccggcc

SEQ ID NO: 1165150 - RNA, 14 nt, Mycobacterium bovis subsp bovis AF2122/97
cgcgcugcagcacg

SEQ ID NO: 1165151 - RNA, 15 nt, Mycobacterium bovis subsp bovis AF2122/97
cgcgcugaaucaccc

SEQ ID NO: 1165152 - RNA, 16 nt, Mycobacterium bovis subsp bovis AF2122/97
cgcgcugagcgacugc

SEQ ID NO: 1165153 - RNA, 14 nt, Mycobacterium bovis subsp bovis AF2122/97
cgcgcgucgcccag

SEQ ID NO: 1165154 - RNA, 22 nt, Mycobacterium bovis subsp bovis AF2122/97
cgcgcguccgggcagccgcgcc

SEQ ID NO: 1165155 - RNA, 17 nt, Mycobacterium bovis subsp bovis AF2122/97
cgcgcuaaccuuggcga

SEQ ID NO: 1165156 - RNA, 19 nt, Mycobacterium bovis subsp bovis AF2122/97
cgcgcguuuagucuccggc

SEQ ID NO: 1165157 - RNA, 19 nt, Mycobacterium bovis subsp bovis AF2122/97
cgcgcuaccagcucacggc

SEQ ID NO: 1165158 - RNA, 14 nt, Mycobacterium bovis subsp bovis AF2122/97
cgcgcuacgcggcc

SEQ ID NO: 1165159 - RNA, 23 nt, Mycobacterium bovis subsp bovis AF2122/97
cgcgcucgauggcggccaccagc

SEQ ID NO: 1165160 - RNA, 17 nt, Mycobacterium bovis subsp bovis AF2122/97
cgcgcucagcuccggcg

SEQ ID NO: 1165161 - RNA, 16 nt, Mycobacterium bovis subsp bovis AF2122/97
cgcgcucagcuccggc

SEQ ID NO: 1165162 - RNA, 15 nt, Mycobacterium bovis subsp bovis AF2122/97
cgcgcuagcucggcc

SEQ ID NO: 1165163 - RNA, 22 nt, Mycobacterium bovis subsp bovis AF2122/97
cgcggcuucaguccggcccccg

SEQ ID NO: 1165164 - RNA, 20 nt, Mycobacterium bovis subsp bovis AF2122/97
cgcggcuuggccuagccgcg

SEQ ID NO: 1165165 - RNA, 14 nt, Mycobacterium bovis subsp bovis AF2122/97
cgcggcuuccccgg

SEQ ID NO: 1165166 - RNA, 20 nt, Mycobacterium bovis subsp bovis AF2122/97
cgcgggcgccgggaagcccc

SEQ ID NO: 1165167 - RNA, 22 nt, Mycobacterium bovis subsp bovis AF2122/97
cgcgggagguacccccagcacc

SEQ ID NO: 1165168 - RNA, 14 nt, Mycobacterium bovis subsp bovis AF2122/97
cgcggcggcgugcu

SEQ ID NO: 1165169 - RNA, 15 nt, Mycobacterium bovis subsp bovis AF2122/97
cgcggcgggcccgau

SEQ ID NO: 1165170 - RNA, 22 nt, Mycobacterium bovis subsp bovis AF2122/97
cgcggcggggguucgcucuggu

SEQ ID NO: 1165171 - RNA, 20 nt, Mycobacterium bovis subsp bovis AF2122/97
cgcggcggguccucgcggag

SEQ ID NO: 1165172 - RNA, 15 nt, Mycobacterium bovis subsp bovis AF2122/97
cgcggcgugcgcggu

SEQ ID NO: 1165173 - RNA, 18 nt, Mycobacterium bovis subsp bovis AF2122/97
cgcggcuacaucggcggc

SEQ ID NO: 1165174 - RNA, 16 nt, Mycobacterium bovis subsp bovis AF2122/97
cgcggcuaggccaagc

SEQ ID NO: 1165175 - RNA, 20 nt, Mycobacterium bovis subsp bovis AF2122/97
cgcggcuaggccagcacggc

SEQ ID NO: 1165176 - RNA, 18 nt, Mycobacterium bovis subsp bovis AF2122/97
cgcggcuucaguccggcc

SEQ ID NO: 1165177 - RNA, 19 nt, Mycobacterium bovis subsp bovis AF2122/97
cgcggcuucaguccggccc

SEQ ID NO: 1165178 - RNA, 13 nt, Mycobacterium bovis subsp bovis AF2122/97
cgcggccagcggg

SEQ ID NO: 1165179 - RNA, 14 nt, Mycobacterium bovis subsp bovis AF2122/97
cgcggcccaccuca

SEQ ID NO: 1165180 - RNA, 13 nt, Mycobacterium bovis subsp bovis AF2122/97
cgcggccacccgc

SEQ ID NO: 1165181 - RNA, 16 nt, Mycobacterium bovis subsp bovis AF2122/97
cgcggccaccgccgcc

SEQ ID NO: 1165182 - RNA, 19 nt, Mycobacterium bovis subsp bovis AF2122/97
cgcggccacccgcgacgau

SEQ ID NO: 1165183 - RNA, 16 nt, Mycobacterium bovis subsp bovis AF2122/97
cgcggccagagccgcg

SEQ ID NO: 1165184 - RNA, 17 nt, Mycobacterium bovis subsp bovis AF2122/97
cgcggccagcccacucg

SEQ ID NO: 1165185 - RNA, 12 nt, Mycobacterium bovis subsp bovis AF2122/97
cgcggcggcgcu

SEQ ID NO: 1165186 - RNA, 17 nt, Mycobacterium bovis subsp bovis AF2122/97
cgcggcggccgcggcuu

SEQ ID NO: 1165187 - RNA, 14 nt, Mycobacterium bovis subsp bovis AF2122/97
cgcggcggcggcca

SEQ ID NO: 1165188 - RNA, 16 nt, Mycobacterium bovis subsp bovis AF2122/97
cgcggcggccuccacc

SEQ ID NO: 1165189 - RNA, 20 nt, Mycobacterium bovis subsp bovis AF2122/97
cgcggcggcgcuggcgggca

SEQ ID NO: 1165190 - RNA, 20 nt, Mycobacterium bovis subsp bovis AF2122/97
cgcggcgacaagccgagccc

SEQ ID NO: 1165191 - RNA, 20 nt, Mycobacterium bovis subsp bovis AF2122/97
cgcggcgaaccgucucgccc

SEQ ID NO: 1165192 - RNA, 18 nt, Mycobacterium bovis subsp bovis AF2122/97
cgcggcgaccuguccggu

SEQ ID NO: 1165193 - RNA, 23 nt, Mycobacterium bovis subsp bovis AF2122/97
cgcggcgaaccgucucgcccccu

SEQ ID NO: 1165194 - RNA, 21 nt, Mycobacterium bovis subsp bovis AF2122/97
cgcggcgagcaccaccccagc

SEQ ID NO: 1165195 - RNA, 19 nt, Mycobacterium bovis subsp bovis AF2122/97
cgcggcacggugugcggca

SEQ ID NO: 1165196 - RNA, 22 nt, Mycobacterium bovis subsp bovis AF2122/97
cgcggcacgcuccagcucggcc

SEQ ID NO: 1165197 - RNA, 21 nt, Mycobacterium bovis subsp bovis AF2122/97
cgcggcacuuuguagcccgcg

SEQ ID NO: 1165198 - RNA, 17 nt, Mycobacterium bovis subsp bovis AF2122/97
cgcggcagcauccucga

SEQ ID NO: 1165199 - RNA, 21 nt, Mycobacterium bovis subsp bovis AF2122/97
cgcggcacgcccacagcugac

SEQ ID NO: 1165200 - RNA, 14 nt, Mycobacterium bovis subsp bovis AF2122/97
cgcggcacccgguc

SEQ ID NO: 1165201 - RNA, 18 nt, Mycobacterium bovis subsp bovis AF2122/97
cgcggcaccgauggcgca

SEQ ID NO: 1165202 - RNA, 15 nt, Mycobacterium bovis subsp bovis AF2122/97
cgcggaucaccaucg

SEQ ID NO: 1165203 - RNA, 16 nt, Mycobacterium bovis subsp bovis AF2122/97
cgcggaucagcccgcg

SEQ ID NO: 1165204 - RNA, 21 nt, Mycobacterium bovis subsp bovis AF2122/97
cgcggaucagcccgcgcagca

SEQ ID NO: 1165205 - RNA, 21 nt, Mycobacterium bovis subsp bovis AF2122/97
cgcggcaacgcggucugcucc

SEQ ID NO: 1165206 - RNA, 15 nt, Mycobacterium bovis subsp bovis AF2122/97
cgcggacuuggcggu

SEQ ID NO: 1165207 - RNA, 21 nt, Mycobacterium bovis subsp bovis AF2122/97
cgcggacuucguuccgugccg

SEQ ID NO: 1165208 - RNA, 20 nt, Mycobacterium bovis subsp bovis AF2122/97
cgcggacucguagcaccggu

SEQ ID NO: 1165209 - RNA, 22 nt, Mycobacterium bovis subsp bovis AF2122/97
cgcggaguucgcugacggccau

SEQ ID NO: 1165210 - RNA, 16 nt, Mycobacterium bovis subsp bovis AF2122/97
cgcggagagccugcuc

SEQ ID NO: 1165211 - RNA, 20 nt, Mycobacterium bovis subsp bovis AF2122/97
cgcggacccgcgcgucgccc

SEQ ID NO: 1165212 - RNA, 12 nt, Mycobacterium bovis subsp bovis AF2122/97
cgcggacccgcg

SEQ ID NO: 1165213 - RNA, 13 nt, Mycobacterium bovis subsp bovis AF2122/97
cgcggacccgcgc

SEQ ID NO: 1165214 - RNA, 22 nt, Mycobacterium bovis subsp bovis AF2122/97
cgcggacccgccgugaguaggu

SEQ ID NO: 1165215 - RNA, 17 nt, Mycobacterium bovis subsp bovis AF2122/97
cgcggaccucgaagccc

SEQ ID NO: 1165216 - RNA, 15 nt, Mycobacterium bovis subsp bovis AF2122/97
cgcgcugggcgcgcu

SEQ ID NO: 1165217 - RNA, 12 nt, Mycobacterium bovis subsp bovis AF2122/97
cgcgcugcgcag

SEQ ID NO: 1165218 - RNA, 20 nt, Mycobacterium bovis subsp bovis AF2122/97
cgcgcuggaccugaugagcu

SEQ ID NO: 1165219 - RNA, 20 nt, Mycobacterium bovis subsp bovis AF2122/97
cgcgcuucacagccaccagc

SEQ ID NO: 1165220 - RNA, 23 nt, Mycobacterium bovis subsp bovis AF2122/97
cgcgcuucacagccaccagccgg

SEQ ID NO: 1165221 - RNA, 17 nt, Mycobacterium bovis subsp bovis AF2122/97
cgcgcuguagggcacug

SEQ ID NO: 1165222 - RNA, 20 nt, Mycobacterium bovis subsp bovis AF2122/97
cgcgcuguccacgaugacgu

SEQ ID NO: 1165223 - RNA, 16 nt, Mycobacterium bovis subsp bovis AF2122/97
cgcgcuggcgccggcc

SEQ ID NO: 1165224 - RNA, 18 nt, Mycobacterium bovis subsp bovis AF2122/97
cgcgcuggcgccggccag

SEQ ID NO: 1165225 - RNA, 19 nt, Mycobacterium bovis subsp bovis AF2122/97
cgcggacaugacagccccg

SEQ ID NO: 1165226 - RNA, 14 nt, Mycobacterium bovis subsp bovis AF2122/97
cgcggacaccagga

SEQ ID NO: 1165227 - RNA, 23 nt, Mycobacterium bovis subsp bovis AF2122/97
cgcggacaccaggaugccuaccg

SEQ ID NO: 1165228 - RNA, 20 nt, Mycobacterium bovis subsp bovis AF2122/97
cgcggaacucgucgcugccc

SEQ ID NO: 1165229 - RNA, 13 nt, Mycobacterium bovis subsp bovis AF2122/97
cgcggaacccagc

SEQ ID NO: 1165230 - RNA, 21 nt, Mycobacterium bovis subsp bovis AF2122/97
cgcgcuuuucuccgccgagca

SEQ ID NO: 1165231 - RNA, 14 nt, Mycobacterium bovis subsp bovis AF2122/97
cgcgucggucaccg

SEQ ID NO: 1165232 - RNA, 17 nt, Mycobacterium bovis subsp bovis AF2122/97
cgcgucgugccacuucc

SEQ ID NO: 1165233 - RNA, 20 nt, Mycobacterium bovis subsp bovis AF2122/97
cgcguggcauccagcagcgc

SEQ ID NO: 1165234 - RNA, 14 nt, Mycobacterium bovis subsp bovis AF2122/97
cgcgugcugcggac

SEQ ID NO: 1165235 - RNA, 14 nt, Mycobacterium bovis subsp bovis AF2122/97
cgcguggugcugac

SEQ ID NO: 1165236 - RNA, 20 nt, Mycobacterium bovis subsp bovis AF2122/97
cgcgugguucggucgggggc

SEQ ID NO: 1165237 - RNA, 19 nt, Mycobacterium bovis subsp bovis AF2122/97
cgcguagugccacgaggac

SEQ ID NO: 1165238 - RNA, 19 nt, Mycobacterium bovis subsp bovis AF2122/97
cgcguagugcuccguccga

SEQ ID NO: 1165239 - RNA, 18 nt, Mycobacterium bovis subsp bovis AF2122/97
cgcguagguggccagcgc

SEQ ID NO: 1165240 - RNA, 13 nt, Mycobacterium bovis subsp bovis AF2122/97
cgcguaguggugg

SEQ ID NO: 1165241 - RNA, 16 nt, Mycobacterium bovis subsp bovis AF2122/97
cgcgucagcggcgagc

SEQ ID NO: 1165242 - RNA, 17 nt, Mycobacterium bovis subsp bovis AF2122/97
cgcgucagcggcgagca

SEQ ID NO: 1165243 - RNA, 13 nt, Mycobacterium bovis subsp bovis AF2122/97
cgcgucggcggcc

SEQ ID NO: 1165244 - RNA, 22 nt, Mycobacterium bovis subsp bovis AF2122/97
cgcgucggcggcgaccgccagc

SEQ ID NO: 1165245 - RNA, 15 nt, Mycobacterium bovis subsp bovis AF2122/97
cgcgucacccggggc

SEQ ID NO: 1165246 - RNA, 14 nt, Mycobacterium bovis subsp bovis AF2122/97
cgcgucagccgcac

SEQ ID NO: 1165247 - RNA, 23 nt, Mycobacterium bovis subsp bovis AF2122/97
cgcgucagccgcaccccgcccga

SEQ ID NO: 1165248 - RNA, 22 nt, Mycobacterium bovis subsp bovis AF2122/97
cgcggugcgcgugacgaccagc

SEQ ID NO: 1165249 - RNA, 20 nt, Mycobacterium bovis subsp bovis AF2122/97
cgcggugcggccacucgccc

SEQ ID NO: 1165250 - RNA, 13 nt, Mycobacterium bovis subsp bovis AF2122/97
cgcggggccgccg

SEQ ID NO: 1165251 - RNA, 15 nt, Mycobacterium bovis subsp bovis AF2122/97
cgcggugccggccgu

SEQ ID NO: 1165252 - RNA, 17 nt, Mycobacterium bovis subsp bovis AF2122/97
cgcgguggcggcgagca

SEQ ID NO: 1165253 - RNA, 13 nt, Mycobacterium bovis subsp bovis AF2122/97
cgcgguggcgguc

SEQ ID NO: 1165254 - RNA, 23 nt, Mycobacterium bovis subsp bovis AF2122/97
cgcgguggaugcgaugcgcgccg

SEQ ID NO: 1165255 - RNA, 16 nt, Mycobacterium bovis subsp bovis AF2122/97
cgcgggcgugccgacc

SEQ ID NO: 1165256 - RNA, 13 nt, Mycobacterium bovis subsp bovis AF2122/97
cgcgggcggcgcu

SEQ ID NO: 1165257 - RNA, 16 nt, Mycobacterium bovis subsp bovis AF2122/97
cgcguagagcagcagc

SEQ ID NO: 1165258 - RNA, 20 nt, Mycobacterium bovis subsp bovis AF2122/97
cgcguacaggccggccacca

SEQ ID NO: 1165259 - RNA, 18 nt, Mycobacterium bovis subsp bovis AF2122/97
cgcggugggcacagccag

SEQ ID NO: 1165260 - RNA, 16 nt, Mycobacterium bovis subsp bovis AF2122/97
cgcggugggccccgau

SEQ ID NO: 1165261 - RNA, 17 nt, Mycobacterium bovis subsp bovis AF2122/97
cgcggugggcacagcca

SEQ ID NO: 1165262 - RNA, 17 nt, Mycobacterium bovis subsp bovis AF2122/97
cgcgguggggcgcgccg

SEQ ID NO: 1165263 - RNA, 13 nt, Mycobacterium bovis subsp bovis AF2122/97
cgcguaauacuug

SEQ ID NO: 1165264 - RNA, 21 nt, Mycobacterium bovis subsp bovis AF2122/97
cgcggugugcggcagcccgcu

SEQ ID NO: 1165265 - RNA, 18 nt, Mycobacterium bovis subsp bovis AF2122/97
cgcggugugcggcagccc

SEQ ID NO: 1165266 - RNA, 24 nt, Mycobacterium bovis subsp bovis AF2122/97
cgcuaggacggcugccgucagccg

SEQ ID NO: 1165267 - RNA, 14 nt, Mycobacterium bovis subsp bovis AF2122/97
cgcuagcccaccac

SEQ ID NO: 1165268 - RNA, 15 nt, Mycobacterium bovis subsp bovis AF2122/97
cgcuagcgccgcgcu

SEQ ID NO: 1165269 - RNA, 20 nt, Mycobacterium bovis subsp bovis AF2122/97
cgcuaggacggcgcgagccg

SEQ ID NO: 1165270 - RNA, 21 nt, Mycobacterium bovis subsp bovis AF2122/97
cgcuaggacggcgcgagccgc

SEQ ID NO: 1165271 - RNA, 12 nt, Mycobacterium bovis subsp bovis AF2122/97
cgcucacccggu

SEQ ID NO: 1165272 - RNA, 23 nt, Mycobacterium bovis subsp bovis AF2122/97
cgcucacccggucgcacuuggcc

SEQ ID NO: 1165273 - RNA, 14 nt, Mycobacterium bovis subsp bovis AF2122/97
cgcucaccggcguc

SEQ ID NO: 1165274 - RNA, 15 nt, Mycobacterium bovis subsp bovis AF2122/97
cgcucaccccgcgcu

SEQ ID NO: 1165275 - RNA, 14 nt, Mycobacterium bovis subsp bovis AF2122/97
cgcucacccgccgc

SEQ ID NO: 1165276 - RNA, 16 nt, Mycobacterium bovis subsp bovis AF2122/97
cgcucaggucaucggc

SEQ ID NO: 1165277 - RNA, 22 nt, Mycobacterium bovis subsp bovis AF2122/97
cgcucacgaagaccgcgucggc

SEQ ID NO: 1165278 - RNA, 17 nt, Mycobacterium bovis subsp bovis AF2122/97
cgcucaucacccagcgc

SEQ ID NO: 1165279 - RNA, 20 nt, Mycobacterium bovis subsp bovis AF2122/97
cgcguuguccgcggccaacg

SEQ ID NO: 1165280 - RNA, 17 nt, Mycobacterium bovis subsp bovis AF2122/97
cgcguuguccgcggcca

SEQ ID NO: 1165281 - RNA, 16 nt, Mycobacterium bovis subsp bovis AF2122/97
cgcguuggcccgccug

SEQ ID NO: 1165282 - RNA, 15 nt, Mycobacterium bovis subsp bovis AF2122/97
cgcguugccaaagcc

SEQ ID NO: 1165283 - RNA, 14 nt, Mycobacterium bovis subsp bovis AF2122/97
cgcucugcgcggcu

SEQ ID NO: 1165284 - RNA, 14 nt, Mycobacterium bovis subsp bovis AF2122/97
cgcucggccgcagc

SEQ ID NO: 1165285 - RNA, 12 nt, Mycobacterium bovis subsp bovis AF2122/97
cgcucggcagcc

SEQ ID NO: 1165286 - RNA, 14 nt, Mycobacterium bovis subsp bovis AF2122/97
cgcucgcugcagca

SEQ ID NO: 1165287 - RNA, 12 nt, Mycobacterium bovis subsp bovis AF2122/97
cgcucgcgcgcu

SEQ ID NO: 1165288 - RNA, 21 nt, Mycobacterium bovis subsp bovis AF2122/97
cgcucgcgcgcugggcgcgcu

SEQ ID NO: 1165289 - RNA, 21 nt, Mycobacterium bovis subsp bovis AF2122/97
cgcugaccuuuucccgcaggc

SEQ ID NO: 1165290 - RNA, 14 nt, Mycobacterium bovis subsp bovis AF2122/97
cgcugacgcccucc

SEQ ID NO: 1165291 - RNA, 22 nt, Mycobacterium bovis subsp bovis AF2122/97
cgcugaaaucgguggccaccac

SEQ ID NO: 1165292 - RNA, 20 nt, Mycobacterium bovis subsp bovis AF2122/97
cgcucggcgaucugcguuug

SEQ ID NO: 1165293 - RNA, 15 nt, Mycobacterium bovis subsp bovis AF2122/97
cgcucuugaauagga

SEQ ID NO: 1165294 - RNA, 13 nt, Mycobacterium bovis subsp bovis AF2122/97
cgcugagcacggc

SEQ ID NO: 1165295 - RNA, 14 nt, Mycobacterium bovis subsp bovis AF2122/97
cgcugagcagcgcc

SEQ ID NO: 1165296 - RNA, 16 nt, Mycobacterium bovis subsp bovis AF2122/97
cgcugagcagcgccgc

SEQ ID NO: 1165297 - RNA, 18 nt, Mycobacterium bovis subsp bovis AF2122/97
cgcugagcagcgccgcgu

SEQ ID NO: 1165298 - RNA, 14 nt, Mycobacterium bovis subsp bovis AF2122/97
cgcugacuccugcg

SEQ ID NO: 1165299 - RNA, 22 nt, Mycobacterium bovis subsp bovis AF2122/97
cgcugacgcccuccuggcgggu

SEQ ID NO: 1165300 - RNA, 15 nt, Mycobacterium bovis subsp bovis AF2122/97
cgcugagccgcucau

SEQ ID NO: 1165301 - RNA, 20 nt, Mycobacterium bovis subsp bovis AF2122/97
cgcugcagacgccccuuccc

SEQ ID NO: 1165302 - RNA, 21 nt, Mycobacterium bovis subsp bovis AF2122/97
cgcugcauccgcagcaccaag

SEQ ID NO: 1165303 - RNA, 14 nt, Mycobacterium bovis subsp bovis AF2122/97
cgcugcauccgcag

SEQ ID NO: 1165304 - RNA, 21 nt, Mycobacterium bovis subsp bovis AF2122/97
cgcugcaggcggccgagcugg

SEQ ID NO: 1165305 - RNA, 15 nt, Mycobacterium bovis subsp bovis AF2122/97
cgcuccagccgcgcg

SEQ ID NO: 1165306 - RNA, 23 nt, Mycobacterium bovis subsp bovis AF2122/97
cgcuccaguggcgccagggccuu

SEQ ID NO: 1165307 - RNA, 20 nt, Mycobacterium bovis subsp bovis AF2122/97
cgcuccauaucgucgggcgu

SEQ ID NO: 1165308 - RNA, 20 nt, Mycobacterium bovis subsp bovis AF2122/97
cgcucccccgcuacgcgcgc

SEQ ID NO: 1165309 - RNA, 21 nt, Mycobacterium bovis subsp bovis AF2122/97
cgcucccccgcuacgcgcgcu

SEQ ID NO: 1165310 - RNA, 17 nt, Mycobacterium bovis subsp bovis AF2122/97
cgcucccucuacacccg

SEQ ID NO: 1165311 - RNA, 23 nt, Mycobacterium bovis subsp bovis AF2122/97
cgcuccaaaagccucagccgcuc

SEQ ID NO: 1165312 - RNA, 17 nt, Mycobacterium bovis subsp bovis AF2122/97
cgcuccaacaacuccag

SEQ ID NO: 1165313 - RNA, 14 nt, Mycobacterium bovis subsp bovis AF2122/97
cgcuccaagcgcgg

SEQ ID NO: 1165314 - RNA, 18 nt, Mycobacterium bovis subsp bovis AF2122/97
cgcucauugcaucugcca

SEQ ID NO: 1165315 - RNA, 18 nt, Mycobacterium bovis subsp bovis AF2122/97
cgcuccacguacgcggcu

SEQ ID NO: 1165316 - RNA, 14 nt, Mycobacterium bovis subsp bovis AF2122/97
cgcuccagaugggg

SEQ ID NO: 1165317 - RNA, 21 nt, Mycobacterium bovis subsp bovis AF2122/97
cgcucaugggcgccaucccgc

SEQ ID NO: 1165318 - RNA, 15 nt, Mycobacterium bovis subsp bovis AF2122/97
cgcuccaaaagccuc

SEQ ID NO: 1165319 - RNA, 22 nt, Mycobacterium bovis subsp bovis AF2122/97
cgcucaucuguaaccuccucga

SEQ ID NO: 1165320 - RNA, 22 nt, Mycobacterium bovis subsp bovis AF2122/97
cgcucauucgugcccgggcggu

SEQ ID NO: 1165321 - RNA, 13 nt, Mycobacterium bovis subsp bovis AF2122/97
cgcucaucgaccg

SEQ ID NO: 1165322 - RNA, 21 nt, Mycobacterium bovis subsp bovis AF2122/97
cgcucaucuguaaccuccucg

SEQ ID NO: 1165323 - RNA, 22 nt, Mycobacterium bovis subsp bovis AF2122/97
cgcucgccgguaggcggccagc

SEQ ID NO: 1165324 - RNA, 20 nt, Mycobacterium bovis subsp bovis AF2122/97
cgcucgccgguguccuuggc

SEQ ID NO: 1165325 - RNA, 16 nt, Mycobacterium bovis subsp bovis AF2122/97
cgcucgcaccgcccgc

SEQ ID NO: 1165326 - RNA, 14 nt, Mycobacterium bovis subsp bovis AF2122/97
cgcucgcaccgccc

SEQ ID NO: 1165327 - RNA, 18 nt, Mycobacterium bovis subsp bovis AF2122/97
cgcucgaugucccgagcc

SEQ ID NO: 1165328 - RNA, 22 nt, Mycobacterium bovis subsp bovis AF2122/97
cgcucgaugucccgagcccgcu

SEQ ID NO: 1165329 - RNA, 22 nt, Mycobacterium bovis subsp bovis AF2122/97
cgcucgacguacagcgcggcgu

SEQ ID NO: 1165330 - RNA, 12 nt, Mycobacterium bovis subsp bovis AF2122/97
cgcuccuccggc

SEQ ID NO: 1165331 - RNA, 17 nt, Mycobacterium bovis subsp bovis AF2122/97
cgcucgacgacgggcgc

SEQ ID NO: 1165332 - RNA, 15 nt, Mycobacterium bovis subsp bovis AF2122/97
cgcucgaacuccccg

SEQ ID NO: 1165333 - RNA, 19 nt, Mycobacterium bovis subsp bovis AF2122/97
cgcucgagcagcgcgccgu

SEQ ID NO: 1165334 - RNA, 19 nt, Mycobacterium bovis subsp bovis AF2122/97
cgcucgaucacuagcgccc

SEQ ID NO: 1165335 - RNA, 23 nt, Mycobacterium bovis subsp bovis AF2122/97
cgcuccggcccugccgccggccc

SEQ ID NO: 1165336 - RNA, 12 nt, Mycobacterium bovis subsp bovis AF2122/97
cgcuccgcggcu

SEQ ID NO: 1165337 - RNA, 23 nt, Mycobacterium bovis subsp bovis AF2122/97
cgcuccgggaauggcgaccaccc

SEQ ID NO: 1165338 - RNA, 16 nt, Mycobacterium bovis subsp bovis AF2122/97
cggaccgcugccugcc

SEQ ID NO: 1165339 - RNA, 20 nt, Mycobacterium bovis subsp bovis AF2122/97
cggaccgcgacggcgccggc

SEQ ID NO: 1165340 - RNA, 22 nt, Mycobacterium bovis subsp bovis AF2122/97
cggaccgcagcgugaucuggcc

SEQ ID NO: 1165341 - RNA, 14 nt, Mycobacterium bovis subsp bovis AF2122/97
cggaccgaccaccg

SEQ ID NO: 1165342 - RNA, 16 nt, Mycobacterium bovis subsp bovis AF2122/97
cggaccgaugguugag

SEQ ID NO: 1165343 - RNA, 20 nt, Mycobacterium bovis subsp bovis AF2122/97
cggaccgauugucggcaacg

SEQ ID NO: 1165344 - RNA, 22 nt, Mycobacterium bovis subsp bovis AF2122/97
cggaccgauugucggcaacgac

SEQ ID NO: 1165345 - RNA, 12 nt, Mycobacterium bovis subsp bovis AF2122/97
cggaccgcuucg

SEQ ID NO: 1165346 - RNA, 23 nt, Mycobacterium bovis subsp bovis AF2122/97
cggaccgucuuuggugccgagca

SEQ ID NO: 1165347 - RNA, 23 nt, Mycobacterium bovis subsp bovis AF2122/97
cggaccguggcagcugcucuccg

SEQ ID NO: 1165348 - RNA, 18 nt, Mycobacterium bovis subsp bovis AF2122/97
cggacccgcagcugcgga

SEQ ID NO: 1165349 - RNA, 14 nt, Mycobacterium bovis subsp bovis AF2122/97
cggacccgcagcug

SEQ ID NO: 1165350 - RNA, 16 nt, Mycobacterium bovis subsp bovis AF2122/97
cggacccgcagcugcg

SEQ ID NO: 1165351 - RNA, 16 nt, Mycobacterium bovis subsp bovis AF2122/97
cggacaugcgggcagc

SEQ ID NO: 1165352 - RNA, 16 nt, Mycobacterium bovis subsp bovis AF2122/97
cggaccaccgccgaag

SEQ ID NO: 1165353 - RNA, 13 nt, Mycobacterium bovis subsp bovis AF2122/97
cggaccaccgcuc

SEQ ID NO: 1165354 - RNA, 23 nt, Mycobacterium bovis subsp bovis AF2122/97
cggaccacuguuggugccgccac

SEQ ID NO: 1165355 - RNA, 15 nt, Mycobacterium bovis subsp bovis AF2122/97
cggaccugcgccggu

SEQ ID NO: 1165356 - RNA, 14 nt, Mycobacterium bovis subsp bovis AF2122/97
cggaccuccucgcc

SEQ ID NO: 1165357 - RNA, 20 nt, Mycobacterium bovis subsp bovis AF2122/97
cggaccucggcgaccugcuc

SEQ ID NO: 1165358 - RNA, 22 nt, Mycobacterium bovis subsp bovis AF2122/97
cggaccguguuguuagccccgc

SEQ ID NO: 1165359 - RNA, 16 nt, Mycobacterium bovis subsp bovis AF2122/97
cggacaguuccccggg

SEQ ID NO: 1165360 - RNA, 15 nt, Mycobacterium bovis subsp bovis AF2122/97
cggacaggcccggug

SEQ ID NO: 1165361 - RNA, 14 nt, Mycobacterium bovis subsp bovis AF2122/97
cggacagggcggcg

SEQ ID NO: 1165362 - RNA, 17 nt, Mycobacterium bovis subsp bovis AF2122/97
cggaaucgucgcggccg

SEQ ID NO: 1165363 - RNA, 14 nt, Mycobacterium bovis subsp bovis AF2122/97
cggaaugcuggggc

SEQ ID NO: 1165364 - RNA, 23 nt, Mycobacterium bovis subsp bovis AF2122/97
cggaauggucccggguccaagaa

SEQ ID NO: 1165365 - RNA, 20 nt, Mycobacterium bovis subsp bovis AF2122/97
cggaauucgguuggcucggg

SEQ ID NO: 1165366 - RNA, 16 nt, Mycobacterium bovis subsp bovis AF2122/97
cggacaaagccgucgc

SEQ ID NO: 1165367 - RNA, 16 nt, Mycobacterium bovis subsp bovis AF2122/97
cggagugguauccagg

SEQ ID NO: 1165368 - RNA, 13 nt, Mycobacterium bovis subsp bovis AF2122/97
cggaguggccagu

SEQ ID NO: 1165369 - RNA, 19 nt, Mycobacterium bovis subsp bovis AF2122/97
cggaguucgcugacggcca

SEQ ID NO: 1165370 - RNA, 22 nt, Mycobacterium bovis subsp bovis AF2122/97
cggaguucuucgaaggcguggg

SEQ ID NO: 1165371 - RNA, 21 nt, Mycobacterium bovis subsp bovis AF2122/97
cggaguugaagaagcccgacg

SEQ ID NO: 1165372 - RNA, 19 nt, Mycobacterium bovis subsp bovis AF2122/97
cggagugguauccaggccc

SEQ ID NO: 1165373 - RNA, 22 nt, Mycobacterium bovis subsp bovis AF2122/97
cggagugucgaugcgcgccggc

SEQ ID NO: 1165374 - RNA, 18 nt, Mycobacterium bovis subsp bovis AF2122/97
cggauaauucaacagcac

SEQ ID NO: 1165375 - RNA, 20 nt, Mycobacterium bovis subsp bovis AF2122/97
cggauaauucaacagcaccg

SEQ ID NO: 1165376 - RNA, 21 nt, Mycobacterium bovis subsp bovis AF2122/97
cggagucgaacaucaccggag

SEQ ID NO: 1165377 - RNA, 20 nt, Mycobacterium bovis subsp bovis AF2122/97
cggagucgacccugcccagc

SEQ ID NO: 1165378 - RNA, 23 nt, Mycobacterium bovis subsp bovis AF2122/97
cggagucgcccgguccgccgcag

SEQ ID NO: 1165379 - RNA, 15 nt, Mycobacterium bovis subsp bovis AF2122/97
cggaguccgucgggg

SEQ ID NO: 1165380 - RNA, 15 nt, Mycobacterium bovis subsp bovis AF2122/97
cggagucaccagcaa

SEQ ID NO: 1165381 - RNA, 13 nt, Mycobacterium bovis subsp bovis AF2122/97
cggaggcggacca

SEQ ID NO: 1165382 - RNA, 20 nt, Mycobacterium bovis subsp bovis AF2122/97
cggaggcggaccaggccgcg

SEQ ID NO: 1165383 - RNA, 18 nt, Mycobacterium bovis subsp bovis AF2122/97
cggaggcuugcaacaccc

SEQ ID NO: 1165384 - RNA, 15 nt, Mycobacterium bovis subsp bovis AF2122/97
cggaggugccggcgc

SEQ ID NO: 1165385 - RNA, 19 nt, Mycobacterium bovis subsp bovis AF2122/97
cggaggugggguggggagc

SEQ ID NO: 1165386 - RNA, 13 nt, Mycobacterium bovis subsp bovis AF2122/97
cggaggguucgga

SEQ ID NO: 1165387 - RNA, 13 nt, Mycobacterium bovis subsp bovis AF2122/97
cggaggucggagc

SEQ ID NO: 1165388 - RNA, 20 nt, Mycobacterium bovis subsp bovis AF2122/97
cggaggugggguggggagcu

SEQ ID NO: 1165389 - RNA, 21 nt, Mycobacterium bovis subsp bovis AF2122/97
cggaggcgaccacgucggcga

SEQ ID NO: 1165390 - RNA, 18 nt, Mycobacterium bovis subsp bovis AF2122/97
cggaggaucgcugguuug

SEQ ID NO: 1165391 - RNA, 13 nt, Mycobacterium bovis subsp bovis AF2122/97
cggaggcaagcaa

SEQ ID NO: 1165392 - RNA, 20 nt, Mycobacterium bovis subsp bovis AF2122/97
cggagagccugcucgcagcg

SEQ ID NO: 1165393 - RNA, 18 nt, Mycobacterium bovis subsp bovis AF2122/97
cggagaucauggcgagcg

SEQ ID NO: 1165394 - RNA, 19 nt, Mycobacterium bovis subsp bovis AF2122/97
cggagauacgggccaccgu

SEQ ID NO: 1165395 - RNA, 18 nt, Mycobacterium bovis subsp bovis AF2122/97
cggacuggccucggggau

SEQ ID NO: 1165396 - RNA, 18 nt, Mycobacterium bovis subsp bovis AF2122/97
cggacugcggcccgaccc

SEQ ID NO: 1165397 - RNA, 14 nt, Mycobacterium bovis subsp bovis AF2122/97
cggacugcggaaca

SEQ ID NO: 1165398 - RNA, 19 nt, Mycobacterium bovis subsp bovis AF2122/97
cggacgucgugaccggcgg

SEQ ID NO: 1165399 - RNA, 14 nt, Mycobacterium bovis subsp bovis AF2122/97
cggacucccucgau

SEQ ID NO: 1165400 - RNA, 17 nt, Mycobacterium bovis subsp bovis AF2122/97
cggagaaaagcgcgcua

SEQ ID NO: 1165401 - RNA, 21 nt, Mycobacterium bovis subsp bovis AF2122/97
cggacuugguuucgaugaaga

SEQ ID NO: 1165402 - RNA, 17 nt, Mycobacterium bovis subsp bovis AF2122/97
cggacuucgccgcccgc

SEQ ID NO: 1165403 - RNA, 22 nt, Mycobacterium bovis subsp bovis AF2122/97
cggagaccggccgggugaacca

SEQ ID NO: 1165404 - RNA, 14 nt, Mycobacterium bovis subsp bovis AF2122/97
cggagacugguugc

SEQ ID NO: 1165405 - RNA, 20 nt, Mycobacterium bovis subsp bovis AF2122/97
cggagacaccgcaacgcgug

SEQ ID NO: 1165406 - RNA, 17 nt, Mycobacterium bovis subsp bovis AF2122/97
cggagaaguucgugagc

SEQ ID NO: 1165407 - RNA, 20 nt, Mycobacterium bovis subsp bovis AF2122/97
cggagaaggcgcgggcgacg

SEQ ID NO: 1165408 - RNA, 20 nt, Mycobacterium bovis subsp bovis AF2122/97
cggaaggacggcagccacca

SEQ ID NO: 1165409 - RNA, 14 nt, Mycobacterium bovis subsp bovis AF2122/97
cggaagggcccggu

SEQ ID NO: 1165410 - RNA, 22 nt, Mycobacterium bovis subsp bovis AF2122/97
cggaaguagcgcaaugcggccc

SEQ ID NO: 1165411 - RNA, 14 nt, Mycobacterium bovis subsp bovis AF2122/97
cggaagcgggcgau

SEQ ID NO: 1165412 - RNA, 17 nt, Mycobacterium bovis subsp bovis AF2122/97
cggaagccgccuaggac

SEQ ID NO: 1165413 - RNA, 23 nt, Mycobacterium bovis subsp bovis AF2122/97
cggaaggacggcagccaccagcg

SEQ ID NO: 1165414 - RNA, 22 nt, Mycobacterium bovis subsp bovis AF2122/97
cggaaguucuccucgugcagca

SEQ ID NO: 1165415 - RNA, 23 nt, Mycobacterium bovis subsp bovis AF2122/97
cggaaucgcaucuagguucaguu

SEQ ID NO: 1165416 - RNA, 15 nt, Mycobacterium bovis subsp bovis AF2122/97
cggaaucggagucuu

SEQ ID NO: 1165417 - RNA, 14 nt, Mycobacterium bovis subsp bovis AF2122/97
cggaaucagcaccc

SEQ ID NO: 1165418 - RNA, 18 nt, Mycobacterium bovis subsp bovis AF2122/97
cggaauauggcggccggg

SEQ ID NO: 1165419 - RNA, 19 nt, Mycobacterium bovis subsp bovis AF2122/97
cggaauacaccagcgacgc

SEQ ID NO: 1165420 - RNA, 16 nt, Mycobacterium bovis subsp bovis AF2122/97
cggaauagcaacgcug

SEQ ID NO: 1165421 - RNA, 18 nt, Mycobacterium bovis subsp bovis AF2122/97
cggaaccgauaccucgcc

SEQ ID NO: 1165422 - RNA, 19 nt, Mycobacterium bovis subsp bovis AF2122/97
cggaaccgauaccucgcca

SEQ ID NO: 1165423 - RNA, 21 nt, Mycobacterium bovis subsp bovis AF2122/97
cggaacaccgacgucaggcuc

SEQ ID NO: 1165424 - RNA, 22 nt, Mycobacterium bovis subsp bovis AF2122/97
cgcuuuggaggugcaguacgcg

SEQ ID NO: 1165425 - RNA, 13 nt, Mycobacterium bovis subsp bovis AF2122/97
cgcuuugaugccg

SEQ ID NO: 1165426 - RNA, 14 nt, Mycobacterium bovis subsp bovis AF2122/97
cggaaauuccaagc

SEQ ID NO: 1165427 - RNA, 16 nt, Mycobacterium bovis subsp bovis AF2122/97
cgcuucuuccgcgcgc

SEQ ID NO: 1165428 - RNA, 22 nt, Mycobacterium bovis subsp bovis AF2122/97
cgcuucggcaccgacugcuguc

SEQ ID NO: 1165429 - RNA, 20 nt, Mycobacterium bovis subsp bovis AF2122/97
cgcuucggcagcucccgcca

SEQ ID NO: 1165430 - RNA, 18 nt, Mycobacterium bovis subsp bovis AF2122/97
cgcuugcucucgcagcau

SEQ ID NO: 1165431 - RNA, 13 nt, Mycobacterium bovis subsp bovis AF2122/97
cgcuugcggccgc

SEQ ID NO: 1165432 - RNA, 17 nt, Mycobacterium bovis subsp bovis AF2122/97
cgcuugaccccuggccg

SEQ ID NO: 1165433 - RNA, 18 nt, Mycobacterium bovis subsp bovis AF2122/97
cgcuugcuggguaguuca

SEQ ID NO: 1165434 - RNA, 13 nt, Mycobacterium bovis subsp bovis AF2122/97
cgcuugcgcggcu

SEQ ID NO: 1165435 - RNA, 16 nt, Mycobacterium bovis subsp bovis AF2122/97
cgcuuggccaggucau

SEQ ID NO: 1165436 - RNA, 18 nt, Mycobacterium bovis subsp bovis AF2122/97
cgcuuggccgcugccuuc

SEQ ID NO: 1165437 - RNA, 18 nt, Mycobacterium bovis subsp bovis AF2122/97
cgcuuggcgagccacggc

SEQ ID NO: 1165438 - RNA, 16 nt, Mycobacterium bovis subsp bovis AF2122/97
cgcuucgccacaccau

SEQ ID NO: 1165439 - RNA, 19 nt, Mycobacterium bovis subsp bovis AF2122/97
cgcuucaugagccgcugcg

SEQ ID NO: 1165440 - RNA, 24 nt, Mycobacterium bovis subsp bovis AF2122/97
cgcuucacgggccguccaggacgg

SEQ ID NO: 1165441 - RNA, 16 nt, Mycobacterium bovis subsp bovis AF2122/97
cgcugccgccgccggc

SEQ ID NO: 1165442 - RNA, 18 nt, Mycobacterium bovis subsp bovis AF2122/97
cgcugccgccgccggcgg

SEQ ID NO: 1165443 - RNA, 21 nt, Mycobacterium bovis subsp bovis AF2122/97
cgcugccaaacuaacggcagc

SEQ ID NO: 1165444 - RNA, 15 nt, Mycobacterium bovis subsp bovis AF2122/97
cgcugccgccgagcu

SEQ ID NO: 1165445 - RNA, 22 nt, Mycobacterium bovis subsp bovis AF2122/97
cgcugccgccgaucgacacccg

SEQ ID NO: 1165446 - RNA, 17 nt, Mycobacterium bovis subsp bovis AF2122/97
cgcugcagcaccgcagc

SEQ ID NO: 1165447 - RNA, 15 nt, Mycobacterium bovis subsp bovis AF2122/97
cgcugccgccgucgc

SEQ ID NO: 1165448 - RNA, 23 nt, Mycobacterium bovis subsp bovis AF2122/97
cgcugccucuugcucggcgugcu

SEQ ID NO: 1165449 - RNA, 22 nt, Mycobacterium bovis subsp bovis AF2122/97
cgcugccggugucucccuugcc

SEQ ID NO: 1165450 - RNA, 16 nt, Mycobacterium bovis subsp bovis AF2122/97
cgcugccggcgccgcc

SEQ ID NO: 1165451 - RNA, 21 nt, Mycobacterium bovis subsp bovis AF2122/97
cgcugccgucggagaccagcu

SEQ ID NO: 1165452 - RNA, 14 nt, Mycobacterium bovis subsp bovis AF2122/97
cgcugccuucuuug

SEQ ID NO: 1165453 - RNA, 17 nt, Mycobacterium bovis subsp bovis AF2122/97
cggcacuagcccgaccg

SEQ ID NO: 1165454 - RNA, 20 nt, Mycobacterium bovis subsp bovis AF2122/97
cggcacuagcgagccggcgc

SEQ ID NO: 1165455 - RNA, 15 nt, Mycobacterium bovis subsp bovis AF2122/97
cggcacucccugggg

SEQ ID NO: 1165456 - RNA, 21 nt, Mycobacterium bovis subsp bovis AF2122/97
cggcagagacguacugggcga

SEQ ID NO: 1165457 - RNA, 16 nt, Mycobacterium bovis subsp bovis AF2122/97
cggcagauacucggcg

SEQ ID NO: 1165458 - RNA, 18 nt, Mycobacterium bovis subsp bovis AF2122/97
cggcagaucccacgccag

SEQ ID NO: 1165459 - RNA, 16 nt, Mycobacterium bovis subsp bovis AF2122/97
cggcagcacccacauc

SEQ ID NO: 1165460 - RNA, 14 nt, Mycobacterium bovis subsp bovis AF2122/97
cggcagcacggucu

SEQ ID NO: 1165461 - RNA, 11 nt, Mycobacterium bovis subsp bovis AF2122/97
cggcagcagca

SEQ ID NO: 1165462 - RNA, 11 nt, Mycobacterium bovis subsp bovis AF2122/97
cggcagauggu

SEQ ID NO: 1165463 - RNA, 18 nt, Mycobacterium bovis subsp bovis AF2122/97
cggcagaugcagcggguc

SEQ ID NO: 1165464 - RNA, 16 nt, Mycobacterium bovis subsp bovis AF2122/97
cggcagccagggcgcc

SEQ ID NO: 1165465 - RNA, 23 nt, Mycobacterium bovis subsp bovis AF2122/97
cggcagcccaaagcgccagcagc

SEQ ID NO: 1165466 - RNA, 14 nt, Mycobacterium bovis subsp bovis AF2122/97
cggcagccaccagc

SEQ ID NO: 1165467 - RNA, 17 nt, Mycobacterium bovis subsp bovis AF2122/97
cggcagccaccagcgac

SEQ ID NO: 1165468 - RNA, 20 nt, Mycobacterium bovis subsp bovis AF2122/97
cggcagccaccagcgacgac

SEQ ID NO: 1165469 - RNA, 14 nt, Mycobacterium bovis subsp bovis AF2122/97
cggcagcauggcca

SEQ ID NO: 1165470 - RNA, 14 nt, Mycobacterium bovis subsp bovis AF2122/97
cggcagcccgggcg

SEQ ID NO: 1165471 - RNA, 17 nt, Mycobacterium bovis subsp bovis AF2122/97
cggcagcggcgcgcugc

SEQ ID NO: 1165472 - RNA, 13 nt, Mycobacterium bovis subsp bovis AF2122/97
cggcagcggcgcu

SEQ ID NO: 1165473 - RNA, 14 nt, Mycobacterium bovis subsp bovis AF2122/97
cggcagcagcgccg

SEQ ID NO: 1165474 - RNA, 19 nt, Mycobacterium bovis subsp bovis AF2122/97
cggcagcagcggugcagcc

SEQ ID NO: 1165475 - RNA, 14 nt, Mycobacterium bovis subsp bovis AF2122/97
cggcagcaggacac

SEQ ID NO: 1165476 - RNA, 14 nt, Mycobacterium bovis subsp bovis AF2122/97
cggcagcaucggca

SEQ ID NO: 1165477 - RNA, 19 nt, Mycobacterium bovis subsp bovis AF2122/97
cggcaauucgggcaugguc

SEQ ID NO: 1165478 - RNA, 18 nt, Mycobacterium bovis subsp bovis AF2122/97
cggcaauucgggcauggu

SEQ ID NO: 1165479 - RNA, 16 nt, Mycobacterium bovis subsp bovis AF2122/97
cggcacacggccuugc

SEQ ID NO: 1165480 - RNA, 23 nt, Mycobacterium bovis subsp bovis AF2122/97
cggcacacccuccacagcggcca

SEQ ID NO: 1165481 - RNA, 20 nt, Mycobacterium bovis subsp bovis AF2122/97
cggcacacccaucaccgcca

SEQ ID NO: 1165482 - RNA, 15 nt, Mycobacterium bovis subsp bovis AF2122/97
cggcacaaucggcgc

SEQ ID NO: 1165483 - RNA, 21 nt, Mycobacterium bovis subsp bovis AF2122/97
cggcaccgccggcgcccaggc

SEQ ID NO: 1165484 - RNA, 22 nt, Mycobacterium bovis subsp bovis AF2122/97
cggcaccgccgguggcgccggg

SEQ ID NO: 1165485 - RNA, 16 nt, Mycobacterium bovis subsp bovis AF2122/97
cggcaccgccugcgcc

SEQ ID NO: 1165486 - RNA, 19 nt, Mycobacterium bovis subsp bovis AF2122/97
cggcaccgccugcgccgcc

SEQ ID NO: 1165487 - RNA, 15 nt, Mycobacterium bovis subsp bovis AF2122/97
cggcaccgccggcuc

SEQ ID NO: 1165488 - RNA, 20 nt, Mycobacterium bovis subsp bovis AF2122/97
cggcaccgccggcuccgccg

SEQ ID NO: 1165489 - RNA, 18 nt, Mycobacterium bovis subsp bovis AF2122/97
cggcaccgccgcccccgc

SEQ ID NO: 1165490 - RNA, 19 nt, Mycobacterium bovis subsp bovis AF2122/97
cggcaccgccgcccccgcc

SEQ ID NO: 1165491 - RNA, 14 nt, Mycobacterium bovis subsp bovis AF2122/97
cggcaccgccgccc

SEQ ID NO: 1165492 - RNA, 15 nt, Mycobacterium bovis subsp bovis AF2122/97
cggcaccgcggccgc

SEQ ID NO: 1165493 - RNA, 16 nt, Mycobacterium bovis subsp bovis AF2122/97
cggcaccgcggccagc

SEQ ID NO: 1165494 - RNA, 13 nt, Mycobacterium bovis subsp bovis AF2122/97
cggcaccgcuuca

SEQ ID NO: 1165495 - RNA, 20 nt, Mycobacterium bovis subsp bovis AF2122/97
cggcaccuccagcaccaccg

SEQ ID NO: 1165496 - RNA, 20 nt, Mycobacterium bovis subsp bovis AF2122/97
cggcaccggccgugccgccg

SEQ ID NO: 1165497 - RNA, 12 nt, Mycobacterium bovis subsp bovis AF2122/97
cggcaccggcuc

SEQ ID NO: 1165498 - RNA, 19 nt, Mycobacterium bovis subsp bovis AF2122/97
cggcaccgguuuucgccgg

SEQ ID NO: 1165499 - RNA, 22 nt, Mycobacterium bovis subsp bovis AF2122/97
cggcaccgguuuucgccggcuc

SEQ ID NO: 1165500 - RNA, 19 nt, Mycobacterium bovis subsp bovis AF2122/97
cggcacgucgcccccggcc

SEQ ID NO: 1165501 - RNA, 20 nt, Mycobacterium bovis subsp bovis AF2122/97
cggcacggucacacgccagc

SEQ ID NO: 1165502 - RNA, 23 nt, Mycobacterium bovis subsp bovis AF2122/97
cggcacggugaacaauccgagga

SEQ ID NO: 1165503 - RNA, 18 nt, Mycobacterium bovis subsp bovis AF2122/97
cggcacgcgucuggaacg

SEQ ID NO: 1165504 - RNA, 16 nt, Mycobacterium bovis subsp bovis AF2122/97
cggcacgcuccagcuc

SEQ ID NO: 1165505 - RNA, 22 nt, Mycobacterium bovis subsp bovis AF2122/97
cggcacgcugaccggaucugac

SEQ ID NO: 1165506 - RNA, 12 nt, Mycobacterium bovis subsp bovis AF2122/97
cggcaagucgac

SEQ ID NO: 1165507 - RNA, 21 nt, Mycobacterium bovis subsp bovis AF2122/97
cggcaaggcauucgagcacgu

SEQ ID NO: 1165508 - RNA, 13 nt, Mycobacterium bovis subsp bovis AF2122/97
cggcaaggguggg

SEQ ID NO: 1165509 - RNA, 18 nt, Mycobacterium bovis subsp bovis AF2122/97
cggcaagaaacagguaag

SEQ ID NO: 1165510 - RNA, 19 nt, Mycobacterium bovis subsp bovis AF2122/97
cggcaacggcgcgccgacc

SEQ ID NO: 1165511 - RNA, 18 nt, Mycobacterium bovis subsp bovis AF2122/97
cggcaagcgcacgcugag

SEQ ID NO: 1165512 - RNA, 14 nt, Mycobacterium bovis subsp bovis AF2122/97
cggcaagcgcagac

SEQ ID NO: 1165513 - RNA, 14 nt, Mycobacterium bovis subsp bovis AF2122/97
cggcaaucaggucg

SEQ ID NO: 1165514 - RNA, 22 nt, Mycobacterium bovis subsp bovis AF2122/97
cggcaauacccgccgcgaugcc

SEQ ID NO: 1165515 - RNA, 17 nt, Mycobacterium bovis subsp bovis AF2122/97
cggcaaucgggucugga

SEQ ID NO: 1165516 - RNA, 18 nt, Mycobacterium bovis subsp bovis AF2122/97
cggcaauggccagcacca

SEQ ID NO: 1165517 - RNA, 14 nt, Mycobacterium bovis subsp bovis AF2122/97
cggaucccagugcc

SEQ ID NO: 1165518 - RNA, 21 nt, Mycobacterium bovis subsp bovis AF2122/97
cggaucccugugccagcagca

SEQ ID NO: 1165519 - RNA, 19 nt, Mycobacterium bovis subsp bovis AF2122/97
cggauccgauccgcacagc

SEQ ID NO: 1165520 - RNA, 15 nt, Mycobacterium bovis subsp bovis AF2122/97
cggaucauuccgacg

SEQ ID NO: 1165521 - RNA, 20 nt, Mycobacterium bovis subsp bovis AF2122/97
cggauccacaccgagaagcu

SEQ ID NO: 1165522 - RNA, 17 nt, Mycobacterium bovis subsp bovis AF2122/97
cggcaacgacugcauga

SEQ ID NO: 1165523 - RNA, 23 nt, Mycobacterium bovis subsp bovis AF2122/97
cggcaacgaucgacaccagggcg

SEQ ID NO: 1165524 - RNA, 14 nt, Mycobacterium bovis subsp bovis AF2122/97
cggcaacgcggucu

SEQ ID NO: 1165525 - RNA, 15 nt, Mycobacterium bovis subsp bovis AF2122/97
cggcaacggcggcaa

SEQ ID NO: 1165526 - RNA, 16 nt, Mycobacterium bovis subsp bovis AF2122/97
cggcaacggcggcgac

SEQ ID NO: 1165527 - RNA, 19 nt, Mycobacterium bovis subsp bovis AF2122/97
cggcaacgggggcgccgga

SEQ ID NO: 1165528 - RNA, 23 nt, Mycobacterium bovis subsp bovis AF2122/97
cggcaacgcggucugcuccaggc

SEQ ID NO: 1165529 - RNA, 14 nt, Mycobacterium bovis subsp bovis AF2122/97
cggauacggcgaca

SEQ ID NO: 1165530 - RNA, 19 nt, Mycobacterium bovis subsp bovis AF2122/97
cggauaggccgcgcggcgg

SEQ ID NO: 1165531 - RNA, 14 nt, Mycobacterium bovis subsp bovis AF2122/97
cggauauuccuuua

SEQ ID NO: 1165532 - RNA, 19 nt, Mycobacterium bovis subsp bovis AF2122/97
cggccagcgugucccaacg

SEQ ID NO: 1165533 - RNA, 15 nt, Mycobacterium bovis subsp bovis AF2122/97
cggccagcucccggg

SEQ ID NO: 1165534 - RNA, 18 nt, Mycobacterium bovis subsp bovis AF2122/97
cggccagcuugcggagcc

SEQ ID NO: 1165535 - RNA, 20 nt, Mycobacterium bovis subsp bovis AF2122/97
cggccagcuugcggagccgc

SEQ ID NO: 1165536 - RNA, 17 nt, Mycobacterium bovis subsp bovis AF2122/97
cggccagcuugcggagc

SEQ ID NO: 1165537 - RNA, 21 nt, Mycobacterium bovis subsp bovis AF2122/97
cggccagcuguucgagccgcg

SEQ ID NO: 1165538 - RNA, 19 nt, Mycobacterium bovis subsp bovis AF2122/97
cggccacgucgaugugcgc

SEQ ID NO: 1165539 - RNA, 12 nt, Mycobacterium bovis subsp bovis AF2122/97
cggccagcagca

SEQ ID NO: 1165540 - RNA, 22 nt, Mycobacterium bovis subsp bovis AF2122/97
cggccagcacccgaaccgggga

SEQ ID NO: 1165541 - RNA, 23 nt, Mycobacterium bovis subsp bovis AF2122/97
cggccaggaugaauuuggugaag

SEQ ID NO: 1165542 - RNA, 23 nt, Mycobacterium bovis subsp bovis AF2122/97
cggccaggaugccugccacccgu

SEQ ID NO: 1165543 - RNA, 22 nt, Mycobacterium bovis subsp bovis AF2122/97
cggccaggaguuugaccaccug

SEQ ID NO: 1165544 - RNA, 18 nt, Mycobacterium bovis subsp bovis AF2122/97
cggccaggcuggccaacu

SEQ ID NO: 1165545 - RNA, 15 nt, Mycobacterium bovis subsp bovis AF2122/97
cggccaguuuccaga

SEQ ID NO: 1165546 - RNA, 16 nt, Mycobacterium bovis subsp bovis AF2122/97
cggccaggggcgcagc

SEQ ID NO: 1165547 - RNA, 20 nt, Mycobacterium bovis subsp bovis AF2122/97
cggccaguugguagccgccc

SEQ ID NO: 1165548 - RNA, 15 nt, Mycobacterium bovis subsp bovis AF2122/97
cggccauacgcgcgc

SEQ ID NO: 1165549 - RNA, 19 nt, Mycobacterium bovis subsp bovis AF2122/97
cggccauagcgccgcgccc

SEQ ID NO: 1165550 - RNA, 15 nt, Mycobacterium bovis subsp bovis AF2122/97
cggccaccagcgccc

SEQ ID NO: 1165551 - RNA, 20 nt, Mycobacterium bovis subsp bovis AF2122/97
cggccaccaccgccgccggc

SEQ ID NO: 1165552 - RNA, 14 nt, Mycobacterium bovis subsp bovis AF2122/97
cggccaccaccgcg

SEQ ID NO: 1165553 - RNA, 14 nt, Mycobacterium bovis subsp bovis AF2122/97
cggccaccagcccg

SEQ ID NO: 1165554 - RNA, 18 nt, Mycobacterium bovis subsp bovis AF2122/97
cggccaccaccgccgccg

SEQ ID NO: 1165555 - RNA, 18 nt, Mycobacterium bovis subsp bovis AF2122/97
cggccaccagcgcccggc

SEQ ID NO: 1165556 - RNA, 22 nt, Mycobacterium bovis subsp bovis AF2122/97
cggccaccagcgcccggcccgc

SEQ ID NO: 1165557 - RNA, 15 nt, Mycobacterium bovis subsp bovis AF2122/97
cggccaccagggcca

SEQ ID NO: 1165558 - RNA, 17 nt, Mycobacterium bovis subsp bovis AF2122/97
cggccaccgccugagcg

SEQ ID NO: 1165559 - RNA, 17 nt, Mycobacterium bovis subsp bovis AF2122/97
cggccaccgccgccgcc

SEQ ID NO: 1165560 - RNA, 17 nt, Mycobacterium bovis subsp bovis AF2122/97
cggccaccgucagcgcg

SEQ ID NO: 1165561 - RNA, 20 nt, Mycobacterium bovis subsp bovis AF2122/97
cggccaccgucagcgcgacc

SEQ ID NO: 1165562 - RNA, 15 nt, Mycobacterium bovis subsp bovis AF2122/97
cggccaccgcacgcu

SEQ ID NO: 1165563 - RNA, 20 nt, Mycobacterium bovis subsp bovis AF2122/97
cggccaccgaggcguucagu

SEQ ID NO: 1165564 - RNA, 20 nt, Mycobacterium bovis subsp bovis AF2122/97
cggccacccggacauagccg

SEQ ID NO: 1165565 - RNA, 14 nt, Mycobacterium bovis subsp bovis AF2122/97
cggccaccuggucg

SEQ ID NO: 1165566 - RNA, 17 nt, Mycobacterium bovis subsp bovis AF2122/97
cggccaccggcgucugc

SEQ ID NO: 1165567 - RNA, 13 nt, Mycobacterium bovis subsp bovis AF2122/97
cggccaccugcuc

SEQ ID NO: 1165568 - RNA, 17 nt, Mycobacterium bovis subsp bovis AF2122/97
cggccacgacgacugga

SEQ ID NO: 1165569 - RNA, 21 nt, Mycobacterium bovis subsp bovis AF2122/97
cggccacggucagccaggugu

SEQ ID NO: 1165570 - RNA, 21 nt, Mycobacterium bovis subsp bovis AF2122/97
cggccacggcgucggccaccc

SEQ ID NO: 1165571 - RNA, 22 nt, Mycobacterium bovis subsp bovis AF2122/97
cggccacggcgucggccacccg

SEQ ID NO: 1165572 - RNA, 17 nt, Mycobacterium bovis subsp bovis AF2122/97
cggccagacccuggccg

SEQ ID NO: 1165573 - RNA, 21 nt, Mycobacterium bovis subsp bovis AF2122/97
cggccacugauucgcaggcuc

SEQ ID NO: 1165574 - RNA, 13 nt, Mycobacterium bovis subsp bovis AF2122/97
cggccacucggga

SEQ ID NO: 1165575 - RNA, 23 nt, Mycobacterium bovis subsp bovis AF2122/97
cggccacuacggccuggccaccu

SEQ ID NO: 1165576 - RNA, 23 nt, Mycobacterium bovis subsp bovis AF2122/97
cggcagcggguuugccgggcgcu

SEQ ID NO: 1165577 - RNA, 20 nt, Mycobacterium bovis subsp bovis AF2122/97
cggcagcguccgaaccaccu

SEQ ID NO: 1165578 - RNA, 15 nt, Mycobacterium bovis subsp bovis AF2122/97
cggcagcucccgcca

SEQ ID NO: 1165579 - RNA, 16 nt, Mycobacterium bovis subsp bovis AF2122/97
cggcagcgugcggggc

SEQ ID NO: 1165580 - RNA, 17 nt, Mycobacterium bovis subsp bovis AF2122/97
cggcaucggugguaaca

SEQ ID NO: 1165581 - RNA, 14 nt, Mycobacterium bovis subsp bovis AF2122/97
cggcaucuccaccg

SEQ ID NO: 1165582 - RNA, 13 nt, Mycobacterium bovis subsp bovis AF2122/97
cggcaucuccacc

SEQ ID NO: 1165583 - RNA, 22 nt, Mycobacterium bovis subsp bovis AF2122/97
cggcaucugaaaauugaccccc

SEQ ID NO: 1165584 - RNA, 16 nt, Mycobacterium bovis subsp bovis AF2122/97
cggcagcuggcgcagc

SEQ ID NO: 1165585 - RNA, 19 nt, Mycobacterium bovis subsp bovis AF2122/97
cggcagcuggucggugggc

SEQ ID NO: 1165586 - RNA, 22 nt, Mycobacterium bovis subsp bovis AF2122/97
cggcaugccgccaugcgcacca

SEQ ID NO: 1165587 - RNA, 15 nt, Mycobacterium bovis subsp bovis AF2122/97
cggcaugggcccugc

SEQ ID NO: 1165588 - RNA, 19 nt, Mycobacterium bovis subsp bovis AF2122/97
cggcaugggccggcgccgc

SEQ ID NO: 1165589 - RNA, 21 nt, Mycobacterium bovis subsp bovis AF2122/97
cggcaugggucgugcaggcga

SEQ ID NO: 1165590 - RNA, 22 nt, Mycobacterium bovis subsp bovis AF2122/97
cggcauguuccuugcggccgcu

SEQ ID NO: 1165591 - RNA, 13 nt, Mycobacterium bovis subsp bovis AF2122/97
cggccacaaccuc

SEQ ID NO: 1165592 - RNA, 13 nt, Mycobacterium bovis subsp bovis AF2122/97
cggccacagugca

SEQ ID NO: 1165593 - RNA, 17 nt, Mycobacterium bovis subsp bovis AF2122/97
cggccacauaccaccac

SEQ ID NO: 1165594 - RNA, 22 nt, Mycobacterium bovis subsp bovis AF2122/97
cggccaauugcgccgccaacuc

SEQ ID NO: 1165595 - RNA, 12 nt, Mycobacterium bovis subsp bovis AF2122/97
cggccaccacca

SEQ ID NO: 1165596 - RNA, 16 nt, Mycobacterium bovis subsp bovis AF2122/97
cggccacaucgccagc

SEQ ID NO: 1165597 - RNA, 23 nt, Mycobacterium bovis subsp bovis AF2122/97
cggccacaucgccagcagcaaac

SEQ ID NO: 1165598 - RNA, 13 nt, Mycobacterium bovis subsp bovis AF2122/97
cggccaacugggc

SEQ ID NO: 1165599 - RNA, 15 nt, Mycobacterium bovis subsp bovis AF2122/97
cggccaacccgggcc

SEQ ID NO: 1165600 - RNA, 23 nt, Mycobacterium bovis subsp bovis AF2122/97
cggccaacgaacgugccccggcg

SEQ ID NO: 1165601 - RNA, 18 nt, Mycobacterium bovis subsp bovis AF2122/97
cggccaagaucggcgccc

SEQ ID NO: 1165602 - RNA, 16 nt, Mycobacterium bovis subsp bovis AF2122/97
cggccaacgccgccgc

SEQ ID NO: 1165603 - RNA, 22 nt, Mycobacterium bovis subsp bovis AF2122/97
cggccaacugggccgagcgcgc

SEQ ID NO: 1165604 - RNA, 15 nt, Mycobacterium bovis subsp bovis AF2122/97
cggccaauccggggc

SEQ ID NO: 1165605 - RNA, 21 nt, Mycobacterium bovis subsp bovis AF2122/97
cggccaacuucugcacgaacg

SEQ ID NO: 1165606 - RNA, 17 nt, Mycobacterium bovis subsp bovis AF2122/97
cggccaaguugaccccc

SEQ ID NO: 1165607 - RNA, 16 nt, Mycobacterium bovis subsp bovis AF2122/97
cggccaaccaccaacu

SEQ ID NO: 1165608 - RNA, 14 nt, Mycobacterium bovis subsp bovis AF2122/97
cggccaaccaugcu

SEQ ID NO: 1165609 - RNA, 13 nt, Mycobacterium bovis subsp bovis AF2122/97
cggccaacccauc

SEQ ID NO: 1165610 - RNA, 13 nt, Mycobacterium bovis subsp bovis AF2122/97
cggccaaaauggc

SEQ ID NO: 1165611 - RNA, 17 nt, Mycobacterium bovis subsp bovis AF2122/97
cggcauuucagcgcgcc

SEQ ID NO: 1165612 - RNA, 21 nt, Mycobacterium bovis subsp bovis AF2122/97
cggcauugcccgagcccagcg

SEQ ID NO: 1165613 - RNA, 17 nt, Mycobacterium bovis subsp bovis AF2122/97
cggcauucgcaccaccu

SEQ ID NO: 1165614 - RNA, 18 nt, Mycobacterium bovis subsp bovis AF2122/97
cggcgccagcgccgccac

SEQ ID NO: 1165615 - RNA, 18 nt, Mycobacterium bovis subsp bovis AF2122/97
cggcgccauagccgcgac

SEQ ID NO: 1165616 - RNA, 15 nt, Mycobacterium bovis subsp bovis AF2122/97
cggcgcccagcgccu

SEQ ID NO: 1165617 - RNA, 22 nt, Mycobacterium bovis subsp bovis AF2122/97
cggcgcccacaucgucggcggg

SEQ ID NO: 1165618 - RNA, 14 nt, Mycobacterium bovis subsp bovis AF2122/97
cggcgcccagcucg

SEQ ID NO: 1165619 - RNA, 19 nt, Mycobacterium bovis subsp bovis AF2122/97
cggcgcccgcucggccgca

SEQ ID NO: 1165620 - RNA, 24 nt, Mycobacterium bovis subsp bovis AF2122/97
cggcgcccgcucggccgcagccag

SEQ ID NO: 1165621 - RNA, 13 nt, Mycobacterium bovis subsp bovis AF2122/97
cggcgcccggcgg

SEQ ID NO: 1165622 - RNA, 13 nt, Mycobacterium bovis subsp bovis AF2122/97
cggcgcccggcuu

SEQ ID NO: 1165623 - RNA, 23 nt, Mycobacterium bovis subsp bovis AF2122/97
cggcgcccgggaucggggcaccg

SEQ ID NO: 1165624 - RNA, 14 nt, Mycobacterium bovis subsp bovis AF2122/97
cggcgcccggucga

SEQ ID NO: 1165625 - RNA, 21 nt, Mycobacterium bovis subsp bovis AF2122/97
cggcgcccuggccgcccuggc

SEQ ID NO: 1165626 - RNA, 17 nt, Mycobacterium bovis subsp bovis AF2122/97
cggcgcccuggccgccc

SEQ ID NO: 1165627 - RNA, 14 nt, Mycobacterium bovis subsp bovis AF2122/97
cggcgccgcagauc

SEQ ID NO: 1165628 - RNA, 14 nt, Mycobacterium bovis subsp bovis AF2122/97
cggcgccgcauacc

SEQ ID NO: 1165629 - RNA, 11 nt, Mycobacterium bovis subsp bovis AF2122/97
cggcgccgccc

SEQ ID NO: 1165630 - RNA, 18 nt, Mycobacterium bovis subsp bovis AF2122/97
cggcgccgcccacggggc

SEQ ID NO: 1165631 - RNA, 21 nt, Mycobacterium bovis subsp bovis AF2122/97
cggcgccgccaagggccccuc

SEQ ID NO: 1165632 - RNA, 16 nt, Mycobacterium bovis subsp bovis AF2122/97
cggcgccgccacggau

SEQ ID NO: 1165633 - RNA, 22 nt, Mycobacterium bovis subsp bovis AF2122/97
cggcgccgccacugccggcagc

SEQ ID NO: 1165634 - RNA, 20 nt, Mycobacterium bovis subsp bovis AF2122/97
cggcgccgccagcaccaccg

SEQ ID NO: 1165635 - RNA, 22 nt, Mycobacterium bovis subsp bovis AF2122/97
cggcgccgcccuugccgccggc

SEQ ID NO: 1165636 - RNA, 14 nt, Mycobacterium bovis subsp bovis AF2122/97
cggcgccgccggcg

SEQ ID NO: 1165637 - RNA, 20 nt, Mycobacterium bovis subsp bovis AF2122/97
cggcgccgccggcgccgccc

SEQ ID NO: 1165638 - RNA, 11 nt, Mycobacterium bovis subsp bovis AF2122/97
cggcgccgcgc

SEQ ID NO: 1165639 - RNA, 15 nt, Mycobacterium bovis subsp bovis AF2122/97
cggcgcaccugggcu

SEQ ID NO: 1165640 - RNA, 22 nt, Mycobacterium bovis subsp bovis AF2122/97
cggcgcaccuugaccgucgcgc

SEQ ID NO: 1165641 - RNA, 16 nt, Mycobacterium bovis subsp bovis AF2122/97
cggcgcaacucgacca

SEQ ID NO: 1165642 - RNA, 21 nt, Mycobacterium bovis subsp bovis AF2122/97
cggcgcagcacggcggccacg

SEQ ID NO: 1165643 - RNA, 13 nt, Mycobacterium bovis subsp bovis AF2122/97
cggcgcagcgacc

SEQ ID NO: 1165644 - RNA, 22 nt, Mycobacterium bovis subsp bovis AF2122/97
cggcgcaccggagucgcccggu

SEQ ID NO: 1165645 - RNA, 19 nt, Mycobacterium bovis subsp bovis AF2122/97
cggcgcacgaaaccgcagc

SEQ ID NO: 1165646 - RNA, 16 nt, Mycobacterium bovis subsp bovis AF2122/97
cggcgccacccgcgcc

SEQ ID NO: 1165647 - RNA, 17 nt, Mycobacterium bovis subsp bovis AF2122/97
cggcgccaauucagcgg

SEQ ID NO: 1165648 - RNA, 16 nt, Mycobacterium bovis subsp bovis AF2122/97
cggcgccaccgccgcu

SEQ ID NO: 1165649 - RNA, 19 nt, Mycobacterium bovis subsp bovis AF2122/97
cggcgccaccggcgccgcc

SEQ ID NO: 1165650 - RNA, 20 nt, Mycobacterium bovis subsp bovis AF2122/97
cggcgccaccggcgccgccc

SEQ ID NO: 1165651 - RNA, 14 nt, Mycobacterium bovis subsp bovis AF2122/97
cggcgccagaugcc

SEQ ID NO: 1165652 - RNA, 17 nt, Mycobacterium bovis subsp bovis AF2122/97
cggcgcaguagccgacc

SEQ ID NO: 1165653 - RNA, 18 nt, Mycobacterium bovis subsp bovis AF2122/97
cggcgcaggucgcgcagu

SEQ ID NO: 1165654 - RNA, 17 nt, Mycobacterium bovis subsp bovis AF2122/97
cggcgccggagccgccc

SEQ ID NO: 1165655 - RNA, 10 nt, Mycobacterium bovis subsp bovis AF2122/97
cggcgccggc

SEQ ID NO: 1165656 - RNA, 20 nt, Mycobacterium bovis subsp bovis AF2122/97
cggcgccggcgucggcgccc

SEQ ID NO: 1165657 - RNA, 13 nt, Mycobacterium bovis subsp bovis AF2122/97
cggcgccggcggc

SEQ ID NO: 1165658 - RNA, 16 nt, Mycobacterium bovis subsp bovis AF2122/97
cggcgccggcggccgc

SEQ ID NO: 1165659 - RNA, 14 nt, Mycobacterium bovis subsp bovis AF2122/97
cggcgccggggggc

SEQ ID NO: 1165660 - RNA, 22 nt, Mycobacterium bovis subsp bovis AF2122/97
cggcgccggggggcugcugcuc

SEQ ID NO: 1165661 - RNA, 21 nt, Mycobacterium bovis subsp bovis AF2122/97
cggcgccgucguugugccggu

SEQ ID NO: 1165662 - RNA, 19 nt, Mycobacterium bovis subsp bovis AF2122/97
cggcgccuacaccggcgcu

SEQ ID NO: 1165663 - RNA, 21 nt, Mycobacterium bovis subsp bovis AF2122/97
cggcgccuagcacgaagcugg

SEQ ID NO: 1165664 - RNA, 13 nt, Mycobacterium bovis subsp bovis AF2122/97
cggcgccucguug

SEQ ID NO: 1165665 - RNA, 18 nt, Mycobacterium bovis subsp bovis AF2122/97
cggcgcgauccccgcgcu

SEQ ID NO: 1165666 - RNA, 17 nt, Mycobacterium bovis subsp bovis AF2122/97
cggcgcgacagccgugg

SEQ ID NO: 1165667 - RNA, 16 nt, Mycobacterium bovis subsp bovis AF2122/97
cggcgcgagccggcuc

SEQ ID NO: 1165668 - RNA, 13 nt, Mycobacterium bovis subsp bovis AF2122/97
cggcgcgccccgc

SEQ ID NO: 1165669 - RNA, 12 nt, Mycobacterium bovis subsp bovis AF2122/97
cggcgcgccccg

SEQ ID NO: 1165670 - RNA, 14 nt, Mycobacterium bovis subsp bovis AF2122/97
cggcgcgccggucg

SEQ ID NO: 1165671 - RNA, 21 nt, Mycobacterium bovis subsp bovis AF2122/97
cggcgcgccgaguugcccggg

SEQ ID NO: 1165672 - RNA, 15 nt, Mycobacterium bovis subsp bovis AF2122/97
cggcgcgccccgccg

SEQ ID NO: 1165673 - RNA, 15 nt, Mycobacterium bovis subsp bovis AF2122/97
cggcgcugcgcaccg

SEQ ID NO: 1165674 - RNA, 13 nt, Mycobacterium bovis subsp bovis AF2122/97
cggcgcugcugcc

SEQ ID NO: 1165675 - RNA, 23 nt, Mycobacterium bovis subsp bovis AF2122/97
cggcgcuggcaggcuuagcuucc

SEQ ID NO: 1165676 - RNA, 16 nt, Mycobacterium bovis subsp bovis AF2122/97
cggcgcgggucggcga

SEQ ID NO: 1165677 - RNA, 19 nt, Mycobacterium bovis subsp bovis AF2122/97
cggcgcgguggggcgcgcc

SEQ ID NO: 1165678 - RNA, 22 nt, Mycobacterium bovis subsp bovis AF2122/97
cggcgcgguggggcgcgccggc

SEQ ID NO: 1165679 - RNA, 23 nt, Mycobacterium bovis subsp bovis AF2122/97
cggcgcgguggggcgcgccggcu

SEQ ID NO: 1165680 - RNA, 18 nt, Mycobacterium bovis subsp bovis AF2122/97
cggcgauccggucggcca

SEQ ID NO: 1165681 - RNA, 15 nt, Mycobacterium bovis subsp bovis AF2122/97
cggcgaucaagccuc

SEQ ID NO: 1165682 - RNA, 22 nt, Mycobacterium bovis subsp bovis AF2122/97
cggcgaucaacucgggcagcgc

SEQ ID NO: 1165683 - RNA, 17 nt, Mycobacterium bovis subsp bovis AF2122/97
cggcgaucgaggugacg

SEQ ID NO: 1165684 - RNA, 14 nt, Mycobacterium bovis subsp bovis AF2122/97
cggcgagucgguug

SEQ ID NO: 1165685 - RNA, 21 nt, Mycobacterium bovis subsp bovis AF2122/97
cggcgagugguccagccagau

SEQ ID NO: 1165686 - RNA, 18 nt, Mycobacterium bovis subsp bovis AF2122/97
cggcgaggucccggccga

SEQ ID NO: 1165687 - RNA, 16 nt, Mycobacterium bovis subsp bovis AF2122/97
cggcgaucaacgcgca

SEQ ID NO: 1165688 - RNA, 17 nt, Mycobacterium bovis subsp bovis AF2122/97
cggcgaucaacgcgcac

SEQ ID NO: 1165689 - RNA, 16 nt, Mycobacterium bovis subsp bovis AF2122/97
cggcgaucaacucggg

SEQ ID NO: 1165690 - RNA, 14 nt, Mycobacterium bovis subsp bovis AF2122/97
cggcgaugcugagc

SEQ ID NO: 1165691 - RNA, 15 nt, Mycobacterium bovis subsp bovis AF2122/97
cggcgauggcgcgca

SEQ ID NO: 1165692 - RNA, 17 nt, Mycobacterium bovis subsp bovis AF2122/97
cggcgaugcggucggcc

SEQ ID NO: 1165693 - RNA, 19 nt, Mycobacterium bovis subsp bovis AF2122/97
cggcgaugcguccgcccag

SEQ ID NO: 1165694 - RNA, 21 nt, Mycobacterium bovis subsp bovis AF2122/97
cggcgaugguaucgccgcuag

SEQ ID NO: 1165695 - RNA, 15 nt, Mycobacterium bovis subsp bovis AF2122/97
cggcgauuacggcca

SEQ ID NO: 1165696 - RNA, 18 nt, Mycobacterium bovis subsp bovis AF2122/97
cggcgaugaccgggcgau

SEQ ID NO: 1165697 - RNA, 20 nt, Mycobacterium bovis subsp bovis AF2122/97
cggcgaucugcugugucgua

SEQ ID NO: 1165698 - RNA, 21 nt, Mycobacterium bovis subsp bovis AF2122/97
cggcgagcaauuccucagccg

SEQ ID NO: 1165699 - RNA, 18 nt, Mycobacterium bovis subsp bovis AF2122/97
cggcgagagggcggggca

SEQ ID NO: 1165700 - RNA, 14 nt, Mycobacterium bovis subsp bovis AF2122/97
cggcgagcagagaa

SEQ ID NO: 1165701 - RNA, 14 nt, Mycobacterium bovis subsp bovis AF2122/97
cggcgagcagggcg

SEQ ID NO: 1165702 - RNA, 22 nt, Mycobacterium bovis subsp bovis AF2122/97
cggcgagcacgucacgcgcggc

SEQ ID NO: 1165703 - RNA, 14 nt, Mycobacterium bovis subsp bovis AF2122/97
cggcgagcacccgc

SEQ ID NO: 1165704 - RNA, 17 nt, Mycobacterium bovis subsp bovis AF2122/97
cggcgagcacccgcugg

SEQ ID NO: 1165705 - RNA, 15 nt, Mycobacterium bovis subsp bovis AF2122/97
cggcgagcaucucga

SEQ ID NO: 1165706 - RNA, 23 nt, Mycobacterium bovis subsp bovis AF2122/97
cggcgagccaaacuacccgccca

SEQ ID NO: 1165707 - RNA, 15 nt, Mycobacterium bovis subsp bovis AF2122/97
cggcgagccgcgccc

SEQ ID NO: 1165708 - RNA, 12 nt, Mycobacterium bovis subsp bovis AF2122/97
cggcgagcgccc

SEQ ID NO: 1165709 - RNA, 16 nt, Mycobacterium bovis subsp bovis AF2122/97
cggcgaggacgcgccc

SEQ ID NO: 1165710 - RNA, 14 nt, Mycobacterium bovis subsp bovis AF2122/97
cggcgagggcaacg

SEQ ID NO: 1165711 - RNA, 14 nt, Mycobacterium bovis subsp bovis AF2122/97
cggcgacggccgcu

SEQ ID NO: 1165712 - RNA, 15 nt, Mycobacterium bovis subsp bovis AF2122/97
cggcgacucugcggg

SEQ ID NO: 1165713 - RNA, 17 nt, Mycobacterium bovis subsp bovis AF2122/97
cggcgacguggcgccga

SEQ ID NO: 1165714 - RNA, 20 nt, Mycobacterium bovis subsp bovis AF2122/97
cggcgacugcgcaccugggu

SEQ ID NO: 1165715 - RNA, 15 nt, Mycobacterium bovis subsp bovis AF2122/97
cggcgacgucggcgg

SEQ ID NO: 1165716 - RNA, 12 nt, Mycobacterium bovis subsp bovis AF2122/97
cggcgacgcgga

SEQ ID NO: 1165717 - RNA, 20 nt, Mycobacterium bovis subsp bovis AF2122/97
cggcgacgcuaccgccggag

SEQ ID NO: 1165718 - RNA, 17 nt, Mycobacterium bovis subsp bovis AF2122/97
cggcgacgagcgcagcg

SEQ ID NO: 1165719 - RNA, 17 nt, Mycobacterium bovis subsp bovis AF2122/97
cggcgacgaaugcagca

SEQ ID NO: 1165720 - RNA, 22 nt, Mycobacterium bovis subsp bovis AF2122/97
cggcgacgaucucgccgccagc

SEQ ID NO: 1165721 - RNA, 19 nt, Mycobacterium bovis subsp bovis AF2122/97
cggcgacgaugucgagcgc

SEQ ID NO: 1165722 - RNA, 19 nt, Mycobacterium bovis subsp bovis AF2122/97
cggcgacgauucgagcggu

SEQ ID NO: 1165723 - RNA, 15 nt, Mycobacterium bovis subsp bovis AF2122/97
cggcgaccugcucgc

SEQ ID NO: 1165724 - RNA, 17 nt, Mycobacterium bovis subsp bovis AF2122/97
cggcgaccucggcggcg

SEQ ID NO: 1165725 - RNA, 14 nt, Mycobacterium bovis subsp bovis AF2122/97
cggccauggacgcc

SEQ ID NO: 1165726 - RNA, 15 nt, Mycobacterium bovis subsp bovis AF2122/97
cggcccagcgcgcca

SEQ ID NO: 1165727 - RNA, 17 nt, Mycobacterium bovis subsp bovis AF2122/97
cggcccagcgcgccagc

SEQ ID NO: 1165728 - RNA, 17 nt, Mycobacterium bovis subsp bovis AF2122/97
cggccauggcgcgcaac

SEQ ID NO: 1165729 - RNA, 18 nt, Mycobacterium bovis subsp bovis AF2122/97
cggcccaguucugcagga

SEQ ID NO: 1165730 - RNA, 20 nt, Mycobacterium bovis subsp bovis AF2122/97
cggcccaguucugcaggaag

SEQ ID NO: 1165731 - RNA, 20 nt, Mycobacterium bovis subsp bovis AF2122/97
cggcccagugggacaggucg

SEQ ID NO: 1165732 - RNA, 18 nt, Mycobacterium bovis subsp bovis AF2122/97
cggccaugaaaaucggca

SEQ ID NO: 1165733 - RNA, 14 nt, Mycobacterium bovis subsp bovis AF2122/97
cggccaucgcgagc

SEQ ID NO: 1165734 - RNA, 19 nt, Mycobacterium bovis subsp bovis AF2122/97
cggccauccaccgcagauc

SEQ ID NO: 1165735 - RNA, 20 nt, Mycobacterium bovis subsp bovis AF2122/97
cggccauaucgcccaccacg

SEQ ID NO: 1165736 - RNA, 20 nt, Mycobacterium bovis subsp bovis AF2122/97
cggccaucagaaccuccucg

SEQ ID NO: 1165737 - RNA, 15 nt, Mycobacterium bovis subsp bovis AF2122/97
cggcgaaaggccagu

SEQ ID NO: 1165738 - RNA, 22 nt, Mycobacterium bovis subsp bovis AF2122/97
cggccuuugucgccuucuuggc

SEQ ID NO: 1165739 - RNA, 20 nt, Mycobacterium bovis subsp bovis AF2122/97
cggccuuggcggccgcgacc

SEQ ID NO: 1165740 - RNA, 16 nt, Mycobacterium bovis subsp bovis AF2122/97
cggccuuuacccgggc

SEQ ID NO: 1165741 - RNA, 16 nt, Mycobacterium bovis subsp bovis AF2122/97
cggccuuuccagcacc

SEQ ID NO: 1165742 - RNA, 17 nt, Mycobacterium bovis subsp bovis AF2122/97
cggccuugcgcacaggc

SEQ ID NO: 1165743 - RNA, 20 nt, Mycobacterium bovis subsp bovis AF2122/97
cggccccaccggugccgccg

SEQ ID NO: 1165744 - RNA, 22 nt, Mycobacterium bovis subsp bovis AF2122/97
cggcccaucuucggacgccagc

SEQ ID NO: 1165745 - RNA, 20 nt, Mycobacterium bovis subsp bovis AF2122/97
cggcccaugaaggagauccc

SEQ ID NO: 1165746 - RNA, 15 nt, Mycobacterium bovis subsp bovis AF2122/97
cggcgaacggcacca

SEQ ID NO: 1165747 - RNA, 21 nt, Mycobacterium bovis subsp bovis AF2122/97
cggcgaacgcgaaugucgcgc

SEQ ID NO: 1165748 - RNA, 12 nt, Mycobacterium bovis subsp bovis AF2122/97
cggcgaacccgc

SEQ ID NO: 1165749 - RNA, 17 nt, Mycobacterium bovis subsp bovis AF2122/97
cggcgaaccacggcagc

SEQ ID NO: 1165750 - RNA, 15 nt, Mycobacterium bovis subsp bovis AF2122/97
cggcgaacccaccgc

SEQ ID NO: 1165751 - RNA, 18 nt, Mycobacterium bovis subsp bovis AF2122/97
cggcgaacccaccgcauu

SEQ ID NO: 1165752 - RNA, 16 nt, Mycobacterium bovis subsp bovis AF2122/97
cggcgaacaggcgacc

SEQ ID NO: 1165753 - RNA, 17 nt, Mycobacterium bovis subsp bovis AF2122/97
cggcgaacaggcgaccg

SEQ ID NO: 1165754 - RNA, 17 nt, Mycobacterium bovis subsp bovis AF2122/97
cggcgaacaaccgccgc

SEQ ID NO: 1165755 - RNA, 13 nt, Mycobacterium bovis subsp bovis AF2122/97
cggcgaagguagu

SEQ ID NO: 1165756 - RNA, 15 nt, Mycobacterium bovis subsp bovis AF2122/97
cggcgaagccggccg

SEQ ID NO: 1165757 - RNA, 22 nt, Mycobacterium bovis subsp bovis AF2122/97
cggcgaccagcucagcugcgga

SEQ ID NO: 1165758 - RNA, 22 nt, Mycobacterium bovis subsp bovis AF2122/97
cggcgaccacgccgccggcgcu

SEQ ID NO: 1165759 - RNA, 19 nt, Mycobacterium bovis subsp bovis AF2122/97
cggcgaccaccgcggcugc

SEQ ID NO: 1165760 - RNA, 17 nt, Mycobacterium bovis subsp bovis AF2122/97
cggcgaccacggcaccg

SEQ ID NO: 1165761 - RNA, 20 nt, Mycobacterium bovis subsp bovis AF2122/97
cggcgaccccgaagaugacc

SEQ ID NO: 1165762 - RNA, 22 nt, Mycobacterium bovis subsp bovis AF2122/97
cggcgaccgggcccccagguag

SEQ ID NO: 1165763 - RNA, 19 nt, Mycobacterium bovis subsp bovis AF2122/97
cggcgaccggcgagcccgc

SEQ ID NO: 1165764 - RNA, 15 nt, Mycobacterium bovis subsp bovis AF2122/97
cggcgaccacgccgc

SEQ ID NO: 1165765 - RNA, 17 nt, Mycobacterium bovis subsp bovis AF2122/97
cggcgaccaccccguag

SEQ ID NO: 1165766 - RNA, 15 nt, Mycobacterium bovis subsp bovis AF2122/97
cggcgaccaccagcg

SEQ ID NO: 1165767 - RNA, 15 nt, Mycobacterium bovis subsp bovis AF2122/97
cggcgacaucggccc

SEQ ID NO: 1165768 - RNA, 15 nt, Mycobacterium bovis subsp bovis AF2122/97
cggcgaagugcaccc

SEQ ID NO: 1165769 - RNA, 16 nt, Mycobacterium bovis subsp bovis AF2122/97
cggcgacacgccaggu

SEQ ID NO: 1165770 - RNA, 19 nt, Mycobacterium bovis subsp bovis AF2122/97
cggcucgggugcgcccggc

SEQ ID NO: 1165771 - RNA, 20 nt, Mycobacterium bovis subsp bovis AF2122/97
cggcucuagaucgccgagcg

SEQ ID NO: 1165772 - RNA, 23 nt, Mycobacterium bovis subsp bovis AF2122/97
cggcucucuucgcgcgcugggcg

SEQ ID NO: 1165773 - RNA, 18 nt, Mycobacterium bovis subsp bovis AF2122/97
cggcucgucgauccccgc

SEQ ID NO: 1165774 - RNA, 17 nt, Mycobacterium bovis subsp bovis AF2122/97
cggcucucuucgcgcgc

SEQ ID NO: 1165775 - RNA, 18 nt, Mycobacterium bovis subsp bovis AF2122/97
cggcugaccggggcgccc

SEQ ID NO: 1165776 - RNA, 13 nt, Mycobacterium bovis subsp bovis AF2122/97
cggcugaccuccc

SEQ ID NO: 1165777 - RNA, 14 nt, Mycobacterium bovis subsp bovis AF2122/97
cggcugaccuccca

SEQ ID NO: 1165778 - RNA, 18 nt, Mycobacterium bovis subsp bovis AF2122/97
cggcugaccgacccggac

SEQ ID NO: 1165779 - RNA, 18 nt, Mycobacterium bovis subsp bovis AF2122/97
cggcugaccucccacccc

SEQ ID NO: 1165780 - RNA, 22 nt, Mycobacterium bovis subsp bovis AF2122/97
cggcugaccuucucacgcacca

SEQ ID NO: 1165781 - RNA, 21 nt, Mycobacterium bovis subsp bovis AF2122/97
cggcugagacagaccgggccc

SEQ ID NO: 1165782 - RNA, 23 nt, Mycobacterium bovis subsp bovis AF2122/97
cggcugagccgcaucuggccggc

SEQ ID NO: 1165783 - RNA, 15 nt, Mycobacterium bovis subsp bovis AF2122/97
cggcucggccaccga

SEQ ID NO: 1165784 - RNA, 22 nt, Mycobacterium bovis subsp bovis AF2122/97
cggcucgggaacuucgccgaag

SEQ ID NO: 1165785 - RNA, 20 nt, Mycobacterium bovis subsp bovis AF2122/97
cggcucggcgggggaccccg

SEQ ID NO: 1165786 - RNA, 24 nt, Mycobacterium bovis subsp bovis AF2122/97
cggcucgcugaucuggggcaccac

SEQ ID NO: 1165787 - RNA, 12 nt, Mycobacterium bovis subsp bovis AF2122/97
cggcuccgccgc

SEQ ID NO: 1165788 - RNA, 21 nt, Mycobacterium bovis subsp bovis AF2122/97
cggcuccgccgcgggcucccc

SEQ ID NO: 1165789 - RNA, 14 nt, Mycobacterium bovis subsp bovis AF2122/97
cggcuccagcaccg

SEQ ID NO: 1165790 - RNA, 17 nt, Mycobacterium bovis subsp bovis AF2122/97
cggcuccagcaugggcg

SEQ ID NO: 1165791 - RNA, 20 nt, Mycobacterium bovis subsp bovis AF2122/97
cggcuccagguccacaucca

SEQ ID NO: 1165792 - RNA, 15 nt, Mycobacterium bovis subsp bovis AF2122/97
cggcuccgcaaccag

SEQ ID NO: 1165793 - RNA, 20 nt, Mycobacterium bovis subsp bovis AF2122/97
cggcguuggaaaagucgggc

SEQ ID NO: 1165794 - RNA, 15 nt, Mycobacterium bovis subsp bovis AF2122/97
cggcguugagcuggc

SEQ ID NO: 1165795 - RNA, 23 nt, Mycobacterium bovis subsp bovis AF2122/97
cggcguuggaaaagucgggcacu

SEQ ID NO: 1165796 - RNA, 21 nt, Mycobacterium bovis subsp bovis AF2122/97
cggcguuggugcagucggugc

SEQ ID NO: 1165797 - RNA, 18 nt, Mycobacterium bovis subsp bovis AF2122/97
cggcguugccgaaacccg

SEQ ID NO: 1165798 - RNA, 15 nt, Mycobacterium bovis subsp bovis AF2122/97
cggcguugccgccgg

SEQ ID NO: 1165799 - RNA, 23 nt, Mycobacterium bovis subsp bovis AF2122/97
cggcguugccggagaaguucgug

SEQ ID NO: 1165800 - RNA, 12 nt, Mycobacterium bovis subsp bovis AF2122/97
cggcguuuauca

SEQ ID NO: 1165801 - RNA, 16 nt, Mycobacterium bovis subsp bovis AF2122/97
cggcguuugagaacaa

SEQ ID NO: 1165802 - RNA, 18 nt, Mycobacterium bovis subsp bovis AF2122/97
cggcguuugagaacaacg

SEQ ID NO: 1165803 - RNA, 22 nt, Mycobacterium bovis subsp bovis AF2122/97
cggcuccaccgggcccgccggc

SEQ ID NO: 1165804 - RNA, 18 nt, Mycobacterium bovis subsp bovis AF2122/97
cggcuccaccgggcccgc

SEQ ID NO: 1165805 - RNA, 22 nt, Mycobacterium bovis subsp bovis AF2122/97
cggcgucuugcaucagcggcgc

SEQ ID NO: 1165806 - RNA, 22 nt, Mycobacterium bovis subsp bovis AF2122/97
cggcgugaucaccggcaucccg

SEQ ID NO: 1165807 - RNA, 20 nt, Mycobacterium bovis subsp bovis AF2122/97
cggcgucuuccucggccacc

SEQ ID NO: 1165808 - RNA, 21 nt, Mycobacterium bovis subsp bovis AF2122/97
cggcgucuuccucggccaccc

SEQ ID NO: 1165809 - RNA, 16 nt, Mycobacterium bovis subsp bovis AF2122/97
cggcgucugcccgccc

SEQ ID NO: 1165810 - RNA, 19 nt, Mycobacterium bovis subsp bovis AF2122/97
cggcgucugcccgcccagc

SEQ ID NO: 1165811 - RNA, 15 nt, Mycobacterium bovis subsp bovis AF2122/97
cggcgucggccaccg

SEQ ID NO: 1165812 - RNA, 16 nt, Mycobacterium bovis subsp bovis AF2122/97
cggcgucuccgccggc

SEQ ID NO: 1165813 - RNA, 14 nt, Mycobacterium bovis subsp bovis AF2122/97
cggcgucucgcagc

SEQ ID NO: 1165814 - RNA, 21 nt, Mycobacterium bovis subsp bovis AF2122/97
cggcgucguugaggaagcccg

SEQ ID NO: 1165815 - RNA, 17 nt, Mycobacterium bovis subsp bovis AF2122/97
cggcgggggcggcggcu

SEQ ID NO: 1165816 - RNA, 17 nt, Mycobacterium bovis subsp bovis AF2122/97
cggcggggccggcggcu

SEQ ID NO: 1165817 - RNA, 15 nt, Mycobacterium bovis subsp bovis AF2122/97
cggcggggccggcgg

SEQ ID NO: 1165818 - RNA, 23 nt, Mycobacterium bovis subsp bovis AF2122/97
cggcggcaucgaguucggcccgc

SEQ ID NO: 1165819 - RNA, 20 nt, Mycobacterium bovis subsp bovis AF2122/97
cggcggcaucggcggcaacg

SEQ ID NO: 1165820 - RNA, 16 nt, Mycobacterium bovis subsp bovis AF2122/97
cggcggcaggccggcc

SEQ ID NO: 1165821 - RNA, 20 nt, Mycobacterium bovis subsp bovis AF2122/97
cggcggguagaaccagcccg

SEQ ID NO: 1165822 - RNA, 22 nt, Mycobacterium bovis subsp bovis AF2122/97
cggcgggggcgucgccgccggg

SEQ ID NO: 1165823 - RNA, 20 nt, Mycobacterium bovis subsp bovis AF2122/97
cggcggguuugcccaucccc

SEQ ID NO: 1165824 - RNA, 19 nt, Mycobacterium bovis subsp bovis AF2122/97
cggcggcacuacgcagccg

SEQ ID NO: 1165825 - RNA, 22 nt, Mycobacterium bovis subsp bovis AF2122/97
cggcggcaaccccgagcggagc

SEQ ID NO: 1165826 - RNA, 13 nt, Mycobacterium bovis subsp bovis AF2122/97
cggcggcaaccgc

SEQ ID NO: 1165827 - RNA, 17 nt, Mycobacterium bovis subsp bovis AF2122/97
cggcggcaaccgccgcc

SEQ ID NO: 1165828 - RNA, 18 nt, Mycobacterium bovis subsp bovis AF2122/97
cggcggcaaccgccgcca

SEQ ID NO: 1165829 - RNA, 22 nt, Mycobacterium bovis subsp bovis AF2122/97
cggcggcaaccgccgccaccag

SEQ ID NO: 1165830 - RNA, 19 nt, Mycobacterium bovis subsp bovis AF2122/97
cggcggcaacggcggcauc

SEQ ID NO: 1165831 - RNA, 20 nt, Mycobacterium bovis subsp bovis AF2122/97
cggcggcaacggcggcgacg

SEQ ID NO: 1165832 - RNA, 17 nt, Mycobacterium bovis subsp bovis AF2122/97
cggcgcuggcgggcagc

SEQ ID NO: 1165833 - RNA, 20 nt, Mycobacterium bovis subsp bovis AF2122/97
cggcggcaaagaacagccgg

SEQ ID NO: 1165834 - RNA, 22 nt, Mycobacterium bovis subsp bovis AF2122/97
cggcggcaaagaacagccggcc

SEQ ID NO: 1165835 - RNA, 23 nt, Mycobacterium bovis subsp bovis AF2122/97
cggcggcaaagaacagccggcca

SEQ ID NO: 1165836 - RNA, 18 nt, Mycobacterium bovis subsp bovis AF2122/97
cggcggugguaccggcgc

SEQ ID NO: 1165837 - RNA, 20 nt, Mycobacterium bovis subsp bovis AF2122/97
cggcggugccgucgccgccc

SEQ ID NO: 1165838 - RNA, 22 nt, Mycobacterium bovis subsp bovis AF2122/97
cggcggugccacgaucggcggg

SEQ ID NO: 1165839 - RNA, 19 nt, Mycobacterium bovis subsp bovis AF2122/97
cggcggugcccagcagcgc

SEQ ID NO: 1165840 - RNA, 17 nt, Mycobacterium bovis subsp bovis AF2122/97
cggcgguaacggcggua

SEQ ID NO: 1165841 - RNA, 14 nt, Mycobacterium bovis subsp bovis AF2122/97
cggcggugcagcag

SEQ ID NO: 1165842 - RNA, 22 nt, Mycobacterium bovis subsp bovis AF2122/97
cggcggugcagcagggcgcgca

SEQ ID NO: 1165843 - RNA, 12 nt, Mycobacterium bovis subsp bovis AF2122/97
cggcggugggcg

SEQ ID NO: 1165844 - RNA, 20 nt, Mycobacterium bovis subsp bovis AF2122/97
cggcggugguaccggcgcca

SEQ ID NO: 1165845 - RNA, 19 nt, Mycobacterium bovis subsp bovis AF2122/97
cggcguccuugcgcagcac

SEQ ID NO: 1165846 - RNA, 17 nt, Mycobacterium bovis subsp bovis AF2122/97
cggcguccuugcgcagc

SEQ ID NO: 1165847 - RNA, 18 nt, Mycobacterium bovis subsp bovis AF2122/97
cggcguccuugcgcagca

SEQ ID NO: 1165848 - RNA, 14 nt, Mycobacterium bovis subsp bovis AF2122/97
cggcgucgacccag

SEQ ID NO: 1165849 - RNA, 15 nt, Mycobacterium bovis subsp bovis AF2122/97
cggcgucgagcaccu

SEQ ID NO: 1165850 - RNA, 19 nt, Mycobacterium bovis subsp bovis AF2122/97
cggcgucgagcucguccuc

SEQ ID NO: 1165851 - RNA, 24 nt, Mycobacterium bovis subsp bovis AF2122/97
cggcgucgagggagcgccgcaggg

SEQ ID NO: 1165852 - RNA, 19 nt, Mycobacterium bovis subsp bovis AF2122/97
cggcgucgaugaccuuggg

SEQ ID NO: 1165853 - RNA, 18 nt, Mycobacterium bovis subsp bovis AF2122/97
cggcgucgccuuggaacu

SEQ ID NO: 1165854 - RNA, 13 nt, Mycobacterium bovis subsp bovis AF2122/97
cggcguccaagaa

SEQ ID NO: 1165855 - RNA, 19 nt, Mycobacterium bovis subsp bovis AF2122/97
cggcguccaccugcuccgc

SEQ ID NO: 1165856 - RNA, 17 nt, Mycobacterium bovis subsp bovis AF2122/97
cggcguccaucgcgcgc

SEQ ID NO: 1165857 - RNA, 16 nt, Mycobacterium bovis subsp bovis AF2122/97
cggcgucauccaccgc

SEQ ID NO: 1165858 - RNA, 12 nt, Mycobacterium bovis subsp bovis AF2122/97
cgggcagccugc

SEQ ID NO: 1165859 - RNA, 15 nt, Mycobacterium bovis subsp bovis AF2122/97
cgggcagccgcccgc

SEQ ID NO: 1165860 - RNA, 16 nt, Mycobacterium bovis subsp bovis AF2122/97
cgggcagcacgccagc

SEQ ID NO: 1165861 - RNA, 16 nt, Mycobacterium bovis subsp bovis AF2122/97
cgggcauccuucacca

SEQ ID NO: 1165862 - RNA, 15 nt, Mycobacterium bovis subsp bovis AF2122/97
cgggcagccugcugc

SEQ ID NO: 1165863 - RNA, 22 nt, Mycobacterium bovis subsp bovis AF2122/97
cgggcagcaacaggcccacggc

SEQ ID NO: 1165864 - RNA, 23 nt, Mycobacterium bovis subsp bovis AF2122/97
cgggcagcaacaggcccacggcg

SEQ ID NO: 1165865 - RNA, 11 nt, Mycobacterium bovis subsp bovis AF2122/97
cgggcagcacc

SEQ ID NO: 1165866 - RNA, 15 nt, Mycobacterium bovis subsp bovis AF2122/97
cgggcacugugaggu

SEQ ID NO: 1165867 - RNA, 14 nt, Mycobacterium bovis subsp bovis AF2122/97
cgggcaacggcagc

SEQ ID NO: 1165868 - RNA, 15 nt, Mycobacterium bovis subsp bovis AF2122/97
cgggcaaccagcagc

SEQ ID NO: 1165869 - RNA, 18 nt, Mycobacterium bovis subsp bovis AF2122/97
cgggcaaccgaugacgcg

SEQ ID NO: 1165870 - RNA, 15 nt, Mycobacterium bovis subsp bovis AF2122/97
cgggcaaggccaccg

SEQ ID NO: 1165871 - RNA, 22 nt, Mycobacterium bovis subsp bovis AF2122/97
cgggcaacggcggggccggcgg

SEQ ID NO: 1165872 - RNA, 19 nt, Mycobacterium bovis subsp bovis AF2122/97
cgggaugugcggcugcacc

SEQ ID NO: 1165873 - RNA, 21 nt, Mycobacterium bovis subsp bovis AF2122/97
cgggauugccgccaccuuggc

SEQ ID NO: 1165874 - RNA, 15 nt, Mycobacterium bovis subsp bovis AF2122/97
cgggcaaaucaagca

SEQ ID NO: 1165875 - RNA, 17 nt, Mycobacterium bovis subsp bovis AF2122/97
cgggcaaaucaagcaca

SEQ ID NO: 1165876 - RNA, 18 nt, Mycobacterium bovis subsp bovis AF2122/97
cgggcaaaucaagcacag

SEQ ID NO: 1165877 - RNA, 17 nt, Mycobacterium bovis subsp bovis AF2122/97
cgggauggacaccaccu

SEQ ID NO: 1165878 - RNA, 17 nt, Mycobacterium bovis subsp bovis AF2122/97
cgggauggacagcuguu

SEQ ID NO: 1165879 - RNA, 22 nt, Mycobacterium bovis subsp bovis AF2122/97
cgggaugccggcgaaggccagc

SEQ ID NO: 1165880 - RNA, 14 nt, Mycobacterium bovis subsp bovis AF2122/97
cgggaugcucccua

SEQ ID NO: 1165881 - RNA, 15 nt, Mycobacterium bovis subsp bovis AF2122/97
cgggaugcucgaucc

SEQ ID NO: 1165882 - RNA, 13 nt, Mycobacterium bovis subsp bovis AF2122/97
cgggaugaccacc

SEQ ID NO: 1165883 - RNA, 17 nt, Mycobacterium bovis subsp bovis AF2122/97
cgggaucugcgccgcgc

SEQ ID NO: 1165884 - RNA, 18 nt, Mycobacterium bovis subsp bovis AF2122/97
cgggaucugcgccgcgcg

SEQ ID NO: 1165885 - RNA, 15 nt, Mycobacterium bovis subsp bovis AF2122/97
cgggaucugcgccgc

SEQ ID NO: 1165886 - RNA, 20 nt, Mycobacterium bovis subsp bovis AF2122/97
cgggaucugagggcucggug

SEQ ID NO: 1165887 - RNA, 15 nt, Mycobacterium bovis subsp bovis AF2122/97
cgggaucgcugccag

SEQ ID NO: 1165888 - RNA, 19 nt, Mycobacterium bovis subsp bovis AF2122/97
cgggaucggcguccaucac

SEQ ID NO: 1165889 - RNA, 15 nt, Mycobacterium bovis subsp bovis AF2122/97
cgggaucgcccaggc

SEQ ID NO: 1165890 - RNA, 16 nt, Mycobacterium bovis subsp bovis AF2122/97
cgggaucgcccaggcg

SEQ ID NO: 1165891 - RNA, 14 nt, Mycobacterium bovis subsp bovis AF2122/97
cgggaucgacccgc

SEQ ID NO: 1165892 - RNA, 17 nt, Mycobacterium bovis subsp bovis AF2122/97
cgggauccaggcccagc

SEQ ID NO: 1165893 - RNA, 19 nt, Mycobacterium bovis subsp bovis AF2122/97
cgggauaucgucgacgccc

SEQ ID NO: 1165894 - RNA, 14 nt, Mycobacterium bovis subsp bovis AF2122/97
cgggaggccaccgc

SEQ ID NO: 1165895 - RNA, 17 nt, Mycobacterium bovis subsp bovis AF2122/97
cgggagguacccccagc

SEQ ID NO: 1165896 - RNA, 15 nt, Mycobacterium bovis subsp bovis AF2122/97
cgggaguguguccga

SEQ ID NO: 1165897 - RNA, 14 nt, Mycobacterium bovis subsp bovis AF2122/97
cgggauaacccagc

SEQ ID NO: 1165898 - RNA, 19 nt, Mycobacterium bovis subsp bovis AF2122/97
cgggauaccgcucagggug

SEQ ID NO: 1165899 - RNA, 18 nt, Mycobacterium bovis subsp bovis AF2122/97
cggcugcguuguguuccg

SEQ ID NO: 1165900 - RNA, 23 nt, Mycobacterium bovis subsp bovis AF2122/97
cggcugcguuguguuccguugcg

SEQ ID NO: 1165901 - RNA, 19 nt, Mycobacterium bovis subsp bovis AF2122/97
cggcugcguuggcuggugc

SEQ ID NO: 1165902 - RNA, 22 nt, Mycobacterium bovis subsp bovis AF2122/97
cggcugcggcgucguugaggaa

SEQ ID NO: 1165903 - RNA, 18 nt, Mycobacterium bovis subsp bovis AF2122/97
cggcugauucgagccaca

SEQ ID NO: 1165904 - RNA, 18 nt, Mycobacterium bovis subsp bovis AF2122/97
cggcuggacggcgccggu

SEQ ID NO: 1165905 - RNA, 19 nt, Mycobacterium bovis subsp bovis AF2122/97
cggcuuggccuagccgcgg

SEQ ID NO: 1165906 - RNA, 23 nt, Mycobacterium bovis subsp bovis AF2122/97
cggcuugggaaacccggccagcu

SEQ ID NO: 1165907 - RNA, 23 nt, Mycobacterium bovis subsp bovis AF2122/97
cggcuuggccuagccgcggcacc

SEQ ID NO: 1165908 - RNA, 23 nt, Mycobacterium bovis subsp bovis AF2122/97
cggcuuggugaaccgcgcggcga

SEQ ID NO: 1165909 - RNA, 22 nt, Mycobacterium bovis subsp bovis AF2122/97
cggcuuggccgccccggccgcu

SEQ ID NO: 1165910 - RNA, 16 nt, Mycobacterium bovis subsp bovis AF2122/97
cgggaaagccaccuac

SEQ ID NO: 1165911 - RNA, 21 nt, Mycobacterium bovis subsp bovis AF2122/97
cggcuucgucggccagcagca

SEQ ID NO: 1165912 - RNA, 13 nt, Mycobacterium bovis subsp bovis AF2122/97
cggcuugcugccc

SEQ ID NO: 1165913 - RNA, 21 nt, Mycobacterium bovis subsp bovis AF2122/97
cggcuuggccgccccggccgc

SEQ ID NO: 1165914 - RNA, 20 nt, Mycobacterium bovis subsp bovis AF2122/97
cggcuugcugccccauaaac

SEQ ID NO: 1165915 - RNA, 17 nt, Mycobacterium bovis subsp bovis AF2122/97
cgggaccuucgagccgc

SEQ ID NO: 1165916 - RNA, 21 nt, Mycobacterium bovis subsp bovis AF2122/97
cgggaccgaucuuggccaccg

SEQ ID NO: 1165917 - RNA, 15 nt, Mycobacterium bovis subsp bovis AF2122/97
cgggaccgccccggc

SEQ ID NO: 1165918 - RNA, 17 nt, Mycobacterium bovis subsp bovis AF2122/97
cgggaccggggacgcgc

SEQ ID NO: 1165919 - RNA, 13 nt, Mycobacterium bovis subsp bovis AF2122/97
cgggacgccgccc

SEQ ID NO: 1165920 - RNA, 13 nt, Mycobacterium bovis subsp bovis AF2122/97
cgggacguugucc

SEQ ID NO: 1165921 - RNA, 23 nt, Mycobacterium bovis subsp bovis AF2122/97
cgggaccgccccggccaggacau

SEQ ID NO: 1165922 - RNA, 23 nt, Mycobacterium bovis subsp bovis AF2122/97
cgggacgccgcccccguggggug

SEQ ID NO: 1165923 - RNA, 16 nt, Mycobacterium bovis subsp bovis AF2122/97
cgggacuaccacccgc

SEQ ID NO: 1165924 - RNA, 22 nt, Mycobacterium bovis subsp bovis AF2122/97
cgggacuaccacccgcaggucg

SEQ ID NO: 1165925 - RNA, 18 nt, Mycobacterium bovis subsp bovis AF2122/97
cgggacguuguccaccgc

SEQ ID NO: 1165926 - RNA, 19 nt, Mycobacterium bovis subsp bovis AF2122/97
cgggagaaaacggcggcgc

SEQ ID NO: 1165927 - RNA, 19 nt, Mycobacterium bovis subsp bovis AF2122/97
cgggagacgcugcgcgcca

SEQ ID NO: 1165928 - RNA, 16 nt, Mycobacterium bovis subsp bovis AF2122/97
cgggaccauagucgcc

SEQ ID NO: 1165929 - RNA, 17 nt, Mycobacterium bovis subsp bovis AF2122/97
cgggaaauaucucggug

SEQ ID NO: 1165930 - RNA, 15 nt, Mycobacterium bovis subsp bovis AF2122/97
cgggaacgaugccgc

SEQ ID NO: 1165931 - RNA, 16 nt, Mycobacterium bovis subsp bovis AF2122/97
cgggaaccacggucag

SEQ ID NO: 1165932 - RNA, 17 nt, Mycobacterium bovis subsp bovis AF2122/97
cggguggcgaggcagca

SEQ ID NO: 1165933 - RNA, 24 nt, Mycobacterium bovis subsp bovis AF2122/97
cggguggugcggccguggcguggc

SEQ ID NO: 1165934 - RNA, 16 nt, Mycobacterium bovis subsp bovis AF2122/97
cgggugggagcagccg

SEQ ID NO: 1165935 - RNA, 19 nt, Mycobacterium bovis subsp bovis AF2122/97
cgggugucacagugguggg

SEQ ID NO: 1165936 - RNA, 17 nt, Mycobacterium bovis subsp bovis AF2122/97
cggguggugccggcgga

SEQ ID NO: 1165937 - RNA, 17 nt, Mycobacterium bovis subsp bovis AF2122/97
cggguuccauguccggc

SEQ ID NO: 1165938 - RNA, 14 nt, Mycobacterium bovis subsp bovis AF2122/97
cggguugcgacgaa

SEQ ID NO: 1165939 - RNA, 14 nt, Mycobacterium bovis subsp bovis AF2122/97
cggguuugaucucc

SEQ ID NO: 1165940 - RNA, 23 nt, Mycobacterium bovis subsp bovis AF2122/97
cggguugggcaucaggccgcgcg

SEQ ID NO: 1165941 - RNA, 14 nt, Mycobacterium bovis subsp bovis AF2122/97
cgguaaagccccgc

SEQ ID NO: 1165942 - RNA, 22 nt, Mycobacterium bovis subsp bovis AF2122/97
cgguaaugccagcggcacaccc

SEQ ID NO: 1165943 - RNA, 15 nt, Mycobacterium bovis subsp bovis AF2122/97
cgguaauggccgccg

SEQ ID NO: 1165944 - RNA, 19 nt, Mycobacterium bovis subsp bovis AF2122/97
cgguaauggcgugcagacc

SEQ ID NO: 1165945 - RNA, 18 nt, Mycobacterium bovis subsp bovis AF2122/97
cgguaacuguccgcccgg

SEQ ID NO: 1165946 - RNA, 17 nt, Mycobacterium bovis subsp bovis AF2122/97
cgguaucccccagccgc

SEQ ID NO: 1165947 - RNA, 16 nt, Mycobacterium bovis subsp bovis AF2122/97
cgguauacccggcccc

SEQ ID NO: 1165948 - RNA, 20 nt, Mycobacterium bovis subsp bovis AF2122/97
cgguaucgucccggcgaccg

SEQ ID NO: 1165949 - RNA, 18 nt, Mycobacterium bovis subsp bovis AF2122/97
cgguaucggcgaccagcu

SEQ ID NO: 1165950 - RNA, 19 nt, Mycobacterium bovis subsp bovis AF2122/97
cgguaucgagggcagccgc

SEQ ID NO: 1165951 - RNA, 19 nt, Mycobacterium bovis subsp bovis AF2122/97
cgguaucccccagccgcgg

SEQ ID NO: 1165952 - RNA, 16 nt, Mycobacterium bovis subsp bovis AF2122/97
cgguaguacuagcacg

SEQ ID NO: 1165953 - RNA, 15 nt, Mycobacterium bovis subsp bovis AF2122/97
cgguaguagcugacc

SEQ ID NO: 1165954 - RNA, 15 nt, Mycobacterium bovis subsp bovis AF2122/97
cgguaggggugaucc

SEQ ID NO: 1165955 - RNA, 19 nt, Mycobacterium bovis subsp bovis AF2122/97
cgguaggugcaugucgaug

SEQ ID NO: 1165956 - RNA, 20 nt, Mycobacterium bovis subsp bovis AF2122/97
cgguaguugcgcggcauccc

SEQ ID NO: 1165957 - RNA, 17 nt, Mycobacterium bovis subsp bovis AF2122/97
cgguaguuaacccaggg

SEQ ID NO: 1165958 - RNA, 22 nt, Mycobacterium bovis subsp bovis AF2122/97
cgguauuugaacgcccgcuuca

SEQ ID NO: 1165959 - RNA, 18 nt, Mycobacterium bovis subsp bovis AF2122/97
cggucaaauccagcagcc

SEQ ID NO: 1165960 - RNA, 18 nt, Mycobacterium bovis subsp bovis AF2122/97
cggucaacgacagccuca

SEQ ID NO: 1165961 - RNA, 20 nt, Mycobacterium bovis subsp bovis AF2122/97
cggucaaagaugucgcuggg

SEQ ID NO: 1165962 - RNA, 15 nt, Mycobacterium bovis subsp bovis AF2122/97
cgguagccgaccagc

SEQ ID NO: 1165963 - RNA, 16 nt, Mycobacterium bovis subsp bovis AF2122/97
cgguagcacagcagca

SEQ ID NO: 1165964 - RNA, 17 nt, Mycobacterium bovis subsp bovis AF2122/97
cgguacugcgcagcgcc

SEQ ID NO: 1165965 - RNA, 24 nt, Mycobacterium bovis subsp bovis AF2122/97
cgguaccaucaccgcgccagccuc

SEQ ID NO: 1165966 - RNA, 17 nt, Mycobacterium bovis subsp bovis AF2122/97
cgguaccaaccugcgcg

SEQ ID NO: 1165967 - RNA, 15 nt, Mycobacterium bovis subsp bovis AF2122/97
cgguaccaccggcac

SEQ ID NO: 1165968 - RNA, 12 nt, Mycobacterium bovis subsp bovis AF2122/97
cgguacgcaacc

SEQ ID NO: 1165969 - RNA, 18 nt, Mycobacterium bovis subsp bovis AF2122/97
cgguacgcaaccaaccgu

SEQ ID NO: 1165970 - RNA, 18 nt, Mycobacterium bovis subsp bovis AF2122/97
cgguaccgaucagcaggg

SEQ ID NO: 1165971 - RNA, 23 nt, Mycobacterium bovis subsp bovis AF2122/97
cgguacccgauguccuauuugca

SEQ ID NO: 1165972 - RNA, 22 nt, Mycobacterium bovis subsp bovis AF2122/97
cgggugauggaugggucgaccg

SEQ ID NO: 1165973 - RNA, 20 nt, Mycobacterium bovis subsp bovis AF2122/97
cgggugcagaucgccccagc

SEQ ID NO: 1165974 - RNA, 15 nt, Mycobacterium bovis subsp bovis AF2122/97
cgggugcagccagau

SEQ ID NO: 1165975 - RNA, 11 nt, Mycobacterium bovis subsp bovis AF2122/97
cgggugaucuu

SEQ ID NO: 1165976 - RNA, 14 nt, Mycobacterium bovis subsp bovis AF2122/97
cgggugccagcccg

SEQ ID NO: 1165977 - RNA, 13 nt, Mycobacterium bovis subsp bovis AF2122/97
cgggugccgagcu

SEQ ID NO: 1165978 - RNA, 19 nt, Mycobacterium bovis subsp bovis AF2122/97
cgggugcgaucgcaacacc

SEQ ID NO: 1165979 - RNA, 13 nt, Mycobacterium bovis subsp bovis AF2122/97
cggguggcacacc

SEQ ID NO: 1165980 - RNA, 21 nt, Mycobacterium bovis subsp bovis AF2122/97
cgggugcgggccgaacacacc

SEQ ID NO: 1165981 - RNA, 19 nt, Mycobacterium bovis subsp bovis AF2122/97
cgggugcgggcgugguaac

SEQ ID NO: 1165982 - RNA, 23 nt, Mycobacterium bovis subsp bovis AF2122/97
cgggugcuacuggguggguagcu

SEQ ID NO: 1165983 - RNA, 22 nt, Mycobacterium bovis subsp bovis AF2122/97
cgggugcgccguugccgccguc

SEQ ID NO: 1165984 - RNA, 14 nt, Mycobacterium bovis subsp bovis AF2122/97
cgggucgucggcgu

SEQ ID NO: 1165985 - RNA, 15 nt, Mycobacterium bovis subsp bovis AF2122/97
cgggucgggcaccgc

SEQ ID NO: 1165986 - RNA, 24 nt, Mycobacterium bovis subsp bovis AF2122/97
cgggucgguccacuucagaucggc

SEQ ID NO: 1165987 - RNA, 19 nt, Mycobacterium bovis subsp bovis AF2122/97
cggguccgaaguacuggcc

SEQ ID NO: 1165988 - RNA, 22 nt, Mycobacterium bovis subsp bovis AF2122/97
cggguccgaaguacuggccgcc

SEQ ID NO: 1165989 - RNA, 23 nt, Mycobacterium bovis subsp bovis AF2122/97
cgggucccuuguggucugccagc

SEQ ID NO: 1165990 - RNA, 15 nt, Mycobacterium bovis subsp bovis AF2122/97
cgggucuccggcgca

SEQ ID NO: 1165991 - RNA, 17 nt, Mycobacterium bovis subsp bovis AF2122/97
cgggucuccggcgcacc

SEQ ID NO: 1165992 - RNA, 16 nt, Mycobacterium bovis subsp bovis AF2122/97
cgggucgugccccggc

SEQ ID NO: 1165993 - RNA, 14 nt, Mycobacterium bovis subsp bovis AF2122/97
cgggucucgcgagc

SEQ ID NO: 1165994 - RNA, 23 nt, Mycobacterium bovis subsp bovis AF2122/97
cgggugaccaggcggcgcggguc

SEQ ID NO: 1165995 - RNA, 19 nt, Mycobacterium bovis subsp bovis AF2122/97
cgggugacucgggcacggg

SEQ ID NO: 1165996 - RNA, 19 nt, Mycobacterium bovis subsp bovis AF2122/97
cgggugaaggaugcggccc

SEQ ID NO: 1165997 - RNA, 14 nt, Mycobacterium bovis subsp bovis AF2122/97
cgggucacuccggc

SEQ ID NO: 1165998 - RNA, 18 nt, Mycobacterium bovis subsp bovis AF2122/97
cgggucacuccggcggcu

SEQ ID NO: 1165999 - RNA, 14 nt, Mycobacterium bovis subsp bovis AF2122/97
cgggucagcccagc

SEQ ID NO: 1166000 - RNA, 13 nt, Mycobacterium bovis subsp bovis AF2122/97
cgggucagcccgg

SEQ ID NO: 1166001 - RNA, 21 nt, Mycobacterium bovis subsp bovis AF2122/97
cgggucagcgccgagagcacc

SEQ ID NO: 1166002 - RNA, 23 nt, Mycobacterium bovis subsp bovis AF2122/97
cgggucauccgugucgagaucuc

SEQ ID NO: 1166003 - RNA, 11 nt, Mycobacterium bovis subsp bovis AF2122/97
cggggcugccg

SEQ ID NO: 1166004 - RNA, 23 nt, Mycobacterium bovis subsp bovis AF2122/97
cggggcugggcgccaugcgccaa

SEQ ID NO: 1166005 - RNA, 16 nt, Mycobacterium bovis subsp bovis AF2122/97
cgggggaagcgcgucc

SEQ ID NO: 1166006 - RNA, 17 nt, Mycobacterium bovis subsp bovis AF2122/97
cgggggaccccgccagc

SEQ ID NO: 1166007 - RNA, 13 nt, Mycobacterium bovis subsp bovis AF2122/97
cgggggcagcgcg

SEQ ID NO: 1166008 - RNA, 20 nt, Mycobacterium bovis subsp bovis AF2122/97
cgggggaccccgccagccgg

SEQ ID NO: 1166009 - RNA, 16 nt, Mycobacterium bovis subsp bovis AF2122/97
cgggggccgagccgac

SEQ ID NO: 1166010 - RNA, 17 nt, Mycobacterium bovis subsp bovis AF2122/97
cgggguugggcggagca

SEQ ID NO: 1166011 - RNA, 14 nt, Mycobacterium bovis subsp bovis AF2122/97
cgggcugcagugac

SEQ ID NO: 1166012 - RNA, 21 nt, Mycobacterium bovis subsp bovis AF2122/97
cgggcugccccuccgggcgca

SEQ ID NO: 1166013 - RNA, 17 nt, Mycobacterium bovis subsp bovis AF2122/97
cgggcugccaaggccuu

SEQ ID NO: 1166014 - RNA, 23 nt, Mycobacterium bovis subsp bovis AF2122/97
cgggcugccgcaugcgcuccggc

SEQ ID NO: 1166015 - RNA, 13 nt, Mycobacterium bovis subsp bovis AF2122/97
cgggcugccgccc

SEQ ID NO: 1166016 - RNA, 22 nt, Mycobacterium bovis subsp bovis AF2122/97
cggggaagcccggcagaugcag

SEQ ID NO: 1166017 - RNA, 22 nt, Mycobacterium bovis subsp bovis AF2122/97
cggggaacgugacccccagcag

SEQ ID NO: 1166018 - RNA, 23 nt, Mycobacterium bovis subsp bovis AF2122/97
cgggcaugauccccguugaccca

SEQ ID NO: 1166019 - RNA, 14 nt, Mycobacterium bovis subsp bovis AF2122/97
cgggccacagcaac

SEQ ID NO: 1166020 - RNA, 20 nt, Mycobacterium bovis subsp bovis AF2122/97
cgggccaaugccguugaucg

SEQ ID NO: 1166021 - RNA, 13 nt, Mycobacterium bovis subsp bovis AF2122/97
cgggccagcaccu

SEQ ID NO: 1166022 - RNA, 18 nt, Mycobacterium bovis subsp bovis AF2122/97
cgggccaccacgcgccgc

SEQ ID NO: 1166023 - RNA, 18 nt, Mycobacterium bovis subsp bovis AF2122/97
cgggccacguccugcccg

SEQ ID NO: 1166024 - RNA, 19 nt, Mycobacterium bovis subsp bovis AF2122/97
cgggccacguccugcccgu

SEQ ID NO: 1166025 - RNA, 21 nt, Mycobacterium bovis subsp bovis AF2122/97
cgggcugaggcggcgacgacc

SEQ ID NO: 1166026 - RNA, 10 nt, Mycobacterium bovis subsp bovis AF2122/97
cgggcugcag

SEQ ID NO: 1166027 - RNA, 17 nt, Mycobacterium bovis subsp bovis AF2122/97
cggggcagcgggccgcc

SEQ ID NO: 1166028 - RNA, 18 nt, Mycobacterium bovis subsp bovis AF2122/97
cggggcagcgggccgccc

SEQ ID NO: 1166029 - RNA, 23 nt, Mycobacterium bovis subsp bovis AF2122/97
cggggccacaccugcgccaccug

SEQ ID NO: 1166030 - RNA, 14 nt, Mycobacterium bovis subsp bovis AF2122/97
cggggccgucggca

SEQ ID NO: 1166031 - RNA, 15 nt, Mycobacterium bovis subsp bovis AF2122/97
cggggccgccgcggc

SEQ ID NO: 1166032 - RNA, 15 nt, Mycobacterium bovis subsp bovis AF2122/97
cggggccgcaaccau

SEQ ID NO: 1166033 - RNA, 16 nt, Mycobacterium bovis subsp bovis AF2122/97
cggggccucgcgagaa

SEQ ID NO: 1166034 - RNA, 10 nt, Mycobacterium bovis subsp bovis AF2122/97
cggggccggu

SEQ ID NO: 1166035 - RNA, 15 nt, Mycobacterium bovis subsp bovis AF2122/97
cggggccgcggccca

SEQ ID NO: 1166036 - RNA, 18 nt, Mycobacterium bovis subsp bovis AF2122/97
cggggcaccacgccagcc

SEQ ID NO: 1166037 - RNA, 14 nt, Mycobacterium bovis subsp bovis AF2122/97
cggggcaaacgggg

SEQ ID NO: 1166038 - RNA, 21 nt, Mycobacterium bovis subsp bovis AF2122/97
cggggauguccgcggccacca

SEQ ID NO: 1166039 - RNA, 14 nt, Mycobacterium bovis subsp bovis AF2122/97
cggggaucggggca

SEQ ID NO: 1166040 - RNA, 18 nt, Mycobacterium bovis subsp bovis AF2122/97
cggggauguccgcggcca

SEQ ID NO: 1166041 - RNA, 20 nt, Mycobacterium bovis subsp bovis AF2122/97
cggggauaucacgacgccga

SEQ ID NO: 1166042 - RNA, 21 nt, Mycobacterium bovis subsp bovis AF2122/97
cggggacgccgcggcgccggu

SEQ ID NO: 1166043 - RNA, 16 nt, Mycobacterium bovis subsp bovis AF2122/97
cggggaccucggcgau

SEQ ID NO: 1166044 - RNA, 15 nt, Mycobacterium bovis subsp bovis AF2122/97
cggggacagcccggc

SEQ ID NO: 1166045 - RNA, 18 nt, Mycobacterium bovis subsp bovis AF2122/97
cggggacagcccggcaga

SEQ ID NO: 1166046 - RNA, 15 nt, Mycobacterium bovis subsp bovis AF2122/97
cgggcuggccgacuc

SEQ ID NO: 1166047 - RNA, 13 nt, Mycobacterium bovis subsp bovis AF2122/97
cggggacgcgccc

SEQ ID NO: 1166048 - RNA, 17 nt, Mycobacterium bovis subsp bovis AF2122/97
cggggacgcgccccagu

SEQ ID NO: 1166049 - RNA, 14 nt, Mycobacterium bovis subsp bovis AF2122/97
cggggacggcggca

SEQ ID NO: 1166050 - RNA, 15 nt, Mycobacterium bovis subsp bovis AF2122/97
cggggacggcggcaa

SEQ ID NO: 1166051 - RNA, 19 nt, Mycobacterium bovis subsp bovis AF2122/97
cggggacggcggcaagggc

SEQ ID NO: 1166052 - RNA, 14 nt, Mycobacterium bovis subsp bovis AF2122/97
cggggaccacgccg

SEQ ID NO: 1166053 - RNA, 21 nt, Mycobacterium bovis subsp bovis AF2122/97
cggggaguggaaacccgccga

SEQ ID NO: 1166054 - RNA, 18 nt, Mycobacterium bovis subsp bovis AF2122/97
cggggauaccggucagca

SEQ ID NO: 1166055 - RNA, 16 nt, Mycobacterium bovis subsp bovis AF2122/97
cggugccgaucagcag

SEQ ID NO: 1166056 - RNA, 14 nt, Mycobacterium bovis subsp bovis AF2122/97
cggugccgcagcag

SEQ ID NO: 1166057 - RNA, 13 nt, Mycobacterium bovis subsp bovis AF2122/97
cggugccgccgcc

SEQ ID NO: 1166058 - RNA, 14 nt, Mycobacterium bovis subsp bovis AF2122/97
cggugccgccgccg

SEQ ID NO: 1166059 - RNA, 16 nt, Mycobacterium bovis subsp bovis AF2122/97
cggugccgccgccggc

SEQ ID NO: 1166060 - RNA, 13 nt, Mycobacterium bovis subsp bovis AF2122/97
cggugccgcccgc

SEQ ID NO: 1166061 - RNA, 20 nt, Mycobacterium bovis subsp bovis AF2122/97
cggugccgccgcggccacca

SEQ ID NO: 1166062 - RNA, 15 nt, Mycobacterium bovis subsp bovis AF2122/97
cggugccgccgucga

SEQ ID NO: 1166063 - RNA, 18 nt, Mycobacterium bovis subsp bovis AF2122/97
cggugccgccguucccac

SEQ ID NO: 1166064 - RNA, 15 nt, Mycobacterium bovis subsp bovis AF2122/97
cggugccgccuccgc

SEQ ID NO: 1166065 - RNA, 15 nt, Mycobacterium bovis subsp bovis AF2122/97
cggugccgcggacgu

SEQ ID NO: 1166066 - RNA, 14 nt, Mycobacterium bovis subsp bovis AF2122/97
cggugccggccgca

SEQ ID NO: 1166067 - RNA, 12 nt, Mycobacterium bovis subsp bovis AF2122/97
cggugccgucga

SEQ ID NO: 1166068 - RNA, 17 nt, Mycobacterium bovis subsp bovis AF2122/97
cggugccgucgccgccc

SEQ ID NO: 1166069 - RNA, 15 nt, Mycobacterium bovis subsp bovis AF2122/97
cggugccguggugga

SEQ ID NO: 1166070 - RNA, 21 nt, Mycobacterium bovis subsp bovis AF2122/97
cggugccguuggagccgccac

SEQ ID NO: 1166071 - RNA, 13 nt, Mycobacterium bovis subsp bovis AF2122/97
cggugccugcagc

SEQ ID NO: 1166072 - RNA, 17 nt, Mycobacterium bovis subsp bovis AF2122/97
cggugcgauccugacca

SEQ ID NO: 1166073 - RNA, 15 nt, Mycobacterium bovis subsp bovis AF2122/97
cggugaucgggcagc

SEQ ID NO: 1166074 - RNA, 18 nt, Mycobacterium bovis subsp bovis AF2122/97
cggugaucgagguugacg

SEQ ID NO: 1166075 - RNA, 17 nt, Mycobacterium bovis subsp bovis AF2122/97
cggugaacggcagcacg

SEQ ID NO: 1166076 - RNA, 23 nt, Mycobacterium bovis subsp bovis AF2122/97
cggugaaucgaagcccggcggca

SEQ ID NO: 1166077 - RNA, 21 nt, Mycobacterium bovis subsp bovis AF2122/97
cggugagcucuucggacacag

SEQ ID NO: 1166078 - RNA, 16 nt, Mycobacterium bovis subsp bovis AF2122/97
cggugaguccgcugag

SEQ ID NO: 1166079 - RNA, 21 nt, Mycobacterium bovis subsp bovis AF2122/97
cggugaacugcuggccgaugu

SEQ ID NO: 1166080 - RNA, 20 nt, Mycobacterium bovis subsp bovis AF2122/97
cggugaacaccagcaggaag

SEQ ID NO: 1166081 - RNA, 18 nt, Mycobacterium bovis subsp bovis AF2122/97
cggugaaaaaggcgacuc

SEQ ID NO: 1166082 - RNA, 21 nt, Mycobacterium bovis subsp bovis AF2122/97
cggucuuggcgauccaggcca

SEQ ID NO: 1166083 - RNA, 19 nt, Mycobacterium bovis subsp bovis AF2122/97
cggucuugggcgcgggugc

SEQ ID NO: 1166084 - RNA, 13 nt, Mycobacterium bovis subsp bovis AF2122/97
cggucuuggugcu

SEQ ID NO: 1166085 - RNA, 18 nt, Mycobacterium bovis subsp bovis AF2122/97
cggucuugggcgcgggug

SEQ ID NO: 1166086 - RNA, 17 nt, Mycobacterium bovis subsp bovis AF2122/97
cggucugcuccaggcgc

SEQ ID NO: 1166087 - RNA, 18 nt, Mycobacterium bovis subsp bovis AF2122/97
cggucagcggauccaggc

SEQ ID NO: 1166088 - RNA, 22 nt, Mycobacterium bovis subsp bovis AF2122/97
cggucagcgggcacgccgccga

SEQ ID NO: 1166089 - RNA, 19 nt, Mycobacterium bovis subsp bovis AF2122/97
cggucagcggccaacccau

SEQ ID NO: 1166090 - RNA, 15 nt, Mycobacterium bovis subsp bovis AF2122/97
cggucugcuccaggc

SEQ ID NO: 1166091 - RNA, 16 nt, Mycobacterium bovis subsp bovis AF2122/97
cggucagccgcggggc

SEQ ID NO: 1166092 - RNA, 13 nt, Mycobacterium bovis subsp bovis AF2122/97
cggucagccgcgg

SEQ ID NO: 1166093 - RNA, 15 nt, Mycobacterium bovis subsp bovis AF2122/97
cggucagcgcggcgc

SEQ ID NO: 1166094 - RNA, 15 nt, Mycobacterium bovis subsp bovis AF2122/97
cggucagcagcgccg

SEQ ID NO: 1166095 - RNA, 17 nt, Mycobacterium bovis subsp bovis AF2122/97
cgguggcgccggggcgc

SEQ ID NO: 1166096 - RNA, 15 nt, Mycobacterium bovis subsp bovis AF2122/97
cgguggcgcggugcc

SEQ ID NO: 1166097 - RNA, 22 nt, Mycobacterium bovis subsp bovis AF2122/97
cgguggcgagguggucacgcag

SEQ ID NO: 1166098 - RNA, 14 nt, Mycobacterium bovis subsp bovis AF2122/97
cgguggcggcagca

SEQ ID NO: 1166099 - RNA, 18 nt, Mycobacterium bovis subsp bovis AF2122/97
cgguggcggcgagcagca

SEQ ID NO: 1166100 - RNA, 17 nt, Mycobacterium bovis subsp bovis AF2122/97
cggugcuguugcgcggu

SEQ ID NO: 1166101 - RNA, 16 nt, Mycobacterium bovis subsp bovis AF2122/97
cgguggaaacccugca

SEQ ID NO: 1166102 - RNA, 19 nt, Mycobacterium bovis subsp bovis AF2122/97
cgguggaagaguuggggca

SEQ ID NO: 1166103 - RNA, 15 nt, Mycobacterium bovis subsp bovis AF2122/97
cgguggacccggcgg

SEQ ID NO: 1166104 - RNA, 22 nt, Mycobacterium bovis subsp bovis AF2122/97
cgguggacgagccagaggugga

SEQ ID NO: 1166105 - RNA, 13 nt, Mycobacterium bovis subsp bovis AF2122/97
cggugcgcgcaga

SEQ ID NO: 1166106 - RNA, 19 nt, Mycobacterium bovis subsp bovis AF2122/97
cggugcgcagccagguguc

SEQ ID NO: 1166107 - RNA, 20 nt, Mycobacterium bovis subsp bovis AF2122/97
cggugcgcauggacaacagc

SEQ ID NO: 1166108 - RNA, 16 nt, Mycobacterium bovis subsp bovis AF2122/97
cggugcgcaccaccga

SEQ ID NO: 1166109 - RNA, 20 nt, Mycobacterium bovis subsp bovis AF2122/97
cggugcgcuggcggcgcagc

SEQ ID NO: 1166110 - RNA, 14 nt, Mycobacterium bovis subsp bovis AF2122/97
cggugcggaacacc

SEQ ID NO: 1166111 - RNA, 16 nt, Mycobacterium bovis subsp bovis AF2122/97
cggugcggaacaccgc

SEQ ID NO: 1166112 - RNA, 15 nt, Mycobacterium bovis subsp bovis AF2122/97
cggugcggcaacagc

SEQ ID NO: 1166113 - RNA, 21 nt, Mycobacterium bovis subsp bovis AF2122/97
cggugcggaacaccgcccggc

SEQ ID NO: 1166114 - RNA, 19 nt, Mycobacterium bovis subsp bovis AF2122/97
cggugcggacuucgauguc

SEQ ID NO: 1166115 - RNA, 14 nt, Mycobacterium bovis subsp bovis AF2122/97
cggugcggugcaca

SEQ ID NO: 1166116 - RNA, 14 nt, Mycobacterium bovis subsp bovis AF2122/97
cggugcguccggug

SEQ ID NO: 1166117 - RNA, 15 nt, Mycobacterium bovis subsp bovis AF2122/97
cggugcgggcuaggc

SEQ ID NO: 1166118 - RNA, 12 nt, Mycobacterium bovis subsp bovis AF2122/97
cgguguugauuc

SEQ ID NO: 1166119 - RNA, 18 nt, Mycobacterium bovis subsp bovis AF2122/97
cgguguugccgaagcccg

SEQ ID NO: 1166120 - RNA, 15 nt, Mycobacterium bovis subsp bovis AF2122/97
cgguguuccgcccag

SEQ ID NO: 1166121 - RNA, 13 nt, Mycobacterium bovis subsp bovis AF2122/97
cggugugcucgau

SEQ ID NO: 1166122 - RNA, 19 nt, Mycobacterium bovis subsp bovis AF2122/97
cggugugugcaagccgaac

SEQ ID NO: 1166123 - RNA, 23 nt, Mycobacterium bovis subsp bovis AF2122/97
cgguguguuccaacuccugcagc

SEQ ID NO: 1166124 - RNA, 18 nt, Mycobacterium bovis subsp bovis AF2122/97
cgguguuucgugccaugg

SEQ ID NO: 1166125 - RNA, 19 nt, Mycobacterium bovis subsp bovis AF2122/97
cgguguuucgugccauggu

SEQ ID NO: 1166126 - RNA, 19 nt, Mycobacterium bovis subsp bovis AF2122/97
cgguguugcucgccgucgu

SEQ ID NO: 1166127 - RNA, 22 nt, Mycobacterium bovis subsp bovis AF2122/97
cgguguuucgacguaaugcgcu

SEQ ID NO: 1166128 - RNA, 15 nt, Mycobacterium bovis subsp bovis AF2122/97
cgguguuggacacuc

SEQ ID NO: 1166129 - RNA, 19 nt, Mycobacterium bovis subsp bovis AF2122/97
cgguucauccacuccgcca

SEQ ID NO: 1166130 - RNA, 22 nt, Mycobacterium bovis subsp bovis AF2122/97
cgguucaccaugucggccaccc

SEQ ID NO: 1166131 - RNA, 13 nt, Mycobacterium bovis subsp bovis AF2122/97
cgguggugucggu

SEQ ID NO: 1166132 - RNA, 14 nt, Mycobacterium bovis subsp bovis AF2122/97
cggugguggccaug

SEQ ID NO: 1166133 - RNA, 18 nt, Mycobacterium bovis subsp bovis AF2122/97
cgguggugccggcgccgc

SEQ ID NO: 1166134 - RNA, 19 nt, Mycobacterium bovis subsp bovis AF2122/97
cgguggcugccacuuggac

SEQ ID NO: 1166135 - RNA, 16 nt, Mycobacterium bovis subsp bovis AF2122/97
cgguggugaccgcggg

SEQ ID NO: 1166136 - RNA, 17 nt, Mycobacterium bovis subsp bovis AF2122/97
cgguggugaccgcgggc

SEQ ID NO: 1166137 - RNA, 23 nt, Mycobacterium bovis subsp bovis AF2122/97
cgguggcgucgucggcgggcugc

SEQ ID NO: 1166138 - RNA, 23 nt, Mycobacterium bovis subsp bovis AF2122/97
cgguggcgugguggaaacugaug

SEQ ID NO: 1166139 - RNA, 19 nt, Mycobacterium bovis subsp bovis AF2122/97
cgguguaauugccgacgcu

SEQ ID NO: 1166140 - RNA, 19 nt, Mycobacterium bovis subsp bovis AF2122/97
cggugguuagguggcuggc

SEQ ID NO: 1166141 - RNA, 16 nt, Mycobacterium bovis subsp bovis AF2122/97
cggugguuccggcugg

SEQ ID NO: 1166142 - RNA, 16 nt, Mycobacterium bovis subsp bovis AF2122/97
cggugguuuggcgcgc

SEQ ID NO: 1166143 - RNA, 17 nt, Mycobacterium bovis subsp bovis AF2122/97
cgguguaacccuggcgg

SEQ ID NO: 1166144 - RNA, 16 nt, Mycobacterium bovis subsp bovis AF2122/97
cguaauagcugcgucc

SEQ ID NO: 1166145 - RNA, 21 nt, Mycobacterium bovis subsp bovis AF2122/97
cguaaggccggagucgacgac

SEQ ID NO: 1166146 - RNA, 13 nt, Mycobacterium bovis subsp bovis AF2122/97
cguaagcaccagc

SEQ ID NO: 1166147 - RNA, 23 nt, Mycobacterium bovis subsp bovis AF2122/97
cguaaauagcgcccugccauggg

SEQ ID NO: 1166148 - RNA, 13 nt, Mycobacterium bovis subsp bovis AF2122/97
cguaacagccggc

SEQ ID NO: 1166149 - RNA, 22 nt, Mycobacterium bovis subsp bovis AF2122/97
cgguucggagucacgcagccgc

SEQ ID NO: 1166150 - RNA, 23 nt, Mycobacterium bovis subsp bovis AF2122/97
cgguucgccccugcacagcaggc

SEQ ID NO: 1166151 - RNA, 13 nt, Mycobacterium bovis subsp bovis AF2122/97
cgguugacccaca

SEQ ID NO: 1166152 - RNA, 17 nt, Mycobacterium bovis subsp bovis AF2122/97
cgguugaucugucagcg

SEQ ID NO: 1166153 - RNA, 21 nt, Mycobacterium bovis subsp bovis AF2122/97
cgguugaugaucuuggugaag

SEQ ID NO: 1166154 - RNA, 14 nt, Mycobacterium bovis subsp bovis AF2122/97
cgguugauucgugc

SEQ ID NO: 1166155 - RNA, 17 nt, Mycobacterium bovis subsp bovis AF2122/97
cgguugauugugcccag

SEQ ID NO: 1166156 - RNA, 17 nt, Mycobacterium bovis subsp bovis AF2122/97
cgguugccacgccgccg

SEQ ID NO: 1166157 - RNA, 17 nt, Mycobacterium bovis subsp bovis AF2122/97
cguacaaccacccaccc

SEQ ID NO: 1166158 - RNA, 12 nt, Mycobacterium bovis subsp bovis AF2122/97
cguacagcgccu

SEQ ID NO: 1166159 - RNA, 21 nt, Mycobacterium bovis subsp bovis AF2122/97
cguacaggacgguugagaugg

SEQ ID NO: 1166160 - RNA, 15 nt, Mycobacterium bovis subsp bovis AF2122/97
cguaaucaagcagcg

SEQ ID NO: 1166161 - RNA, 21 nt, Mycobacterium bovis subsp bovis AF2122/97
cguaccgguggaaacccugca

SEQ ID NO: 1166162 - RNA, 13 nt, Mycobacterium bovis subsp bovis AF2122/97
cguaccgggcgag

SEQ ID NO: 1166163 - RNA, 18 nt, Mycobacterium bovis subsp bovis AF2122/97
cguacucggcauccaggc

SEQ ID NO: 1166164 - RNA, 18 nt, Mycobacterium bovis subsp bovis AF2122/97
cguacggggucgccggca

SEQ ID NO: 1166165 - RNA, 14 nt, Mycobacterium bovis subsp bovis AF2122/97
cguacgccggcggu

SEQ ID NO: 1166166 - RNA, 15 nt, Mycobacterium bovis subsp bovis AF2122/97
cguaccagcuggcca

SEQ ID NO: 1166167 - RNA, 21 nt, Mycobacterium bovis subsp bovis AF2122/97
cguacccguuaugcgccgccc

SEQ ID NO: 1166168 - RNA, 12 nt, Mycobacterium bovis subsp bovis AF2122/97
cguaccgacagg

SEQ ID NO: 1166169 - RNA, 17 nt, Mycobacterium bovis subsp bovis AF2122/97
cguacaucagcgcgaac

SEQ ID NO: 1166170 - RNA, 18 nt, Mycobacterium bovis subsp bovis AF2122/97
cccucgucgaucgccgcg

SEQ ID NO: 1166171 - RNA, 17 nt, Mycobacterium bovis subsp bovis AF2122/97
cccucguaauccacgcc

SEQ ID NO: 1166172 - RNA, 16 nt, Mycobacterium bovis subsp bovis AF2122/97
cccucuacacccggac

SEQ ID NO: 1166173 - RNA, 20 nt, Mycobacterium bovis subsp bovis AF2122/97
cccucguuaucgaccgccgc

SEQ ID NO: 1166174 - RNA, 14 nt, Mycobacterium bovis subsp bovis AF2122/97
cccucuagcgccuc

SEQ ID NO: 1166175 - RNA, 12 nt, Mycobacterium bovis subsp bovis AF2122/97
cccucggugcca

SEQ ID NO: 1166176 - RNA, 15 nt, Mycobacterium bovis subsp bovis AF2122/97
cccucggcgaccugg

SEQ ID NO: 1166177 - RNA, 12 nt, Mycobacterium bovis subsp bovis AF2122/97
ccccuggccgcc

SEQ ID NO: 1166178 - RNA, 14 nt, Mycobacterium bovis subsp bovis AF2122/97
ccccuggccgccgc

SEQ ID NO: 1166179 - RNA, 15 nt, Mycobacterium bovis subsp bovis AF2122/97
ccccuguugccccuc

SEQ ID NO: 1166180 - RNA, 21 nt, Mycobacterium bovis subsp bovis AF2122/97
ccccuguggacacggcgcugc

SEQ ID NO: 1166181 - RNA, 17 nt, Mycobacterium bovis subsp bovis AF2122/97
ccccuggccgccggcgc

SEQ ID NO: 1166182 - RNA, 14 nt, Mycobacterium bovis subsp bovis AF2122/97
cccugcacccgacc

SEQ ID NO: 1166183 - RNA, 20 nt, Mycobacterium bovis subsp bovis AF2122/97
cccugcacccagccgugccc

SEQ ID NO: 1166184 - RNA, 21 nt, Mycobacterium bovis subsp bovis AF2122/97
cccugcacccagccgugccca

SEQ ID NO: 1166185 - RNA, 12 nt, Mycobacterium bovis subsp bovis AF2122/97
cccugcacagca

SEQ ID NO: 1166186 - RNA, 14 nt, Mycobacterium bovis subsp bovis AF2122/97
cccugagcucccgc

SEQ ID NO: 1166187 - RNA, 19 nt, Mycobacterium bovis subsp bovis AF2122/97
cccugaugaucguccagcc

SEQ ID NO: 1166188 - RNA, 20 nt, Mycobacterium bovis subsp bovis AF2122/97
cccugaaaagggcuggucua

SEQ ID NO: 1166189 - RNA, 13 nt, Mycobacterium bovis subsp bovis AF2122/97
cccugacacccau

SEQ ID NO: 1166190 - RNA, 13 nt, Mycobacterium bovis subsp bovis AF2122/97
cccugacagcgag

SEQ ID NO: 1166191 - RNA, 19 nt, Mycobacterium bovis subsp bovis AF2122/97
cccugagcgaagugucgcu

SEQ ID NO: 1166192 - RNA, 20 nt, Mycobacterium bovis subsp bovis AF2122/97
cccugacccggagccgccag

SEQ ID NO: 1166193 - RNA, 22 nt, Mycobacterium bovis subsp bovis AF2122/97
cccuggauggcgcccugcgcca

SEQ ID NO: 1166194 - RNA, 20 nt, Mycobacterium bovis subsp bovis AF2122/97
cccuggccgcccagaccgcc

SEQ ID NO: 1166195 - RNA, 12 nt, Mycobacterium bovis subsp bovis AF2122/97
cccuggccgccg

SEQ ID NO: 1166196 - RNA, 16 nt, Mycobacterium bovis subsp bovis AF2122/97
cccuggccgccggccc

SEQ ID NO: 1166197 - RNA, 23 nt, Mycobacterium bovis subsp bovis AF2122/97
cccuggccgccggccccgccguu

SEQ ID NO: 1166198 - RNA, 19 nt, Mycobacterium bovis subsp bovis AF2122/97
cccuggccgccggcgccgc

SEQ ID NO: 1166199 - RNA, 14 nt, Mycobacterium bovis subsp bovis AF2122/97
cccuggccgcgccg

SEQ ID NO: 1166200 - RNA, 16 nt, Mycobacterium bovis subsp bovis AF2122/97
cccuggcgaccagccg

SEQ ID NO: 1166201 - RNA, 18 nt, Mycobacterium bovis subsp bovis AF2122/97
cccuggaaagggccgccg

SEQ ID NO: 1166202 - RNA, 17 nt, Mycobacterium bovis subsp bovis AF2122/97
cccugcuccucgcgggc

SEQ ID NO: 1166203 - RNA, 17 nt, Mycobacterium bovis subsp bovis AF2122/97
cccugcuggugucggcu

SEQ ID NO: 1166204 - RNA, 20 nt, Mycobacterium bovis subsp bovis AF2122/97
cccugcuggugucggcucga

SEQ ID NO: 1166205 - RNA, 14 nt, Mycobacterium bovis subsp bovis AF2122/97
cccugcuggcccaa

SEQ ID NO: 1166206 - RNA, 16 nt, Mycobacterium bovis subsp bovis AF2122/97
cccugcugcagggccu

SEQ ID NO: 1166207 - RNA, 21 nt, Mycobacterium bovis subsp bovis AF2122/97
cccugcgcgugcuuggcagcg

SEQ ID NO: 1166208 - RNA, 15 nt, Mycobacterium bovis subsp bovis AF2122/97
cccugcgcggccacc

SEQ ID NO: 1166209 - RNA, 14 nt, Mycobacterium bovis subsp bovis AF2122/97
cccugcgccgccac

SEQ ID NO: 1166210 - RNA, 13 nt, Mycobacterium bovis subsp bovis AF2122/97
cccugcgccucgg

SEQ ID NO: 1166211 - RNA, 20 nt, Mycobacterium bovis subsp bovis AF2122/97
cccugcgccucggcggccag

SEQ ID NO: 1166212 - RNA, 19 nt, Mycobacterium bovis subsp bovis AF2122/97
cccugcgccgccacagcac

SEQ ID NO: 1166213 - RNA, 19 nt, Mycobacterium bovis subsp bovis AF2122/97
cccugcgccacacccggca

SEQ ID NO: 1166214 - RNA, 13 nt, Mycobacterium bovis subsp bovis AF2122/97
cccugcgcagccg

SEQ ID NO: 1166215 - RNA, 16 nt, Mycobacterium bovis subsp bovis AF2122/97
cccugccgccggcccc

SEQ ID NO: 1166216 - RNA, 17 nt, Mycobacterium bovis subsp bovis AF2122/97
cccugccgccggccccg

SEQ ID NO: 1166217 - RNA, 18 nt, Mycobacterium bovis subsp bovis AF2122/97
cccugccgccggccccgc

SEQ ID NO: 1166218 - RNA, 19 nt, Mycobacterium bovis subsp bovis AF2122/97
cccugccgccggccccgcc

SEQ ID NO: 1166219 - RNA, 15 nt, Mycobacterium bovis subsp bovis AF2122/97
cccugcccggcccgc

SEQ ID NO: 1166220 - RNA, 16 nt, Mycobacterium bovis subsp bovis AF2122/97
cccugucaacgccgcg

SEQ ID NO: 1166221 - RNA, 13 nt, Mycobacterium bovis subsp bovis AF2122/97
cccugucgcgcac

SEQ ID NO: 1166222 - RNA, 23 nt, Mycobacterium bovis subsp bovis AF2122/97
cccuguucggcccuauggguucc

SEQ ID NO: 1166223 - RNA, 20 nt, Mycobacterium bovis subsp bovis AF2122/97
cccuguugccccuccagggg

SEQ ID NO: 1166224 - RNA, 15 nt, Mycobacterium bovis subsp bovis AF2122/97
cccugucgcgcaccg

SEQ ID NO: 1166225 - RNA, 15 nt, Mycobacterium bovis subsp bovis AF2122/97
cccugggcgccggcg

SEQ ID NO: 1166226 - RNA, 23 nt, Mycobacterium bovis subsp bovis AF2122/97
cccugggcgucgaccacgcaagg

SEQ ID NO: 1166227 - RNA, 14 nt, Mycobacterium bovis subsp bovis AF2122/97
cccuggcggcccgg

SEQ ID NO: 1166228 - RNA, 14 nt, Mycobacterium bovis subsp bovis AF2122/97
cccuggcgugugug

SEQ ID NO: 1166229 - RNA, 22 nt, Mycobacterium bovis subsp bovis AF2122/97
cccuggcgugugugcgccuccg

SEQ ID NO: 1166230 - RNA, 16 nt, Mycobacterium bovis subsp bovis AF2122/97
cccuggggguggcagc

SEQ ID NO: 1166231 - RNA, 23 nt, Mycobacterium bovis subsp bovis AF2122/97
cccuggggguggcagcgcggccg

SEQ ID NO: 1166232 - RNA, 14 nt, Mycobacterium bovis subsp bovis AF2122/97
cccugggguccagc

SEQ ID NO: 1166233 - RNA, 21 nt, Mycobacterium bovis subsp bovis AF2122/97
cccugguggucagucaccaac

SEQ ID NO: 1166234 - RNA, 17 nt, Mycobacterium bovis subsp bovis AF2122/97
cccuggugugccgcguu

SEQ ID NO: 1166235 - RNA, 15 nt, Mycobacterium bovis subsp bovis AF2122/97
cccugguccacccgu

SEQ ID NO: 1166236 - RNA, 18 nt, Mycobacterium bovis subsp bovis AF2122/97
cccuucagcgaagccggg

SEQ ID NO: 1166237 - RNA, 16 nt, Mycobacterium bovis subsp bovis AF2122/97
cccuucaaagcggccu

SEQ ID NO: 1166238 - RNA, 16 nt, Mycobacterium bovis subsp bovis AF2122/97
ccgaaccgcaaggccc

SEQ ID NO: 1166239 - RNA, 17 nt, Mycobacterium bovis subsp bovis AF2122/97
ccgaaccgacguucccc

SEQ ID NO: 1166240 - RNA, 23 nt, Mycobacterium bovis subsp bovis AF2122/97
ccgaaccgagggauggccguuga

SEQ ID NO: 1166241 - RNA, 15 nt, Mycobacterium bovis subsp bovis AF2122/97
ccgaagaaaacgaac

SEQ ID NO: 1166242 - RNA, 22 nt, Mycobacterium bovis subsp bovis AF2122/97
ccgaacagcugcccgccagcgc

SEQ ID NO: 1166243 - RNA, 18 nt, Mycobacterium bovis subsp bovis AF2122/97
ccgaacagcuggacggcc

SEQ ID NO: 1166244 - RNA, 13 nt, Mycobacterium bovis subsp bovis AF2122/97
ccgaacaggauga

SEQ ID NO: 1166245 - RNA, 14 nt, Mycobacterium bovis subsp bovis AF2122/97
ccgaacccacccau

SEQ ID NO: 1166246 - RNA, 17 nt, Mycobacterium bovis subsp bovis AF2122/97
ccgaaccaccaccggca

SEQ ID NO: 1166247 - RNA, 18 nt, Mycobacterium bovis subsp bovis AF2122/97
ccgaaccacgcgcccgca

SEQ ID NO: 1166248 - RNA, 16 nt, Mycobacterium bovis subsp bovis AF2122/97
ccgaacauucccaugc

SEQ ID NO: 1166249 - RNA, 12 nt, Mycobacterium bovis subsp bovis AF2122/97
ccgaagaugccu

SEQ ID NO: 1166250 - RNA, 16 nt, Mycobacterium bovis subsp bovis AF2122/97
ccgaagaugccuggaa

SEQ ID NO: 1166251 - RNA, 18 nt, Mycobacterium bovis subsp bovis AF2122/97
ccgaagagucgugccgcc

SEQ ID NO: 1166252 - RNA, 15 nt, Mycobacterium bovis subsp bovis AF2122/97
ccgaagagcgcgcgc

SEQ ID NO: 1166253 - RNA, 16 nt, Mycobacterium bovis subsp bovis AF2122/97
ccgaagagcgcgcgca

SEQ ID NO: 1166254 - RNA, 14 nt, Mycobacterium bovis subsp bovis AF2122/97
ccgaagcagaacag

SEQ ID NO: 1166255 - RNA, 14 nt, Mycobacterium bovis subsp bovis AF2122/97
ccgaaguacuggcc

SEQ ID NO: 1166256 - RNA, 17 nt, Mycobacterium bovis subsp bovis AF2122/97
ccgaaguacuggccgcc

SEQ ID NO: 1166257 - RNA, 19 nt, Mycobacterium bovis subsp bovis AF2122/97
ccgaaguagaagcccagga

SEQ ID NO: 1166258 - RNA, 22 nt, Mycobacterium bovis subsp bovis AF2122/97
ccgaaguacuggccgccgcgca

SEQ ID NO: 1166259 - RNA, 17 nt, Mycobacterium bovis subsp bovis AF2122/97
ccgaaguagaagcccag

SEQ ID NO: 1166260 - RNA, 22 nt, Mycobacterium bovis subsp bovis AF2122/97
ccgaaguccacgcaccacgagc

SEQ ID NO: 1166261 - RNA, 21 nt, Mycobacterium bovis subsp bovis AF2122/97
ccgaauaccacaccgugacca

SEQ ID NO: 1166262 - RNA, 17 nt, Mycobacterium bovis subsp bovis AF2122/97
ccgaaucagcacggugu

SEQ ID NO: 1166263 - RNA, 14 nt, Mycobacterium bovis subsp bovis AF2122/97
ccgaauccaccagc

SEQ ID NO: 1166264 - RNA, 17 nt, Mycobacterium bovis subsp bovis AF2122/97
ccgaaaauucaggcgcc

SEQ ID NO: 1166265 - RNA, 23 nt, Mycobacterium bovis subsp bovis AF2122/97
ccgaaaaccucgccccaccggcc

SEQ ID NO: 1166266 - RNA, 20 nt, Mycobacterium bovis subsp bovis AF2122/97
ccgaaaacgacaucaccacc

SEQ ID NO: 1166267 - RNA, 16 nt, Mycobacterium bovis subsp bovis AF2122/97
ccgaaaacugaccccc

SEQ ID NO: 1166268 - RNA, 15 nt, Mycobacterium bovis subsp bovis AF2122/97
ccgaaaaacaccagc

SEQ ID NO: 1166269 - RNA, 14 nt, Mycobacterium bovis subsp bovis AF2122/97
cccuugaccaugug

SEQ ID NO: 1166270 - RNA, 11 nt, Mycobacterium bovis subsp bovis AF2122/97
cccuugccgcc

SEQ ID NO: 1166271 - RNA, 14 nt, Mycobacterium bovis subsp bovis AF2122/97
cccuugccgccauu

SEQ ID NO: 1166272 - RNA, 16 nt, Mycobacterium bovis subsp bovis AF2122/97
cccuugccgcccgcuc

SEQ ID NO: 1166273 - RNA, 16 nt, Mycobacterium bovis subsp bovis AF2122/97
cccuugccgccggccc

SEQ ID NO: 1166274 - RNA, 18 nt, Mycobacterium bovis subsp bovis AF2122/97
cccuugccgccuuggccc

SEQ ID NO: 1166275 - RNA, 17 nt, Mycobacterium bovis subsp bovis AF2122/97
ccgcagggcaucggucu

SEQ ID NO: 1166276 - RNA, 12 nt, Mycobacterium bovis subsp bovis AF2122/97
ccgcaggccugu

SEQ ID NO: 1166277 - RNA, 13 nt, Mycobacterium bovis subsp bovis AF2122/97
ccgcaggucggcc

SEQ ID NO: 1166278 - RNA, 21 nt, Mycobacterium bovis subsp bovis AF2122/97
ccgcaggucggccaccugcuc

SEQ ID NO: 1166279 - RNA, 16 nt, Mycobacterium bovis subsp bovis AF2122/97
ccgcagucgcggcaga

SEQ ID NO: 1166280 - RNA, 22 nt, Mycobacterium bovis subsp bovis AF2122/97
ccgcagcccaaaucccagagca

SEQ ID NO: 1166281 - RNA, 15 nt, Mycobacterium bovis subsp bovis AF2122/97
ccgcagccagaucuc

SEQ ID NO: 1166282 - RNA, 19 nt, Mycobacterium bovis subsp bovis AF2122/97
ccgcagccagaucuccccg

SEQ ID NO: 1166283 - RNA, 23 nt, Mycobacterium bovis subsp bovis AF2122/97
ccgcagcuuuaaucguggcacug

SEQ ID NO: 1166284 - RNA, 16 nt, Mycobacterium bovis subsp bovis AF2122/97
ccgcagcucgaccagg

SEQ ID NO: 1166285 - RNA, 15 nt, Mycobacterium bovis subsp bovis AF2122/97
ccgcagcgugaucug

SEQ ID NO: 1166286 - RNA, 18 nt, Mycobacterium bovis subsp bovis AF2122/97
ccgcagcgugaucuggcc

SEQ ID NO: 1166287 - RNA, 21 nt, Mycobacterium bovis subsp bovis AF2122/97
ccgcagcccgccgggcuccac

SEQ ID NO: 1166288 - RNA, 20 nt, Mycobacterium bovis subsp bovis AF2122/97
ccgcagccccgacaguugug

SEQ ID NO: 1166289 - RNA, 16 nt, Mycobacterium bovis subsp bovis AF2122/97
ccgcagcccgugacug

SEQ ID NO: 1166290 - RNA, 20 nt, Mycobacterium bovis subsp bovis AF2122/97
ccgcaaguucacccaucauc

SEQ ID NO: 1166291 - RNA, 13 nt, Mycobacterium bovis subsp bovis AF2122/97
ccgcaaggaccug

SEQ ID NO: 1166292 - RNA, 14 nt, Mycobacterium bovis subsp bovis AF2122/97
ccgcaagaaucagc

SEQ ID NO: 1166293 - RNA, 17 nt, Mycobacterium bovis subsp bovis AF2122/97
ccgcaccaccggcccca

SEQ ID NO: 1166294 - RNA, 22 nt, Mycobacterium bovis subsp bovis AF2122/97
ccgcaccacaccgugggcgacg

SEQ ID NO: 1166295 - RNA, 16 nt, Mycobacterium bovis subsp bovis AF2122/97
ccgcaauacccgagcg

SEQ ID NO: 1166296 - RNA, 17 nt, Mycobacterium bovis subsp bovis AF2122/97
ccgcaccaguggcgccc

SEQ ID NO: 1166297 - RNA, 16 nt, Mycobacterium bovis subsp bovis AF2122/97
ccgcaccagcugucgg

SEQ ID NO: 1166298 - RNA, 16 nt, Mycobacterium bovis subsp bovis AF2122/97
ccgcaccccggccgcg

SEQ ID NO: 1166299 - RNA, 10 nt, Mycobacterium bovis subsp bovis AF2122/97
ccgcaccacc

SEQ ID NO: 1166300 - RNA, 19 nt, Mycobacterium bovis subsp bovis AF2122/97
ccgcaccagaucgucgggc

SEQ ID NO: 1166301 - RNA, 15 nt, Mycobacterium bovis subsp bovis AF2122/97
ccgcaccagucgcgc

SEQ ID NO: 1166302 - RNA, 14 nt, Mycobacterium bovis subsp bovis AF2122/97
ccgcaccaguggcg

SEQ ID NO: 1166303 - RNA, 13 nt, Mycobacterium bovis subsp bovis AF2122/97
ccgcacugccgcc

SEQ ID NO: 1166304 - RNA, 12 nt, Mycobacterium bovis subsp bovis AF2122/97
ccgcacuccacg

SEQ ID NO: 1166305 - RNA, 21 nt, Mycobacterium bovis subsp bovis AF2122/97
ccgcacucggucgggggugcu

SEQ ID NO: 1166306 - RNA, 14 nt, Mycobacterium bovis subsp bovis AF2122/97
ccgcacccgcuccc

SEQ ID NO: 1166307 - RNA, 14 nt, Mycobacterium bovis subsp bovis AF2122/97
ccgcacggugacca

SEQ ID NO: 1166308 - RNA, 22 nt, Mycobacterium bovis subsp bovis AF2122/97
ccgcacuuucuuccucggggcu

SEQ ID NO: 1166309 - RNA, 19 nt, Mycobacterium bovis subsp bovis AF2122/97
ccgcacuugaucgacggcc

SEQ ID NO: 1166310 - RNA, 19 nt, Mycobacterium bovis subsp bovis AF2122/97
ccgcacguauccacggucg

SEQ ID NO: 1166311 - RNA, 14 nt, Mycobacterium bovis subsp bovis AF2122/97
ccgaucugcuccuc

SEQ ID NO: 1166312 - RNA, 15 nt, Mycobacterium bovis subsp bovis AF2122/97
ccgaucugcugucgg

SEQ ID NO: 1166313 - RNA, 19 nt, Mycobacterium bovis subsp bovis AF2122/97
ccgaucucgaccagcgccg

SEQ ID NO: 1166314 - RNA, 16 nt, Mycobacterium bovis subsp bovis AF2122/97
ccgaucuuggccaccg

SEQ ID NO: 1166315 - RNA, 22 nt, Mycobacterium bovis subsp bovis AF2122/97
ccgaugacgaucggcggcgcgc

SEQ ID NO: 1166316 - RNA, 16 nt, Mycobacterium bovis subsp bovis AF2122/97
ccgaugaagccaagaa

SEQ ID NO: 1166317 - RNA, 15 nt, Mycobacterium bovis subsp bovis AF2122/97
ccgaugacccacugc

SEQ ID NO: 1166318 - RNA, 19 nt, Mycobacterium bovis subsp bovis AF2122/97
ccgaugacccacugcaggc

SEQ ID NO: 1166319 - RNA, 15 nt, Mycobacterium bovis subsp bovis AF2122/97
ccgaugacggucccc

SEQ ID NO: 1166320 - RNA, 21 nt, Mycobacterium bovis subsp bovis AF2122/97
ccgaugacgguccccaggucg

SEQ ID NO: 1166321 - RNA, 13 nt, Mycobacterium bovis subsp bovis AF2122/97
ccgaugaccugcc

SEQ ID NO: 1166322 - RNA, 13 nt, Mycobacterium bovis subsp bovis AF2122/97
ccgaugccacauc

SEQ ID NO: 1166323 - RNA, 17 nt, Mycobacterium bovis subsp bovis AF2122/97
ccgaugaucucacccag

SEQ ID NO: 1166324 - RNA, 21 nt, Mycobacterium bovis subsp bovis AF2122/97
ccgaugacuacuccugagaug

SEQ ID NO: 1166325 - RNA, 16 nt, Mycobacterium bovis subsp bovis AF2122/97
ccgaugagcccagccg

SEQ ID NO: 1166326 - RNA, 21 nt, Mycobacterium bovis subsp bovis AF2122/97
ccgaugguggugccaaccugg

SEQ ID NO: 1166327 - RNA, 18 nt, Mycobacterium bovis subsp bovis AF2122/97
ccgaugugggcgccgucg

SEQ ID NO: 1166328 - RNA, 19 nt, Mycobacterium bovis subsp bovis AF2122/97
ccgaugccuugaccgcggu

SEQ ID NO: 1166329 - RNA, 13 nt, Mycobacterium bovis subsp bovis AF2122/97
ccgaugccgccgg

SEQ ID NO: 1166330 - RNA, 15 nt, Mycobacterium bovis subsp bovis AF2122/97
ccgaugccgccggcc

SEQ ID NO: 1166331 - RNA, 18 nt, Mycobacterium bovis subsp bovis AF2122/97
ccgauugcguucaucauc

SEQ ID NO: 1166332 - RNA, 23 nt, Mycobacterium bovis subsp bovis AF2122/97
ccgauucagcgccccaugcaaca

SEQ ID NO: 1166333 - RNA, 19 nt, Mycobacterium bovis subsp bovis AF2122/97
ccgauggugccgacccgcc

SEQ ID NO: 1166334 - RNA, 23 nt, Mycobacterium bovis subsp bovis AF2122/97
ccgauguuggcagggccagcggc

SEQ ID NO: 1166335 - RNA, 13 nt, Mycobacterium bovis subsp bovis AF2122/97
ccgauuucccagc

SEQ ID NO: 1166336 - RNA, 21 nt, Mycobacterium bovis subsp bovis AF2122/97
ccgauuuauccggaucggccu

SEQ ID NO: 1166337 - RNA, 14 nt, Mycobacterium bovis subsp bovis AF2122/97
ccgauuuugggauc

SEQ ID NO: 1166338 - RNA, 18 nt, Mycobacterium bovis subsp bovis AF2122/97
ccgcaacgcgucggucgc

SEQ ID NO: 1166339 - RNA, 17 nt, Mycobacterium bovis subsp bovis AF2122/97
ccgcaagaaucagcagc

SEQ ID NO: 1166340 - RNA, 16 nt, Mycobacterium bovis subsp bovis AF2122/97
ccgcaacucgccgaaa

SEQ ID NO: 1166341 - RNA, 16 nt, Mycobacterium bovis subsp bovis AF2122/97
ccgcaacagcucggcc

SEQ ID NO: 1166342 - RNA, 19 nt, Mycobacterium bovis subsp bovis AF2122/97
ccgcaacagcucggccagg

SEQ ID NO: 1166343 - RNA, 19 nt, Mycobacterium bovis subsp bovis AF2122/97
ccgcaacauuuucgcccgc

SEQ ID NO: 1166344 - RNA, 15 nt, Mycobacterium bovis subsp bovis AF2122/97
ccgagggcgucgccg

SEQ ID NO: 1166345 - RNA, 16 nt, Mycobacterium bovis subsp bovis AF2122/97
ccgagggcgucgccgc

SEQ ID NO: 1166346 - RNA, 16 nt, Mycobacterium bovis subsp bovis AF2122/97
ccgagguaacgcagcg

SEQ ID NO: 1166347 - RNA, 19 nt, Mycobacterium bovis subsp bovis AF2122/97
ccgaggggagugucagcgc

SEQ ID NO: 1166348 - RNA, 18 nt, Mycobacterium bovis subsp bovis AF2122/97
ccgagggcgucgccgccg

SEQ ID NO: 1166349 - RNA, 22 nt, Mycobacterium bovis subsp bovis AF2122/97
ccgaggguagacggggcgagca

SEQ ID NO: 1166350 - RNA, 15 nt, Mycobacterium bovis subsp bovis AF2122/97
ccgaggcucgggccg

SEQ ID NO: 1166351 - RNA, 21 nt, Mycobacterium bovis subsp bovis AF2122/97
ccgaggcggucuuguccagga

SEQ ID NO: 1166352 - RNA, 21 nt, Mycobacterium bovis subsp bovis AF2122/97
ccgagcuucagcgcgcugcag

SEQ ID NO: 1166353 - RNA, 18 nt, Mycobacterium bovis subsp bovis AF2122/97
ccgagcuuggccgccgcc

SEQ ID NO: 1166354 - RNA, 19 nt, Mycobacterium bovis subsp bovis AF2122/97
ccgagcuuggccgccgcca

SEQ ID NO: 1166355 - RNA, 19 nt, Mycobacterium bovis subsp bovis AF2122/97
ccgaggaaaccaccagugg

SEQ ID NO: 1166356 - RNA, 17 nt, Mycobacterium bovis subsp bovis AF2122/97
ccgagccguugcgccuc

SEQ ID NO: 1166357 - RNA, 13 nt, Mycobacterium bovis subsp bovis AF2122/97
ccgagccuggauc

SEQ ID NO: 1166358 - RNA, 16 nt, Mycobacterium bovis subsp bovis AF2122/97
ccgagccguccaagcc

SEQ ID NO: 1166359 - RNA, 22 nt, Mycobacterium bovis subsp bovis AF2122/97
ccgagccgcuaggacggcgcga

SEQ ID NO: 1166360 - RNA, 21 nt, Mycobacterium bovis subsp bovis AF2122/97
ccgagccgguauacccggccc

SEQ ID NO: 1166361 - RNA, 22 nt, Mycobacterium bovis subsp bovis AF2122/97
ccgagccgguauacccggcccc

SEQ ID NO: 1166362 - RNA, 23 nt, Mycobacterium bovis subsp bovis AF2122/97
ccgagcugguuggcgccgaaaag

SEQ ID NO: 1166363 - RNA, 19 nt, Mycobacterium bovis subsp bovis AF2122/97
ccgagcuggcaacgccgcg

SEQ ID NO: 1166364 - RNA, 18 nt, Mycobacterium bovis subsp bovis AF2122/97
ccgagcugauccgggugg

SEQ ID NO: 1166365 - RNA, 16 nt, Mycobacterium bovis subsp bovis AF2122/97
ccgagcucgccgcagc

SEQ ID NO: 1166366 - RNA, 19 nt, Mycobacterium bovis subsp bovis AF2122/97
ccgagcugagcggccagca

SEQ ID NO: 1166367 - RNA, 15 nt, Mycobacterium bovis subsp bovis AF2122/97
ccgagcucggcgccc

SEQ ID NO: 1166368 - RNA, 22 nt, Mycobacterium bovis subsp bovis AF2122/97
ccgagcucacuucacgccgccc

SEQ ID NO: 1166369 - RNA, 21 nt, Mycobacterium bovis subsp bovis AF2122/97
ccgagcucuuggagcuuggcc

SEQ ID NO: 1166370 - RNA, 20 nt, Mycobacterium bovis subsp bovis AF2122/97
ccgaucgggcccaccgcugc

SEQ ID NO: 1166371 - RNA, 15 nt, Mycobacterium bovis subsp bovis AF2122/97
ccgaucggcaggccg

SEQ ID NO: 1166372 - RNA, 14 nt, Mycobacterium bovis subsp bovis AF2122/97
ccgaucggcgcgcc

SEQ ID NO: 1166373 - RNA, 15 nt, Mycobacterium bovis subsp bovis AF2122/97
ccgaucggcgcgccg

SEQ ID NO: 1166374 - RNA, 20 nt, Mycobacterium bovis subsp bovis AF2122/97
ccgaucaucauauccgcccc

SEQ ID NO: 1166375 - RNA, 18 nt, Mycobacterium bovis subsp bovis AF2122/97
ccgaucacgcuggguggg

SEQ ID NO: 1166376 - RNA, 15 nt, Mycobacterium bovis subsp bovis AF2122/97
ccgaucaccccgguc

SEQ ID NO: 1166377 - RNA, 13 nt, Mycobacterium bovis subsp bovis AF2122/97
ccgaucagcagcu

SEQ ID NO: 1166378 - RNA, 16 nt, Mycobacterium bovis subsp bovis AF2122/97
ccgaucagcccggccu

SEQ ID NO: 1166379 - RNA, 13 nt, Mycobacterium bovis subsp bovis AF2122/97
ccgaucagcgacg

SEQ ID NO: 1166380 - RNA, 20 nt, Mycobacterium bovis subsp bovis AF2122/97
ccgaguugcccgggucggcc

SEQ ID NO: 1166381 - RNA, 18 nt, Mycobacterium bovis subsp bovis AF2122/97
ccgaguggccggugggcc

SEQ ID NO: 1166382 - RNA, 21 nt, Mycobacterium bovis subsp bovis AF2122/97
ccgaguggccggugggccgcc

SEQ ID NO: 1166383 - RNA, 16 nt, Mycobacterium bovis subsp bovis AF2122/97
ccgagucucgucgggu

SEQ ID NO: 1166384 - RNA, 17 nt, Mycobacterium bovis subsp bovis AF2122/97
ccgagugaccagggugg

SEQ ID NO: 1166385 - RNA, 17 nt, Mycobacterium bovis subsp bovis AF2122/97
ccgauaaaaaccacccc

SEQ ID NO: 1166386 - RNA, 20 nt, Mycobacterium bovis subsp bovis AF2122/97
ccgagacuugcuggcccgca

SEQ ID NO: 1166387 - RNA, 14 nt, Mycobacterium bovis subsp bovis AF2122/97
ccgagagcaccgcu

SEQ ID NO: 1166388 - RNA, 22 nt, Mycobacterium bovis subsp bovis AF2122/97
ccgagcaacaccccuggguuga

SEQ ID NO: 1166389 - RNA, 21 nt, Mycobacterium bovis subsp bovis AF2122/97
ccgagcaacaccgucggcagc

SEQ ID NO: 1166390 - RNA, 17 nt, Mycobacterium bovis subsp bovis AF2122/97
ccgagcccuccagggcc

SEQ ID NO: 1166391 - RNA, 19 nt, Mycobacterium bovis subsp bovis AF2122/97
ccgagcacgacgacgucgg

SEQ ID NO: 1166392 - RNA, 16 nt, Mycobacterium bovis subsp bovis AF2122/97
ccgagcaccccagggg

SEQ ID NO: 1166393 - RNA, 16 nt, Mycobacterium bovis subsp bovis AF2122/97
ccgagcaacggcggca

SEQ ID NO: 1166394 - RNA, 15 nt, Mycobacterium bovis subsp bovis AF2122/97
ccgagaagugggcgg

SEQ ID NO: 1166395 - RNA, 16 nt, Mycobacterium bovis subsp bovis AF2122/97
ccgagaauuccccagc

SEQ ID NO: 1166396 - RNA, 12 nt, Mycobacterium bovis subsp bovis AF2122/97
ccgagacaccac

SEQ ID NO: 1166397 - RNA, 21 nt, Mycobacterium bovis subsp bovis AF2122/97
ccgagaacgcccgagugacca

SEQ ID NO: 1166398 - RNA, 22 nt, Mycobacterium bovis subsp bovis AF2122/97
ccgagaagcccaccgucugcug

SEQ ID NO: 1166399 - RNA, 14 nt, Mycobacterium bovis subsp bovis AF2122/97
ccgagaacaccggc

SEQ ID NO: 1166400 - RNA, 14 nt, Mycobacterium bovis subsp bovis AF2122/97
ccgacuaucggccg

SEQ ID NO: 1166401 - RNA, 19 nt, Mycobacterium bovis subsp bovis AF2122/97
ccgacucaucggccgcggu

SEQ ID NO: 1166402 - RNA, 14 nt, Mycobacterium bovis subsp bovis AF2122/97
ccgacgccccgauc

SEQ ID NO: 1166403 - RNA, 16 nt, Mycobacterium bovis subsp bovis AF2122/97
ccgacgccgccggcgc

SEQ ID NO: 1166404 - RNA, 21 nt, Mycobacterium bovis subsp bovis AF2122/97
ccgacgccgccggcgccaccg

SEQ ID NO: 1166405 - RNA, 20 nt, Mycobacterium bovis subsp bovis AF2122/97
ccgacgcccaggcauggccu

SEQ ID NO: 1166406 - RNA, 16 nt, Mycobacterium bovis subsp bovis AF2122/97
ccgacgccaccgccac

SEQ ID NO: 1166407 - RNA, 18 nt, Mycobacterium bovis subsp bovis AF2122/97
ccgacgccugggcacggc

SEQ ID NO: 1166408 - RNA, 22 nt, Mycobacterium bovis subsp bovis AF2122/97
ccgacgccugggcacggccguc

SEQ ID NO: 1166409 - RNA, 13 nt, Mycobacterium bovis subsp bovis AF2122/97
ccgacgccggugg

SEQ ID NO: 1166410 - RNA, 12 nt, Mycobacterium bovis subsp bovis AF2122/97
ccgacgccgccg

SEQ ID NO: 1166411 - RNA, 20 nt, Mycobacterium bovis subsp bovis AF2122/97
ccgacgcgcucggcgaucug

SEQ ID NO: 1166412 - RNA, 14 nt, Mycobacterium bovis subsp bovis AF2122/97
ccgacgccgguggg

SEQ ID NO: 1166413 - RNA, 16 nt, Mycobacterium bovis subsp bovis AF2122/97
ccgacgcgcggccagc

SEQ ID NO: 1166414 - RNA, 22 nt, Mycobacterium bovis subsp bovis AF2122/97
ccgacggugaugggggagccgg

SEQ ID NO: 1166415 - RNA, 14 nt, Mycobacterium bovis subsp bovis AF2122/97
ccgacgcggacagg

SEQ ID NO: 1166416 - RNA, 18 nt, Mycobacterium bovis subsp bovis AF2122/97
ccgacgguguagccgccg

SEQ ID NO: 1166417 - RNA, 19 nt, Mycobacterium bovis subsp bovis AF2122/97
ccgacgguguagccgccgg

SEQ ID NO: 1166418 - RNA, 17 nt, Mycobacterium bovis subsp bovis AF2122/97
ccgacguauagaccagg

SEQ ID NO: 1166419 - RNA, 22 nt, Mycobacterium bovis subsp bovis AF2122/97
ccgacgucaggcagcuccgccg

SEQ ID NO: 1166420 - RNA, 15 nt, Mycobacterium bovis subsp bovis AF2122/97
ccgacgucgccgacg

SEQ ID NO: 1166421 - RNA, 20 nt, Mycobacterium bovis subsp bovis AF2122/97
ccgacgucgaccacugcccg

SEQ ID NO: 1166422 - RNA, 18 nt, Mycobacterium bovis subsp bovis AF2122/97
ccgacgucgaccacugcc

SEQ ID NO: 1166423 - RNA, 22 nt, Mycobacterium bovis subsp bovis AF2122/97
ccgacgucgcggaguagccgca

SEQ ID NO: 1166424 - RNA, 18 nt, Mycobacterium bovis subsp bovis AF2122/97
ccgacguggccagcccgc

SEQ ID NO: 1166425 - RNA, 20 nt, Mycobacterium bovis subsp bovis AF2122/97
ccgacguggccagcccgccc

SEQ ID NO: 1166426 - RNA, 14 nt, Mycobacterium bovis subsp bovis AF2122/97
ccgacgacgcgcgc

SEQ ID NO: 1166427 - RNA, 14 nt, Mycobacterium bovis subsp bovis AF2122/97
ccgacgaacugcag

SEQ ID NO: 1166428 - RNA, 22 nt, Mycobacterium bovis subsp bovis AF2122/97
ccgacgagauacggccaccagg

SEQ ID NO: 1166429 - RNA, 15 nt, Mycobacterium bovis subsp bovis AF2122/97
ccgacgaggaugucg

SEQ ID NO: 1166430 - RNA, 15 nt, Mycobacterium bovis subsp bovis AF2122/97
ccgacgagucgccgc

SEQ ID NO: 1166431 - RNA, 19 nt, Mycobacterium bovis subsp bovis AF2122/97
ccgacgacggcgacggcgc

SEQ ID NO: 1166432 - RNA, 17 nt, Mycobacterium bovis subsp bovis AF2122/97
ccgacgaucgacgccgc

SEQ ID NO: 1166433 - RNA, 19 nt, Mycobacterium bovis subsp bovis AF2122/97
ccgacgaucgacgccgcca

SEQ ID NO: 1166434 - RNA, 17 nt, Mycobacterium bovis subsp bovis AF2122/97
ccgacgaugcgggcgau

SEQ ID NO: 1166435 - RNA, 19 nt, Mycobacterium bovis subsp bovis AF2122/97
ccgacgaugugcacggugu

SEQ ID NO: 1166436 - RNA, 19 nt, Mycobacterium bovis subsp bovis AF2122/97
ccgaccuuuugcggcaagc

SEQ ID NO: 1166437 - RNA, 12 nt, Mycobacterium bovis subsp bovis AF2122/97
ccgacgaccagc

SEQ ID NO: 1166438 - RNA, 18 nt, Mycobacterium bovis subsp bovis AF2122/97
ccgaaucggcaccgugcg

SEQ ID NO: 1166439 - RNA, 20 nt, Mycobacterium bovis subsp bovis AF2122/97
ccgaaucugccggccggcgg

SEQ ID NO: 1166440 - RNA, 19 nt, Mycobacterium bovis subsp bovis AF2122/97
ccgaccuguaugccgcggu

SEQ ID NO: 1166441 - RNA, 14 nt, Mycobacterium bovis subsp bovis AF2122/97
ccgaaucucaccgu

SEQ ID NO: 1166442 - RNA, 16 nt, Mycobacterium bovis subsp bovis AF2122/97
ccgaccuucggcccgc

SEQ ID NO: 1166443 - RNA, 14 nt, Mycobacterium bovis subsp bovis AF2122/97
ccgccggccccgcc

SEQ ID NO: 1166444 - RNA, 15 nt, Mycobacterium bovis subsp bovis AF2122/97
ccgccggccccgcca

SEQ ID NO: 1166445 - RNA, 15 nt, Mycobacterium bovis subsp bovis AF2122/97
ccgccggccccgccg

SEQ ID NO: 1166446 - RNA, 15 nt, Mycobacterium bovis subsp bovis AF2122/97
ccgccggccgccagc

SEQ ID NO: 1166447 - RNA, 18 nt, Mycobacterium bovis subsp bovis AF2122/97
ccgccggccgucggccgg

SEQ ID NO: 1166448 - RNA, 15 nt, Mycobacterium bovis subsp bovis AF2122/97
ccgccggcgccaccc

SEQ ID NO: 1166449 - RNA, 17 nt, Mycobacterium bovis subsp bovis AF2122/97
ccgccggcgccacccgc

SEQ ID NO: 1166450 - RNA, 19 nt, Mycobacterium bovis subsp bovis AF2122/97
ccgccggcgccaccgucgc

SEQ ID NO: 1166451 - RNA, 14 nt, Mycobacterium bovis subsp bovis AF2122/97
ccgccggcgccagc

SEQ ID NO: 1166452 - RNA, 19 nt, Mycobacterium bovis subsp bovis AF2122/97
ccgccggcgccagcgccgc

SEQ ID NO: 1166453 - RNA, 15 nt, Mycobacterium bovis subsp bovis AF2122/97
ccgccggcgcccagg

SEQ ID NO: 1166454 - RNA, 18 nt, Mycobacterium bovis subsp bovis AF2122/97
ccgccggcgcccaggccg

SEQ ID NO: 1166455 - RNA, 12 nt, Mycobacterium bovis subsp bovis AF2122/97
ccgccggcgccg

SEQ ID NO: 1166456 - RNA, 15 nt, Mycobacterium bovis subsp bovis AF2122/97
ccgccggcgccgccg

SEQ ID NO: 1166457 - RNA, 18 nt, Mycobacterium bovis subsp bovis AF2122/97
ccgccggcgccgccgaug

SEQ ID NO: 1166458 - RNA, 14 nt, Mycobacterium bovis subsp bovis AF2122/97
ccgccggcgccggc

SEQ ID NO: 1166459 - RNA, 18 nt, Mycobacterium bovis subsp bovis AF2122/97
ccgccggcgccggugccg

SEQ ID NO: 1166460 - RNA, 14 nt, Mycobacterium bovis subsp bovis AF2122/97
ccgccggcggcggc

SEQ ID NO: 1166461 - RNA, 15 nt, Mycobacterium bovis subsp bovis AF2122/97
ccgccgggccaggcc

SEQ ID NO: 1166462 - RNA, 21 nt, Mycobacterium bovis subsp bovis AF2122/97
ccgccggcuccggcggugccg

SEQ ID NO: 1166463 - RNA, 12 nt, Mycobacterium bovis subsp bovis AF2122/97
ccgccggcugcg

SEQ ID NO: 1166464 - RNA, 13 nt, Mycobacterium bovis subsp bovis AF2122/97
ccgccggccaguc

SEQ ID NO: 1166465 - RNA, 14 nt, Mycobacterium bovis subsp bovis AF2122/97
ccgccggccccacc

SEQ ID NO: 1166466 - RNA, 21 nt, Mycobacterium bovis subsp bovis AF2122/97
ccgccggcagugagucgguga

SEQ ID NO: 1166467 - RNA, 14 nt, Mycobacterium bovis subsp bovis AF2122/97
ccgccggaguuggu

SEQ ID NO: 1166468 - RNA, 21 nt, Mycobacterium bovis subsp bovis AF2122/97
ccgccggcaauaccgccagcg

SEQ ID NO: 1166469 - RNA, 23 nt, Mycobacterium bovis subsp bovis AF2122/97
ccgccggcaauaccgccagcgcc

SEQ ID NO: 1166470 - RNA, 16 nt, Mycobacterium bovis subsp bovis AF2122/97
ccgccggcaccgccgc

SEQ ID NO: 1166471 - RNA, 19 nt, Mycobacterium bovis subsp bovis AF2122/97
ccgccggcaccgccgcccc

SEQ ID NO: 1166472 - RNA, 15 nt, Mycobacterium bovis subsp bovis AF2122/97
ccgccggaaucgaga

SEQ ID NO: 1166473 - RNA, 15 nt, Mycobacterium bovis subsp bovis AF2122/97
ccgccggacccaccg

SEQ ID NO: 1166474 - RNA, 15 nt, Mycobacterium bovis subsp bovis AF2122/97
ccgccggaccgccgc

SEQ ID NO: 1166475 - RNA, 15 nt, Mycobacterium bovis subsp bovis AF2122/97
ccgccgcugccgccg

SEQ ID NO: 1166476 - RNA, 17 nt, Mycobacterium bovis subsp bovis AF2122/97
ccgccgcugccgccgag

SEQ ID NO: 1166477 - RNA, 21 nt, Mycobacterium bovis subsp bovis AF2122/97
ccgccgcugccgccggugccg

SEQ ID NO: 1166478 - RNA, 21 nt, Mycobacterium bovis subsp bovis AF2122/97
ccgccgcgauggccccuguca

SEQ ID NO: 1166479 - RNA, 16 nt, Mycobacterium bovis subsp bovis AF2122/97
ccgccgcgccggcacg

SEQ ID NO: 1166480 - RNA, 13 nt, Mycobacterium bovis subsp bovis AF2122/97
ccgccgcggcagg

SEQ ID NO: 1166481 - RNA, 14 nt, Mycobacterium bovis subsp bovis AF2122/97
ccgccgcggccgcc

SEQ ID NO: 1166482 - RNA, 15 nt, Mycobacterium bovis subsp bovis AF2122/97
ccgccgcggccgccg

SEQ ID NO: 1166483 - RNA, 14 nt, Mycobacterium bovis subsp bovis AF2122/97
ccgccgcggccggc

SEQ ID NO: 1166484 - RNA, 16 nt, Mycobacterium bovis subsp bovis AF2122/97
ccgccgcuaccgcccg

SEQ ID NO: 1166485 - RNA, 13 nt, Mycobacterium bovis subsp bovis AF2122/97
ccgccgcuccagg

SEQ ID NO: 1166486 - RNA, 16 nt, Mycobacterium bovis subsp bovis AF2122/97
ccgccgcuaccgaaca

SEQ ID NO: 1166487 - RNA, 18 nt, Mycobacterium bovis subsp bovis AF2122/97
ccgccgcggccaccaccg

SEQ ID NO: 1166488 - RNA, 13 nt, Mycobacterium bovis subsp bovis AF2122/97
ccgccgcgcgucg

SEQ ID NO: 1166489 - RNA, 17 nt, Mycobacterium bovis subsp bovis AF2122/97
ccgccgcgggcuccccg

SEQ ID NO: 1166490 - RNA, 17 nt, Mycobacterium bovis subsp bovis AF2122/97
ccgccgcgagcgccggc

SEQ ID NO: 1166491 - RNA, 20 nt, Mycobacterium bovis subsp bovis AF2122/97
ccgccgcgaggaugcugagc

SEQ ID NO: 1166492 - RNA, 23 nt, Mycobacterium bovis subsp bovis AF2122/97
ccgccgcgacgcacugccccgca

SEQ ID NO: 1166493 - RNA, 19 nt, Mycobacterium bovis subsp bovis AF2122/97
ccgccgcgaccacgcaccg

SEQ ID NO: 1166494 - RNA, 18 nt, Mycobacterium bovis subsp bovis AF2122/97
ccgccgcgaccgccucgc

SEQ ID NO: 1166495 - RNA, 20 nt, Mycobacterium bovis subsp bovis AF2122/97
ccgccgcgaccgccucgccg

SEQ ID NO: 1166496 - RNA, 23 nt, Mycobacterium bovis subsp bovis AF2122/97
ccgccgccaccagggcggccucc

SEQ ID NO: 1166497 - RNA, 14 nt, Mycobacterium bovis subsp bovis AF2122/97
ccgccgccaccggc

SEQ ID NO: 1166498 - RNA, 12 nt, Mycobacterium bovis subsp bovis AF2122/97
ccgccgcacgca

SEQ ID NO: 1166499 - RNA, 15 nt, Mycobacterium bovis subsp bovis AF2122/97
ccgccgcaccgccgc

SEQ ID NO: 1166500 - RNA, 19 nt, Mycobacterium bovis subsp bovis AF2122/97
ccgccgcagcuccccgacc

SEQ ID NO: 1166501 - RNA, 12 nt, Mycobacterium bovis subsp bovis AF2122/97
ccgccgccacca

SEQ ID NO: 1166502 - RNA, 18 nt, Mycobacterium bovis subsp bovis AF2122/97
ccgccgccaagcucggcc

SEQ ID NO: 1166503 - RNA, 13 nt, Mycobacterium bovis subsp bovis AF2122/97
ccgccgaccggac

SEQ ID NO: 1166504 - RNA, 19 nt, Mycobacterium bovis subsp bovis AF2122/97
ccgccgacaccaccggcgc

SEQ ID NO: 1166505 - RNA, 16 nt, Mycobacterium bovis subsp bovis AF2122/97
ccgccgacaaccccgc

SEQ ID NO: 1166506 - RNA, 18 nt, Mycobacterium bovis subsp bovis AF2122/97
ccgccgacaaucaccaac

SEQ ID NO: 1166507 - RNA, 15 nt, Mycobacterium bovis subsp bovis AF2122/97
ccgccgacuccccgc

SEQ ID NO: 1166508 - RNA, 22 nt, Mycobacterium bovis subsp bovis AF2122/97
ccgccgagaugaugcugccggc

SEQ ID NO: 1166509 - RNA, 15 nt, Mycobacterium bovis subsp bovis AF2122/97
ccgccgagauagcaa

SEQ ID NO: 1166510 - RNA, 20 nt, Mycobacterium bovis subsp bovis AF2122/97
ccgcccucccuggggccguc

SEQ ID NO: 1166511 - RNA, 21 nt, Mycobacterium bovis subsp bovis AF2122/97
ccgcccucucacggcgguagc

SEQ ID NO: 1166512 - RNA, 14 nt, Mycobacterium bovis subsp bovis AF2122/97
ccgcccuggccgcc

SEQ ID NO: 1166513 - RNA, 16 nt, Mycobacterium bovis subsp bovis AF2122/97
ccgcccuggccgccgg

SEQ ID NO: 1166514 - RNA, 21 nt, Mycobacterium bovis subsp bovis AF2122/97
ccgcccucaccgccugugccg

SEQ ID NO: 1166515 - RNA, 15 nt, Mycobacterium bovis subsp bovis AF2122/97
ccgccgaagccgcgc

SEQ ID NO: 1166516 - RNA, 16 nt, Mycobacterium bovis subsp bovis AF2122/97
ccgccgaagccgcgca

SEQ ID NO: 1166517 - RNA, 18 nt, Mycobacterium bovis subsp bovis AF2122/97
ccgccgaagccgcgcauc

SEQ ID NO: 1166518 - RNA, 12 nt, Mycobacterium bovis subsp bovis AF2122/97
ccgcccgccagc

SEQ ID NO: 1166519 - RNA, 23 nt, Mycobacterium bovis subsp bovis AF2122/97
ccgcccggucgggcgcggggcgg

SEQ ID NO: 1166520 - RNA, 14 nt, Mycobacterium bovis subsp bovis AF2122/97
ccgcccggucgggc

SEQ ID NO: 1166521 - RNA, 24 nt, Mycobacterium bovis subsp bovis AF2122/97
ccgcccguagacccacagucgccg

SEQ ID NO: 1166522 - RNA, 22 nt, Mycobacterium bovis subsp bovis AF2122/97
ccgcccgucuuccagccaggcc

SEQ ID NO: 1166523 - RNA, 14 nt, Mycobacterium bovis subsp bovis AF2122/97
ccgcccgacgugaa

SEQ ID NO: 1166524 - RNA, 14 nt, Mycobacterium bovis subsp bovis AF2122/97
ccgccccggccagg

SEQ ID NO: 1166525 - RNA, 16 nt, Mycobacterium bovis subsp bovis AF2122/97
ccgccccggcggcggc

SEQ ID NO: 1166526 - RNA, 15 nt, Mycobacterium bovis subsp bovis AF2122/97
ccgccccgggccacc

SEQ ID NO: 1166527 - RNA, 16 nt, Mycobacterium bovis subsp bovis AF2122/97
ccgcauaggccccgcc

SEQ ID NO: 1166528 - RNA, 20 nt, Mycobacterium bovis subsp bovis AF2122/97
ccgccaucgucgaagaccuc

SEQ ID NO: 1166529 - RNA, 22 nt, Mycobacterium bovis subsp bovis AF2122/97
ccgccaucgucgaagaccucaa

SEQ ID NO: 1166530 - RNA, 23 nt, Mycobacterium bovis subsp bovis AF2122/97
ccgcauacgcggcuuugacgccc

SEQ ID NO: 1166531 - RNA, 16 nt, Mycobacterium bovis subsp bovis AF2122/97
ccgcaguggucggcuc

SEQ ID NO: 1166532 - RNA, 21 nt, Mycobacterium bovis subsp bovis AF2122/97
ccgccauuccagccggugccg

SEQ ID NO: 1166533 - RNA, 22 nt, Mycobacterium bovis subsp bovis AF2122/97
ccgccaugagguaggucgccgc

SEQ ID NO: 1166534 - RNA, 23 nt, Mycobacterium bovis subsp bovis AF2122/97
ccgcccccgccggccgcgccggc

SEQ ID NO: 1166535 - RNA, 23 nt, Mycobacterium bovis subsp bovis AF2122/97
ccgcccagcugucauccccggcc

SEQ ID NO: 1166536 - RNA, 18 nt, Mycobacterium bovis subsp bovis AF2122/97
ccgccauugccgccgucg

SEQ ID NO: 1166537 - RNA, 17 nt, Mycobacterium bovis subsp bovis AF2122/97
ccgcccaugccuccaga

SEQ ID NO: 1166538 - RNA, 18 nt, Mycobacterium bovis subsp bovis AF2122/97
ccgcccaugccuccagaa

SEQ ID NO: 1166539 - RNA, 15 nt, Mycobacterium bovis subsp bovis AF2122/97
ccgcgcaccaacacc

SEQ ID NO: 1166540 - RNA, 21 nt, Mycobacterium bovis subsp bovis AF2122/97
ccgcgcacccguccgccgcag

SEQ ID NO: 1166541 - RNA, 15 nt, Mycobacterium bovis subsp bovis AF2122/97
ccgcgcaacccggac

SEQ ID NO: 1166542 - RNA, 14 nt, Mycobacterium bovis subsp bovis AF2122/97
ccgcgcagccggcc

SEQ ID NO: 1166543 - RNA, 16 nt, Mycobacterium bovis subsp bovis AF2122/97
ccgcgcagccggcccg

SEQ ID NO: 1166544 - RNA, 21 nt, Mycobacterium bovis subsp bovis AF2122/97
ccgcgccauagcagagccggg

SEQ ID NO: 1166545 - RNA, 19 nt, Mycobacterium bovis subsp bovis AF2122/97
ccgcgcagcgguccgccgc

SEQ ID NO: 1166546 - RNA, 14 nt, Mycobacterium bovis subsp bovis AF2122/97
ccgcgcccaccagc

SEQ ID NO: 1166547 - RNA, 13 nt, Mycobacterium bovis subsp bovis AF2122/97
ccgcgcccacccc

SEQ ID NO: 1166548 - RNA, 17 nt, Mycobacterium bovis subsp bovis AF2122/97
ccgcgccccagacgcgc

SEQ ID NO: 1166549 - RNA, 15 nt, Mycobacterium bovis subsp bovis AF2122/97
ccgcgcccgccgcgg

SEQ ID NO: 1166550 - RNA, 19 nt, Mycobacterium bovis subsp bovis AF2122/97
ccgcgcccgccgcggcagc

SEQ ID NO: 1166551 - RNA, 23 nt, Mycobacterium bovis subsp bovis AF2122/97
ccgcgcccgcgggcaguggcagc

SEQ ID NO: 1166552 - RNA, 16 nt, Mycobacterium bovis subsp bovis AF2122/97
ccgcgcccuucagcac

SEQ ID NO: 1166553 - RNA, 20 nt, Mycobacterium bovis subsp bovis AF2122/97
ccgcgccgccucgggcaccu

SEQ ID NO: 1166554 - RNA, 19 nt, Mycobacterium bovis subsp bovis AF2122/97
ccgcgccgccgccaccacc

SEQ ID NO: 1166555 - RNA, 16 nt, Mycobacterium bovis subsp bovis AF2122/97
ccgcgccgccccgcuc

SEQ ID NO: 1166556 - RNA, 22 nt, Mycobacterium bovis subsp bovis AF2122/97
ccgcgccgcccgcuccuccggc

SEQ ID NO: 1166557 - RNA, 17 nt, Mycobacterium bovis subsp bovis AF2122/97
ccgcgccgaucaccacc

SEQ ID NO: 1166558 - RNA, 12 nt, Mycobacterium bovis subsp bovis AF2122/97
ccgcgagcagca

SEQ ID NO: 1166559 - RNA, 20 nt, Mycobacterium bovis subsp bovis AF2122/97
ccgcgacggcgccggcaucg

SEQ ID NO: 1166560 - RNA, 14 nt, Mycobacterium bovis subsp bovis AF2122/97
ccgcgacggcggcu

SEQ ID NO: 1166561 - RNA, 18 nt, Mycobacterium bovis subsp bovis AF2122/97
ccgcgacggcggcucccg

SEQ ID NO: 1166562 - RNA, 13 nt, Mycobacterium bovis subsp bovis AF2122/97
ccgcgacggccuu

SEQ ID NO: 1166563 - RNA, 19 nt, Mycobacterium bovis subsp bovis AF2122/97
ccgcgacgcucgcugcagc

SEQ ID NO: 1166564 - RNA, 14 nt, Mycobacterium bovis subsp bovis AF2122/97
ccgcgacggccuug

SEQ ID NO: 1166565 - RNA, 15 nt, Mycobacterium bovis subsp bovis AF2122/97
ccgcgagcccggccu

SEQ ID NO: 1166566 - RNA, 19 nt, Mycobacterium bovis subsp bovis AF2122/97
ccgcgagguacccaucguc

SEQ ID NO: 1166567 - RNA, 23 nt, Mycobacterium bovis subsp bovis AF2122/97
ccgccuuggucaccuucuuggcg

SEQ ID NO: 1166568 - RNA, 18 nt, Mycobacterium bovis subsp bovis AF2122/97
ccgccuuggucgcgucgg

SEQ ID NO: 1166569 - RNA, 16 nt, Mycobacterium bovis subsp bovis AF2122/97
ccgccuuggucaccuu

SEQ ID NO: 1166570 - RNA, 22 nt, Mycobacterium bovis subsp bovis AF2122/97
ccgccuuggucaccuucuuggc

SEQ ID NO: 1166571 - RNA, 13 nt, Mycobacterium bovis subsp bovis AF2122/97
ccgccuuggcccc

SEQ ID NO: 1166572 - RNA, 12 nt, Mycobacterium bovis subsp bovis AF2122/97
ccgccuucuugg

SEQ ID NO: 1166573 - RNA, 15 nt, Mycobacterium bovis subsp bovis AF2122/97
ccgccuucuccggcg

SEQ ID NO: 1166574 - RNA, 20 nt, Mycobacterium bovis subsp bovis AF2122/97
ccgccuugaggcccugcggc

SEQ ID NO: 1166575 - RNA, 16 nt, Mycobacterium bovis subsp bovis AF2122/97
ccgccuuacgcaccga

SEQ ID NO: 1166576 - RNA, 14 nt, Mycobacterium bovis subsp bovis AF2122/97
ccgccuucuccggc

SEQ ID NO: 1166577 - RNA, 17 nt, Mycobacterium bovis subsp bovis AF2122/97
ccgccgguuccgccggc

SEQ ID NO: 1166578 - RNA, 21 nt, Mycobacterium bovis subsp bovis AF2122/97
ccgccgguguuagccccgaag

SEQ ID NO: 1166579 - RNA, 22 nt, Mycobacterium bovis subsp bovis AF2122/97
ccgccguaacggucgcugucgg

SEQ ID NO: 1166580 - RNA, 21 nt, Mycobacterium bovis subsp bovis AF2122/97
ccgccguaugccgccaaccgc

SEQ ID NO: 1166581 - RNA, 15 nt, Mycobacterium bovis subsp bovis AF2122/97
ccgccgucacccccg

SEQ ID NO: 1166582 - RNA, 15 nt, Mycobacterium bovis subsp bovis AF2122/97
ccgccgucaccgccc

SEQ ID NO: 1166583 - RNA, 15 nt, Mycobacterium bovis subsp bovis AF2122/97
ccgccguccagcgcc

SEQ ID NO: 1166584 - RNA, 16 nt, Mycobacterium bovis subsp bovis AF2122/97
ccgccguccagcgccg

SEQ ID NO: 1166585 - RNA, 15 nt, Mycobacterium bovis subsp bovis AF2122/97
ccgccgucgaccacg

SEQ ID NO: 1166586 - RNA, 15 nt, Mycobacterium bovis subsp bovis AF2122/97
ccgccgucgccacca

SEQ ID NO: 1166587 - RNA, 15 nt, Mycobacterium bovis subsp bovis AF2122/97
ccgccguccccgccg

SEQ ID NO: 1166588 - RNA, 22 nt, Mycobacterium bovis subsp bovis AF2122/97
ccgccguaccgaagcggaucug

SEQ ID NO: 1166589 - RNA, 20 nt, Mycobacterium bovis subsp bovis AF2122/97
ccgccguagaccagccgucg

SEQ ID NO: 1166590 - RNA, 19 nt, Mycobacterium bovis subsp bovis AF2122/97
ccgccgucguugcccgacc

SEQ ID NO: 1166591 - RNA, 21 nt, Mycobacterium bovis subsp bovis AF2122/97
ccgccgucguugcccgacccg

SEQ ID NO: 1166592 - RNA, 16 nt, Mycobacterium bovis subsp bovis AF2122/97
ccgccgugcccccggc

SEQ ID NO: 1166593 - RNA, 23 nt, Mycobacterium bovis subsp bovis AF2122/97
ccgccgugccgcggcgacgguga

SEQ ID NO: 1166594 - RNA, 14 nt, Mycobacterium bovis subsp bovis AF2122/97
ccgccgugugcucu

SEQ ID NO: 1166595 - RNA, 17 nt, Mycobacterium bovis subsp bovis AF2122/97
ccgccggcggugaugug

SEQ ID NO: 1166596 - RNA, 13 nt, Mycobacterium bovis subsp bovis AF2122/97
ccgccgggcucca

SEQ ID NO: 1166597 - RNA, 19 nt, Mycobacterium bovis subsp bovis AF2122/97
ccgccggguccgccgggcc

SEQ ID NO: 1166598 - RNA, 19 nt, Mycobacterium bovis subsp bovis AF2122/97
ccgccgggcagugugguca

SEQ ID NO: 1166599 - RNA, 21 nt, Mycobacterium bovis subsp bovis AF2122/97
ccgccggucccggacgugccg

SEQ ID NO: 1166600 - RNA, 16 nt, Mycobacterium bovis subsp bovis AF2122/97
ccgccggugccgccgc

SEQ ID NO: 1166601 - RNA, 17 nt, Mycobacterium bovis subsp bovis AF2122/97
ccgccggugccaccggc

SEQ ID NO: 1166602 - RNA, 18 nt, Mycobacterium bovis subsp bovis AF2122/97
ccgccggugccaccggcu

SEQ ID NO: 1166603 - RNA, 16 nt, Mycobacterium bovis subsp bovis AF2122/97
ccgccggugccgccgu

SEQ ID NO: 1166604 - RNA, 16 nt, Mycobacterium bovis subsp bovis AF2122/97
ccgccggugccgccug

SEQ ID NO: 1166605 - RNA, 17 nt, Mycobacterium bovis subsp bovis AF2122/97
ccgccggugccgccugc

SEQ ID NO: 1166606 - RNA, 20 nt, Mycobacterium bovis subsp bovis AF2122/97
ccgccgguggcgccggggcc

SEQ ID NO: 1166607 - RNA, 14 nt, Mycobacterium bovis subsp bovis AF2122/97
ccgccucgccguag

SEQ ID NO: 1166608 - RNA, 21 nt, Mycobacterium bovis subsp bovis AF2122/97
ccgccuccucgauagcggcgc

SEQ ID NO: 1166609 - RNA, 15 nt, Mycobacterium bovis subsp bovis AF2122/97
ccgccucgaccgcca

SEQ ID NO: 1166610 - RNA, 16 nt, Mycobacterium bovis subsp bovis AF2122/97
ccgccuccgccugccc

SEQ ID NO: 1166611 - RNA, 14 nt, Mycobacterium bovis subsp bovis AF2122/97
ccgccuccgccugc

SEQ ID NO: 1166612 - RNA, 14 nt, Mycobacterium bovis subsp bovis AF2122/97
ccgccuccgccgag

SEQ ID NO: 1166613 - RNA, 16 nt, Mycobacterium bovis subsp bovis AF2122/97
ccgccucugucuucag

SEQ ID NO: 1166614 - RNA, 12 nt, Mycobacterium bovis subsp bovis AF2122/97
ccgccugcaccg

SEQ ID NO: 1166615 - RNA, 15 nt, Mycobacterium bovis subsp bovis AF2122/97
ccgccucgggccggc

SEQ ID NO: 1166616 - RNA, 18 nt, Mycobacterium bovis subsp bovis AF2122/97
ccgccucgggcaccuggu

SEQ ID NO: 1166617 - RNA, 18 nt, Mycobacterium bovis subsp bovis AF2122/97
ccgccucgaccgccagcc

SEQ ID NO: 1166618 - RNA, 18 nt, Mycobacterium bovis subsp bovis AF2122/97
ccgccguugccgccgaag

SEQ ID NO: 1166619 - RNA, 16 nt, Mycobacterium bovis subsp bovis AF2122/97
ccgccguugccgccgg

SEQ ID NO: 1166620 - RNA, 17 nt, Mycobacterium bovis subsp bovis AF2122/97
ccgccguugccgccggc

SEQ ID NO: 1166621 - RNA, 19 nt, Mycobacterium bovis subsp bovis AF2122/97
ccgccguugccgccggcgc

SEQ ID NO: 1166622 - RNA, 18 nt, Mycobacterium bovis subsp bovis AF2122/97
ccgccguugccgccgucg

SEQ ID NO: 1166623 - RNA, 19 nt, Mycobacterium bovis subsp bovis AF2122/97
ccgccguugccgucgucgc

SEQ ID NO: 1166624 - RNA, 16 nt, Mycobacterium bovis subsp bovis AF2122/97
ccgccguugccguugg

SEQ ID NO: 1166625 - RNA, 22 nt, Mycobacterium bovis subsp bovis AF2122/97
ccgccguugaacggcaccagcg

SEQ ID NO: 1166626 - RNA, 22 nt, Mycobacterium bovis subsp bovis AF2122/97
ccgccguucccaccaccaccgc

SEQ ID NO: 1166627 - RNA, 17 nt, Mycobacterium bovis subsp bovis AF2122/97
ccgccguuaccgccgcu

SEQ ID NO: 1166628 - RNA, 16 nt, Mycobacterium bovis subsp bovis AF2122/97
ccgccguuaccgccgg

SEQ ID NO: 1166629 - RNA, 23 nt, Mycobacterium bovis subsp bovis AF2122/97
ccgccuaagcauucagcgcgccg

SEQ ID NO: 1166630 - RNA, 21 nt, Mycobacterium bovis subsp bovis AF2122/97
ccgccuaaucggccugccggc

SEQ ID NO: 1166631 - RNA, 18 nt, Mycobacterium bovis subsp bovis AF2122/97
ccgccuacccguucuucg

SEQ ID NO: 1166632 - RNA, 20 nt, Mycobacterium bovis subsp bovis AF2122/97
ccgccuaggugaguaagccc

SEQ ID NO: 1166633 - RNA, 16 nt, Mycobacterium bovis subsp bovis AF2122/97
ccgccuccaccgccgc

SEQ ID NO: 1166634 - RNA, 18 nt, Mycobacterium bovis subsp bovis AF2122/97
ccgccuccaccgccgcgc

SEQ ID NO: 1166635 - RNA, 19 nt, Mycobacterium bovis subsp bovis AF2122/97
ccgccuccaccgccgcgcg

SEQ ID NO: 1166636 - RNA, 18 nt, Mycobacterium bovis subsp bovis AF2122/97
ccgcucgguccagccggu

SEQ ID NO: 1166637 - RNA, 15 nt, Mycobacterium bovis subsp bovis AF2122/97
ccgcucagccguccg

SEQ ID NO: 1166638 - RNA, 19 nt, Mycobacterium bovis subsp bovis AF2122/97
ccgcucagggugcgccgca

SEQ ID NO: 1166639 - RNA, 20 nt, Mycobacterium bovis subsp bovis AF2122/97
ccgcucagggugcgccgcag

SEQ ID NO: 1166640 - RNA, 19 nt, Mycobacterium bovis subsp bovis AF2122/97
ccgcucgucgccgguggca

SEQ ID NO: 1166641 - RNA, 15 nt, Mycobacterium bovis subsp bovis AF2122/97
ccgcucaccccgcgc

SEQ ID NO: 1166642 - RNA, 20 nt, Mycobacterium bovis subsp bovis AF2122/97
ccgcucaccccgcgcuccuc

SEQ ID NO: 1166643 - RNA, 13 nt, Mycobacterium bovis subsp bovis AF2122/97
ccgcucacccgcc

SEQ ID NO: 1166644 - RNA, 16 nt, Mycobacterium bovis subsp bovis AF2122/97
ccgcuauggcccgggc

SEQ ID NO: 1166645 - RNA, 15 nt, Mycobacterium bovis subsp bovis AF2122/97
ccgcuaugaggcagu

SEQ ID NO: 1166646 - RNA, 20 nt, Mycobacterium bovis subsp bovis AF2122/97
ccgcuauggcccgggccgaa

SEQ ID NO: 1166647 - RNA, 15 nt, Mycobacterium bovis subsp bovis AF2122/97
ccgcugccaucgccu

SEQ ID NO: 1166648 - RNA, 23 nt, Mycobacterium bovis subsp bovis AF2122/97
ccgcugccaugcgggugucgggc

SEQ ID NO: 1166649 - RNA, 20 nt, Mycobacterium bovis subsp bovis AF2122/97
ccgcugccgaagcggccacc

SEQ ID NO: 1166650 - RNA, 14 nt, Mycobacterium bovis subsp bovis AF2122/97
ccgcugaccaucac

SEQ ID NO: 1166651 - RNA, 17 nt, Mycobacterium bovis subsp bovis AF2122/97
ccgcugaccccggcagc

SEQ ID NO: 1166652 - RNA, 12 nt, Mycobacterium bovis subsp bovis AF2122/97
ccgcucugcggc

SEQ ID NO: 1166653 - RNA, 14 nt, Mycobacterium bovis subsp bovis AF2122/97
ccgcuggccuccug

SEQ ID NO: 1166654 - RNA, 12 nt, Mycobacterium bovis subsp bovis AF2122/97
ccgcuggccagc

SEQ ID NO: 1166655 - RNA, 20 nt, Mycobacterium bovis subsp bovis AF2122/97
ccgcugccgguggcggcggc

SEQ ID NO: 1166656 - RNA, 14 nt, Mycobacterium bovis subsp bovis AF2122/97
ccgcuggaggcggc

SEQ ID NO: 1166657 - RNA, 19 nt, Mycobacterium bovis subsp bovis AF2122/97
ccgcugccgguagcacagc

SEQ ID NO: 1166658 - RNA, 20 nt, Mycobacterium bovis subsp bovis AF2122/97
ccgcugccgguagcacagca

SEQ ID NO: 1166659 - RNA, 14 nt, Mycobacterium bovis subsp bovis AF2122/97
ccgcugccggcacg

SEQ ID NO: 1166660 - RNA, 16 nt, Mycobacterium bovis subsp bovis AF2122/97
ccgcugccggcacgca

SEQ ID NO: 1166661 - RNA, 13 nt, Mycobacterium bovis subsp bovis AF2122/97
ccgcugccggcac

SEQ ID NO: 1166662 - RNA, 13 nt, Mycobacterium bovis subsp bovis AF2122/97
ccgcugccgcccu

SEQ ID NO: 1166663 - RNA, 22 nt, Mycobacterium bovis subsp bovis AF2122/97
ccgcugccgcccuugccgcccg

SEQ ID NO: 1166664 - RNA, 23 nt, Mycobacterium bovis subsp bovis AF2122/97
ccgcugccgccgagcuggcgcgc

SEQ ID NO: 1166665 - RNA, 13 nt, Mycobacterium bovis subsp bovis AF2122/97
ccgcuucccccgg

SEQ ID NO: 1166666 - RNA, 14 nt, Mycobacterium bovis subsp bovis AF2122/97
ccgcuuggcccggc

SEQ ID NO: 1166667 - RNA, 13 nt, Mycobacterium bovis subsp bovis AF2122/97
ccgcuugguguga

SEQ ID NO: 1166668 - RNA, 15 nt, Mycobacterium bovis subsp bovis AF2122/97
ccgcuugugacacca

SEQ ID NO: 1166669 - RNA, 19 nt, Mycobacterium bovis subsp bovis AF2122/97
ccgcuugugacaccacauc

SEQ ID NO: 1166670 - RNA, 19 nt, Mycobacterium bovis subsp bovis AF2122/97
ccgcuguucuuggugacca

SEQ ID NO: 1166671 - RNA, 13 nt, Mycobacterium bovis subsp bovis AF2122/97
ccgcgggccgcca

SEQ ID NO: 1166672 - RNA, 21 nt, Mycobacterium bovis subsp bovis AF2122/97
ccgcgggaucgguggcggcac

SEQ ID NO: 1166673 - RNA, 18 nt, Mycobacterium bovis subsp bovis AF2122/97
ccgcgggcaguggcagcc

SEQ ID NO: 1166674 - RNA, 15 nt, Mycobacterium bovis subsp bovis AF2122/97
ccgcgggccagcacc

SEQ ID NO: 1166675 - RNA, 14 nt, Mycobacterium bovis subsp bovis AF2122/97
ccgcgggcggcauc

SEQ ID NO: 1166676 - RNA, 16 nt, Mycobacterium bovis subsp bovis AF2122/97
ccgcgggcuccccggc

SEQ ID NO: 1166677 - RNA, 16 nt, Mycobacterium bovis subsp bovis AF2122/97
ccgcgggggaccgccc

SEQ ID NO: 1166678 - RNA, 17 nt, Mycobacterium bovis subsp bovis AF2122/97
ccgcggcugccaucccg

SEQ ID NO: 1166679 - RNA, 18 nt, Mycobacterium bovis subsp bovis AF2122/97
ccgcgggaaguucgccgg

SEQ ID NO: 1166680 - RNA, 19 nt, Mycobacterium bovis subsp bovis AF2122/97
ccgcgggaucgguggcggc

SEQ ID NO: 1166681 - RNA, 11 nt, Mycobacterium bovis subsp bovis AF2122/97
ccgcggcggcg

SEQ ID NO: 1166682 - RNA, 16 nt, Mycobacterium bovis subsp bovis AF2122/97
ccgcggcgucgugaga

SEQ ID NO: 1166683 - RNA, 22 nt, Mycobacterium bovis subsp bovis AF2122/97
ccgcgccuugauggucuccacc

SEQ ID NO: 1166684 - RNA, 17 nt, Mycobacterium bovis subsp bovis AF2122/97
ccgcgccuuggcacccu

SEQ ID NO: 1166685 - RNA, 15 nt, Mycobacterium bovis subsp bovis AF2122/97
ccgcgccugccucac

SEQ ID NO: 1166686 - RNA, 17 nt, Mycobacterium bovis subsp bovis AF2122/97
ccgcgccugccucaccg

SEQ ID NO: 1166687 - RNA, 15 nt, Mycobacterium bovis subsp bovis AF2122/97
ccgcggcgccgccac

SEQ ID NO: 1166688 - RNA, 17 nt, Mycobacterium bovis subsp bovis AF2122/97
ccgcgcgacaacccggc

SEQ ID NO: 1166689 - RNA, 15 nt, Mycobacterium bovis subsp bovis AF2122/97
ccgcgcgacaggccc

SEQ ID NO: 1166690 - RNA, 21 nt, Mycobacterium bovis subsp bovis AF2122/97
ccgcgcgacgccguccucgcu

SEQ ID NO: 1166691 - RNA, 23 nt, Mycobacterium bovis subsp bovis AF2122/97
ccgcgcgagagccuccauggccu

SEQ ID NO: 1166692 - RNA, 16 nt, Mycobacterium bovis subsp bovis AF2122/97
ccgcgcgagccucgcg

SEQ ID NO: 1166693 - RNA, 13 nt, Mycobacterium bovis subsp bovis AF2122/97
ccgcggcgccgcc

SEQ ID NO: 1166694 - RNA, 12 nt, Mycobacterium bovis subsp bovis AF2122/97
ccgcgccgucgu

SEQ ID NO: 1166695 - RNA, 24 nt, Mycobacterium bovis subsp bovis AF2122/97
ccgcgccggccgcacgccggccag

SEQ ID NO: 1166696 - RNA, 16 nt, Mycobacterium bovis subsp bovis AF2122/97
ccgcgccggcggaagc

SEQ ID NO: 1166697 - RNA, 17 nt, Mycobacterium bovis subsp bovis AF2122/97
ccgcgggguaguucguu

SEQ ID NO: 1166698 - RNA, 15 nt, Mycobacterium bovis subsp bovis AF2122/97
ccgcgguacccaccu

SEQ ID NO: 1166699 - RNA, 15 nt, Mycobacterium bovis subsp bovis AF2122/97
ccgcggucagcucgg

SEQ ID NO: 1166700 - RNA, 18 nt, Mycobacterium bovis subsp bovis AF2122/97
ccgcggucagcucggcag

SEQ ID NO: 1166701 - RNA, 16 nt, Mycobacterium bovis subsp bovis AF2122/97
ccgcgguuuucgccgg

SEQ ID NO: 1166702 - RNA, 18 nt, Mycobacterium bovis subsp bovis AF2122/97
ccgcguccaaggcgcgcu

SEQ ID NO: 1166703 - RNA, 20 nt, Mycobacterium bovis subsp bovis AF2122/97
ccgcguagugguggaagugu

SEQ ID NO: 1166704 - RNA, 12 nt, Mycobacterium bovis subsp bovis AF2122/97
ccgcgucaccgg

SEQ ID NO: 1166705 - RNA, 15 nt, Mycobacterium bovis subsp bovis AF2122/97
ccgcgucaccggagg

SEQ ID NO: 1166706 - RNA, 20 nt, Mycobacterium bovis subsp bovis AF2122/97
ccgcgucaccggaggccgcc

SEQ ID NO: 1166707 - RNA, 17 nt, Mycobacterium bovis subsp bovis AF2122/97
ccgcguagguggccagc

SEQ ID NO: 1166708 - RNA, 13 nt, Mycobacterium bovis subsp bovis AF2122/97
ccgcguugccaaa

SEQ ID NO: 1166709 - RNA, 22 nt, Mycobacterium bovis subsp bovis AF2122/97
ccgcgucgaacugggcgcccgc

SEQ ID NO: 1166710 - RNA, 14 nt, Mycobacterium bovis subsp bovis AF2122/97
ccgcuaauggaucc

SEQ ID NO: 1166711 - RNA, 22 nt, Mycobacterium bovis subsp bovis AF2122/97
ccgcuaacuggcccggacaugc

SEQ ID NO: 1166712 - RNA, 23 nt, Mycobacterium bovis subsp bovis AF2122/97
ccgcguuuauaccucgccgcccu

SEQ ID NO: 1166713 - RNA, 17 nt, Mycobacterium bovis subsp bovis AF2122/97
ccggcacccgccgugcc

SEQ ID NO: 1166714 - RNA, 15 nt, Mycobacterium bovis subsp bovis AF2122/97
ccggcaccgccgccc

SEQ ID NO: 1166715 - RNA, 17 nt, Mycobacterium bovis subsp bovis AF2122/97
ccggcaccgccgccccc

SEQ ID NO: 1166716 - RNA, 18 nt, Mycobacterium bovis subsp bovis AF2122/97
ccggcaccgccagugccc

SEQ ID NO: 1166717 - RNA, 14 nt, Mycobacterium bovis subsp bovis AF2122/97
ccggcacccgucgg

SEQ ID NO: 1166718 - RNA, 16 nt, Mycobacterium bovis subsp bovis AF2122/97
ccggcacccgaguuau

SEQ ID NO: 1166719 - RNA, 12 nt, Mycobacterium bovis subsp bovis AF2122/97
ccggcacccgcc

SEQ ID NO: 1166720 - RNA, 16 nt, Mycobacterium bovis subsp bovis AF2122/97
ccggcaaucggcggca

SEQ ID NO: 1166721 - RNA, 17 nt, Mycobacterium bovis subsp bovis AF2122/97
ccggcacgaccgcuccc

SEQ ID NO: 1166722 - RNA, 18 nt, Mycobacterium bovis subsp bovis AF2122/97
ccggcaccggccgugccg

SEQ ID NO: 1166723 - RNA, 14 nt, Mycobacterium bovis subsp bovis AF2122/97
ccggcacgcagcca

SEQ ID NO: 1166724 - RNA, 15 nt, Mycobacterium bovis subsp bovis AF2122/97
ccggcacgcaugccg

SEQ ID NO: 1166725 - RNA, 16 nt, Mycobacterium bovis subsp bovis AF2122/97
ccggcaccgccggcgc

SEQ ID NO: 1166726 - RNA, 19 nt, Mycobacterium bovis subsp bovis AF2122/97
ccggcaccgccgguggcgc

SEQ ID NO: 1166727 - RNA, 21 nt, Mycobacterium bovis subsp bovis AF2122/97
ccggcaccgccugcgccgccc

SEQ ID NO: 1166728 - RNA, 22 nt, Mycobacterium bovis subsp bovis AF2122/97
ccggcaccgccugcgccgcccg

SEQ ID NO: 1166729 - RNA, 14 nt, Mycobacterium bovis subsp bovis AF2122/97
ccggcaagcgcaga

SEQ ID NO: 1166730 - RNA, 15 nt, Mycobacterium bovis subsp bovis AF2122/97
ccggcaagcgcagac

SEQ ID NO: 1166731 - RNA, 17 nt, Mycobacterium bovis subsp bovis AF2122/97
ccggcaagcacaccgcc

SEQ ID NO: 1166732 - RNA, 22 nt, Mycobacterium bovis subsp bovis AF2122/97
ccggcaagcacaccgccagcgg

SEQ ID NO: 1166733 - RNA, 23 nt, Mycobacterium bovis subsp bovis AF2122/97
ccggcaagcacaccgccagcggc

SEQ ID NO: 1166734 - RNA, 11 nt, Mycobacterium bovis subsp bovis AF2122/97
ccggcaagcag

SEQ ID NO: 1166735 - RNA, 15 nt, Mycobacterium bovis subsp bovis AF2122/97
ccggcaacgcggccu

SEQ ID NO: 1166736 - RNA, 15 nt, Mycobacterium bovis subsp bovis AF2122/97
ccggcaaccuggacu

SEQ ID NO: 1166737 - RNA, 20 nt, Mycobacterium bovis subsp bovis AF2122/97
ccggauagcgucgucccagc

SEQ ID NO: 1166738 - RNA, 14 nt, Mycobacterium bovis subsp bovis AF2122/97
ccggauacagccac

SEQ ID NO: 1166739 - RNA, 15 nt, Mycobacterium bovis subsp bovis AF2122/97
ccggauacagccacg

SEQ ID NO: 1166740 - RNA, 13 nt, Mycobacterium bovis subsp bovis AF2122/97
ccggcagcccggc

SEQ ID NO: 1166741 - RNA, 19 nt, Mycobacterium bovis subsp bovis AF2122/97
ccggcagcgcccccggacu

SEQ ID NO: 1166742 - RNA, 16 nt, Mycobacterium bovis subsp bovis AF2122/97
ccggcagaugcagcgg

SEQ ID NO: 1166743 - RNA, 22 nt, Mycobacterium bovis subsp bovis AF2122/97
ccggcagauguguccggcaucg

SEQ ID NO: 1166744 - RNA, 14 nt, Mycobacterium bovis subsp bovis AF2122/97
ccggcacgucgccc

SEQ ID NO: 1166745 - RNA, 19 nt, Mycobacterium bovis subsp bovis AF2122/97
ccggcacgccgaccggugg

SEQ ID NO: 1166746 - RNA, 15 nt, Mycobacterium bovis subsp bovis AF2122/97
ccggcacgccggcgg

SEQ ID NO: 1166747 - RNA, 14 nt, Mycobacterium bovis subsp bovis AF2122/97
ccggcacugcccag

SEQ ID NO: 1166748 - RNA, 17 nt, Mycobacterium bovis subsp bovis AF2122/97
ccggcacugcccagcag

SEQ ID NO: 1166749 - RNA, 19 nt, Mycobacterium bovis subsp bovis AF2122/97
ccggcagcuugcagugccg

SEQ ID NO: 1166750 - RNA, 20 nt, Mycobacterium bovis subsp bovis AF2122/97
ccggcagcgguggcaagccu

SEQ ID NO: 1166751 - RNA, 22 nt, Mycobacterium bovis subsp bovis AF2122/97
ccggcagcguccgaaccaccug

SEQ ID NO: 1166752 - RNA, 16 nt, Mycobacterium bovis subsp bovis AF2122/97
ccggcagcggcgcgcu

SEQ ID NO: 1166753 - RNA, 20 nt, Mycobacterium bovis subsp bovis AF2122/97
ccggcagcggcgcucggcgc

SEQ ID NO: 1166754 - RNA, 13 nt, Mycobacterium bovis subsp bovis AF2122/97
ccggcagcggcgc

SEQ ID NO: 1166755 - RNA, 19 nt, Mycobacterium bovis subsp bovis AF2122/97
ccggcaggcccgacggcgc

SEQ ID NO: 1166756 - RNA, 17 nt, Mycobacterium bovis subsp bovis AF2122/97
ccggcauugagccgggc

SEQ ID NO: 1166757 - RNA, 21 nt, Mycobacterium bovis subsp bovis AF2122/97
ccggccaaaauuuugucggcc

SEQ ID NO: 1166758 - RNA, 20 nt, Mycobacterium bovis subsp bovis AF2122/97
ccggcauuccguaggccaca

SEQ ID NO: 1166759 - RNA, 23 nt, Mycobacterium bovis subsp bovis AF2122/97
ccggcaugccgccaugcgcacca

SEQ ID NO: 1166760 - RNA, 20 nt, Mycobacterium bovis subsp bovis AF2122/97
ccggcaugcgugccggcagc

SEQ ID NO: 1166761 - RNA, 17 nt, Mycobacterium bovis subsp bovis AF2122/97
ccggaagauccgggccu

SEQ ID NO: 1166762 - RNA, 21 nt, Mycobacterium bovis subsp bovis AF2122/97
ccggaagcgccggccgaucgg

SEQ ID NO: 1166763 - RNA, 21 nt, Mycobacterium bovis subsp bovis AF2122/97
ccggaacuguggugccugcgg

SEQ ID NO: 1166764 - RNA, 20 nt, Mycobacterium bovis subsp bovis AF2122/97
ccggaauacccgcuggcccg

SEQ ID NO: 1166765 - RNA, 18 nt, Mycobacterium bovis subsp bovis AF2122/97
ccggaauacgcgccgccg

SEQ ID NO: 1166766 - RNA, 23 nt, Mycobacterium bovis subsp bovis AF2122/97
ccggaaguugaucuugccgcccu

SEQ ID NO: 1166767 - RNA, 12 nt, Mycobacterium bovis subsp bovis AF2122/97
ccggaauacacc

SEQ ID NO: 1166768 - RNA, 14 nt, Mycobacterium bovis subsp bovis AF2122/97
ccggaacgccgucg

SEQ ID NO: 1166769 - RNA, 16 nt, Mycobacterium bovis subsp bovis AF2122/97
ccggaaccggcgugca

SEQ ID NO: 1166770 - RNA, 14 nt, Mycobacterium bovis subsp bovis AF2122/97
ccggaacccgagcc

SEQ ID NO: 1166771 - RNA, 16 nt, Mycobacterium bovis subsp bovis AF2122/97
ccggaaccagccgcgg

SEQ ID NO: 1166772 - RNA, 17 nt, Mycobacterium bovis subsp bovis AF2122/97
ccgcuuucuuggcgggc

SEQ ID NO: 1166773 - RNA, 20 nt, Mycobacterium bovis subsp bovis AF2122/97
ccgcuuugaauugcgcgccc

SEQ ID NO: 1166774 - RNA, 14 nt, Mycobacterium bovis subsp bovis AF2122/97
ccggaaaccacagc

SEQ ID NO: 1166775 - RNA, 15 nt, Mycobacterium bovis subsp bovis AF2122/97
ccggaaacgccaggg

SEQ ID NO: 1166776 - RNA, 15 nt, Mycobacterium bovis subsp bovis AF2122/97
ccggacggcagccgg

SEQ ID NO: 1166777 - RNA, 23 nt, Mycobacterium bovis subsp bovis AF2122/97
ccggacaugcgggcagcacucuu

SEQ ID NO: 1166778 - RNA, 15 nt, Mycobacterium bovis subsp bovis AF2122/97
ccggacagggcggcg

SEQ ID NO: 1166779 - RNA, 18 nt, Mycobacterium bovis subsp bovis AF2122/97
ccggacagggugggggca

SEQ ID NO: 1166780 - RNA, 23 nt, Mycobacterium bovis subsp bovis AF2122/97
ccggacacgaucaguccaugugg

SEQ ID NO: 1166781 - RNA, 23 nt, Mycobacterium bovis subsp bovis AF2122/97
ccggacaaccuggggccaccaga

SEQ ID NO: 1166782 - RNA, 20 nt, Mycobacterium bovis subsp bovis AF2122/97
ccggacaaccuggggccacc

SEQ ID NO: 1166783 - RNA, 21 nt, Mycobacterium bovis subsp bovis AF2122/97
ccggaaucgucgcggccgucg

SEQ ID NO: 1166784 - RNA, 18 nt, Mycobacterium bovis subsp bovis AF2122/97
ccggaauccuggccgccg

SEQ ID NO: 1166785 - RNA, 19 nt, Mycobacterium bovis subsp bovis AF2122/97
ccggagaucccggucccaa

SEQ ID NO: 1166786 - RNA, 18 nt, Mycobacterium bovis subsp bovis AF2122/97
ccggagaucccgguccca

SEQ ID NO: 1166787 - RNA, 14 nt, Mycobacterium bovis subsp bovis AF2122/97
ccggauaacccagc

SEQ ID NO: 1166788 - RNA, 19 nt, Mycobacterium bovis subsp bovis AF2122/97
ccggauaacccagcggcgc

SEQ ID NO: 1166789 - RNA, 17 nt, Mycobacterium bovis subsp bovis AF2122/97
ccggagacccgggugcu

SEQ ID NO: 1166790 - RNA, 14 nt, Mycobacterium bovis subsp bovis AF2122/97
ccggacgucggcgg

SEQ ID NO: 1166791 - RNA, 20 nt, Mycobacterium bovis subsp bovis AF2122/97
ccggacuaccgccggcggcg

SEQ ID NO: 1166792 - RNA, 21 nt, Mycobacterium bovis subsp bovis AF2122/97
ccggacuccaaagccgugcca

SEQ ID NO: 1166793 - RNA, 21 nt, Mycobacterium bovis subsp bovis AF2122/97
ccggacugcggcccgacccgg

SEQ ID NO: 1166794 - RNA, 19 nt, Mycobacterium bovis subsp bovis AF2122/97
ccggcugcauccuccucgu

SEQ ID NO: 1166795 - RNA, 22 nt, Mycobacterium bovis subsp bovis AF2122/97
ccggcugcgguaaucgccaccg

SEQ ID NO: 1166796 - RNA, 17 nt, Mycobacterium bovis subsp bovis AF2122/97
ccggcugccagcgccgc

SEQ ID NO: 1166797 - RNA, 22 nt, Mycobacterium bovis subsp bovis AF2122/97
ccggcugccagcgccgccgccg

SEQ ID NO: 1166798 - RNA, 19 nt, Mycobacterium bovis subsp bovis AF2122/97
ccggcugggcgccaccauc

SEQ ID NO: 1166799 - RNA, 21 nt, Mycobacterium bovis subsp bovis AF2122/97
ccggcucggccagccagcggg

SEQ ID NO: 1166800 - RNA, 12 nt, Mycobacterium bovis subsp bovis AF2122/97
ccggcucgccgg

SEQ ID NO: 1166801 - RNA, 19 nt, Mycobacterium bovis subsp bovis AF2122/97
ccggcucggaaaccgcccc

SEQ ID NO: 1166802 - RNA, 17 nt, Mycobacterium bovis subsp bovis AF2122/97
ccggcugaccgacccgg

SEQ ID NO: 1166803 - RNA, 14 nt, Mycobacterium bovis subsp bovis AF2122/97
ccggcucgucgggc

SEQ ID NO: 1166804 - RNA, 20 nt, Mycobacterium bovis subsp bovis AF2122/97
ccggcugcaaccagcggcac

SEQ ID NO: 1166805 - RNA, 22 nt, Mycobacterium bovis subsp bovis AF2122/97
ccggcugaccggggcgcccggc

SEQ ID NO: 1166806 - RNA, 20 nt, Mycobacterium bovis subsp bovis AF2122/97
ccggcuggugccaacugcgc

SEQ ID NO: 1166807 - RNA, 23 nt, Mycobacterium bovis subsp bovis AF2122/97
ccggcuggugccuuaccaccguc

SEQ ID NO: 1166808 - RNA, 22 nt, Mycobacterium bovis subsp bovis AF2122/97
ccggcugguugaccgaguugaa

SEQ ID NO: 1166809 - RNA, 15 nt, Mycobacterium bovis subsp bovis AF2122/97
ccggcuucgccgcgc

SEQ ID NO: 1166810 - RNA, 16 nt, Mycobacterium bovis subsp bovis AF2122/97
ccggcuucgccgcgcu

SEQ ID NO: 1166811 - RNA, 19 nt, Mycobacterium bovis subsp bovis AF2122/97
ccggcuuaaggcccuggcc

SEQ ID NO: 1166812 - RNA, 13 nt, Mycobacterium bovis subsp bovis AF2122/97
ccggcuuggauac

SEQ ID NO: 1166813 - RNA, 21 nt, Mycobacterium bovis subsp bovis AF2122/97
ccggcuuggccuuugccgucg

SEQ ID NO: 1166814 - RNA, 13 nt, Mycobacterium bovis subsp bovis AF2122/97
ccggcuugggcca

SEQ ID NO: 1166815 - RNA, 16 nt, Mycobacterium bovis subsp bovis AF2122/97
ccggcuugggccaggc

SEQ ID NO: 1166816 - RNA, 18 nt, Mycobacterium bovis subsp bovis AF2122/97
ccggcuucgucggccagc

SEQ ID NO: 1166817 - RNA, 15 nt, Mycobacterium bovis subsp bovis AF2122/97
ccggcuucgucggcc

SEQ ID NO: 1166818 - RNA, 15 nt, Mycobacterium bovis subsp bovis AF2122/97
ccggcuucggccagc

SEQ ID NO: 1166819 - RNA, 22 nt, Mycobacterium bovis subsp bovis AF2122/97
ccggcuucggcgaacccuccgc

SEQ ID NO: 1166820 - RNA, 22 nt, Mycobacterium bovis subsp bovis AF2122/97
ccggcgucgaaggugaccaggc

SEQ ID NO: 1166821 - RNA, 13 nt, Mycobacterium bovis subsp bovis AF2122/97
ccggcgucgcugg

SEQ ID NO: 1166822 - RNA, 19 nt, Mycobacterium bovis subsp bovis AF2122/97
ccggcgucggcgcccagcu

SEQ ID NO: 1166823 - RNA, 16 nt, Mycobacterium bovis subsp bovis AF2122/97
ccggcgucggcgccca

SEQ ID NO: 1166824 - RNA, 22 nt, Mycobacterium bovis subsp bovis AF2122/97
ccggcgucggucgucggguagg

SEQ ID NO: 1166825 - RNA, 13 nt, Mycobacterium bovis subsp bovis AF2122/97
ccggcguguucug

SEQ ID NO: 1166826 - RNA, 22 nt, Mycobacterium bovis subsp bovis AF2122/97
ccggcguugacgaucaguccga

SEQ ID NO: 1166827 - RNA, 19 nt, Mycobacterium bovis subsp bovis AF2122/97
ccggcguugccgccguccc

SEQ ID NO: 1166828 - RNA, 20 nt, Mycobacterium bovis subsp bovis AF2122/97
ccggcguugccgccgucccc

SEQ ID NO: 1166829 - RNA, 20 nt, Mycobacterium bovis subsp bovis AF2122/97
ccggcguugccgccguuccc

SEQ ID NO: 1166830 - RNA, 19 nt, Mycobacterium bovis subsp bovis AF2122/97
ccggcgugucgccgccacc

SEQ ID NO: 1166831 - RNA, 14 nt, Mycobacterium bovis subsp bovis AF2122/97
ccggcucgacugcc

SEQ ID NO: 1166832 - RNA, 14 nt, Mycobacterium bovis subsp bovis AF2122/97
ccggcucgccgacc

SEQ ID NO: 1166833 - RNA, 16 nt, Mycobacterium bovis subsp bovis AF2122/97
ccggcucgccgacccg

SEQ ID NO: 1166834 - RNA, 17 nt, Mycobacterium bovis subsp bovis AF2122/97
ccggcucgccgacccgc

SEQ ID NO: 1166835 - RNA, 16 nt, Mycobacterium bovis subsp bovis AF2122/97
ccggcuccuccccggc

SEQ ID NO: 1166836 - RNA, 21 nt, Mycobacterium bovis subsp bovis AF2122/97
ccggcuccuccccggcccgcu

SEQ ID NO: 1166837 - RNA, 16 nt, Mycobacterium bovis subsp bovis AF2122/97
ccggcuacgacggcgc

SEQ ID NO: 1166838 - RNA, 23 nt, Mycobacterium bovis subsp bovis AF2122/97
ccggcuacggcgacacgccagcc

SEQ ID NO: 1166839 - RNA, 14 nt, Mycobacterium bovis subsp bovis AF2122/97
ccggccagguguug

SEQ ID NO: 1166840 - RNA, 12 nt, Mycobacterium bovis subsp bovis AF2122/97
ccggccaggccg

SEQ ID NO: 1166841 - RNA, 20 nt, Mycobacterium bovis subsp bovis AF2122/97
ccggccaccagggccaccgc

SEQ ID NO: 1166842 - RNA, 11 nt, Mycobacterium bovis subsp bovis AF2122/97
ccggccagcgg

SEQ ID NO: 1166843 - RNA, 18 nt, Mycobacterium bovis subsp bovis AF2122/97
ccggccagcuccucagcc

SEQ ID NO: 1166844 - RNA, 12 nt, Mycobacterium bovis subsp bovis AF2122/97
ccggccaccacg

SEQ ID NO: 1166845 - RNA, 12 nt, Mycobacterium bovis subsp bovis AF2122/97
ccggccaccagc

SEQ ID NO: 1166846 - RNA, 13 nt, Mycobacterium bovis subsp bovis AF2122/97
ccggccaccagcc

SEQ ID NO: 1166847 - RNA, 14 nt, Mycobacterium bovis subsp bovis AF2122/97
ccggccaccaccgc

SEQ ID NO: 1166848 - RNA, 13 nt, Mycobacterium bovis subsp bovis AF2122/97
ccggcggcccgau

SEQ ID NO: 1166849 - RNA, 15 nt, Mycobacterium bovis subsp bovis AF2122/97
ccggcggcccgcucg

SEQ ID NO: 1166850 - RNA, 13 nt, Mycobacterium bovis subsp bovis AF2122/97
ccggcggccgcca

SEQ ID NO: 1166851 - RNA, 18 nt, Mycobacterium bovis subsp bovis AF2122/97
ccggcggccgccaucagc

SEQ ID NO: 1166852 - RNA, 13 nt, Mycobacterium bovis subsp bovis AF2122/97
ccggcggccgccc

SEQ ID NO: 1166853 - RNA, 13 nt, Mycobacterium bovis subsp bovis AF2122/97
ccggcggccgcgg

SEQ ID NO: 1166854 - RNA, 18 nt, Mycobacterium bovis subsp bovis AF2122/97
ccggcggccgcggugccc

SEQ ID NO: 1166855 - RNA, 23 nt, Mycobacterium bovis subsp bovis AF2122/97
ccggcggcgagcggccuccagca

SEQ ID NO: 1166856 - RNA, 15 nt, Mycobacterium bovis subsp bovis AF2122/97
ccggcggcgaccaga

SEQ ID NO: 1166857 - RNA, 14 nt, Mycobacterium bovis subsp bovis AF2122/97
ccggcggccacgcc

SEQ ID NO: 1166858 - RNA, 14 nt, Mycobacterium bovis subsp bovis AF2122/97
ccggcggcagguag

SEQ ID NO: 1166859 - RNA, 21 nt, Mycobacterium bovis subsp bovis AF2122/97
ccggcggagcgggccagcacc

SEQ ID NO: 1166860 - RNA, 16 nt, Mycobacterium bovis subsp bovis AF2122/97
ccggccaucgcccgau

SEQ ID NO: 1166861 - RNA, 14 nt, Mycobacterium bovis subsp bovis AF2122/97
ccggccaucuugag

SEQ ID NO: 1166862 - RNA, 23 nt, Mycobacterium bovis subsp bovis AF2122/97
ccggcggcaaagaacagccggcc

SEQ ID NO: 1166863 - RNA, 20 nt, Mycobacterium bovis subsp bovis AF2122/97
ccggcggaucugaucggcgc

SEQ ID NO: 1166864 - RNA, 16 nt, Mycobacterium bovis subsp bovis AF2122/97
ccggcggauucggcgc

SEQ ID NO: 1166865 - RNA, 19 nt, Mycobacterium bovis subsp bovis AF2122/97
ccggcgggcggugggcagc

SEQ ID NO: 1166866 - RNA, 14 nt, Mycobacterium bovis subsp bovis AF2122/97
ccggcgggcucgcc

SEQ ID NO: 1166867 - RNA, 21 nt, Mycobacterium bovis subsp bovis AF2122/97
ccggcgggugccgagcuggcg

SEQ ID NO: 1166868 - RNA, 23 nt, Mycobacterium bovis subsp bovis AF2122/97
ccggcggucagcagcgccgucag

SEQ ID NO: 1166869 - RNA, 18 nt, Mycobacterium bovis subsp bovis AF2122/97
ccggcgguaccgccgcgg

SEQ ID NO: 1166870 - RNA, 20 nt, Mycobacterium bovis subsp bovis AF2122/97
ccggcggguggcccccgccg

SEQ ID NO: 1166871 - RNA, 21 nt, Mycobacterium bovis subsp bovis AF2122/97
ccggcggguuugcccaucccc

SEQ ID NO: 1166872 - RNA, 15 nt, Mycobacterium bovis subsp bovis AF2122/97
ccggcggcggccgca

SEQ ID NO: 1166873 - RNA, 22 nt, Mycobacterium bovis subsp bovis AF2122/97
ccggcggcgccggaggcggcgc

SEQ ID NO: 1166874 - RNA, 18 nt, Mycobacterium bovis subsp bovis AF2122/97
ccggcggcgccggccucg

SEQ ID NO: 1166875 - RNA, 13 nt, Mycobacterium bovis subsp bovis AF2122/97
ccggcgggcccgc

SEQ ID NO: 1166876 - RNA, 19 nt, Mycobacterium bovis subsp bovis AF2122/97
ccggcgggcccgccggccc

SEQ ID NO: 1166877 - RNA, 18 nt, Mycobacterium bovis subsp bovis AF2122/97
ccggcgggaugcgcgccc

SEQ ID NO: 1166878 - RNA, 20 nt, Mycobacterium bovis subsp bovis AF2122/97
ccggcgggaugcgcgcccga

SEQ ID NO: 1166879 - RNA, 16 nt, Mycobacterium bovis subsp bovis AF2122/97
ccggcggugccggugg

SEQ ID NO: 1166880 - RNA, 13 nt, Mycobacterium bovis subsp bovis AF2122/97
ccggcggucgggc

SEQ ID NO: 1166881 - RNA, 19 nt, Mycobacterium bovis subsp bovis AF2122/97
ccggcggucgggcccggcg

SEQ ID NO: 1166882 - RNA, 20 nt, Mycobacterium bovis subsp bovis AF2122/97
ccggcggugacggcggcaac

SEQ ID NO: 1166883 - RNA, 13 nt, Mycobacterium bovis subsp bovis AF2122/97
ccggcgguggugu

SEQ ID NO: 1166884 - RNA, 19 nt, Mycobacterium bovis subsp bovis AF2122/97
ccggcggugccgucgccgc

SEQ ID NO: 1166885 - RNA, 21 nt, Mycobacterium bovis subsp bovis AF2122/97
ccggcggugccgucgccgccc

SEQ ID NO: 1166886 - RNA, 22 nt, Mycobacterium bovis subsp bovis AF2122/97
ccggcggugccgucgccgcccu

SEQ ID NO: 1166887 - RNA, 21 nt, Mycobacterium bovis subsp bovis AF2122/97
ccggcgggcccgccggccccg

SEQ ID NO: 1166888 - RNA, 12 nt, Mycobacterium bovis subsp bovis AF2122/97
ccggcgguggug

SEQ ID NO: 1166889 - RNA, 19 nt, Mycobacterium bovis subsp bovis AF2122/97
ccggcguccggagccccug

SEQ ID NO: 1166890 - RNA, 16 nt, Mycobacterium bovis subsp bovis AF2122/97
ccggcgucgacgucgg

SEQ ID NO: 1166891 - RNA, 22 nt, Mycobacterium bovis subsp bovis AF2122/97
ccggcguaggcaggaucgccug

SEQ ID NO: 1166892 - RNA, 18 nt, Mycobacterium bovis subsp bovis AF2122/97
ccggcguacgccguaccc

SEQ ID NO: 1166893 - RNA, 19 nt, Mycobacterium bovis subsp bovis AF2122/97
ccggcguacucggugaucg

SEQ ID NO: 1166894 - RNA, 16 nt, Mycobacterium bovis subsp bovis AF2122/97
ccgggcccgccggccc

SEQ ID NO: 1166895 - RNA, 19 nt, Mycobacterium bovis subsp bovis AF2122/97
ccgggcccgccggccccgc

SEQ ID NO: 1166896 - RNA, 13 nt, Mycobacterium bovis subsp bovis AF2122/97
ccgggcggccgcc

SEQ ID NO: 1166897 - RNA, 21 nt, Mycobacterium bovis subsp bovis AF2122/97
ccgggccgagugcccagcgau

SEQ ID NO: 1166898 - RNA, 21 nt, Mycobacterium bovis subsp bovis AF2122/97
ccgggccgaucaccccggugg

SEQ ID NO: 1166899 - RNA, 17 nt, Mycobacterium bovis subsp bovis AF2122/97
ccgggcggccucccggg

SEQ ID NO: 1166900 - RNA, 22 nt, Mycobacterium bovis subsp bovis AF2122/97
ccgggcggccucccgggccgcc

SEQ ID NO: 1166901 - RNA, 22 nt, Mycobacterium bovis subsp bovis AF2122/97
ccgggcguugggaucgcgcagc

SEQ ID NO: 1166902 - RNA, 19 nt, Mycobacterium bovis subsp bovis AF2122/97
ccgggcgugguaucgccgg

SEQ ID NO: 1166903 - RNA, 16 nt, Mycobacterium bovis subsp bovis AF2122/97
ccgggcgugcggcggc

SEQ ID NO: 1166904 - RNA, 17 nt, Mycobacterium bovis subsp bovis AF2122/97
ccgggcgugcggcggcc

SEQ ID NO: 1166905 - RNA, 19 nt, Mycobacterium bovis subsp bovis AF2122/97
ccgggcgugggcaccccgc

SEQ ID NO: 1166906 - RNA, 13 nt, Mycobacterium bovis subsp bovis AF2122/97
ccgggcggcggcg

SEQ ID NO: 1166907 - RNA, 12 nt, Mycobacterium bovis subsp bovis AF2122/97
ccgggcgggcug

SEQ ID NO: 1166908 - RNA, 11 nt, Mycobacterium bovis subsp bovis AF2122/97
ccgggcgugcc

SEQ ID NO: 1166909 - RNA, 23 nt, Mycobacterium bovis subsp bovis AF2122/97
ccgggcuccaauugcggccgcgc

SEQ ID NO: 1166910 - RNA, 22 nt, Mycobacterium bovis subsp bovis AF2122/97
ccgggcucggcgaaggccgcgc

SEQ ID NO: 1166911 - RNA, 16 nt, Mycobacterium bovis subsp bovis AF2122/97
ccgggcuggccagcgc

SEQ ID NO: 1166912 - RNA, 15 nt, Mycobacterium bovis subsp bovis AF2122/97
ccgggcuuaggccgc

SEQ ID NO: 1166913 - RNA, 17 nt, Mycobacterium bovis subsp bovis AF2122/97
ccgggcuuggccgcgcc

SEQ ID NO: 1166914 - RNA, 18 nt, Mycobacterium bovis subsp bovis AF2122/97
ccggggacgccgcggcgc

SEQ ID NO: 1166915 - RNA, 13 nt, Mycobacterium bovis subsp bovis AF2122/97
ccggggccacccg

SEQ ID NO: 1166916 - RNA, 21 nt, Mycobacterium bovis subsp bovis AF2122/97
ccggggcagcucaccuuccuc

SEQ ID NO: 1166917 - RNA, 17 nt, Mycobacterium bovis subsp bovis AF2122/97
ccggcuugggccaggcc

SEQ ID NO: 1166918 - RNA, 20 nt, Mycobacterium bovis subsp bovis AF2122/97
ccggcuugggccaggcccag

SEQ ID NO: 1166919 - RNA, 15 nt, Mycobacterium bovis subsp bovis AF2122/97
ccgggaaacaccggc

SEQ ID NO: 1166920 - RNA, 14 nt, Mycobacterium bovis subsp bovis AF2122/97
ccgggaagucgcug

SEQ ID NO: 1166921 - RNA, 21 nt, Mycobacterium bovis subsp bovis AF2122/97
ccgggaauggacaggucgggc

SEQ ID NO: 1166922 - RNA, 14 nt, Mycobacterium bovis subsp bovis AF2122/97
ccgggaauggcgac

SEQ ID NO: 1166923 - RNA, 17 nt, Mycobacterium bovis subsp bovis AF2122/97
ccgggccaggcugcgca

SEQ ID NO: 1166924 - RNA, 18 nt, Mycobacterium bovis subsp bovis AF2122/97
ccgggccacguccugccc

SEQ ID NO: 1166925 - RNA, 21 nt, Mycobacterium bovis subsp bovis AF2122/97
ccgggccacgucgagcacccg

SEQ ID NO: 1166926 - RNA, 19 nt, Mycobacterium bovis subsp bovis AF2122/97
ccgggcauccuucaccagc

SEQ ID NO: 1166927 - RNA, 20 nt, Mycobacterium bovis subsp bovis AF2122/97
ccgggcaugaucacacugcc

SEQ ID NO: 1166928 - RNA, 18 nt, Mycobacterium bovis subsp bovis AF2122/97
ccgggauaacccagcacc

SEQ ID NO: 1166929 - RNA, 20 nt, Mycobacterium bovis subsp bovis AF2122/97
ccgggacaaucucggccgca

SEQ ID NO: 1166930 - RNA, 14 nt, Mycobacterium bovis subsp bovis AF2122/97
ccgggacuaccacc

SEQ ID NO: 1166931 - RNA, 20 nt, Mycobacterium bovis subsp bovis AF2122/97
ccgggacguuguccaccgcc

SEQ ID NO: 1166932 - RNA, 15 nt, Mycobacterium bovis subsp bovis AF2122/97
ccgggaaggaaccgg

SEQ ID NO: 1166933 - RNA, 14 nt, Mycobacterium bovis subsp bovis AF2122/97
ccgggagucgucgg

SEQ ID NO: 1166934 - RNA, 16 nt, Mycobacterium bovis subsp bovis AF2122/97
ccgggagucgucggca

SEQ ID NO: 1166935 - RNA, 15 nt, Mycobacterium bovis subsp bovis AF2122/97
ccgggauaacccagc

SEQ ID NO: 1166936 - RNA, 15 nt, Mycobacterium bovis subsp bovis AF2122/97
ccggggccccaugcc

SEQ ID NO: 1166937 - RNA, 12 nt, Mycobacterium bovis subsp bovis AF2122/97
ccggggccgcaa

SEQ ID NO: 1166938 - RNA, 17 nt, Mycobacterium bovis subsp bovis AF2122/97
ccggggccgcggcccac

SEQ ID NO: 1166939 - RNA, 13 nt, Mycobacterium bovis subsp bovis AF2122/97
ccggggcgcccgg

SEQ ID NO: 1166940 - RNA, 15 nt, Mycobacterium bovis subsp bovis AF2122/97
ccggggcgcccggcc

SEQ ID NO: 1166941 - RNA, 15 nt, Mycobacterium bovis subsp bovis AF2122/97
ccggggcggugggcg

SEQ ID NO: 1166942 - RNA, 21 nt, Mycobacterium bovis subsp bovis AF2122/97
ccggggcgcccggccaggucg

SEQ ID NO: 1166943 - RNA, 15 nt, Mycobacterium bovis subsp bovis AF2122/97
ccggggcgcucgcgc

SEQ ID NO: 1166944 - RNA, 16 nt, Mycobacterium bovis subsp bovis AF2122/97
ccggguagcggauagc

SEQ ID NO: 1166945 - RNA, 16 nt, Mycobacterium bovis subsp bovis AF2122/97
ccggguagcggcgccg

SEQ ID NO: 1166946 - RNA, 14 nt, Mycobacterium bovis subsp bovis AF2122/97
ccggguauggcggc

SEQ ID NO: 1166947 - RNA, 13 nt, Mycobacterium bovis subsp bovis AF2122/97
ccgggucaccagc

SEQ ID NO: 1166948 - RNA, 20 nt, Mycobacterium bovis subsp bovis AF2122/97
ccgggucaccgauucggcca

SEQ ID NO: 1166949 - RNA, 19 nt, Mycobacterium bovis subsp bovis AF2122/97
ccggguagacaugggugaa

SEQ ID NO: 1166950 - RNA, 18 nt, Mycobacterium bovis subsp bovis AF2122/97
ccggguagccggcgugca

SEQ ID NO: 1166951 - RNA, 19 nt, Mycobacterium bovis subsp bovis AF2122/97
ccggguagcggcgccgccc

SEQ ID NO: 1166952 - RNA, 20 nt, Mycobacterium bovis subsp bovis AF2122/97
ccggguagcggcgccgcccu

SEQ ID NO: 1166953 - RNA, 19 nt, Mycobacterium bovis subsp bovis AF2122/97
ccggguagcucccugggcg

SEQ ID NO: 1166954 - RNA, 17 nt, Mycobacterium bovis subsp bovis AF2122/97
ccgggguuggucgucgc

SEQ ID NO: 1166955 - RNA, 19 nt, Mycobacterium bovis subsp bovis AF2122/97
ccggguugguacccaccag

SEQ ID NO: 1166956 - RNA, 19 nt, Mycobacterium bovis subsp bovis AF2122/97
ccggguuggaagccgcacc

SEQ ID NO: 1166957 - RNA, 15 nt, Mycobacterium bovis subsp bovis AF2122/97
ccgguaacgaacagc

SEQ ID NO: 1166958 - RNA, 19 nt, Mycobacterium bovis subsp bovis AF2122/97
ccgggucacuccggcggcu

SEQ ID NO: 1166959 - RNA, 16 nt, Mycobacterium bovis subsp bovis AF2122/97
ccgggucagcccagcc

SEQ ID NO: 1166960 - RNA, 19 nt, Mycobacterium bovis subsp bovis AF2122/97
ccggguugagccgccgcga

SEQ ID NO: 1166961 - RNA, 16 nt, Mycobacterium bovis subsp bovis AF2122/97
ccgguccggucggcgg

SEQ ID NO: 1166962 - RNA, 22 nt, Mycobacterium bovis subsp bovis AF2122/97
ccggucagcaauacggcggcgc

SEQ ID NO: 1166963 - RNA, 18 nt, Mycobacterium bovis subsp bovis AF2122/97
ccgguccgucaccaccgc

SEQ ID NO: 1166964 - RNA, 18 nt, Mycobacterium bovis subsp bovis AF2122/97
ccggucaccucgccggcg

SEQ ID NO: 1166965 - RNA, 22 nt, Mycobacterium bovis subsp bovis AF2122/97
ccggucaaacugccaucggaca

SEQ ID NO: 1166966 - RNA, 18 nt, Mycobacterium bovis subsp bovis AF2122/97
ccgguaggcggccagcgc

SEQ ID NO: 1166967 - RNA, 16 nt, Mycobacterium bovis subsp bovis AF2122/97
ccgguaucgucccggc

SEQ ID NO: 1166968 - RNA, 20 nt, Mycobacterium bovis subsp bovis AF2122/97
ccgguaggcgagacauugac

SEQ ID NO: 1166969 - RNA, 14 nt, Mycobacterium bovis subsp bovis AF2122/97
ccgguaguccgcgc

SEQ ID NO: 1166970 - RNA, 15 nt, Mycobacterium bovis subsp bovis AF2122/97
ccgguaguccgcgcu

SEQ ID NO: 1166971 - RNA, 16 nt, Mycobacterium bovis subsp bovis AF2122/97
ccgguaggcggccagc

SEQ ID NO: 1166972 - RNA, 17 nt, Mycobacterium bovis subsp bovis AF2122/97
ccgguaggcggccagcg

SEQ ID NO: 1166973 - RNA, 18 nt, Mycobacterium bovis subsp bovis AF2122/97
ccgguauuaccgccgugg

SEQ ID NO: 1166974 - RNA, 21 nt, Mycobacterium bovis subsp bovis AF2122/97
ccgguaucgccaaauccggug

SEQ ID NO: 1166975 - RNA, 17 nt, Mycobacterium bovis subsp bovis AF2122/97
ccggugacaaguggugc

SEQ ID NO: 1166976 - RNA, 16 nt, Mycobacterium bovis subsp bovis AF2122/97
ccggugaacggcagca

SEQ ID NO: 1166977 - RNA, 14 nt, Mycobacterium bovis subsp bovis AF2122/97
ccggucgcggaacu

SEQ ID NO: 1166978 - RNA, 14 nt, Mycobacterium bovis subsp bovis AF2122/97
ccggucgccucacc

SEQ ID NO: 1166979 - RNA, 16 nt, Mycobacterium bovis subsp bovis AF2122/97
ccggucgccucaccgg

SEQ ID NO: 1166980 - RNA, 18 nt, Mycobacterium bovis subsp bovis AF2122/97
ccggucgcacuuggcccc

SEQ ID NO: 1166981 - RNA, 17 nt, Mycobacterium bovis subsp bovis AF2122/97
ccggucgaugaccucca

SEQ ID NO: 1166982 - RNA, 12 nt, Mycobacterium bovis subsp bovis AF2122/97
ccggucgccgcg

SEQ ID NO: 1166983 - RNA, 13 nt, Mycobacterium bovis subsp bovis AF2122/97
ccggucgccgcga

SEQ ID NO: 1166984 - RNA, 14 nt, Mycobacterium bovis subsp bovis AF2122/97
ccggucgaggugac

SEQ ID NO: 1166985 - RNA, 16 nt, Mycobacterium bovis subsp bovis AF2122/97
ccggucgacuccagca

SEQ ID NO: 1166986 - RNA, 17 nt, Mycobacterium bovis subsp bovis AF2122/97
ccgguccugggauccgg

SEQ ID NO: 1166987 - RNA, 22 nt, Mycobacterium bovis subsp bovis AF2122/97
ccgguccugggauccggcggca

SEQ ID NO: 1166988 - RNA, 18 nt, Mycobacterium bovis subsp bovis AF2122/97
ccggucgacccacucauc

SEQ ID NO: 1166989 - RNA, 20 nt, Mycobacterium bovis subsp bovis AF2122/97
ccgucgacaacaaacccggc

SEQ ID NO: 1166990 - RNA, 21 nt, Mycobacterium bovis subsp bovis AF2122/97
ccgucgacaacaaacccggcc

SEQ ID NO: 1166991 - RNA, 20 nt, Mycobacterium bovis subsp bovis AF2122/97
ccgucgacaccgcggacccg

SEQ ID NO: 1166992 - RNA, 23 nt, Mycobacterium bovis subsp bovis AF2122/97
ccgucagcggcaacaugucaccu

SEQ ID NO: 1166993 - RNA, 18 nt, Mycobacterium bovis subsp bovis AF2122/97
ccgucagcggcggccacg

SEQ ID NO: 1166994 - RNA, 16 nt, Mycobacterium bovis subsp bovis AF2122/97
ccgucagcgucggcgc

SEQ ID NO: 1166995 - RNA, 22 nt, Mycobacterium bovis subsp bovis AF2122/97
ccgucagcgccgcugacuccug

SEQ ID NO: 1166996 - RNA, 15 nt, Mycobacterium bovis subsp bovis AF2122/97
ccgucagccaggugc

SEQ ID NO: 1166997 - RNA, 18 nt, Mycobacterium bovis subsp bovis AF2122/97
ccgucagccaggugccca

SEQ ID NO: 1166998 - RNA, 15 nt, Mycobacterium bovis subsp bovis AF2122/97
ccgucgaguccaggc

SEQ ID NO: 1166999 - RNA, 15 nt, Mycobacterium bovis subsp bovis AF2122/97
ccgucgaucagcggc

SEQ ID NO: 1167000 - RNA, 15 nt, Mycobacterium bovis subsp bovis AF2122/97
ccgucgcggcggcac

SEQ ID NO: 1167001 - RNA, 18 nt, Mycobacterium bovis subsp bovis AF2122/97
ccgucgauggucagcaga

SEQ ID NO: 1167002 - RNA, 19 nt, Mycobacterium bovis subsp bovis AF2122/97
ccgucgcguugagcgcagc

SEQ ID NO: 1167003 - RNA, 18 nt, Mycobacterium bovis subsp bovis AF2122/97
ccgucgcuacccgccacg

SEQ ID NO: 1167004 - RNA, 21 nt, Mycobacterium bovis subsp bovis AF2122/97
ccgucgcugacgcccuccugg

SEQ ID NO: 1167005 - RNA, 18 nt, Mycobacterium bovis subsp bovis AF2122/97
ccgucggcgcgcaccucg

SEQ ID NO: 1167006 - RNA, 14 nt, Mycobacterium bovis subsp bovis AF2122/97
ccgucggcgacucc

SEQ ID NO: 1167007 - RNA, 17 nt, Mycobacterium bovis subsp bovis AF2122/97
ccgucggcgacuccucu

SEQ ID NO: 1167008 - RNA, 21 nt, Mycobacterium bovis subsp bovis AF2122/97
ccgucgcugggaggcgcgguc

SEQ ID NO: 1167009 - RNA, 16 nt, Mycobacterium bovis subsp bovis AF2122/97
ccgucgcgucgaccgg

SEQ ID NO: 1167010 - RNA, 13 nt, Mycobacterium bovis subsp bovis AF2122/97
ccgucggaacuga

SEQ ID NO: 1167011 - RNA, 12 nt, Mycobacterium bovis subsp bovis AF2122/97
ccgucggcagca

SEQ ID NO: 1167012 - RNA, 17 nt, Mycobacterium bovis subsp bovis AF2122/97
ccgucggcagcagcggu

SEQ ID NO: 1167013 - RNA, 23 nt, Mycobacterium bovis subsp bovis AF2122/97
ccgucgggugcugaugggucagg

SEQ ID NO: 1167014 - RNA, 16 nt, Mycobacterium bovis subsp bovis AF2122/97
ccgucggugccgccgc

SEQ ID NO: 1167015 - RNA, 18 nt, Mycobacterium bovis subsp bovis AF2122/97
ccgucggguaggccgccg

SEQ ID NO: 1167016 - RNA, 22 nt, Mycobacterium bovis subsp bovis AF2122/97
ccgucggggguaauugccagcc

SEQ ID NO: 1167017 - RNA, 19 nt, Mycobacterium bovis subsp bovis AF2122/97
ccgucgggcacaccgacgc

SEQ ID NO: 1167018 - RNA, 15 nt, Mycobacterium bovis subsp bovis AF2122/97
ccgucgggcccagcc

SEQ ID NO: 1167019 - RNA, 18 nt, Mycobacterium bovis subsp bovis AF2122/97
ccgucgggccgucgggug

SEQ ID NO: 1167020 - RNA, 21 nt, Mycobacterium bovis subsp bovis AF2122/97
ccgucguccgcugacccgcca

SEQ ID NO: 1167021 - RNA, 21 nt, Mycobacterium bovis subsp bovis AF2122/97
ccgucggugccggggcugccg

SEQ ID NO: 1167022 - RNA, 14 nt, Mycobacterium bovis subsp bovis AF2122/97
ccgucuucgccgcc

SEQ ID NO: 1167023 - RNA, 17 nt, Mycobacterium bovis subsp bovis AF2122/97
ccgucugcuggccgggu

SEQ ID NO: 1167024 - RNA, 11 nt, Mycobacterium bovis subsp bovis AF2122/97
ccgucugcggu

SEQ ID NO: 1167025 - RNA, 22 nt, Mycobacterium bovis subsp bovis AF2122/97
ccgucugcgacccgggccgcgg

SEQ ID NO: 1167026 - RNA, 17 nt, Mycobacterium bovis subsp bovis AF2122/97
ccgucugcgacccgggc

SEQ ID NO: 1167027 - RNA, 15 nt, Mycobacterium bovis subsp bovis AF2122/97
ccgucucggcgaccg

SEQ ID NO: 1167028 - RNA, 19 nt, Mycobacterium bovis subsp bovis AF2122/97
ccgucugacccaccgcccc

SEQ ID NO: 1167029 - RNA, 12 nt, Mycobacterium bovis subsp bovis AF2122/97
ccgucugaucac

SEQ ID NO: 1167030 - RNA, 19 nt, Mycobacterium bovis subsp bovis AF2122/97
ccgucguugcccgacccgc

SEQ ID NO: 1167031 - RNA, 17 nt, Mycobacterium bovis subsp bovis AF2122/97
ccgucguugugccgguc

SEQ ID NO: 1167032 - RNA, 22 nt, Mycobacterium bovis subsp bovis AF2122/97
ccgucucgaagcucagcuucuu

SEQ ID NO: 1167033 - RNA, 14 nt, Mycobacterium bovis subsp bovis AF2122/97
ccgucucgccgcgc

SEQ ID NO: 1167034 - RNA, 15 nt, Mycobacterium bovis subsp bovis AF2122/97
ccgucucgccgcgca

SEQ ID NO: 1167035 - RNA, 23 nt, Mycobacterium bovis subsp bovis AF2122/97
ccguagucgucaaacacucugau

SEQ ID NO: 1167036 - RNA, 19 nt, Mycobacterium bovis subsp bovis AF2122/97
ccguagugcacgucggcgg

SEQ ID NO: 1167037 - RNA, 14 nt, Mycobacterium bovis subsp bovis AF2122/97
ccguaguaguggcc

SEQ ID NO: 1167038 - RNA, 23 nt, Mycobacterium bovis subsp bovis AF2122/97
ccguaguaguggccgccacccgc

SEQ ID NO: 1167039 - RNA, 22 nt, Mycobacterium bovis subsp bovis AF2122/97
ccguaguaguucagccaggccg

SEQ ID NO: 1167040 - RNA, 23 nt, Mycobacterium bovis subsp bovis AF2122/97
ccguaguaaggagccgggccguc

SEQ ID NO: 1167041 - RNA, 13 nt, Mycobacterium bovis subsp bovis AF2122/97
ccguaggccacag

SEQ ID NO: 1167042 - RNA, 19 nt, Mycobacterium bovis subsp bovis AF2122/97
ccguagccagcaggaacgc

SEQ ID NO: 1167043 - RNA, 13 nt, Mycobacterium bovis subsp bovis AF2122/97
ccgucagaccauc

SEQ ID NO: 1167044 - RNA, 20 nt, Mycobacterium bovis subsp bovis AF2122/97
ccgucagaacaccggccagg

SEQ ID NO: 1167045 - RNA, 23 nt, Mycobacterium bovis subsp bovis AF2122/97
ccgucagaacaccggccaggccg

SEQ ID NO: 1167046 - RNA, 15 nt, Mycobacterium bovis subsp bovis AF2122/97
ccguagugucggcgu

SEQ ID NO: 1167047 - RNA, 15 nt, Mycobacterium bovis subsp bovis AF2122/97
ccguaguggccggcu

SEQ ID NO: 1167048 - RNA, 14 nt, Mycobacterium bovis subsp bovis AF2122/97
ccguaguggccggc

SEQ ID NO: 1167049 - RNA, 19 nt, Mycobacterium bovis subsp bovis AF2122/97
ccguaguugguccagguga

SEQ ID NO: 1167050 - RNA, 13 nt, Mycobacterium bovis subsp bovis AF2122/97
ccguagaccagcc

SEQ ID NO: 1167051 - RNA, 13 nt, Mycobacterium bovis subsp bovis AF2122/97
ccguagacccaca

SEQ ID NO: 1167052 - RNA, 19 nt, Mycobacterium bovis subsp bovis AF2122/97
ccguagagcaugccgcccg

SEQ ID NO: 1167053 - RNA, 15 nt, Mycobacterium bovis subsp bovis AF2122/97
ccguacgccggcggu

SEQ ID NO: 1167054 - RNA, 22 nt, Mycobacterium bovis subsp bovis AF2122/97
ccguagcacaccgguggacccg

SEQ ID NO: 1167055 - RNA, 14 nt, Mycobacterium bovis subsp bovis AF2122/97
ccguagcacaccgg

SEQ ID NO: 1167056 - RNA, 18 nt, Mycobacterium bovis subsp bovis AF2122/97
ccguagcacaccggugga

SEQ ID NO: 1167057 - RNA, 17 nt, Mycobacterium bovis subsp bovis AF2122/97
ccguagccggccggccc

SEQ ID NO: 1167058 - RNA, 18 nt, Mycobacterium bovis subsp bovis AF2122/97
ccguagcgcaggagcgcg

SEQ ID NO: 1167059 - RNA, 22 nt, Mycobacterium bovis subsp bovis AF2122/97
ccguagcggucuccccagagcu

SEQ ID NO: 1167060 - RNA, 16 nt, Mycobacterium bovis subsp bovis AF2122/97
ccguagcugcgcagcg

SEQ ID NO: 1167061 - RNA, 18 nt, Mycobacterium bovis subsp bovis AF2122/97
ccguagcugcgcagcgca

SEQ ID NO: 1167062 - RNA, 16 nt, Mycobacterium bovis subsp bovis AF2122/97
ccggugaucggcggca

SEQ ID NO: 1167063 - RNA, 22 nt, Mycobacterium bovis subsp bovis AF2122/97
ccggugauccaacuggccgcgu

SEQ ID NO: 1167064 - RNA, 19 nt, Mycobacterium bovis subsp bovis AF2122/97
ccggugauggccgaccagc

SEQ ID NO: 1167065 - RNA, 19 nt, Mycobacterium bovis subsp bovis AF2122/97
ccggugauggugugcagca

SEQ ID NO: 1167066 - RNA, 20 nt, Mycobacterium bovis subsp bovis AF2122/97
ccggugauggugugcagcag

SEQ ID NO: 1167067 - RNA, 16 nt, Mycobacterium bovis subsp bovis AF2122/97
ccggugaacgguagca

SEQ ID NO: 1167068 - RNA, 18 nt, Mycobacterium bovis subsp bovis AF2122/97
ccggugagcgagcgcgcg

SEQ ID NO: 1167069 - RNA, 19 nt, Mycobacterium bovis subsp bovis AF2122/97
ccggugacgcacagcagca

SEQ ID NO: 1167070 - RNA, 24 nt, Mycobacterium bovis subsp bovis AF2122/97
ccggugacgcacagcagcaccgcg

SEQ ID NO: 1167071 - RNA, 13 nt, Mycobacterium bovis subsp bovis AF2122/97
ccggugacgccgu

SEQ ID NO: 1167072 - RNA, 13 nt, Mycobacterium bovis subsp bovis AF2122/97
ccggugacggugu

SEQ ID NO: 1167073 - RNA, 17 nt, Mycobacterium bovis subsp bovis AF2122/97
ccggugagaagaagccc

SEQ ID NO: 1167074 - RNA, 13 nt, Mycobacterium bovis subsp bovis AF2122/97
ccggugccgccau

SEQ ID NO: 1167075 - RNA, 21 nt, Mycobacterium bovis subsp bovis AF2122/97
ccggugccgccaucgccgccg

SEQ ID NO: 1167076 - RNA, 17 nt, Mycobacterium bovis subsp bovis AF2122/97
ccggugccgccauugac

SEQ ID NO: 1167077 - RNA, 12 nt, Mycobacterium bovis subsp bovis AF2122/97
ccggugccgccc

SEQ ID NO: 1167078 - RNA, 17 nt, Mycobacterium bovis subsp bovis AF2122/97
ccggugccgcccgagcc

SEQ ID NO: 1167079 - RNA, 22 nt, Mycobacterium bovis subsp bovis AF2122/97
ccggugcccaccaccgacagca

SEQ ID NO: 1167080 - RNA, 14 nt, Mycobacterium bovis subsp bovis AF2122/97
ccggugccaccggc

SEQ ID NO: 1167081 - RNA, 14 nt, Mycobacterium bovis subsp bovis AF2122/97
ccggugccagucca

SEQ ID NO: 1167082 - RNA, 21 nt, Mycobacterium bovis subsp bovis AF2122/97
ccggugcagaugcggcugaau

SEQ ID NO: 1167083 - RNA, 21 nt, Mycobacterium bovis subsp bovis AF2122/97
ccguaaauaucggggccacug

SEQ ID NO: 1167084 - RNA, 14 nt, Mycobacterium bovis subsp bovis AF2122/97
ccggugccgcccgc

SEQ ID NO: 1167085 - RNA, 15 nt, Mycobacterium bovis subsp bovis AF2122/97
ccggugccgccgccu

SEQ ID NO: 1167086 - RNA, 20 nt, Mycobacterium bovis subsp bovis AF2122/97
ccggugccgcccgcgccgcc

SEQ ID NO: 1167087 - RNA, 20 nt, Mycobacterium bovis subsp bovis AF2122/97
ccggugccgccggugccgcc

SEQ ID NO: 1167088 - RNA, 19 nt, Mycobacterium bovis subsp bovis AF2122/97
ccggugccgccgucgccgc

SEQ ID NO: 1167089 - RNA, 22 nt, Mycobacterium bovis subsp bovis AF2122/97
ccggugccgccggugccgccug

SEQ ID NO: 1167090 - RNA, 13 nt, Mycobacterium bovis subsp bovis AF2122/97
ccggugccgcagc

SEQ ID NO: 1167091 - RNA, 19 nt, Mycobacterium bovis subsp bovis AF2122/97
ccgguuugcacgcaccaca

SEQ ID NO: 1167092 - RNA, 18 nt, Mycobacterium bovis subsp bovis AF2122/97
ccguugauucggccgccg

SEQ ID NO: 1167093 - RNA, 17 nt, Mycobacterium bovis subsp bovis AF2122/97
ccguugcgaauccccaa

SEQ ID NO: 1167094 - RNA, 16 nt, Mycobacterium bovis subsp bovis AF2122/97
ccguugccgcccacua

SEQ ID NO: 1167095 - RNA, 15 nt, Mycobacterium bovis subsp bovis AF2122/97
ccguugccgccgccu

SEQ ID NO: 1167096 - RNA, 22 nt, Mycobacterium bovis subsp bovis AF2122/97
ccguugccgccggugccacccu

SEQ ID NO: 1167097 - RNA, 16 nt, Mycobacterium bovis subsp bovis AF2122/97
ccguugccgccgucgc

SEQ ID NO: 1167098 - RNA, 17 nt, Mycobacterium bovis subsp bovis AF2122/97
ccguugccguacagccc

SEQ ID NO: 1167099 - RNA, 21 nt, Mycobacterium bovis subsp bovis AF2122/97
ccguugccguacagcccggcc

SEQ ID NO: 1167100 - RNA, 13 nt, Mycobacterium bovis subsp bovis AF2122/97
ccguuggagccgc

SEQ ID NO: 1167101 - RNA, 14 nt, Mycobacterium bovis subsp bovis AF2122/97
ccguucgccgucgg

SEQ ID NO: 1167102 - RNA, 18 nt, Mycobacterium bovis subsp bovis AF2122/97
ccguugcccccauugccg

SEQ ID NO: 1167103 - RNA, 18 nt, Mycobacterium bovis subsp bovis AF2122/97
ccguugccgaucagcccg

SEQ ID NO: 1167104 - RNA, 21 nt, Mycobacterium bovis subsp bovis AF2122/97
ccguugccgaucagcccggcc

SEQ ID NO: 1167105 - RNA, 17 nt, Mycobacterium bovis subsp bovis AF2122/97
ccguugccgccauuggc

SEQ ID NO: 1167106 - RNA, 17 nt, Mycobacterium bovis subsp bovis AF2122/97
ccguucgacccagcggu

SEQ ID NO: 1167107 - RNA, 19 nt, Mycobacterium bovis subsp bovis AF2122/97
ccguucgaccguguaacca

SEQ ID NO: 1167108 - RNA, 22 nt, Mycobacterium bovis subsp bovis AF2122/97
ccguucgcccgcccgucuucca

SEQ ID NO: 1167109 - RNA, 19 nt, Mycobacterium bovis subsp bovis AF2122/97
ccuaaauugccgggcccag

SEQ ID NO: 1167110 - RNA, 14 nt, Mycobacterium bovis subsp bovis AF2122/97
ccguugcgggccag

SEQ ID NO: 1167111 - RNA, 14 nt, Mycobacterium bovis subsp bovis AF2122/97
ccuaacucgccugc

SEQ ID NO: 1167112 - RNA, 19 nt, Mycobacterium bovis subsp bovis AF2122/97
ccuaacgaaccagcccgcc

SEQ ID NO: 1167113 - RNA, 17 nt, Mycobacterium bovis subsp bovis AF2122/97
ccuaacaucguugaucu

SEQ ID NO: 1167114 - RNA, 18 nt, Mycobacterium bovis subsp bovis AF2122/97
ccgugcgaugcacaaccg

SEQ ID NO: 1167115 - RNA, 19 nt, Mycobacterium bovis subsp bovis AF2122/97
ccgugccgccgacaccacc

SEQ ID NO: 1167116 - RNA, 21 nt, Mycobacterium bovis subsp bovis AF2122/97
ccgugccgguguguccagcgg

SEQ ID NO: 1167117 - RNA, 22 nt, Mycobacterium bovis subsp bovis AF2122/97
ccgugccgguguguccagcgga

SEQ ID NO: 1167118 - RNA, 19 nt, Mycobacterium bovis subsp bovis AF2122/97
ccgugcgcgcgcagcugac

SEQ ID NO: 1167119 - RNA, 17 nt, Mycobacterium bovis subsp bovis AF2122/97
ccgugccagcccaggcc

SEQ ID NO: 1167120 - RNA, 15 nt, Mycobacterium bovis subsp bovis AF2122/97
ccgugcccccggcuu

SEQ ID NO: 1167121 - RNA, 14 nt, Mycobacterium bovis subsp bovis AF2122/97
ccgugcccggugcg

SEQ ID NO: 1167122 - RNA, 12 nt, Mycobacterium bovis subsp bovis AF2122/97
ccgugccgccag

SEQ ID NO: 1167123 - RNA, 13 nt, Mycobacterium bovis subsp bovis AF2122/97
ccgugccgcccgg

SEQ ID NO: 1167124 - RNA, 23 nt, Mycobacterium bovis subsp bovis AF2122/97
ccgucuuuggugccgagcagcuu

SEQ ID NO: 1167125 - RNA, 21 nt, Mycobacterium bovis subsp bovis AF2122/97
ccgucuuugucacgcaccgcg

SEQ ID NO: 1167126 - RNA, 14 nt, Mycobacterium bovis subsp bovis AF2122/97
ccgucuuggcccgg

SEQ ID NO: 1167127 - RNA, 16 nt, Mycobacterium bovis subsp bovis AF2122/97
ccgucuuggcccgguc

SEQ ID NO: 1167128 - RNA, 12 nt, Mycobacterium bovis subsp bovis AF2122/97
ccgugaagcccu

SEQ ID NO: 1167129 - RNA, 21 nt, Mycobacterium bovis subsp bovis AF2122/97
ccgugagccuuucgugcaccg

SEQ ID NO: 1167130 - RNA, 16 nt, Mycobacterium bovis subsp bovis AF2122/97
ccgugacguagggcag

SEQ ID NO: 1167131 - RNA, 20 nt, Mycobacterium bovis subsp bovis AF2122/97
ccgugacguagggcagcgcc

SEQ ID NO: 1167132 - RNA, 23 nt, Mycobacterium bovis subsp bovis AF2122/97
ccguggguguugaugggcagccg

SEQ ID NO: 1167133 - RNA, 14 nt, Mycobacterium bovis subsp bovis AF2122/97
ccguggucgaggug

SEQ ID NO: 1167134 - RNA, 15 nt, Mycobacterium bovis subsp bovis AF2122/97
ccgugguggucgggc

SEQ ID NO: 1167135 - RNA, 18 nt, Mycobacterium bovis subsp bovis AF2122/97
ccguggugcuagcgccgc

SEQ ID NO: 1167136 - RNA, 19 nt, Mycobacterium bovis subsp bovis AF2122/97
ccguggugcuagcgccgcc

SEQ ID NO: 1167137 - RNA, 20 nt, Mycobacterium bovis subsp bovis AF2122/97
ccguggugcuagcgccgcca

SEQ ID NO: 1167138 - RNA, 16 nt, Mycobacterium bovis subsp bovis AF2122/97
ccgugcggggggcagc

SEQ ID NO: 1167139 - RNA, 20 nt, Mycobacterium bovis subsp bovis AF2122/97
ccgugcgcgcgcagcugacg

SEQ ID NO: 1167140 - RNA, 21 nt, Mycobacterium bovis subsp bovis AF2122/97
ccgugcuuuccuugcgcgcca

SEQ ID NO: 1167141 - RNA, 16 nt, Mycobacterium bovis subsp bovis AF2122/97
ccgugcugcccauccc

SEQ ID NO: 1167142 - RNA, 19 nt, Mycobacterium bovis subsp bovis AF2122/97
ccgugugugcgauccaggg

SEQ ID NO: 1167143 - RNA, 23 nt, Mycobacterium bovis subsp bovis AF2122/97
ccgugugcggacaguucccggcc

SEQ ID NO: 1167144 - RNA, 19 nt, Mycobacterium bovis subsp bovis AF2122/97
ccgugugcuucgagcaccg

SEQ ID NO: 1167145 - RNA, 16 nt, Mycobacterium bovis subsp bovis AF2122/97
ccgugucgagaucuca

SEQ ID NO: 1167146 - RNA, 22 nt, Mycobacterium bovis subsp bovis AF2122/97
ccguucaacguggaaaccgcuc

SEQ ID NO: 1167147 - RNA, 14 nt, Mycobacterium bovis subsp bovis AF2122/97
ccguucccgccggc

SEQ ID NO: 1167148 - RNA, 15 nt, Mycobacterium bovis subsp bovis AF2122/97
ccucccgcggcaccu

SEQ ID NO: 1167149 - RNA, 14 nt, Mycobacterium bovis subsp bovis AF2122/97
ccucccgcgugcgg

SEQ ID NO: 1167150 - RNA, 13 nt, Mycobacterium bovis subsp bovis AF2122/97
ccucccgggccgc

SEQ ID NO: 1167151 - RNA, 15 nt, Mycobacterium bovis subsp bovis AF2122/97
ccucccgggccgccg

SEQ ID NO: 1167152 - RNA, 16 nt, Mycobacterium bovis subsp bovis AF2122/97
ccucccgggccgccgc

SEQ ID NO: 1167153 - RNA, 21 nt, Mycobacterium bovis subsp bovis AF2122/97
ccucccgggcccgcugggcuu

SEQ ID NO: 1167154 - RNA, 17 nt, Mycobacterium bovis subsp bovis AF2122/97
ccucccgggccgccgcg

SEQ ID NO: 1167155 - RNA, 20 nt, Mycobacterium bovis subsp bovis AF2122/97
ccucccgauucucgaucugg

SEQ ID NO: 1167156 - RNA, 15 nt, Mycobacterium bovis subsp bovis AF2122/97
ccuccccgaccgcca

SEQ ID NO: 1167157 - RNA, 17 nt, Mycobacterium bovis subsp bovis AF2122/97
ccuccccgaccgccacc

SEQ ID NO: 1167158 - RNA, 22 nt, Mycobacterium bovis subsp bovis AF2122/97
ccuccccaacgucgucauccaa

SEQ ID NO: 1167159 - RNA, 22 nt, Mycobacterium bovis subsp bovis AF2122/97
ccucccagggcucggcggcccg

SEQ ID NO: 1167160 - RNA, 15 nt, Mycobacterium bovis subsp bovis AF2122/97
ccucccacgccgccg

SEQ ID NO: 1167161 - RNA, 23 nt, Mycobacterium bovis subsp bovis AF2122/97
ccuccauuucgucggagaacgcc

SEQ ID NO: 1167162 - RNA, 15 nt, Mycobacterium bovis subsp bovis AF2122/97
ccucccacagguaga

SEQ ID NO: 1167163 - RNA, 15 nt, Mycobacterium bovis subsp bovis AF2122/97
ccucccaccagcggc

SEQ ID NO: 1167164 - RNA, 13 nt, Mycobacterium bovis subsp bovis AF2122/97
ccucccacccccg

SEQ ID NO: 1167165 - RNA, 17 nt, Mycobacterium bovis subsp bovis AF2122/97
ccuccgccugccccacc

SEQ ID NO: 1167166 - RNA, 14 nt, Mycobacterium bovis subsp bovis AF2122/97
ccuccgccugcccc

SEQ ID NO: 1167167 - RNA, 15 nt, Mycobacterium bovis subsp bovis AF2122/97
ccuccgcuagaacag

SEQ ID NO: 1167168 - RNA, 17 nt, Mycobacterium bovis subsp bovis AF2122/97
ccuccggaaggcucgcc

SEQ ID NO: 1167169 - RNA, 20 nt, Mycobacterium bovis subsp bovis AF2122/97
ccuccggauaacccagcggc

SEQ ID NO: 1167170 - RNA, 13 nt, Mycobacterium bovis subsp bovis AF2122/97
ccuccgcguccaa

SEQ ID NO: 1167171 - RNA, 17 nt, Mycobacterium bovis subsp bovis AF2122/97
ccuccgcguccaaggcg

SEQ ID NO: 1167172 - RNA, 17 nt, Mycobacterium bovis subsp bovis AF2122/97
ccuccgcugccgcccgc

SEQ ID NO: 1167173 - RNA, 20 nt, Mycobacterium bovis subsp bovis AF2122/97
ccuccgaggaauacagcuug

SEQ ID NO: 1167174 - RNA, 13 nt, Mycobacterium bovis subsp bovis AF2122/97
ccuccgaggccgc

SEQ ID NO: 1167175 - RNA, 13 nt, Mycobacterium bovis subsp bovis AF2122/97
ccuccggcguggc

SEQ ID NO: 1167176 - RNA, 12 nt, Mycobacterium bovis subsp bovis AF2122/97
ccuccggcagca

SEQ ID NO: 1167177 - RNA, 22 nt, Mycobacterium bovis subsp bovis AF2122/97
ccuccggcaccaacgccaccgu

SEQ ID NO: 1167178 - RNA, 20 nt, Mycobacterium bovis subsp bovis AF2122/97
ccuccggcgcagcgaccggu

SEQ ID NO: 1167179 - RNA, 17 nt, Mycobacterium bovis subsp bovis AF2122/97
ccuccguaacgccaagc

SEQ ID NO: 1167180 - RNA, 20 nt, Mycobacterium bovis subsp bovis AF2122/97
ccuccguaacgccaagcucg

SEQ ID NO: 1167181 - RNA, 18 nt, Mycobacterium bovis subsp bovis AF2122/97
ccuccgguaucggcgacc

SEQ ID NO: 1167182 - RNA, 15 nt, Mycobacterium bovis subsp bovis AF2122/97
ccuccgucagcgccg

SEQ ID NO: 1167183 - RNA, 12 nt, Mycobacterium bovis subsp bovis AF2122/97
ccuccugccuuu

SEQ ID NO: 1167184 - RNA, 15 nt, Mycobacterium bovis subsp bovis AF2122/97
ccuccucggcgcgaa

SEQ ID NO: 1167185 - RNA, 18 nt, Mycobacterium bovis subsp bovis AF2122/97
ccuccucggcaggaagga

SEQ ID NO: 1167186 - RNA, 23 nt, Mycobacterium bovis subsp bovis AF2122/97
ccuccucgauagcggcgccugac

SEQ ID NO: 1167187 - RNA, 20 nt, Mycobacterium bovis subsp bovis AF2122/97
ccuccucgaugaggcgcagc

SEQ ID NO: 1167188 - RNA, 21 nt, Mycobacterium bovis subsp bovis AF2122/97
ccuccucgcccauuggccagg

SEQ ID NO: 1167189 - RNA, 16 nt, Mycobacterium bovis subsp bovis AF2122/97
ccuccuccgcaaucgc

SEQ ID NO: 1167190 - RNA, 20 nt, Mycobacterium bovis subsp bovis AF2122/97
ccuccagcaccacggcgcgc

SEQ ID NO: 1167191 - RNA, 17 nt, Mycobacterium bovis subsp bovis AF2122/97
ccuccauaucgcagcgu

SEQ ID NO: 1167192 - RNA, 21 nt, Mycobacterium bovis subsp bovis AF2122/97
ccuccagaaccgaagccucgg

SEQ ID NO: 1167193 - RNA, 15 nt, Mycobacterium bovis subsp bovis AF2122/97
ccuccagccggcgaa

SEQ ID NO: 1167194 - RNA, 22 nt, Mycobacterium bovis subsp bovis AF2122/97
ccuccaauugcgaaccggccgu

SEQ ID NO: 1167195 - RNA, 14 nt, Mycobacterium bovis subsp bovis AF2122/97
ccuccacagcggcc

SEQ ID NO: 1167196 - RNA, 18 nt, Mycobacterium bovis subsp bovis AF2122/97
ccuaccguacgcagcgug

SEQ ID NO: 1167197 - RNA, 21 nt, Mycobacterium bovis subsp bovis AF2122/97
ccuaccgugcuggcaccagca

SEQ ID NO: 1167198 - RNA, 12 nt, Mycobacterium bovis subsp bovis AF2122/97
ccuaccgggccc

SEQ ID NO: 1167199 - RNA, 15 nt, Mycobacterium bovis subsp bovis AF2122/97
ccuacgaugacguuu

SEQ ID NO: 1167200 - RNA, 12 nt, Mycobacterium bovis subsp bovis AF2122/97
ccuaccaggcgc

SEQ ID NO: 1167201 - RNA, 19 nt, Mycobacterium bovis subsp bovis AF2122/97
ccuaccgagaucaccgcca

SEQ ID NO: 1167202 - RNA, 13 nt, Mycobacterium bovis subsp bovis AF2122/97
ccucaucgugggg

SEQ ID NO: 1167203 - RNA, 13 nt, Mycobacterium bovis subsp bovis AF2122/97
ccucaucgccauc

SEQ ID NO: 1167204 - RNA, 14 nt, Mycobacterium bovis subsp bovis AF2122/97
ccuacggugcaguc

SEQ ID NO: 1167205 - RNA, 13 nt, Mycobacterium bovis subsp bovis AF2122/97
ccucgggccggcg

SEQ ID NO: 1167206 - RNA, 18 nt, Mycobacterium bovis subsp bovis AF2122/97
ccucggcgcugcgcaccg

SEQ ID NO: 1167207 - RNA, 23 nt, Mycobacterium bovis subsp bovis AF2122/97
ccucggcgccgucggagccggcc

SEQ ID NO: 1167208 - RNA, 15 nt, Mycobacterium bovis subsp bovis AF2122/97
ccucggcggccagcu

SEQ ID NO: 1167209 - RNA, 20 nt, Mycobacterium bovis subsp bovis AF2122/97
ccucggcggccagcucggcc

SEQ ID NO: 1167210 - RNA, 12 nt, Mycobacterium bovis subsp bovis AF2122/97
ccucggcgccgu

SEQ ID NO: 1167211 - RNA, 20 nt, Mycobacterium bovis subsp bovis AF2122/97
ccucgcguagggccagcgcc

SEQ ID NO: 1167212 - RNA, 19 nt, Mycobacterium bovis subsp bovis AF2122/97
ccucgcuaauugcggccgc

SEQ ID NO: 1167213 - RNA, 21 nt, Mycobacterium bovis subsp bovis AF2122/97
ccucgcuaauugcggccgccg

SEQ ID NO: 1167214 - RNA, 17 nt, Mycobacterium bovis subsp bovis AF2122/97
ccucgggguuacguugu

SEQ ID NO: 1167215 - RNA, 14 nt, Mycobacterium bovis subsp bovis AF2122/97
ccucggucugcucc

SEQ ID NO: 1167216 - RNA, 14 nt, Mycobacterium bovis subsp bovis AF2122/97
ccucggucaccgag

SEQ ID NO: 1167217 - RNA, 22 nt, Mycobacterium bovis subsp bovis AF2122/97
ccucggugacuucacucguuga

SEQ ID NO: 1167218 - RNA, 22 nt, Mycobacterium bovis subsp bovis AF2122/97
ccucggugugcucgccgaccag

SEQ ID NO: 1167219 - RNA, 16 nt, Mycobacterium bovis subsp bovis AF2122/97
ccucggugccggccgc

SEQ ID NO: 1167220 - RNA, 22 nt, Mycobacterium bovis subsp bovis AF2122/97
ccucgucggugugccagugcug

SEQ ID NO: 1167221 - RNA, 21 nt, Mycobacterium bovis subsp bovis AF2122/97
ccucgucggcgacggccagcg

SEQ ID NO: 1167222 - RNA, 23 nt, Mycobacterium bovis subsp bovis AF2122/97
ccucgucggccgacaccgccacc

SEQ ID NO: 1167223 - RNA, 19 nt, Mycobacterium bovis subsp bovis AF2122/97
ccucgcgcaccggcuggcc

SEQ ID NO: 1167224 - RNA, 19 nt, Mycobacterium bovis subsp bovis AF2122/97
ccucgcgggcuuaugcacg

SEQ ID NO: 1167225 - RNA, 14 nt, Mycobacterium bovis subsp bovis AF2122/97
ccucgacgccccag

SEQ ID NO: 1167226 - RNA, 15 nt, Mycobacterium bovis subsp bovis AF2122/97
ccucgacgccgcgca

SEQ ID NO: 1167227 - RNA, 16 nt, Mycobacterium bovis subsp bovis AF2122/97
ccucgacgccgcgcag

SEQ ID NO: 1167228 - RNA, 15 nt, Mycobacterium bovis subsp bovis AF2122/97
ccucgacgcggcagg

SEQ ID NO: 1167229 - RNA, 17 nt, Mycobacterium bovis subsp bovis AF2122/97
ccucgaccagagccgcg

SEQ ID NO: 1167230 - RNA, 21 nt, Mycobacterium bovis subsp bovis AF2122/97
ccucgaccgcggccuuggcgg

SEQ ID NO: 1167231 - RNA, 18 nt, Mycobacterium bovis subsp bovis AF2122/97
ccucgaccgcggggcagc

SEQ ID NO: 1167232 - RNA, 16 nt, Mycobacterium bovis subsp bovis AF2122/97
ccucgacacccauccu

SEQ ID NO: 1167233 - RNA, 16 nt, Mycobacterium bovis subsp bovis AF2122/97
ccucgacacccagccg

SEQ ID NO: 1167234 - RNA, 20 nt, Mycobacterium bovis subsp bovis AF2122/97
ccucgaagggcuugucgccg

SEQ ID NO: 1167235 - RNA, 17 nt, Mycobacterium bovis subsp bovis AF2122/97
ccucgaagcccagcacc

SEQ ID NO: 1167236 - RNA, 23 nt, Mycobacterium bovis subsp bovis AF2122/97
ccucgaagcccagcaccaccacc

SEQ ID NO: 1167237 - RNA, 23 nt, Mycobacterium bovis subsp bovis AF2122/97
ccucgaacgggaaggcauugccc

SEQ ID NO: 1167238 - RNA, 15 nt, Mycobacterium bovis subsp bovis AF2122/97
ccucgaagcccagca

SEQ ID NO: 1167239 - RNA, 18 nt, Mycobacterium bovis subsp bovis AF2122/97
ccucguuaucgaccgccg

SEQ ID NO: 1167240 - RNA, 22 nt, Mycobacterium bovis subsp bovis AF2122/97
ccucguuaucgaccgccgcgag

SEQ ID NO: 1167241 - RNA, 22 nt, Mycobacterium bovis subsp bovis AF2122/97
ccucuucgggguagaccuucuc

SEQ ID NO: 1167242 - RNA, 17 nt, Mycobacterium bovis subsp bovis AF2122/97
ccucuucgggcagcgcg

SEQ ID NO: 1167243 - RNA, 21 nt, Mycobacterium bovis subsp bovis AF2122/97
ccucucuucccaaccgcccgu

SEQ ID NO: 1167244 - RNA, 14 nt, Mycobacterium bovis subsp bovis AF2122/97
ccugaagccgcgcu

SEQ ID NO: 1167245 - RNA, 20 nt, Mycobacterium bovis subsp bovis AF2122/97
ccugaagccgcgcugcgacu

SEQ ID NO: 1167246 - RNA, 16 nt, Mycobacterium bovis subsp bovis AF2122/97
ccugaaacggcugcag

SEQ ID NO: 1167247 - RNA, 16 nt, Mycobacterium bovis subsp bovis AF2122/97
ccugcggcaacggcuc

SEQ ID NO: 1167248 - RNA, 19 nt, Mycobacterium bovis subsp bovis AF2122/97
ccugcggcagcggaccgcu

SEQ ID NO: 1167249 - RNA, 20 nt, Mycobacterium bovis subsp bovis AF2122/97
ccugcggcaccucauugccg

SEQ ID NO: 1167250 - RNA, 19 nt, Mycobacterium bovis subsp bovis AF2122/97
ccugcgcaucaccacuggc

SEQ ID NO: 1167251 - RNA, 22 nt, Mycobacterium bovis subsp bovis AF2122/97
ccugcgccuuggucgccggcgu

SEQ ID NO: 1167252 - RNA, 16 nt, Mycobacterium bovis subsp bovis AF2122/97
ccugcgcgaccgacca

SEQ ID NO: 1167253 - RNA, 13 nt, Mycobacterium bovis subsp bovis AF2122/97
ccugcgcugcagc

SEQ ID NO: 1167254 - RNA, 18 nt, Mycobacterium bovis subsp bovis AF2122/97
ccugcgcgcggccgcgcu

SEQ ID NO: 1167255 - RNA, 21 nt, Mycobacterium bovis subsp bovis AF2122/97
ccugcguccgacgccugggca

SEQ ID NO: 1167256 - RNA, 23 nt, Mycobacterium bovis subsp bovis AF2122/97
ccugcgggaaguugcccagguga

SEQ ID NO: 1167257 - RNA, 16 nt, Mycobacterium bovis subsp bovis AF2122/97
ccugcgggaacgcggc

SEQ ID NO: 1167258 - RNA, 17 nt, Mycobacterium bovis subsp bovis AF2122/97
ccugcgggacuggcuga

SEQ ID NO: 1167259 - RNA, 22 nt, Mycobacterium bovis subsp bovis AF2122/97
ccugcgcgaccgaccagccgug

SEQ ID NO: 1167260 - RNA, 13 nt, Mycobacterium bovis subsp bovis AF2122/97
ccugccguuccgg

SEQ ID NO: 1167261 - RNA, 14 nt, Mycobacterium bovis subsp bovis AF2122/97
ccugcgaccaggcg

SEQ ID NO: 1167262 - RNA, 20 nt, Mycobacterium bovis subsp bovis AF2122/97
ccugcgacuaagggcacucc

SEQ ID NO: 1167263 - RNA, 17 nt, Mycobacterium bovis subsp bovis AF2122/97
ccugcgccacacccggc

SEQ ID NO: 1167264 - RNA, 17 nt, Mycobacterium bovis subsp bovis AF2122/97
ccugcgccgccacagca

SEQ ID NO: 1167265 - RNA, 18 nt, Mycobacterium bovis subsp bovis AF2122/97
ccugcgccgguaacuguc

SEQ ID NO: 1167266 - RNA, 19 nt, Mycobacterium bovis subsp bovis AF2122/97
ccugcgccgguaacugucc

SEQ ID NO: 1167267 - RNA, 13 nt, Mycobacterium bovis subsp bovis AF2122/97
ccugcgccgcccg

SEQ ID NO: 1167268 - RNA, 18 nt, Mycobacterium bovis subsp bovis AF2122/97
ccugcgccgcccgcgcca

SEQ ID NO: 1167269 - RNA, 16 nt, Mycobacterium bovis subsp bovis AF2122/97
ccugcgccacaauggc

SEQ ID NO: 1167270 - RNA, 13 nt, Mycobacterium bovis subsp bovis AF2122/97
ccugcgccacacc

SEQ ID NO: 1167271 - RNA, 15 nt, Mycobacterium bovis subsp bovis AF2122/97
ccugcgcagccgccu

SEQ ID NO: 1167272 - RNA, 16 nt, Mycobacterium bovis subsp bovis AF2122/97
ccugcgcagccgccuc

SEQ ID NO: 1167273 - RNA, 22 nt, Mycobacterium bovis subsp bovis AF2122/97
ccugcgcaaauugcaacagagc

SEQ ID NO: 1167274 - RNA, 14 nt, Mycobacterium bovis subsp bovis AF2122/97
ccugcgaaacgcug

SEQ ID NO: 1167275 - RNA, 17 nt, Mycobacterium bovis subsp bovis AF2122/97
ccugcgaggugccgggg

SEQ ID NO: 1167276 - RNA, 22 nt, Mycobacterium bovis subsp bovis AF2122/97
ccugcaccacggcggccaccug

SEQ ID NO: 1167277 - RNA, 14 nt, Mycobacterium bovis subsp bovis AF2122/97
ccugcacagcagcg

SEQ ID NO: 1167278 - RNA, 13 nt, Mycobacterium bovis subsp bovis AF2122/97
ccugcacccaggc

SEQ ID NO: 1167279 - RNA, 21 nt, Mycobacterium bovis subsp bovis AF2122/97
ccugcaccgccgccgcccgua

SEQ ID NO: 1167280 - RNA, 22 nt, Mycobacterium bovis subsp bovis AF2122/97
ccugcacgccggcgcuggagac

SEQ ID NO: 1167281 - RNA, 19 nt, Mycobacterium bovis subsp bovis AF2122/97
ccugcacgugacccugggg

SEQ ID NO: 1167282 - RNA, 14 nt, Mycobacterium bovis subsp bovis AF2122/97
ccugaagggccgcc

SEQ ID NO: 1167283 - RNA, 13 nt, Mycobacterium bovis subsp bovis AF2122/97
ccugcaagaacca

SEQ ID NO: 1167284 - RNA, 19 nt, Mycobacterium bovis subsp bovis AF2122/97
ccugcaagaaccacugcau

SEQ ID NO: 1167285 - RNA, 22 nt, Mycobacterium bovis subsp bovis AF2122/97
ccugcagcacgacgugcgucgg

SEQ ID NO: 1167286 - RNA, 16 nt, Mycobacterium bovis subsp bovis AF2122/97
ccugccgcacgggccc

SEQ ID NO: 1167287 - RNA, 16 nt, Mycobacterium bovis subsp bovis AF2122/97
ccugccgccggccccg

SEQ ID NO: 1167288 - RNA, 22 nt, Mycobacterium bovis subsp bovis AF2122/97
ccugccgaaacgccgaccgcgc

SEQ ID NO: 1167289 - RNA, 22 nt, Mycobacterium bovis subsp bovis AF2122/97
ccugccgacaguuuaccgugcc

SEQ ID NO: 1167290 - RNA, 19 nt, Mycobacterium bovis subsp bovis AF2122/97
ccugccgaucccguggugg

SEQ ID NO: 1167291 - RNA, 12 nt, Mycobacterium bovis subsp bovis AF2122/97
ccugcccuccgu

SEQ ID NO: 1167292 - RNA, 13 nt, Mycobacterium bovis subsp bovis AF2122/97
ccugcccuccgug

SEQ ID NO: 1167293 - RNA, 17 nt, Mycobacterium bovis subsp bovis AF2122/97
ccugcccggcccgcccg

SEQ ID NO: 1167294 - RNA, 15 nt, Mycobacterium bovis subsp bovis AF2122/97
ccugcccggcccgcc

SEQ ID NO: 1167295 - RNA, 12 nt, Mycobacterium bovis subsp bovis AF2122/97
ccugcccggccc

SEQ ID NO: 1167296 - RNA, 13 nt, Mycobacterium bovis subsp bovis AF2122/97
ccuguccggcgcc

SEQ ID NO: 1167297 - RNA, 13 nt, Mycobacterium bovis subsp bovis AF2122/97
ccugucgcaccag

SEQ ID NO: 1167298 - RNA, 21 nt, Mycobacterium bovis subsp bovis AF2122/97
ccugucauguccugggccgcc

SEQ ID NO: 1167299 - RNA, 23 nt, Mycobacterium bovis subsp bovis AF2122/97
ccuguacaaccugaugcucuggg

SEQ ID NO: 1167300 - RNA, 15 nt, Mycobacterium bovis subsp bovis AF2122/97
ccugggcggccagca

SEQ ID NO: 1167301 - RNA, 17 nt, Mycobacterium bovis subsp bovis AF2122/97
ccugggcggccagcacg

SEQ ID NO: 1167302 - RNA, 16 nt, Mycobacterium bovis subsp bovis AF2122/97
ccugggcggccgggcu

SEQ ID NO: 1167303 - RNA, 23 nt, Mycobacterium bovis subsp bovis AF2122/97
ccugggcggcgcgaagucuugac

SEQ ID NO: 1167304 - RNA, 19 nt, Mycobacterium bovis subsp bovis AF2122/97
ccugggcgcgcuggcgggc

SEQ ID NO: 1167305 - RNA, 18 nt, Mycobacterium bovis subsp bovis AF2122/97
ccuggguugugccgcccu

SEQ ID NO: 1167306 - RNA, 16 nt, Mycobacterium bovis subsp bovis AF2122/97
ccugguaaggccggcc

SEQ ID NO: 1167307 - RNA, 21 nt, Mycobacterium bovis subsp bovis AF2122/97
ccuggaguccagcucgggcau

SEQ ID NO: 1167308 - RNA, 16 nt, Mycobacterium bovis subsp bovis AF2122/97
ccuggacgucggcgau

SEQ ID NO: 1167309 - RNA, 21 nt, Mycobacterium bovis subsp bovis AF2122/97
ccugcugcagggccuggccac

SEQ ID NO: 1167310 - RNA, 15 nt, Mycobacterium bovis subsp bovis AF2122/97
ccugcucgcugguga

SEQ ID NO: 1167311 - RNA, 15 nt, Mycobacterium bovis subsp bovis AF2122/97
ccugcucggcgaccg

SEQ ID NO: 1167312 - RNA, 20 nt, Mycobacterium bovis subsp bovis AF2122/97
ccugcucgggggccgaccag

SEQ ID NO: 1167313 - RNA, 19 nt, Mycobacterium bovis subsp bovis AF2122/97
ccuggcgugucgccgccac

SEQ ID NO: 1167314 - RNA, 21 nt, Mycobacterium bovis subsp bovis AF2122/97
ccuggcguagaucaucuggcu

SEQ ID NO: 1167315 - RNA, 15 nt, Mycobacterium bovis subsp bovis AF2122/97
ccuggcgugucgccg

SEQ ID NO: 1167316 - RNA, 17 nt, Mycobacterium bovis subsp bovis AF2122/97
ccugggcgacuaccggc

SEQ ID NO: 1167317 - RNA, 15 nt, Mycobacterium bovis subsp bovis AF2122/97
ccugggcgccccagg

SEQ ID NO: 1167318 - RNA, 13 nt, Mycobacterium bovis subsp bovis AF2122/97
ccuggcggucccg

SEQ ID NO: 1167319 - RNA, 18 nt, Mycobacterium bovis subsp bovis AF2122/97
ccuggcguagugcagcug

SEQ ID NO: 1167320 - RNA, 19 nt, Mycobacterium bovis subsp bovis AF2122/97
ccuggcggcccggguuggc

SEQ ID NO: 1167321 - RNA, 21 nt, Mycobacterium bovis subsp bovis AF2122/97
ccuggcggcgccgcagaucac

SEQ ID NO: 1167322 - RNA, 18 nt, Mycobacterium bovis subsp bovis AF2122/97
ccuggcaccucgcccucc

SEQ ID NO: 1167323 - RNA, 15 nt, Mycobacterium bovis subsp bovis AF2122/97
ccuggcaccucgccc

SEQ ID NO: 1167324 - RNA, 15 nt, Mycobacterium bovis subsp bovis AF2122/97
ccuggcaacgacacg

SEQ ID NO: 1167325 - RNA, 22 nt, Mycobacterium bovis subsp bovis AF2122/97
cgagcaccacccgggccucggc

SEQ ID NO: 1167326 - RNA, 13 nt, Mycobacterium bovis subsp bovis AF2122/97
cgagcacccgcug

SEQ ID NO: 1167327 - RNA, 15 nt, Mycobacterium bovis subsp bovis AF2122/97
cgagcaccccagggg

SEQ ID NO: 1167328 - RNA, 17 nt, Mycobacterium bovis subsp bovis AF2122/97
cgagcacaugcucgacg

SEQ ID NO: 1167329 - RNA, 22 nt, Mycobacterium bovis subsp bovis AF2122/97
cgagcaccuugcgauugcgcac

SEQ ID NO: 1167330 - RNA, 17 nt, Mycobacterium bovis subsp bovis AF2122/97
cgagcaccucggccucg

SEQ ID NO: 1167331 - RNA, 23 nt, Mycobacterium bovis subsp bovis AF2122/97
cgagcacgggacuucgugccucg

SEQ ID NO: 1167332 - RNA, 14 nt, Mycobacterium bovis subsp bovis AF2122/97
cgagcacgccaacg

SEQ ID NO: 1167333 - RNA, 16 nt, Mycobacterium bovis subsp bovis AF2122/97
cgagcaacggcggcag

SEQ ID NO: 1167334 - RNA, 18 nt, Mycobacterium bovis subsp bovis AF2122/97
cgagcaacucguccagca

SEQ ID NO: 1167335 - RNA, 14 nt, Mycobacterium bovis subsp bovis AF2122/97
cgagcaacgccacc

SEQ ID NO: 1167336 - RNA, 23 nt, Mycobacterium bovis subsp bovis AF2122/97
cgagcacacaacacccaacgcaa

SEQ ID NO: 1167337 - RNA, 17 nt, Mycobacterium bovis subsp bovis AF2122/97
cgagcacacuccuagcc

SEQ ID NO: 1167338 - RNA, 15 nt, Mycobacterium bovis subsp bovis AF2122/97
cgagcaaggggaucu

SEQ ID NO: 1167339 - RNA, 13 nt, Mycobacterium bovis subsp bovis AF2122/97
cgagcagcuacag

SEQ ID NO: 1167340 - RNA, 18 nt, Mycobacterium bovis subsp bovis AF2122/97
cgagcagcagaaacggcg

SEQ ID NO: 1167341 - RNA, 13 nt, Mycobacterium bovis subsp bovis AF2122/97
cgagcagcccgcg

SEQ ID NO: 1167342 - RNA, 15 nt, Mycobacterium bovis subsp bovis AF2122/97
cgagcagacgcagaa

SEQ ID NO: 1167343 - RNA, 20 nt, Mycobacterium bovis subsp bovis AF2122/97
cgagcagacacuaaagcccu

SEQ ID NO: 1167344 - RNA, 16 nt, Mycobacterium bovis subsp bovis AF2122/97
cgagcacucggccacg

SEQ ID NO: 1167345 - RNA, 20 nt, Mycobacterium bovis subsp bovis AF2122/97
cgagcacugaggagaugagc

SEQ ID NO: 1167346 - RNA, 20 nt, Mycobacterium bovis subsp bovis AF2122/97
cgagcagacgcggaaucgca

SEQ ID NO: 1167347 - RNA, 17 nt, Mycobacterium bovis subsp bovis AF2122/97
cgagcagacgugggcgc

SEQ ID NO: 1167348 - RNA, 17 nt, Mycobacterium bovis subsp bovis AF2122/97
cgagcagacgccgcguu

SEQ ID NO: 1167349 - RNA, 17 nt, Mycobacterium bovis subsp bovis AF2122/97
cgagcagcaccacccgc

SEQ ID NO: 1167350 - RNA, 18 nt, Mycobacterium bovis subsp bovis AF2122/97
cgagcagauacuuguuga

SEQ ID NO: 1167351 - RNA, 10 nt, Mycobacterium bovis subsp bovis AF2122/97
cgagcagcaa

SEQ ID NO: 1167352 - RNA, 17 nt, Mycobacterium bovis subsp bovis AF2122/97
cgagcccgaaccaccgc

SEQ ID NO: 1167353 - RNA, 18 nt, Mycobacterium bovis subsp bovis AF2122/97
cgagccgcacaaacgggc

SEQ ID NO: 1167354 - RNA, 24 nt, Mycobacterium bovis subsp bovis AF2122/97
cgagccgcacaaacgggcgugggc

SEQ ID NO: 1167355 - RNA, 16 nt, Mycobacterium bovis subsp bovis AF2122/97
cgagccgcacagcaug

SEQ ID NO: 1167356 - RNA, 22 nt, Mycobacterium bovis subsp bovis AF2122/97
cgagcccgccggccucuggauc

SEQ ID NO: 1167357 - RNA, 15 nt, Mycobacterium bovis subsp bovis AF2122/97
cgagcccagcgccuc

SEQ ID NO: 1167358 - RNA, 19 nt, Mycobacterium bovis subsp bovis AF2122/97
cgagcccagcgccuccagc

SEQ ID NO: 1167359 - RNA, 13 nt, Mycobacterium bovis subsp bovis AF2122/97
cgagcccagcugc

SEQ ID NO: 1167360 - RNA, 14 nt, Mycobacterium bovis subsp bovis AF2122/97
cgagcccagcugcg

SEQ ID NO: 1167361 - RNA, 16 nt, Mycobacterium bovis subsp bovis AF2122/97
cgagcccagccgggca

SEQ ID NO: 1167362 - RNA, 12 nt, Mycobacterium bovis subsp bovis AF2122/97
cgagccacagcg

SEQ ID NO: 1167363 - RNA, 17 nt, Mycobacterium bovis subsp bovis AF2122/97
cgagccacaugaccuga

SEQ ID NO: 1167364 - RNA, 19 nt, Mycobacterium bovis subsp bovis AF2122/97
cgagccaccaccgccgacc

SEQ ID NO: 1167365 - RNA, 13 nt, Mycobacterium bovis subsp bovis AF2122/97
cgagccagcuccg

SEQ ID NO: 1167366 - RNA, 15 nt, Mycobacterium bovis subsp bovis AF2122/97
cgagccacggcuucg

SEQ ID NO: 1167367 - RNA, 19 nt, Mycobacterium bovis subsp bovis AF2122/97
cgagcaugauguccuccca

SEQ ID NO: 1167368 - RNA, 13 nt, Mycobacterium bovis subsp bovis AF2122/97
cgagccaacgcau

SEQ ID NO: 1167369 - RNA, 17 nt, Mycobacterium bovis subsp bovis AF2122/97
cgagccaacgcgcagag

SEQ ID NO: 1167370 - RNA, 22 nt, Mycobacterium bovis subsp bovis AF2122/97
cgagcagggccggcaccgcagc

SEQ ID NO: 1167371 - RNA, 15 nt, Mycobacterium bovis subsp bovis AF2122/97
cgagcagggugacca

SEQ ID NO: 1167372 - RNA, 22 nt, Mycobacterium bovis subsp bovis AF2122/97
cgagcaucaacgaaccagcuug

SEQ ID NO: 1167373 - RNA, 19 nt, Mycobacterium bovis subsp bovis AF2122/97
cgagaggugcugcaccugg

SEQ ID NO: 1167374 - RNA, 16 nt, Mycobacterium bovis subsp bovis AF2122/97
cgagauaaccaccauc

SEQ ID NO: 1167375 - RNA, 22 nt, Mycobacterium bovis subsp bovis AF2122/97
cgagagggcggggcagaagucg

SEQ ID NO: 1167376 - RNA, 16 nt, Mycobacterium bovis subsp bovis AF2122/97
cgagauacggccacca

SEQ ID NO: 1167377 - RNA, 18 nt, Mycobacterium bovis subsp bovis AF2122/97
cgagagcagccagccacc

SEQ ID NO: 1167378 - RNA, 23 nt, Mycobacterium bovis subsp bovis AF2122/97
cgagagcaccgacuucagcaacg

SEQ ID NO: 1167379 - RNA, 17 nt, Mycobacterium bovis subsp bovis AF2122/97
cgagagccccgaccagc

SEQ ID NO: 1167380 - RNA, 19 nt, Mycobacterium bovis subsp bovis AF2122/97
cgagagccccgaccagcag

SEQ ID NO: 1167381 - RNA, 20 nt, Mycobacterium bovis subsp bovis AF2122/97
cgagagccccgaccagcaga

SEQ ID NO: 1167382 - RNA, 22 nt, Mycobacterium bovis subsp bovis AF2122/97
cgagagccccgaccagcagacc

SEQ ID NO: 1167383 - RNA, 16 nt, Mycobacterium bovis subsp bovis AF2122/97
cgagaucagccucgcg

SEQ ID NO: 1167384 - RNA, 23 nt, Mycobacterium bovis subsp bovis AF2122/97
cgagaucagccucgcgggcaggg

SEQ ID NO: 1167385 - RNA, 16 nt, Mycobacterium bovis subsp bovis AF2122/97
cgagaucgccgagcag

SEQ ID NO: 1167386 - RNA, 15 nt, Mycobacterium bovis subsp bovis AF2122/97
cgagaugcugcaccc

SEQ ID NO: 1167387 - RNA, 20 nt, Mycobacterium bovis subsp bovis AF2122/97
cgagaugccgcgaucgugca

SEQ ID NO: 1167388 - RNA, 22 nt, Mycobacterium bovis subsp bovis AF2122/97
cgagaugccgcgaucgugcagg

SEQ ID NO: 1167389 - RNA, 23 nt, Mycobacterium bovis subsp bovis AF2122/97
cgagauggcgaucaugagcagca

SEQ ID NO: 1167390 - RNA, 22 nt, Mycobacterium bovis subsp bovis AF2122/97
cgagauggaauggcugagcccg

SEQ ID NO: 1167391 - RNA, 18 nt, Mycobacterium bovis subsp bovis AF2122/97
cgagauugccgggccgcc

SEQ ID NO: 1167392 - RNA, 16 nt, Mycobacterium bovis subsp bovis AF2122/97
cgagaccgccgcugcc

SEQ ID NO: 1167393 - RNA, 18 nt, Mycobacterium bovis subsp bovis AF2122/97
cgagaccgcgagcagcac

SEQ ID NO: 1167394 - RNA, 20 nt, Mycobacterium bovis subsp bovis AF2122/97
cgagaccgcgagcagcacag

SEQ ID NO: 1167395 - RNA, 23 nt, Mycobacterium bovis subsp bovis AF2122/97
cgagaccucucugcgccaggcgg

SEQ ID NO: 1167396 - RNA, 14 nt, Mycobacterium bovis subsp bovis AF2122/97
cgagacggccacgu

SEQ ID NO: 1167397 - RNA, 18 nt, Mycobacterium bovis subsp bovis AF2122/97
cgagaacaccggccaaca

SEQ ID NO: 1167398 - RNA, 13 nt, Mycobacterium bovis subsp bovis AF2122/97
cgagaacacccgu

SEQ ID NO: 1167399 - RNA, 20 nt, Mycobacterium bovis subsp bovis AF2122/97
cgagaaacacgacagccagu

SEQ ID NO: 1167400 - RNA, 15 nt, Mycobacterium bovis subsp bovis AF2122/97
cgagaacgcccgcug

SEQ ID NO: 1167401 - RNA, 14 nt, Mycobacterium bovis subsp bovis AF2122/97
cgagaagcugugcc

SEQ ID NO: 1167402 - RNA, 15 nt, Mycobacterium bovis subsp bovis AF2122/97
cgagaagucgcagcg

SEQ ID NO: 1167403 - RNA, 21 nt, Mycobacterium bovis subsp bovis AF2122/97
cgagaagcguugcacugcugg

SEQ ID NO: 1167404 - RNA, 16 nt, Mycobacterium bovis subsp bovis AF2122/97
cgacggcgucacccgc

SEQ ID NO: 1167405 - RNA, 15 nt, Mycobacterium bovis subsp bovis AF2122/97
cgacggcuccuccgg

SEQ ID NO: 1167406 - RNA, 21 nt, Mycobacterium bovis subsp bovis AF2122/97
cgacggguucacccugccaga

SEQ ID NO: 1167407 - RNA, 19 nt, Mycobacterium bovis subsp bovis AF2122/97
cgacgggcacccgagccgc

SEQ ID NO: 1167408 - RNA, 21 nt, Mycobacterium bovis subsp bovis AF2122/97
cgacgggcacccgagccgcac

SEQ ID NO: 1167409 - RNA, 16 nt, Mycobacterium bovis subsp bovis AF2122/97
cgacggcggccgcgau

SEQ ID NO: 1167410 - RNA, 19 nt, Mycobacterium bovis subsp bovis AF2122/97
cgacggcggagucgcgcag

SEQ ID NO: 1167411 - RNA, 15 nt, Mycobacterium bovis subsp bovis AF2122/97
cgacggcggcacggg

SEQ ID NO: 1167412 - RNA, 21 nt, Mycobacterium bovis subsp bovis AF2122/97
cgacggcgccgucguugugcc

SEQ ID NO: 1167413 - RNA, 18 nt, Mycobacterium bovis subsp bovis AF2122/97
cgacggcgcucggcgagc

SEQ ID NO: 1167414 - RNA, 14 nt, Mycobacterium bovis subsp bovis AF2122/97
cgacggcgccggca

SEQ ID NO: 1167415 - RNA, 18 nt, Mycobacterium bovis subsp bovis AF2122/97
cgacggcgccccgcgcuu

SEQ ID NO: 1167416 - RNA, 15 nt, Mycobacterium bovis subsp bovis AF2122/97
cgacggcgauggcgc

SEQ ID NO: 1167417 - RNA, 14 nt, Mycobacterium bovis subsp bovis AF2122/97
cgacggugaugggg

SEQ ID NO: 1167418 - RNA, 18 nt, Mycobacterium bovis subsp bovis AF2122/97
cgacggucaaggugcgcc

SEQ ID NO: 1167419 - RNA, 22 nt, Mycobacterium bovis subsp bovis AF2122/97
cgacggucaaggugcgccgcca

SEQ ID NO: 1167420 - RNA, 17 nt, Mycobacterium bovis subsp bovis AF2122/97
cgacguauuggcgcagc

SEQ ID NO: 1167421 - RNA, 20 nt, Mycobacterium bovis subsp bovis AF2122/97
cgacgucaggguauccacgc

SEQ ID NO: 1167422 - RNA, 15 nt, Mycobacterium bovis subsp bovis AF2122/97
cgacgucagcaccau

SEQ ID NO: 1167423 - RNA, 18 nt, Mycobacterium bovis subsp bovis AF2122/97
cgacguaguugccggcuu

SEQ ID NO: 1167424 - RNA, 20 nt, Mycobacterium bovis subsp bovis AF2122/97
cgacgucgccgccgcgggcg

SEQ ID NO: 1167425 - RNA, 20 nt, Mycobacterium bovis subsp bovis AF2122/97
cgacggccacgguggagcgc

SEQ ID NO: 1167426 - RNA, 13 nt, Mycobacterium bovis subsp bovis AF2122/97
cgacggccagcag

SEQ ID NO: 1167427 - RNA, 22 nt, Mycobacterium bovis subsp bovis AF2122/97
cgacggcauuucagcgcgccgc

SEQ ID NO: 1167428 - RNA, 20 nt, Mycobacterium bovis subsp bovis AF2122/97
cgacggcaucaacgcgggcg

SEQ ID NO: 1167429 - RNA, 14 nt, Mycobacterium bovis subsp bovis AF2122/97
cgacggcccgccgu

SEQ ID NO: 1167430 - RNA, 15 nt, Mycobacterium bovis subsp bovis AF2122/97
cgacggccgccagca

SEQ ID NO: 1167431 - RNA, 20 nt, Mycobacterium bovis subsp bovis AF2122/97
cgacggccgcucgggccagc

SEQ ID NO: 1167432 - RNA, 17 nt, Mycobacterium bovis subsp bovis AF2122/97
cgacggccggcaagcag

SEQ ID NO: 1167433 - RNA, 12 nt, Mycobacterium bovis subsp bovis AF2122/97
cgacggccaccc

SEQ ID NO: 1167434 - RNA, 14 nt, Mycobacterium bovis subsp bovis AF2122/97
cgacggccagccca

SEQ ID NO: 1167435 - RNA, 16 nt, Mycobacterium bovis subsp bovis AF2122/97
cgacggccagugcgca

SEQ ID NO: 1167436 - RNA, 18 nt, Mycobacterium bovis subsp bovis AF2122/97
cgacgcuggucggcggcu

SEQ ID NO: 1167437 - RNA, 18 nt, Mycobacterium bovis subsp bovis AF2122/97
cgacgcuguggcucgacg

SEQ ID NO: 1167438 - RNA, 16 nt, Mycobacterium bovis subsp bovis AF2122/97
cgacggacacccuggg

SEQ ID NO: 1167439 - RNA, 21 nt, Mycobacterium bovis subsp bovis AF2122/97
cgacgccggugucggcugguc

SEQ ID NO: 1167440 - RNA, 20 nt, Mycobacterium bovis subsp bovis AF2122/97
cgacgcgcauucgccgggcg

SEQ ID NO: 1167441 - RNA, 18 nt, Mycobacterium bovis subsp bovis AF2122/97
cgacgcgcccgcgcgcuc

SEQ ID NO: 1167442 - RNA, 15 nt, Mycobacterium bovis subsp bovis AF2122/97
cgacgcgcucgggcg

SEQ ID NO: 1167443 - RNA, 22 nt, Mycobacterium bovis subsp bovis AF2122/97
cgacgcgcucgggcgagaucuu

SEQ ID NO: 1167444 - RNA, 20 nt, Mycobacterium bovis subsp bovis AF2122/97
cgacgcggccagcggcaagg

SEQ ID NO: 1167445 - RNA, 22 nt, Mycobacterium bovis subsp bovis AF2122/97
cgacgcggucaucgagcugacc

SEQ ID NO: 1167446 - RNA, 16 nt, Mycobacterium bovis subsp bovis AF2122/97
cgacgcucgcugcagc

SEQ ID NO: 1167447 - RNA, 17 nt, Mycobacterium bovis subsp bovis AF2122/97
cgacgcucgcugcagca

SEQ ID NO: 1167448 - RNA, 17 nt, Mycobacterium bovis subsp bovis AF2122/97
cgacuguggcgccgccg

SEQ ID NO: 1167449 - RNA, 19 nt, Mycobacterium bovis subsp bovis AF2122/97
cgacugcgugccgcaccgc

SEQ ID NO: 1167450 - RNA, 16 nt, Mycobacterium bovis subsp bovis AF2122/97
cgacuggaaggcgggc

SEQ ID NO: 1167451 - RNA, 21 nt, Mycobacterium bovis subsp bovis AF2122/97
cgacuggccccgccagcggca

SEQ ID NO: 1167452 - RNA, 18 nt, Mycobacterium bovis subsp bovis AF2122/97
cgacugcgaaugcugggc

SEQ ID NO: 1167453 - RNA, 16 nt, Mycobacterium bovis subsp bovis AF2122/97
cgacugcaacucuucc

SEQ ID NO: 1167454 - RNA, 17 nt, Mycobacterium bovis subsp bovis AF2122/97
cgacugagaucgcuucc

SEQ ID NO: 1167455 - RNA, 16 nt, Mycobacterium bovis subsp bovis AF2122/97
cgacugaucgccaccc

SEQ ID NO: 1167456 - RNA, 13 nt, Mycobacterium bovis subsp bovis AF2122/97
cgacuuggcaucg

SEQ ID NO: 1167457 - RNA, 12 nt, Mycobacterium bovis subsp bovis AF2122/97
cgacuucuccag

SEQ ID NO: 1167458 - RNA, 17 nt, Mycobacterium bovis subsp bovis AF2122/97
cgacuucuccaggcuga

SEQ ID NO: 1167459 - RNA, 18 nt, Mycobacterium bovis subsp bovis AF2122/97
cgacucgguugaggacga

SEQ ID NO: 1167460 - RNA, 22 nt, Mycobacterium bovis subsp bovis AF2122/97
cgacucggcggcgcggucgaag

SEQ ID NO: 1167461 - RNA, 22 nt, Mycobacterium bovis subsp bovis AF2122/97
cgacucgccggcgaauccgcac

SEQ ID NO: 1167462 - RNA, 23 nt, Mycobacterium bovis subsp bovis AF2122/97
cgacucugugacgggcacaacca

SEQ ID NO: 1167463 - RNA, 16 nt, Mycobacterium bovis subsp bovis AF2122/97
cgacucgugucugccu

SEQ ID NO: 1167464 - RNA, 13 nt, Mycobacterium bovis subsp bovis AF2122/97
cgacucacacacc

SEQ ID NO: 1167465 - RNA, 17 nt, Mycobacterium bovis subsp bovis AF2122/97
cgacucaguucugcaca

SEQ ID NO: 1167466 - RNA, 22 nt, Mycobacterium bovis subsp bovis AF2122/97
cgacuccagcaccagcacggca

SEQ ID NO: 1167467 - RNA, 18 nt, Mycobacterium bovis subsp bovis AF2122/97
cgacguucuuguccagga

SEQ ID NO: 1167468 - RNA, 14 nt, Mycobacterium bovis subsp bovis AF2122/97
cgacgugcgcggca

SEQ ID NO: 1167469 - RNA, 19 nt, Mycobacterium bovis subsp bovis AF2122/97
cgacguggccagcccgccc

SEQ ID NO: 1167470 - RNA, 12 nt, Mycobacterium bovis subsp bovis AF2122/97
cgacgucugcca

SEQ ID NO: 1167471 - RNA, 12 nt, Mycobacterium bovis subsp bovis AF2122/97
cgacgucggcgc

SEQ ID NO: 1167472 - RNA, 17 nt, Mycobacterium bovis subsp bovis AF2122/97
cgacgucggcuucaccu

SEQ ID NO: 1167473 - RNA, 18 nt, Mycobacterium bovis subsp bovis AF2122/97
cgacgucggcuucaccuu

SEQ ID NO: 1167474 - RNA, 15 nt, Mycobacterium bovis subsp bovis AF2122/97
cgacguccgcgacuu

SEQ ID NO: 1167475 - RNA, 22 nt, Mycobacterium bovis subsp bovis AF2122/97
cgacgucugccaggcgcagcug

SEQ ID NO: 1167476 - RNA, 15 nt, Mycobacterium bovis subsp bovis AF2122/97
cgacguugcggacgg

SEQ ID NO: 1167477 - RNA, 22 nt, Mycobacterium bovis subsp bovis AF2122/97
cgacgugaccagcuucggcugg

SEQ ID NO: 1167478 - RNA, 21 nt, Mycobacterium bovis subsp bovis AF2122/97
cgacguuguuuuugcacugaa

SEQ ID NO: 1167479 - RNA, 19 nt, Mycobacterium bovis subsp bovis AF2122/97
cgacuacccagccagccgc

SEQ ID NO: 1167480 - RNA, 17 nt, Mycobacterium bovis subsp bovis AF2122/97
cgaggaugccgaaccgc

SEQ ID NO: 1167481 - RNA, 16 nt, Mycobacterium bovis subsp bovis AF2122/97
cgaggaugugguuggu

SEQ ID NO: 1167482 - RNA, 14 nt, Mycobacterium bovis subsp bovis AF2122/97
cgaggcaacaagca

SEQ ID NO: 1167483 - RNA, 20 nt, Mycobacterium bovis subsp bovis AF2122/97
cgaggcacaaucaccgccgc

SEQ ID NO: 1167484 - RNA, 21 nt, Mycobacterium bovis subsp bovis AF2122/97
cgaggcagcgucgucgacgac

SEQ ID NO: 1167485 - RNA, 18 nt, Mycobacterium bovis subsp bovis AF2122/97
cgaggccgcacgucgacc

SEQ ID NO: 1167486 - RNA, 15 nt, Mycobacterium bovis subsp bovis AF2122/97
cgaggcccgggugcu

SEQ ID NO: 1167487 - RNA, 12 nt, Mycobacterium bovis subsp bovis AF2122/97
cgaggccagcgg

SEQ ID NO: 1167488 - RNA, 16 nt, Mycobacterium bovis subsp bovis AF2122/97
cgaggccaaacgccau

SEQ ID NO: 1167489 - RNA, 21 nt, Mycobacterium bovis subsp bovis AF2122/97
cgaggcgggcagaagaguguc

SEQ ID NO: 1167490 - RNA, 21 nt, Mycobacterium bovis subsp bovis AF2122/97
cgaggcgacgucguucuuugu

SEQ ID NO: 1167491 - RNA, 12 nt, Mycobacterium bovis subsp bovis AF2122/97
cgaggcgaucac

SEQ ID NO: 1167492 - RNA, 17 nt, Mycobacterium bovis subsp bovis AF2122/97
cgaggcgaucaccgcgc

SEQ ID NO: 1167493 - RNA, 21 nt, Mycobacterium bovis subsp bovis AF2122/97
cgaggcgaucaccgcgccgga

SEQ ID NO: 1167494 - RNA, 23 nt, Mycobacterium bovis subsp bovis AF2122/97
cgaggccgcugccagggugcgcc

SEQ ID NO: 1167495 - RNA, 17 nt, Mycobacterium bovis subsp bovis AF2122/97
cgaggccucgucccaca

SEQ ID NO: 1167496 - RNA, 18 nt, Mycobacterium bovis subsp bovis AF2122/97
cgaggcguaaucaagcag

SEQ ID NO: 1167497 - RNA, 14 nt, Mycobacterium bovis subsp bovis AF2122/97
cgaggcguucagug

SEQ ID NO: 1167498 - RNA, 19 nt, Mycobacterium bovis subsp bovis AF2122/97
cgaggcucccccaccaggg

SEQ ID NO: 1167499 - RNA, 19 nt, Mycobacterium bovis subsp bovis AF2122/97
cgaggcucgcguggccgcc

SEQ ID NO: 1167500 - RNA, 20 nt, Mycobacterium bovis subsp bovis AF2122/97
cgagggauguagugcugcuc

SEQ ID NO: 1167501 - RNA, 17 nt, Mycobacterium bovis subsp bovis AF2122/97
cgagggaacggugcaca

SEQ ID NO: 1167502 - RNA, 12 nt, Mycobacterium bovis subsp bovis AF2122/97
cgaggagggccg

SEQ ID NO: 1167503 - RNA, 18 nt, Mycobacterium bovis subsp bovis AF2122/97
cgaggaguuggugcagcg

SEQ ID NO: 1167504 - RNA, 19 nt, Mycobacterium bovis subsp bovis AF2122/97
cgaggaucccgcugcacga

SEQ ID NO: 1167505 - RNA, 15 nt, Mycobacterium bovis subsp bovis AF2122/97
cgaggaauuccgcua

SEQ ID NO: 1167506 - RNA, 21 nt, Mycobacterium bovis subsp bovis AF2122/97
cgaggaauuccgcuaccgcac

SEQ ID NO: 1167507 - RNA, 22 nt, Mycobacterium bovis subsp bovis AF2122/97
cgaggacuggaaagcagcagcg

SEQ ID NO: 1167508 - RNA, 19 nt, Mycobacterium bovis subsp bovis AF2122/97
cgaggacgccggcgccgcc

SEQ ID NO: 1167509 - RNA, 18 nt, Mycobacterium bovis subsp bovis AF2122/97
cgaggaccugcucgggcg

SEQ ID NO: 1167510 - RNA, 14 nt, Mycobacterium bovis subsp bovis AF2122/97
cgaggaacgccggg

SEQ ID NO: 1167511 - RNA, 14 nt, Mycobacterium bovis subsp bovis AF2122/97
cgagcuuggccgcc

SEQ ID NO: 1167512 - RNA, 23 nt, Mycobacterium bovis subsp bovis AF2122/97
cgagcuugagcgugagcgccgcg

SEQ ID NO: 1167513 - RNA, 18 nt, Mycobacterium bovis subsp bovis AF2122/97
cgagcuugccgucgcuga

SEQ ID NO: 1167514 - RNA, 18 nt, Mycobacterium bovis subsp bovis AF2122/97
cgagcuggcgcgcggggu

SEQ ID NO: 1167515 - RNA, 17 nt, Mycobacterium bovis subsp bovis AF2122/97
cgagcuggcaacgccgc

SEQ ID NO: 1167516 - RNA, 14 nt, Mycobacterium bovis subsp bovis AF2122/97
cgagcugauccggg

SEQ ID NO: 1167517 - RNA, 20 nt, Mycobacterium bovis subsp bovis AF2122/97
cgagcgcggugccgccaccg

SEQ ID NO: 1167518 - RNA, 19 nt, Mycobacterium bovis subsp bovis AF2122/97
cgagcgcuaucaccgccuc

SEQ ID NO: 1167519 - RNA, 14 nt, Mycobacterium bovis subsp bovis AF2122/97
cgagcguggcaacg

SEQ ID NO: 1167520 - RNA, 12 nt, Mycobacterium bovis subsp bovis AF2122/97
cgagcgugcgca

SEQ ID NO: 1167521 - RNA, 19 nt, Mycobacterium bovis subsp bovis AF2122/97
cgagcguaaugcugcugca

SEQ ID NO: 1167522 - RNA, 13 nt, Mycobacterium bovis subsp bovis AF2122/97
cgagcggcugagc

SEQ ID NO: 1167523 - RNA, 20 nt, Mycobacterium bovis subsp bovis AF2122/97
cgagcgcuugaccccgccga

SEQ ID NO: 1167524 - RNA, 23 nt, Mycobacterium bovis subsp bovis AF2122/97
cgagcucguugcuggcggccagc

SEQ ID NO: 1167525 - RNA, 17 nt, Mycobacterium bovis subsp bovis AF2122/97
cgagcucggccccgccg

SEQ ID NO: 1167526 - RNA, 21 nt, Mycobacterium bovis subsp bovis AF2122/97
cgagcucggcgaacggcacca

SEQ ID NO: 1167527 - RNA, 14 nt, Mycobacterium bovis subsp bovis AF2122/97
cgagcucggcgccc

SEQ ID NO: 1167528 - RNA, 17 nt, Mycobacterium bovis subsp bovis AF2122/97
cgagcucggucaccacg

SEQ ID NO: 1167529 - RNA, 16 nt, Mycobacterium bovis subsp bovis AF2122/97
cgagcucguccucguc

SEQ ID NO: 1167530 - RNA, 20 nt, Mycobacterium bovis subsp bovis AF2122/97
cgagcugacgccgagcuggu

SEQ ID NO: 1167531 - RNA, 18 nt, Mycobacterium bovis subsp bovis AF2122/97
cgagcugccgucgcugcc

SEQ ID NO: 1167532 - RNA, 14 nt, Mycobacterium bovis subsp bovis AF2122/97
cgagcugccaacgc

SEQ ID NO: 1167533 - RNA, 15 nt, Mycobacterium bovis subsp bovis AF2122/97
cgagcucaccgcaca

SEQ ID NO: 1167534 - RNA, 18 nt, Mycobacterium bovis subsp bovis AF2122/97
cgagcuccuccaccaacu

SEQ ID NO: 1167535 - RNA, 16 nt, Mycobacterium bovis subsp bovis AF2122/97
cgagcucgccgcagcg

SEQ ID NO: 1167536 - RNA, 17 nt, Mycobacterium bovis subsp bovis AF2122/97
cgagcgcgccgaaggcc

SEQ ID NO: 1167537 - RNA, 22 nt, Mycobacterium bovis subsp bovis AF2122/97
cgagcgccaggucagcucgagc

SEQ ID NO: 1167538 - RNA, 15 nt, Mycobacterium bovis subsp bovis AF2122/97
cgagcgcgccggcca

SEQ ID NO: 1167539 - RNA, 14 nt, Mycobacterium bovis subsp bovis AF2122/97
cgagcgccggccgc

SEQ ID NO: 1167540 - RNA, 15 nt, Mycobacterium bovis subsp bovis AF2122/97
cgagcgccggccgcg

SEQ ID NO: 1167541 - RNA, 19 nt, Mycobacterium bovis subsp bovis AF2122/97
cgagcgcaccgcugaccgc

SEQ ID NO: 1167542 - RNA, 20 nt, Mycobacterium bovis subsp bovis AF2122/97
cgagcgcaagagccguccga

SEQ ID NO: 1167543 - RNA, 12 nt, Mycobacterium bovis subsp bovis AF2122/97
cgagcgcacugg

SEQ ID NO: 1167544 - RNA, 16 nt, Mycobacterium bovis subsp bovis AF2122/97
cgagcgcacaccggcu

SEQ ID NO: 1167545 - RNA, 17 nt, Mycobacterium bovis subsp bovis AF2122/97
cgagcgcacaccggcuu

SEQ ID NO: 1167546 - RNA, 12 nt, Mycobacterium bovis subsp bovis AF2122/97
cgagccgcagcu

SEQ ID NO: 1167547 - RNA, 24 nt, Mycobacterium bovis subsp bovis AF2122/97
cgagccgccggaucgccacggugg

SEQ ID NO: 1167548 - RNA, 22 nt, Mycobacterium bovis subsp bovis AF2122/97
cgagccgcgauugugcagcgaa

SEQ ID NO: 1167549 - RNA, 13 nt, Mycobacterium bovis subsp bovis AF2122/97
cgagccguagacc

SEQ ID NO: 1167550 - RNA, 18 nt, Mycobacterium bovis subsp bovis AF2122/97
cgagccgguggcgugggc

SEQ ID NO: 1167551 - RNA, 17 nt, Mycobacterium bovis subsp bovis AF2122/97
cgagcgaccgucccagc

SEQ ID NO: 1167552 - RNA, 23 nt, Mycobacterium bovis subsp bovis AF2122/97
cgaggucggccagcagcagugcc

SEQ ID NO: 1167553 - RNA, 12 nt, Mycobacterium bovis subsp bovis AF2122/97
cgaggucggcgg

SEQ ID NO: 1167554 - RNA, 12 nt, Mycobacterium bovis subsp bovis AF2122/97
cgaggucggaga

SEQ ID NO: 1167555 - RNA, 17 nt, Mycobacterium bovis subsp bovis AF2122/97
cgaggucgagcgccgcg

SEQ ID NO: 1167556 - RNA, 15 nt, Mycobacterium bovis subsp bovis AF2122/97
cgaggucgagcgccg

SEQ ID NO: 1167557 - RNA, 24 nt, Mycobacterium bovis subsp bovis AF2122/97
cgaggucccggccgagcguggcca

SEQ ID NO: 1167558 - RNA, 14 nt, Mycobacterium bovis subsp bovis AF2122/97
cgaggugcccaagg

SEQ ID NO: 1167559 - RNA, 20 nt, Mycobacterium bovis subsp bovis AF2122/97
cgaggugagguugacccccg

SEQ ID NO: 1167560 - RNA, 21 nt, Mycobacterium bovis subsp bovis AF2122/97
cgagguugauuggggccaggu

SEQ ID NO: 1167561 - RNA, 16 nt, Mycobacterium bovis subsp bovis AF2122/97
cgagguugcgccgacc

SEQ ID NO: 1167562 - RNA, 18 nt, Mycobacterium bovis subsp bovis AF2122/97
cgagguguagcccuccga

SEQ ID NO: 1167563 - RNA, 21 nt, Mycobacterium bovis subsp bovis AF2122/97
cgagguguagcccuccgagca

SEQ ID NO: 1167564 - RNA, 18 nt, Mycobacterium bovis subsp bovis AF2122/97
cgagguauucgcgcagca

SEQ ID NO: 1167565 - RNA, 15 nt, Mycobacterium bovis subsp bovis AF2122/97
cgagguccaccaccc

SEQ ID NO: 1167566 - RNA, 16 nt, Mycobacterium bovis subsp bovis AF2122/97
cgagggcgggacccgu

SEQ ID NO: 1167567 - RNA, 20 nt, Mycobacterium bovis subsp bovis AF2122/97
cgaggggagugucagcgcca

SEQ ID NO: 1167568 - RNA, 14 nt, Mycobacterium bovis subsp bovis AF2122/97
cgagggcgcguguc

SEQ ID NO: 1167569 - RNA, 16 nt, Mycobacterium bovis subsp bovis AF2122/97
cgagggcuugcaccug

SEQ ID NO: 1167570 - RNA, 16 nt, Mycobacterium bovis subsp bovis AF2122/97
cgagggcaacggcacu

SEQ ID NO: 1167571 - RNA, 19 nt, Mycobacterium bovis subsp bovis AF2122/97
cgagggcaacggcacuagc

SEQ ID NO: 1167572 - RNA, 16 nt, Mycobacterium bovis subsp bovis AF2122/97
cgagucgaugaccccg

SEQ ID NO: 1167573 - RNA, 20 nt, Mycobacterium bovis subsp bovis AF2122/97
cgagucgggguacaggcugc

SEQ ID NO: 1167574 - RNA, 13 nt, Mycobacterium bovis subsp bovis AF2122/97
cgagugaccaggg

SEQ ID NO: 1167575 - RNA, 23 nt, Mycobacterium bovis subsp bovis AF2122/97
cgagugcggugugugcaagccga

SEQ ID NO: 1167576 - RNA, 17 nt, Mycobacterium bovis subsp bovis AF2122/97
cgagucgguccugccaa

SEQ ID NO: 1167577 - RNA, 14 nt, Mycobacterium bovis subsp bovis AF2122/97
cgaguccaggcagc

SEQ ID NO: 1167578 - RNA, 20 nt, Mycobacterium bovis subsp bovis AF2122/97
cgagucaccggguccaccgc

SEQ ID NO: 1167579 - RNA, 16 nt, Mycobacterium bovis subsp bovis AF2122/97
cgaguaugggggugcu

SEQ ID NO: 1167580 - RNA, 18 nt, Mycobacterium bovis subsp bovis AF2122/97
cgaguaggcgugggucca

SEQ ID NO: 1167581 - RNA, 17 nt, Mycobacterium bovis subsp bovis AF2122/97
cgaguaccagcccaccg

SEQ ID NO: 1167582 - RNA, 17 nt, Mycobacterium bovis subsp bovis AF2122/97
cgaguaccggccagccg

SEQ ID NO: 1167583 - RNA, 19 nt, Mycobacterium bovis subsp bovis AF2122/97
cgaguaccggccagccgcg

SEQ ID NO: 1167584 - RNA, 17 nt, Mycobacterium bovis subsp bovis AF2122/97
cgaguagcugacccgcg

SEQ ID NO: 1167585 - RNA, 17 nt, Mycobacterium bovis subsp bovis AF2122/97
cgaguucgcgaaucccg

SEQ ID NO: 1167586 - RNA, 15 nt, Mycobacterium bovis subsp bovis AF2122/97
cgaguuaggccgcca

SEQ ID NO: 1167587 - RNA, 17 nt, Mycobacterium bovis subsp bovis AF2122/97
cgaguuucugcucgacc

SEQ ID NO: 1167588 - RNA, 17 nt, Mycobacterium bovis subsp bovis AF2122/97
cgaguuggcgaagcccg

SEQ ID NO: 1167589 - RNA, 12 nt, Mycobacterium bovis subsp bovis AF2122/97
cgaguugaagaa

SEQ ID NO: 1167590 - RNA, 23 nt, Mycobacterium bovis subsp bovis AF2122/97
cgaguugaacaauccgguguuga

SEQ ID NO: 1167591 - RNA, 23 nt, Mycobacterium bovis subsp bovis AF2122/97
cgauagcggcccgaucaccagcc

SEQ ID NO: 1167592 - RNA, 15 nt, Mycobacterium bovis subsp bovis AF2122/97
cgauaggugaacgcu

SEQ ID NO: 1167593 - RNA, 20 nt, Mycobacterium bovis subsp bovis AF2122/97
cgauagucauucgcuccggu

SEQ ID NO: 1167594 - RNA, 17 nt, Mycobacterium bovis subsp bovis AF2122/97
cgauaugcagcucgcug

SEQ ID NO: 1167595 - RNA, 16 nt, Mycobacterium bovis subsp bovis AF2122/97
cgauagcccgccaccc

SEQ ID NO: 1167596 - RNA, 16 nt, Mycobacterium bovis subsp bovis AF2122/97
cgauaccgcaccaaag

SEQ ID NO: 1167597 - RNA, 17 nt, Mycobacterium bovis subsp bovis AF2122/97
cgauggcgguggggcug

SEQ ID NO: 1167598 - RNA, 22 nt, Mycobacterium bovis subsp bovis AF2122/97
cgauggauuggcgucagcagca

SEQ ID NO: 1167599 - RNA, 15 nt, Mycobacterium bovis subsp bovis AF2122/97
cgauggacgcccagu

SEQ ID NO: 1167600 - RNA, 14 nt, Mycobacterium bovis subsp bovis AF2122/97
cgauggauggcguc

SEQ ID NO: 1167601 - RNA, 16 nt, Mycobacterium bovis subsp bovis AF2122/97
cgauggcggccaccgu

SEQ ID NO: 1167602 - RNA, 22 nt, Mycobacterium bovis subsp bovis AF2122/97
cgauggcucaccagcuccucgu

SEQ ID NO: 1167603 - RNA, 20 nt, Mycobacterium bovis subsp bovis AF2122/97
cgaugggccgguccggggca

SEQ ID NO: 1167604 - RNA, 16 nt, Mycobacterium bovis subsp bovis AF2122/97
cgauggcuaccccagg

SEQ ID NO: 1167605 - RNA, 17 nt, Mycobacterium bovis subsp bovis AF2122/97
cgauggcuaccccaggg

SEQ ID NO: 1167606 - RNA, 15 nt, Mycobacterium bovis subsp bovis AF2122/97
cgauggcguacagca

SEQ ID NO: 1167607 - RNA, 17 nt, Mycobacterium bovis subsp bovis AF2122/97
cgaugcucgucccagaa

SEQ ID NO: 1167608 - RNA, 13 nt, Mycobacterium bovis subsp bovis AF2122/97
cgauguccucgua

SEQ ID NO: 1167609 - RNA, 20 nt, Mycobacterium bovis subsp bovis AF2122/97
cgauggguguugcuggccgc

SEQ ID NO: 1167610 - RNA, 18 nt, Mycobacterium bovis subsp bovis AF2122/97
cgaugucccgagcccgcu

SEQ ID NO: 1167611 - RNA, 14 nt, Mycobacterium bovis subsp bovis AF2122/97
cgauggugaugggg

SEQ ID NO: 1167612 - RNA, 18 nt, Mycobacterium bovis subsp bovis AF2122/97
cgaugguacccgcgccgc

SEQ ID NO: 1167613 - RNA, 17 nt, Mycobacterium bovis subsp bovis AF2122/97
cgauguggcgcuccggc

SEQ ID NO: 1167614 - RNA, 16 nt, Mycobacterium bovis subsp bovis AF2122/97
cgaugcgacgcagacc

SEQ ID NO: 1167615 - RNA, 19 nt, Mycobacterium bovis subsp bovis AF2122/97
cgaugccguccaagauguc

SEQ ID NO: 1167616 - RNA, 17 nt, Mycobacterium bovis subsp bovis AF2122/97
cgaugccgccgaagagg

SEQ ID NO: 1167617 - RNA, 17 nt, Mycobacterium bovis subsp bovis AF2122/97
cgaugccgugcugggcc

SEQ ID NO: 1167618 - RNA, 16 nt, Mycobacterium bovis subsp bovis AF2122/97
cgaugccggguguguu

SEQ ID NO: 1167619 - RNA, 20 nt, Mycobacterium bovis subsp bovis AF2122/97
cgaugccgccggccccgccg

SEQ ID NO: 1167620 - RNA, 15 nt, Mycobacterium bovis subsp bovis AF2122/97
cgaugccgaagcccc

SEQ ID NO: 1167621 - RNA, 20 nt, Mycobacterium bovis subsp bovis AF2122/97
cgaucaauccgcccuugccg

SEQ ID NO: 1167622 - RNA, 15 nt, Mycobacterium bovis subsp bovis AF2122/97
cgaucaccacggcgu

SEQ ID NO: 1167623 - RNA, 15 nt, Mycobacterium bovis subsp bovis AF2122/97
cgaucaccauccagc

SEQ ID NO: 1167624 - RNA, 16 nt, Mycobacterium bovis subsp bovis AF2122/97
cgaucaccucgcgggu

SEQ ID NO: 1167625 - RNA, 18 nt, Mycobacterium bovis subsp bovis AF2122/97
cgaucacccgcacuccac

SEQ ID NO: 1167626 - RNA, 16 nt, Mycobacterium bovis subsp bovis AF2122/97
cgaucacggccgucga

SEQ ID NO: 1167627 - RNA, 13 nt, Mycobacterium bovis subsp bovis AF2122/97
cgaucacaccacg

SEQ ID NO: 1167628 - RNA, 15 nt, Mycobacterium bovis subsp bovis AF2122/97
cgaucaacagcaccg

SEQ ID NO: 1167629 - RNA, 21 nt, Mycobacterium bovis subsp bovis AF2122/97
cgauucgccuagcgagcgcac

SEQ ID NO: 1167630 - RNA, 16 nt, Mycobacterium bovis subsp bovis AF2122/97
cgauucugcgucugcu

SEQ ID NO: 1167631 - RNA, 21 nt, Mycobacterium bovis subsp bovis AF2122/97
cgaugugggcggagccgauga

SEQ ID NO: 1167632 - RNA, 14 nt, Mycobacterium bovis subsp bovis AF2122/97
cgauugcccgcgcu

SEQ ID NO: 1167633 - RNA, 13 nt, Mycobacterium bovis subsp bovis AF2122/97
cgauugccgucgu

SEQ ID NO: 1167634 - RNA, 14 nt, Mycobacterium bovis subsp bovis AF2122/97
cgauugcagcuucg

SEQ ID NO: 1167635 - RNA, 18 nt, Mycobacterium bovis subsp bovis AF2122/97
cgauuuccaucgcgaccu

SEQ ID NO: 1167636 - RNA, 20 nt, Mycobacterium bovis subsp bovis AF2122/97
cgauuucgagcgcugcuccc

SEQ ID NO: 1167637 - RNA, 24 nt, Mycobacterium bovis subsp bovis AF2122/97
cgauuucgaugacgaacaagaaaa

SEQ ID NO: 1167638 - RNA, 22 nt, Mycobacterium bovis subsp bovis AF2122/97
cgcaccgugugggccccgccga

SEQ ID NO: 1167639 - RNA, 15 nt, Mycobacterium bovis subsp bovis AF2122/97
cgcaccuacccugcg

SEQ ID NO: 1167640 - RNA, 16 nt, Mycobacterium bovis subsp bovis AF2122/97
cgcacgaaaucagccc

SEQ ID NO: 1167641 - RNA, 20 nt, Mycobacterium bovis subsp bovis AF2122/97
cgcacgaaaucagcccgccc

SEQ ID NO: 1167642 - RNA, 21 nt, Mycobacterium bovis subsp bovis AF2122/97
cgcacgaaccccacgcagaag

SEQ ID NO: 1167643 - RNA, 13 nt, Mycobacterium bovis subsp bovis AF2122/97
cgcacgaccagcu

SEQ ID NO: 1167644 - RNA, 16 nt, Mycobacterium bovis subsp bovis AF2122/97
cgcacgaccagcugag

SEQ ID NO: 1167645 - RNA, 19 nt, Mycobacterium bovis subsp bovis AF2122/97
cgcaccggugacgcacagc

SEQ ID NO: 1167646 - RNA, 12 nt, Mycobacterium bovis subsp bovis AF2122/97
cgcacgacaccu

SEQ ID NO: 1167647 - RNA, 19 nt, Mycobacterium bovis subsp bovis AF2122/97
cgcacgauggugugcagca

SEQ ID NO: 1167648 - RNA, 18 nt, Mycobacterium bovis subsp bovis AF2122/97
cgcacgauuucgagcgcu

SEQ ID NO: 1167649 - RNA, 14 nt, Mycobacterium bovis subsp bovis AF2122/97
cgcacgaucugcag

SEQ ID NO: 1167650 - RNA, 18 nt, Mycobacterium bovis subsp bovis AF2122/97
cgcacgcaaugcgggccc

SEQ ID NO: 1167651 - RNA, 13 nt, Mycobacterium bovis subsp bovis AF2122/97
cgcacgcacggcg

SEQ ID NO: 1167652 - RNA, 13 nt, Mycobacterium bovis subsp bovis AF2122/97
cgcacgccaccgg

SEQ ID NO: 1167653 - RNA, 13 nt, Mycobacterium bovis subsp bovis AF2122/97
cgcacgccggcau

SEQ ID NO: 1167654 - RNA, 18 nt, Mycobacterium bovis subsp bovis AF2122/97
cgcaccgaccgcaccgug

SEQ ID NO: 1167655 - RNA, 15 nt, Mycobacterium bovis subsp bovis AF2122/97
cgcaccaccugggcg

SEQ ID NO: 1167656 - RNA, 16 nt, Mycobacterium bovis subsp bovis AF2122/97
cgcaccaccugggcgg

SEQ ID NO: 1167657 - RNA, 17 nt, Mycobacterium bovis subsp bovis AF2122/97
cgcaccaccugggcggc

SEQ ID NO: 1167658 - RNA, 16 nt, Mycobacterium bovis subsp bovis AF2122/97
cgcaccaccgccccgc

SEQ ID NO: 1167659 - RNA, 16 nt, Mycobacterium bovis subsp bovis AF2122/97
cgcaccaccgagccga

SEQ ID NO: 1167660 - RNA, 15 nt, Mycobacterium bovis subsp bovis AF2122/97
cgcaccaccgccccg

SEQ ID NO: 1167661 - RNA, 23 nt, Mycobacterium bovis subsp bovis AF2122/97
cgcaccacaccacgguggccgcu

SEQ ID NO: 1167662 - RNA, 22 nt, Mycobacterium bovis subsp bovis AF2122/97
cgcacauugguguccaccaccg

SEQ ID NO: 1167663 - RNA, 14 nt, Mycobacterium bovis subsp bovis AF2122/97
cgcaccacaccacg

SEQ ID NO: 1167664 - RNA, 13 nt, Mycobacterium bovis subsp bovis AF2122/97
cgcaccgccccgc

SEQ ID NO: 1167665 - RNA, 18 nt, Mycobacterium bovis subsp bovis AF2122/97
cgcaccggaucaccgcgc

SEQ ID NO: 1167666 - RNA, 13 nt, Mycobacterium bovis subsp bovis AF2122/97
cgcagaggcggcu

SEQ ID NO: 1167667 - RNA, 22 nt, Mycobacterium bovis subsp bovis AF2122/97
cgcagaucgaaaucagcccgcg

SEQ ID NO: 1167668 - RNA, 18 nt, Mycobacterium bovis subsp bovis AF2122/97
cgcagaucaggguggcgc

SEQ ID NO: 1167669 - RNA, 21 nt, Mycobacterium bovis subsp bovis AF2122/97
cgcagagcguacaggucggcc

SEQ ID NO: 1167670 - RNA, 22 nt, Mycobacterium bovis subsp bovis AF2122/97
cgcagacucgauaugcagcucg

SEQ ID NO: 1167671 - RNA, 12 nt, Mycobacterium bovis subsp bovis AF2122/97
cgcagaccagac

SEQ ID NO: 1167672 - RNA, 17 nt, Mycobacterium bovis subsp bovis AF2122/97
cgcagaccgccaccggc

SEQ ID NO: 1167673 - RNA, 18 nt, Mycobacterium bovis subsp bovis AF2122/97
cgcagaccugcaucacaa

SEQ ID NO: 1167674 - RNA, 19 nt, Mycobacterium bovis subsp bovis AF2122/97
cgcacggcuagcgccguga

SEQ ID NO: 1167675 - RNA, 21 nt, Mycobacterium bovis subsp bovis AF2122/97
cgcacgguugccgucaggguc

SEQ ID NO: 1167676 - RNA, 20 nt, Mycobacterium bovis subsp bovis AF2122/97
cgcacgugaugcccuggggg

SEQ ID NO: 1167677 - RNA, 21 nt, Mycobacterium bovis subsp bovis AF2122/97
cgcacguauccacggucgacc

SEQ ID NO: 1167678 - RNA, 23 nt, Mycobacterium bovis subsp bovis AF2122/97
cgcacgucgaccucggcaaccac

SEQ ID NO: 1167679 - RNA, 19 nt, Mycobacterium bovis subsp bovis AF2122/97
cgcacuacucgaacaaccc

SEQ ID NO: 1167680 - RNA, 14 nt, Mycobacterium bovis subsp bovis AF2122/97
cgcacuaccgccuu

SEQ ID NO: 1167681 - RNA, 16 nt, Mycobacterium bovis subsp bovis AF2122/97
cgcacguuggcggcca

SEQ ID NO: 1167682 - RNA, 15 nt, Mycobacterium bovis subsp bovis AF2122/97
cgcacaaacgggcgu

SEQ ID NO: 1167683 - RNA, 20 nt, Mycobacterium bovis subsp bovis AF2122/97
cgcacaaacgggcgugggcc

SEQ ID NO: 1167684 - RNA, 16 nt, Mycobacterium bovis subsp bovis AF2122/97
cgcacaauggcggcgc

SEQ ID NO: 1167685 - RNA, 17 nt, Mycobacterium bovis subsp bovis AF2122/97
cgcacaccaacaccgcg

SEQ ID NO: 1167686 - RNA, 22 nt, Mycobacterium bovis subsp bovis AF2122/97
cgcacaccaacaccgcggcgcu

SEQ ID NO: 1167687 - RNA, 12 nt, Mycobacterium bovis subsp bovis AF2122/97
cgcaccaacacc

SEQ ID NO: 1167688 - RNA, 17 nt, Mycobacterium bovis subsp bovis AF2122/97
cgcaccaaggccgccug

SEQ ID NO: 1167689 - RNA, 18 nt, Mycobacterium bovis subsp bovis AF2122/97
cgcaccaaggccgccugc

SEQ ID NO: 1167690 - RNA, 23 nt, Mycobacterium bovis subsp bovis AF2122/97
cgcaagcugguagguggagagcc

SEQ ID NO: 1167691 - RNA, 14 nt, Mycobacterium bovis subsp bovis AF2122/97
cgcaagaaugccgc

SEQ ID NO: 1167692 - RNA, 15 nt, Mycobacterium bovis subsp bovis AF2122/97
cgcaacgccgauggc

SEQ ID NO: 1167693 - RNA, 22 nt, Mycobacterium bovis subsp bovis AF2122/97
cgcaacaugggugaugcaacgc

SEQ ID NO: 1167694 - RNA, 20 nt, Mycobacterium bovis subsp bovis AF2122/97
cgcaaaacgagcuuccacgc

SEQ ID NO: 1167695 - RNA, 22 nt, Mycobacterium bovis subsp bovis AF2122/97
cgcaaaagaacccgauucuggu

SEQ ID NO: 1167696 - RNA, 14 nt, Mycobacterium bovis subsp bovis AF2122/97
cgcaaccgcggccc

SEQ ID NO: 1167697 - RNA, 22 nt, Mycobacterium bovis subsp bovis AF2122/97
cgcaaccuaaauugccgggccc

SEQ ID NO: 1167698 - RNA, 22 nt, Mycobacterium bovis subsp bovis AF2122/97
cgcaaccccuggggugcucggg

SEQ ID NO: 1167699 - RNA, 21 nt, Mycobacterium bovis subsp bovis AF2122/97
cgcaaccgcgcuuggagcggg

SEQ ID NO: 1167700 - RNA, 15 nt, Mycobacterium bovis subsp bovis AF2122/97
cgcaacccagccgcg

SEQ ID NO: 1167701 - RNA, 14 nt, Mycobacterium bovis subsp bovis AF2122/97
cgccagaccgcggc

SEQ ID NO: 1167702 - RNA, 21 nt, Mycobacterium bovis subsp bovis AF2122/97
cgccagaacguggccauccuc

SEQ ID NO: 1167703 - RNA, 16 nt, Mycobacterium bovis subsp bovis AF2122/97
cgccacggcagcgccc

SEQ ID NO: 1167704 - RNA, 20 nt, Mycobacterium bovis subsp bovis AF2122/97
cgccacugccggcagcgccc

SEQ ID NO: 1167705 - RNA, 23 nt, Mycobacterium bovis subsp bovis AF2122/97
cgccacuggacucuucagcuacc

SEQ ID NO: 1167706 - RNA, 23 nt, Mycobacterium bovis subsp bovis AF2122/97
cgccacuggcgccggugccgccg

SEQ ID NO: 1167707 - RNA, 19 nt, Mycobacterium bovis subsp bovis AF2122/97
cgccacggaucgcggcggc

SEQ ID NO: 1167708 - RNA, 17 nt, Mycobacterium bovis subsp bovis AF2122/97
cgccacgccgaugaugg

SEQ ID NO: 1167709 - RNA, 12 nt, Mycobacterium bovis subsp bovis AF2122/97
cgccaauccacc

SEQ ID NO: 1167710 - RNA, 14 nt, Mycobacterium bovis subsp bovis AF2122/97
cgccaagggccccu

SEQ ID NO: 1167711 - RNA, 13 nt, Mycobacterium bovis subsp bovis AF2122/97
cgccaaggaggcc

SEQ ID NO: 1167712 - RNA, 21 nt, Mycobacterium bovis subsp bovis AF2122/97
cgccaaguccgcucaccuuug

SEQ ID NO: 1167713 - RNA, 19 nt, Mycobacterium bovis subsp bovis AF2122/97
cgccaccgcacgcacgcca

SEQ ID NO: 1167714 - RNA, 14 nt, Mycobacterium bovis subsp bovis AF2122/97
cgccaccgccagcg

SEQ ID NO: 1167715 - RNA, 19 nt, Mycobacterium bovis subsp bovis AF2122/97
cgccaccgauaccgucagc

SEQ ID NO: 1167716 - RNA, 15 nt, Mycobacterium bovis subsp bovis AF2122/97
cgccaccgccgcugc

SEQ ID NO: 1167717 - RNA, 12 nt, Mycobacterium bovis subsp bovis AF2122/97
cgccaccgccgg

SEQ ID NO: 1167718 - RNA, 16 nt, Mycobacterium bovis subsp bovis AF2122/97
cgccaccgccggcagc

SEQ ID NO: 1167719 - RNA, 15 nt, Mycobacterium bovis subsp bovis AF2122/97
cgccacgcacccggc

SEQ ID NO: 1167720 - RNA, 11 nt, Mycobacterium bovis subsp bovis AF2122/97
cgccacccggu

SEQ ID NO: 1167721 - RNA, 16 nt, Mycobacterium bovis subsp bovis AF2122/97
cgccacgcacccggca

SEQ ID NO: 1167722 - RNA, 19 nt, Mycobacterium bovis subsp bovis AF2122/97
cgccaccgagaucggacag

SEQ ID NO: 1167723 - RNA, 19 nt, Mycobacterium bovis subsp bovis AF2122/97
cgccaccgagcccuccagg

SEQ ID NO: 1167724 - RNA, 13 nt, Mycobacterium bovis subsp bovis AF2122/97
cgccacccgcgcc

SEQ ID NO: 1167725 - RNA, 19 nt, Mycobacterium bovis subsp bovis AF2122/97
cgccacccgcgccgcccgc

SEQ ID NO: 1167726 - RNA, 16 nt, Mycobacterium bovis subsp bovis AF2122/97
cgccacccgccaacgc

SEQ ID NO: 1167727 - RNA, 19 nt, Mycobacterium bovis subsp bovis AF2122/97
cgccaccccgcgcgccagc

SEQ ID NO: 1167728 - RNA, 19 nt, Mycobacterium bovis subsp bovis AF2122/97
cgccacccgacaugcgccg

SEQ ID NO: 1167729 - RNA, 16 nt, Mycobacterium bovis subsp bovis AF2122/97
cgccaacgccacggca

SEQ ID NO: 1167730 - RNA, 22 nt, Mycobacterium bovis subsp bovis AF2122/97
cgccaacgacucacccacccgc

SEQ ID NO: 1167731 - RNA, 21 nt, Mycobacterium bovis subsp bovis AF2122/97
cgccaaccacuuuccggccga

SEQ ID NO: 1167732 - RNA, 16 nt, Mycobacterium bovis subsp bovis AF2122/97
cgccaaccgcgugcgu

SEQ ID NO: 1167733 - RNA, 19 nt, Mycobacterium bovis subsp bovis AF2122/97
cgccaacgcccccauccgg

SEQ ID NO: 1167734 - RNA, 19 nt, Mycobacterium bovis subsp bovis AF2122/97
cgccaacgggcugccccuc

SEQ ID NO: 1167735 - RNA, 15 nt, Mycobacterium bovis subsp bovis AF2122/97
cgccaacuucaccac

SEQ ID NO: 1167736 - RNA, 18 nt, Mycobacterium bovis subsp bovis AF2122/97
cgccaacuucaccacccu

SEQ ID NO: 1167737 - RNA, 22 nt, Mycobacterium bovis subsp bovis AF2122/97
cgccaacucgagaguggccucg

SEQ ID NO: 1167738 - RNA, 17 nt, Mycobacterium bovis subsp bovis AF2122/97
cgccaacuccagcaccc

SEQ ID NO: 1167739 - RNA, 21 nt, Mycobacterium bovis subsp bovis AF2122/97
cgccaacuccucagccgccug

SEQ ID NO: 1167740 - RNA, 19 nt, Mycobacterium bovis subsp bovis AF2122/97
cgccaacugcggcaggucu

SEQ ID NO: 1167741 - RNA, 14 nt, Mycobacterium bovis subsp bovis AF2122/97
cgccaacaccaacc

SEQ ID NO: 1167742 - RNA, 22 nt, Mycobacterium bovis subsp bovis AF2122/97
cgccaaagccgggauugccgcc

SEQ ID NO: 1167743 - RNA, 10 nt, Mycobacterium bovis subsp bovis AF2122/97
cgccaaaauc

SEQ ID NO: 1167744 - RNA, 15 nt, Mycobacterium bovis subsp bovis AF2122/97
cgccaaacaccccgg

SEQ ID NO: 1167745 - RNA, 13 nt, Mycobacterium bovis subsp bovis AF2122/97
cgcaugggccagg

SEQ ID NO: 1167746 - RNA, 15 nt, Mycobacterium bovis subsp bovis AF2122/97
cgcaugcccuggacc

SEQ ID NO: 1167747 - RNA, 21 nt, Mycobacterium bovis subsp bovis AF2122/97
cgcaugcuugaaacccaggcc

SEQ ID NO: 1167748 - RNA, 14 nt, Mycobacterium bovis subsp bovis AF2122/97
cgcauggacaacag

SEQ ID NO: 1167749 - RNA, 17 nt, Mycobacterium bovis subsp bovis AF2122/97
cgcaugucgggccaggc

SEQ ID NO: 1167750 - RNA, 14 nt, Mycobacterium bovis subsp bovis AF2122/97
cgcauuagccugcg

SEQ ID NO: 1167751 - RNA, 19 nt, Mycobacterium bovis subsp bovis AF2122/97
cgcauuucguggcgcgccg

SEQ ID NO: 1167752 - RNA, 19 nt, Mycobacterium bovis subsp bovis AF2122/97
cgcauuuguugcugcugcc

SEQ ID NO: 1167753 - RNA, 21 nt, Mycobacterium bovis subsp bovis AF2122/97
cgcauuuuucgccagcugaca

SEQ ID NO: 1167754 - RNA, 15 nt, Mycobacterium bovis subsp bovis AF2122/97
cgcauuccggcgcca

SEQ ID NO: 1167755 - RNA, 20 nt, Mycobacterium bovis subsp bovis AF2122/97
cgcauucguggagccggccg

SEQ ID NO: 1167756 - RNA, 21 nt, Mycobacterium bovis subsp bovis AF2122/97
cgcauugagcuggcgcccggg

SEQ ID NO: 1167757 - RNA, 16 nt, Mycobacterium bovis subsp bovis AF2122/97
cgcaggcgcagauucc

SEQ ID NO: 1167758 - RNA, 16 nt, Mycobacterium bovis subsp bovis AF2122/97
cgcagggcgucggcga

SEQ ID NO: 1167759 - RNA, 15 nt, Mycobacterium bovis subsp bovis AF2122/97
cgcagggccgccgcg

SEQ ID NO: 1167760 - RNA, 17 nt, Mycobacterium bovis subsp bovis AF2122/97
cgcaggccgccgccagu

SEQ ID NO: 1167761 - RNA, 21 nt, Mycobacterium bovis subsp bovis AF2122/97
cgcaggccagggucagcucgg

SEQ ID NO: 1167762 - RNA, 12 nt, Mycobacterium bovis subsp bovis AF2122/97
cgcaggucgcgc

SEQ ID NO: 1167763 - RNA, 18 nt, Mycobacterium bovis subsp bovis AF2122/97
cgcaggucggccaccugc

SEQ ID NO: 1167764 - RNA, 17 nt, Mycobacterium bovis subsp bovis AF2122/97
cgcagguagucgacgac

SEQ ID NO: 1167765 - RNA, 15 nt, Mycobacterium bovis subsp bovis AF2122/97
cgcagucgcggcaga

SEQ ID NO: 1167766 - RNA, 14 nt, Mycobacterium bovis subsp bovis AF2122/97
cgcagucgggcagc

SEQ ID NO: 1167767 - RNA, 12 nt, Mycobacterium bovis subsp bovis AF2122/97
cgcagucugacg

SEQ ID NO: 1167768 - RNA, 13 nt, Mycobacterium bovis subsp bovis AF2122/97
cgcagucugacga

SEQ ID NO: 1167769 - RNA, 14 nt, Mycobacterium bovis subsp bovis AF2122/97
cgcagugcgacucu

SEQ ID NO: 1167770 - RNA, 22 nt, Mycobacterium bovis subsp bovis AF2122/97
cgcaguggcguuacgcucggcg

SEQ ID NO: 1167771 - RNA, 18 nt, Mycobacterium bovis subsp bovis AF2122/97
cgcagcaacugggcggcc

SEQ ID NO: 1167772 - RNA, 16 nt, Mycobacterium bovis subsp bovis AF2122/97
cgcagcaacggcggcg

SEQ ID NO: 1167773 - RNA, 13 nt, Mycobacterium bovis subsp bovis AF2122/97
cgcagcaacggcg

SEQ ID NO: 1167774 - RNA, 23 nt, Mycobacterium bovis subsp bovis AF2122/97
cgcagcaacaccucgucacccgg

SEQ ID NO: 1167775 - RNA, 16 nt, Mycobacterium bovis subsp bovis AF2122/97
cgcagcaccaaggucu

SEQ ID NO: 1167776 - RNA, 22 nt, Mycobacterium bovis subsp bovis AF2122/97
cgcagcaccgucgggcccagcc

SEQ ID NO: 1167777 - RNA, 19 nt, Mycobacterium bovis subsp bovis AF2122/97
cgcagcaccgucggcacca

SEQ ID NO: 1167778 - RNA, 18 nt, Mycobacterium bovis subsp bovis AF2122/97
cgcagcaccgucgggccc

SEQ ID NO: 1167779 - RNA, 21 nt, Mycobacterium bovis subsp bovis AF2122/97
cgcagcaccgucgggcccagc

SEQ ID NO: 1167780 - RNA, 22 nt, Mycobacterium bovis subsp bovis AF2122/97
cgcagcaccucgucgaucgccg

SEQ ID NO: 1167781 - RNA, 16 nt, Mycobacterium bovis subsp bovis AF2122/97
cgcagcucgaccagga

SEQ ID NO: 1167782 - RNA, 21 nt, Mycobacterium bovis subsp bovis AF2122/97
cgcaggcagugagggucccac

SEQ ID NO: 1167783 - RNA, 19 nt, Mycobacterium bovis subsp bovis AF2122/97
cgcagcugccgcacccccu

SEQ ID NO: 1167784 - RNA, 18 nt, Mycobacterium bovis subsp bovis AF2122/97
cgcagcgugagugcagca

SEQ ID NO: 1167785 - RNA, 15 nt, Mycobacterium bovis subsp bovis AF2122/97
cgcagcuaacccgcc

SEQ ID NO: 1167786 - RNA, 23 nt, Mycobacterium bovis subsp bovis AF2122/97
cgcagcagacuccguugccaccu

SEQ ID NO: 1167787 - RNA, 14 nt, Mycobacterium bovis subsp bovis AF2122/97
cgcagcacucgccc

SEQ ID NO: 1167788 - RNA, 18 nt, Mycobacterium bovis subsp bovis AF2122/97
cgcagcacugcggcagcg

SEQ ID NO: 1167789 - RNA, 19 nt, Mycobacterium bovis subsp bovis AF2122/97
cgcagcacugcggcagcga

SEQ ID NO: 1167790 - RNA, 19 nt, Mycobacterium bovis subsp bovis AF2122/97
cgcagcuaacccgccacgu

SEQ ID NO: 1167791 - RNA, 16 nt, Mycobacterium bovis subsp bovis AF2122/97
cgcagcucagcauccc

SEQ ID NO: 1167792 - RNA, 22 nt, Mycobacterium bovis subsp bovis AF2122/97
cgcaguucaucgggcaccaacc

SEQ ID NO: 1167793 - RNA, 16 nt, Mycobacterium bovis subsp bovis AF2122/97
cgcauagggccaccgc

SEQ ID NO: 1167794 - RNA, 22 nt, Mycobacterium bovis subsp bovis AF2122/97
cgcauaggcggccaucgacgac

SEQ ID NO: 1167795 - RNA, 17 nt, Mycobacterium bovis subsp bovis AF2122/97
cgcaucagggugggcga

SEQ ID NO: 1167796 - RNA, 23 nt, Mycobacterium bovis subsp bovis AF2122/97
cgcaucacccgggaugaccaccg

SEQ ID NO: 1167797 - RNA, 20 nt, Mycobacterium bovis subsp bovis AF2122/97
cgcauccagccgugcggcgg

SEQ ID NO: 1167798 - RNA, 15 nt, Mycobacterium bovis subsp bovis AF2122/97
cgcaucgccucacca

SEQ ID NO: 1167799 - RNA, 22 nt, Mycobacterium bovis subsp bovis AF2122/97
cgcaucgccgcuggccagcaca

SEQ ID NO: 1167800 - RNA, 17 nt, Mycobacterium bovis subsp bovis AF2122/97
cgcaucgagcaccucca

SEQ ID NO: 1167801 - RNA, 22 nt, Mycobacterium bovis subsp bovis AF2122/97
cgcauccgcgguuggcaguggc

SEQ ID NO: 1167802 - RNA, 19 nt, Mycobacterium bovis subsp bovis AF2122/97
cgcauccgcgacggcgccc

SEQ ID NO: 1167803 - RNA, 20 nt, Mycobacterium bovis subsp bovis AF2122/97
cgcaucgacgugcgcggcau

SEQ ID NO: 1167804 - RNA, 20 nt, Mycobacterium bovis subsp bovis AF2122/97
cgcaucuugucgagcaccuc

SEQ ID NO: 1167805 - RNA, 19 nt, Mycobacterium bovis subsp bovis AF2122/97
ccuucuccagauccacgcc

SEQ ID NO: 1167806 - RNA, 21 nt, Mycobacterium bovis subsp bovis AF2122/97
ccuucuccaucgucggcaaca

SEQ ID NO: 1167807 - RNA, 13 nt, Mycobacterium bovis subsp bovis AF2122/97
ccuucucccgcac

SEQ ID NO: 1167808 - RNA, 17 nt, Mycobacterium bovis subsp bovis AF2122/97
ccuucgucacauugcca

SEQ ID NO: 1167809 - RNA, 23 nt, Mycobacterium bovis subsp bovis AF2122/97
ccuucguagcggccgcaggcgaa

SEQ ID NO: 1167810 - RNA, 21 nt, Mycobacterium bovis subsp bovis AF2122/97
ccuucgguaggcaggccggcu

SEQ ID NO: 1167811 - RNA, 22 nt, Mycobacterium bovis subsp bovis AF2122/97
ccuucggugccggaaacgccag

SEQ ID NO: 1167812 - RNA, 19 nt, Mycobacterium bovis subsp bovis AF2122/97
ccuucucguaacgcggcac

SEQ ID NO: 1167813 - RNA, 15 nt, Mycobacterium bovis subsp bovis AF2122/97
ccuucucgccgccgc

SEQ ID NO: 1167814 - RNA, 14 nt, Mycobacterium bovis subsp bovis AF2122/97
ccuucucgccgugu

SEQ ID NO: 1167815 - RNA, 15 nt, Mycobacterium bovis subsp bovis AF2122/97
ccuucugguccagca

SEQ ID NO: 1167816 - RNA, 21 nt, Mycobacterium bovis subsp bovis AF2122/97
ccuugaccgcggucuucuuca

SEQ ID NO: 1167817 - RNA, 18 nt, Mycobacterium bovis subsp bovis AF2122/97
ccuugaccgcugcccagu

SEQ ID NO: 1167818 - RNA, 22 nt, Mycobacterium bovis subsp bovis AF2122/97
ccuugaccucggguaacguguu

SEQ ID NO: 1167819 - RNA, 13 nt, Mycobacterium bovis subsp bovis AF2122/97
ccuugacggugag

SEQ ID NO: 1167820 - RNA, 14 nt, Mycobacterium bovis subsp bovis AF2122/97
ccuugaccgaccag

SEQ ID NO: 1167821 - RNA, 22 nt, Mycobacterium bovis subsp bovis AF2122/97
ccuugacgcgcaacgccgccag

SEQ ID NO: 1167822 - RNA, 22 nt, Mycobacterium bovis subsp bovis AF2122/97
ccuucuuggcaggugccuucuu

SEQ ID NO: 1167823 - RNA, 16 nt, Mycobacterium bovis subsp bovis AF2122/97
ccugugucgccgucgc

SEQ ID NO: 1167824 - RNA, 13 nt, Mycobacterium bovis subsp bovis AF2122/97
ccuucggcgagcg

SEQ ID NO: 1167825 - RNA, 19 nt, Mycobacterium bovis subsp bovis AF2122/97
ccuucggccgaccgggcuc

SEQ ID NO: 1167826 - RNA, 22 nt, Mycobacterium bovis subsp bovis AF2122/97
ccuucgcggugugcggcagccc

SEQ ID NO: 1167827 - RNA, 14 nt, Mycobacterium bovis subsp bovis AF2122/97
ccuucgccggcgcc

SEQ ID NO: 1167828 - RNA, 22 nt, Mycobacterium bovis subsp bovis AF2122/97
ccuuggugggcagauacgagcu

SEQ ID NO: 1167829 - RNA, 18 nt, Mycobacterium bovis subsp bovis AF2122/97
ccuugguguggggcggcu

SEQ ID NO: 1167830 - RNA, 16 nt, Mycobacterium bovis subsp bovis AF2122/97
ccuuggucaccuucuu

SEQ ID NO: 1167831 - RNA, 15 nt, Mycobacterium bovis subsp bovis AF2122/97
ccuuggucgccgccu

SEQ ID NO: 1167832 - RNA, 17 nt, Mycobacterium bovis subsp bovis AF2122/97
ccuuggucgccgccuuc

SEQ ID NO: 1167833 - RNA, 15 nt, Mycobacterium bovis subsp bovis AF2122/97
ccuuggucgccggcg

SEQ ID NO: 1167834 - RNA, 16 nt, Mycobacterium bovis subsp bovis AF2122/97
ccuugguagccggccg

SEQ ID NO: 1167835 - RNA, 20 nt, Mycobacterium bovis subsp bovis AF2122/97
ccuugggcgacgcggcgccg

SEQ ID NO: 1167836 - RNA, 21 nt, Mycobacterium bovis subsp bovis AF2122/97
ccuugucggccccggccgcgu

SEQ ID NO: 1167837 - RNA, 20 nt, Mycobacterium bovis subsp bovis AF2122/97
ccuuggccagacccaccacc

SEQ ID NO: 1167838 - RNA, 22 nt, Mycobacterium bovis subsp bovis AF2122/97
ccuuggccagcagggccaccac

SEQ ID NO: 1167839 - RNA, 14 nt, Mycobacterium bovis subsp bovis AF2122/97
ccuuggcaguccag

SEQ ID NO: 1167840 - RNA, 17 nt, Mycobacterium bovis subsp bovis AF2122/97
ccuuggaugcccugccc

SEQ ID NO: 1167841 - RNA, 12 nt, Mycobacterium bovis subsp bovis AF2122/97
ccuuggacucgg

SEQ ID NO: 1167842 - RNA, 22 nt, Mycobacterium bovis subsp bovis AF2122/97
ccuuggccguucggcgcccgcu

SEQ ID NO: 1167843 - RNA, 14 nt, Mycobacterium bovis subsp bovis AF2122/97
ccuugggaccaccg

SEQ ID NO: 1167844 - RNA, 16 nt, Mycobacterium bovis subsp bovis AF2122/97
ccuuggcggucggcag

SEQ ID NO: 1167845 - RNA, 12 nt, Mycobacterium bovis subsp bovis AF2122/97
ccuugugacccc

SEQ ID NO: 1167846 - RNA, 12 nt, Mycobacterium bovis subsp bovis AF2122/97
ccuugugcagau

SEQ ID NO: 1167847 - RNA, 19 nt, Mycobacterium bovis subsp bovis AF2122/97
ccuuguggcacacccgcac

SEQ ID NO: 1167848 - RNA, 20 nt, Mycobacterium bovis subsp bovis AF2122/97
ccuuguggucugccagcacc

SEQ ID NO: 1167849 - RNA, 21 nt, Mycobacterium bovis subsp bovis AF2122/97
ccuuguguggcgaaucuuugg

SEQ ID NO: 1167850 - RNA, 18 nt, Mycobacterium bovis subsp bovis AF2122/97
ccuuguugaacguucugc

SEQ ID NO: 1167851 - RNA, 15 nt, Mycobacterium bovis subsp bovis AF2122/97
ccuuguucccgaaac

SEQ ID NO: 1167852 - RNA, 14 nt, Mycobacterium bovis subsp bovis AF2122/97
ccuuguucgcccac

SEQ ID NO: 1167853 - RNA, 22 nt, Mycobacterium bovis subsp bovis AF2122/97
ccuugcccacggcgaccacgcc

SEQ ID NO: 1167854 - RNA, 12 nt, Mycobacterium bovis subsp bovis AF2122/97
ccuugcagcgcc

SEQ ID NO: 1167855 - RNA, 13 nt, Mycobacterium bovis subsp bovis AF2122/97
ccuugcaccggcc

SEQ ID NO: 1167856 - RNA, 16 nt, Mycobacterium bovis subsp bovis AF2122/97
ccuugaugcggccgcg

SEQ ID NO: 1167857 - RNA, 15 nt, Mycobacterium bovis subsp bovis AF2122/97
ccuugagccgccgug

SEQ ID NO: 1167858 - RNA, 17 nt, Mycobacterium bovis subsp bovis AF2122/97
ccuugaucgagcagggu

SEQ ID NO: 1167859 - RNA, 16 nt, Mycobacterium bovis subsp bovis AF2122/97
ccuugaggucacccau

SEQ ID NO: 1167860 - RNA, 13 nt, Mycobacterium bovis subsp bovis AF2122/97
ccuugauggucuc

SEQ ID NO: 1167861 - RNA, 16 nt, Mycobacterium bovis subsp bovis AF2122/97
ccuugauggucuccac

SEQ ID NO: 1167862 - RNA, 15 nt, Mycobacterium bovis subsp bovis AF2122/97
ccuugaucugagcgc

SEQ ID NO: 1167863 - RNA, 22 nt, Mycobacterium bovis subsp bovis AF2122/97
ccuugcccucaacggcggcaac

SEQ ID NO: 1167864 - RNA, 21 nt, Mycobacterium bovis subsp bovis AF2122/97
ccuugccgaugacgaugcccu

SEQ ID NO: 1167865 - RNA, 16 nt, Mycobacterium bovis subsp bovis AF2122/97
ccuugccgcccgcucc

SEQ ID NO: 1167866 - RNA, 13 nt, Mycobacterium bovis subsp bovis AF2122/97
ccuugccgguggg

SEQ ID NO: 1167867 - RNA, 22 nt, Mycobacterium bovis subsp bovis AF2122/97
ccuugcgauugcgcacacccug

SEQ ID NO: 1167868 - RNA, 16 nt, Mycobacterium bovis subsp bovis AF2122/97
ccuugcgacguucuug

SEQ ID NO: 1167869 - RNA, 14 nt, Mycobacterium bovis subsp bovis AF2122/97
ccuugcuccacauc

SEQ ID NO: 1167870 - RNA, 18 nt, Mycobacterium bovis subsp bovis AF2122/97
ccuugcucagccggcccu

SEQ ID NO: 1167871 - RNA, 16 nt, Mycobacterium bovis subsp bovis AF2122/97
ccuuuccggccgccug

SEQ ID NO: 1167872 - RNA, 20 nt, Mycobacterium bovis subsp bovis AF2122/97
ccuuuggcucccuuuuccaa

SEQ ID NO: 1167873 - RNA, 13 nt, Mycobacterium bovis subsp bovis AF2122/97
ccuuugccgccga

SEQ ID NO: 1167874 - RNA, 14 nt, Mycobacterium bovis subsp bovis AF2122/97
ccuuugauucuaac

SEQ ID NO: 1167875 - RNA, 23 nt, Mycobacterium bovis subsp bovis AF2122/97
cgaaaccacuuccggcguggccc

SEQ ID NO: 1167876 - RNA, 18 nt, Mycobacterium bovis subsp bovis AF2122/97
cgaaacaucucggcgcag

SEQ ID NO: 1167877 - RNA, 17 nt, Mycobacterium bovis subsp bovis AF2122/97
cgaaaaccuccgggucc

SEQ ID NO: 1167878 - RNA, 23 nt, Mycobacterium bovis subsp bovis AF2122/97
cgaaaaacgaccccucacccagc

SEQ ID NO: 1167879 - RNA, 13 nt, Mycobacterium bovis subsp bovis AF2122/97
cgaaaaaccucga

SEQ ID NO: 1167880 - RNA, 19 nt, Mycobacterium bovis subsp bovis AF2122/97
cgaacaacgcgacgaagca

SEQ ID NO: 1167881 - RNA, 13 nt, Mycobacterium bovis subsp bovis AF2122/97
cgaacaagaaaag

SEQ ID NO: 1167882 - RNA, 22 nt, Mycobacterium bovis subsp bovis AF2122/97
cgaaauuccgggccuggccugc

SEQ ID NO: 1167883 - RNA, 12 nt, Mycobacterium bovis subsp bovis AF2122/97
cgaacaccagcg

SEQ ID NO: 1167884 - RNA, 16 nt, Mycobacterium bovis subsp bovis AF2122/97
cgaacaccagcgcgcc

SEQ ID NO: 1167885 - RNA, 23 nt, Mycobacterium bovis subsp bovis AF2122/97
cgaacaccagcgcgccguagacc

SEQ ID NO: 1167886 - RNA, 18 nt, Mycobacterium bovis subsp bovis AF2122/97
cgaacacgagcucaccug

SEQ ID NO: 1167887 - RNA, 13 nt, Mycobacterium bovis subsp bovis AF2122/97
cgaacaauucacg

SEQ ID NO: 1167888 - RNA, 23 nt, Mycobacterium bovis subsp bovis AF2122/97
cgaacaaguggccagcgccaacu

SEQ ID NO: 1167889 - RNA, 24 nt, Mycobacterium bovis subsp bovis AF2122/97
cgaaaucagcccgcgcagcggucc

SEQ ID NO: 1167890 - RNA, 15 nt, Mycobacterium bovis subsp bovis AF2122/97
cgaaaucccccgaca

SEQ ID NO: 1167891 - RNA, 20 nt, Mycobacterium bovis subsp bovis AF2122/97
cgaaauccccugcgcugcag

SEQ ID NO: 1167892 - RNA, 16 nt, Mycobacterium bovis subsp bovis AF2122/97
cgaaauccugguggca

SEQ ID NO: 1167893 - RNA, 19 nt, Mycobacterium bovis subsp bovis AF2122/97
cgaaaucggccagcuuccc

SEQ ID NO: 1167894 - RNA, 16 nt, Mycobacterium bovis subsp bovis AF2122/97
cgaaaucucaucgauu

SEQ ID NO: 1167895 - RNA, 19 nt, Mycobacterium bovis subsp bovis AF2122/97
cgaaacgcuuacccagccc

SEQ ID NO: 1167896 - RNA, 12 nt, Mycobacterium bovis subsp bovis AF2122/97
cgaaacugaccc

SEQ ID NO: 1167897 - RNA, 16 nt, Mycobacterium bovis subsp bovis AF2122/97
cgaaacucgacgugaa

SEQ ID NO: 1167898 - RNA, 14 nt, Mycobacterium bovis subsp bovis AF2122/97
cgaaacucaccagc

SEQ ID NO: 1167899 - RNA, 14 nt, Mycobacterium bovis subsp bovis AF2122/97
cgaaacccaugacc

SEQ ID NO: 1167900 - RNA, 15 nt, Mycobacterium bovis subsp bovis AF2122/97
cgaaaccggaccuga

SEQ ID NO: 1167901 - RNA, 16 nt, Mycobacterium bovis subsp bovis AF2122/97
cgaaagccucucuucc

SEQ ID NO: 1167902 - RNA, 22 nt, Mycobacterium bovis subsp bovis AF2122/97
cgaaaguccugcagugcggcgu

SEQ ID NO: 1167903 - RNA, 16 nt, Mycobacterium bovis subsp bovis AF2122/97
cgaacacuuugcgcac

SEQ ID NO: 1167904 - RNA, 21 nt, Mycobacterium bovis subsp bovis AF2122/97
cgaacagcaccgaacccgcca

SEQ ID NO: 1167905 - RNA, 20 nt, Mycobacterium bovis subsp bovis AF2122/97
cgaacagcgggggcagcgcg

SEQ ID NO: 1167906 - RNA, 18 nt, Mycobacterium bovis subsp bovis AF2122/97
cgaacaguaggccuccgc

SEQ ID NO: 1167907 - RNA, 19 nt, Mycobacterium bovis subsp bovis AF2122/97
cgaacaguaggccuccgcu

SEQ ID NO: 1167908 - RNA, 21 nt, Mycobacterium bovis subsp bovis AF2122/97
cgaaccagcuugcgccgcagc

SEQ ID NO: 1167909 - RNA, 14 nt, Mycobacterium bovis subsp bovis AF2122/97
cgaaccaccgcguu

SEQ ID NO: 1167910 - RNA, 22 nt, Mycobacterium bovis subsp bovis AF2122/97
cgaaccacgcgcccgcaccacc

SEQ ID NO: 1167911 - RNA, 23 nt, Mycobacterium bovis subsp bovis AF2122/97
cgaaccacgcgcccgcaccaccg

SEQ ID NO: 1167912 - RNA, 13 nt, Mycobacterium bovis subsp bovis AF2122/97
cgaaccacggcag

SEQ ID NO: 1167913 - RNA, 22 nt, Mycobacterium bovis subsp bovis AF2122/97
cgaacaucaccgucgcccgggu

SEQ ID NO: 1167914 - RNA, 17 nt, Mycobacterium bovis subsp bovis AF2122/97
cgaacaucaucgggucc

SEQ ID NO: 1167915 - RNA, 15 nt, Mycobacterium bovis subsp bovis AF2122/97
cgaacagucgaguga

SEQ ID NO: 1167916 - RNA, 17 nt, Mycobacterium bovis subsp bovis AF2122/97
cgaacagucgagugaag

SEQ ID NO: 1167917 - RNA, 17 nt, Mycobacterium bovis subsp bovis AF2122/97
cgaacagggcugcgaug

SEQ ID NO: 1167918 - RNA, 16 nt, Mycobacterium bovis subsp bovis AF2122/97
cgaacaucgccagcgc

SEQ ID NO: 1167919 - RNA, 17 nt, Mycobacterium bovis subsp bovis AF2122/97
cgaacgccucaccgacg

SEQ ID NO: 1167920 - RNA, 19 nt, Mycobacterium bovis subsp bovis AF2122/97
cgaacgcgacagccaccuc

SEQ ID NO: 1167921 - RNA, 16 nt, Mycobacterium bovis subsp bovis AF2122/97
cgaacgcguccagcgc

SEQ ID NO: 1167922 - RNA, 16 nt, Mycobacterium bovis subsp bovis AF2122/97
cgaacgcccugacggu

SEQ ID NO: 1167923 - RNA, 23 nt, Mycobacterium bovis subsp bovis AF2122/97
cgaacgcccugacgguggugacc

SEQ ID NO: 1167924 - RNA, 23 nt, Mycobacterium bovis subsp bovis AF2122/97
cgaaccucggcgggauccucgaa

SEQ ID NO: 1167925 - RNA, 16 nt, Mycobacterium bovis subsp bovis AF2122/97
cgaaccugcggcagcg

SEQ ID NO: 1167926 - RNA, 14 nt, Mycobacterium bovis subsp bovis AF2122/97
cgaaccgcugcggg

SEQ ID NO: 1167927 - RNA, 13 nt, Mycobacterium bovis subsp bovis AF2122/97
cgaaccgcuccac

SEQ ID NO: 1167928 - RNA, 14 nt, Mycobacterium bovis subsp bovis AF2122/97
cgaaccggcugggc

SEQ ID NO: 1167929 - RNA, 19 nt, Mycobacterium bovis subsp bovis AF2122/97
cgaaccgguguagcagcgc

SEQ ID NO: 1167930 - RNA, 15 nt, Mycobacterium bovis subsp bovis AF2122/97
cgaacccgccaccgc

SEQ ID NO: 1167931 - RNA, 18 nt, Mycobacterium bovis subsp bovis AF2122/97
cgaaccgacguuccccuu

SEQ ID NO: 1167932 - RNA, 16 nt, Mycobacterium bovis subsp bovis AF2122/97
cgaacccucagccgcg

SEQ ID NO: 1167933 - RNA, 17 nt, Mycobacterium bovis subsp bovis AF2122/97
cgaaccccacgcagaag

SEQ ID NO: 1167934 - RNA, 14 nt, Mycobacterium bovis subsp bovis AF2122/97
cgaacccaggcaca

SEQ ID NO: 1167935 - RNA, 15 nt, Mycobacterium bovis subsp bovis AF2122/97
cgaccgcggccuugg

SEQ ID NO: 1167936 - RNA, 20 nt, Mycobacterium bovis subsp bovis AF2122/97
cgaccgcguacaggccggcc

SEQ ID NO: 1167937 - RNA, 21 nt, Mycobacterium bovis subsp bovis AF2122/97
cgaccggaacuguggugccug

SEQ ID NO: 1167938 - RNA, 14 nt, Mycobacterium bovis subsp bovis AF2122/97
cgaccggacacucc

SEQ ID NO: 1167939 - RNA, 13 nt, Mycobacterium bovis subsp bovis AF2122/97
cgaccgcucccgg

SEQ ID NO: 1167940 - RNA, 17 nt, Mycobacterium bovis subsp bovis AF2122/97
cgaccggcgagcccgca

SEQ ID NO: 1167941 - RNA, 14 nt, Mycobacterium bovis subsp bovis AF2122/97
cgaccggccaacgc

SEQ ID NO: 1167942 - RNA, 14 nt, Mycobacterium bovis subsp bovis AF2122/97
cgaccgccagccgc

SEQ ID NO: 1167943 - RNA, 18 nt, Mycobacterium bovis subsp bovis AF2122/97
cgaccgccgcgagcagaa

SEQ ID NO: 1167944 - RNA, 15 nt, Mycobacterium bovis subsp bovis AF2122/97
cgaccgccguggccc

SEQ ID NO: 1167945 - RNA, 12 nt, Mycobacterium bovis subsp bovis AF2122/97
cgaccgccuccu

SEQ ID NO: 1167946 - RNA, 18 nt, Mycobacterium bovis subsp bovis AF2122/97
cgaccgccgcuaccccag

SEQ ID NO: 1167947 - RNA, 18 nt, Mycobacterium bovis subsp bovis AF2122/97
cgaccgcgacccggccca

SEQ ID NO: 1167948 - RNA, 16 nt, Mycobacterium bovis subsp bovis AF2122/97
cgaccgcggccgggug

SEQ ID NO: 1167949 - RNA, 16 nt, Mycobacterium bovis subsp bovis AF2122/97
cgacccggccgcugac

SEQ ID NO: 1167950 - RNA, 21 nt, Mycobacterium bovis subsp bovis AF2122/97
cgacccgggucggcacgaccc

SEQ ID NO: 1167951 - RNA, 23 nt, Mycobacterium bovis subsp bovis AF2122/97
cgacccgggccgcggcggccagc

SEQ ID NO: 1167952 - RNA, 14 nt, Mycobacterium bovis subsp bovis AF2122/97
cgacccgggucggc

SEQ ID NO: 1167953 - RNA, 17 nt, Mycobacterium bovis subsp bovis AF2122/97
cgacccgggaaggaacc

SEQ ID NO: 1167954 - RNA, 18 nt, Mycobacterium bovis subsp bovis AF2122/97
cgacccgggaaggaaccg

SEQ ID NO: 1167955 - RNA, 11 nt, Mycobacterium bovis subsp bovis AF2122/97
cgacccgggcc

SEQ ID NO: 1167956 - RNA, 17 nt, Mycobacterium bovis subsp bovis AF2122/97
cgacccgcugccaccca

SEQ ID NO: 1167957 - RNA, 15 nt, Mycobacterium bovis subsp bovis AF2122/97
cgacccggccagcgg

SEQ ID NO: 1167958 - RNA, 18 nt, Mycobacterium bovis subsp bovis AF2122/97
cgacccggcccagcgccc

SEQ ID NO: 1167959 - RNA, 16 nt, Mycobacterium bovis subsp bovis AF2122/97
cgacccgcgcgccggc

SEQ ID NO: 1167960 - RNA, 13 nt, Mycobacterium bovis subsp bovis AF2122/97
cgacccggccgcu

SEQ ID NO: 1167961 - RNA, 20 nt, Mycobacterium bovis subsp bovis AF2122/97
cgaccgaccuggucggugac

SEQ ID NO: 1167962 - RNA, 19 nt, Mycobacterium bovis subsp bovis AF2122/97
cgaccgacuuuggccaucu

SEQ ID NO: 1167963 - RNA, 18 nt, Mycobacterium bovis subsp bovis AF2122/97
cgaccgcauugaacagcg

SEQ ID NO: 1167964 - RNA, 22 nt, Mycobacterium bovis subsp bovis AF2122/97
cgaccgauggcucaccagcucc

SEQ ID NO: 1167965 - RNA, 12 nt, Mycobacterium bovis subsp bovis AF2122/97
cgacccuccagc

SEQ ID NO: 1167966 - RNA, 13 nt, Mycobacterium bovis subsp bovis AF2122/97
cgacccuccagca

SEQ ID NO: 1167967 - RNA, 15 nt, Mycobacterium bovis subsp bovis AF2122/97
cgaccgaaccgucag

SEQ ID NO: 1167968 - RNA, 22 nt, Mycobacterium bovis subsp bovis AF2122/97
cgacccguccaacuacgccagc

SEQ ID NO: 1167969 - RNA, 20 nt, Mycobacterium bovis subsp bovis AF2122/97
cgaccucggcaacgacugca

SEQ ID NO: 1167970 - RNA, 14 nt, Mycobacterium bovis subsp bovis AF2122/97
cgaccuccucgacc

SEQ ID NO: 1167971 - RNA, 18 nt, Mycobacterium bovis subsp bovis AF2122/97
cgaccgugucaccgccgg

SEQ ID NO: 1167972 - RNA, 19 nt, Mycobacterium bovis subsp bovis AF2122/97
cgaccucacccacccgcgg

SEQ ID NO: 1167973 - RNA, 15 nt, Mycobacterium bovis subsp bovis AF2122/97
cgaccugaggcaccu

SEQ ID NO: 1167974 - RNA, 16 nt, Mycobacterium bovis subsp bovis AF2122/97
cgaccggcuaccggcg

SEQ ID NO: 1167975 - RNA, 18 nt, Mycobacterium bovis subsp bovis AF2122/97
cgaccggcuaccggcgug

SEQ ID NO: 1167976 - RNA, 20 nt, Mycobacterium bovis subsp bovis AF2122/97
cgaccggcuugcccuccggg

SEQ ID NO: 1167977 - RNA, 22 nt, Mycobacterium bovis subsp bovis AF2122/97
cgaccgggaucggcuccgccgc

SEQ ID NO: 1167978 - RNA, 21 nt, Mycobacterium bovis subsp bovis AF2122/97
cgaccggcgggaugcgcgccc

SEQ ID NO: 1167979 - RNA, 22 nt, Mycobacterium bovis subsp bovis AF2122/97
cgaccgguacccguagcaccac

SEQ ID NO: 1167980 - RNA, 18 nt, Mycobacterium bovis subsp bovis AF2122/97
cgaccgggcucuggccag

SEQ ID NO: 1167981 - RNA, 21 nt, Mycobacterium bovis subsp bovis AF2122/97
cgaccgggucgcaaccgccgc

SEQ ID NO: 1167982 - RNA, 18 nt, Mycobacterium bovis subsp bovis AF2122/97
cgaccgguccagccaacg

SEQ ID NO: 1167983 - RNA, 19 nt, Mycobacterium bovis subsp bovis AF2122/97
cgaccgguggcaccggcgg

SEQ ID NO: 1167984 - RNA, 19 nt, Mycobacterium bovis subsp bovis AF2122/97
cgaccgucgcgcugccggc

SEQ ID NO: 1167985 - RNA, 16 nt, Mycobacterium bovis subsp bovis AF2122/97
cgaccgucgucaccgc

SEQ ID NO: 1167986 - RNA, 15 nt, Mycobacterium bovis subsp bovis AF2122/97
cgaccgugcugggcg

SEQ ID NO: 1167987 - RNA, 17 nt, Mycobacterium bovis subsp bovis AF2122/97
cgaccguggcggccucc

SEQ ID NO: 1167988 - RNA, 16 nt, Mycobacterium bovis subsp bovis AF2122/97
cgaccgucccagcgcc

SEQ ID NO: 1167989 - RNA, 12 nt, Mycobacterium bovis subsp bovis AF2122/97
cgaccguccggg

SEQ ID NO: 1167990 - RNA, 17 nt, Mycobacterium bovis subsp bovis AF2122/97
cgacgccgaaaaugccg

SEQ ID NO: 1167991 - RNA, 20 nt, Mycobacterium bovis subsp bovis AF2122/97
cgacgcauaaccggcgcgcc

SEQ ID NO: 1167992 - RNA, 15 nt, Mycobacterium bovis subsp bovis AF2122/97
cgacgccauggucag

SEQ ID NO: 1167993 - RNA, 16 nt, Mycobacterium bovis subsp bovis AF2122/97
cgacgccccaggacac

SEQ ID NO: 1167994 - RNA, 12 nt, Mycobacterium bovis subsp bovis AF2122/97
cgacgccaccgc

SEQ ID NO: 1167995 - RNA, 15 nt, Mycobacterium bovis subsp bovis AF2122/97
cgacgccaccgccac

SEQ ID NO: 1167996 - RNA, 22 nt, Mycobacterium bovis subsp bovis AF2122/97
cgacgccaucugcuggcuggga

SEQ ID NO: 1167997 - RNA, 16 nt, Mycobacterium bovis subsp bovis AF2122/97
cgacgccaacgccagc

SEQ ID NO: 1167998 - RNA, 16 nt, Mycobacterium bovis subsp bovis AF2122/97
cgacgccaaugccgcg

SEQ ID NO: 1167999 - RNA, 21 nt, Mycobacterium bovis subsp bovis AF2122/97
cgacgccaaugccgcggaggc

SEQ ID NO: 1168000 - RNA, 23 nt, Mycobacterium bovis subsp bovis AF2122/97
cgacgccgaaaaugccgcccagc

SEQ ID NO: 1168001 - RNA, 19 nt, Mycobacterium bovis subsp bovis AF2122/97
cgacgccgaucgcggcggc

SEQ ID NO: 1168002 - RNA, 13 nt, Mycobacterium bovis subsp bovis AF2122/97
cgacgccgcagcg

SEQ ID NO: 1168003 - RNA, 14 nt, Mycobacterium bovis subsp bovis AF2122/97
cgacgccgccaccc

SEQ ID NO: 1168004 - RNA, 21 nt, Mycobacterium bovis subsp bovis AF2122/97
cgacgccgcuggagaucacgc

SEQ ID NO: 1168005 - RNA, 13 nt, Mycobacterium bovis subsp bovis AF2122/97
cgacgcccgccuu

SEQ ID NO: 1168006 - RNA, 13 nt, Mycobacterium bovis subsp bovis AF2122/97
cgacgccgcgguu

SEQ ID NO: 1168007 - RNA, 15 nt, Mycobacterium bovis subsp bovis AF2122/97
cgacgaucugcagca

SEQ ID NO: 1168008 - RNA, 19 nt, Mycobacterium bovis subsp bovis AF2122/97
cgacgaugccucggcggcc

SEQ ID NO: 1168009 - RNA, 19 nt, Mycobacterium bovis subsp bovis AF2122/97
cgacgauaucgggagcggc

SEQ ID NO: 1168010 - RNA, 12 nt, Mycobacterium bovis subsp bovis AF2122/97
cgacgcacaccc

SEQ ID NO: 1168011 - RNA, 16 nt, Mycobacterium bovis subsp bovis AF2122/97
cgacgcacaggcgacg

SEQ ID NO: 1168012 - RNA, 15 nt, Mycobacterium bovis subsp bovis AF2122/97
cgacgcaaagcagcg

SEQ ID NO: 1168013 - RNA, 22 nt, Mycobacterium bovis subsp bovis AF2122/97
cgacgauuaccagcggcaccgc

SEQ ID NO: 1168014 - RNA, 16 nt, Mycobacterium bovis subsp bovis AF2122/97
cgacgcauaaccggcg

SEQ ID NO: 1168015 - RNA, 23 nt, Mycobacterium bovis subsp bovis AF2122/97
cgacgcagaccguccagcaacag

SEQ ID NO: 1168016 - RNA, 12 nt, Mycobacterium bovis subsp bovis AF2122/97
cgacgcacugcc

SEQ ID NO: 1168017 - RNA, 17 nt, Mycobacterium bovis subsp bovis AF2122/97
cgacgagaucagccucg

SEQ ID NO: 1168018 - RNA, 16 nt, Mycobacterium bovis subsp bovis AF2122/97
cgacgagauccagcgc

SEQ ID NO: 1168019 - RNA, 13 nt, Mycobacterium bovis subsp bovis AF2122/97
cgacgagcaccau

SEQ ID NO: 1168020 - RNA, 18 nt, Mycobacterium bovis subsp bovis AF2122/97
cgacgagcaccgcgccgc

SEQ ID NO: 1168021 - RNA, 12 nt, Mycobacterium bovis subsp bovis AF2122/97
cgacgagccgca

SEQ ID NO: 1168022 - RNA, 14 nt, Mycobacterium bovis subsp bovis AF2122/97
cgacgacggccugc

SEQ ID NO: 1168023 - RNA, 16 nt, Mycobacterium bovis subsp bovis AF2122/97
cgacgacuccuauugc

SEQ ID NO: 1168024 - RNA, 17 nt, Mycobacterium bovis subsp bovis AF2122/97
cgacgagaagacaccgc

SEQ ID NO: 1168025 - RNA, 22 nt, Mycobacterium bovis subsp bovis AF2122/97
cgacgacuucgaaucaggcucc

SEQ ID NO: 1168026 - RNA, 20 nt, Mycobacterium bovis subsp bovis AF2122/97
cgacgacauacgagcaguga

SEQ ID NO: 1168027 - RNA, 16 nt, Mycobacterium bovis subsp bovis AF2122/97
cgacgacaaggugugg

SEQ ID NO: 1168028 - RNA, 20 nt, Mycobacterium bovis subsp bovis AF2122/97
cgacgacaagugcccggcca

SEQ ID NO: 1168029 - RNA, 16 nt, Mycobacterium bovis subsp bovis AF2122/97
cgacgacaccagagcg

SEQ ID NO: 1168030 - RNA, 14 nt, Mycobacterium bovis subsp bovis AF2122/97
cgacgacgggcgcc

SEQ ID NO: 1168031 - RNA, 13 nt, Mycobacterium bovis subsp bovis AF2122/97
cgacgacgcgcgc

SEQ ID NO: 1168032 - RNA, 13 nt, Mycobacterium bovis subsp bovis AF2122/97
cgacgacauuggu

SEQ ID NO: 1168033 - RNA, 20 nt, Mycobacterium bovis subsp bovis AF2122/97
cgacgacaucgagccaacgc

SEQ ID NO: 1168034 - RNA, 23 nt, Mycobacterium bovis subsp bovis AF2122/97
cgacgaagaucgcgugccacagc

SEQ ID NO: 1168035 - RNA, 23 nt, Mycobacterium bovis subsp bovis AF2122/97
cgacgaagaucuucaccggccgg

SEQ ID NO: 1168036 - RNA, 16 nt, Mycobacterium bovis subsp bovis AF2122/97
cgacgaacuccgcguu

SEQ ID NO: 1168037 - RNA, 14 nt, Mycobacterium bovis subsp bovis AF2122/97
cgacgaacugcagc

SEQ ID NO: 1168038 - RNA, 18 nt, Mycobacterium bovis subsp bovis AF2122/97
cgacgaacaccccgggcg

SEQ ID NO: 1168039 - RNA, 20 nt, Mycobacterium bovis subsp bovis AF2122/97
cgacgaacaccccgggcgcc

SEQ ID NO: 1168040 - RNA, 14 nt, Mycobacterium bovis subsp bovis AF2122/97
cgacgaacccgaca

SEQ ID NO: 1168041 - RNA, 21 nt, Mycobacterium bovis subsp bovis AF2122/97
cgaccuucucgaugcugacga

SEQ ID NO: 1168042 - RNA, 14 nt, Mycobacterium bovis subsp bovis AF2122/97
cgaccuucaccgcg

SEQ ID NO: 1168043 - RNA, 15 nt, Mycobacterium bovis subsp bovis AF2122/97
cgaccaugcuccuau

SEQ ID NO: 1168044 - RNA, 14 nt, Mycobacterium bovis subsp bovis AF2122/97
cgaccaugcuccua

SEQ ID NO: 1168045 - RNA, 17 nt, Mycobacterium bovis subsp bovis AF2122/97
cgaccaugguagcgccc

SEQ ID NO: 1168046 - RNA, 13 nt, Mycobacterium bovis subsp bovis AF2122/97
cgaccaugaugcc

SEQ ID NO: 1168047 - RNA, 19 nt, Mycobacterium bovis subsp bovis AF2122/97
cgaccaucucaccgggccc

SEQ ID NO: 1168048 - RNA, 22 nt, Mycobacterium bovis subsp bovis AF2122/97
cgaccaguucggaaucggagcc

SEQ ID NO: 1168049 - RNA, 20 nt, Mycobacterium bovis subsp bovis AF2122/97
cgaccaucaccacggccgcc

SEQ ID NO: 1168050 - RNA, 16 nt, Mycobacterium bovis subsp bovis AF2122/97
cgaccaggucgccagc

SEQ ID NO: 1168051 - RNA, 20 nt, Mycobacterium bovis subsp bovis AF2122/97
cgaccagggccgccgcugcc

SEQ ID NO: 1168052 - RNA, 21 nt, Mycobacterium bovis subsp bovis AF2122/97
cgacccgcagaccgccaccgg

SEQ ID NO: 1168053 - RNA, 13 nt, Mycobacterium bovis subsp bovis AF2122/97
cgacccgccgccc

SEQ ID NO: 1168054 - RNA, 17 nt, Mycobacterium bovis subsp bovis AF2122/97
cgaccccggcugcgcuu

SEQ ID NO: 1168055 - RNA, 13 nt, Mycobacterium bovis subsp bovis AF2122/97
cgaccccggcggu

SEQ ID NO: 1168056 - RNA, 19 nt, Mycobacterium bovis subsp bovis AF2122/97
cgaccccgaacauccgccg

SEQ ID NO: 1168057 - RNA, 22 nt, Mycobacterium bovis subsp bovis AF2122/97
cgaccccgaacauccgccgccc

SEQ ID NO: 1168058 - RNA, 19 nt, Mycobacterium bovis subsp bovis AF2122/97
cgaccccgaagaugaccuc

SEQ ID NO: 1168059 - RNA, 17 nt, Mycobacterium bovis subsp bovis AF2122/97
cgacccaucaccagcgg

SEQ ID NO: 1168060 - RNA, 20 nt, Mycobacterium bovis subsp bovis AF2122/97
cgaccauucgagagccucua

SEQ ID NO: 1168061 - RNA, 17 nt, Mycobacterium bovis subsp bovis AF2122/97
cgacccagcugaccuga

SEQ ID NO: 1168062 - RNA, 13 nt, Mycobacterium bovis subsp bovis AF2122/97
cgacccaucacca

SEQ ID NO: 1168063 - RNA, 14 nt, Mycobacterium bovis subsp bovis AF2122/97
cgacccaucaccag

SEQ ID NO: 1168064 - RNA, 13 nt, Mycobacterium bovis subsp bovis AF2122/97
cgacccagcugac

SEQ ID NO: 1168065 - RNA, 16 nt, Mycobacterium bovis subsp bovis AF2122/97
cgaccagcccgcucuu

SEQ ID NO: 1168066 - RNA, 13 nt, Mycobacterium bovis subsp bovis AF2122/97
cgaccagccccgc

SEQ ID NO: 1168067 - RNA, 22 nt, Mycobacterium bovis subsp bovis AF2122/97
cgaccagcugugaacaggccga

SEQ ID NO: 1168068 - RNA, 20 nt, Mycobacterium bovis subsp bovis AF2122/97
cgaccagcacccgcucggcc

SEQ ID NO: 1168069 - RNA, 14 nt, Mycobacterium bovis subsp bovis AF2122/97
cgaccagcagacca

SEQ ID NO: 1168070 - RNA, 15 nt, Mycobacterium bovis subsp bovis AF2122/97
cgaccagcagaucca

SEQ ID NO: 1168071 - RNA, 16 nt, Mycobacterium bovis subsp bovis AF2122/97
cgaccacuucccgcuu

SEQ ID NO: 1168072 - RNA, 14 nt, Mycobacterium bovis subsp bovis AF2122/97
cgaccacugcccgg

SEQ ID NO: 1168073 - RNA, 17 nt, Mycobacterium bovis subsp bovis AF2122/97
cgaccaccggaucgccg

SEQ ID NO: 1168074 - RNA, 19 nt, Mycobacterium bovis subsp bovis AF2122/97
cgaccaccuucugacgcgg

SEQ ID NO: 1168075 - RNA, 20 nt, Mycobacterium bovis subsp bovis AF2122/97
cgaccaccucagcugcggac

SEQ ID NO: 1168076 - RNA, 14 nt, Mycobacterium bovis subsp bovis AF2122/97
cgaccaccgccgag

SEQ ID NO: 1168077 - RNA, 17 nt, Mycobacterium bovis subsp bovis AF2122/97
cgaccaccgcggcugcu

SEQ ID NO: 1168078 - RNA, 17 nt, Mycobacterium bovis subsp bovis AF2122/97
cgaccaauaccaguccg

SEQ ID NO: 1168079 - RNA, 19 nt, Mycobacterium bovis subsp bovis AF2122/97
cgaccacauuccgcagucc

SEQ ID NO: 1168080 - RNA, 12 nt, Mycobacterium bovis subsp bovis AF2122/97
cgaccaccacca

SEQ ID NO: 1168081 - RNA, 15 nt, Mycobacterium bovis subsp bovis AF2122/97
cgaccaccaccaacg

SEQ ID NO: 1168082 - RNA, 12 nt, Mycobacterium bovis subsp bovis AF2122/97
cgaccaccaccc

SEQ ID NO: 1168083 - RNA, 16 nt, Mycobacterium bovis subsp bovis AF2122/97
cgaccaccaccgccgc

SEQ ID NO: 1168084 - RNA, 14 nt, Mycobacterium bovis subsp bovis AF2122/97
cgacaucggcggcc

SEQ ID NO: 1168085 - RNA, 21 nt, Mycobacterium bovis subsp bovis AF2122/97
cgacaucggcccgaucaccau

SEQ ID NO: 1168086 - RNA, 17 nt, Mycobacterium bovis subsp bovis AF2122/97
cgacaucgguggcggcc

SEQ ID NO: 1168087 - RNA, 12 nt, Mycobacterium bovis subsp bovis AF2122/97
cgacaucaccac

SEQ ID NO: 1168088 - RNA, 14 nt, Mycobacterium bovis subsp bovis AF2122/97
cgacaucaccaccg

SEQ ID NO: 1168089 - RNA, 15 nt, Mycobacterium bovis subsp bovis AF2122/97
cgacaucaccaccgc

SEQ ID NO: 1168090 - RNA, 15 nt, Mycobacterium bovis subsp bovis AF2122/97
cgacauaggccaccu

SEQ ID NO: 1168091 - RNA, 16 nt, Mycobacterium bovis subsp bovis AF2122/97
cgacaugacgcggcca

SEQ ID NO: 1168092 - RNA, 20 nt, Mycobacterium bovis subsp bovis AF2122/97
cgacaugaaccggucgaucc

SEQ ID NO: 1168093 - RNA, 15 nt, Mycobacterium bovis subsp bovis AF2122/97
cgacauugccacggc

SEQ ID NO: 1168094 - RNA, 21 nt, Mycobacterium bovis subsp bovis AF2122/97
cgacauuugcccgaugguacc

SEQ ID NO: 1168095 - RNA, 14 nt, Mycobacterium bovis subsp bovis AF2122/97
cgacagcgcggcgg

SEQ ID NO: 1168096 - RNA, 16 nt, Mycobacterium bovis subsp bovis AF2122/97
cgacagcgcugggccc

SEQ ID NO: 1168097 - RNA, 17 nt, Mycobacterium bovis subsp bovis AF2122/97
cgacagcgcugggccca

SEQ ID NO: 1168098 - RNA, 17 nt, Mycobacterium bovis subsp bovis AF2122/97
cgacaggacgucggcga

SEQ ID NO: 1168099 - RNA, 15 nt, Mycobacterium bovis subsp bovis AF2122/97
cgacagccguggcgc

SEQ ID NO: 1168100 - RNA, 17 nt, Mycobacterium bovis subsp bovis AF2122/97
cgacagccgcugcggug

SEQ ID NO: 1168101 - RNA, 12 nt, Mycobacterium bovis subsp bovis AF2122/97
cgacagcccgcc

SEQ ID NO: 1168102 - RNA, 13 nt, Mycobacterium bovis subsp bovis AF2122/97
cgacagccaccgc

SEQ ID NO: 1168103 - RNA, 14 nt, Mycobacterium bovis subsp bovis AF2122/97
cgacagcaucacgc

SEQ ID NO: 1168104 - RNA, 19 nt, Mycobacterium bovis subsp bovis AF2122/97
cgacagccccaucaccacc

SEQ ID NO: 1168105 - RNA, 20 nt, Mycobacterium bovis subsp bovis AF2122/97
cgacagccccaucaccaccg

SEQ ID NO: 1168106 - RNA, 19 nt, Mycobacterium bovis subsp bovis AF2122/97
cgacagggacccgagauca

SEQ ID NO: 1168107 - RNA, 16 nt, Mycobacterium bovis subsp bovis AF2122/97
cgacaggccgagcaga

SEQ ID NO: 1168108 - RNA, 15 nt, Mycobacterium bovis subsp bovis AF2122/97
cgacaguggcucacc

SEQ ID NO: 1168109 - RNA, 21 nt, Mycobacterium bovis subsp bovis AF2122/97
cgacaguuuaccgugccgccc

SEQ ID NO: 1168110 - RNA, 18 nt, Mycobacterium bovis subsp bovis AF2122/97
cgacagucaacagggcca

SEQ ID NO: 1168111 - RNA, 15 nt, Mycobacterium bovis subsp bovis AF2122/97
cgacaggugaaggug

SEQ ID NO: 1168112 - RNA, 23 nt, Mycobacterium bovis subsp bovis AF2122/97
cgacaggugccagaccagggcag

SEQ ID NO: 1168113 - RNA, 21 nt, Mycobacterium bovis subsp bovis AF2122/97
cgaagcccagcaccaccaccc

SEQ ID NO: 1168114 - RNA, 11 nt, Mycobacterium bovis subsp bovis AF2122/97
cgaagcccacg

SEQ ID NO: 1168115 - RNA, 20 nt, Mycobacterium bovis subsp bovis AF2122/97
cgaagauggccagcgcggcg

SEQ ID NO: 1168116 - RNA, 17 nt, Mycobacterium bovis subsp bovis AF2122/97
cgaagauggccagcgcg

SEQ ID NO: 1168117 - RNA, 20 nt, Mycobacterium bovis subsp bovis AF2122/97
cgaagaucgcgugccacagc

SEQ ID NO: 1168118 - RNA, 21 nt, Mycobacterium bovis subsp bovis AF2122/97
cgaagauccagcgcaccggcg

SEQ ID NO: 1168119 - RNA, 18 nt, Mycobacterium bovis subsp bovis AF2122/97
cgaagaugaccgcucgug

SEQ ID NO: 1168120 - RNA, 13 nt, Mycobacterium bovis subsp bovis AF2122/97
cgaagagggcgcc

SEQ ID NO: 1168121 - RNA, 16 nt, Mycobacterium bovis subsp bovis AF2122/97
cgaagagccagcaacg

SEQ ID NO: 1168122 - RNA, 20 nt, Mycobacterium bovis subsp bovis AF2122/97
cgaagaccuggccugcggca

SEQ ID NO: 1168123 - RNA, 15 nt, Mycobacterium bovis subsp bovis AF2122/97
cgaagaccagcaacg

SEQ ID NO: 1168124 - RNA, 23 nt, Mycobacterium bovis subsp bovis AF2122/97
cgaagaaugggauggcaccaccc

SEQ ID NO: 1168125 - RNA, 14 nt, Mycobacterium bovis subsp bovis AF2122/97
cgaacugaucgacc

SEQ ID NO: 1168126 - RNA, 15 nt, Mycobacterium bovis subsp bovis AF2122/97
cgaacuccaucacca

SEQ ID NO: 1168127 - RNA, 15 nt, Mycobacterium bovis subsp bovis AF2122/97
cgaacucgcgggcga

SEQ ID NO: 1168128 - RNA, 16 nt, Mycobacterium bovis subsp bovis AF2122/97
cgaacucggccgggcg

SEQ ID NO: 1168129 - RNA, 16 nt, Mycobacterium bovis subsp bovis AF2122/97
cgaacugggggccggc

SEQ ID NO: 1168130 - RNA, 18 nt, Mycobacterium bovis subsp bovis AF2122/97
cgaacugggggccggcac

SEQ ID NO: 1168131 - RNA, 23 nt, Mycobacterium bovis subsp bovis AF2122/97
cgaacugggggccggcacugccg

SEQ ID NO: 1168132 - RNA, 21 nt, Mycobacterium bovis subsp bovis AF2122/97
cgaacgggucggcgaccaccc

SEQ ID NO: 1168133 - RNA, 17 nt, Mycobacterium bovis subsp bovis AF2122/97
cgaacgguugcucgucc

SEQ ID NO: 1168134 - RNA, 15 nt, Mycobacterium bovis subsp bovis AF2122/97
cgaacgucaccaucg

SEQ ID NO: 1168135 - RNA, 18 nt, Mycobacterium bovis subsp bovis AF2122/97
cgaacggcagcccgggcg

SEQ ID NO: 1168136 - RNA, 19 nt, Mycobacterium bovis subsp bovis AF2122/97
cgaacuccagcagcccggu

SEQ ID NO: 1168137 - RNA, 20 nt, Mycobacterium bovis subsp bovis AF2122/97
cgaacucaucgugguaacca

SEQ ID NO: 1168138 - RNA, 23 nt, Mycobacterium bovis subsp bovis AF2122/97
cgaacuaucguugugcggacauc

SEQ ID NO: 1168139 - RNA, 21 nt, Mycobacterium bovis subsp bovis AF2122/97
cgaagcgucuggucagccgcg

SEQ ID NO: 1168140 - RNA, 21 nt, Mycobacterium bovis subsp bovis AF2122/97
cgaagcuacgucggcucgucg

SEQ ID NO: 1168141 - RNA, 15 nt, Mycobacterium bovis subsp bovis AF2122/97
cgaagcugaccagac

SEQ ID NO: 1168142 - RNA, 18 nt, Mycobacterium bovis subsp bovis AF2122/97
cgaagcuucggccuucuu

SEQ ID NO: 1168143 - RNA, 15 nt, Mycobacterium bovis subsp bovis AF2122/97
cgaagcugcgggucu

SEQ ID NO: 1168144 - RNA, 20 nt, Mycobacterium bovis subsp bovis AF2122/97
cgaagcugcugcugcuugac

SEQ ID NO: 1168145 - RNA, 15 nt, Mycobacterium bovis subsp bovis AF2122/97
cgaagcuggcgugca

SEQ ID NO: 1168146 - RNA, 17 nt, Mycobacterium bovis subsp bovis AF2122/97
cgaaggaugcugucaga

SEQ ID NO: 1168147 - RNA, 23 nt, Mycobacterium bovis subsp bovis AF2122/97
cgaaggaaaaugauagcggcgca

SEQ ID NO: 1168148 - RNA, 20 nt, Mycobacterium bovis subsp bovis AF2122/97
cgaaggcguucgacucgacc

SEQ ID NO: 1168149 - RNA, 17 nt, Mycobacterium bovis subsp bovis AF2122/97
cgaaggccgccaaccgu

SEQ ID NO: 1168150 - RNA, 12 nt, Mycobacterium bovis subsp bovis AF2122/97
cgaaggccaccc

SEQ ID NO: 1168151 - RNA, 18 nt, Mycobacterium bovis subsp bovis AF2122/97
cgaagcgggacugcagcg

SEQ ID NO: 1168152 - RNA, 19 nt, Mycobacterium bovis subsp bovis AF2122/97
cgaagcgggcuugagcgcc

SEQ ID NO: 1168153 - RNA, 17 nt, Mycobacterium bovis subsp bovis AF2122/97
cgaagcggccaccgccg

SEQ ID NO: 1168154 - RNA, 15 nt, Mycobacterium bovis subsp bovis AF2122/97
cgaagcggaccagcg

SEQ ID NO: 1168155 - RNA, 23 nt, Mycobacterium bovis subsp bovis AF2122/97
cgaagcccgacuguagaaaaccc

SEQ ID NO: 1168156 - RNA, 17 nt, Mycobacterium bovis subsp bovis AF2122/97
cgaagccgccgcgacca

SEQ ID NO: 1168157 - RNA, 17 nt, Mycobacterium bovis subsp bovis AF2122/97
cgaagccuugcagcgcc

SEQ ID NO: 1168158 - RNA, 19 nt, Mycobacterium bovis subsp bovis AF2122/97
cgaagccgguucgcccagc

SEQ ID NO: 1168159 - RNA, 18 nt, Mycobacterium bovis subsp bovis AF2122/97
cgaagccggcgccggcuu

SEQ ID NO: 1168160 - RNA, 22 nt, Mycobacterium bovis subsp bovis AF2122/97
cgaagccgguucgcccagcagg

SEQ ID NO: 1168161 - RNA, 20 nt, Mycobacterium bovis subsp bovis AF2122/97
cgaagggcuugucgccggca

SEQ ID NO: 1168162 - RNA, 14 nt, Mycobacterium bovis subsp bovis AF2122/97
cgaaggcggcuucg

SEQ ID NO: 1168163 - RNA, 20 nt, Mycobacterium bovis subsp bovis AF2122/97
cgaaggggugcccggcggcc

SEQ ID NO: 1168164 - RNA, 23 nt, Mycobacterium bovis subsp bovis AF2122/97
cgaaggguaagaguucgcgcgcc

SEQ ID NO: 1168165 - RNA, 18 nt, Mycobacterium bovis subsp bovis AF2122/97
cgaaggucagcaccgcuu

SEQ ID NO: 1168166 - RNA, 22 nt, Mycobacterium bovis subsp bovis AF2122/97
cgaaggucgguaccccagcgcu

SEQ ID NO: 1168167 - RNA, 14 nt, Mycobacterium bovis subsp bovis AF2122/97
cgaaggucuccggc

SEQ ID NO: 1168168 - RNA, 16 nt, Mycobacterium bovis subsp bovis AF2122/97
cgaagguguccuccag

SEQ ID NO: 1168169 - RNA, 18 nt, Mycobacterium bovis subsp bovis AF2122/97
cgaagguguccuccagcu

SEQ ID NO: 1168170 - RNA, 22 nt, Mycobacterium bovis subsp bovis AF2122/97
cgaaggugcgcgugacgaucac

SEQ ID NO: 1168171 - RNA, 17 nt, Mycobacterium bovis subsp bovis AF2122/97
cgaaguacgacgacccg

SEQ ID NO: 1168172 - RNA, 21 nt, Mycobacterium bovis subsp bovis AF2122/97
cgaaggugaugaacaccggcg

SEQ ID NO: 1168173 - RNA, 22 nt, Mycobacterium bovis subsp bovis AF2122/97
cgaaggugaacgacaugggcag

SEQ ID NO: 1168174 - RNA, 17 nt, Mycobacterium bovis subsp bovis AF2122/97
cgaaggugaaucgacug

SEQ ID NO: 1168175 - RNA, 20 nt, Mycobacterium bovis subsp bovis AF2122/97
cgaaggugaaucgacugauc

SEQ ID NO: 1168176 - RNA, 18 nt, Mycobacterium bovis subsp bovis AF2122/97
cgaagucgagugccgcgu

SEQ ID NO: 1168177 - RNA, 15 nt, Mycobacterium bovis subsp bovis AF2122/97
cgaagucacgcaccc

SEQ ID NO: 1168178 - RNA, 18 nt, Mycobacterium bovis subsp bovis AF2122/97
cgaaguacuggccgccgc

SEQ ID NO: 1168179 - RNA, 22 nt, Mycobacterium bovis subsp bovis AF2122/97
cgaagucguacugguagcacuc

SEQ ID NO: 1168180 - RNA, 15 nt, Mycobacterium bovis subsp bovis AF2122/97
cgaagucgcauggcg

SEQ ID NO: 1168181 - RNA, 18 nt, Mycobacterium bovis subsp bovis AF2122/97
cgaaguuuuggaagcccg

SEQ ID NO: 1168182 - RNA, 22 nt, Mycobacterium bovis subsp bovis AF2122/97
cgaagugucgcugcaaccgccg

SEQ ID NO: 1168183 - RNA, 19 nt, Mycobacterium bovis subsp bovis AF2122/97
cgaauugcguucgccgccc

SEQ ID NO: 1168184 - RNA, 14 nt, Mycobacterium bovis subsp bovis AF2122/97
cgaauuccggcuca

SEQ ID NO: 1168185 - RNA, 15 nt, Mycobacterium bovis subsp bovis AF2122/97
cgaaugucgccgccu

SEQ ID NO: 1168186 - RNA, 22 nt, Mycobacterium bovis subsp bovis AF2122/97
cgaaugccauaaccggugggga

SEQ ID NO: 1168187 - RNA, 20 nt, Mycobacterium bovis subsp bovis AF2122/97
cgaaugcugggcccgccagc

SEQ ID NO: 1168188 - RNA, 16 nt, Mycobacterium bovis subsp bovis AF2122/97
cgaaugcgguccucga

SEQ ID NO: 1168189 - RNA, 16 nt, Mycobacterium bovis subsp bovis AF2122/97
cgaaugggggcugguc

SEQ ID NO: 1168190 - RNA, 18 nt, Mycobacterium bovis subsp bovis AF2122/97
cgaauggccgaaccguuc

SEQ ID NO: 1168191 - RNA, 20 nt, Mycobacterium bovis subsp bovis AF2122/97
cgaauggccgaucccaccgg

SEQ ID NO: 1168192 - RNA, 14 nt, Mycobacterium bovis subsp bovis AF2122/97
cgaaucgucacgga

SEQ ID NO: 1168193 - RNA, 19 nt, Mycobacterium bovis subsp bovis AF2122/97
cgaaucugaaaaagcauca

SEQ ID NO: 1168194 - RNA, 13 nt, Mycobacterium bovis subsp bovis AF2122/97
cgaaugacggcca

SEQ ID NO: 1168195 - RNA, 14 nt, Mycobacterium bovis subsp bovis AF2122/97
cgaauaccagaccg

SEQ ID NO: 1168196 - RNA, 19 nt, Mycobacterium bovis subsp bovis AF2122/97
cgaauacggcugccuccau

SEQ ID NO: 1168197 - RNA, 14 nt, Mycobacterium bovis subsp bovis AF2122/97
cgaauccaucgaga

SEQ ID NO: 1168198 - RNA, 12 nt, Mycobacterium bovis subsp bovis AF2122/97
cgaaucagcucg

SEQ ID NO: 1168199 - RNA, 19 nt, Mycobacterium bovis subsp bovis AF2122/97
cgaauagccaccaagcaca

SEQ ID NO: 1168200 - RNA, 13 nt, Mycobacterium bovis subsp bovis AF2122/97
cgacaccgcccga

SEQ ID NO: 1168201 - RNA, 20 nt, Mycobacterium bovis subsp bovis AF2122/97
cgacaccgcggacccgcagc

SEQ ID NO: 1168202 - RNA, 20 nt, Mycobacterium bovis subsp bovis AF2122/97
cgacaccgcggugccccgga

SEQ ID NO: 1168203 - RNA, 22 nt, Mycobacterium bovis subsp bovis AF2122/97
cgacacccugggugccggcagc

SEQ ID NO: 1168204 - RNA, 15 nt, Mycobacterium bovis subsp bovis AF2122/97
cgacaccggcugacc

SEQ ID NO: 1168205 - RNA, 18 nt, Mycobacterium bovis subsp bovis AF2122/97
cgacacccagccgcagcc

SEQ ID NO: 1168206 - RNA, 15 nt, Mycobacterium bovis subsp bovis AF2122/97
cgacacgccggcggg

SEQ ID NO: 1168207 - RNA, 20 nt, Mycobacterium bovis subsp bovis AF2122/97
cgacaccggcugaccgaccc

SEQ ID NO: 1168208 - RNA, 14 nt, Mycobacterium bovis subsp bovis AF2122/97
cgacacggugaucu

SEQ ID NO: 1168209 - RNA, 21 nt, Mycobacterium bovis subsp bovis AF2122/97
cgacaacaugcccgucagcgg

SEQ ID NO: 1168210 - RNA, 18 nt, Mycobacterium bovis subsp bovis AF2122/97
cgacaacccggccgggcc

SEQ ID NO: 1168211 - RNA, 16 nt, Mycobacterium bovis subsp bovis AF2122/97
cgacaacgcugggcgg

SEQ ID NO: 1168212 - RNA, 21 nt, Mycobacterium bovis subsp bovis AF2122/97
cgacaacacccacgugcugcc

SEQ ID NO: 1168213 - RNA, 17 nt, Mycobacterium bovis subsp bovis AF2122/97
cgacaacacgccgucga

SEQ ID NO: 1168214 - RNA, 18 nt, Mycobacterium bovis subsp bovis AF2122/97
ccaaagcgacgagcagca

SEQ ID NO: 1168215 - RNA, 22 nt, Mycobacterium bovis subsp bovis AF2122/97
ccaaagccgggauugccgccac

SEQ ID NO: 1168216 - RNA, 14 nt, Mycobacterium bovis subsp bovis AF2122/97
ccaaaggacgacac

SEQ ID NO: 1168217 - RNA, 21 nt, Mycobacterium bovis subsp bovis AF2122/97
ccaaacuaacggcagccaccg

SEQ ID NO: 1168218 - RNA, 15 nt, Mycobacterium bovis subsp bovis AF2122/97
ccaaagggaguguuu

SEQ ID NO: 1168219 - RNA, 20 nt, Mycobacterium bovis subsp bovis AF2122/97
cauuucgucgucgcagugca

SEQ ID NO: 1168220 - RNA, 23 nt, Mycobacterium bovis subsp bovis AF2122/97
ccaaaauccuucgcgcucauugc

SEQ ID NO: 1168221 - RNA, 21 nt, Mycobacterium bovis subsp bovis AF2122/97
ccaaaauuuugucggccgccu

SEQ ID NO: 1168222 - RNA, 23 nt, Mycobacterium bovis subsp bovis AF2122/97
ccaaaaugccuuggcagcccagu

SEQ ID NO: 1168223 - RNA, 17 nt, Mycobacterium bovis subsp bovis AF2122/97
ccaaaccggcccgcagc

SEQ ID NO: 1168224 - RNA, 21 nt, Mycobacterium bovis subsp bovis AF2122/97
ccaaaccggcccgcagcagca

SEQ ID NO: 1168225 - RNA, 16 nt, Mycobacterium bovis subsp bovis AF2122/97
ccaacgccaccgucgc

SEQ ID NO: 1168226 - RNA, 21 nt, Mycobacterium bovis subsp bovis AF2122/97
ccaaccucggaucgccaggcc

SEQ ID NO: 1168227 - RNA, 14 nt, Mycobacterium bovis subsp bovis AF2122/97
ccaacgagucagug

SEQ ID NO: 1168228 - RNA, 21 nt, Mycobacterium bovis subsp bovis AF2122/97
ccaacgacuguggcgccgccg

SEQ ID NO: 1168229 - RNA, 13 nt, Mycobacterium bovis subsp bovis AF2122/97
ccaaccugggcca

SEQ ID NO: 1168230 - RNA, 17 nt, Mycobacterium bovis subsp bovis AF2122/97
ccaacgacuguggcgcc

SEQ ID NO: 1168231 - RNA, 23 nt, Mycobacterium bovis subsp bovis AF2122/97
ccaacgcugucccuauugaucug

SEQ ID NO: 1168232 - RNA, 19 nt, Mycobacterium bovis subsp bovis AF2122/97
ccaacgucgacuucagcgg

SEQ ID NO: 1168233 - RNA, 18 nt, Mycobacterium bovis subsp bovis AF2122/97
ccaacgucgccaggucau

SEQ ID NO: 1168234 - RNA, 18 nt, Mycobacterium bovis subsp bovis AF2122/97
ccaacguugcgccagcgg

SEQ ID NO: 1168235 - RNA, 16 nt, Mycobacterium bovis subsp bovis AF2122/97
ccaacguugugccgcu

SEQ ID NO: 1168236 - RNA, 24 nt, Mycobacterium bovis subsp bovis AF2122/97
ccaacggguaguucuuggucaggc

SEQ ID NO: 1168237 - RNA, 23 nt, Mycobacterium bovis subsp bovis AF2122/97
ccaacggggcagucaacucccga

SEQ ID NO: 1168238 - RNA, 20 nt, Mycobacterium bovis subsp bovis AF2122/97
ccaacugcgaaacgccaccg

SEQ ID NO: 1168239 - RNA, 18 nt, Mycobacterium bovis subsp bovis AF2122/97
ccaacucggcggccagcg

SEQ ID NO: 1168240 - RNA, 17 nt, Mycobacterium bovis subsp bovis AF2122/97
ccaacucgguucgcccc

SEQ ID NO: 1168241 - RNA, 23 nt, Mycobacterium bovis subsp bovis AF2122/97
ccaacucguggaacuccguccgc

SEQ ID NO: 1168242 - RNA, 14 nt, Mycobacterium bovis subsp bovis AF2122/97
ccaacucggccagc

SEQ ID NO: 1168243 - RNA, 14 nt, Mycobacterium bovis subsp bovis AF2122/97
ccaacuccucagcc

SEQ ID NO: 1168244 - RNA, 22 nt, Mycobacterium bovis subsp bovis AF2122/97
ccaacuccagcacccgcugcac

SEQ ID NO: 1168245 - RNA, 18 nt, Mycobacterium bovis subsp bovis AF2122/97
ccaacguuuugggcgccg

SEQ ID NO: 1168246 - RNA, 15 nt, Mycobacterium bovis subsp bovis AF2122/97
ccaacuacgccagcc

SEQ ID NO: 1168247 - RNA, 15 nt, Mycobacterium bovis subsp bovis AF2122/97
ccaacucaugggcca

SEQ ID NO: 1168248 - RNA, 18 nt, Mycobacterium bovis subsp bovis AF2122/97
ccaacuccaagaugccgc

SEQ ID NO: 1168249 - RNA, 17 nt, Mycobacterium bovis subsp bovis AF2122/97
ccaacuuggcggccagc

SEQ ID NO: 1168250 - RNA, 13 nt, Mycobacterium bovis subsp bovis AF2122/97
ccaacuucaccac

SEQ ID NO: 1168251 - RNA, 18 nt, Mycobacterium bovis subsp bovis AF2122/97
ccaacuucaccacccugu

SEQ ID NO: 1168252 - RNA, 16 nt, Mycobacterium bovis subsp bovis AF2122/97
ccaacugggccgagcg

SEQ ID NO: 1168253 - RNA, 18 nt, Mycobacterium bovis subsp bovis AF2122/97
ccaacugggccgagcgcg

SEQ ID NO: 1168254 - RNA, 16 nt, Mycobacterium bovis subsp bovis AF2122/97
ccaacuggucgccaac

SEQ ID NO: 1168255 - RNA, 12 nt, Mycobacterium bovis subsp bovis AF2122/97
ccaaccagcacc

SEQ ID NO: 1168256 - RNA, 15 nt, Mycobacterium bovis subsp bovis AF2122/97
ccaaccagcccggcc

SEQ ID NO: 1168257 - RNA, 20 nt, Mycobacterium bovis subsp bovis AF2122/97
ccaacagucgcagcacggcu

SEQ ID NO: 1168258 - RNA, 21 nt, Mycobacterium bovis subsp bovis AF2122/97
ccaacaggccuaggucgacgc

SEQ ID NO: 1168259 - RNA, 14 nt, Mycobacterium bovis subsp bovis AF2122/97
ccaacagggcggca

SEQ ID NO: 1168260 - RNA, 17 nt, Mycobacterium bovis subsp bovis AF2122/97
ccaacccugcggcgucg

SEQ ID NO: 1168261 - RNA, 14 nt, Mycobacterium bovis subsp bovis AF2122/97
ccaaccgcuuccaa

SEQ ID NO: 1168262 - RNA, 21 nt, Mycobacterium bovis subsp bovis AF2122/97
ccaaccgggacaaccccuugc

SEQ ID NO: 1168263 - RNA, 22 nt, Mycobacterium bovis subsp bovis AF2122/97
ccaacccgucuuaucggcgucg

SEQ ID NO: 1168264 - RNA, 15 nt, Mycobacterium bovis subsp bovis AF2122/97
ccaacccguguggca

SEQ ID NO: 1168265 - RNA, 22 nt, Mycobacterium bovis subsp bovis AF2122/97
ccaacccuaaaccagccaccac

SEQ ID NO: 1168266 - RNA, 13 nt, Mycobacterium bovis subsp bovis AF2122/97
ccaacccggcucg

SEQ ID NO: 1168267 - RNA, 14 nt, Mycobacterium bovis subsp bovis AF2122/97
ccaacccgggccgc

SEQ ID NO: 1168268 - RNA, 14 nt, Mycobacterium bovis subsp bovis AF2122/97
ccaaccccgccggc

SEQ ID NO: 1168269 - RNA, 13 nt, Mycobacterium bovis subsp bovis AF2122/97
ccaacccggcggc

SEQ ID NO: 1168270 - RNA, 21 nt, Mycobacterium bovis subsp bovis AF2122/97
ccaaccaugcugucggugccg

SEQ ID NO: 1168271 - RNA, 20 nt, Mycobacterium bovis subsp bovis AF2122/97
ccaaccaugcgguuagcagc

SEQ ID NO: 1168272 - RNA, 17 nt, Mycobacterium bovis subsp bovis AF2122/97
ccaacagcacccgggcc

SEQ ID NO: 1168273 - RNA, 22 nt, Mycobacterium bovis subsp bovis AF2122/97
ccaacacccacugcacggagcc

SEQ ID NO: 1168274 - RNA, 14 nt, Mycobacterium bovis subsp bovis AF2122/97
ccaacaccgcccgc

SEQ ID NO: 1168275 - RNA, 21 nt, Mycobacterium bovis subsp bovis AF2122/97
ccaacaccgguggcuucaacc

SEQ ID NO: 1168276 - RNA, 23 nt, Mycobacterium bovis subsp bovis AF2122/97
ccaacacauugccggccaccagc

SEQ ID NO: 1168277 - RNA, 12 nt, Mycobacterium bovis subsp bovis AF2122/97
ccaacaccagca

SEQ ID NO: 1168278 - RNA, 15 nt, Mycobacterium bovis subsp bovis AF2122/97
ccaacaccagcagca

SEQ ID NO: 1168279 - RNA, 20 nt, Mycobacterium bovis subsp bovis AF2122/97
ccaacaacaucagcgacagc

SEQ ID NO: 1168280 - RNA, 20 nt, Mycobacterium bovis subsp bovis AF2122/97
ccaacaacccaacaaaaggc

SEQ ID NO: 1168281 - RNA, 20 nt, Mycobacterium bovis subsp bovis AF2122/97
ccaagcugucaagcgggcug

SEQ ID NO: 1168282 - RNA, 21 nt, Mycobacterium bovis subsp bovis AF2122/97
ccaaggucuucaggccgcgca

SEQ ID NO: 1168283 - RNA, 15 nt, Mycobacterium bovis subsp bovis AF2122/97
ccaagguggccacca

SEQ ID NO: 1168284 - RNA, 15 nt, Mycobacterium bovis subsp bovis AF2122/97
ccaagguguccagca

SEQ ID NO: 1168285 - RNA, 14 nt, Mycobacterium bovis subsp bovis AF2122/97
ccaaggcuuccucc

SEQ ID NO: 1168286 - RNA, 21 nt, Mycobacterium bovis subsp bovis AF2122/97
ccaaggcguugguagccaggg

SEQ ID NO: 1168287 - RNA, 16 nt, Mycobacterium bovis subsp bovis AF2122/97
ccaaggcucagcagcg

SEQ ID NO: 1168288 - RNA, 16 nt, Mycobacterium bovis subsp bovis AF2122/97
ccaaguugaccuucac

SEQ ID NO: 1168289 - RNA, 14 nt, Mycobacterium bovis subsp bovis AF2122/97
ccaaguccagcagc

SEQ ID NO: 1168290 - RNA, 23 nt, Mycobacterium bovis subsp bovis AF2122/97
ccaagucgacgguggcgccgucg

SEQ ID NO: 1168291 - RNA, 15 nt, Mycobacterium bovis subsp bovis AF2122/97
ccaaguacugggcca

SEQ ID NO: 1168292 - RNA, 14 nt, Mycobacterium bovis subsp bovis AF2122/97
ccaagucacagcuc

SEQ ID NO: 1168293 - RNA, 22 nt, Mycobacterium bovis subsp bovis AF2122/97
ccaagucagaacggcggcagcg

SEQ ID NO: 1168294 - RNA, 18 nt, Mycobacterium bovis subsp bovis AF2122/97
ccaagagcgcgcagcagu

SEQ ID NO: 1168295 - RNA, 18 nt, Mycobacterium bovis subsp bovis AF2122/97
ccaagccgggugggagca

SEQ ID NO: 1168296 - RNA, 19 nt, Mycobacterium bovis subsp bovis AF2122/97
ccaagcucggccaccagcg

SEQ ID NO: 1168297 - RNA, 16 nt, Mycobacterium bovis subsp bovis AF2122/97
ccaagcucggcccagc

SEQ ID NO: 1168298 - RNA, 16 nt, Mycobacterium bovis subsp bovis AF2122/97
ccaagccgcggcuagg

SEQ ID NO: 1168299 - RNA, 21 nt, Mycobacterium bovis subsp bovis AF2122/97
ccaagccgcggcuaggccagc

SEQ ID NO: 1168300 - RNA, 19 nt, Mycobacterium bovis subsp bovis AF2122/97
ccaagccggcugcauccuc

SEQ ID NO: 1168301 - RNA, 19 nt, Mycobacterium bovis subsp bovis AF2122/97
ccaaugaaaacggaugugu

SEQ ID NO: 1168302 - RNA, 18 nt, Mycobacterium bovis subsp bovis AF2122/97
ccaaugacuuggccagca

SEQ ID NO: 1168303 - RNA, 18 nt, Mycobacterium bovis subsp bovis AF2122/97
ccaaucgggaucgcugcc

SEQ ID NO: 1168304 - RNA, 16 nt, Mycobacterium bovis subsp bovis AF2122/97
ccaauccggggcccgg

SEQ ID NO: 1168305 - RNA, 22 nt, Mycobacterium bovis subsp bovis AF2122/97
ccaaucaccguaauuucuucac

SEQ ID NO: 1168306 - RNA, 15 nt, Mycobacterium bovis subsp bovis AF2122/97
ccaaucagcccgccg

SEQ ID NO: 1168307 - RNA, 23 nt, Mycobacterium bovis subsp bovis AF2122/97
ccaauaggcgaaaauugcuccac

SEQ ID NO: 1168308 - RNA, 14 nt, Mycobacterium bovis subsp bovis AF2122/97
ccaauacgugaugu

SEQ ID NO: 1168309 - RNA, 21 nt, Mycobacterium bovis subsp bovis AF2122/97
ccacagcuugcccgagcccag

SEQ ID NO: 1168310 - RNA, 19 nt, Mycobacterium bovis subsp bovis AF2122/97
ccacagcgccaucagacca

SEQ ID NO: 1168311 - RNA, 11 nt, Mycobacterium bovis subsp bovis AF2122/97
ccacagcgcca

SEQ ID NO: 1168312 - RNA, 14 nt, Mycobacterium bovis subsp bovis AF2122/97
ccacagcgacagcg

SEQ ID NO: 1168313 - RNA, 22 nt, Mycobacterium bovis subsp bovis AF2122/97
ccacaggggcagcgcggccacc

SEQ ID NO: 1168314 - RNA, 23 nt, Mycobacterium bovis subsp bovis AF2122/97
ccacagguuugcgccgcgcagcg

SEQ ID NO: 1168315 - RNA, 17 nt, Mycobacterium bovis subsp bovis AF2122/97
ccacagucgucgagcgc

SEQ ID NO: 1168316 - RNA, 18 nt, Mycobacterium bovis subsp bovis AF2122/97
ccacagucgucgagcgcu

SEQ ID NO: 1168317 - RNA, 23 nt, Mycobacterium bovis subsp bovis AF2122/97
ccacaggggcagcgcggccaccc

SEQ ID NO: 1168318 - RNA, 16 nt, Mycobacterium bovis subsp bovis AF2122/97
ccacagguagaccguc

SEQ ID NO: 1168319 - RNA, 13 nt, Mycobacterium bovis subsp bovis AF2122/97
ccacaccggcagc

SEQ ID NO: 1168320 - RNA, 15 nt, Mycobacterium bovis subsp bovis AF2122/97
ccacacccaguugau

SEQ ID NO: 1168321 - RNA, 13 nt, Mycobacterium bovis subsp bovis AF2122/97
ccacaccaggccg

SEQ ID NO: 1168322 - RNA, 18 nt, Mycobacterium bovis subsp bovis AF2122/97
ccacacaccgagcacggg

SEQ ID NO: 1168323 - RNA, 13 nt, Mycobacterium bovis subsp bovis AF2122/97
ccacacacugccg

SEQ ID NO: 1168324 - RNA, 23 nt, Mycobacterium bovis subsp bovis AF2122/97
ccacacagaucuugugccaggcg

SEQ ID NO: 1168325 - RNA, 12 nt, Mycobacterium bovis subsp bovis AF2122/97
ccacacucagca

SEQ ID NO: 1168326 - RNA, 14 nt, Mycobacterium bovis subsp bovis AF2122/97
ccacacuggcagug

SEQ ID NO: 1168327 - RNA, 16 nt, Mycobacterium bovis subsp bovis AF2122/97
ccacaccugcggcugc

SEQ ID NO: 1168328 - RNA, 13 nt, Mycobacterium bovis subsp bovis AF2122/97
ccacacgaagugg

SEQ ID NO: 1168329 - RNA, 20 nt, Mycobacterium bovis subsp bovis AF2122/97
ccacacgcccucgacgccgc

SEQ ID NO: 1168330 - RNA, 20 nt, Mycobacterium bovis subsp bovis AF2122/97
ccacacggggccgccagcug

SEQ ID NO: 1168331 - RNA, 15 nt, Mycobacterium bovis subsp bovis AF2122/97
ccaauugcgccgcca

SEQ ID NO: 1168332 - RNA, 20 nt, Mycobacterium bovis subsp bovis AF2122/97
ccacaaccgugagcaccagc

SEQ ID NO: 1168333 - RNA, 16 nt, Mycobacterium bovis subsp bovis AF2122/97
ccaauggccugcagcg

SEQ ID NO: 1168334 - RNA, 19 nt, Mycobacterium bovis subsp bovis AF2122/97
ccaaugccuugagcaaaau

SEQ ID NO: 1168335 - RNA, 19 nt, Mycobacterium bovis subsp bovis AF2122/97
ccaaugcccuuggccagca

SEQ ID NO: 1168336 - RNA, 15 nt, Mycobacterium bovis subsp bovis AF2122/97
ccaaugcccaggugu

SEQ ID NO: 1168337 - RNA, 16 nt, Mycobacterium bovis subsp bovis AF2122/97
ccaauugauaggcccc

SEQ ID NO: 1168338 - RNA, 14 nt, Mycobacterium bovis subsp bovis AF2122/97
ccacggccggccgc

SEQ ID NO: 1168339 - RNA, 18 nt, Mycobacterium bovis subsp bovis AF2122/97
ccacggccggccgcugcc

SEQ ID NO: 1168340 - RNA, 15 nt, Mycobacterium bovis subsp bovis AF2122/97
ccacggccgccgcgu

SEQ ID NO: 1168341 - RNA, 18 nt, Mycobacterium bovis subsp bovis AF2122/97
ccacggcgaccacgccgc

SEQ ID NO: 1168342 - RNA, 23 nt, Mycobacterium bovis subsp bovis AF2122/97
ccacggcgcgcgcgccggcugcc

SEQ ID NO: 1168343 - RNA, 12 nt, Mycobacterium bovis subsp bovis AF2122/97
ccacggcgcagu

SEQ ID NO: 1168344 - RNA, 22 nt, Mycobacterium bovis subsp bovis AF2122/97
ccacggcgccuacaccggcgcu

SEQ ID NO: 1168345 - RNA, 15 nt, Mycobacterium bovis subsp bovis AF2122/97
ccacggcgaugcagc

SEQ ID NO: 1168346 - RNA, 20 nt, Mycobacterium bovis subsp bovis AF2122/97
ccacggcgaugcagccacau

SEQ ID NO: 1168347 - RNA, 12 nt, Mycobacterium bovis subsp bovis AF2122/97
ccacggcagcca

SEQ ID NO: 1168348 - RNA, 21 nt, Mycobacterium bovis subsp bovis AF2122/97
ccacggcagccaaccggcgca

SEQ ID NO: 1168349 - RNA, 23 nt, Mycobacterium bovis subsp bovis AF2122/97
ccacggcagccaaccggcgcagu

SEQ ID NO: 1168350 - RNA, 14 nt, Mycobacterium bovis subsp bovis AF2122/97
ccacggcagcgccg

SEQ ID NO: 1168351 - RNA, 21 nt, Mycobacterium bovis subsp bovis AF2122/97
ccacggcaggcagggcagccc

SEQ ID NO: 1168352 - RNA, 14 nt, Mycobacterium bovis subsp bovis AF2122/97
ccacggggcugccg

SEQ ID NO: 1168353 - RNA, 15 nt, Mycobacterium bovis subsp bovis AF2122/97
ccacgggaucugcgg

SEQ ID NO: 1168354 - RNA, 12 nt, Mycobacterium bovis subsp bovis AF2122/97
ccacggcugugg

SEQ ID NO: 1168355 - RNA, 17 nt, Mycobacterium bovis subsp bovis AF2122/97
ccacggcuuugcggcgc

SEQ ID NO: 1168356 - RNA, 16 nt, Mycobacterium bovis subsp bovis AF2122/97
ccacggcguugccgcc

SEQ ID NO: 1168357 - RNA, 17 nt, Mycobacterium bovis subsp bovis AF2122/97
ccacggcguugccgccg

SEQ ID NO: 1168358 - RNA, 18 nt, Mycobacterium bovis subsp bovis AF2122/97
ccacggucgccgaccacu

SEQ ID NO: 1168359 - RNA, 19 nt, Mycobacterium bovis subsp bovis AF2122/97
ccacgguggccgcugccag

SEQ ID NO: 1168360 - RNA, 14 nt, Mycobacterium bovis subsp bovis AF2122/97
ccacggggcagguc

SEQ ID NO: 1168361 - RNA, 21 nt, Mycobacterium bovis subsp bovis AF2122/97
ccacgggcggccaccgcacgc

SEQ ID NO: 1168362 - RNA, 16 nt, Mycobacterium bovis subsp bovis AF2122/97
ccacggucauugggug

SEQ ID NO: 1168363 - RNA, 18 nt, Mycobacterium bovis subsp bovis AF2122/97
ccacggaaguaucgccgg

SEQ ID NO: 1168364 - RNA, 17 nt, Mycobacterium bovis subsp bovis AF2122/97
ccacggcaaaggcgcuc

SEQ ID NO: 1168365 - RNA, 22 nt, Mycobacterium bovis subsp bovis AF2122/97
ccacggcaaaggcgcucugcug

SEQ ID NO: 1168366 - RNA, 22 nt, Mycobacterium bovis subsp bovis AF2122/97
ccacgcugcccacgggccggcc

SEQ ID NO: 1168367 - RNA, 15 nt, Mycobacterium bovis subsp bovis AF2122/97
ccacgcccggccccg

SEQ ID NO: 1168368 - RNA, 17 nt, Mycobacterium bovis subsp bovis AF2122/97
ccacgccagcucgccgg

SEQ ID NO: 1168369 - RNA, 18 nt, Mycobacterium bovis subsp bovis AF2122/97
ccacgccagcucgccggc

SEQ ID NO: 1168370 - RNA, 19 nt, Mycobacterium bovis subsp bovis AF2122/97
ccacgaaccgugcugggca

SEQ ID NO: 1168371 - RNA, 17 nt, Mycobacterium bovis subsp bovis AF2122/97
ccacgauggcggccacc

SEQ ID NO: 1168372 - RNA, 15 nt, Mycobacterium bovis subsp bovis AF2122/97
ccaccucgucacagu

SEQ ID NO: 1168373 - RNA, 22 nt, Mycobacterium bovis subsp bovis AF2122/97
ccaccucggugaccaggccggc

SEQ ID NO: 1168374 - RNA, 20 nt, Mycobacterium bovis subsp bovis AF2122/97
ccaccucggugaccaggccg

SEQ ID NO: 1168375 - RNA, 19 nt, Mycobacterium bovis subsp bovis AF2122/97
ccaccuucggguagccccg

SEQ ID NO: 1168376 - RNA, 18 nt, Mycobacterium bovis subsp bovis AF2122/97
ccaccuucugguccagca

SEQ ID NO: 1168377 - RNA, 12 nt, Mycobacterium bovis subsp bovis AF2122/97
ccaccucccagg

SEQ ID NO: 1168378 - RNA, 19 nt, Mycobacterium bovis subsp bovis AF2122/97
ccaccucggugaccaggcc

SEQ ID NO: 1168379 - RNA, 17 nt, Mycobacterium bovis subsp bovis AF2122/97
ccaccuccgaggccgcc

SEQ ID NO: 1168380 - RNA, 19 nt, Mycobacterium bovis subsp bovis AF2122/97
ccacgaucggcccagcccu

SEQ ID NO: 1168381 - RNA, 20 nt, Mycobacterium bovis subsp bovis AF2122/97
ccacgaucuguggaagcccg

SEQ ID NO: 1168382 - RNA, 17 nt, Mycobacterium bovis subsp bovis AF2122/97
ccacgaacccucagccg

SEQ ID NO: 1168383 - RNA, 15 nt, Mycobacterium bovis subsp bovis AF2122/97
ccacgaguuggccaa

SEQ ID NO: 1168384 - RNA, 15 nt, Mycobacterium bovis subsp bovis AF2122/97
ccacgaggcuugcgg

SEQ ID NO: 1168385 - RNA, 20 nt, Mycobacterium bovis subsp bovis AF2122/97
ccacgagcguagcgaccucg

SEQ ID NO: 1168386 - RNA, 23 nt, Mycobacterium bovis subsp bovis AF2122/97
ccaccuuggcguugaccagcacg

SEQ ID NO: 1168387 - RNA, 21 nt, Mycobacterium bovis subsp bovis AF2122/97
ccaccuuggcugggcccgccg

SEQ ID NO: 1168388 - RNA, 18 nt, Mycobacterium bovis subsp bovis AF2122/97
ccaccccgagcucaccaa

SEQ ID NO: 1168389 - RNA, 14 nt, Mycobacterium bovis subsp bovis AF2122/97
ccacccccaccgaa

SEQ ID NO: 1168390 - RNA, 19 nt, Mycobacterium bovis subsp bovis AF2122/97
ccaccccccagcgccgccg

SEQ ID NO: 1168391 - RNA, 23 nt, Mycobacterium bovis subsp bovis AF2122/97
ccacccuaaucguuccgcagucu

SEQ ID NO: 1168392 - RNA, 22 nt, Mycobacterium bovis subsp bovis AF2122/97
ccaccccugcgguccgcugcca

SEQ ID NO: 1168393 - RNA, 14 nt, Mycobacterium bovis subsp bovis AF2122/97
ccaccccguagcgg

SEQ ID NO: 1168394 - RNA, 15 nt, Mycobacterium bovis subsp bovis AF2122/97
ccaccccgucugcag

SEQ ID NO: 1168395 - RNA, 14 nt, Mycobacterium bovis subsp bovis AF2122/97
ccaccgaccgcaug

SEQ ID NO: 1168396 - RNA, 22 nt, Mycobacterium bovis subsp bovis AF2122/97
ccaccgacauguguggcagccc

SEQ ID NO: 1168397 - RNA, 22 nt, Mycobacterium bovis subsp bovis AF2122/97
ccaccgacgacaucgguggccc

SEQ ID NO: 1168398 - RNA, 19 nt, Mycobacterium bovis subsp bovis AF2122/97
ccaccgacguggccagccc

SEQ ID NO: 1168399 - RNA, 20 nt, Mycobacterium bovis subsp bovis AF2122/97
ccacccuguuguugccccgg

SEQ ID NO: 1168400 - RNA, 22 nt, Mycobacterium bovis subsp bovis AF2122/97
ccaccgacagcacccggccacc

SEQ ID NO: 1168401 - RNA, 14 nt, Mycobacterium bovis subsp bovis AF2122/97
ccacccuugccgcu

SEQ ID NO: 1168402 - RNA, 15 nt, Mycobacterium bovis subsp bovis AF2122/97
ccacccuugccgcug

SEQ ID NO: 1168403 - RNA, 18 nt, Mycobacterium bovis subsp bovis AF2122/97
ccaccgaacgcggccacc

SEQ ID NO: 1168404 - RNA, 23 nt, Mycobacterium bovis subsp bovis AF2122/97
ccaccgaacgcggccaccgaccg

SEQ ID NO: 1168405 - RNA, 20 nt, Mycobacterium bovis subsp bovis AF2122/97
ccaccgaagcggugacccac

SEQ ID NO: 1168406 - RNA, 19 nt, Mycobacterium bovis subsp bovis AF2122/97
ccaccgucaccgccggcac

SEQ ID NO: 1168407 - RNA, 16 nt, Mycobacterium bovis subsp bovis AF2122/97
ccaccgucaccgccgu

SEQ ID NO: 1168408 - RNA, 13 nt, Mycobacterium bovis subsp bovis AF2122/97
ccaccgucccugu

SEQ ID NO: 1168409 - RNA, 17 nt, Mycobacterium bovis subsp bovis AF2122/97
ccaccgucccugugucg

SEQ ID NO: 1168410 - RNA, 22 nt, Mycobacterium bovis subsp bovis AF2122/97
ccaccgucgaaccaugguugau

SEQ ID NO: 1168411 - RNA, 16 nt, Mycobacterium bovis subsp bovis AF2122/97
ccaccgucgccguaca

SEQ ID NO: 1168412 - RNA, 17 nt, Mycobacterium bovis subsp bovis AF2122/97
ccaccgucucgccgcgc

SEQ ID NO: 1168413 - RNA, 16 nt, Mycobacterium bovis subsp bovis AF2122/97
ccaccguagccgaggg

SEQ ID NO: 1168414 - RNA, 23 nt, Mycobacterium bovis subsp bovis AF2122/97
ccaccgugucacgcgaccaccgc

SEQ ID NO: 1168415 - RNA, 15 nt, Mycobacterium bovis subsp bovis AF2122/97
ccaccguuaccgccg

SEQ ID NO: 1168416 - RNA, 18 nt, Mycobacterium bovis subsp bovis AF2122/97
ccaccguuagccaggucg

SEQ ID NO: 1168417 - RNA, 19 nt, Mycobacterium bovis subsp bovis AF2122/97
ccaccguuugcgcaccggu

SEQ ID NO: 1168418 - RNA, 24 nt, Mycobacterium bovis subsp bovis AF2122/97
ccaccguugccgaaccacgcgccc

SEQ ID NO: 1168419 - RNA, 16 nt, Mycobacterium bovis subsp bovis AF2122/97
ccaccguuaccgccgu

SEQ ID NO: 1168420 - RNA, 16 nt, Mycobacterium bovis subsp bovis AF2122/97
ccaccagcuggugagc

SEQ ID NO: 1168421 - RNA, 16 nt, Mycobacterium bovis subsp bovis AF2122/97
ccaccagcggcggccc

SEQ ID NO: 1168422 - RNA, 16 nt, Mycobacterium bovis subsp bovis AF2122/97
ccaccagccgguccag

SEQ ID NO: 1168423 - RNA, 21 nt, Mycobacterium bovis subsp bovis AF2122/97
ccaccagccgguccagcagcu

SEQ ID NO: 1168424 - RNA, 22 nt, Mycobacterium bovis subsp bovis AF2122/97
ccaccagcgacgaccacaccac

SEQ ID NO: 1168425 - RNA, 12 nt, Mycobacterium bovis subsp bovis AF2122/97
ccaccagcgccc

SEQ ID NO: 1168426 - RNA, 22 nt, Mycobacterium bovis subsp bovis AF2122/97
ccaccacggccagaaacccggc

SEQ ID NO: 1168427 - RNA, 23 nt, Mycobacterium bovis subsp bovis AF2122/97
ccaccacggucaagccggcgccc

SEQ ID NO: 1168428 - RNA, 19 nt, Mycobacterium bovis subsp bovis AF2122/97
ccaccacgccgucgacaac

SEQ ID NO: 1168429 - RNA, 14 nt, Mycobacterium bovis subsp bovis AF2122/97
ccaccaccuggccg

SEQ ID NO: 1168430 - RNA, 19 nt, Mycobacterium bovis subsp bovis AF2122/97
ccaccacguggcccuccuc

SEQ ID NO: 1168431 - RNA, 17 nt, Mycobacterium bovis subsp bovis AF2122/97
ccaccacgcuggccucg

SEQ ID NO: 1168432 - RNA, 23 nt, Mycobacterium bovis subsp bovis AF2122/97
ccaccacgucgggaugcccgcug

SEQ ID NO: 1168433 - RNA, 22 nt, Mycobacterium bovis subsp bovis AF2122/97
ccaccacugugacacccgaggg

SEQ ID NO: 1168434 - RNA, 23 nt, Mycobacterium bovis subsp bovis AF2122/97
ccaccagggacgaugcccuccuc

SEQ ID NO: 1168435 - RNA, 15 nt, Mycobacterium bovis subsp bovis AF2122/97
ccaccagucacgccc

SEQ ID NO: 1168436 - RNA, 23 nt, Mycobacterium bovis subsp bovis AF2122/97
ccaccaguccgaugggaaucagu

SEQ ID NO: 1168437 - RNA, 15 nt, Mycobacterium bovis subsp bovis AF2122/97
ccaccaucaccgccu

SEQ ID NO: 1168438 - RNA, 16 nt, Mycobacterium bovis subsp bovis AF2122/97
ccaccaucaccgccuu

SEQ ID NO: 1168439 - RNA, 17 nt, Mycobacterium bovis subsp bovis AF2122/97
ccaccagugagcccgcu

SEQ ID NO: 1168440 - RNA, 19 nt, Mycobacterium bovis subsp bovis AF2122/97
ccaccagugagcccgcuuc

SEQ ID NO: 1168441 - RNA, 15 nt, Mycobacterium bovis subsp bovis AF2122/97
ccaccaucgccucgg

SEQ ID NO: 1168442 - RNA, 24 nt, Mycobacterium bovis subsp bovis AF2122/97
ccacccagauugccugggcggccg

SEQ ID NO: 1168443 - RNA, 16 nt, Mycobacterium bovis subsp bovis AF2122/97
ccacccagaugcagcg

SEQ ID NO: 1168444 - RNA, 14 nt, Mycobacterium bovis subsp bovis AF2122/97
ccaccccacccagc

SEQ ID NO: 1168445 - RNA, 22 nt, Mycobacterium bovis subsp bovis AF2122/97
ccaccccagcggccaccgaggc

SEQ ID NO: 1168446 - RNA, 23 nt, Mycobacterium bovis subsp bovis AF2122/97
ccaccauucccggacccaccaau

SEQ ID NO: 1168447 - RNA, 23 nt, Mycobacterium bovis subsp bovis AF2122/97
ccaccauguauuucucccagccc

SEQ ID NO: 1168448 - RNA, 17 nt, Mycobacterium bovis subsp bovis AF2122/97
ccacccaacagcccacc

SEQ ID NO: 1168449 - RNA, 23 nt, Mycobacterium bovis subsp bovis AF2122/97
ccacccacauggcggcccggugg

SEQ ID NO: 1168450 - RNA, 13 nt, Mycobacterium bovis subsp bovis AF2122/97
ccacccaccacag

SEQ ID NO: 1168451 - RNA, 13 nt, Mycobacterium bovis subsp bovis AF2122/97
ccacccaccgaca

SEQ ID NO: 1168452 - RNA, 17 nt, Mycobacterium bovis subsp bovis AF2122/97
ccaccaccgccgccgaa

SEQ ID NO: 1168453 - RNA, 15 nt, Mycobacterium bovis subsp bovis AF2122/97
ccaccaccgacgagg

SEQ ID NO: 1168454 - RNA, 12 nt, Mycobacterium bovis subsp bovis AF2122/97
ccaccaccguga

SEQ ID NO: 1168455 - RNA, 13 nt, Mycobacterium bovis subsp bovis AF2122/97
ccaccaccggcgc

SEQ ID NO: 1168456 - RNA, 15 nt, Mycobacterium bovis subsp bovis AF2122/97
ccaccaccggcgccu

SEQ ID NO: 1168457 - RNA, 14 nt, Mycobacterium bovis subsp bovis AF2122/97
ccaccaccuccgcg

SEQ ID NO: 1168458 - RNA, 12 nt, Mycobacterium bovis subsp bovis AF2122/97
ccaccacccugc

SEQ ID NO: 1168459 - RNA, 13 nt, Mycobacterium bovis subsp bovis AF2122/97
ccaccacccugca

SEQ ID NO: 1168460 - RNA, 15 nt, Mycobacterium bovis subsp bovis AF2122/97
ccaccacccugcacu

SEQ ID NO: 1168461 - RNA, 14 nt, Mycobacterium bovis subsp bovis AF2122/97
ccaccaagcucgca

SEQ ID NO: 1168462 - RNA, 20 nt, Mycobacterium bovis subsp bovis AF2122/97
ccaccaagguguggccuugc

SEQ ID NO: 1168463 - RNA, 21 nt, Mycobacterium bovis subsp bovis AF2122/97
ccaccaaacgcugcuggcaug

SEQ ID NO: 1168464 - RNA, 13 nt, Mycobacterium bovis subsp bovis AF2122/97
ccacauaccccga

SEQ ID NO: 1168465 - RNA, 16 nt, Mycobacterium bovis subsp bovis AF2122/97
ccacauacaccggccg

SEQ ID NO: 1168466 - RNA, 20 nt, Mycobacterium bovis subsp bovis AF2122/97
ccacagugcauacgguugau

SEQ ID NO: 1168467 - RNA, 21 nt, Mycobacterium bovis subsp bovis AF2122/97
ccacagucgccggccggcccg

SEQ ID NO: 1168468 - RNA, 15 nt, Mycobacterium bovis subsp bovis AF2122/97
ccacaucaccaaaaa

SEQ ID NO: 1168469 - RNA, 16 nt, Mycobacterium bovis subsp bovis AF2122/97
ccacaucaugccagcc

SEQ ID NO: 1168470 - RNA, 23 nt, Mycobacterium bovis subsp bovis AF2122/97
ccacauguucuccucgucgcggg

SEQ ID NO: 1168471 - RNA, 22 nt, Mycobacterium bovis subsp bovis AF2122/97
ccacaugaucgagcaguuccag

SEQ ID NO: 1168472 - RNA, 21 nt, Mycobacterium bovis subsp bovis AF2122/97
ccacaugacgaucgcggcggg

SEQ ID NO: 1168473 - RNA, 20 nt, Mycobacterium bovis subsp bovis AF2122/97
ccacauccuggcggcugcag

SEQ ID NO: 1168474 - RNA, 22 nt, Mycobacterium bovis subsp bovis AF2122/97
ccacauccuggcggcugcagcc

SEQ ID NO: 1168475 - RNA, 18 nt, Mycobacterium bovis subsp bovis AF2122/97
ccagccaccaccaggucg

SEQ ID NO: 1168476 - RNA, 16 nt, Mycobacterium bovis subsp bovis AF2122/97
ccagccacagcccggc

SEQ ID NO: 1168477 - RNA, 19 nt, Mycobacterium bovis subsp bovis AF2122/97
ccagcauucucgccgacgg

SEQ ID NO: 1168478 - RNA, 16 nt, Mycobacterium bovis subsp bovis AF2122/97
ccagccaacucaggcc

SEQ ID NO: 1168479 - RNA, 17 nt, Mycobacterium bovis subsp bovis AF2122/97
ccagccaacucaggccg

SEQ ID NO: 1168480 - RNA, 21 nt, Mycobacterium bovis subsp bovis AF2122/97
ccagccaggugauuaccuggu

SEQ ID NO: 1168481 - RNA, 23 nt, Mycobacterium bovis subsp bovis AF2122/97
ccagccauagugcggcagcggug

SEQ ID NO: 1168482 - RNA, 13 nt, Mycobacterium bovis subsp bovis AF2122/97
ccagccagcgggc

SEQ ID NO: 1168483 - RNA, 16 nt, Mycobacterium bovis subsp bovis AF2122/97
ccagccagcgggcgau

SEQ ID NO: 1168484 - RNA, 20 nt, Mycobacterium bovis subsp bovis AF2122/97
ccagccagcuggacuccggu

SEQ ID NO: 1168485 - RNA, 18 nt, Mycobacterium bovis subsp bovis AF2122/97
ccagccagccugcuggcc

SEQ ID NO: 1168486 - RNA, 14 nt, Mycobacterium bovis subsp bovis AF2122/97
ccagccagccgccc

SEQ ID NO: 1168487 - RNA, 19 nt, Mycobacterium bovis subsp bovis AF2122/97
ccagccagcagcggcgagc

SEQ ID NO: 1168488 - RNA, 20 nt, Mycobacterium bovis subsp bovis AF2122/97
ccagccagcagcggcgagcc

SEQ ID NO: 1168489 - RNA, 20 nt, Mycobacterium bovis subsp bovis AF2122/97
ccagcaucgcggugguuggg

SEQ ID NO: 1168490 - RNA, 20 nt, Mycobacterium bovis subsp bovis AF2122/97
ccagcaucgagcaguggccg

SEQ ID NO: 1168491 - RNA, 22 nt, Mycobacterium bovis subsp bovis AF2122/97
ccagcaucgagcaguggccgcc

SEQ ID NO: 1168492 - RNA, 18 nt, Mycobacterium bovis subsp bovis AF2122/97
ccagcagccagcccagcc

SEQ ID NO: 1168493 - RNA, 13 nt, Mycobacterium bovis subsp bovis AF2122/97
ccagcaccccgag

SEQ ID NO: 1168494 - RNA, 15 nt, Mycobacterium bovis subsp bovis AF2122/97
ccagcacccccugca

SEQ ID NO: 1168495 - RNA, 13 nt, Mycobacterium bovis subsp bovis AF2122/97
ccagcacccggcu

SEQ ID NO: 1168496 - RNA, 16 nt, Mycobacterium bovis subsp bovis AF2122/97
ccagcaccccgagguc

SEQ ID NO: 1168497 - RNA, 16 nt, Mycobacterium bovis subsp bovis AF2122/97
ccagcacccggcuucg

SEQ ID NO: 1168498 - RNA, 16 nt, Mycobacterium bovis subsp bovis AF2122/97
ccagcacccgagcgau

SEQ ID NO: 1168499 - RNA, 18 nt, Mycobacterium bovis subsp bovis AF2122/97
ccagcacccgcugcacgc

SEQ ID NO: 1168500 - RNA, 13 nt, Mycobacterium bovis subsp bovis AF2122/97
ccagcaccgccgc

SEQ ID NO: 1168501 - RNA, 23 nt, Mycobacterium bovis subsp bovis AF2122/97
ccagcaccagcgucgcggccacg

SEQ ID NO: 1168502 - RNA, 23 nt, Mycobacterium bovis subsp bovis AF2122/97
ccagcacacccccgucugcgugg

SEQ ID NO: 1168503 - RNA, 16 nt, Mycobacterium bovis subsp bovis AF2122/97
ccagcagauccaggcg

SEQ ID NO: 1168504 - RNA, 17 nt, Mycobacterium bovis subsp bovis AF2122/97
ccagcagauccaggcgu

SEQ ID NO: 1168505 - RNA, 20 nt, Mycobacterium bovis subsp bovis AF2122/97
ccagcagauccaggcgucgg

SEQ ID NO: 1168506 - RNA, 20 nt, Mycobacterium bovis subsp bovis AF2122/97
ccagcacuccaccgcuggcc

SEQ ID NO: 1168507 - RNA, 21 nt, Mycobacterium bovis subsp bovis AF2122/97
ccagcacuccgcgggguugau

SEQ ID NO: 1168508 - RNA, 21 nt, Mycobacterium bovis subsp bovis AF2122/97
ccagcaccgccgcgccggcgg

SEQ ID NO: 1168509 - RNA, 18 nt, Mycobacterium bovis subsp bovis AF2122/97
ccagaucgaagcgcagca

SEQ ID NO: 1168510 - RNA, 15 nt, Mycobacterium bovis subsp bovis AF2122/97
ccagaucgacgccaa

SEQ ID NO: 1168511 - RNA, 19 nt, Mycobacterium bovis subsp bovis AF2122/97
ccagaucggcguuggcaug

SEQ ID NO: 1168512 - RNA, 17 nt, Mycobacterium bovis subsp bovis AF2122/97
ccagaucuugcagugcg

SEQ ID NO: 1168513 - RNA, 22 nt, Mycobacterium bovis subsp bovis AF2122/97
ccagcaagugugagcagaccca

SEQ ID NO: 1168514 - RNA, 15 nt, Mycobacterium bovis subsp bovis AF2122/97
ccagcaaggccagca

SEQ ID NO: 1168515 - RNA, 14 nt, Mycobacterium bovis subsp bovis AF2122/97
ccagcaaggccagc

SEQ ID NO: 1168516 - RNA, 14 nt, Mycobacterium bovis subsp bovis AF2122/97
ccagcaacuaccug

SEQ ID NO: 1168517 - RNA, 23 nt, Mycobacterium bovis subsp bovis AF2122/97
ccagcaacuaccuguugacacaa

SEQ ID NO: 1168518 - RNA, 22 nt, Mycobacterium bovis subsp bovis AF2122/97
ccagacccuggccgucccacca

SEQ ID NO: 1168519 - RNA, 12 nt, Mycobacterium bovis subsp bovis AF2122/97
ccagaccgccga

SEQ ID NO: 1168520 - RNA, 18 nt, Mycobacterium bovis subsp bovis AF2122/97
ccagaccgccgacgccgu

SEQ ID NO: 1168521 - RNA, 14 nt, Mycobacterium bovis subsp bovis AF2122/97
ccagaccagggcag

SEQ ID NO: 1168522 - RNA, 15 nt, Mycobacterium bovis subsp bovis AF2122/97
ccagaccagggcagc

SEQ ID NO: 1168523 - RNA, 15 nt, Mycobacterium bovis subsp bovis AF2122/97
ccagacccagcucgu

SEQ ID NO: 1168524 - RNA, 15 nt, Mycobacterium bovis subsp bovis AF2122/97
ccagacccgaaucca

SEQ ID NO: 1168525 - RNA, 16 nt, Mycobacterium bovis subsp bovis AF2122/97
ccagacgcucuugaau

SEQ ID NO: 1168526 - RNA, 19 nt, Mycobacterium bovis subsp bovis AF2122/97
ccagagaaaucgguggugc

SEQ ID NO: 1168527 - RNA, 15 nt, Mycobacterium bovis subsp bovis AF2122/97
ccagaggcccgcggu

SEQ ID NO: 1168528 - RNA, 18 nt, Mycobacterium bovis subsp bovis AF2122/97
ccagaucgaacgcagcca

SEQ ID NO: 1168529 - RNA, 17 nt, Mycobacterium bovis subsp bovis AF2122/97
ccagagcuucgccgcgc

SEQ ID NO: 1168530 - RNA, 22 nt, Mycobacterium bovis subsp bovis AF2122/97
ccagagcuucgccgcgcagccu

SEQ ID NO: 1168531 - RNA, 11 nt, Mycobacterium bovis subsp bovis AF2122/97
ccagagccgcg

SEQ ID NO: 1168532 - RNA, 13 nt, Mycobacterium bovis subsp bovis AF2122/97
ccagagccgcgcg

SEQ ID NO: 1168533 - RNA, 16 nt, Mycobacterium bovis subsp bovis AF2122/97
ccagagaucagcaccc

SEQ ID NO: 1168534 - RNA, 14 nt, Mycobacterium bovis subsp bovis AF2122/97
ccacguccucagcc

SEQ ID NO: 1168535 - RNA, 21 nt, Mycobacterium bovis subsp bovis AF2122/97
ccacguccucagccgugccca

SEQ ID NO: 1168536 - RNA, 13 nt, Mycobacterium bovis subsp bovis AF2122/97
ccacguccugccc

SEQ ID NO: 1168537 - RNA, 15 nt, Mycobacterium bovis subsp bovis AF2122/97
ccacgucgagcaccc

SEQ ID NO: 1168538 - RNA, 21 nt, Mycobacterium bovis subsp bovis AF2122/97
ccacgucgagcacccgcucca

SEQ ID NO: 1168539 - RNA, 14 nt, Mycobacterium bovis subsp bovis AF2122/97
ccacgucgagcagg

SEQ ID NO: 1168540 - RNA, 22 nt, Mycobacterium bovis subsp bovis AF2122/97
ccacgucgagguccaccacccu

SEQ ID NO: 1168541 - RNA, 23 nt, Mycobacterium bovis subsp bovis AF2122/97
ccacgucgaucagugcaagaccg

SEQ ID NO: 1168542 - RNA, 20 nt, Mycobacterium bovis subsp bovis AF2122/97
ccacgucgcggcguuguugc

SEQ ID NO: 1168543 - RNA, 21 nt, Mycobacterium bovis subsp bovis AF2122/97
ccacgucggcgaacgcgucca

SEQ ID NO: 1168544 - RNA, 21 nt, Mycobacterium bovis subsp bovis AF2122/97
ccacuuuucgguggcggcagc

SEQ ID NO: 1168545 - RNA, 16 nt, Mycobacterium bovis subsp bovis AF2122/97
ccacuuugcguuccca

SEQ ID NO: 1168546 - RNA, 14 nt, Mycobacterium bovis subsp bovis AF2122/97
ccagaaaaccgccg

SEQ ID NO: 1168547 - RNA, 22 nt, Mycobacterium bovis subsp bovis AF2122/97
ccagaacgguggcgcggugccg

SEQ ID NO: 1168548 - RNA, 15 nt, Mycobacterium bovis subsp bovis AF2122/97
ccagaacgacgccgc

SEQ ID NO: 1168549 - RNA, 17 nt, Mycobacterium bovis subsp bovis AF2122/97
ccagacaauccgccgcc

SEQ ID NO: 1168550 - RNA, 15 nt, Mycobacterium bovis subsp bovis AF2122/97
ccagacacaaccgcu

SEQ ID NO: 1168551 - RNA, 21 nt, Mycobacterium bovis subsp bovis AF2122/97
ccagaaucucgccgggcugca

SEQ ID NO: 1168552 - RNA, 16 nt, Mycobacterium bovis subsp bovis AF2122/97
ccagggcaacggccgc

SEQ ID NO: 1168553 - RNA, 13 nt, Mycobacterium bovis subsp bovis AF2122/97
ccagggagcggcu

SEQ ID NO: 1168554 - RNA, 20 nt, Mycobacterium bovis subsp bovis AF2122/97
ccaggcuugcggcacccagu

SEQ ID NO: 1168555 - RNA, 21 nt, Mycobacterium bovis subsp bovis AF2122/97
ccaggcuugcggcacccaguc

SEQ ID NO: 1168556 - RNA, 21 nt, Mycobacterium bovis subsp bovis AF2122/97
ccaggcugucgcgggccacca

SEQ ID NO: 1168557 - RNA, 20 nt, Mycobacterium bovis subsp bovis AF2122/97
ccaggcgcucaucacccagc

SEQ ID NO: 1168558 - RNA, 15 nt, Mycobacterium bovis subsp bovis AF2122/97
ccagggccgccgcug

SEQ ID NO: 1168559 - RNA, 21 nt, Mycobacterium bovis subsp bovis AF2122/97
ccagggccgccgcugccgccu

SEQ ID NO: 1168560 - RNA, 16 nt, Mycobacterium bovis subsp bovis AF2122/97
ccagggccgaguccga

SEQ ID NO: 1168561 - RNA, 18 nt, Mycobacterium bovis subsp bovis AF2122/97
ccagggccuccacccgcc

SEQ ID NO: 1168562 - RNA, 17 nt, Mycobacterium bovis subsp bovis AF2122/97
ccagggccucgaccgcc

SEQ ID NO: 1168563 - RNA, 18 nt, Mycobacterium bovis subsp bovis AF2122/97
ccagggcgacgagaucug

SEQ ID NO: 1168564 - RNA, 20 nt, Mycobacterium bovis subsp bovis AF2122/97
ccagggccucgaccgccagc

SEQ ID NO: 1168565 - RNA, 17 nt, Mycobacterium bovis subsp bovis AF2122/97
ccagggccuucgggcca

SEQ ID NO: 1168566 - RNA, 15 nt, Mycobacterium bovis subsp bovis AF2122/97
ccagggcccugcugg

SEQ ID NO: 1168567 - RNA, 17 nt, Mycobacterium bovis subsp bovis AF2122/97
ccagggcccugcuggcc

SEQ ID NO: 1168568 - RNA, 11 nt, Mycobacterium bovis subsp bovis AF2122/97
ccagggccgac

SEQ ID NO: 1168569 - RNA, 22 nt, Mycobacterium bovis subsp bovis AF2122/97
ccagggcaucagcagagccccg

SEQ ID NO: 1168570 - RNA, 17 nt, Mycobacterium bovis subsp bovis AF2122/97
ccagggagcggcugcac

SEQ ID NO: 1168571 - RNA, 17 nt, Mycobacterium bovis subsp bovis AF2122/97
ccagggccaccgcgccg

SEQ ID NO: 1168572 - RNA, 13 nt, Mycobacterium bovis subsp bovis AF2122/97
ccaggccgucagg

SEQ ID NO: 1168573 - RNA, 19 nt, Mycobacterium bovis subsp bovis AF2122/97
ccaggcacaacaucgccgc

SEQ ID NO: 1168574 - RNA, 21 nt, Mycobacterium bovis subsp bovis AF2122/97
ccaggcacaacaucgccgcag

SEQ ID NO: 1168575 - RNA, 20 nt, Mycobacterium bovis subsp bovis AF2122/97
ccaggcaagccagcacugcc

SEQ ID NO: 1168576 - RNA, 15 nt, Mycobacterium bovis subsp bovis AF2122/97
ccaggcaccacgacc

SEQ ID NO: 1168577 - RNA, 23 nt, Mycobacterium bovis subsp bovis AF2122/97
ccaggcacguccgaucggcgcgc

SEQ ID NO: 1168578 - RNA, 13 nt, Mycobacterium bovis subsp bovis AF2122/97
ccaggcgcagcug

SEQ ID NO: 1168579 - RNA, 19 nt, Mycobacterium bovis subsp bovis AF2122/97
ccaggcgcauagggccacc

SEQ ID NO: 1168580 - RNA, 17 nt, Mycobacterium bovis subsp bovis AF2122/97
ccaggcgcgaucgcgcc

SEQ ID NO: 1168581 - RNA, 20 nt, Mycobacterium bovis subsp bovis AF2122/97
ccaggcgauaaagccgcuga

SEQ ID NO: 1168582 - RNA, 12 nt, Mycobacterium bovis subsp bovis AF2122/97
ccaggcgagccg

SEQ ID NO: 1168583 - RNA, 16 nt, Mycobacterium bovis subsp bovis AF2122/97
ccaggcgagccgccac

SEQ ID NO: 1168584 - RNA, 14 nt, Mycobacterium bovis subsp bovis AF2122/97
ccaggcgaacaggg

SEQ ID NO: 1168585 - RNA, 17 nt, Mycobacterium bovis subsp bovis AF2122/97
ccaggcgaacagggcug

SEQ ID NO: 1168586 - RNA, 18 nt, Mycobacterium bovis subsp bovis AF2122/97
ccagggugucgucuugcg

SEQ ID NO: 1168587 - RNA, 19 nt, Mycobacterium bovis subsp bovis AF2122/97
ccaggggagcugaccacuu

SEQ ID NO: 1168588 - RNA, 18 nt, Mycobacterium bovis subsp bovis AF2122/97
ccaggguguauggccacc

SEQ ID NO: 1168589 - RNA, 20 nt, Mycobacterium bovis subsp bovis AF2122/97
ccaggguguauggccaccac

SEQ ID NO: 1168590 - RNA, 22 nt, Mycobacterium bovis subsp bovis AF2122/97
ccagguaauugccgaccgccug

SEQ ID NO: 1168591 - RNA, 20 nt, Mycobacterium bovis subsp bovis AF2122/97
ccagggcgguggccacccgg

SEQ ID NO: 1168592 - RNA, 16 nt, Mycobacterium bovis subsp bovis AF2122/97
ccagguggaccggccu

SEQ ID NO: 1168593 - RNA, 14 nt, Mycobacterium bovis subsp bovis AF2122/97
ccagguggccaggc

SEQ ID NO: 1168594 - RNA, 11 nt, Mycobacterium bovis subsp bovis AF2122/97
ccaggugcagg

SEQ ID NO: 1168595 - RNA, 13 nt, Mycobacterium bovis subsp bovis AF2122/97
ccaggugcaggcu

SEQ ID NO: 1168596 - RNA, 17 nt, Mycobacterium bovis subsp bovis AF2122/97
ccaggugcccaagcagu

SEQ ID NO: 1168597 - RNA, 19 nt, Mycobacterium bovis subsp bovis AF2122/97
ccaggugcccaagcagucc

SEQ ID NO: 1168598 - RNA, 13 nt, Mycobacterium bovis subsp bovis AF2122/97
ccaggugcccgcc

SEQ ID NO: 1168599 - RNA, 16 nt, Mycobacterium bovis subsp bovis AF2122/97
ccaggugcccgccccg

SEQ ID NO: 1168600 - RNA, 16 nt, Mycobacterium bovis subsp bovis AF2122/97
ccaggugaugccgccg

SEQ ID NO: 1168601 - RNA, 15 nt, Mycobacterium bovis subsp bovis AF2122/97
ccagguagaccaggu

SEQ ID NO: 1168602 - RNA, 23 nt, Mycobacterium bovis subsp bovis AF2122/97
ccagguucuucuccaccaccguc

SEQ ID NO: 1168603 - RNA, 23 nt, Mycobacterium bovis subsp bovis AF2122/97
ccagguugaagaaugccgucuga

SEQ ID NO: 1168604 - RNA, 17 nt, Mycobacterium bovis subsp bovis AF2122/97
ccagguuggagcccgag

SEQ ID NO: 1168605 - RNA, 21 nt, Mycobacterium bovis subsp bovis AF2122/97
ccagguugugauccugggugu

SEQ ID NO: 1168606 - RNA, 19 nt, Mycobacterium bovis subsp bovis AF2122/97
ccaggugggugaacgccug

SEQ ID NO: 1168607 - RNA, 22 nt, Mycobacterium bovis subsp bovis AF2122/97
ccagguguucgccggagacccg

SEQ ID NO: 1168608 - RNA, 21 nt, Mycobacterium bovis subsp bovis AF2122/97
ccaguaaaaaggcaggacuga

SEQ ID NO: 1168609 - RNA, 19 nt, Mycobacterium bovis subsp bovis AF2122/97
ccagcguguggagcucgcg

SEQ ID NO: 1168610 - RNA, 19 nt, Mycobacterium bovis subsp bovis AF2122/97
ccagcgugucuugucgcgc

SEQ ID NO: 1168611 - RNA, 22 nt, Mycobacterium bovis subsp bovis AF2122/97
ccagcguggagaucacgugccg

SEQ ID NO: 1168612 - RNA, 15 nt, Mycobacterium bovis subsp bovis AF2122/97
ccagcgugcccgcca

SEQ ID NO: 1168613 - RNA, 20 nt, Mycobacterium bovis subsp bovis AF2122/97
ccagcucgucgagcugaucc

SEQ ID NO: 1168614 - RNA, 18 nt, Mycobacterium bovis subsp bovis AF2122/97
ccagcuccucagccaccg

SEQ ID NO: 1168615 - RNA, 16 nt, Mycobacterium bovis subsp bovis AF2122/97
ccagcuccgccugccg

SEQ ID NO: 1168616 - RNA, 14 nt, Mycobacterium bovis subsp bovis AF2122/97
ccagcucacccugc

SEQ ID NO: 1168617 - RNA, 20 nt, Mycobacterium bovis subsp bovis AF2122/97
ccagcucacggacgcugggc

SEQ ID NO: 1168618 - RNA, 17 nt, Mycobacterium bovis subsp bovis AF2122/97
ccagcggccgccgcggc

SEQ ID NO: 1168619 - RNA, 15 nt, Mycobacterium bovis subsp bovis AF2122/97
ccagcggcgccacgu

SEQ ID NO: 1168620 - RNA, 17 nt, Mycobacterium bovis subsp bovis AF2122/97
ccagcggcgccacgugg

SEQ ID NO: 1168621 - RNA, 21 nt, Mycobacterium bovis subsp bovis AF2122/97
ccagcggcgccacguggucga

SEQ ID NO: 1168622 - RNA, 14 nt, Mycobacterium bovis subsp bovis AF2122/97
ccagcgguggacca

SEQ ID NO: 1168623 - RNA, 20 nt, Mycobacterium bovis subsp bovis AF2122/97
ccagcgguugccgucugcgg

SEQ ID NO: 1168624 - RNA, 17 nt, Mycobacterium bovis subsp bovis AF2122/97
ccagcgguggaccaccg

SEQ ID NO: 1168625 - RNA, 22 nt, Mycobacterium bovis subsp bovis AF2122/97
ccagcguaaauagcgcccugcc

SEQ ID NO: 1168626 - RNA, 12 nt, Mycobacterium bovis subsp bovis AF2122/97
ccagcccgccga

SEQ ID NO: 1168627 - RNA, 14 nt, Mycobacterium bovis subsp bovis AF2122/97
ccagcggccauccg

SEQ ID NO: 1168628 - RNA, 12 nt, Mycobacterium bovis subsp bovis AF2122/97
ccagcggccacc

SEQ ID NO: 1168629 - RNA, 21 nt, Mycobacterium bovis subsp bovis AF2122/97
ccagcccgaugaucccgccac

SEQ ID NO: 1168630 - RNA, 13 nt, Mycobacterium bovis subsp bovis AF2122/97
ccagccccccggc

SEQ ID NO: 1168631 - RNA, 20 nt, Mycobacterium bovis subsp bovis AF2122/97
ccagccccgcgcccaccccg

SEQ ID NO: 1168632 - RNA, 22 nt, Mycobacterium bovis subsp bovis AF2122/97
ccagccccgcgcccaccccggc

SEQ ID NO: 1168633 - RNA, 19 nt, Mycobacterium bovis subsp bovis AF2122/97
ccaggagugcgggcaugcc

SEQ ID NO: 1168634 - RNA, 17 nt, Mycobacterium bovis subsp bovis AF2122/97
ccaggaacucggcccac

SEQ ID NO: 1168635 - RNA, 17 nt, Mycobacterium bovis subsp bovis AF2122/97
ccaggacuggcaccgcc

SEQ ID NO: 1168636 - RNA, 22 nt, Mycobacterium bovis subsp bovis AF2122/97
ccaggcaaccggucagccugcc

SEQ ID NO: 1168637 - RNA, 21 nt, Mycobacterium bovis subsp bovis AF2122/97
ccaggcaagccagcacugcca

SEQ ID NO: 1168638 - RNA, 15 nt, Mycobacterium bovis subsp bovis AF2122/97
ccagcugagccgucg

SEQ ID NO: 1168639 - RNA, 20 nt, Mycobacterium bovis subsp bovis AF2122/97
ccagcugucauccccggcca

SEQ ID NO: 1168640 - RNA, 23 nt, Mycobacterium bovis subsp bovis AF2122/97
ccagcugucauccccggccagcc

SEQ ID NO: 1168641 - RNA, 19 nt, Mycobacterium bovis subsp bovis AF2122/97
ccagcuguccucgcgggcu

SEQ ID NO: 1168642 - RNA, 17 nt, Mycobacterium bovis subsp bovis AF2122/97
ccagcuugagguccguc

SEQ ID NO: 1168643 - RNA, 15 nt, Mycobacterium bovis subsp bovis AF2122/97
ccagcuugcgccgca

SEQ ID NO: 1168644 - RNA, 16 nt, Mycobacterium bovis subsp bovis AF2122/97
ccagcuugcgccgcag

SEQ ID NO: 1168645 - RNA, 19 nt, Mycobacterium bovis subsp bovis AF2122/97
ccagcuugcggagccgccg

SEQ ID NO: 1168646 - RNA, 23 nt, Mycobacterium bovis subsp bovis AF2122/97
ccagcuuggagaggcggugcagc

SEQ ID NO: 1168647 - RNA, 20 nt, Mycobacterium bovis subsp bovis AF2122/97
ccagcuugccgaccugcgcg

SEQ ID NO: 1168648 - RNA, 18 nt, Mycobacterium bovis subsp bovis AF2122/97
ccagcuguucgagccgcg

SEQ ID NO: 1168649 - RNA, 16 nt, Mycobacterium bovis subsp bovis AF2122/97
ccaguuugugccgccg

SEQ ID NO: 1168650 - RNA, 15 nt, Mycobacterium bovis subsp bovis AF2122/97
ccaguguugcgcugc

SEQ ID NO: 1168651 - RNA, 14 nt, Mycobacterium bovis subsp bovis AF2122/97
ccaguggugcaccg

SEQ ID NO: 1168652 - RNA, 20 nt, Mycobacterium bovis subsp bovis AF2122/97
ccaguggcgcccauggccac

SEQ ID NO: 1168653 - RNA, 21 nt, Mycobacterium bovis subsp bovis AF2122/97
ccaguggcgcccauggccacc

SEQ ID NO: 1168654 - RNA, 16 nt, Mycobacterium bovis subsp bovis AF2122/97
ccaguagaucgccucg

SEQ ID NO: 1168655 - RNA, 20 nt, Mycobacterium bovis subsp bovis AF2122/97
ccaguacguuggugucccac

SEQ ID NO: 1168656 - RNA, 17 nt, Mycobacterium bovis subsp bovis AF2122/97
ccaucaacaucggcccg

SEQ ID NO: 1168657 - RNA, 20 nt, Mycobacterium bovis subsp bovis AF2122/97
ccaucaacaucggcccgcug

SEQ ID NO: 1168658 - RNA, 21 nt, Mycobacterium bovis subsp bovis AF2122/97
ccaucaacauugugcucgccg

SEQ ID NO: 1168659 - RNA, 16 nt, Mycobacterium bovis subsp bovis AF2122/97
ccaucacauccacgca

SEQ ID NO: 1168660 - RNA, 13 nt, Mycobacterium bovis subsp bovis AF2122/97
ccaucaccagcgg

SEQ ID NO: 1168661 - RNA, 20 nt, Mycobacterium bovis subsp bovis AF2122/97
ccaucaccacaccggcagcu

SEQ ID NO: 1168662 - RNA, 19 nt, Mycobacterium bovis subsp bovis AF2122/97
ccaucaccaccggcaccgc

SEQ ID NO: 1168663 - RNA, 18 nt, Mycobacterium bovis subsp bovis AF2122/97
ccaucacaucggccucug

SEQ ID NO: 1168664 - RNA, 11 nt, Mycobacterium bovis subsp bovis AF2122/97
ccaucaacaag

SEQ ID NO: 1168665 - RNA, 18 nt, Mycobacterium bovis subsp bovis AF2122/97
ccauagugaggccgacca

SEQ ID NO: 1168666 - RNA, 16 nt, Mycobacterium bovis subsp bovis AF2122/97
ccauagcugccggccc

SEQ ID NO: 1168667 - RNA, 20 nt, Mycobacterium bovis subsp bovis AF2122/97
ccauaccucggcgaccuccg

SEQ ID NO: 1168668 - RNA, 14 nt, Mycobacterium bovis subsp bovis AF2122/97
ccauagaugcccgc

SEQ ID NO: 1168669 - RNA, 19 nt, Mycobacterium bovis subsp bovis AF2122/97
ccauagcaccucgaugaug

SEQ ID NO: 1168670 - RNA, 12 nt, Mycobacterium bovis subsp bovis AF2122/97
ccauagccaggu

SEQ ID NO: 1168671 - RNA, 14 nt, Mycobacterium bovis subsp bovis AF2122/97
ccaucaccgccagc

SEQ ID NO: 1168672 - RNA, 13 nt, Mycobacterium bovis subsp bovis AF2122/97
ccaucaccgccag

SEQ ID NO: 1168673 - RNA, 13 nt, Mycobacterium bovis subsp bovis AF2122/97
ccaucaccgcaag

SEQ ID NO: 1168674 - RNA, 20 nt, Mycobacterium bovis subsp bovis AF2122/97
ccaucacgacucccccggcu

SEQ ID NO: 1168675 - RNA, 12 nt, Mycobacterium bovis subsp bovis AF2122/97
ccaucacgcccu

SEQ ID NO: 1168676 - RNA, 14 nt, Mycobacterium bovis subsp bovis AF2122/97
ccaucacggucagc

SEQ ID NO: 1168677 - RNA, 18 nt, Mycobacterium bovis subsp bovis AF2122/97
ccauccggccgucgggca

SEQ ID NO: 1168678 - RNA, 21 nt, Mycobacterium bovis subsp bovis AF2122/97
ccauccggccgucgggcagca

SEQ ID NO: 1168679 - RNA, 13 nt, Mycobacterium bovis subsp bovis AF2122/97
ccaucgaccgccc

SEQ ID NO: 1168680 - RNA, 17 nt, Mycobacterium bovis subsp bovis AF2122/97
ccaucgaccgcccgcca

SEQ ID NO: 1168681 - RNA, 20 nt, Mycobacterium bovis subsp bovis AF2122/97
ccaucucggaccacaucugg

SEQ ID NO: 1168682 - RNA, 13 nt, Mycobacterium bovis subsp bovis AF2122/97
ccaucucggacca

SEQ ID NO: 1168683 - RNA, 16 nt, Mycobacterium bovis subsp bovis AF2122/97
ccaucucggaccacau

SEQ ID NO: 1168684 - RNA, 17 nt, Mycobacterium bovis subsp bovis AF2122/97
ccaucucggaccacauc

SEQ ID NO: 1168685 - RNA, 19 nt, Mycobacterium bovis subsp bovis AF2122/97
ccaucucgacgucggugaa

SEQ ID NO: 1168686 - RNA, 15 nt, Mycobacterium bovis subsp bovis AF2122/97
ccaucucgcaagggg

SEQ ID NO: 1168687 - RNA, 16 nt, Mycobacterium bovis subsp bovis AF2122/97
ccaucuaccagcucac

SEQ ID NO: 1168688 - RNA, 19 nt, Mycobacterium bovis subsp bovis AF2122/97
ccaucgcgucgucuucuuc

SEQ ID NO: 1168689 - RNA, 20 nt, Mycobacterium bovis subsp bovis AF2122/97
ccaucguucguugacucugc

SEQ ID NO: 1168690 - RNA, 20 nt, Mycobacterium bovis subsp bovis AF2122/97
ccaucguguacuggucugga

SEQ ID NO: 1168691 - RNA, 18 nt, Mycobacterium bovis subsp bovis AF2122/97
ccaucgcggcguugugac

SEQ ID NO: 1168692 - RNA, 19 nt, Mycobacterium bovis subsp bovis AF2122/97
ccaucgcgacggcaagcac

SEQ ID NO: 1168693 - RNA, 23 nt, Mycobacterium bovis subsp bovis AF2122/97
ccaucgcgacuagacgccgccgc

SEQ ID NO: 1168694 - RNA, 15 nt, Mycobacterium bovis subsp bovis AF2122/97
ccaucgcgacaucgg

SEQ ID NO: 1168695 - RNA, 14 nt, Mycobacterium bovis subsp bovis AF2122/97
ccaugaugaugaca

SEQ ID NO: 1168696 - RNA, 19 nt, Mycobacterium bovis subsp bovis AF2122/97
ccaugcacggccgagcagg

SEQ ID NO: 1168697 - RNA, 12 nt, Mycobacterium bovis subsp bovis AF2122/97
ccaugccuccag

SEQ ID NO: 1168698 - RNA, 15 nt, Mycobacterium bovis subsp bovis AF2122/97
ccaugccgggaacca

SEQ ID NO: 1168699 - RNA, 23 nt, Mycobacterium bovis subsp bovis AF2122/97
ccaugccgaauaccgguggcagc

SEQ ID NO: 1168700 - RNA, 17 nt, Mycobacterium bovis subsp bovis AF2122/97
ccaugccgaucggccug

SEQ ID NO: 1168701 - RNA, 23 nt, Mycobacterium bovis subsp bovis AF2122/97
ccaugcccgugggugcgucuggg

SEQ ID NO: 1168702 - RNA, 18 nt, Mycobacterium bovis subsp bovis AF2122/97
ccaugccacaacgccucg

SEQ ID NO: 1168703 - RNA, 15 nt, Mycobacterium bovis subsp bovis AF2122/97
ccaugcccgcacgcu

SEQ ID NO: 1168704 - RNA, 20 nt, Mycobacterium bovis subsp bovis AF2122/97
ccaugagcgcgcccaaccug

SEQ ID NO: 1168705 - RNA, 18 nt, Mycobacterium bovis subsp bovis AF2122/97
ccaugaacucgaacuggg

SEQ ID NO: 1168706 - RNA, 21 nt, Mycobacterium bovis subsp bovis AF2122/97
ccaugaagaacuggcugcugu

SEQ ID NO: 1168707 - RNA, 16 nt, Mycobacterium bovis subsp bovis AF2122/97
ccaugaaggagauccc

SEQ ID NO: 1168708 - RNA, 15 nt, Mycobacterium bovis subsp bovis AF2122/97
ccaucugccugccug

SEQ ID NO: 1168709 - RNA, 20 nt, Mycobacterium bovis subsp bovis AF2122/97
ccaucuggcugagcagacug

SEQ ID NO: 1168710 - RNA, 14 nt, Mycobacterium bovis subsp bovis AF2122/97
ccauggcacugccg

SEQ ID NO: 1168711 - RNA, 13 nt, Mycobacterium bovis subsp bovis AF2122/97
ccauggcagcgcc

SEQ ID NO: 1168712 - RNA, 16 nt, Mycobacterium bovis subsp bovis AF2122/97
ccaugcuucggagacc

SEQ ID NO: 1168713 - RNA, 17 nt, Mycobacterium bovis subsp bovis AF2122/97
ccaugcuaggaccacca

SEQ ID NO: 1168714 - RNA, 23 nt, Mycobacterium bovis subsp bovis AF2122/97
ccaugcuaggaccaccagcgcuc

SEQ ID NO: 1168715 - RNA, 20 nt, Mycobacterium bovis subsp bovis AF2122/97
ccaugcgguuagcagccgcu

SEQ ID NO: 1168716 - RNA, 17 nt, Mycobacterium bovis subsp bovis AF2122/97
ccaugcgguuagcagcc

SEQ ID NO: 1168717 - RNA, 18 nt, Mycobacterium bovis subsp bovis AF2122/97
ccaugcgcaccaguccag

SEQ ID NO: 1168718 - RNA, 23 nt, Mycobacterium bovis subsp bovis AF2122/97
ccaugcggaauuugcuugggccc

SEQ ID NO: 1168719 - RNA, 21 nt, Mycobacterium bovis subsp bovis AF2122/97
ccaugcggguaaaccaggugg

SEQ ID NO: 1168720 - RNA, 18 nt, Mycobacterium bovis subsp bovis AF2122/97
ccaugcggcaggugccca

SEQ ID NO: 1168721 - RNA, 20 nt, Mycobacterium bovis subsp bovis AF2122/97
ccauggucgcgccacccgcg

SEQ ID NO: 1168722 - RNA, 12 nt, Mycobacterium bovis subsp bovis AF2122/97
ccauggugggcc

SEQ ID NO: 1168723 - RNA, 17 nt, Mycobacterium bovis subsp bovis AF2122/97
ccaugggucuggcaggc

SEQ ID NO: 1168724 - RNA, 22 nt, Mycobacterium bovis subsp bovis AF2122/97
ccaugggucuggcaggccagca

SEQ ID NO: 1168725 - RNA, 14 nt, Mycobacterium bovis subsp bovis AF2122/97
ccauggcccgcucg

SEQ ID NO: 1168726 - RNA, 16 nt, Mycobacterium bovis subsp bovis AF2122/97
ccauggcgccgcgccg

SEQ ID NO: 1168727 - RNA, 12 nt, Mycobacterium bovis subsp bovis AF2122/97
ccaugucggcca

SEQ ID NO: 1168728 - RNA, 22 nt, Mycobacterium bovis subsp bovis AF2122/97
ccauguugaagcgaagccagau

SEQ ID NO: 1168729 - RNA, 17 nt, Mycobacterium bovis subsp bovis AF2122/97
ccaugugucccggacca

SEQ ID NO: 1168730 - RNA, 12 nt, Mycobacterium bovis subsp bovis AF2122/97
ccauguguuuga

SEQ ID NO: 1168731 - RNA, 17 nt, Mycobacterium bovis subsp bovis AF2122/97
ccauuccggucagguac

SEQ ID NO: 1168732 - RNA, 19 nt, Mycobacterium bovis subsp bovis AF2122/97
ccauucccggacccaccaa

SEQ ID NO: 1168733 - RNA, 17 nt, Mycobacterium bovis subsp bovis AF2122/97
ccauucccaacacagcc

SEQ ID NO: 1168734 - RNA, 18 nt, Mycobacterium bovis subsp bovis AF2122/97
ccauugcgaacucgcugc

SEQ ID NO: 1168735 - RNA, 13 nt, Mycobacterium bovis subsp bovis AF2122/97
ccauugccucccg

SEQ ID NO: 1168736 - RNA, 16 nt, Mycobacterium bovis subsp bovis AF2122/97
ccauucuuggugaucg

SEQ ID NO: 1168737 - RNA, 15 nt, Mycobacterium bovis subsp bovis AF2122/97
ccauuggcgccgccg

SEQ ID NO: 1168738 - RNA, 14 nt, Mycobacterium bovis subsp bovis AF2122/97
ccauuggcgccguc

SEQ ID NO: 1168739 - RNA, 17 nt, Mycobacterium bovis subsp bovis AF2122/97
ccauucacgagccgcuc

SEQ ID NO: 1168740 - RNA, 17 nt, Mycobacterium bovis subsp bovis AF2122/97
ccauuaccgugggugga

SEQ ID NO: 1168741 - RNA, 14 nt, Mycobacterium bovis subsp bovis AF2122/97
cccacucgcagcag

SEQ ID NO: 1168742 - RNA, 21 nt, Mycobacterium bovis subsp bovis AF2122/97
cccacucggacccgcaauucc

SEQ ID NO: 1168743 - RNA, 13 nt, Mycobacterium bovis subsp bovis AF2122/97
cccacgcacagca

SEQ ID NO: 1168744 - RNA, 19 nt, Mycobacterium bovis subsp bovis AF2122/97
cccacgcacagcaacgccc

SEQ ID NO: 1168745 - RNA, 13 nt, Mycobacterium bovis subsp bovis AF2122/97
cccacgaauccca

SEQ ID NO: 1168746 - RNA, 14 nt, Mycobacterium bovis subsp bovis AF2122/97
cccacgagagcgcu

SEQ ID NO: 1168747 - RNA, 14 nt, Mycobacterium bovis subsp bovis AF2122/97
cccacgaucagcag

SEQ ID NO: 1168748 - RNA, 21 nt, Mycobacterium bovis subsp bovis AF2122/97
cccaccgacauguguggcagc

SEQ ID NO: 1168749 - RNA, 18 nt, Mycobacterium bovis subsp bovis AF2122/97
cccacuggugcagcgccg

SEQ ID NO: 1168750 - RNA, 14 nt, Mycobacterium bovis subsp bovis AF2122/97
cccacugggccggu

SEQ ID NO: 1168751 - RNA, 22 nt, Mycobacterium bovis subsp bovis AF2122/97
cccacugccgugccgguguguc

SEQ ID NO: 1168752 - RNA, 23 nt, Mycobacterium bovis subsp bovis AF2122/97
cccacugccgugccggugugucc

SEQ ID NO: 1168753 - RNA, 15 nt, Mycobacterium bovis subsp bovis AF2122/97
cccacugccacuccu

SEQ ID NO: 1168754 - RNA, 17 nt, Mycobacterium bovis subsp bovis AF2122/97
cccagagaaucagcgug

SEQ ID NO: 1168755 - RNA, 13 nt, Mycobacterium bovis subsp bovis AF2122/97
cccagagcugguc

SEQ ID NO: 1168756 - RNA, 24 nt, Mycobacterium bovis subsp bovis AF2122/97
cccagaccgccgacgccguugccc

SEQ ID NO: 1168757 - RNA, 22 nt, Mycobacterium bovis subsp bovis AF2122/97
cccagaccgccgaagaagguga

SEQ ID NO: 1168758 - RNA, 19 nt, Mycobacterium bovis subsp bovis AF2122/97
cccagcaaaggggugugug

SEQ ID NO: 1168759 - RNA, 21 nt, Mycobacterium bovis subsp bovis AF2122/97
cccagauugcccaacacccac

SEQ ID NO: 1168760 - RNA, 18 nt, Mycobacterium bovis subsp bovis AF2122/97
cccagcacacccccgucu

SEQ ID NO: 1168761 - RNA, 17 nt, Mycobacterium bovis subsp bovis AF2122/97
cccagcacaaccagcug

SEQ ID NO: 1168762 - RNA, 15 nt, Mycobacterium bovis subsp bovis AF2122/97
cccagauacccgcgu

SEQ ID NO: 1168763 - RNA, 19 nt, Mycobacterium bovis subsp bovis AF2122/97
cccagaugcagcgguccag

SEQ ID NO: 1168764 - RNA, 18 nt, Mycobacterium bovis subsp bovis AF2122/97
cccagaucggcgacgccg

SEQ ID NO: 1168765 - RNA, 19 nt, Mycobacterium bovis subsp bovis AF2122/97
cccagaucuugcagugcgc

SEQ ID NO: 1168766 - RNA, 15 nt, Mycobacterium bovis subsp bovis AF2122/97
cccagauccgcagcg

SEQ ID NO: 1168767 - RNA, 16 nt, Mycobacterium bovis subsp bovis AF2122/97
cccagauccgcagcgu

SEQ ID NO: 1168768 - RNA, 18 nt, Mycobacterium bovis subsp bovis AF2122/97
cccacagucgccggccgg

SEQ ID NO: 1168769 - RNA, 20 nt, Mycobacterium bovis subsp bovis AF2122/97
cccacagguuugcgccgcgc

SEQ ID NO: 1168770 - RNA, 15 nt, Mycobacterium bovis subsp bovis AF2122/97
cccacaacaugcugg

SEQ ID NO: 1168771 - RNA, 17 nt, Mycobacterium bovis subsp bovis AF2122/97
cccacaggggcagcgcg

SEQ ID NO: 1168772 - RNA, 13 nt, Mycobacterium bovis subsp bovis AF2122/97
cccaaugcgggcu

SEQ ID NO: 1168773 - RNA, 22 nt, Mycobacterium bovis subsp bovis AF2122/97
cccaaucgggaucgcugccagc

SEQ ID NO: 1168774 - RNA, 21 nt, Mycobacterium bovis subsp bovis AF2122/97
cccaauucacgacgccgagca

SEQ ID NO: 1168775 - RNA, 21 nt, Mycobacterium bovis subsp bovis AF2122/97
cccaccgaagcggugacccac

SEQ ID NO: 1168776 - RNA, 13 nt, Mycobacterium bovis subsp bovis AF2122/97
cccacccgccgcc

SEQ ID NO: 1168777 - RNA, 19 nt, Mycobacterium bovis subsp bovis AF2122/97
cccacccucggguccaacc

SEQ ID NO: 1168778 - RNA, 18 nt, Mycobacterium bovis subsp bovis AF2122/97
cccacccgcaccaccggc

SEQ ID NO: 1168779 - RNA, 15 nt, Mycobacterium bovis subsp bovis AF2122/97
cccacccgcaccgcc

SEQ ID NO: 1168780 - RNA, 16 nt, Mycobacterium bovis subsp bovis AF2122/97
cccacccgcaccgccg

SEQ ID NO: 1168781 - RNA, 22 nt, Mycobacterium bovis subsp bovis AF2122/97
cccacccagcgacucggccagg

SEQ ID NO: 1168782 - RNA, 20 nt, Mycobacterium bovis subsp bovis AF2122/97
cccaccccccagcgccgccg

SEQ ID NO: 1168783 - RNA, 21 nt, Mycobacterium bovis subsp bovis AF2122/97
cccacccccgguucaccuccc

SEQ ID NO: 1168784 - RNA, 22 nt, Mycobacterium bovis subsp bovis AF2122/97
cccacauggcccggaggccgcu

SEQ ID NO: 1168785 - RNA, 18 nt, Mycobacterium bovis subsp bovis AF2122/97
cccaagccugccgaaccc

SEQ ID NO: 1168786 - RNA, 20 nt, Mycobacterium bovis subsp bovis AF2122/97
cccaagcgugcugccgccuu

SEQ ID NO: 1168787 - RNA, 21 nt, Mycobacterium bovis subsp bovis AF2122/97
cccaagcccgauucagcgccc

SEQ ID NO: 1168788 - RNA, 13 nt, Mycobacterium bovis subsp bovis AF2122/97
cccaaggccagga

SEQ ID NO: 1168789 - RNA, 15 nt, Mycobacterium bovis subsp bovis AF2122/97
cccaaucgaccgccc

SEQ ID NO: 1168790 - RNA, 23 nt, Mycobacterium bovis subsp bovis AF2122/97
cccaacgcgguaaagccccgcuc

SEQ ID NO: 1168791 - RNA, 16 nt, Mycobacterium bovis subsp bovis AF2122/97
cccaacgcggugggca

SEQ ID NO: 1168792 - RNA, 20 nt, Mycobacterium bovis subsp bovis AF2122/97
cccaacgacggcaacagcca

SEQ ID NO: 1168793 - RNA, 15 nt, Mycobacterium bovis subsp bovis AF2122/97
cccaacgaccaccac

SEQ ID NO: 1168794 - RNA, 13 nt, Mycobacterium bovis subsp bovis AF2122/97
ccccgaaccgcgc

SEQ ID NO: 1168795 - RNA, 17 nt, Mycobacterium bovis subsp bovis AF2122/97
ccccgaacauccgccgc

SEQ ID NO: 1168796 - RNA, 17 nt, Mycobacterium bovis subsp bovis AF2122/97
cccccuuuacaccccca

SEQ ID NO: 1168797 - RNA, 12 nt, Mycobacterium bovis subsp bovis AF2122/97
cccccugccaca

SEQ ID NO: 1168798 - RNA, 16 nt, Mycobacterium bovis subsp bovis AF2122/97
ccccgaccgccaccgc

SEQ ID NO: 1168799 - RNA, 17 nt, Mycobacterium bovis subsp bovis AF2122/97
ccccggaacgaccccac

SEQ ID NO: 1168800 - RNA, 22 nt, Mycobacterium bovis subsp bovis AF2122/97
ccccggcaaccgggaucugcuc

SEQ ID NO: 1168801 - RNA, 17 nt, Mycobacterium bovis subsp bovis AF2122/97
ccccgacggacuccggc

SEQ ID NO: 1168802 - RNA, 18 nt, Mycobacterium bovis subsp bovis AF2122/97
ccccgaccgccguggccg

SEQ ID NO: 1168803 - RNA, 13 nt, Mycobacterium bovis subsp bovis AF2122/97
ccccgaccgccac

SEQ ID NO: 1168804 - RNA, 19 nt, Mycobacterium bovis subsp bovis AF2122/97
ccccgaacauccgccgccc

SEQ ID NO: 1168805 - RNA, 19 nt, Mycobacterium bovis subsp bovis AF2122/97
ccccggcccgaucggcaac

SEQ ID NO: 1168806 - RNA, 12 nt, Mycobacterium bovis subsp bovis AF2122/97
ccccggccacca

SEQ ID NO: 1168807 - RNA, 14 nt, Mycobacterium bovis subsp bovis AF2122/97
ccccggccagccuc

SEQ ID NO: 1168808 - RNA, 13 nt, Mycobacterium bovis subsp bovis AF2122/97
ccccggccaggac

SEQ ID NO: 1168809 - RNA, 12 nt, Mycobacterium bovis subsp bovis AF2122/97
ccccggccggcu

SEQ ID NO: 1168810 - RNA, 18 nt, Mycobacterium bovis subsp bovis AF2122/97
ccccggccccgacgguca

SEQ ID NO: 1168811 - RNA, 14 nt, Mycobacterium bovis subsp bovis AF2122/97
ccccggccuugcca

SEQ ID NO: 1168812 - RNA, 18 nt, Mycobacterium bovis subsp bovis AF2122/97
ccccggcgacggcguagc

SEQ ID NO: 1168813 - RNA, 18 nt, Mycobacterium bovis subsp bovis AF2122/97
ccccggcugccagcgccg

SEQ ID NO: 1168814 - RNA, 17 nt, Mycobacterium bovis subsp bovis AF2122/97
ccccguaggcgccgaac

SEQ ID NO: 1168815 - RNA, 23 nt, Mycobacterium bovis subsp bovis AF2122/97
ccccguaggugcacaacccgugc

SEQ ID NO: 1168816 - RNA, 22 nt, Mycobacterium bovis subsp bovis AF2122/97
ccccguagauggugguggcccg

SEQ ID NO: 1168817 - RNA, 17 nt, Mycobacterium bovis subsp bovis AF2122/97
ccccgucagcgggcagc

SEQ ID NO: 1168818 - RNA, 22 nt, Mycobacterium bovis subsp bovis AF2122/97
ccccgguugaucuuguccuccg

SEQ ID NO: 1168819 - RNA, 17 nt, Mycobacterium bovis subsp bovis AF2122/97
ccccgucgaccuccacc

SEQ ID NO: 1168820 - RNA, 15 nt, Mycobacterium bovis subsp bovis AF2122/97
ccccggucccgccga

SEQ ID NO: 1168821 - RNA, 19 nt, Mycobacterium bovis subsp bovis AF2122/97
ccccgguugacucgcuccg

SEQ ID NO: 1168822 - RNA, 21 nt, Mycobacterium bovis subsp bovis AF2122/97
ccccggucggcgacguauacc

SEQ ID NO: 1168823 - RNA, 16 nt, Mycobacterium bovis subsp bovis AF2122/97
ccccggugccgcccgc

SEQ ID NO: 1168824 - RNA, 15 nt, Mycobacterium bovis subsp bovis AF2122/97
ccccucccaccagcg

SEQ ID NO: 1168825 - RNA, 18 nt, Mycobacterium bovis subsp bovis AF2122/97
ccccuccgaucacgcugu

SEQ ID NO: 1168826 - RNA, 17 nt, Mycobacterium bovis subsp bovis AF2122/97
ccccugcgguccgcugc

SEQ ID NO: 1168827 - RNA, 20 nt, Mycobacterium bovis subsp bovis AF2122/97
ccccagggagugccgcacga

SEQ ID NO: 1168828 - RNA, 17 nt, Mycobacterium bovis subsp bovis AF2122/97
ccccagggggcgugccg

SEQ ID NO: 1168829 - RNA, 15 nt, Mycobacterium bovis subsp bovis AF2122/97
ccccagguagugcac

SEQ ID NO: 1168830 - RNA, 12 nt, Mycobacterium bovis subsp bovis AF2122/97
ccccaguucggc

SEQ ID NO: 1168831 - RNA, 11 nt, Mycobacterium bovis subsp bovis AF2122/97
ccccaggcacc

SEQ ID NO: 1168832 - RNA, 19 nt, Mycobacterium bovis subsp bovis AF2122/97
ccccagcugcggucgcggc

SEQ ID NO: 1168833 - RNA, 13 nt, Mycobacterium bovis subsp bovis AF2122/97
ccccagcgacggc

SEQ ID NO: 1168834 - RNA, 15 nt, Mycobacterium bovis subsp bovis AF2122/97
ccccagcgccgccgc

SEQ ID NO: 1168835 - RNA, 13 nt, Mycobacterium bovis subsp bovis AF2122/97
ccccagccgcggc

SEQ ID NO: 1168836 - RNA, 13 nt, Mycobacterium bovis subsp bovis AF2122/97
ccccagccaugcu

SEQ ID NO: 1168837 - RNA, 12 nt, Mycobacterium bovis subsp bovis AF2122/97
ccccagccccac

SEQ ID NO: 1168838 - RNA, 16 nt, Mycobacterium bovis subsp bovis AF2122/97
cccauuugccuugagc

SEQ ID NO: 1168839 - RNA, 12 nt, Mycobacterium bovis subsp bovis AF2122/97
cccauugccgcc

SEQ ID NO: 1168840 - RNA, 13 nt, Mycobacterium bovis subsp bovis AF2122/97
cccauugccgccg

SEQ ID NO: 1168841 - RNA, 16 nt, Mycobacterium bovis subsp bovis AF2122/97
cccauugccgccgucg

SEQ ID NO: 1168842 - RNA, 18 nt, Mycobacterium bovis subsp bovis AF2122/97
cccauucucggccggcgg

SEQ ID NO: 1168843 - RNA, 15 nt, Mycobacterium bovis subsp bovis AF2122/97
cccccggugccgccc

SEQ ID NO: 1168844 - RNA, 20 nt, Mycobacterium bovis subsp bovis AF2122/97
cccccggguagaccaccugc

SEQ ID NO: 1168845 - RNA, 15 nt, Mycobacterium bovis subsp bovis AF2122/97
cccccggcgcggcgg

SEQ ID NO: 1168846 - RNA, 22 nt, Mycobacterium bovis subsp bovis AF2122/97
cccccgggugcgggugggacac

SEQ ID NO: 1168847 - RNA, 22 nt, Mycobacterium bovis subsp bovis AF2122/97
cccccggauuccagcagccugc

SEQ ID NO: 1168848 - RNA, 17 nt, Mycobacterium bovis subsp bovis AF2122/97
cccccggcaccgccggc

SEQ ID NO: 1168849 - RNA, 13 nt, Mycobacterium bovis subsp bovis AF2122/97
cccccgggcccgc

SEQ ID NO: 1168850 - RNA, 19 nt, Mycobacterium bovis subsp bovis AF2122/97
cccccggcaccgccggcuc

SEQ ID NO: 1168851 - RNA, 17 nt, Mycobacterium bovis subsp bovis AF2122/97
ccccauugccgucgcgg

SEQ ID NO: 1168852 - RNA, 14 nt, Mycobacterium bovis subsp bovis AF2122/97
ccccauugcgcccc

SEQ ID NO: 1168853 - RNA, 16 nt, Mycobacterium bovis subsp bovis AF2122/97
cccccaagcucugcgu

SEQ ID NO: 1168854 - RNA, 21 nt, Mycobacterium bovis subsp bovis AF2122/97
ccccaguugugcggccaggcg

SEQ ID NO: 1168855 - RNA, 16 nt, Mycobacterium bovis subsp bovis AF2122/97
ccccauacucggcggc

SEQ ID NO: 1168856 - RNA, 20 nt, Mycobacterium bovis subsp bovis AF2122/97
ccccauacucggcggcuucg

SEQ ID NO: 1168857 - RNA, 17 nt, Mycobacterium bovis subsp bovis AF2122/97
ccccaucaccaccggca

SEQ ID NO: 1168858 - RNA, 21 nt, Mycobacterium bovis subsp bovis AF2122/97
ccccaucagaaugccuggccc

SEQ ID NO: 1168859 - RNA, 18 nt, Mycobacterium bovis subsp bovis AF2122/97
ccccaucgcaucucgcag

SEQ ID NO: 1168860 - RNA, 14 nt, Mycobacterium bovis subsp bovis AF2122/97
ccccaugaccggga

SEQ ID NO: 1168861 - RNA, 20 nt, Mycobacterium bovis subsp bovis AF2122/97
cccaggcgcugccgguguug

SEQ ID NO: 1168862 - RNA, 19 nt, Mycobacterium bovis subsp bovis AF2122/97
cccaggcgcucagcgcggc

SEQ ID NO: 1168863 - RNA, 19 nt, Mycobacterium bovis subsp bovis AF2122/97
cccaggugcguccaggcca

SEQ ID NO: 1168864 - RNA, 13 nt, Mycobacterium bovis subsp bovis AF2122/97
cccaggugggcag

SEQ ID NO: 1168865 - RNA, 14 nt, Mycobacterium bovis subsp bovis AF2122/97
cccaggugggcagc

SEQ ID NO: 1168866 - RNA, 18 nt, Mycobacterium bovis subsp bovis AF2122/97
cccaggugguucaaccgg

SEQ ID NO: 1168867 - RNA, 17 nt, Mycobacterium bovis subsp bovis AF2122/97
cccagguguguggcggc

SEQ ID NO: 1168868 - RNA, 19 nt, Mycobacterium bovis subsp bovis AF2122/97
cccagguguguggcggcgu

SEQ ID NO: 1168869 - RNA, 20 nt, Mycobacterium bovis subsp bovis AF2122/97
cccagguuggagcccgagcu

SEQ ID NO: 1168870 - RNA, 17 nt, Mycobacterium bovis subsp bovis AF2122/97
cccaguaaguccucgau

SEQ ID NO: 1168871 - RNA, 21 nt, Mycobacterium bovis subsp bovis AF2122/97
cccagucccaacacggcgaca

SEQ ID NO: 1168872 - RNA, 13 nt, Mycobacterium bovis subsp bovis AF2122/97
cccaguccaggac

SEQ ID NO: 1168873 - RNA, 19 nt, Mycobacterium bovis subsp bovis AF2122/97
cccaguccgaagcugcugc

SEQ ID NO: 1168874 - RNA, 20 nt, Mycobacterium bovis subsp bovis AF2122/97
cccaguccgaagcugcugcu

SEQ ID NO: 1168875 - RNA, 17 nt, Mycobacterium bovis subsp bovis AF2122/97
cccaguauaauucgaga

SEQ ID NO: 1168876 - RNA, 14 nt, Mycobacterium bovis subsp bovis AF2122/97
cccagucgcggcgc

SEQ ID NO: 1168877 - RNA, 16 nt, Mycobacterium bovis subsp bovis AF2122/97
cccagucggcgccgcc

SEQ ID NO: 1168878 - RNA, 17 nt, Mycobacterium bovis subsp bovis AF2122/97
cccagucggcgccgccg

SEQ ID NO: 1168879 - RNA, 22 nt, Mycobacterium bovis subsp bovis AF2122/97
cccagucggcgccgccguccag

SEQ ID NO: 1168880 - RNA, 16 nt, Mycobacterium bovis subsp bovis AF2122/97
cccagugccagaaccc

SEQ ID NO: 1168881 - RNA, 22 nt, Mycobacterium bovis subsp bovis AF2122/97
cccagcaucuuuggcggccgca

SEQ ID NO: 1168882 - RNA, 21 nt, Mycobacterium bovis subsp bovis AF2122/97
cccagcucgcgcacccagccc

SEQ ID NO: 1168883 - RNA, 16 nt, Mycobacterium bovis subsp bovis AF2122/97
cccagccccacccgcc

SEQ ID NO: 1168884 - RNA, 15 nt, Mycobacterium bovis subsp bovis AF2122/97
cccagcugaccagcg

SEQ ID NO: 1168885 - RNA, 15 nt, Mycobacterium bovis subsp bovis AF2122/97
cccagcugaccugaa

SEQ ID NO: 1168886 - RNA, 23 nt, Mycobacterium bovis subsp bovis AF2122/97
cccagcccaugucgagcacgcca

SEQ ID NO: 1168887 - RNA, 21 nt, Mycobacterium bovis subsp bovis AF2122/97
cccagccagcagcggcgagcc

SEQ ID NO: 1168888 - RNA, 22 nt, Mycobacterium bovis subsp bovis AF2122/97
cccaggacuccggccgcacgcc

SEQ ID NO: 1168889 - RNA, 17 nt, Mycobacterium bovis subsp bovis AF2122/97
cccaggagcaccucgaa

SEQ ID NO: 1168890 - RNA, 18 nt, Mycobacterium bovis subsp bovis AF2122/97
cccaggaaggcgacgccg

SEQ ID NO: 1168891 - RNA, 12 nt, Mycobacterium bovis subsp bovis AF2122/97
cccaggacaccu

SEQ ID NO: 1168892 - RNA, 14 nt, Mycobacterium bovis subsp bovis AF2122/97
cccaggacaccuug

SEQ ID NO: 1168893 - RNA, 19 nt, Mycobacterium bovis subsp bovis AF2122/97
cccaggacagcagccgccg

SEQ ID NO: 1168894 - RNA, 17 nt, Mycobacterium bovis subsp bovis AF2122/97
cccaggaacgggacgcc

SEQ ID NO: 1168895 - RNA, 17 nt, Mycobacterium bovis subsp bovis AF2122/97
cccagcugucauccccg

SEQ ID NO: 1168896 - RNA, 21 nt, Mycobacterium bovis subsp bovis AF2122/97
cccagcuuucgcgucacccgg

SEQ ID NO: 1168897 - RNA, 12 nt, Mycobacterium bovis subsp bovis AF2122/97
cccagcugcgcc

SEQ ID NO: 1168898 - RNA, 13 nt, Mycobacterium bovis subsp bovis AF2122/97
cccaucgcgucgg

SEQ ID NO: 1168899 - RNA, 15 nt, Mycobacterium bovis subsp bovis AF2122/97
cccaucgggcgccca

SEQ ID NO: 1168900 - RNA, 17 nt, Mycobacterium bovis subsp bovis AF2122/97
cccaucgucgagccgcc

SEQ ID NO: 1168901 - RNA, 19 nt, Mycobacterium bovis subsp bovis AF2122/97
cccaucuaccagcucaccc

SEQ ID NO: 1168902 - RNA, 23 nt, Mycobacterium bovis subsp bovis AF2122/97
cccauccccgguucugcgcccac

SEQ ID NO: 1168903 - RNA, 16 nt, Mycobacterium bovis subsp bovis AF2122/97
cccaucgaccgcccgc

SEQ ID NO: 1168904 - RNA, 15 nt, Mycobacterium bovis subsp bovis AF2122/97
cccaucaccaccggc

SEQ ID NO: 1168905 - RNA, 14 nt, Mycobacterium bovis subsp bovis AF2122/97
cccaucaccagcgg

SEQ ID NO: 1168906 - RNA, 19 nt, Mycobacterium bovis subsp bovis AF2122/97
cccaucacccuguuugccc

SEQ ID NO: 1168907 - RNA, 15 nt, Mycobacterium bovis subsp bovis AF2122/97
cccaucaccgccagc

SEQ ID NO: 1168908 - RNA, 20 nt, Mycobacterium bovis subsp bovis AF2122/97
cccagugcgcaacccagccg

SEQ ID NO: 1168909 - RNA, 15 nt, Mycobacterium bovis subsp bovis AF2122/97
cccagugggacaggu

SEQ ID NO: 1168910 - RNA, 18 nt, Mycobacterium bovis subsp bovis AF2122/97
cccaguucguugguguug

SEQ ID NO: 1168911 - RNA, 13 nt, Mycobacterium bovis subsp bovis AF2122/97
cccaguucugcag

SEQ ID NO: 1168912 - RNA, 16 nt, Mycobacterium bovis subsp bovis AF2122/97
cccauacgugccgccg

SEQ ID NO: 1168913 - RNA, 13 nt, Mycobacterium bovis subsp bovis AF2122/97
cagcguucccgcc

SEQ ID NO: 1168914 - RNA, 14 nt, Mycobacterium bovis subsp bovis AF2122/97
cagcguuggccgcu

SEQ ID NO: 1168915 - RNA, 21 nt, Mycobacterium bovis subsp bovis AF2122/97
cagcguugucggguggcugcu

SEQ ID NO: 1168916 - RNA, 23 nt, Mycobacterium bovis subsp bovis AF2122/97
cagcguugucggguggcugcugg

SEQ ID NO: 1168917 - RNA, 14 nt, Mycobacterium bovis subsp bovis AF2122/97
cagcgugcccgcca

SEQ ID NO: 1168918 - RNA, 22 nt, Mycobacterium bovis subsp bovis AF2122/97
cagcguguaguggcccgcgggc

SEQ ID NO: 1168919 - RNA, 23 nt, Mycobacterium bovis subsp bovis AF2122/97
cagcguguggagcucgcggcgca

SEQ ID NO: 1168920 - RNA, 22 nt, Mycobacterium bovis subsp bovis AF2122/97
cagcgugucuugucgcgcagca

SEQ ID NO: 1168921 - RNA, 14 nt, Mycobacterium bovis subsp bovis AF2122/97
cagcuaauaccugc

SEQ ID NO: 1168922 - RNA, 16 nt, Mycobacterium bovis subsp bovis AF2122/97
cagcgugagugcagca

SEQ ID NO: 1168923 - RNA, 18 nt, Mycobacterium bovis subsp bovis AF2122/97
cagcgugaucuggccacg

SEQ ID NO: 1168924 - RNA, 12 nt, Mycobacterium bovis subsp bovis AF2122/97
cagcgugaacug

SEQ ID NO: 1168925 - RNA, 17 nt, Mycobacterium bovis subsp bovis AF2122/97
cagcguggggccgccac

SEQ ID NO: 1168926 - RNA, 13 nt, Mycobacterium bovis subsp bovis AF2122/97
cagcgugcccgcc

SEQ ID NO: 1168927 - RNA, 19 nt, Mycobacterium bovis subsp bovis AF2122/97
cagcguggacgcccgcccg

SEQ ID NO: 1168928 - RNA, 23 nt, Mycobacterium bovis subsp bovis AF2122/97
cagcgugcggggcgccugaugcg

SEQ ID NO: 1168929 - RNA, 21 nt, Mycobacterium bovis subsp bovis AF2122/97
cagcgucgcaaggcccgcacc

SEQ ID NO: 1168930 - RNA, 17 nt, Mycobacterium bovis subsp bovis AF2122/97
cagcguccagcgccugc

SEQ ID NO: 1168931 - RNA, 13 nt, Mycobacterium bovis subsp bovis AF2122/97
cagcgucggcgca

SEQ ID NO: 1168932 - RNA, 14 nt, Mycobacterium bovis subsp bovis AF2122/97
cagcgucucgccgg

SEQ ID NO: 1168933 - RNA, 17 nt, Mycobacterium bovis subsp bovis AF2122/97
cagcgucucggaggcga

SEQ ID NO: 1168934 - RNA, 14 nt, Mycobacterium bovis subsp bovis AF2122/97
cagcgucuccuuga

SEQ ID NO: 1168935 - RNA, 18 nt, Mycobacterium bovis subsp bovis AF2122/97
cagcgggucgccgggccc

SEQ ID NO: 1168936 - RNA, 17 nt, Mycobacterium bovis subsp bovis AF2122/97
cagcgggugagagaaaa

SEQ ID NO: 1168937 - RNA, 20 nt, Mycobacterium bovis subsp bovis AF2122/97
cagcggguucaacgcgcgca

SEQ ID NO: 1168938 - RNA, 20 nt, Mycobacterium bovis subsp bovis AF2122/97
cagcggguugcggucaccgg

SEQ ID NO: 1168939 - RNA, 18 nt, Mycobacterium bovis subsp bovis AF2122/97
cagcgguccagccaccgc

SEQ ID NO: 1168940 - RNA, 13 nt, Mycobacterium bovis subsp bovis AF2122/97
cagcggucagccg

SEQ ID NO: 1168941 - RNA, 16 nt, Mycobacterium bovis subsp bovis AF2122/97
cagcgguaucccccag

SEQ ID NO: 1168942 - RNA, 17 nt, Mycobacterium bovis subsp bovis AF2122/97
cagcgggccgaagcccc

SEQ ID NO: 1168943 - RNA, 19 nt, Mycobacterium bovis subsp bovis AF2122/97
cagcgggcauaacccgcac

SEQ ID NO: 1168944 - RNA, 18 nt, Mycobacterium bovis subsp bovis AF2122/97
cagcgggccacugagcca

SEQ ID NO: 1168945 - RNA, 14 nt, Mycobacterium bovis subsp bovis AF2122/97
cagcgggcgcgcua

SEQ ID NO: 1168946 - RNA, 21 nt, Mycobacterium bovis subsp bovis AF2122/97
cagcgggacugcggaagccac

SEQ ID NO: 1168947 - RNA, 21 nt, Mycobacterium bovis subsp bovis AF2122/97
cagcgggacauccagugcggu

SEQ ID NO: 1168948 - RNA, 20 nt, Mycobacterium bovis subsp bovis AF2122/97
cacugaggagaugagcacca

SEQ ID NO: 1168949 - RNA, 21 nt, Mycobacterium bovis subsp bovis AF2122/97
cacugaggagaugagcaccaa

SEQ ID NO: 1168950 - RNA, 22 nt, Mycobacterium bovis subsp bovis AF2122/97
cacugaggagaugagcaccaaa

SEQ ID NO: 1168951 - RNA, 19 nt, Mycobacterium bovis subsp bovis AF2122/97
cagcguaucggccggcaga

SEQ ID NO: 1168952 - RNA, 13 nt, Mycobacterium bovis subsp bovis AF2122/97
cagcgucagcugu

SEQ ID NO: 1168953 - RNA, 17 nt, Mycobacterium bovis subsp bovis AF2122/97
cagcguccgaaccaccu

SEQ ID NO: 1168954 - RNA, 18 nt, Mycobacterium bovis subsp bovis AF2122/97
cagcguccagccgcccuc

SEQ ID NO: 1168955 - RNA, 19 nt, Mycobacterium bovis subsp bovis AF2122/97
cagcguccagccgcccucg

SEQ ID NO: 1168956 - RNA, 17 nt, Mycobacterium bovis subsp bovis AF2122/97
cagcgucaucccgaugu

SEQ ID NO: 1168957 - RNA, 23 nt, Mycobacterium bovis subsp bovis AF2122/97
cagcgguucggugaucgggcagc

SEQ ID NO: 1168958 - RNA, 19 nt, Mycobacterium bovis subsp bovis AF2122/97
cagcgguugaugcggccgc

SEQ ID NO: 1168959 - RNA, 13 nt, Mycobacterium bovis subsp bovis AF2122/97
cagcggugcuggu

SEQ ID NO: 1168960 - RNA, 20 nt, Mycobacterium bovis subsp bovis AF2122/97
cagcggugcugguggcggca

SEQ ID NO: 1168961 - RNA, 17 nt, Mycobacterium bovis subsp bovis AF2122/97
cagcgguggcuugcccc

SEQ ID NO: 1168962 - RNA, 16 nt, Mycobacterium bovis subsp bovis AF2122/97
cagcugacgggccgcu

SEQ ID NO: 1168963 - RNA, 18 nt, Mycobacterium bovis subsp bovis AF2122/97
cagcugacgggccgcugu

SEQ ID NO: 1168964 - RNA, 13 nt, Mycobacterium bovis subsp bovis AF2122/97
cagcugaucccag

SEQ ID NO: 1168965 - RNA, 16 nt, Mycobacterium bovis subsp bovis AF2122/97
cagcugaccagcgucc

SEQ ID NO: 1168966 - RNA, 21 nt, Mycobacterium bovis subsp bovis AF2122/97
cagcugcccgccagcgccgcc

SEQ ID NO: 1168967 - RNA, 14 nt, Mycobacterium bovis subsp bovis AF2122/97
cagcugcccggcgu

SEQ ID NO: 1168968 - RNA, 23 nt, Mycobacterium bovis subsp bovis AF2122/97
cagcugccgcacccccuccgcga

SEQ ID NO: 1168969 - RNA, 21 nt, Mycobacterium bovis subsp bovis AF2122/97
cagcugcggauacagccgccg

SEQ ID NO: 1168970 - RNA, 23 nt, Mycobacterium bovis subsp bovis AF2122/97
cagcugcggauuaagucggcggc

SEQ ID NO: 1168971 - RNA, 22 nt, Mycobacterium bovis subsp bovis AF2122/97
cagcugcggauacagccgccgc

SEQ ID NO: 1168972 - RNA, 20 nt, Mycobacterium bovis subsp bovis AF2122/97
cagcugcggauccaccacgc

SEQ ID NO: 1168973 - RNA, 20 nt, Mycobacterium bovis subsp bovis AF2122/97
cagcugcgggucgugccccg

SEQ ID NO: 1168974 - RNA, 12 nt, Mycobacterium bovis subsp bovis AF2122/97
cagcugcccgcc

SEQ ID NO: 1168975 - RNA, 15 nt, Mycobacterium bovis subsp bovis AF2122/97
cagcugcccgccagc

SEQ ID NO: 1168976 - RNA, 17 nt, Mycobacterium bovis subsp bovis AF2122/97
cagcugcccgccagcgc

SEQ ID NO: 1168977 - RNA, 19 nt, Mycobacterium bovis subsp bovis AF2122/97
cagcugaucuuggcaagcc

SEQ ID NO: 1168978 - RNA, 17 nt, Mycobacterium bovis subsp bovis AF2122/97
cagcugcacacagaggu

SEQ ID NO: 1168979 - RNA, 15 nt, Mycobacterium bovis subsp bovis AF2122/97
cagcugcaccuccga

SEQ ID NO: 1168980 - RNA, 21 nt, Mycobacterium bovis subsp bovis AF2122/97
cagcugcaccuccgacggccg

SEQ ID NO: 1168981 - RNA, 21 nt, Mycobacterium bovis subsp bovis AF2122/97
cagcuccuuggcuaacaccgc

SEQ ID NO: 1168982 - RNA, 23 nt, Mycobacterium bovis subsp bovis AF2122/97
cagcuccuuggcuaacaccgcag

SEQ ID NO: 1168983 - RNA, 17 nt, Mycobacterium bovis subsp bovis AF2122/97
cagcucgaggaccaccu

SEQ ID NO: 1168984 - RNA, 14 nt, Mycobacterium bovis subsp bovis AF2122/97
cagcucgaccagga

SEQ ID NO: 1168985 - RNA, 21 nt, Mycobacterium bovis subsp bovis AF2122/97
cagcuccuguaacugcuccug

SEQ ID NO: 1168986 - RNA, 15 nt, Mycobacterium bovis subsp bovis AF2122/97
cagcucgauacccag

SEQ ID NO: 1168987 - RNA, 22 nt, Mycobacterium bovis subsp bovis AF2122/97
cagcucgauacccaggaugugu

SEQ ID NO: 1168988 - RNA, 14 nt, Mycobacterium bovis subsp bovis AF2122/97
cagcucagcugcgg

SEQ ID NO: 1168989 - RNA, 13 nt, Mycobacterium bovis subsp bovis AF2122/97
cagcucagcugcg

SEQ ID NO: 1168990 - RNA, 17 nt, Mycobacterium bovis subsp bovis AF2122/97
cagcucacggcggaaga

SEQ ID NO: 1168991 - RNA, 23 nt, Mycobacterium bovis subsp bovis AF2122/97
cagcucaccacccgcacuccaag

SEQ ID NO: 1168992 - RNA, 15 nt, Mycobacterium bovis subsp bovis AF2122/97
cagcucaccacccag

SEQ ID NO: 1168993 - RNA, 17 nt, Mycobacterium bovis subsp bovis AF2122/97
cagcucaccuuccucga

SEQ ID NO: 1168994 - RNA, 22 nt, Mycobacterium bovis subsp bovis AF2122/97
cagcucacccggagcacccggg

SEQ ID NO: 1168995 - RNA, 18 nt, Mycobacterium bovis subsp bovis AF2122/97
cagcuaccuccgccacca

SEQ ID NO: 1168996 - RNA, 14 nt, Mycobacterium bovis subsp bovis AF2122/97
cagcuucucagcac

SEQ ID NO: 1168997 - RNA, 14 nt, Mycobacterium bovis subsp bovis AF2122/97
cagcuugcgcagcc

SEQ ID NO: 1168998 - RNA, 17 nt, Mycobacterium bovis subsp bovis AF2122/97
cagcuugcugcgcacca

SEQ ID NO: 1168999 - RNA, 16 nt, Mycobacterium bovis subsp bovis AF2122/97
cagcuugcggagccgc

SEQ ID NO: 1169000 - RNA, 20 nt, Mycobacterium bovis subsp bovis AF2122/97
cagcugggugaccucgucga

SEQ ID NO: 1169001 - RNA, 20 nt, Mycobacterium bovis subsp bovis AF2122/97
cagcugggucccgcuggcau

SEQ ID NO: 1169002 - RNA, 19 nt, Mycobacterium bovis subsp bovis AF2122/97
cagcuggucgugggccacc

SEQ ID NO: 1169003 - RNA, 19 nt, Mycobacterium bovis subsp bovis AF2122/97
cagcugguagcgcaccaca

SEQ ID NO: 1169004 - RNA, 22 nt, Mycobacterium bovis subsp bovis AF2122/97
cagcuggucgugggccaccacc

SEQ ID NO: 1169005 - RNA, 15 nt, Mycobacterium bovis subsp bovis AF2122/97
cagcuggugcugcuu

SEQ ID NO: 1169006 - RNA, 22 nt, Mycobacterium bovis subsp bovis AF2122/97
cagcugcgggucgugccccggc

SEQ ID NO: 1169007 - RNA, 20 nt, Mycobacterium bovis subsp bovis AF2122/97
cagcugggcaucaccgccgc

SEQ ID NO: 1169008 - RNA, 20 nt, Mycobacterium bovis subsp bovis AF2122/97
cagcuggcgcagccugccga

SEQ ID NO: 1169009 - RNA, 20 nt, Mycobacterium bovis subsp bovis AF2122/97
cagcuugguggcguggcccu

SEQ ID NO: 1169010 - RNA, 15 nt, Mycobacterium bovis subsp bovis AF2122/97
cagcuuuaucggccc

SEQ ID NO: 1169011 - RNA, 21 nt, Mycobacterium bovis subsp bovis AF2122/97
cagcuuggacccugcgccgcc

SEQ ID NO: 1169012 - RNA, 22 nt, Mycobacterium bovis subsp bovis AF2122/97
cagcuuggacccugcgccgcca

SEQ ID NO: 1169013 - RNA, 16 nt, Mycobacterium bovis subsp bovis AF2122/97
cagcuuggccagccac

SEQ ID NO: 1169014 - RNA, 23 nt, Mycobacterium bovis subsp bovis AF2122/97
cagcuuggcgucgaugcgggcca

SEQ ID NO: 1169015 - RNA, 15 nt, Mycobacterium bovis subsp bovis AF2122/97
caggaaaaccccggc

SEQ ID NO: 1169016 - RNA, 20 nt, Mycobacterium bovis subsp bovis AF2122/97
caggaaaaccccggccacca

SEQ ID NO: 1169017 - RNA, 16 nt, Mycobacterium bovis subsp bovis AF2122/97
cagcuuugacgcccuc

SEQ ID NO: 1169018 - RNA, 15 nt, Mycobacterium bovis subsp bovis AF2122/97
cagcuuugagucccg

SEQ ID NO: 1169019 - RNA, 12 nt, Mycobacterium bovis subsp bovis AF2122/97
caggccacgggc

SEQ ID NO: 1169020 - RNA, 23 nt, Mycobacterium bovis subsp bovis AF2122/97
caggccacugccgaccagcgcgc

SEQ ID NO: 1169021 - RNA, 21 nt, Mycobacterium bovis subsp bovis AF2122/97
caggccacugcguuccaucgc

SEQ ID NO: 1169022 - RNA, 23 nt, Mycobacterium bovis subsp bovis AF2122/97
caggccaccccgaccucccggca

SEQ ID NO: 1169023 - RNA, 13 nt, Mycobacterium bovis subsp bovis AF2122/97
caggcccagccga

SEQ ID NO: 1169024 - RNA, 22 nt, Mycobacterium bovis subsp bovis AF2122/97
caggccccacuggugcagcgcc

SEQ ID NO: 1169025 - RNA, 17 nt, Mycobacterium bovis subsp bovis AF2122/97
caggcccauaccgaugg

SEQ ID NO: 1169026 - RNA, 18 nt, Mycobacterium bovis subsp bovis AF2122/97
caggcccauaccgauggu

SEQ ID NO: 1169027 - RNA, 19 nt, Mycobacterium bovis subsp bovis AF2122/97
caggccccggugccgaccg

SEQ ID NO: 1169028 - RNA, 13 nt, Mycobacterium bovis subsp bovis AF2122/97
caggcccacccgg

SEQ ID NO: 1169029 - RNA, 18 nt, Mycobacterium bovis subsp bovis AF2122/97
caggccauccgggcugcc

SEQ ID NO: 1169030 - RNA, 15 nt, Mycobacterium bovis subsp bovis AF2122/97
caggccagugugagg

SEQ ID NO: 1169031 - RNA, 19 nt, Mycobacterium bovis subsp bovis AF2122/97
caggccagugccaccuggg

SEQ ID NO: 1169032 - RNA, 19 nt, Mycobacterium bovis subsp bovis AF2122/97
caggccagggugaccaggc

SEQ ID NO: 1169033 - RNA, 21 nt, Mycobacterium bovis subsp bovis AF2122/97
caggccagggugaccaggccg

SEQ ID NO: 1169034 - RNA, 20 nt, Mycobacterium bovis subsp bovis AF2122/97
caggaaccacccaccggcca

SEQ ID NO: 1169035 - RNA, 18 nt, Mycobacterium bovis subsp bovis AF2122/97
caggaucccgguggcagc

SEQ ID NO: 1169036 - RNA, 13 nt, Mycobacterium bovis subsp bovis AF2122/97
caggauccgaccc

SEQ ID NO: 1169037 - RNA, 17 nt, Mycobacterium bovis subsp bovis AF2122/97
caggaucacgccgccgg

SEQ ID NO: 1169038 - RNA, 21 nt, Mycobacterium bovis subsp bovis AF2122/97
caggaucacacuggccugcuc

SEQ ID NO: 1169039 - RNA, 16 nt, Mycobacterium bovis subsp bovis AF2122/97
caggauauuucuaaau

SEQ ID NO: 1169040 - RNA, 20 nt, Mycobacterium bovis subsp bovis AF2122/97
caggcccgggcggaugcugu

SEQ ID NO: 1169041 - RNA, 20 nt, Mycobacterium bovis subsp bovis AF2122/97
caggcccgguucgaggaucc

SEQ ID NO: 1169042 - RNA, 18 nt, Mycobacterium bovis subsp bovis AF2122/97
caggcccgugccuggccg

SEQ ID NO: 1169043 - RNA, 20 nt, Mycobacterium bovis subsp bovis AF2122/97
caggcccgugccuggccggu

SEQ ID NO: 1169044 - RNA, 15 nt, Mycobacterium bovis subsp bovis AF2122/97
caggcccuggccacc

SEQ ID NO: 1169045 - RNA, 18 nt, Mycobacterium bovis subsp bovis AF2122/97
caggcccuggccacccag

SEQ ID NO: 1169046 - RNA, 19 nt, Mycobacterium bovis subsp bovis AF2122/97
caggccuaguccggcacug

SEQ ID NO: 1169047 - RNA, 15 nt, Mycobacterium bovis subsp bovis AF2122/97
caggcgaacaccaga

SEQ ID NO: 1169048 - RNA, 20 nt, Mycobacterium bovis subsp bovis AF2122/97
caggcgaacaccagauggcu

SEQ ID NO: 1169049 - RNA, 15 nt, Mycobacterium bovis subsp bovis AF2122/97
caggcggugaacacc

SEQ ID NO: 1169050 - RNA, 17 nt, Mycobacterium bovis subsp bovis AF2122/97
caggcggugaacaccgc

SEQ ID NO: 1169051 - RNA, 20 nt, Mycobacterium bovis subsp bovis AF2122/97
caggcggugaacaccgccuc

SEQ ID NO: 1169052 - RNA, 14 nt, Mycobacterium bovis subsp bovis AF2122/97
caggcgcugcagca

SEQ ID NO: 1169053 - RNA, 18 nt, Mycobacterium bovis subsp bovis AF2122/97
caggcgcugcagcauggc

SEQ ID NO: 1169054 - RNA, 20 nt, Mycobacterium bovis subsp bovis AF2122/97
caggcgcugcagcauggcuc

SEQ ID NO: 1169055 - RNA, 14 nt, Mycobacterium bovis subsp bovis AF2122/97
caggcgcugccggu

SEQ ID NO: 1169056 - RNA, 19 nt, Mycobacterium bovis subsp bovis AF2122/97
caggcgcagauuccucuuc

SEQ ID NO: 1169057 - RNA, 18 nt, Mycobacterium bovis subsp bovis AF2122/97
caggcgagccggcgcgca

SEQ ID NO: 1169058 - RNA, 22 nt, Mycobacterium bovis subsp bovis AF2122/97
caggcgagugaacucguccuga

SEQ ID NO: 1169059 - RNA, 15 nt, Mycobacterium bovis subsp bovis AF2122/97
caggcuugcggcacc

SEQ ID NO: 1169060 - RNA, 13 nt, Mycobacterium bovis subsp bovis AF2122/97
cagggaggggccg

SEQ ID NO: 1169061 - RNA, 21 nt, Mycobacterium bovis subsp bovis AF2122/97
cagggagugccgcacgauggc

SEQ ID NO: 1169062 - RNA, 18 nt, Mycobacterium bovis subsp bovis AF2122/97
caggcuuccagccacagc

SEQ ID NO: 1169063 - RNA, 15 nt, Mycobacterium bovis subsp bovis AF2122/97
caggcugucgcgggc

SEQ ID NO: 1169064 - RNA, 22 nt, Mycobacterium bovis subsp bovis AF2122/97
caggcugucgcgggccaccacc

SEQ ID NO: 1169065 - RNA, 15 nt, Mycobacterium bovis subsp bovis AF2122/97
caggcuguggccagc

SEQ ID NO: 1169066 - RNA, 22 nt, Mycobacterium bovis subsp bovis AF2122/97
caggcguagguccuugucggcc

SEQ ID NO: 1169067 - RNA, 14 nt, Mycobacterium bovis subsp bovis AF2122/97
caggcguccaucag

SEQ ID NO: 1169068 - RNA, 18 nt, Mycobacterium bovis subsp bovis AF2122/97
caggcgucccagccgauc

SEQ ID NO: 1169069 - RNA, 15 nt, Mycobacterium bovis subsp bovis AF2122/97
caggcucgcaccgug

SEQ ID NO: 1169070 - RNA, 11 nt, Mycobacterium bovis subsp bovis AF2122/97
caggcucgccg

SEQ ID NO: 1169071 - RNA, 16 nt, Mycobacterium bovis subsp bovis AF2122/97
caggcucgccgaugcu

SEQ ID NO: 1169072 - RNA, 20 nt, Mycobacterium bovis subsp bovis AF2122/97
caggcucgggcaaggccacc

SEQ ID NO: 1169073 - RNA, 21 nt, Mycobacterium bovis subsp bovis AF2122/97
caggcucgggcaaggccaccg

SEQ ID NO: 1169074 - RNA, 14 nt, Mycobacterium bovis subsp bovis AF2122/97
cagguacgccaggu

SEQ ID NO: 1169075 - RNA, 21 nt, Mycobacterium bovis subsp bovis AF2122/97
cagguacggcgggcggccgcu

SEQ ID NO: 1169076 - RNA, 22 nt, Mycobacterium bovis subsp bovis AF2122/97
cagguaaugguggcguccaggg

SEQ ID NO: 1169077 - RNA, 21 nt, Mycobacterium bovis subsp bovis AF2122/97
cagguaauugccgaccgccug

SEQ ID NO: 1169078 - RNA, 18 nt, Mycobacterium bovis subsp bovis AF2122/97
cagggaucagccgugcgg

SEQ ID NO: 1169079 - RNA, 16 nt, Mycobacterium bovis subsp bovis AF2122/97
cagggauucuggaugc

SEQ ID NO: 1169080 - RNA, 13 nt, Mycobacterium bovis subsp bovis AF2122/97
cagguaagcagcc

SEQ ID NO: 1169081 - RNA, 13 nt, Mycobacterium bovis subsp bovis AF2122/97
cagguaagccaca

SEQ ID NO: 1169082 - RNA, 23 nt, Mycobacterium bovis subsp bovis AF2122/97
cagguagucgccggucaggcuca

SEQ ID NO: 1169083 - RNA, 15 nt, Mycobacterium bovis subsp bovis AF2122/97
cagguccaccgcugc

SEQ ID NO: 1169084 - RNA, 17 nt, Mycobacterium bovis subsp bovis AF2122/97
cagguccaccgcugccg

SEQ ID NO: 1169085 - RNA, 13 nt, Mycobacterium bovis subsp bovis AF2122/97
cagguccaccccg

SEQ ID NO: 1169086 - RNA, 18 nt, Mycobacterium bovis subsp bovis AF2122/97
caggucagccgcgcgggu

SEQ ID NO: 1169087 - RNA, 17 nt, Mycobacterium bovis subsp bovis AF2122/97
caggucagcgcugccac

SEQ ID NO: 1169088 - RNA, 15 nt, Mycobacterium bovis subsp bovis AF2122/97
caggucgugcccggg

SEQ ID NO: 1169089 - RNA, 20 nt, Mycobacterium bovis subsp bovis AF2122/97
caggucguccaucgcgucgu

SEQ ID NO: 1169090 - RNA, 15 nt, Mycobacterium bovis subsp bovis AF2122/97
caggucuccuugggc

SEQ ID NO: 1169091 - RNA, 15 nt, Mycobacterium bovis subsp bovis AF2122/97
caggucgugcuccca

SEQ ID NO: 1169092 - RNA, 22 nt, Mycobacterium bovis subsp bovis AF2122/97
caggucggcccacggugucccg

SEQ ID NO: 1169093 - RNA, 15 nt, Mycobacterium bovis subsp bovis AF2122/97
caggucggccgccuc

SEQ ID NO: 1169094 - RNA, 16 nt, Mycobacterium bovis subsp bovis AF2122/97
caggucgggcagcacu

SEQ ID NO: 1169095 - RNA, 21 nt, Mycobacterium bovis subsp bovis AF2122/97
caggucggcuucgacaaccuc

SEQ ID NO: 1169096 - RNA, 19 nt, Mycobacterium bovis subsp bovis AF2122/97
caggucuucgauggccaug

SEQ ID NO: 1169097 - RNA, 15 nt, Mycobacterium bovis subsp bovis AF2122/97
caggugaacgccggu

SEQ ID NO: 1169098 - RNA, 23 nt, Mycobacterium bovis subsp bovis AF2122/97
caggugaacgccggugcgcugga

SEQ ID NO: 1169099 - RNA, 22 nt, Mycobacterium bovis subsp bovis AF2122/97
caggugacguucgaugcccugg

SEQ ID NO: 1169100 - RNA, 15 nt, Mycobacterium bovis subsp bovis AF2122/97
caggugacgcccgcu

SEQ ID NO: 1169101 - RNA, 20 nt, Mycobacterium bovis subsp bovis AF2122/97
caggugauucgcgcagcgcg

SEQ ID NO: 1169102 - RNA, 16 nt, Mycobacterium bovis subsp bovis AF2122/97
caggugagugcggcgu

SEQ ID NO: 1169103 - RNA, 18 nt, Mycobacterium bovis subsp bovis AF2122/97
caggucgacaccgcggug

SEQ ID NO: 1169104 - RNA, 22 nt, Mycobacterium bovis subsp bovis AF2122/97
caggucgacaccgcggugcccc

SEQ ID NO: 1169105 - RNA, 22 nt, Mycobacterium bovis subsp bovis AF2122/97
caggucgauaccggcgugcagu

SEQ ID NO: 1169106 - RNA, 14 nt, Mycobacterium bovis subsp bovis AF2122/97
cagguccgccggug

SEQ ID NO: 1169107 - RNA, 13 nt, Mycobacterium bovis subsp bovis AF2122/97
cagguccaucugg

SEQ ID NO: 1169108 - RNA, 21 nt, Mycobacterium bovis subsp bovis AF2122/97
cagguccggggaaagccgcag

SEQ ID NO: 1169109 - RNA, 15 nt, Mycobacterium bovis subsp bovis AF2122/97
caggucgccuuccca

SEQ ID NO: 1169110 - RNA, 22 nt, Mycobacterium bovis subsp bovis AF2122/97
caggucgccuucuucgcggcgg

SEQ ID NO: 1169111 - RNA, 16 nt, Mycobacterium bovis subsp bovis AF2122/97
caggucggcauccucu

SEQ ID NO: 1169112 - RNA, 22 nt, Mycobacterium bovis subsp bovis AF2122/97
caggucggcauccucugaacca

SEQ ID NO: 1169113 - RNA, 20 nt, Mycobacterium bovis subsp bovis AF2122/97
caggucgcgauagccgccgc

SEQ ID NO: 1169114 - RNA, 18 nt, Mycobacterium bovis subsp bovis AF2122/97
caggucgccagcucggca

SEQ ID NO: 1169115 - RNA, 15 nt, Mycobacterium bovis subsp bovis AF2122/97
caggucgaugcugcc

SEQ ID NO: 1169116 - RNA, 22 nt, Mycobacterium bovis subsp bovis AF2122/97
caggucgaugcugccagccaug

SEQ ID NO: 1169117 - RNA, 17 nt, Mycobacterium bovis subsp bovis AF2122/97
caggucgaugcgggcga

SEQ ID NO: 1169118 - RNA, 12 nt, Mycobacterium bovis subsp bovis AF2122/97
caguccagccgg

SEQ ID NO: 1169119 - RNA, 21 nt, Mycobacterium bovis subsp bovis AF2122/97
caguccaggacggucgccagg

SEQ ID NO: 1169120 - RNA, 15 nt, Mycobacterium bovis subsp bovis AF2122/97
caguccaucgacagg

SEQ ID NO: 1169121 - RNA, 18 nt, Mycobacterium bovis subsp bovis AF2122/97
caguccaccgcgcggcgc

SEQ ID NO: 1169122 - RNA, 14 nt, Mycobacterium bovis subsp bovis AF2122/97
cagucccggcgcac

SEQ ID NO: 1169123 - RNA, 18 nt, Mycobacterium bovis subsp bovis AF2122/97
caguccaugugcccaggu

SEQ ID NO: 1169124 - RNA, 16 nt, Mycobacterium bovis subsp bovis AF2122/97
cagucccagcgccgca

SEQ ID NO: 1169125 - RNA, 17 nt, Mycobacterium bovis subsp bovis AF2122/97
caguaugcggugcccgc

SEQ ID NO: 1169126 - RNA, 15 nt, Mycobacterium bovis subsp bovis AF2122/97
caguccaagcuguca

SEQ ID NO: 1169127 - RNA, 19 nt, Mycobacterium bovis subsp bovis AF2122/97
caguccaaucuucucgagc

SEQ ID NO: 1169128 - RNA, 22 nt, Mycobacterium bovis subsp bovis AF2122/97
caguccaaucuucucgagccgc

SEQ ID NO: 1169129 - RNA, 16 nt, Mycobacterium bovis subsp bovis AF2122/97
caguacggugguaaga

SEQ ID NO: 1169130 - RNA, 19 nt, Mycobacterium bovis subsp bovis AF2122/97
caguaggccuccgcugccg

SEQ ID NO: 1169131 - RNA, 16 nt, Mycobacterium bovis subsp bovis AF2122/97
caguaggccuccgcug

SEQ ID NO: 1169132 - RNA, 20 nt, Mycobacterium bovis subsp bovis AF2122/97
caguaggugucgggcucgca

SEQ ID NO: 1169133 - RNA, 16 nt, Mycobacterium bovis subsp bovis AF2122/97
cagguugugauccugg

SEQ ID NO: 1169134 - RNA, 17 nt, Mycobacterium bovis subsp bovis AF2122/97
cagguugauccagugcu

SEQ ID NO: 1169135 - RNA, 19 nt, Mycobacterium bovis subsp bovis AF2122/97
cagguucuugaccagcagc

SEQ ID NO: 1169136 - RNA, 17 nt, Mycobacterium bovis subsp bovis AF2122/97
cagguucuucuccacca

SEQ ID NO: 1169137 - RNA, 15 nt, Mycobacterium bovis subsp bovis AF2122/97
cagguuccgcugucg

SEQ ID NO: 1169138 - RNA, 19 nt, Mycobacterium bovis subsp bovis AF2122/97
cagguucgagggugacccc

SEQ ID NO: 1169139 - RNA, 14 nt, Mycobacterium bovis subsp bovis AF2122/97
cagguucgucaggu

SEQ ID NO: 1169140 - RNA, 15 nt, Mycobacterium bovis subsp bovis AF2122/97
caggugccaggaugu

SEQ ID NO: 1169141 - RNA, 12 nt, Mycobacterium bovis subsp bovis AF2122/97
caggugcccggc

SEQ ID NO: 1169142 - RNA, 13 nt, Mycobacterium bovis subsp bovis AF2122/97
caggugcagcacc

SEQ ID NO: 1169143 - RNA, 19 nt, Mycobacterium bovis subsp bovis AF2122/97
caggugcagcaccagccac

SEQ ID NO: 1169144 - RNA, 18 nt, Mycobacterium bovis subsp bovis AF2122/97
caguucgccgcgcagcgu

SEQ ID NO: 1169145 - RNA, 18 nt, Mycobacterium bovis subsp bovis AF2122/97
caguucgcgccguggcgu

SEQ ID NO: 1169146 - RNA, 15 nt, Mycobacterium bovis subsp bovis AF2122/97
caguuccccgggcuc

SEQ ID NO: 1169147 - RNA, 13 nt, Mycobacterium bovis subsp bovis AF2122/97
caguucccggcca

SEQ ID NO: 1169148 - RNA, 20 nt, Mycobacterium bovis subsp bovis AF2122/97
caguuccacccggugccgca

SEQ ID NO: 1169149 - RNA, 16 nt, Mycobacterium bovis subsp bovis AF2122/97
caguuccagcucgcgg

SEQ ID NO: 1169150 - RNA, 17 nt, Mycobacterium bovis subsp bovis AF2122/97
caguucccagaccaccg

SEQ ID NO: 1169151 - RNA, 17 nt, Mycobacterium bovis subsp bovis AF2122/97
cagugccccgccgagcg

SEQ ID NO: 1169152 - RNA, 19 nt, Mycobacterium bovis subsp bovis AF2122/97
cagugccccgccgagcggu

SEQ ID NO: 1169153 - RNA, 12 nt, Mycobacterium bovis subsp bovis AF2122/97
cagugccgugcu

SEQ ID NO: 1169154 - RNA, 20 nt, Mycobacterium bovis subsp bovis AF2122/97
cagugccguguccagcaugc

SEQ ID NO: 1169155 - RNA, 22 nt, Mycobacterium bovis subsp bovis AF2122/97
cagugccgcccaccacacagcc

SEQ ID NO: 1169156 - RNA, 21 nt, Mycobacterium bovis subsp bovis AF2122/97
cagugcgcaacccagccgcgc

SEQ ID NO: 1169157 - RNA, 23 nt, Mycobacterium bovis subsp bovis AF2122/97
cagugcgcaacccagccgcgcca

SEQ ID NO: 1169158 - RNA, 14 nt, Mycobacterium bovis subsp bovis AF2122/97
cagugcgcagaaca

SEQ ID NO: 1169159 - RNA, 15 nt, Mycobacterium bovis subsp bovis AF2122/97
cagugcgcagaacac

SEQ ID NO: 1169160 - RNA, 21 nt, Mycobacterium bovis subsp bovis AF2122/97
cagugcgcagaacaccaccgc

SEQ ID NO: 1169161 - RNA, 22 nt, Mycobacterium bovis subsp bovis AF2122/97
caguggcuacgcgaucagcugg

SEQ ID NO: 1169162 - RNA, 12 nt, Mycobacterium bovis subsp bovis AF2122/97
cagugcucccga

SEQ ID NO: 1169163 - RNA, 18 nt, Mycobacterium bovis subsp bovis AF2122/97
caguggcgcguaggccca

SEQ ID NO: 1169164 - RNA, 20 nt, Mycobacterium bovis subsp bovis AF2122/97
cagugggacaaagacgccgu

SEQ ID NO: 1169165 - RNA, 15 nt, Mycobacterium bovis subsp bovis AF2122/97
cagugggacgggcgc

SEQ ID NO: 1169166 - RNA, 21 nt, Mycobacterium bovis subsp bovis AF2122/97
caguccggcccccgacuccgg

SEQ ID NO: 1169167 - RNA, 14 nt, Mycobacterium bovis subsp bovis AF2122/97
caguccguccaggu

SEQ ID NO: 1169168 - RNA, 14 nt, Mycobacterium bovis subsp bovis AF2122/97
caguccgucggccu

SEQ ID NO: 1169169 - RNA, 12 nt, Mycobacterium bovis subsp bovis AF2122/97
caguccggcccc

SEQ ID NO: 1169170 - RNA, 17 nt, Mycobacterium bovis subsp bovis AF2122/97
caguccgaaagccgccg

SEQ ID NO: 1169171 - RNA, 21 nt, Mycobacterium bovis subsp bovis AF2122/97
caguccggggcgcaggucguc

SEQ ID NO: 1169172 - RNA, 16 nt, Mycobacterium bovis subsp bovis AF2122/97
cagugaucaccaaccc

SEQ ID NO: 1169173 - RNA, 18 nt, Mycobacterium bovis subsp bovis AF2122/97
cagugccccgcagcacuc

SEQ ID NO: 1169174 - RNA, 14 nt, Mycobacterium bovis subsp bovis AF2122/97
cagugccaucgcca

SEQ ID NO: 1169175 - RNA, 15 nt, Mycobacterium bovis subsp bovis AF2122/97
caguucgugacgugc

SEQ ID NO: 1169176 - RNA, 23 nt, Mycobacterium bovis subsp bovis AF2122/97
caguucguugguguuggaagcgc

SEQ ID NO: 1169177 - RNA, 16 nt, Mycobacterium bovis subsp bovis AF2122/97
caguuugugccgccgc

SEQ ID NO: 1169178 - RNA, 16 nt, Mycobacterium bovis subsp bovis AF2122/97
cauaagugaacagcag

SEQ ID NO: 1169179 - RNA, 24 nt, Mycobacterium bovis subsp bovis AF2122/97
cauaagcccccgcacgcacggcgu

SEQ ID NO: 1169180 - RNA, 17 nt, Mycobacterium bovis subsp bovis AF2122/97
cauaaagguccaaccac

SEQ ID NO: 1169181 - RNA, 21 nt, Mycobacterium bovis subsp bovis AF2122/97
caugaccaccgaaauacccag

SEQ ID NO: 1169182 - RNA, 12 nt, Mycobacterium bovis subsp bovis AF2122/97
caugacggcucc

SEQ ID NO: 1169183 - RNA, 17 nt, Mycobacterium bovis subsp bovis AF2122/97
caugacaccggccacca

SEQ ID NO: 1169184 - RNA, 20 nt, Mycobacterium bovis subsp bovis AF2122/97
caugacaccggccaccagcc

SEQ ID NO: 1169185 - RNA, 19 nt, Mycobacterium bovis subsp bovis AF2122/97
caugacagccccgccgccc

SEQ ID NO: 1169186 - RNA, 19 nt, Mycobacterium bovis subsp bovis AF2122/97
caugaaccggucgaucccc

SEQ ID NO: 1169187 - RNA, 19 nt, Mycobacterium bovis subsp bovis AF2122/97
caugaacgcaagcagcgcg

SEQ ID NO: 1169188 - RNA, 19 nt, Mycobacterium bovis subsp bovis AF2122/97
caugaacucgaacuggguc

SEQ ID NO: 1169189 - RNA, 18 nt, Mycobacterium bovis subsp bovis AF2122/97
caugaagaacuggcugcu

SEQ ID NO: 1169190 - RNA, 15 nt, Mycobacterium bovis subsp bovis AF2122/97
caugaauccacugaa

SEQ ID NO: 1169191 - RNA, 17 nt, Mycobacterium bovis subsp bovis AF2122/97
caugagccgcugcgcca

SEQ ID NO: 1169192 - RNA, 20 nt, Mycobacterium bovis subsp bovis AF2122/97
caugagccgcugcgccaggu

SEQ ID NO: 1169193 - RNA, 22 nt, Mycobacterium bovis subsp bovis AF2122/97
caugcaucugcuucugcguaua

SEQ ID NO: 1169194 - RNA, 17 nt, Mycobacterium bovis subsp bovis AF2122/97
caugcuaggaccaccag

SEQ ID NO: 1169195 - RNA, 22 nt, Mycobacterium bovis subsp bovis AF2122/97
caugcuaggcaugccacacacu

SEQ ID NO: 1169196 - RNA, 14 nt, Mycobacterium bovis subsp bovis AF2122/97
caugcucagggcag

SEQ ID NO: 1169197 - RNA, 21 nt, Mycobacterium bovis subsp bovis AF2122/97
caugcucaccgaaacgaugcg

SEQ ID NO: 1169198 - RNA, 21 nt, Mycobacterium bovis subsp bovis AF2122/97
caugcucacgaucacccgcac

SEQ ID NO: 1169199 - RNA, 15 nt, Mycobacterium bovis subsp bovis AF2122/97
caugccgaucggccu

SEQ ID NO: 1169200 - RNA, 21 nt, Mycobacterium bovis subsp bovis AF2122/97
caugccgaucggccugcagcg

SEQ ID NO: 1169201 - RNA, 23 nt, Mycobacterium bovis subsp bovis AF2122/97
caugccgacgacaacagccagcu

SEQ ID NO: 1169202 - RNA, 14 nt, Mycobacterium bovis subsp bovis AF2122/97
caugcccaccgccu

SEQ ID NO: 1169203 - RNA, 15 nt, Mycobacterium bovis subsp bovis AF2122/97
caugccaagcuccaa

SEQ ID NO: 1169204 - RNA, 14 nt, Mycobacterium bovis subsp bovis AF2122/97
caugccacagcggc

SEQ ID NO: 1169205 - RNA, 14 nt, Mycobacterium bovis subsp bovis AF2122/97
cauggccgccaggu

SEQ ID NO: 1169206 - RNA, 12 nt, Mycobacterium bovis subsp bovis AF2122/97
cauggccaccga

SEQ ID NO: 1169207 - RNA, 21 nt, Mycobacterium bovis subsp bovis AF2122/97
caugcucgucuugggccggga

SEQ ID NO: 1169208 - RNA, 14 nt, Mycobacterium bovis subsp bovis AF2122/97
cauggcgugcccca

SEQ ID NO: 1169209 - RNA, 17 nt, Mycobacterium bovis subsp bovis AF2122/97
cauggcgucgaaccagu

SEQ ID NO: 1169210 - RNA, 17 nt, Mycobacterium bovis subsp bovis AF2122/97
cauguauuuguuguaaa

SEQ ID NO: 1169211 - RNA, 18 nt, Mycobacterium bovis subsp bovis AF2122/97
caugucaagcgauguccc

SEQ ID NO: 1169212 - RNA, 16 nt, Mycobacterium bovis subsp bovis AF2122/97
caugucagcggccugc

SEQ ID NO: 1169213 - RNA, 14 nt, Mycobacterium bovis subsp bovis AF2122/97
caugucacacccac

SEQ ID NO: 1169214 - RNA, 21 nt, Mycobacterium bovis subsp bovis AF2122/97
caugucacacccacacccagc

SEQ ID NO: 1169215 - RNA, 14 nt, Mycobacterium bovis subsp bovis AF2122/97
caugucggcgcgcc

SEQ ID NO: 1169216 - RNA, 16 nt, Mycobacterium bovis subsp bovis AF2122/97
caugucgcggacccgc

SEQ ID NO: 1169217 - RNA, 21 nt, Mycobacterium bovis subsp bovis AF2122/97
caugucgcugccgccgccggc

SEQ ID NO: 1169218 - RNA, 16 nt, Mycobacterium bovis subsp bovis AF2122/97
caugucggccacccgg

SEQ ID NO: 1169219 - RNA, 20 nt, Mycobacterium bovis subsp bovis AF2122/97
caugucgccgaacgccacca

SEQ ID NO: 1169220 - RNA, 21 nt, Mycobacterium bovis subsp bovis AF2122/97
caugucgccgaacgccaccac

SEQ ID NO: 1169221 - RNA, 17 nt, Mycobacterium bovis subsp bovis AF2122/97
caugucgauccggcgcc

SEQ ID NO: 1169222 - RNA, 15 nt, Mycobacterium bovis subsp bovis AF2122/97
caugucgcgccaggc

SEQ ID NO: 1169223 - RNA, 14 nt, Mycobacterium bovis subsp bovis AF2122/97
cauguccagugccg

SEQ ID NO: 1169224 - RNA, 14 nt, Mycobacterium bovis subsp bovis AF2122/97
caugucgagcacgc

SEQ ID NO: 1169225 - RNA, 15 nt, Mycobacterium bovis subsp bovis AF2122/97
caugucgagcacgcc

SEQ ID NO: 1169226 - RNA, 18 nt, Mycobacterium bovis subsp bovis AF2122/97
cauguccuuggagauguc

SEQ ID NO: 1169227 - RNA, 15 nt, Mycobacterium bovis subsp bovis AF2122/97
cauguccgcagcggu

SEQ ID NO: 1169228 - RNA, 19 nt, Mycobacterium bovis subsp bovis AF2122/97
cauuccguaggccacagcc

SEQ ID NO: 1169229 - RNA, 16 nt, Mycobacterium bovis subsp bovis AF2122/97
cauucccgaguugccc

SEQ ID NO: 1169230 - RNA, 21 nt, Mycobacterium bovis subsp bovis AF2122/97
cauucccgaguugcccucugg

SEQ ID NO: 1169231 - RNA, 11 nt, Mycobacterium bovis subsp bovis AF2122/97
cauucgccggg

SEQ ID NO: 1169232 - RNA, 17 nt, Mycobacterium bovis subsp bovis AF2122/97
cauuccagaucaacgcg

SEQ ID NO: 1169233 - RNA, 13 nt, Mycobacterium bovis subsp bovis AF2122/97
cauguguggcagc

SEQ ID NO: 1169234 - RNA, 15 nt, Mycobacterium bovis subsp bovis AF2122/97
cauguuccacccggu

SEQ ID NO: 1169235 - RNA, 14 nt, Mycobacterium bovis subsp bovis AF2122/97
cauuacucaacagu

SEQ ID NO: 1169236 - RNA, 18 nt, Mycobacterium bovis subsp bovis AF2122/97
cauuacucaacaguucac

SEQ ID NO: 1169237 - RNA, 18 nt, Mycobacterium bovis subsp bovis AF2122/97
cauucaacagauccgacg

SEQ ID NO: 1169238 - RNA, 18 nt, Mycobacterium bovis subsp bovis AF2122/97
cauugccgacgcgcggcc

SEQ ID NO: 1169239 - RNA, 19 nt, Mycobacterium bovis subsp bovis AF2122/97
cauugcccgagcccagcgc

SEQ ID NO: 1169240 - RNA, 20 nt, Mycobacterium bovis subsp bovis AF2122/97
cauugcccgagcccagcgcc

SEQ ID NO: 1169241 - RNA, 10 nt, Mycobacterium bovis subsp bovis AF2122/97
cauugccaua

SEQ ID NO: 1169242 - RNA, 21 nt, Mycobacterium bovis subsp bovis AF2122/97
cauugccauacagcaccccgc

SEQ ID NO: 1169243 - RNA, 17 nt, Mycobacterium bovis subsp bovis AF2122/97
cauucgcgacaacucgc

SEQ ID NO: 1169244 - RNA, 13 nt, Mycobacterium bovis subsp bovis AF2122/97
cauucgggcgccc

SEQ ID NO: 1169245 - RNA, 14 nt, Mycobacterium bovis subsp bovis AF2122/97
cauucgguguggcc

SEQ ID NO: 1169246 - RNA, 21 nt, Mycobacterium bovis subsp bovis AF2122/97
cauugcgggagccucgccugu

SEQ ID NO: 1169247 - RNA, 20 nt, Mycobacterium bovis subsp bovis AF2122/97
cauugccgauuacgacuugg

SEQ ID NO: 1169248 - RNA, 20 nt, Mycobacterium bovis subsp bovis AF2122/97
cauugccgcaugcucagcau

SEQ ID NO: 1169249 - RNA, 15 nt, Mycobacterium bovis subsp bovis AF2122/97
cauugccgccagccc

SEQ ID NO: 1169250 - RNA, 13 nt, Mycobacterium bovis subsp bovis AF2122/97
cauugccgccggc

SEQ ID NO: 1169251 - RNA, 19 nt, Mycobacterium bovis subsp bovis AF2122/97
cauugcugcucgugagccc

SEQ ID NO: 1169252 - RNA, 17 nt, Mycobacterium bovis subsp bovis AF2122/97
cauugguguccaccacc

SEQ ID NO: 1169253 - RNA, 17 nt, Mycobacterium bovis subsp bovis AF2122/97
cauuggguaaccagcgc

SEQ ID NO: 1169254 - RNA, 18 nt, Mycobacterium bovis subsp bovis AF2122/97
cauuggguaaccagcgcc

SEQ ID NO: 1169255 - RNA, 23 nt, Mycobacterium bovis subsp bovis AF2122/97
cauuggccuaggacaccggcacc

SEQ ID NO: 1169256 - RNA, 13 nt, Mycobacterium bovis subsp bovis AF2122/97
cauuggcgccgcc

SEQ ID NO: 1169257 - RNA, 23 nt, Mycobacterium bovis subsp bovis AF2122/97
cauuggcgucgacaacacgccgu

SEQ ID NO: 1169258 - RNA, 14 nt, Mycobacterium bovis subsp bovis AF2122/97
cauuuccacaucca

SEQ ID NO: 1169259 - RNA, 22 nt, Mycobacterium bovis subsp bovis AF2122/97
cauuucaacguauccccgacca

SEQ ID NO: 1169260 - RNA, 14 nt, Mycobacterium bovis subsp bovis AF2122/97
cauccagccgugcg

SEQ ID NO: 1169261 - RNA, 17 nt, Mycobacterium bovis subsp bovis AF2122/97
cauccacaccgcggcgg

SEQ ID NO: 1169262 - RNA, 15 nt, Mycobacterium bovis subsp bovis AF2122/97
cauccagcagcgccu

SEQ ID NO: 1169263 - RNA, 21 nt, Mycobacterium bovis subsp bovis AF2122/97
cauccaggcugucgcgggcca

SEQ ID NO: 1169264 - RNA, 14 nt, Mycobacterium bovis subsp bovis AF2122/97
cauccaucgccagu

SEQ ID NO: 1169265 - RNA, 14 nt, Mycobacterium bovis subsp bovis AF2122/97
caucaugucggcgc

SEQ ID NO: 1169266 - RNA, 20 nt, Mycobacterium bovis subsp bovis AF2122/97
caucaugucggcgcaggcgu

SEQ ID NO: 1169267 - RNA, 22 nt, Mycobacterium bovis subsp bovis AF2122/97
caucauggccgugaacugcgua

SEQ ID NO: 1169268 - RNA, 15 nt, Mycobacterium bovis subsp bovis AF2122/97
cauccaacgcggcgc

SEQ ID NO: 1169269 - RNA, 23 nt, Mycobacterium bovis subsp bovis AF2122/97
cauccaacgcggcgcgagccugc

SEQ ID NO: 1169270 - RNA, 20 nt, Mycobacterium bovis subsp bovis AF2122/97
cauccaagaaagugcacaca

SEQ ID NO: 1169271 - RNA, 16 nt, Mycobacterium bovis subsp bovis AF2122/97
cauccaauaucgcuuu

SEQ ID NO: 1169272 - RNA, 18 nt, Mycobacterium bovis subsp bovis AF2122/97
cauccaaccguggucccu

SEQ ID NO: 1169273 - RNA, 14 nt, Mycobacterium bovis subsp bovis AF2122/97
cauccgacaagcug

SEQ ID NO: 1169274 - RNA, 13 nt, Mycobacterium bovis subsp bovis AF2122/97
caucccugacgaa

SEQ ID NO: 1169275 - RNA, 18 nt, Mycobacterium bovis subsp bovis AF2122/97
caucccguucagcgacca

SEQ ID NO: 1169276 - RNA, 18 nt, Mycobacterium bovis subsp bovis AF2122/97
caucccucaguguacacc

SEQ ID NO: 1169277 - RNA, 21 nt, Mycobacterium bovis subsp bovis AF2122/97
caucccucaguguacaccgcg

SEQ ID NO: 1169278 - RNA, 20 nt, Mycobacterium bovis subsp bovis AF2122/97
caucccuuucgcgccgcgag

SEQ ID NO: 1169279 - RNA, 12 nt, Mycobacterium bovis subsp bovis AF2122/97
cauccggcgccg

SEQ ID NO: 1169280 - RNA, 21 nt, Mycobacterium bovis subsp bovis AF2122/97
cauccggccgucggcgggcau

SEQ ID NO: 1169281 - RNA, 15 nt, Mycobacterium bovis subsp bovis AF2122/97
cauccggccgucggg

SEQ ID NO: 1169282 - RNA, 21 nt, Mycobacterium bovis subsp bovis AF2122/97
cauccugccuuacacgccugg

SEQ ID NO: 1169283 - RNA, 16 nt, Mycobacterium bovis subsp bovis AF2122/97
cauccccgccggcgcc

SEQ ID NO: 1169284 - RNA, 23 nt, Mycobacterium bovis subsp bovis AF2122/97
cauccccgguucugcgcccaccc

SEQ ID NO: 1169285 - RNA, 19 nt, Mycobacterium bovis subsp bovis AF2122/97
caucccgaaguagaagccc

SEQ ID NO: 1169286 - RNA, 20 nt, Mycobacterium bovis subsp bovis AF2122/97
caucccgauccugcccacca

SEQ ID NO: 1169287 - RNA, 13 nt, Mycobacterium bovis subsp bovis AF2122/97
caucccgccgccc

SEQ ID NO: 1169288 - RNA, 20 nt, Mycobacterium bovis subsp bovis AF2122/97
caucccgaucccggccagcu

SEQ ID NO: 1169289 - RNA, 13 nt, Mycobacterium bovis subsp bovis AF2122/97
caucccggcgccg

SEQ ID NO: 1169290 - RNA, 18 nt, Mycobacterium bovis subsp bovis AF2122/97
cauccauucggcggcggc

SEQ ID NO: 1169291 - RNA, 22 nt, Mycobacterium bovis subsp bovis AF2122/97
cauccaugauggccgucagcca

SEQ ID NO: 1169292 - RNA, 17 nt, Mycobacterium bovis subsp bovis AF2122/97
caucgccgagguggaca

SEQ ID NO: 1169293 - RNA, 23 nt, Mycobacterium bovis subsp bovis AF2122/97
caucgccgaugauguuuuccccg

SEQ ID NO: 1169294 - RNA, 15 nt, Mycobacterium bovis subsp bovis AF2122/97
caucgccgacccgcc

SEQ ID NO: 1169295 - RNA, 17 nt, Mycobacterium bovis subsp bovis AF2122/97
caucgccgccaaccacu

SEQ ID NO: 1169296 - RNA, 21 nt, Mycobacterium bovis subsp bovis AF2122/97
caucgccacuguugaagaagc

SEQ ID NO: 1169297 - RNA, 14 nt, Mycobacterium bovis subsp bovis AF2122/97
caucgccagcagca

SEQ ID NO: 1169298 - RNA, 14 nt, Mycobacterium bovis subsp bovis AF2122/97
caucgccuccucga

SEQ ID NO: 1169299 - RNA, 15 nt, Mycobacterium bovis subsp bovis AF2122/97
caucgccucaccacg

SEQ ID NO: 1169300 - RNA, 20 nt, Mycobacterium bovis subsp bovis AF2122/97
caucgccucgaggaccacca

SEQ ID NO: 1169301 - RNA, 15 nt, Mycobacterium bovis subsp bovis AF2122/97
caucgccggagucga

SEQ ID NO: 1169302 - RNA, 20 nt, Mycobacterium bovis subsp bovis AF2122/97
caucgccggguagcuguaca

SEQ ID NO: 1169303 - RNA, 13 nt, Mycobacterium bovis subsp bovis AF2122/97
caucgccgcuggc

SEQ ID NO: 1169304 - RNA, 15 nt, Mycobacterium bovis subsp bovis AF2122/97
caucgccaacaccaa

SEQ ID NO: 1169305 - RNA, 18 nt, Mycobacterium bovis subsp bovis AF2122/97
caucgccaacaccaacca

SEQ ID NO: 1169306 - RNA, 14 nt, Mycobacterium bovis subsp bovis AF2122/97
caucgcacgggcca

SEQ ID NO: 1169307 - RNA, 13 nt, Mycobacterium bovis subsp bovis AF2122/97
caucgcaggcacc

SEQ ID NO: 1169308 - RNA, 14 nt, Mycobacterium bovis subsp bovis AF2122/97
caucgcacccacca

SEQ ID NO: 1169309 - RNA, 19 nt, Mycobacterium bovis subsp bovis AF2122/97
cauccuggcggcugcagcc

SEQ ID NO: 1169310 - RNA, 19 nt, Mycobacterium bovis subsp bovis AF2122/97
caucgauccucgcccgcac

SEQ ID NO: 1169311 - RNA, 14 nt, Mycobacterium bovis subsp bovis AF2122/97
caucgaucagaugc

SEQ ID NO: 1169312 - RNA, 22 nt, Mycobacterium bovis subsp bovis AF2122/97
caucgaugucagugaucaccaa

SEQ ID NO: 1169313 - RNA, 21 nt, Mycobacterium bovis subsp bovis AF2122/97
caucggcacaggcggccagca

SEQ ID NO: 1169314 - RNA, 18 nt, Mycobacterium bovis subsp bovis AF2122/97
caucggcaucgacugcca

SEQ ID NO: 1169315 - RNA, 12 nt, Mycobacterium bovis subsp bovis AF2122/97
caucggcccgcu

SEQ ID NO: 1169316 - RNA, 16 nt, Mycobacterium bovis subsp bovis AF2122/97
caucgucgaagaccuc

SEQ ID NO: 1169317 - RNA, 15 nt, Mycobacterium bovis subsp bovis AF2122/97
caucgucgccgcgca

SEQ ID NO: 1169318 - RNA, 15 nt, Mycobacterium bovis subsp bovis AF2122/97
caucguaggccggca

SEQ ID NO: 1169319 - RNA, 16 nt, Mycobacterium bovis subsp bovis AF2122/97
caucgucugguggcag

SEQ ID NO: 1169320 - RNA, 21 nt, Mycobacterium bovis subsp bovis AF2122/97
caucguggggaucgaccaugg

SEQ ID NO: 1169321 - RNA, 16 nt, Mycobacterium bovis subsp bovis AF2122/97
caucgugcugaagcug

SEQ ID NO: 1169322 - RNA, 13 nt, Mycobacterium bovis subsp bovis AF2122/97
caucucggcggcc

SEQ ID NO: 1169323 - RNA, 22 nt, Mycobacterium bovis subsp bovis AF2122/97
caucucggcggccaacagcacc

SEQ ID NO: 1169324 - RNA, 23 nt, Mycobacterium bovis subsp bovis AF2122/97
caucucggcggccaacagcaccc

SEQ ID NO: 1169325 - RNA, 21 nt, Mycobacterium bovis subsp bovis AF2122/97
caucucgucgucgcggccgcu

SEQ ID NO: 1169326 - RNA, 15 nt, Mycobacterium bovis subsp bovis AF2122/97
caucucaccgggccc

SEQ ID NO: 1169327 - RNA, 20 nt, Mycobacterium bovis subsp bovis AF2122/97
caucuccaccgucgccgccg

SEQ ID NO: 1169328 - RNA, 21 nt, Mycobacterium bovis subsp bovis AF2122/97
caucuacaucgucgagcgcgg

SEQ ID NO: 1169329 - RNA, 14 nt, Mycobacterium bovis subsp bovis AF2122/97
cauaucgcccacca

SEQ ID NO: 1169330 - RNA, 13 nt, Mycobacterium bovis subsp bovis AF2122/97
cauauccgccggc

SEQ ID NO: 1169331 - RNA, 16 nt, Mycobacterium bovis subsp bovis AF2122/97
caucagaaugccuggc

SEQ ID NO: 1169332 - RNA, 14 nt, Mycobacterium bovis subsp bovis AF2122/97
caucaccagcagug

SEQ ID NO: 1169333 - RNA, 22 nt, Mycobacterium bovis subsp bovis AF2122/97
caucaccacuggacccgcccag

SEQ ID NO: 1169334 - RNA, 14 nt, Mycobacterium bovis subsp bovis AF2122/97
caucacauccacgc

SEQ ID NO: 1169335 - RNA, 15 nt, Mycobacterium bovis subsp bovis AF2122/97
caucacauccacgca

SEQ ID NO: 1169336 - RNA, 19 nt, Mycobacterium bovis subsp bovis AF2122/97
caucacacccaucacccug

SEQ ID NO: 1169337 - RNA, 21 nt, Mycobacterium bovis subsp bovis AF2122/97
cauagugcggcagcgguggcu

SEQ ID NO: 1169338 - RNA, 19 nt, Mycobacterium bovis subsp bovis AF2122/97
cauaggccccgccagcgcc

SEQ ID NO: 1169339 - RNA, 18 nt, Mycobacterium bovis subsp bovis AF2122/97
cauagcugccggcccacc

SEQ ID NO: 1169340 - RNA, 15 nt, Mycobacterium bovis subsp bovis AF2122/97
cauagccgcgacccg

SEQ ID NO: 1169341 - RNA, 15 nt, Mycobacterium bovis subsp bovis AF2122/97
cauagccacgcaagc

SEQ ID NO: 1169342 - RNA, 17 nt, Mycobacterium bovis subsp bovis AF2122/97
cauagccacgcaagcaa

SEQ ID NO: 1169343 - RNA, 21 nt, Mycobacterium bovis subsp bovis AF2122/97
cauagccguugcgggccaggc

SEQ ID NO: 1169344 - RNA, 16 nt, Mycobacterium bovis subsp bovis AF2122/97
cauagagcggcaccag

SEQ ID NO: 1169345 - RNA, 15 nt, Mycobacterium bovis subsp bovis AF2122/97
cauacacaacgccau

SEQ ID NO: 1169346 - RNA, 18 nt, Mycobacterium bovis subsp bovis AF2122/97
caauuccguuaggcucca

SEQ ID NO: 1169347 - RNA, 18 nt, Mycobacterium bovis subsp bovis AF2122/97
caauuccaugcaguuguc

SEQ ID NO: 1169348 - RNA, 12 nt, Mycobacterium bovis subsp bovis AF2122/97
caauuccagccc

SEQ ID NO: 1169349 - RNA, 12 nt, Mycobacterium bovis subsp bovis AF2122/97
caauucgacugc

SEQ ID NO: 1169350 - RNA, 18 nt, Mycobacterium bovis subsp bovis AF2122/97
caauucggugcgcuggcg

SEQ ID NO: 1169351 - RNA, 23 nt, Mycobacterium bovis subsp bovis AF2122/97
caauucggugcgcuggcggcgca

SEQ ID NO: 1169352 - RNA, 17 nt, Mycobacterium bovis subsp bovis AF2122/97
caauugcaccuucucca

SEQ ID NO: 1169353 - RNA, 19 nt, Mycobacterium bovis subsp bovis AF2122/97
caauugcgcugaagcccau

SEQ ID NO: 1169354 - RNA, 18 nt, Mycobacterium bovis subsp bovis AF2122/97
caauugaacgcaccaacg

SEQ ID NO: 1169355 - RNA, 15 nt, Mycobacterium bovis subsp bovis AF2122/97
caauugucaagccgu

SEQ ID NO: 1169356 - RNA, 14 nt, Mycobacterium bovis subsp bovis AF2122/97
caaucagugcagcg

SEQ ID NO: 1169357 - RNA, 14 nt, Mycobacterium bovis subsp bovis AF2122/97
caauuucacugcga

SEQ ID NO: 1169358 - RNA, 16 nt, Mycobacterium bovis subsp bovis AF2122/97
caauuuucugcugcug

SEQ ID NO: 1169359 - RNA, 18 nt, Mycobacterium bovis subsp bovis AF2122/97
cacaaacauacgccaccc

SEQ ID NO: 1169360 - RNA, 21 nt, Mycobacterium bovis subsp bovis AF2122/97
cacaaacgggcgugggccgcu

SEQ ID NO: 1169361 - RNA, 15 nt, Mycobacterium bovis subsp bovis AF2122/97
cacaaccgcugcugc

SEQ ID NO: 1169362 - RNA, 16 nt, Mycobacterium bovis subsp bovis AF2122/97
cacaaccgcugcugcu

SEQ ID NO: 1169363 - RNA, 22 nt, Mycobacterium bovis subsp bovis AF2122/97
cacaaccgugagcaccagcagc

SEQ ID NO: 1169364 - RNA, 17 nt, Mycobacterium bovis subsp bovis AF2122/97
cacaacgacgaauaagu

SEQ ID NO: 1169365 - RNA, 18 nt, Mycobacterium bovis subsp bovis AF2122/97
cacaaccgugagcaccag

SEQ ID NO: 1169366 - RNA, 12 nt, Mycobacterium bovis subsp bovis AF2122/97
cacaacaccggc

SEQ ID NO: 1169367 - RNA, 21 nt, Mycobacterium bovis subsp bovis AF2122/97
cacaacugcccgacgaccauu

SEQ ID NO: 1169368 - RNA, 18 nt, Mycobacterium bovis subsp bovis AF2122/97
cacacguuggcagcccuc

SEQ ID NO: 1169369 - RNA, 22 nt, Mycobacterium bovis subsp bovis AF2122/97
cacacgucaggcaacgaagagg

SEQ ID NO: 1169370 - RNA, 15 nt, Mycobacterium bovis subsp bovis AF2122/97
cacacggggccgcca

SEQ ID NO: 1169371 - RNA, 22 nt, Mycobacterium bovis subsp bovis AF2122/97
cacacugccggacagccacgca

SEQ ID NO: 1169372 - RNA, 19 nt, Mycobacterium bovis subsp bovis AF2122/97
cacacugaagaucgcgccc

SEQ ID NO: 1169373 - RNA, 14 nt, Mycobacterium bovis subsp bovis AF2122/97
cacacucagcaccc

SEQ ID NO: 1169374 - RNA, 15 nt, Mycobacterium bovis subsp bovis AF2122/97
cacacucccgcgccc

SEQ ID NO: 1169375 - RNA, 21 nt, Mycobacterium bovis subsp bovis AF2122/97
cacacuccuagccaacgagcg

SEQ ID NO: 1169376 - RNA, 22 nt, Mycobacterium bovis subsp bovis AF2122/97
cacacuguuacuccgacggccc

SEQ ID NO: 1169377 - RNA, 18 nt, Mycobacterium bovis subsp bovis AF2122/97
cacaccccaggcacccug

SEQ ID NO: 1169378 - RNA, 18 nt, Mycobacterium bovis subsp bovis AF2122/97
cacacccggcacacccuc

SEQ ID NO: 1169379 - RNA, 23 nt, Mycobacterium bovis subsp bovis AF2122/97
cacacccgucaugcccaccgccu

SEQ ID NO: 1169380 - RNA, 16 nt, Mycobacterium bovis subsp bovis AF2122/97
cacaccgagcgcaauc

SEQ ID NO: 1169381 - RNA, 13 nt, Mycobacterium bovis subsp bovis AF2122/97
cacaccgccgcca

SEQ ID NO: 1169382 - RNA, 14 nt, Mycobacterium bovis subsp bovis AF2122/97
cacaccgccagcgg

SEQ ID NO: 1169383 - RNA, 12 nt, Mycobacterium bovis subsp bovis AF2122/97
cacaccgccgcc

SEQ ID NO: 1169384 - RNA, 13 nt, Mycobacterium bovis subsp bovis AF2122/97
cacaccccaggca

SEQ ID NO: 1169385 - RNA, 14 nt, Mycobacterium bovis subsp bovis AF2122/97
cacacccacaccca

SEQ ID NO: 1169386 - RNA, 14 nt, Mycobacterium bovis subsp bovis AF2122/97
cacacccagcgcgc

SEQ ID NO: 1169387 - RNA, 22 nt, Mycobacterium bovis subsp bovis AF2122/97
cacacgcccucgacgccgcgca

SEQ ID NO: 1169388 - RNA, 16 nt, Mycobacterium bovis subsp bovis AF2122/97
cacaccugcgccaccu

SEQ ID NO: 1169389 - RNA, 17 nt, Mycobacterium bovis subsp bovis AF2122/97
cacaccuccucgagcag

SEQ ID NO: 1169390 - RNA, 14 nt, Mycobacterium bovis subsp bovis AF2122/97
cacaccggcacugc

SEQ ID NO: 1169391 - RNA, 19 nt, Mycobacterium bovis subsp bovis AF2122/97
cacaccggauagguggucu

SEQ ID NO: 1169392 - RNA, 19 nt, Mycobacterium bovis subsp bovis AF2122/97
cacaccggcacugcccagc

SEQ ID NO: 1169393 - RNA, 23 nt, Mycobacterium bovis subsp bovis AF2122/97
cacaccggcacugcccagcagac

SEQ ID NO: 1169394 - RNA, 21 nt, Mycobacterium bovis subsp bovis AF2122/97
cacacaggcggcgaacugccu

SEQ ID NO: 1169395 - RNA, 23 nt, Mycobacterium bovis subsp bovis AF2122/97
cacacacugccggacagccacgc

SEQ ID NO: 1169396 - RNA, 23 nt, Mycobacterium bovis subsp bovis AF2122/97
cacacagaggucggucagccacc

SEQ ID NO: 1169397 - RNA, 19 nt, Mycobacterium bovis subsp bovis AF2122/97
cacacacccgacacggcuc

SEQ ID NO: 1169398 - RNA, 20 nt, Mycobacterium bovis subsp bovis AF2122/97
cacacacagccgguggcauu

SEQ ID NO: 1169399 - RNA, 14 nt, Mycobacterium bovis subsp bovis AF2122/97
cacaagcugaacua

SEQ ID NO: 1169400 - RNA, 17 nt, Mycobacterium bovis subsp bovis AF2122/97
cacaagcgauggcacca

SEQ ID NO: 1169401 - RNA, 23 nt, Mycobacterium bovis subsp bovis AF2122/97
cacaagcgauggcaccacuacau

SEQ ID NO: 1169402 - RNA, 17 nt, Mycobacterium bovis subsp bovis AF2122/97
cacaauacggucagcag

SEQ ID NO: 1169403 - RNA, 20 nt, Mycobacterium bovis subsp bovis AF2122/97
cacaggacaauggacaccaa

SEQ ID NO: 1169404 - RNA, 16 nt, Mycobacterium bovis subsp bovis AF2122/97
cacaggauuggccgcu

SEQ ID NO: 1169405 - RNA, 19 nt, Mycobacterium bovis subsp bovis AF2122/97
cacaggcgacggcccucga

SEQ ID NO: 1169406 - RNA, 12 nt, Mycobacterium bovis subsp bovis AF2122/97
cacaggcggcca

SEQ ID NO: 1169407 - RNA, 13 nt, Mycobacterium bovis subsp bovis AF2122/97
cacaggcugaaga

SEQ ID NO: 1169408 - RNA, 15 nt, Mycobacterium bovis subsp bovis AF2122/97
cacagguuugcgccg

SEQ ID NO: 1169409 - RNA, 17 nt, Mycobacterium bovis subsp bovis AF2122/97
cacagguuugcgccgcg

SEQ ID NO: 1169410 - RNA, 22 nt, Mycobacterium bovis subsp bovis AF2122/97
cacagguuugcgccgcgcagcg

SEQ ID NO: 1169411 - RNA, 15 nt, Mycobacterium bovis subsp bovis AF2122/97
cacagguccugcgcc

SEQ ID NO: 1169412 - RNA, 14 nt, Mycobacterium bovis subsp bovis AF2122/97
cacaggggcagcgc

SEQ ID NO: 1169413 - RNA, 19 nt, Mycobacterium bovis subsp bovis AF2122/97
cacaggggcagcgcggcca

SEQ ID NO: 1169414 - RNA, 22 nt, Mycobacterium bovis subsp bovis AF2122/97
cacaggggcagcgcggccaccc

SEQ ID NO: 1169415 - RNA, 20 nt, Mycobacterium bovis subsp bovis AF2122/97
cacagugaugguucaaugcc

SEQ ID NO: 1169416 - RNA, 17 nt, Mycobacterium bovis subsp bovis AF2122/97
cacagugcggccccgac

SEQ ID NO: 1169417 - RNA, 22 nt, Mycobacterium bovis subsp bovis AF2122/97
cacaguuaucagccgcgcgcca

SEQ ID NO: 1169418 - RNA, 13 nt, Mycobacterium bovis subsp bovis AF2122/97
cacauaagccccc

SEQ ID NO: 1169419 - RNA, 21 nt, Mycobacterium bovis subsp bovis AF2122/97
cacauacagcaggccgcgcuc

SEQ ID NO: 1169420 - RNA, 15 nt, Mycobacterium bovis subsp bovis AF2122/97
cacagccaguaaaaa

SEQ ID NO: 1169421 - RNA, 12 nt, Mycobacterium bovis subsp bovis AF2122/97
cacagcgcagcc

SEQ ID NO: 1169422 - RNA, 21 nt, Mycobacterium bovis subsp bovis AF2122/97
cacagcgcguagcgggcgccc

SEQ ID NO: 1169423 - RNA, 18 nt, Mycobacterium bovis subsp bovis AF2122/97
cacagcucgccgugacca

SEQ ID NO: 1169424 - RNA, 22 nt, Mycobacterium bovis subsp bovis AF2122/97
cacagcggccauaucgcccacc

SEQ ID NO: 1169425 - RNA, 23 nt, Mycobacterium bovis subsp bovis AF2122/97
cacagcggcgggucccgccacca

SEQ ID NO: 1169426 - RNA, 20 nt, Mycobacterium bovis subsp bovis AF2122/97
cacagcagcgucaucagguc

SEQ ID NO: 1169427 - RNA, 21 nt, Mycobacterium bovis subsp bovis AF2122/97
cacagcagcaccgcgaccauc

SEQ ID NO: 1169428 - RNA, 12 nt, Mycobacterium bovis subsp bovis AF2122/97
cacagcaggcuc

SEQ ID NO: 1169429 - RNA, 13 nt, Mycobacterium bovis subsp bovis AF2122/97
cacagcaccgucc

SEQ ID NO: 1169430 - RNA, 19 nt, Mycobacterium bovis subsp bovis AF2122/97
cacagcaacgugugcacca

SEQ ID NO: 1169431 - RNA, 13 nt, Mycobacterium bovis subsp bovis AF2122/97
cacagacagacag

SEQ ID NO: 1169432 - RNA, 18 nt, Mycobacterium bovis subsp bovis AF2122/97
cacagaccgaacagcacc

SEQ ID NO: 1169433 - RNA, 19 nt, Mycobacterium bovis subsp bovis AF2122/97
cacagaccgaacagcaccg

SEQ ID NO: 1169434 - RNA, 14 nt, Mycobacterium bovis subsp bovis AF2122/97
cacagaaccgggua

SEQ ID NO: 1169435 - RNA, 21 nt, Mycobacterium bovis subsp bovis AF2122/97
cacagaaucgcacgaaaucag

SEQ ID NO: 1169436 - RNA, 13 nt, Mycobacterium bovis subsp bovis AF2122/97
cacagaccgugac

SEQ ID NO: 1169437 - RNA, 17 nt, Mycobacterium bovis subsp bovis AF2122/97
cacaucaugccagccgu

SEQ ID NO: 1169438 - RNA, 17 nt, Mycobacterium bovis subsp bovis AF2122/97
cacauaugugcccggcg

SEQ ID NO: 1169439 - RNA, 22 nt, Mycobacterium bovis subsp bovis AF2122/97
cacaucaccaaaaacccgguga

SEQ ID NO: 1169440 - RNA, 13 nt, Mycobacterium bovis subsp bovis AF2122/97
cacauccaguaac

SEQ ID NO: 1169441 - RNA, 14 nt, Mycobacterium bovis subsp bovis AF2122/97
cacauccaucucca

SEQ ID NO: 1169442 - RNA, 20 nt, Mycobacterium bovis subsp bovis AF2122/97
cacauccacgcacucacuac

SEQ ID NO: 1169443 - RNA, 21 nt, Mycobacterium bovis subsp bovis AF2122/97
cacauccuggcggcugcagcc

SEQ ID NO: 1169444 - RNA, 19 nt, Mycobacterium bovis subsp bovis AF2122/97
cacaucguugucauagaaa

SEQ ID NO: 1169445 - RNA, 16 nt, Mycobacterium bovis subsp bovis AF2122/97
cacaucgucacugcca

SEQ ID NO: 1169446 - RNA, 17 nt, Mycobacterium bovis subsp bovis AF2122/97
cacaucgucacugccac

SEQ ID NO: 1169447 - RNA, 15 nt, Mycobacterium bovis subsp bovis AF2122/97
cacaugaucgagcag

SEQ ID NO: 1169448 - RNA, 17 nt, Mycobacterium bovis subsp bovis AF2122/97
cacauggaacucacccu

SEQ ID NO: 1169449 - RNA, 19 nt, Mycobacterium bovis subsp bovis AF2122/97
cacaugcgcguccagcugg

SEQ ID NO: 1169450 - RNA, 20 nt, Mycobacterium bovis subsp bovis AF2122/97
cacaugcucgacgcccgcca

SEQ ID NO: 1169451 - RNA, 15 nt, Mycobacterium bovis subsp bovis AF2122/97
caccaaccagugcag

SEQ ID NO: 1169452 - RNA, 15 nt, Mycobacterium bovis subsp bovis AF2122/97
caccaacgccaccgu

SEQ ID NO: 1169453 - RNA, 14 nt, Mycobacterium bovis subsp bovis AF2122/97
caccaacgccaccg

SEQ ID NO: 1169454 - RNA, 23 nt, Mycobacterium bovis subsp bovis AF2122/97
caccaacgcgaucaggcgcucga

SEQ ID NO: 1169455 - RNA, 22 nt, Mycobacterium bovis subsp bovis AF2122/97
caccaagcucggccagcacgcc

SEQ ID NO: 1169456 - RNA, 13 nt, Mycobacterium bovis subsp bovis AF2122/97
caccaaguucagc

SEQ ID NO: 1169457 - RNA, 17 nt, Mycobacterium bovis subsp bovis AF2122/97
caccaaguucagcacgu

SEQ ID NO: 1169458 - RNA, 20 nt, Mycobacterium bovis subsp bovis AF2122/97
caccaaggccgccugcaaca

SEQ ID NO: 1169459 - RNA, 18 nt, Mycobacterium bovis subsp bovis AF2122/97
cacauuuuuguuguuauu

SEQ ID NO: 1169460 - RNA, 15 nt, Mycobacterium bovis subsp bovis AF2122/97
cacauuggcgaucag

SEQ ID NO: 1169461 - RNA, 13 nt, Mycobacterium bovis subsp bovis AF2122/97
cacauucagcgcc

SEQ ID NO: 1169462 - RNA, 16 nt, Mycobacterium bovis subsp bovis AF2122/97
cacauuccgcaguccc

SEQ ID NO: 1169463 - RNA, 20 nt, Mycobacterium bovis subsp bovis AF2122/97
cacauugccggccaccagcc

SEQ ID NO: 1169464 - RNA, 21 nt, Mycobacterium bovis subsp bovis AF2122/97
cacauugaucgacggccagcc

SEQ ID NO: 1169465 - RNA, 12 nt, Mycobacterium bovis subsp bovis AF2122/97
cacauugaccag

SEQ ID NO: 1169466 - RNA, 14 nt, Mycobacterium bovis subsp bovis AF2122/97
caccacggcgcgcg

SEQ ID NO: 1169467 - RNA, 17 nt, Mycobacterium bovis subsp bovis AF2122/97
caccacggcggccaccu

SEQ ID NO: 1169468 - RNA, 23 nt, Mycobacterium bovis subsp bovis AF2122/97
caccacggcguugccgccggcuc

SEQ ID NO: 1169469 - RNA, 18 nt, Mycobacterium bovis subsp bovis AF2122/97
caccacgcuggccucguc

SEQ ID NO: 1169470 - RNA, 18 nt, Mycobacterium bovis subsp bovis AF2122/97
caccacgguuggccacca

SEQ ID NO: 1169471 - RNA, 23 nt, Mycobacterium bovis subsp bovis AF2122/97
caccacgguggccgcugccagcc

SEQ ID NO: 1169472 - RNA, 20 nt, Mycobacterium bovis subsp bovis AF2122/97
caccacggucaagccggcgc

SEQ ID NO: 1169473 - RNA, 14 nt, Mycobacterium bovis subsp bovis AF2122/97
caccacgugcgcca

SEQ ID NO: 1169474 - RNA, 14 nt, Mycobacterium bovis subsp bovis AF2122/97
caccacguggcccu

SEQ ID NO: 1169475 - RNA, 21 nt, Mycobacterium bovis subsp bovis AF2122/97
caccacuagcggcucaccgcg

SEQ ID NO: 1169476 - RNA, 16 nt, Mycobacterium bovis subsp bovis AF2122/97
caccacgauggcggcc

SEQ ID NO: 1169477 - RNA, 20 nt, Mycobacterium bovis subsp bovis AF2122/97
caccacgauggcggccaccg

SEQ ID NO: 1169478 - RNA, 19 nt, Mycobacterium bovis subsp bovis AF2122/97
caccacgaucaacucgugc

SEQ ID NO: 1169479 - RNA, 20 nt, Mycobacterium bovis subsp bovis AF2122/97
caccacgcaugcgcgcgccg

SEQ ID NO: 1169480 - RNA, 13 nt, Mycobacterium bovis subsp bovis AF2122/97
caccaccuuggau

SEQ ID NO: 1169481 - RNA, 23 nt, Mycobacterium bovis subsp bovis AF2122/97
caccacgaacacguucggguacc

SEQ ID NO: 1169482 - RNA, 17 nt, Mycobacterium bovis subsp bovis AF2122/97
caccagaauccugcuuu

SEQ ID NO: 1169483 - RNA, 20 nt, Mycobacterium bovis subsp bovis AF2122/97
caccagaauccugcuuucca

SEQ ID NO: 1169484 - RNA, 16 nt, Mycobacterium bovis subsp bovis AF2122/97
caccagauggcucucg

SEQ ID NO: 1169485 - RNA, 22 nt, Mycobacterium bovis subsp bovis AF2122/97
caccagaucgcacaccaacacc

SEQ ID NO: 1169486 - RNA, 22 nt, Mycobacterium bovis subsp bovis AF2122/97
caccagaugcaccucgcccugc

SEQ ID NO: 1169487 - RNA, 22 nt, Mycobacterium bovis subsp bovis AF2122/97
caccagaaaugguucgcacacc

SEQ ID NO: 1169488 - RNA, 12 nt, Mycobacterium bovis subsp bovis AF2122/97
caccagaaacac

SEQ ID NO: 1169489 - RNA, 22 nt, Mycobacterium bovis subsp bovis AF2122/97
caccacguugugcagcgcguca

SEQ ID NO: 1169490 - RNA, 18 nt, Mycobacterium bovis subsp bovis AF2122/97
caccacugcgcccgccac

SEQ ID NO: 1169491 - RNA, 17 nt, Mycobacterium bovis subsp bovis AF2122/97
caccacuggacccgccc

SEQ ID NO: 1169492 - RNA, 14 nt, Mycobacterium bovis subsp bovis AF2122/97
caccaccguggcgc

SEQ ID NO: 1169493 - RNA, 14 nt, Mycobacterium bovis subsp bovis AF2122/97
caccaccggcgccu

SEQ ID NO: 1169494 - RNA, 12 nt, Mycobacterium bovis subsp bovis AF2122/97
caccaccggccc

SEQ ID NO: 1169495 - RNA, 20 nt, Mycobacterium bovis subsp bovis AF2122/97
caccaccgucgagccggaca

SEQ ID NO: 1169496 - RNA, 13 nt, Mycobacterium bovis subsp bovis AF2122/97
caccaccgugaag

SEQ ID NO: 1169497 - RNA, 22 nt, Mycobacterium bovis subsp bovis AF2122/97
caccaccucggugaccaggccg

SEQ ID NO: 1169498 - RNA, 14 nt, Mycobacterium bovis subsp bovis AF2122/97
caccaccggcaccg

SEQ ID NO: 1169499 - RNA, 15 nt, Mycobacterium bovis subsp bovis AF2122/97
caccaccggccccac

SEQ ID NO: 1169500 - RNA, 20 nt, Mycobacterium bovis subsp bovis AF2122/97
caccaccggccccaccggca

SEQ ID NO: 1169501 - RNA, 19 nt, Mycobacterium bovis subsp bovis AF2122/97
caccaccgcggcggcggcc

SEQ ID NO: 1169502 - RNA, 18 nt, Mycobacterium bovis subsp bovis AF2122/97
caccaccggcaacaucag

SEQ ID NO: 1169503 - RNA, 19 nt, Mycobacterium bovis subsp bovis AF2122/97
caccaccggaucgcucccg

SEQ ID NO: 1169504 - RNA, 12 nt, Mycobacterium bovis subsp bovis AF2122/97
caccaccgccga

SEQ ID NO: 1169505 - RNA, 15 nt, Mycobacterium bovis subsp bovis AF2122/97
caccaccgccgaccc

SEQ ID NO: 1169506 - RNA, 16 nt, Mycobacterium bovis subsp bovis AF2122/97
caccaccgccgacccu

SEQ ID NO: 1169507 - RNA, 17 nt, Mycobacterium bovis subsp bovis AF2122/97
caccaccgccgccggca

SEQ ID NO: 1169508 - RNA, 20 nt, Mycobacterium bovis subsp bovis AF2122/97
caccaccgccgccggcaccg

SEQ ID NO: 1169509 - RNA, 13 nt, Mycobacterium bovis subsp bovis AF2122/97
caccaccgccccg

SEQ ID NO: 1169510 - RNA, 22 nt, Mycobacterium bovis subsp bovis AF2122/97
caccaccgccccgcgcccaacg

SEQ ID NO: 1169511 - RNA, 13 nt, Mycobacterium bovis subsp bovis AF2122/97
caccaccgccaga

SEQ ID NO: 1169512 - RNA, 13 nt, Mycobacterium bovis subsp bovis AF2122/97
caccaccauuccc

SEQ ID NO: 1169513 - RNA, 20 nt, Mycobacterium bovis subsp bovis AF2122/97
caccaccauucccggaccca

SEQ ID NO: 1169514 - RNA, 21 nt, Mycobacterium bovis subsp bovis AF2122/97
caccaccauucccggacccac

SEQ ID NO: 1169515 - RNA, 14 nt, Mycobacterium bovis subsp bovis AF2122/97
caccacccaacagc

SEQ ID NO: 1169516 - RNA, 17 nt, Mycobacterium bovis subsp bovis AF2122/97
caccaccccagcggcca

SEQ ID NO: 1169517 - RNA, 21 nt, Mycobacterium bovis subsp bovis AF2122/97
caccaccgacagcacccggcc

SEQ ID NO: 1169518 - RNA, 21 nt, Mycobacterium bovis subsp bovis AF2122/97
caccacccuguuguugccccg

SEQ ID NO: 1169519 - RNA, 15 nt, Mycobacterium bovis subsp bovis AF2122/97
caccacccugcacug

SEQ ID NO: 1169520 - RNA, 13 nt, Mycobacterium bovis subsp bovis AF2122/97
caccaccccagcg

SEQ ID NO: 1169521 - RNA, 18 nt, Mycobacterium bovis subsp bovis AF2122/97
caccacccgaccgccauc

SEQ ID NO: 1169522 - RNA, 14 nt, Mycobacterium bovis subsp bovis AF2122/97
caccaccgcacggg

SEQ ID NO: 1169523 - RNA, 24 nt, Mycobacterium bovis subsp bovis AF2122/97
caccacauuggcgaucagcagccg

SEQ ID NO: 1169524 - RNA, 13 nt, Mycobacterium bovis subsp bovis AF2122/97
caccaccacgccg

SEQ ID NO: 1169525 - RNA, 15 nt, Mycobacterium bovis subsp bovis AF2122/97
caccaccacggccag

SEQ ID NO: 1169526 - RNA, 14 nt, Mycobacterium bovis subsp bovis AF2122/97
caccacaccgagca

SEQ ID NO: 1169527 - RNA, 17 nt, Mycobacterium bovis subsp bovis AF2122/97
caccacaccgagcaccu

SEQ ID NO: 1169528 - RNA, 18 nt, Mycobacterium bovis subsp bovis AF2122/97
caccacaauccacgcacu

SEQ ID NO: 1169529 - RNA, 19 nt, Mycobacterium bovis subsp bovis AF2122/97
caccacaccggagccgaac

SEQ ID NO: 1169530 - RNA, 14 nt, Mycobacterium bovis subsp bovis AF2122/97
caccaaugcuccug

SEQ ID NO: 1169531 - RNA, 16 nt, Mycobacterium bovis subsp bovis AF2122/97
caccaugaucacaccg

SEQ ID NO: 1169532 - RNA, 17 nt, Mycobacterium bovis subsp bovis AF2122/97
caccaugauugccagga

SEQ ID NO: 1169533 - RNA, 21 nt, Mycobacterium bovis subsp bovis AF2122/97
caccauguacaggcuguccag

SEQ ID NO: 1169534 - RNA, 19 nt, Mycobacterium bovis subsp bovis AF2122/97
caccaugguggugaugcca

SEQ ID NO: 1169535 - RNA, 18 nt, Mycobacterium bovis subsp bovis AF2122/97
caccaugggucuggcagg

SEQ ID NO: 1169536 - RNA, 21 nt, Mycobacterium bovis subsp bovis AF2122/97
caccaugggucuggcaggcca

SEQ ID NO: 1169537 - RNA, 14 nt, Mycobacterium bovis subsp bovis AF2122/97
caccauccccggca

SEQ ID NO: 1169538 - RNA, 14 nt, Mycobacterium bovis subsp bovis AF2122/97
caccauccgguccc

SEQ ID NO: 1169539 - RNA, 13 nt, Mycobacterium bovis subsp bovis AF2122/97
caccaucgccgcc

SEQ ID NO: 1169540 - RNA, 19 nt, Mycobacterium bovis subsp bovis AF2122/97
caccaucgccgccgcgcgu

SEQ ID NO: 1169541 - RNA, 19 nt, Mycobacterium bovis subsp bovis AF2122/97
caccaucgcggccgcuggg

SEQ ID NO: 1169542 - RNA, 18 nt, Mycobacterium bovis subsp bovis AF2122/97
caccaucggcgaggccuc

SEQ ID NO: 1169543 - RNA, 22 nt, Mycobacterium bovis subsp bovis AF2122/97
caccaucgguaucgagggcagc

SEQ ID NO: 1169544 - RNA, 11 nt, Mycobacterium bovis subsp bovis AF2122/97
caccaucauca

SEQ ID NO: 1169545 - RNA, 13 nt, Mycobacterium bovis subsp bovis AF2122/97
caccauccagccc

SEQ ID NO: 1169546 - RNA, 15 nt, Mycobacterium bovis subsp bovis AF2122/97
cacccaccggccacc

SEQ ID NO: 1169547 - RNA, 14 nt, Mycobacterium bovis subsp bovis AF2122/97
cacccacccgcacc

SEQ ID NO: 1169548 - RNA, 17 nt, Mycobacterium bovis subsp bovis AF2122/97
cacccacccgcaccgcg

SEQ ID NO: 1169549 - RNA, 22 nt, Mycobacterium bovis subsp bovis AF2122/97
cacccacccguucggcugcgcu

SEQ ID NO: 1169550 - RNA, 18 nt, Mycobacterium bovis subsp bovis AF2122/97
cacccaccggaccaccgc

SEQ ID NO: 1169551 - RNA, 19 nt, Mycobacterium bovis subsp bovis AF2122/97
cacccaccggaccaccgcc

SEQ ID NO: 1169552 - RNA, 20 nt, Mycobacterium bovis subsp bovis AF2122/97
cacccaccggaccaccgccg

SEQ ID NO: 1169553 - RNA, 16 nt, Mycobacterium bovis subsp bovis AF2122/97
cacccaccggccacca

SEQ ID NO: 1169554 - RNA, 18 nt, Mycobacterium bovis subsp bovis AF2122/97
cacccagaccgccgaaga

SEQ ID NO: 1169555 - RNA, 17 nt, Mycobacterium bovis subsp bovis AF2122/97
cacccacgucgagcagg

SEQ ID NO: 1169556 - RNA, 23 nt, Mycobacterium bovis subsp bovis AF2122/97
cacccacuuucgacccgcggcgg

SEQ ID NO: 1169557 - RNA, 20 nt, Mycobacterium bovis subsp bovis AF2122/97
cacccacuuuucgguggcgg

SEQ ID NO: 1169558 - RNA, 23 nt, Mycobacterium bovis subsp bovis AF2122/97
cacccacaugacgaucgcggcgg

SEQ ID NO: 1169559 - RNA, 16 nt, Mycobacterium bovis subsp bovis AF2122/97
cacccaccacaccaag

SEQ ID NO: 1169560 - RNA, 17 nt, Mycobacterium bovis subsp bovis AF2122/97
cacccaccacaccaagg

SEQ ID NO: 1169561 - RNA, 20 nt, Mycobacterium bovis subsp bovis AF2122/97
cacccaauggagccgcgacc

SEQ ID NO: 1169562 - RNA, 19 nt, Mycobacterium bovis subsp bovis AF2122/97
cacccaauacacccaacuc

SEQ ID NO: 1169563 - RNA, 16 nt, Mycobacterium bovis subsp bovis AF2122/97
cacccaaugccaccgc

SEQ ID NO: 1169564 - RNA, 17 nt, Mycobacterium bovis subsp bovis AF2122/97
cacccaauggagccgcg

SEQ ID NO: 1169565 - RNA, 14 nt, Mycobacterium bovis subsp bovis AF2122/97
cacccaaccccgcc

SEQ ID NO: 1169566 - RNA, 17 nt, Mycobacterium bovis subsp bovis AF2122/97
cacccaaaccggcccgc

SEQ ID NO: 1169567 - RNA, 21 nt, Mycobacterium bovis subsp bovis AF2122/97
cacccaaaccggcccgcagca

SEQ ID NO: 1169568 - RNA, 21 nt, Mycobacterium bovis subsp bovis AF2122/97
cacccaacgcaauaagggaga

SEQ ID NO: 1169569 - RNA, 23 nt, Mycobacterium bovis subsp bovis AF2122/97
cacccaacggugggugggcgccg

SEQ ID NO: 1169570 - RNA, 21 nt, Mycobacterium bovis subsp bovis AF2122/97
cacccaacucaugggccaacu

SEQ ID NO: 1169571 - RNA, 20 nt, Mycobacterium bovis subsp bovis AF2122/97
caccaugucggccacccgga

SEQ ID NO: 1169572 - RNA, 15 nt, Mycobacterium bovis subsp bovis AF2122/97
caccauguauuucuc

SEQ ID NO: 1169573 - RNA, 14 nt, Mycobacterium bovis subsp bovis AF2122/97
caccccgaccacca

SEQ ID NO: 1169574 - RNA, 16 nt, Mycobacterium bovis subsp bovis AF2122/97
cacccccaccgaagcg

SEQ ID NO: 1169575 - RNA, 14 nt, Mycobacterium bovis subsp bovis AF2122/97
cacccccgauagcg

SEQ ID NO: 1169576 - RNA, 22 nt, Mycobacterium bovis subsp bovis AF2122/97
caccccgaucuggcguagugcu

SEQ ID NO: 1169577 - RNA, 16 nt, Mycobacterium bovis subsp bovis AF2122/97
caccccgagcucacca

SEQ ID NO: 1169578 - RNA, 13 nt, Mycobacterium bovis subsp bovis AF2122/97
caccccggccacu

SEQ ID NO: 1169579 - RNA, 19 nt, Mycobacterium bovis subsp bovis AF2122/97
caccccggcucggccaccg

SEQ ID NO: 1169580 - RNA, 18 nt, Mycobacterium bovis subsp bovis AF2122/97
caccccgcuugcgcggcu

SEQ ID NO: 1169581 - RNA, 13 nt, Mycobacterium bovis subsp bovis AF2122/97
caccccggcggcc

SEQ ID NO: 1169582 - RNA, 17 nt, Mycobacterium bovis subsp bovis AF2122/97
caccccggugcccgcgg

SEQ ID NO: 1169583 - RNA, 19 nt, Mycobacterium bovis subsp bovis AF2122/97
caccccggucccgccgacc

SEQ ID NO: 1169584 - RNA, 15 nt, Mycobacterium bovis subsp bovis AF2122/97
cacccgcacgaagcc

SEQ ID NO: 1169585 - RNA, 16 nt, Mycobacterium bovis subsp bovis AF2122/97
cacccgcaccgccggc

SEQ ID NO: 1169586 - RNA, 14 nt, Mycobacterium bovis subsp bovis AF2122/97
cacccgcaccgcgg

SEQ ID NO: 1169587 - RNA, 18 nt, Mycobacterium bovis subsp bovis AF2122/97
cacccgcaaugaccgcgg

SEQ ID NO: 1169588 - RNA, 17 nt, Mycobacterium bovis subsp bovis AF2122/97
cacccgcaccaccggcc

SEQ ID NO: 1169589 - RNA, 19 nt, Mycobacterium bovis subsp bovis AF2122/97
cacccgcaccaccggcccc

SEQ ID NO: 1169590 - RNA, 14 nt, Mycobacterium bovis subsp bovis AF2122/97
caccccuuugacgc

SEQ ID NO: 1169591 - RNA, 15 nt, Mycobacterium bovis subsp bovis AF2122/97
caccccuucgccagc

SEQ ID NO: 1169592 - RNA, 12 nt, Mycobacterium bovis subsp bovis AF2122/97
caccccagggca

SEQ ID NO: 1169593 - RNA, 19 nt, Mycobacterium bovis subsp bovis AF2122/97
caccccaugaccgggaggc

SEQ ID NO: 1169594 - RNA, 18 nt, Mycobacterium bovis subsp bovis AF2122/97
caccccauggccaccgaa

SEQ ID NO: 1169595 - RNA, 23 nt, Mycobacterium bovis subsp bovis AF2122/97
cacccccgacgagauacggccac

SEQ ID NO: 1169596 - RNA, 22 nt, Mycobacterium bovis subsp bovis AF2122/97
caccccacccagcgacucggcc

SEQ ID NO: 1169597 - RNA, 20 nt, Mycobacterium bovis subsp bovis AF2122/97
caccccacuggcacacgguc

SEQ ID NO: 1169598 - RNA, 13 nt, Mycobacterium bovis subsp bovis AF2122/97
caccccaggcacc

SEQ ID NO: 1169599 - RNA, 13 nt, Mycobacterium bovis subsp bovis AF2122/97
cacccaugauccc

SEQ ID NO: 1169600 - RNA, 22 nt, Mycobacterium bovis subsp bovis AF2122/97
cacccauggccucccacucacc

SEQ ID NO: 1169601 - RNA, 17 nt, Mycobacterium bovis subsp bovis AF2122/97
caccccaaaaccgccgg

SEQ ID NO: 1169602 - RNA, 21 nt, Mycobacterium bovis subsp bovis AF2122/97
cacccagcgugcccgccaccg

SEQ ID NO: 1169603 - RNA, 19 nt, Mycobacterium bovis subsp bovis AF2122/97
cacccaggugucgcugcug

SEQ ID NO: 1169604 - RNA, 14 nt, Mycobacterium bovis subsp bovis AF2122/97
cacccagaugcagg

SEQ ID NO: 1169605 - RNA, 14 nt, Mycobacterium bovis subsp bovis AF2122/97
cacccagcacgcgc

SEQ ID NO: 1169606 - RNA, 16 nt, Mycobacterium bovis subsp bovis AF2122/97
cacccagcgccgaccc

SEQ ID NO: 1169607 - RNA, 14 nt, Mycobacterium bovis subsp bovis AF2122/97
cacccaucccguuc

SEQ ID NO: 1169608 - RNA, 21 nt, Mycobacterium bovis subsp bovis AF2122/97
cacccauccucgcggugcgcc

SEQ ID NO: 1169609 - RNA, 18 nt, Mycobacterium bovis subsp bovis AF2122/97
cacccaucgaccgcccgc

SEQ ID NO: 1169610 - RNA, 20 nt, Mycobacterium bovis subsp bovis AF2122/97
cacccaucgaccgcccgcca

SEQ ID NO: 1169611 - RNA, 23 nt, Mycobacterium bovis subsp bovis AF2122/97
cacccaucaacgccggcgacggc

SEQ ID NO: 1169612 - RNA, 14 nt, Mycobacterium bovis subsp bovis AF2122/97
cacccaucaccgcc

SEQ ID NO: 1169613 - RNA, 16 nt, Mycobacterium bovis subsp bovis AF2122/97
cacccauagacccggc

SEQ ID NO: 1169614 - RNA, 22 nt, Mycobacterium bovis subsp bovis AF2122/97
cacccaggugucgcugcugaac

SEQ ID NO: 1169615 - RNA, 20 nt, Mycobacterium bovis subsp bovis AF2122/97
caccagcggcaccgcggcca

SEQ ID NO: 1169616 - RNA, 23 nt, Mycobacterium bovis subsp bovis AF2122/97
caccagcggcauauggauguugg

SEQ ID NO: 1169617 - RNA, 21 nt, Mycobacterium bovis subsp bovis AF2122/97
caccagcgcgagcccgaacca

SEQ ID NO: 1169618 - RNA, 18 nt, Mycobacterium bovis subsp bovis AF2122/97
caccagcgcuccagcacc

SEQ ID NO: 1169619 - RNA, 16 nt, Mycobacterium bovis subsp bovis AF2122/97
caccagcgcuccagca

SEQ ID NO: 1169620 - RNA, 14 nt, Mycobacterium bovis subsp bovis AF2122/97
caccagcggcggca

SEQ ID NO: 1169621 - RNA, 16 nt, Mycobacterium bovis subsp bovis AF2122/97
caccagcggcggcccu

SEQ ID NO: 1169622 - RNA, 20 nt, Mycobacterium bovis subsp bovis AF2122/97
caccagcggcugaccgggca

SEQ ID NO: 1169623 - RNA, 20 nt, Mycobacterium bovis subsp bovis AF2122/97
caccagcggucagccggcca

SEQ ID NO: 1169624 - RNA, 17 nt, Mycobacterium bovis subsp bovis AF2122/97
caccagcgucgcggcca

SEQ ID NO: 1169625 - RNA, 21 nt, Mycobacterium bovis subsp bovis AF2122/97
caccagcucacccggagcacc

SEQ ID NO: 1169626 - RNA, 18 nt, Mycobacterium bovis subsp bovis AF2122/97
caccagcugucgggcagc

SEQ ID NO: 1169627 - RNA, 19 nt, Mycobacterium bovis subsp bovis AF2122/97
caccagcgcagcauugacc

SEQ ID NO: 1169628 - RNA, 21 nt, Mycobacterium bovis subsp bovis AF2122/97
caccagcgcagcauugaccaa

SEQ ID NO: 1169629 - RNA, 21 nt, Mycobacterium bovis subsp bovis AF2122/97
caccagcgaccaggucgccag

SEQ ID NO: 1169630 - RNA, 14 nt, Mycobacterium bovis subsp bovis AF2122/97
caccagcgacgcca

SEQ ID NO: 1169631 - RNA, 13 nt, Mycobacterium bovis subsp bovis AF2122/97
caccagcgcgccg

SEQ ID NO: 1169632 - RNA, 15 nt, Mycobacterium bovis subsp bovis AF2122/97
caccagcgcccggcc

SEQ ID NO: 1169633 - RNA, 17 nt, Mycobacterium bovis subsp bovis AF2122/97
caccagcgcccggcccg

SEQ ID NO: 1169634 - RNA, 20 nt, Mycobacterium bovis subsp bovis AF2122/97
caccagcgcccggcccgcca

SEQ ID NO: 1169635 - RNA, 23 nt, Mycobacterium bovis subsp bovis AF2122/97
caccagcgcccggcccgccaccc

SEQ ID NO: 1169636 - RNA, 20 nt, Mycobacterium bovis subsp bovis AF2122/97
caccagcgccgacccguacc

SEQ ID NO: 1169637 - RNA, 14 nt, Mycobacterium bovis subsp bovis AF2122/97
caccagcacacccg

SEQ ID NO: 1169638 - RNA, 14 nt, Mycobacterium bovis subsp bovis AF2122/97
caccagcacacucu

SEQ ID NO: 1169639 - RNA, 22 nt, Mycobacterium bovis subsp bovis AF2122/97
caccagcaagugugagcagacc

SEQ ID NO: 1169640 - RNA, 13 nt, Mycobacterium bovis subsp bovis AF2122/97
caccagcagcacu

SEQ ID NO: 1169641 - RNA, 20 nt, Mycobacterium bovis subsp bovis AF2122/97
caccagcagcacuccggcga

SEQ ID NO: 1169642 - RNA, 16 nt, Mycobacterium bovis subsp bovis AF2122/97
caccagcacggcaacc

SEQ ID NO: 1169643 - RNA, 14 nt, Mycobacterium bovis subsp bovis AF2122/97
caccagccccaacc

SEQ ID NO: 1169644 - RNA, 23 nt, Mycobacterium bovis subsp bovis AF2122/97
caccagcccggcggcggucacca

SEQ ID NO: 1169645 - RNA, 12 nt, Mycobacterium bovis subsp bovis AF2122/97
caccagcccggc

SEQ ID NO: 1169646 - RNA, 23 nt, Mycobacterium bovis subsp bovis AF2122/97
caccagccgggcaaggcccgguc

SEQ ID NO: 1169647 - RNA, 20 nt, Mycobacterium bovis subsp bovis AF2122/97
caccagccgguagccgggca

SEQ ID NO: 1169648 - RNA, 21 nt, Mycobacterium bovis subsp bovis AF2122/97
caccagccgguuggcugccgg

SEQ ID NO: 1169649 - RNA, 17 nt, Mycobacterium bovis subsp bovis AF2122/97
caccagcauucucgccg

SEQ ID NO: 1169650 - RNA, 13 nt, Mycobacterium bovis subsp bovis AF2122/97
caccagcaugccu

SEQ ID NO: 1169651 - RNA, 13 nt, Mycobacterium bovis subsp bovis AF2122/97
caccagccagccu

SEQ ID NO: 1169652 - RNA, 15 nt, Mycobacterium bovis subsp bovis AF2122/97
caccagccagccugc

SEQ ID NO: 1169653 - RNA, 15 nt, Mycobacterium bovis subsp bovis AF2122/97
caccagucacgccca

SEQ ID NO: 1169654 - RNA, 19 nt, Mycobacterium bovis subsp bovis AF2122/97
caccagucacgcccaccac

SEQ ID NO: 1169655 - RNA, 19 nt, Mycobacterium bovis subsp bovis AF2122/97
caccaguguggcgaugacc

SEQ ID NO: 1169656 - RNA, 23 nt, Mycobacterium bovis subsp bovis AF2122/97
caccaggucuucgaccacggucu

SEQ ID NO: 1169657 - RNA, 20 nt, Mycobacterium bovis subsp bovis AF2122/97
caccagugccccgccgagcg

SEQ ID NO: 1169658 - RNA, 23 nt, Mycobacterium bovis subsp bovis AF2122/97
caccaucaacauugugcucgccg

SEQ ID NO: 1169659 - RNA, 14 nt, Mycobacterium bovis subsp bovis AF2122/97
caccaucaaggacu

SEQ ID NO: 1169660 - RNA, 16 nt, Mycobacterium bovis subsp bovis AF2122/97
caccaggucauugccg

SEQ ID NO: 1169661 - RNA, 18 nt, Mycobacterium bovis subsp bovis AF2122/97
caccagguccaccccgcc

SEQ ID NO: 1169662 - RNA, 17 nt, Mycobacterium bovis subsp bovis AF2122/97
caccaggguguauggcc

SEQ ID NO: 1169663 - RNA, 17 nt, Mycobacterium bovis subsp bovis AF2122/97
caccagggugccgggca

SEQ ID NO: 1169664 - RNA, 17 nt, Mycobacterium bovis subsp bovis AF2122/97
caccaggggaccgcggc

SEQ ID NO: 1169665 - RNA, 14 nt, Mycobacterium bovis subsp bovis AF2122/97
caccagggcggccu

SEQ ID NO: 1169666 - RNA, 15 nt, Mycobacterium bovis subsp bovis AF2122/97
caccaggcccgguuc

SEQ ID NO: 1169667 - RNA, 17 nt, Mycobacterium bovis subsp bovis AF2122/97
caccgucacgccaccgc

SEQ ID NO: 1169668 - RNA, 22 nt, Mycobacterium bovis subsp bovis AF2122/97
caccguagccgcugcacguggc

SEQ ID NO: 1169669 - RNA, 20 nt, Mycobacterium bovis subsp bovis AF2122/97
caccguagagcaugccgccc

SEQ ID NO: 1169670 - RNA, 21 nt, Mycobacterium bovis subsp bovis AF2122/97
caccgguucggggggcagguc

SEQ ID NO: 1169671 - RNA, 20 nt, Mycobacterium bovis subsp bovis AF2122/97
caccgguuugacguccaggg

SEQ ID NO: 1169672 - RNA, 21 nt, Mycobacterium bovis subsp bovis AF2122/97
caccgucguacucggcggcca

SEQ ID NO: 1169673 - RNA, 17 nt, Mycobacterium bovis subsp bovis AF2122/97
caccgucggcagcagcg

SEQ ID NO: 1169674 - RNA, 18 nt, Mycobacterium bovis subsp bovis AF2122/97
caccgucggcagcagcgg

SEQ ID NO: 1169675 - RNA, 17 nt, Mycobacterium bovis subsp bovis AF2122/97
caccgucuccggcgcca

SEQ ID NO: 1169676 - RNA, 14 nt, Mycobacterium bovis subsp bovis AF2122/97
caccgucgcggcgg

SEQ ID NO: 1169677 - RNA, 18 nt, Mycobacterium bovis subsp bovis AF2122/97
caccguccgucggcgcuc

SEQ ID NO: 1169678 - RNA, 14 nt, Mycobacterium bovis subsp bovis AF2122/97
caccgggcgcugcu

SEQ ID NO: 1169679 - RNA, 23 nt, Mycobacterium bovis subsp bovis AF2122/97
caccgggguuacucgcagcgccg

SEQ ID NO: 1169680 - RNA, 15 nt, Mycobacterium bovis subsp bovis AF2122/97
caccggucaccgcgc

SEQ ID NO: 1169681 - RNA, 12 nt, Mycobacterium bovis subsp bovis AF2122/97
caccgguaccgc

SEQ ID NO: 1169682 - RNA, 19 nt, Mycobacterium bovis subsp bovis AF2122/97
caccggguugagccgccgc

SEQ ID NO: 1169683 - RNA, 13 nt, Mycobacterium bovis subsp bovis AF2122/97
caccgguaccgau

SEQ ID NO: 1169684 - RNA, 17 nt, Mycobacterium bovis subsp bovis AF2122/97
caccgguggcuucaacc

SEQ ID NO: 1169685 - RNA, 16 nt, Mycobacterium bovis subsp bovis AF2122/97
caccggugcccaccac

SEQ ID NO: 1169686 - RNA, 14 nt, Mycobacterium bovis subsp bovis AF2122/97
caccggugccgccc

SEQ ID NO: 1169687 - RNA, 22 nt, Mycobacterium bovis subsp bovis AF2122/97
caccggugccgcccgcgccgcc

SEQ ID NO: 1169688 - RNA, 17 nt, Mycobacterium bovis subsp bovis AF2122/97
caccggucggcagcuuc

SEQ ID NO: 1169689 - RNA, 18 nt, Mycobacterium bovis subsp bovis AF2122/97
caccggucaccgcgcagc

SEQ ID NO: 1169690 - RNA, 18 nt, Mycobacterium bovis subsp bovis AF2122/97
caccggugucggccagca

SEQ ID NO: 1169691 - RNA, 17 nt, Mycobacterium bovis subsp bovis AF2122/97
caccuaccgagaucacc

SEQ ID NO: 1169692 - RNA, 19 nt, Mycobacterium bovis subsp bovis AF2122/97
caccuaccguacgcagcgu

SEQ ID NO: 1169693 - RNA, 14 nt, Mycobacterium bovis subsp bovis AF2122/97
caccuauggucaac

SEQ ID NO: 1169694 - RNA, 13 nt, Mycobacterium bovis subsp bovis AF2122/97
caccuagucgcgg

SEQ ID NO: 1169695 - RNA, 17 nt, Mycobacterium bovis subsp bovis AF2122/97
caccuagucgcggccgu

SEQ ID NO: 1169696 - RNA, 17 nt, Mycobacterium bovis subsp bovis AF2122/97
caccgugaccgccgcgc

SEQ ID NO: 1169697 - RNA, 21 nt, Mycobacterium bovis subsp bovis AF2122/97
caccgugccgacgccccgauc

SEQ ID NO: 1169698 - RNA, 14 nt, Mycobacterium bovis subsp bovis AF2122/97
caccgugccgggcg

SEQ ID NO: 1169699 - RNA, 17 nt, Mycobacterium bovis subsp bovis AF2122/97
caccguggaucggcagc

SEQ ID NO: 1169700 - RNA, 22 nt, Mycobacterium bovis subsp bovis AF2122/97
caccguuguaugcugcgcgccg

SEQ ID NO: 1169701 - RNA, 21 nt, Mycobacterium bovis subsp bovis AF2122/97
caccguugccgaaccacgcgc

SEQ ID NO: 1169702 - RNA, 12 nt, Mycobacterium bovis subsp bovis AF2122/97
caccguugcguu

SEQ ID NO: 1169703 - RNA, 19 nt, Mycobacterium bovis subsp bovis AF2122/97
caccguugcguuggcgcca

SEQ ID NO: 1169704 - RNA, 15 nt, Mycobacterium bovis subsp bovis AF2122/97
caccguuaccgccgu

SEQ ID NO: 1169705 - RNA, 18 nt, Mycobacterium bovis subsp bovis AF2122/97
caccguguugcacgcggg

SEQ ID NO: 1169706 - RNA, 16 nt, Mycobacterium bovis subsp bovis AF2122/97
caccguuaccgccguc

SEQ ID NO: 1169707 - RNA, 16 nt, Mycobacterium bovis subsp bovis AF2122/97
caccguuagccagguc

SEQ ID NO: 1169708 - RNA, 16 nt, Mycobacterium bovis subsp bovis AF2122/97
caccucccacgccgcc

SEQ ID NO: 1169709 - RNA, 13 nt, Mycobacterium bovis subsp bovis AF2122/97
caccucccgcagc

SEQ ID NO: 1169710 - RNA, 17 nt, Mycobacterium bovis subsp bovis AF2122/97
caccucccgcggcaccu

SEQ ID NO: 1169711 - RNA, 16 nt, Mycobacterium bovis subsp bovis AF2122/97
caccucccgcagccgg

SEQ ID NO: 1169712 - RNA, 17 nt, Mycobacterium bovis subsp bovis AF2122/97
caccucccgcagccggg

SEQ ID NO: 1169713 - RNA, 17 nt, Mycobacterium bovis subsp bovis AF2122/97
caccucgaucgcgccgu

SEQ ID NO: 1169714 - RNA, 23 nt, Mycobacterium bovis subsp bovis AF2122/97
caccucgaugaugcgcucggccu

SEQ ID NO: 1169715 - RNA, 16 nt, Mycobacterium bovis subsp bovis AF2122/97
caccucgaaggcacug

SEQ ID NO: 1169716 - RNA, 16 nt, Mycobacterium bovis subsp bovis AF2122/97
caccucgaaggcccgc

SEQ ID NO: 1169717 - RNA, 15 nt, Mycobacterium bovis subsp bovis AF2122/97
caccucgaaggcacu

SEQ ID NO: 1169718 - RNA, 16 nt, Mycobacterium bovis subsp bovis AF2122/97
caccuccucgagcagg

SEQ ID NO: 1169719 - RNA, 22 nt, Mycobacterium bovis subsp bovis AF2122/97
caccucgccaacaucccaacac

SEQ ID NO: 1169720 - RNA, 16 nt, Mycobacterium bovis subsp bovis AF2122/97
caccucgggcgcccgc

SEQ ID NO: 1169721 - RNA, 22 nt, Mycobacterium bovis subsp bovis AF2122/97
caccucggugaccaggccggcc

SEQ ID NO: 1169722 - RNA, 18 nt, Mycobacterium bovis subsp bovis AF2122/97
caccucggugccggccgc

SEQ ID NO: 1169723 - RNA, 17 nt, Mycobacterium bovis subsp bovis AF2122/97
caccugcacgugacccu

SEQ ID NO: 1169724 - RNA, 19 nt, Mycobacterium bovis subsp bovis AF2122/97
caccugcacgugacccugg

SEQ ID NO: 1169725 - RNA, 20 nt, Mycobacterium bovis subsp bovis AF2122/97
caccugcacgugacccuggg

SEQ ID NO: 1169726 - RNA, 13 nt, Mycobacterium bovis subsp bovis AF2122/97
caccugcaccgca

SEQ ID NO: 1169727 - RNA, 18 nt, Mycobacterium bovis subsp bovis AF2122/97
caccugacgugcggcgcg

SEQ ID NO: 1169728 - RNA, 22 nt, Mycobacterium bovis subsp bovis AF2122/97
caccugacgugcggcgcggcga

SEQ ID NO: 1169729 - RNA, 23 nt, Mycobacterium bovis subsp bovis AF2122/97
caccucgucgacaaaccacagac

SEQ ID NO: 1169730 - RNA, 21 nt, Mycobacterium bovis subsp bovis AF2122/97
caccucgucgaucgccgcgcc

SEQ ID NO: 1169731 - RNA, 16 nt, Mycobacterium bovis subsp bovis AF2122/97
caccucgguggcugcc

SEQ ID NO: 1169732 - RNA, 23 nt, Mycobacterium bovis subsp bovis AF2122/97
caccucguguccggggaccucgg

SEQ ID NO: 1169733 - RNA, 23 nt, Mycobacterium bovis subsp bovis AF2122/97
caccucuucgaucuguuccugca

SEQ ID NO: 1169734 - RNA, 20 nt, Mycobacterium bovis subsp bovis AF2122/97
caccucuucucggacacgcu

SEQ ID NO: 1169735 - RNA, 13 nt, Mycobacterium bovis subsp bovis AF2122/97
cacgaccugguua

SEQ ID NO: 1169736 - RNA, 19 nt, Mycobacterium bovis subsp bovis AF2122/97
cacgaccugcucauccacc

SEQ ID NO: 1169737 - RNA, 12 nt, Mycobacterium bovis subsp bovis AF2122/97
cacgaccucuug

SEQ ID NO: 1169738 - RNA, 16 nt, Mycobacterium bovis subsp bovis AF2122/97
cacgaccugcucaucc

SEQ ID NO: 1169739 - RNA, 14 nt, Mycobacterium bovis subsp bovis AF2122/97
cacgacccagcaug

SEQ ID NO: 1169740 - RNA, 15 nt, Mycobacterium bovis subsp bovis AF2122/97
cacgacggcacgcca

SEQ ID NO: 1169741 - RNA, 13 nt, Mycobacterium bovis subsp bovis AF2122/97
cacgacgggccga

SEQ ID NO: 1169742 - RNA, 20 nt, Mycobacterium bovis subsp bovis AF2122/97
cacgacgggggagcacuacc

SEQ ID NO: 1169743 - RNA, 17 nt, Mycobacterium bovis subsp bovis AF2122/97
cacgacgcgacacgccg

SEQ ID NO: 1169744 - RNA, 19 nt, Mycobacterium bovis subsp bovis AF2122/97
cacgacgccggccuggccg

SEQ ID NO: 1169745 - RNA, 17 nt, Mycobacterium bovis subsp bovis AF2122/97
cacgacgaacaccagcg

SEQ ID NO: 1169746 - RNA, 22 nt, Mycobacterium bovis subsp bovis AF2122/97
cacgacgaacaccagcgcgccg

SEQ ID NO: 1169747 - RNA, 20 nt, Mycobacterium bovis subsp bovis AF2122/97
cacgacgaagucguugggaa

SEQ ID NO: 1169748 - RNA, 21 nt, Mycobacterium bovis subsp bovis AF2122/97
cacgacgacaaccggccagau

SEQ ID NO: 1169749 - RNA, 22 nt, Mycobacterium bovis subsp bovis AF2122/97
cacgaguccgcggaucaccauc

SEQ ID NO: 1169750 - RNA, 14 nt, Mycobacterium bovis subsp bovis AF2122/97
cacgaguuggccaa

SEQ ID NO: 1169751 - RNA, 15 nt, Mycobacterium bovis subsp bovis AF2122/97
cacgacguucgacga

SEQ ID NO: 1169752 - RNA, 22 nt, Mycobacterium bovis subsp bovis AF2122/97
cacgagcacgggacuucgugcc

SEQ ID NO: 1169753 - RNA, 18 nt, Mycobacterium bovis subsp bovis AF2122/97
cacgacaugaccgacagg

SEQ ID NO: 1169754 - RNA, 14 nt, Mycobacterium bovis subsp bovis AF2122/97
cacgacagccagug

SEQ ID NO: 1169755 - RNA, 14 nt, Mycobacterium bovis subsp bovis AF2122/97
cacgaauccggcca

SEQ ID NO: 1169756 - RNA, 13 nt, Mycobacterium bovis subsp bovis AF2122/97
cacgaacgccugc

SEQ ID NO: 1169757 - RNA, 23 nt, Mycobacterium bovis subsp bovis AF2122/97
cacgaacugaucgaccgccuccu

SEQ ID NO: 1169758 - RNA, 15 nt, Mycobacterium bovis subsp bovis AF2122/97
cacgaacccucagcc

SEQ ID NO: 1169759 - RNA, 19 nt, Mycobacterium bovis subsp bovis AF2122/97
caccugguuccagaggccc

SEQ ID NO: 1169760 - RNA, 22 nt, Mycobacterium bovis subsp bovis AF2122/97
caccugggucgacgagauccag

SEQ ID NO: 1169761 - RNA, 20 nt, Mycobacterium bovis subsp bovis AF2122/97
caccugggcgcgcuggcggg

SEQ ID NO: 1169762 - RNA, 16 nt, Mycobacterium bovis subsp bovis AF2122/97
caccugggcugccggc

SEQ ID NO: 1169763 - RNA, 21 nt, Mycobacterium bovis subsp bovis AF2122/97
caccuguaguucgaugacuga

SEQ ID NO: 1169764 - RNA, 19 nt, Mycobacterium bovis subsp bovis AF2122/97
caccuguccgguggaaucc

SEQ ID NO: 1169765 - RNA, 22 nt, Mycobacterium bovis subsp bovis AF2122/97
caccuguccgguggaauccacc

SEQ ID NO: 1169766 - RNA, 14 nt, Mycobacterium bovis subsp bovis AF2122/97
caccugcgcgcggc

SEQ ID NO: 1169767 - RNA, 20 nt, Mycobacterium bovis subsp bovis AF2122/97
caccugcgggcccacgccca

SEQ ID NO: 1169768 - RNA, 17 nt, Mycobacterium bovis subsp bovis AF2122/97
caccugcgcgcggccgc

SEQ ID NO: 1169769 - RNA, 20 nt, Mycobacterium bovis subsp bovis AF2122/97
caccugcgcgcggccgcgcu

SEQ ID NO: 1169770 - RNA, 16 nt, Mycobacterium bovis subsp bovis AF2122/97
caccuggauccaccag

SEQ ID NO: 1169771 - RNA, 15 nt, Mycobacterium bovis subsp bovis AF2122/97
caccugggccagcag

SEQ ID NO: 1169772 - RNA, 20 nt, Mycobacterium bovis subsp bovis AF2122/97
caccuggcgugucgccgcca

SEQ ID NO: 1169773 - RNA, 18 nt, Mycobacterium bovis subsp bovis AF2122/97
caccuuggaugcccugcc

SEQ ID NO: 1169774 - RNA, 18 nt, Mycobacterium bovis subsp bovis AF2122/97
caccuugccuagccgcag

SEQ ID NO: 1169775 - RNA, 19 nt, Mycobacterium bovis subsp bovis AF2122/97
caccuugacgcccaucuca

SEQ ID NO: 1169776 - RNA, 16 nt, Mycobacterium bovis subsp bovis AF2122/97
caccuuggccggcccc

SEQ ID NO: 1169777 - RNA, 17 nt, Mycobacterium bovis subsp bovis AF2122/97
caccuucugguccagca

SEQ ID NO: 1169778 - RNA, 12 nt, Mycobacterium bovis subsp bovis AF2122/97
caccuuccacga

SEQ ID NO: 1169779 - RNA, 17 nt, Mycobacterium bovis subsp bovis AF2122/97
caccgcgaucaccaccg

SEQ ID NO: 1169780 - RNA, 17 nt, Mycobacterium bovis subsp bovis AF2122/97
caccgcgcaacccggac

SEQ ID NO: 1169781 - RNA, 13 nt, Mycobacterium bovis subsp bovis AF2122/97
caccgcgccgagc

SEQ ID NO: 1169782 - RNA, 12 nt, Mycobacterium bovis subsp bovis AF2122/97
caccgcgccgcg

SEQ ID NO: 1169783 - RNA, 20 nt, Mycobacterium bovis subsp bovis AF2122/97
caccgcgaccucgcggcgcu

SEQ ID NO: 1169784 - RNA, 19 nt, Mycobacterium bovis subsp bovis AF2122/97
caccgcgacgagcggccgu

SEQ ID NO: 1169785 - RNA, 20 nt, Mycobacterium bovis subsp bovis AF2122/97
caccgccuuugccgccggca

SEQ ID NO: 1169786 - RNA, 18 nt, Mycobacterium bovis subsp bovis AF2122/97
caccgccguugccguaca

SEQ ID NO: 1169787 - RNA, 20 nt, Mycobacterium bovis subsp bovis AF2122/97
caccgccguugggccgcgcc

SEQ ID NO: 1169788 - RNA, 18 nt, Mycobacterium bovis subsp bovis AF2122/97
caccgccugcgccgcccg

SEQ ID NO: 1169789 - RNA, 23 nt, Mycobacterium bovis subsp bovis AF2122/97
caccgccugcgccgcccgcgcca

SEQ ID NO: 1169790 - RNA, 18 nt, Mycobacterium bovis subsp bovis AF2122/97
caccgccugugccgccgg

SEQ ID NO: 1169791 - RNA, 23 nt, Mycobacterium bovis subsp bovis AF2122/97
caccgccugugccgccggcgcca

SEQ ID NO: 1169792 - RNA, 15 nt, Mycobacterium bovis subsp bovis AF2122/97
caccgcggcggcgcg

SEQ ID NO: 1169793 - RNA, 16 nt, Mycobacterium bovis subsp bovis AF2122/97
caccgcggcggcggcc

SEQ ID NO: 1169794 - RNA, 17 nt, Mycobacterium bovis subsp bovis AF2122/97
caccgcggcggcggcca

SEQ ID NO: 1169795 - RNA, 16 nt, Mycobacterium bovis subsp bovis AF2122/97
caccgcgguacgccgg

SEQ ID NO: 1169796 - RNA, 22 nt, Mycobacterium bovis subsp bovis AF2122/97
caccgcggauaggccgcgcggc

SEQ ID NO: 1169797 - RNA, 16 nt, Mycobacterium bovis subsp bovis AF2122/97
caccgcggccgcggac

SEQ ID NO: 1169798 - RNA, 22 nt, Mycobacterium bovis subsp bovis AF2122/97
caccgcggacccgcagcugcgg

SEQ ID NO: 1169799 - RNA, 22 nt, Mycobacterium bovis subsp bovis AF2122/97
caccgcggagauaccggacccc

SEQ ID NO: 1169800 - RNA, 18 nt, Mycobacterium bovis subsp bovis AF2122/97
caccgcggaaggccagcu

SEQ ID NO: 1169801 - RNA, 14 nt, Mycobacterium bovis subsp bovis AF2122/97
caccgcggacccgc

SEQ ID NO: 1169802 - RNA, 18 nt, Mycobacterium bovis subsp bovis AF2122/97
caccgcgcggcgcagcac

SEQ ID NO: 1169803 - RNA, 17 nt, Mycobacterium bovis subsp bovis AF2122/97
caccgcgcgcuccagau

SEQ ID NO: 1169804 - RNA, 18 nt, Mycobacterium bovis subsp bovis AF2122/97
caccgccguugccgaucg

SEQ ID NO: 1169805 - RNA, 17 nt, Mycobacterium bovis subsp bovis AF2122/97
caccgccguugccgccg

SEQ ID NO: 1169806 - RNA, 19 nt, Mycobacterium bovis subsp bovis AF2122/97
caccgccguugccgccggc

SEQ ID NO: 1169807 - RNA, 24 nt, Mycobacterium bovis subsp bovis AF2122/97
caccgccguugccgccggcgccgc

SEQ ID NO: 1169808 - RNA, 19 nt, Mycobacterium bovis subsp bovis AF2122/97
caccgcccuugccgccggc

SEQ ID NO: 1169809 - RNA, 14 nt, Mycobacterium bovis subsp bovis AF2122/97
caccgccggcgccc

SEQ ID NO: 1169810 - RNA, 15 nt, Mycobacterium bovis subsp bovis AF2122/97
caccgccgcggccgc

SEQ ID NO: 1169811 - RNA, 23 nt, Mycobacterium bovis subsp bovis AF2122/97
caccgccgcggccgccguccccg

SEQ ID NO: 1169812 - RNA, 20 nt, Mycobacterium bovis subsp bovis AF2122/97
caccgccgcgccggcggcca

SEQ ID NO: 1169813 - RNA, 15 nt, Mycobacterium bovis subsp bovis AF2122/97
caccgccgcgcgaca

SEQ ID NO: 1169814 - RNA, 18 nt, Mycobacterium bovis subsp bovis AF2122/97
caccgccgcuaccgcccg

SEQ ID NO: 1169815 - RNA, 19 nt, Mycobacterium bovis subsp bovis AF2122/97
caccgccgcuaccgcccgc

SEQ ID NO: 1169816 - RNA, 23 nt, Mycobacterium bovis subsp bovis AF2122/97
caccgccgcuaccgcccgcgcca

SEQ ID NO: 1169817 - RNA, 17 nt, Mycobacterium bovis subsp bovis AF2122/97
caccgccgcgcggauac

SEQ ID NO: 1169818 - RNA, 12 nt, Mycobacterium bovis subsp bovis AF2122/97
caccgccgcggc

SEQ ID NO: 1169819 - RNA, 12 nt, Mycobacterium bovis subsp bovis AF2122/97
caccgccgccug

SEQ ID NO: 1169820 - RNA, 19 nt, Mycobacterium bovis subsp bovis AF2122/97
caccgccgccugcccggcc

SEQ ID NO: 1169821 - RNA, 20 nt, Mycobacterium bovis subsp bovis AF2122/97
caccgccgccugcccggccc

SEQ ID NO: 1169822 - RNA, 21 nt, Mycobacterium bovis subsp bovis AF2122/97
caccgccgccugcccggcccg

SEQ ID NO: 1169823 - RNA, 13 nt, Mycobacterium bovis subsp bovis AF2122/97
caccgccgcgacc

SEQ ID NO: 1169824 - RNA, 19 nt, Mycobacterium bovis subsp bovis AF2122/97
caccgccgcgaccgccucg

SEQ ID NO: 1169825 - RNA, 15 nt, Mycobacterium bovis subsp bovis AF2122/97
caccgccgccggcac

SEQ ID NO: 1169826 - RNA, 18 nt, Mycobacterium bovis subsp bovis AF2122/97
caccgccgccggcaccgc

SEQ ID NO: 1169827 - RNA, 14 nt, Mycobacterium bovis subsp bovis AF2122/97
caccgccgccgccc

SEQ ID NO: 1169828 - RNA, 17 nt, Mycobacterium bovis subsp bovis AF2122/97
caccgccgccgccaccg

SEQ ID NO: 1169829 - RNA, 22 nt, Mycobacterium bovis subsp bovis AF2122/97
caccgccgccgccaccggcgcc

SEQ ID NO: 1169830 - RNA, 14 nt, Mycobacterium bovis subsp bovis AF2122/97
caccgccccgccgc

SEQ ID NO: 1169831 - RNA, 12 nt, Mycobacterium bovis subsp bovis AF2122/97
caccgccccgcc

SEQ ID NO: 1169832 - RNA, 15 nt, Mycobacterium bovis subsp bovis AF2122/97
caccgccccgccaac

SEQ ID NO: 1169833 - RNA, 19 nt, Mycobacterium bovis subsp bovis AF2122/97
caccgccccgccaaccacu

SEQ ID NO: 1169834 - RNA, 16 nt, Mycobacterium bovis subsp bovis AF2122/97
caccgccccgcgccca

SEQ ID NO: 1169835 - RNA, 22 nt, Mycobacterium bovis subsp bovis AF2122/97
caccgccccggcggcggcggcc

SEQ ID NO: 1169836 - RNA, 21 nt, Mycobacterium bovis subsp bovis AF2122/97
caccgcccgcacuuggcugcg

SEQ ID NO: 1169837 - RNA, 17 nt, Mycobacterium bovis subsp bovis AF2122/97
caccgccaugaacucga

SEQ ID NO: 1169838 - RNA, 17 nt, Mycobacterium bovis subsp bovis AF2122/97
caccgcccuugccgccg

SEQ ID NO: 1169839 - RNA, 14 nt, Mycobacterium bovis subsp bovis AF2122/97
caccgccgccgcca

SEQ ID NO: 1169840 - RNA, 15 nt, Mycobacterium bovis subsp bovis AF2122/97
caccgccgccgccac

SEQ ID NO: 1169841 - RNA, 21 nt, Mycobacterium bovis subsp bovis AF2122/97
caccggcuuggugaaccgcgc

SEQ ID NO: 1169842 - RNA, 16 nt, Mycobacterium bovis subsp bovis AF2122/97
caccggcuuggugaac

SEQ ID NO: 1169843 - RNA, 18 nt, Mycobacterium bovis subsp bovis AF2122/97
caccgggcccgccggccc

SEQ ID NO: 1169844 - RNA, 18 nt, Mycobacterium bovis subsp bovis AF2122/97
caccggcgucgcugccuu

SEQ ID NO: 1169845 - RNA, 21 nt, Mycobacterium bovis subsp bovis AF2122/97
caccggcugaccgacccggac

SEQ ID NO: 1169846 - RNA, 12 nt, Mycobacterium bovis subsp bovis AF2122/97
caccggcugcaa

SEQ ID NO: 1169847 - RNA, 15 nt, Mycobacterium bovis subsp bovis AF2122/97
caccggcugcaacca

SEQ ID NO: 1169848 - RNA, 18 nt, Mycobacterium bovis subsp bovis AF2122/97
caccggcugaccgacccg

SEQ ID NO: 1169849 - RNA, 21 nt, Mycobacterium bovis subsp bovis AF2122/97
caccggcuaugcuggcgcagc

SEQ ID NO: 1169850 - RNA, 16 nt, Mycobacterium bovis subsp bovis AF2122/97
caccggcucccggggg

SEQ ID NO: 1169851 - RNA, 13 nt, Mycobacterium bovis subsp bovis AF2122/97
caccggcucgacu

SEQ ID NO: 1169852 - RNA, 19 nt, Mycobacterium bovis subsp bovis AF2122/97
caccggcuucuccuccaga

SEQ ID NO: 1169853 - RNA, 23 nt, Mycobacterium bovis subsp bovis AF2122/97
caccggcuugggccaggcccagc

SEQ ID NO: 1169854 - RNA, 23 nt, Mycobacterium bovis subsp bovis AF2122/97
caccggcuggugccaacugcgcc

SEQ ID NO: 1169855 - RNA, 19 nt, Mycobacterium bovis subsp bovis AF2122/97
caccggcugguucaacacc

SEQ ID NO: 1169856 - RNA, 17 nt, Mycobacterium bovis subsp bovis AF2122/97
caccggcuucggccagc

SEQ ID NO: 1169857 - RNA, 17 nt, Mycobacterium bovis subsp bovis AF2122/97
caccggcuucuccucca

SEQ ID NO: 1169858 - RNA, 11 nt, Mycobacterium bovis subsp bovis AF2122/97
caccggcgccg

SEQ ID NO: 1169859 - RNA, 21 nt, Mycobacterium bovis subsp bovis AF2122/97
caccggcgcccagcgccucga

SEQ ID NO: 1169860 - RNA, 13 nt, Mycobacterium bovis subsp bovis AF2122/97
caccggcgccgcc

SEQ ID NO: 1169861 - RNA, 18 nt, Mycobacterium bovis subsp bovis AF2122/97
caccggcgaucugcucga

SEQ ID NO: 1169862 - RNA, 22 nt, Mycobacterium bovis subsp bovis AF2122/97
caccggccgugccgccgacacc

SEQ ID NO: 1169863 - RNA, 23 nt, Mycobacterium bovis subsp bovis AF2122/97
caccggccgguggguagccagcg

SEQ ID NO: 1169864 - RNA, 12 nt, Mycobacterium bovis subsp bovis AF2122/97
caccggccggcg

SEQ ID NO: 1169865 - RNA, 18 nt, Mycobacterium bovis subsp bovis AF2122/97
caccggcccucgccagag

SEQ ID NO: 1169866 - RNA, 14 nt, Mycobacterium bovis subsp bovis AF2122/97
caccggccccaccg

SEQ ID NO: 1169867 - RNA, 15 nt, Mycobacterium bovis subsp bovis AF2122/97
caccggcgccgcccg

SEQ ID NO: 1169868 - RNA, 20 nt, Mycobacterium bovis subsp bovis AF2122/97
caccggcgccgcccgcgcca

SEQ ID NO: 1169869 - RNA, 15 nt, Mycobacterium bovis subsp bovis AF2122/97
caccggcgccgccgg

SEQ ID NO: 1169870 - RNA, 18 nt, Mycobacterium bovis subsp bovis AF2122/97
caccggcgccgccggcac

SEQ ID NO: 1169871 - RNA, 15 nt, Mycobacterium bovis subsp bovis AF2122/97
caccggcgccgccgu

SEQ ID NO: 1169872 - RNA, 11 nt, Mycobacterium bovis subsp bovis AF2122/97
caccggcgccu

SEQ ID NO: 1169873 - RNA, 24 nt, Mycobacterium bovis subsp bovis AF2122/97
caccggcgcgggcacgcccucguc

SEQ ID NO: 1169874 - RNA, 22 nt, Mycobacterium bovis subsp bovis AF2122/97
caccggcggcgacggugccacc

SEQ ID NO: 1169875 - RNA, 16 nt, Mycobacterium bovis subsp bovis AF2122/97
caccggaggccgccgc

SEQ ID NO: 1169876 - RNA, 23 nt, Mycobacterium bovis subsp bovis AF2122/97
caccggacgaaacgaucgcgcca

SEQ ID NO: 1169877 - RNA, 18 nt, Mycobacterium bovis subsp bovis AF2122/97
caccggaggugcgccgcg

SEQ ID NO: 1169878 - RNA, 17 nt, Mycobacterium bovis subsp bovis AF2122/97
caccggauacagccacg

SEQ ID NO: 1169879 - RNA, 14 nt, Mycobacterium bovis subsp bovis AF2122/97
caccggauccacgg

SEQ ID NO: 1169880 - RNA, 18 nt, Mycobacterium bovis subsp bovis AF2122/97
caccggcaaucggcggca

SEQ ID NO: 1169881 - RNA, 13 nt, Mycobacterium bovis subsp bovis AF2122/97
caccggcacccgc

SEQ ID NO: 1169882 - RNA, 13 nt, Mycobacterium bovis subsp bovis AF2122/97
caccggcaccgcu

SEQ ID NO: 1169883 - RNA, 14 nt, Mycobacterium bovis subsp bovis AF2122/97
caccggcaccggcc

SEQ ID NO: 1169884 - RNA, 14 nt, Mycobacterium bovis subsp bovis AF2122/97
caccggcacugccc

SEQ ID NO: 1169885 - RNA, 16 nt, Mycobacterium bovis subsp bovis AF2122/97
caccggccaccagccc

SEQ ID NO: 1169886 - RNA, 17 nt, Mycobacterium bovis subsp bovis AF2122/97
caccgcguucugguugu

SEQ ID NO: 1169887 - RNA, 21 nt, Mycobacterium bovis subsp bovis AF2122/97
caccgcguccaggugcgccgu

SEQ ID NO: 1169888 - RNA, 17 nt, Mycobacterium bovis subsp bovis AF2122/97
caccgcgucgggccgca

SEQ ID NO: 1169889 - RNA, 20 nt, Mycobacterium bovis subsp bovis AF2122/97
caccgcuacgaccaauagca

SEQ ID NO: 1169890 - RNA, 14 nt, Mycobacterium bovis subsp bovis AF2122/97
caccgcuugcuggc

SEQ ID NO: 1169891 - RNA, 19 nt, Mycobacterium bovis subsp bovis AF2122/97
caccgcuguguucagcgca

SEQ ID NO: 1169892 - RNA, 17 nt, Mycobacterium bovis subsp bovis AF2122/97
caccgcugccggcgccg

SEQ ID NO: 1169893 - RNA, 18 nt, Mycobacterium bovis subsp bovis AF2122/97
caccgcugcggcaccacc

SEQ ID NO: 1169894 - RNA, 22 nt, Mycobacterium bovis subsp bovis AF2122/97
caccgcugcggcaccacccggc

SEQ ID NO: 1169895 - RNA, 15 nt, Mycobacterium bovis subsp bovis AF2122/97
caccgacaugacgcg

SEQ ID NO: 1169896 - RNA, 16 nt, Mycobacterium bovis subsp bovis AF2122/97
caccgacagccccauc

SEQ ID NO: 1169897 - RNA, 14 nt, Mycobacterium bovis subsp bovis AF2122/97
caccgacagcaccc

SEQ ID NO: 1169898 - RNA, 16 nt, Mycobacterium bovis subsp bovis AF2122/97
caccgacagcacccgg

SEQ ID NO: 1169899 - RNA, 18 nt, Mycobacterium bovis subsp bovis AF2122/97
caccgacgacgcgcgcga

SEQ ID NO: 1169900 - RNA, 20 nt, Mycobacterium bovis subsp bovis AF2122/97
caccgaaugcacgacggugu

SEQ ID NO: 1169901 - RNA, 23 nt, Mycobacterium bovis subsp bovis AF2122/97
caccgaccccggaacgaccccac

SEQ ID NO: 1169902 - RNA, 20 nt, Mycobacterium bovis subsp bovis AF2122/97
caccgacgcgaacgcggcca

SEQ ID NO: 1169903 - RNA, 21 nt, Mycobacterium bovis subsp bovis AF2122/97
caccgacggaaugucagccgg

SEQ ID NO: 1169904 - RNA, 15 nt, Mycobacterium bovis subsp bovis AF2122/97
caccgacgcugacca

SEQ ID NO: 1169905 - RNA, 14 nt, Mycobacterium bovis subsp bovis AF2122/97
caccgacgccgcca

SEQ ID NO: 1169906 - RNA, 14 nt, Mycobacterium bovis subsp bovis AF2122/97
caccgacuucagca

SEQ ID NO: 1169907 - RNA, 17 nt, Mycobacterium bovis subsp bovis AF2122/97
caccgacuucagcaacg

SEQ ID NO: 1169908 - RNA, 18 nt, Mycobacterium bovis subsp bovis AF2122/97
caccgacgucggcuucac

SEQ ID NO: 1169909 - RNA, 18 nt, Mycobacterium bovis subsp bovis AF2122/97
caccgagcugagcggcca

SEQ ID NO: 1169910 - RNA, 21 nt, Mycobacterium bovis subsp bovis AF2122/97
caccgagccguccaagccagc

SEQ ID NO: 1169911 - RNA, 22 nt, Mycobacterium bovis subsp bovis AF2122/97
caccgagcccuccagggcccug

SEQ ID NO: 1169912 - RNA, 15 nt, Mycobacterium bovis subsp bovis AF2122/97
caccgagaucggaca

SEQ ID NO: 1169913 - RNA, 21 nt, Mycobacterium bovis subsp bovis AF2122/97
caccgagaugcgcaauagacc

SEQ ID NO: 1169914 - RNA, 15 nt, Mycobacterium bovis subsp bovis AF2122/97
caccgagccacgacc

SEQ ID NO: 1169915 - RNA, 13 nt, Mycobacterium bovis subsp bovis AF2122/97
caccgagcaucuc

SEQ ID NO: 1169916 - RNA, 23 nt, Mycobacterium bovis subsp bovis AF2122/97
caccgaggugccgcgcagcugcc

SEQ ID NO: 1169917 - RNA, 21 nt, Mycobacterium bovis subsp bovis AF2122/97
caccgaggccgccgagaugau

SEQ ID NO: 1169918 - RNA, 17 nt, Mycobacterium bovis subsp bovis AF2122/97
caccgagucgacggcca

SEQ ID NO: 1169919 - RNA, 14 nt, Mycobacterium bovis subsp bovis AF2122/97
caccgccagccacc

SEQ ID NO: 1169920 - RNA, 15 nt, Mycobacterium bovis subsp bovis AF2122/97
caccgccagccccgc

SEQ ID NO: 1169921 - RNA, 16 nt, Mycobacterium bovis subsp bovis AF2122/97
caccgcauaacgccag

SEQ ID NO: 1169922 - RNA, 22 nt, Mycobacterium bovis subsp bovis AF2122/97
caccgcauucguggagccggcc

SEQ ID NO: 1169923 - RNA, 20 nt, Mycobacterium bovis subsp bovis AF2122/97
caccgaugccgaagcccccg

SEQ ID NO: 1169924 - RNA, 15 nt, Mycobacterium bovis subsp bovis AF2122/97
caccgaugccuugac

SEQ ID NO: 1169925 - RNA, 15 nt, Mycobacterium bovis subsp bovis AF2122/97
caccgaugcacucca

SEQ ID NO: 1169926 - RNA, 13 nt, Mycobacterium bovis subsp bovis AF2122/97
caccgauccugga

SEQ ID NO: 1169927 - RNA, 19 nt, Mycobacterium bovis subsp bovis AF2122/97
caccgaucgacugcagccc

SEQ ID NO: 1169928 - RNA, 15 nt, Mycobacterium bovis subsp bovis AF2122/97
caccgcaaccacgcc

SEQ ID NO: 1169929 - RNA, 15 nt, Mycobacterium bovis subsp bovis AF2122/97
caccgcaaccaaagc

SEQ ID NO: 1169930 - RNA, 16 nt, Mycobacterium bovis subsp bovis AF2122/97
caccgcacgcacgcca

SEQ ID NO: 1169931 - RNA, 14 nt, Mycobacterium bovis subsp bovis AF2122/97
caccgcacgcuggc

SEQ ID NO: 1169932 - RNA, 22 nt, Mycobacterium bovis subsp bovis AF2122/97
cacccugggcaaacugggcacc

SEQ ID NO: 1169933 - RNA, 14 nt, Mycobacterium bovis subsp bovis AF2122/97
cacccuguuugccc

SEQ ID NO: 1169934 - RNA, 24 nt, Mycobacterium bovis subsp bovis AF2122/97
cacccuguuugcccaacagacauu

SEQ ID NO: 1169935 - RNA, 14 nt, Mycobacterium bovis subsp bovis AF2122/97
cacccuugccgccg

SEQ ID NO: 1169936 - RNA, 16 nt, Mycobacterium bovis subsp bovis AF2122/97
caccgaaacgccgacc

SEQ ID NO: 1169937 - RNA, 15 nt, Mycobacterium bovis subsp bovis AF2122/97
caccgaaccgccgcu

SEQ ID NO: 1169938 - RNA, 15 nt, Mycobacterium bovis subsp bovis AF2122/97
caccgaacgcggcca

SEQ ID NO: 1169939 - RNA, 21 nt, Mycobacterium bovis subsp bovis AF2122/97
caccgaacuugcggaccuggc

SEQ ID NO: 1169940 - RNA, 21 nt, Mycobacterium bovis subsp bovis AF2122/97
caccgacaagaauggccgccu

SEQ ID NO: 1169941 - RNA, 21 nt, Mycobacterium bovis subsp bovis AF2122/97
caccgacaauucaacacacgg

SEQ ID NO: 1169942 - RNA, 13 nt, Mycobacterium bovis subsp bovis AF2122/97
caccgacaccggc

SEQ ID NO: 1169943 - RNA, 16 nt, Mycobacterium bovis subsp bovis AF2122/97
caccgacaccggccgc

SEQ ID NO: 1169944 - RNA, 14 nt, Mycobacterium bovis subsp bovis AF2122/97
caccgacaccgugc

SEQ ID NO: 1169945 - RNA, 17 nt, Mycobacterium bovis subsp bovis AF2122/97
caccgaaauaggcuucg

SEQ ID NO: 1169946 - RNA, 16 nt, Mycobacterium bovis subsp bovis AF2122/97
cacccguugcgacacc

SEQ ID NO: 1169947 - RNA, 23 nt, Mycobacterium bovis subsp bovis AF2122/97
cacccguugcucccacggcaccc

SEQ ID NO: 1169948 - RNA, 15 nt, Mycobacterium bovis subsp bovis AF2122/97
cacccguaagcggau

SEQ ID NO: 1169949 - RNA, 15 nt, Mycobacterium bovis subsp bovis AF2122/97
cacccugcggcaccu

SEQ ID NO: 1169950 - RNA, 21 nt, Mycobacterium bovis subsp bovis AF2122/97
cacccugcucgaacgcugagg

SEQ ID NO: 1169951 - RNA, 12 nt, Mycobacterium bovis subsp bovis AF2122/97
cacccucgggca

SEQ ID NO: 1169952 - RNA, 21 nt, Mycobacterium bovis subsp bovis AF2122/97
cacccugaugugaguccagcc

SEQ ID NO: 1169953 - RNA, 22 nt, Mycobacterium bovis subsp bovis AF2122/97
cacccugaugugaguccagccg

SEQ ID NO: 1169954 - RNA, 18 nt, Mycobacterium bovis subsp bovis AF2122/97
cacccgcuggcgguaagc

SEQ ID NO: 1169955 - RNA, 15 nt, Mycobacterium bovis subsp bovis AF2122/97
cacccgcggcgccgu

SEQ ID NO: 1169956 - RNA, 23 nt, Mycobacterium bovis subsp bovis AF2122/97
cacccgcggcgccguugccaccg

SEQ ID NO: 1169957 - RNA, 13 nt, Mycobacterium bovis subsp bovis AF2122/97
cacccgcgcucca

SEQ ID NO: 1169958 - RNA, 12 nt, Mycobacterium bovis subsp bovis AF2122/97
cacccgcggcga

SEQ ID NO: 1169959 - RNA, 18 nt, Mycobacterium bovis subsp bovis AF2122/97
cacccgcgccuacccuuc

SEQ ID NO: 1169960 - RNA, 19 nt, Mycobacterium bovis subsp bovis AF2122/97
cacccgcgcggagaccccg

SEQ ID NO: 1169961 - RNA, 19 nt, Mycobacterium bovis subsp bovis AF2122/97
cacccgcaucggcacgcca

SEQ ID NO: 1169962 - RNA, 18 nt, Mycobacterium bovis subsp bovis AF2122/97
cacccgcauggcagcggc

SEQ ID NO: 1169963 - RNA, 20 nt, Mycobacterium bovis subsp bovis AF2122/97
cacccgcauggcagcggcgg

SEQ ID NO: 1169964 - RNA, 23 nt, Mycobacterium bovis subsp bovis AF2122/97
cacccgcgaacgcgacagccacc

SEQ ID NO: 1169965 - RNA, 13 nt, Mycobacterium bovis subsp bovis AF2122/97
cacccgccggccg

SEQ ID NO: 1169966 - RNA, 22 nt, Mycobacterium bovis subsp bovis AF2122/97
cacccgccggucaaacugccau

SEQ ID NO: 1169967 - RNA, 14 nt, Mycobacterium bovis subsp bovis AF2122/97
cacccgcgccgccc

SEQ ID NO: 1169968 - RNA, 18 nt, Mycobacterium bovis subsp bovis AF2122/97
cacccggcaaucucccga

SEQ ID NO: 1169969 - RNA, 21 nt, Mycobacterium bovis subsp bovis AF2122/97
cacccgcucgcccgccgccac

SEQ ID NO: 1169970 - RNA, 17 nt, Mycobacterium bovis subsp bovis AF2122/97
cacccgcucggcgcgcg

SEQ ID NO: 1169971 - RNA, 17 nt, Mycobacterium bovis subsp bovis AF2122/97
cacccgcuuugcacugu

SEQ ID NO: 1169972 - RNA, 18 nt, Mycobacterium bovis subsp bovis AF2122/97
cacccggaaagaucucgg

SEQ ID NO: 1169973 - RNA, 14 nt, Mycobacterium bovis subsp bovis AF2122/97
cacccggccgaccu

SEQ ID NO: 1169974 - RNA, 20 nt, Mycobacterium bovis subsp bovis AF2122/97
cacccggggugcccggccgc

SEQ ID NO: 1169975 - RNA, 21 nt, Mycobacterium bovis subsp bovis AF2122/97
cacccggggugcccggccgcc

SEQ ID NO: 1169976 - RNA, 19 nt, Mycobacterium bovis subsp bovis AF2122/97
cacccggcuucgccgcgcu

SEQ ID NO: 1169977 - RNA, 21 nt, Mycobacterium bovis subsp bovis AF2122/97
cacccgggacgaaccggccga

SEQ ID NO: 1169978 - RNA, 23 nt, Mycobacterium bovis subsp bovis AF2122/97
cacccgggacguuguccaccgcc

SEQ ID NO: 1169979 - RNA, 20 nt, Mycobacterium bovis subsp bovis AF2122/97
cacccgggcagccugcugca

SEQ ID NO: 1169980 - RNA, 20 nt, Mycobacterium bovis subsp bovis AF2122/97
cacccgggccaccccgagcu

SEQ ID NO: 1169981 - RNA, 17 nt, Mycobacterium bovis subsp bovis AF2122/97
cacccgggccgccucga

SEQ ID NO: 1169982 - RNA, 15 nt, Mycobacterium bovis subsp bovis AF2122/97
cacccgguccggccc

SEQ ID NO: 1169983 - RNA, 17 nt, Mycobacterium bovis subsp bovis AF2122/97
cacccggucaacgugaa

SEQ ID NO: 1169984 - RNA, 21 nt, Mycobacterium bovis subsp bovis AF2122/97
cacccgggccucggcgccguc

SEQ ID NO: 1169985 - RNA, 14 nt, Mycobacterium bovis subsp bovis AF2122/97
cacccgguagguga

SEQ ID NO: 1169986 - RNA, 19 nt, Mycobacterium bovis subsp bovis AF2122/97
cacggcgaugcagccacau

SEQ ID NO: 1169987 - RNA, 15 nt, Mycobacterium bovis subsp bovis AF2122/97
cacggcgauugcccg

SEQ ID NO: 1169988 - RNA, 16 nt, Mycobacterium bovis subsp bovis AF2122/97
cacggcgaaccggccc

SEQ ID NO: 1169989 - RNA, 14 nt, Mycobacterium bovis subsp bovis AF2122/97
cacggcgccgccac

SEQ ID NO: 1169990 - RNA, 14 nt, Mycobacterium bovis subsp bovis AF2122/97
cacggccgagcagg

SEQ ID NO: 1169991 - RNA, 14 nt, Mycobacterium bovis subsp bovis AF2122/97
cacggccuccggac

SEQ ID NO: 1169992 - RNA, 17 nt, Mycobacterium bovis subsp bovis AF2122/97
cacggccgucauuucca

SEQ ID NO: 1169993 - RNA, 12 nt, Mycobacterium bovis subsp bovis AF2122/97
cacggccagcgg

SEQ ID NO: 1169994 - RNA, 18 nt, Mycobacterium bovis subsp bovis AF2122/97
cacggccccugccacgac

SEQ ID NO: 1169995 - RNA, 12 nt, Mycobacterium bovis subsp bovis AF2122/97
cacggcugccca

SEQ ID NO: 1169996 - RNA, 14 nt, Mycobacterium bovis subsp bovis AF2122/97
cacggcuuugcggc

SEQ ID NO: 1169997 - RNA, 21 nt, Mycobacterium bovis subsp bovis AF2122/97
cacggcuuugcggcgcgacca

SEQ ID NO: 1169998 - RNA, 16 nt, Mycobacterium bovis subsp bovis AF2122/97
cacgggaagccgcgcc

SEQ ID NO: 1169999 - RNA, 17 nt, Mycobacterium bovis subsp bovis AF2122/97
cacggcggcaucaccug

SEQ ID NO: 1170000 - RNA, 15 nt, Mycobacterium bovis subsp bovis AF2122/97
cacggcgcuaccagc

SEQ ID NO: 1170001 - RNA, 12 nt, Mycobacterium bovis subsp bovis AF2122/97
cacggcgcgcca

SEQ ID NO: 1170002 - RNA, 22 nt, Mycobacterium bovis subsp bovis AF2122/97
cacggcggaagaagugcacugc

SEQ ID NO: 1170003 - RNA, 15 nt, Mycobacterium bovis subsp bovis AF2122/97
cacggcggccaccug

SEQ ID NO: 1170004 - RNA, 16 nt, Mycobacterium bovis subsp bovis AF2122/97
cacggcggccaccugc

SEQ ID NO: 1170005 - RNA, 14 nt, Mycobacterium bovis subsp bovis AF2122/97
cacggcggccaggg

SEQ ID NO: 1170006 - RNA, 15 nt, Mycobacterium bovis subsp bovis AF2122/97
cacggcggccccggc

SEQ ID NO: 1170007 - RNA, 23 nt, Mycobacterium bovis subsp bovis AF2122/97
cacggcagccuugaucucguccc

SEQ ID NO: 1170008 - RNA, 22 nt, Mycobacterium bovis subsp bovis AF2122/97
cacggcaccaccaagcucggcc

SEQ ID NO: 1170009 - RNA, 14 nt, Mycobacterium bovis subsp bovis AF2122/97
cacggcaccgauca

SEQ ID NO: 1170010 - RNA, 13 nt, Mycobacterium bovis subsp bovis AF2122/97
cacggaccgccac

SEQ ID NO: 1170011 - RNA, 15 nt, Mycobacterium bovis subsp bovis AF2122/97
cacggaccgccaccu

SEQ ID NO: 1170012 - RNA, 12 nt, Mycobacterium bovis subsp bovis AF2122/97
cacggagcucuu

SEQ ID NO: 1170013 - RNA, 20 nt, Mycobacterium bovis subsp bovis AF2122/97
cacgcuucuuccgcgcgccg

SEQ ID NO: 1170014 - RNA, 17 nt, Mycobacterium bovis subsp bovis AF2122/97
cacgcgcccgcaccacc

SEQ ID NO: 1170015 - RNA, 14 nt, Mycobacterium bovis subsp bovis AF2122/97
cacgcgcucaccga

SEQ ID NO: 1170016 - RNA, 18 nt, Mycobacterium bovis subsp bovis AF2122/97
cacgcgcucaccgacgcu

SEQ ID NO: 1170017 - RNA, 19 nt, Mycobacterium bovis subsp bovis AF2122/97
cacgcgcgcaggccgccgc

SEQ ID NO: 1170018 - RNA, 18 nt, Mycobacterium bovis subsp bovis AF2122/97
cacgcggguugcgcggcu

SEQ ID NO: 1170019 - RNA, 20 nt, Mycobacterium bovis subsp bovis AF2122/97
cacgcgggagguacccccag

SEQ ID NO: 1170020 - RNA, 19 nt, Mycobacterium bovis subsp bovis AF2122/97
cacgccuggcuacgcgcgc

SEQ ID NO: 1170021 - RNA, 22 nt, Mycobacterium bovis subsp bovis AF2122/97
cacgccugccgaaacgccgacc

SEQ ID NO: 1170022 - RNA, 15 nt, Mycobacterium bovis subsp bovis AF2122/97
cacgccuugagccga

SEQ ID NO: 1170023 - RNA, 15 nt, Mycobacterium bovis subsp bovis AF2122/97
cacgcgaaugacgau

SEQ ID NO: 1170024 - RNA, 22 nt, Mycobacterium bovis subsp bovis AF2122/97
cacgcgaaugacgauccagccc

SEQ ID NO: 1170025 - RNA, 22 nt, Mycobacterium bovis subsp bovis AF2122/97
cacgcgacuugcaccccgucuc

SEQ ID NO: 1170026 - RNA, 17 nt, Mycobacterium bovis subsp bovis AF2122/97
cacgcugaauuccacug

SEQ ID NO: 1170027 - RNA, 15 nt, Mycobacterium bovis subsp bovis AF2122/97
cacgcugcccacggg

SEQ ID NO: 1170028 - RNA, 21 nt, Mycobacterium bovis subsp bovis AF2122/97
cacgcugcccacgggccggcc

SEQ ID NO: 1170029 - RNA, 18 nt, Mycobacterium bovis subsp bovis AF2122/97
cacgcuggccuccagcuu

SEQ ID NO: 1170030 - RNA, 14 nt, Mycobacterium bovis subsp bovis AF2122/97
cacgcuggcgcccc

SEQ ID NO: 1170031 - RNA, 18 nt, Mycobacterium bovis subsp bovis AF2122/97
cacgcuggcgcccccgac

SEQ ID NO: 1170032 - RNA, 20 nt, Mycobacterium bovis subsp bovis AF2122/97
cacgcucgugacgaucagcg

SEQ ID NO: 1170033 - RNA, 20 nt, Mycobacterium bovis subsp bovis AF2122/97
cacgcucguuugcgagcagg

SEQ ID NO: 1170034 - RNA, 22 nt, Mycobacterium bovis subsp bovis AF2122/97
cacgcucguuugcgagcagggg

SEQ ID NO: 1170035 - RNA, 17 nt, Mycobacterium bovis subsp bovis AF2122/97
cacgcuccagcucggcc

SEQ ID NO: 1170036 - RNA, 23 nt, Mycobacterium bovis subsp bovis AF2122/97
cacgcuccagcucggccagugcc

SEQ ID NO: 1170037 - RNA, 17 nt, Mycobacterium bovis subsp bovis AF2122/97
cacgcucaacccgugcg

SEQ ID NO: 1170038 - RNA, 17 nt, Mycobacterium bovis subsp bovis AF2122/97
cacgcccaugaccggcc

SEQ ID NO: 1170039 - RNA, 13 nt, Mycobacterium bovis subsp bovis AF2122/97
cacgcccggcccc

SEQ ID NO: 1170040 - RNA, 18 nt, Mycobacterium bovis subsp bovis AF2122/97
cacgccgaccggcccgca

SEQ ID NO: 1170041 - RNA, 19 nt, Mycobacterium bovis subsp bovis AF2122/97
cacgccgaccagcacccgc

SEQ ID NO: 1170042 - RNA, 16 nt, Mycobacterium bovis subsp bovis AF2122/97
cacgccgaccagcacc

SEQ ID NO: 1170043 - RNA, 21 nt, Mycobacterium bovis subsp bovis AF2122/97
cacgccggccucgccgaagcg

SEQ ID NO: 1170044 - RNA, 15 nt, Mycobacterium bovis subsp bovis AF2122/97
cacgccggcaugcca

SEQ ID NO: 1170045 - RNA, 23 nt, Mycobacterium bovis subsp bovis AF2122/97
cacgccgccggccgccagcgcac

SEQ ID NO: 1170046 - RNA, 12 nt, Mycobacterium bovis subsp bovis AF2122/97
cacgccgccccu

SEQ ID NO: 1170047 - RNA, 20 nt, Mycobacterium bovis subsp bovis AF2122/97
cacgccgccggccgccagcg

SEQ ID NO: 1170048 - RNA, 19 nt, Mycobacterium bovis subsp bovis AF2122/97
cacgccguggcccgcuccc

SEQ ID NO: 1170049 - RNA, 21 nt, Mycobacterium bovis subsp bovis AF2122/97
cacgccggcaugccagccacg

SEQ ID NO: 1170050 - RNA, 20 nt, Mycobacterium bovis subsp bovis AF2122/97
cacgccguagcgcagcgccu

SEQ ID NO: 1170051 - RNA, 15 nt, Mycobacterium bovis subsp bovis AF2122/97
cacgccagcucgccg

SEQ ID NO: 1170052 - RNA, 13 nt, Mycobacterium bovis subsp bovis AF2122/97
cacgccagccggu

SEQ ID NO: 1170053 - RNA, 12 nt, Mycobacterium bovis subsp bovis AF2122/97
cacgccagccgu

SEQ ID NO: 1170054 - RNA, 16 nt, Mycobacterium bovis subsp bovis AF2122/97
cacgccagccgugccg

SEQ ID NO: 1170055 - RNA, 11 nt, Mycobacterium bovis subsp bovis AF2122/97
cacgcccaggc

SEQ ID NO: 1170056 - RNA, 14 nt, Mycobacterium bovis subsp bovis AF2122/97
cacgcccaggcaag

SEQ ID NO: 1170057 - RNA, 13 nt, Mycobacterium bovis subsp bovis AF2122/97
cacgcccacagcu

SEQ ID NO: 1170058 - RNA, 22 nt, Mycobacterium bovis subsp bovis AF2122/97
cacgccaugguaugacccgccu

SEQ ID NO: 1170059 - RNA, 14 nt, Mycobacterium bovis subsp bovis AF2122/97
cacgccaccgcaac

SEQ ID NO: 1170060 - RNA, 13 nt, Mycobacterium bovis subsp bovis AF2122/97
cacgccaccgcgg

SEQ ID NO: 1170061 - RNA, 14 nt, Mycobacterium bovis subsp bovis AF2122/97
cacgccacguccaa

SEQ ID NO: 1170062 - RNA, 22 nt, Mycobacterium bovis subsp bovis AF2122/97
cacgccacuggacucuucagcu

SEQ ID NO: 1170063 - RNA, 15 nt, Mycobacterium bovis subsp bovis AF2122/97
cacgccagcccgucc

SEQ ID NO: 1170064 - RNA, 13 nt, Mycobacterium bovis subsp bovis AF2122/97
cacgcaugggcca

SEQ ID NO: 1170065 - RNA, 17 nt, Mycobacterium bovis subsp bovis AF2122/97
cacgcauguuggugauc

SEQ ID NO: 1170066 - RNA, 21 nt, Mycobacterium bovis subsp bovis AF2122/97
cacgaucugcaggcccaggcu

SEQ ID NO: 1170067 - RNA, 14 nt, Mycobacterium bovis subsp bovis AF2122/97
cacgaugaucccaa

SEQ ID NO: 1170068 - RNA, 20 nt, Mycobacterium bovis subsp bovis AF2122/97
cacgaugaucuugccgcggc

SEQ ID NO: 1170069 - RNA, 23 nt, Mycobacterium bovis subsp bovis AF2122/97
cacgaugaucuugccgcggcgca

SEQ ID NO: 1170070 - RNA, 17 nt, Mycobacterium bovis subsp bovis AF2122/97
cacgaucgucgcggcca

SEQ ID NO: 1170071 - RNA, 22 nt, Mycobacterium bovis subsp bovis AF2122/97
cacgaucggcagucccagcgcc

SEQ ID NO: 1170072 - RNA, 22 nt, Mycobacterium bovis subsp bovis AF2122/97
cacgaucucguggaucugccuc

SEQ ID NO: 1170073 - RNA, 20 nt, Mycobacterium bovis subsp bovis AF2122/97
cacgaucugcaggcccaggc

SEQ ID NO: 1170074 - RNA, 14 nt, Mycobacterium bovis subsp bovis AF2122/97
cacgauggcggcca

SEQ ID NO: 1170075 - RNA, 13 nt, Mycobacterium bovis subsp bovis AF2122/97
cacgaucgccaac

SEQ ID NO: 1170076 - RNA, 17 nt, Mycobacterium bovis subsp bovis AF2122/97
cacgaucaguugcccca

SEQ ID NO: 1170077 - RNA, 17 nt, Mycobacterium bovis subsp bovis AF2122/97
cacgcaggaaaaccccg

SEQ ID NO: 1170078 - RNA, 17 nt, Mycobacterium bovis subsp bovis AF2122/97
cacgcagucgggcagcg

SEQ ID NO: 1170079 - RNA, 13 nt, Mycobacterium bovis subsp bovis AF2122/97
cacgcagcccguc

SEQ ID NO: 1170080 - RNA, 14 nt, Mycobacterium bovis subsp bovis AF2122/97
cacgcacgccgcgu

SEQ ID NO: 1170081 - RNA, 20 nt, Mycobacterium bovis subsp bovis AF2122/97
cacgcacgcgguucaccacg

SEQ ID NO: 1170082 - RNA, 14 nt, Mycobacterium bovis subsp bovis AF2122/97
cacgcaccacaaac

SEQ ID NO: 1170083 - RNA, 23 nt, Mycobacterium bovis subsp bovis AF2122/97
cacgcacccggcgcaacaaccgg

SEQ ID NO: 1170084 - RNA, 15 nt, Mycobacterium bovis subsp bovis AF2122/97
cacgcaccgccccgc

SEQ ID NO: 1170085 - RNA, 14 nt, Mycobacterium bovis subsp bovis AF2122/97
cacgcaauucaaau

SEQ ID NO: 1170086 - RNA, 17 nt, Mycobacterium bovis subsp bovis AF2122/97
cacgcaccacaaacacc

SEQ ID NO: 1170087 - RNA, 19 nt, Mycobacterium bovis subsp bovis AF2122/97
cacgcaagggaauccgaac

SEQ ID NO: 1170088 - RNA, 14 nt, Mycobacterium bovis subsp bovis AF2122/97
cacgcaacaccgcc

SEQ ID NO: 1170089 - RNA, 20 nt, Mycobacterium bovis subsp bovis AF2122/97
cacgauuucgagcgcugcuc

SEQ ID NO: 1170090 - RNA, 15 nt, Mycobacterium bovis subsp bovis AF2122/97
cacggucacacgcca

SEQ ID NO: 1170091 - RNA, 21 nt, Mycobacterium bovis subsp bovis AF2122/97
cacggucaauugugcggcccc

SEQ ID NO: 1170092 - RNA, 18 nt, Mycobacterium bovis subsp bovis AF2122/97
cacggucaagccggcgcc

SEQ ID NO: 1170093 - RNA, 19 nt, Mycobacterium bovis subsp bovis AF2122/97
cacgggcggggacggcggc

SEQ ID NO: 1170094 - RNA, 13 nt, Mycobacterium bovis subsp bovis AF2122/97
cacggggcugccg

SEQ ID NO: 1170095 - RNA, 19 nt, Mycobacterium bovis subsp bovis AF2122/97
cacggguagcguccagguc

SEQ ID NO: 1170096 - RNA, 18 nt, Mycobacterium bovis subsp bovis AF2122/97
cacgggcccaggacagca

SEQ ID NO: 1170097 - RNA, 12 nt, Mycobacterium bovis subsp bovis AF2122/97
cacggugcccag

SEQ ID NO: 1170098 - RNA, 14 nt, Mycobacterium bovis subsp bovis AF2122/97
cacggugcccaggg

SEQ ID NO: 1170099 - RNA, 21 nt, Mycobacterium bovis subsp bovis AF2122/97
cacggucagcucgcugacggc

SEQ ID NO: 1170100 - RNA, 17 nt, Mycobacterium bovis subsp bovis AF2122/97
cacggucaggcguaggu

SEQ ID NO: 1170101 - RNA, 14 nt, Mycobacterium bovis subsp bovis AF2122/97
cacggucagcacgc

SEQ ID NO: 1170102 - RNA, 19 nt, Mycobacterium bovis subsp bovis AF2122/97
cacggucagcacgcugacc

SEQ ID NO: 1170103 - RNA, 17 nt, Mycobacterium bovis subsp bovis AF2122/97
cacggucaucucggugg

SEQ ID NO: 1170104 - RNA, 16 nt, Mycobacterium bovis subsp bovis AF2122/97
cacggucaugccgccg

SEQ ID NO: 1170105 - RNA, 22 nt, Mycobacterium bovis subsp bovis AF2122/97
cacgguggagcgcgccucgccc

SEQ ID NO: 1170106 - RNA, 22 nt, Mycobacterium bovis subsp bovis AF2122/97
cacggugguggugggaguucgc

SEQ ID NO: 1170107 - RNA, 20 nt, Mycobacterium bovis subsp bovis AF2122/97
cacgguguugcgcacccgcg

SEQ ID NO: 1170108 - RNA, 23 nt, Mycobacterium bovis subsp bovis AF2122/97
cacgguguauugggguggcagcu

SEQ ID NO: 1170109 - RNA, 13 nt, Mycobacterium bovis subsp bovis AF2122/97
cacggugucccgc

SEQ ID NO: 1170110 - RNA, 23 nt, Mycobacterium bovis subsp bovis AF2122/97
cacgucgacaccgaggaccucgu

SEQ ID NO: 1170111 - RNA, 21 nt, Mycobacterium bovis subsp bovis AF2122/97
cacgucgacggcggccgccac

SEQ ID NO: 1170112 - RNA, 20 nt, Mycobacterium bovis subsp bovis AF2122/97
cacgucgagcaggcuggcug

SEQ ID NO: 1170113 - RNA, 17 nt, Mycobacterium bovis subsp bovis AF2122/97
cacgucgaggcggcagu

SEQ ID NO: 1170114 - RNA, 23 nt, Mycobacterium bovis subsp bovis AF2122/97
cacgucgagguccaccacccugc

SEQ ID NO: 1170115 - RNA, 12 nt, Mycobacterium bovis subsp bovis AF2122/97
cacguccugccc

SEQ ID NO: 1170116 - RNA, 18 nt, Mycobacterium bovis subsp bovis AF2122/97
cacgucggauccgcccgc

SEQ ID NO: 1170117 - RNA, 17 nt, Mycobacterium bovis subsp bovis AF2122/97
cacguccgcggagcuca

SEQ ID NO: 1170118 - RNA, 14 nt, Mycobacterium bovis subsp bovis AF2122/97
cacguacgccgccg

SEQ ID NO: 1170119 - RNA, 14 nt, Mycobacterium bovis subsp bovis AF2122/97
cacguacuccaccg

SEQ ID NO: 1170120 - RNA, 15 nt, Mycobacterium bovis subsp bovis AF2122/97
cacguagcagcagac

SEQ ID NO: 1170121 - RNA, 22 nt, Mycobacterium bovis subsp bovis AF2122/97
cacgguucgggcagcacccgcg

SEQ ID NO: 1170122 - RNA, 18 nt, Mycobacterium bovis subsp bovis AF2122/97
cacgguggccgagccgcg

SEQ ID NO: 1170123 - RNA, 19 nt, Mycobacterium bovis subsp bovis AF2122/97
cacgguuuucgagggaugg

SEQ ID NO: 1170124 - RNA, 23 nt, Mycobacterium bovis subsp bovis AF2122/97
cacguugccgaucccggcgagca

SEQ ID NO: 1170125 - RNA, 17 nt, Mycobacterium bovis subsp bovis AF2122/97
cacguugcacagcuugg

SEQ ID NO: 1170126 - RNA, 23 nt, Mycobacterium bovis subsp bovis AF2122/97
cacguucggcgaugaucaccagu

SEQ ID NO: 1170127 - RNA, 22 nt, Mycobacterium bovis subsp bovis AF2122/97
cacguucggcgcugccaggccg

SEQ ID NO: 1170128 - RNA, 19 nt, Mycobacterium bovis subsp bovis AF2122/97
cacguuauucaugcccaug

SEQ ID NO: 1170129 - RNA, 17 nt, Mycobacterium bovis subsp bovis AF2122/97
cacgugcccgcgcggcg

SEQ ID NO: 1170130 - RNA, 22 nt, Mycobacterium bovis subsp bovis AF2122/97
cacgugaaggcgauggcaccgu

SEQ ID NO: 1170131 - RNA, 19 nt, Mycobacterium bovis subsp bovis AF2122/97
cacgucgcgccaggcgcga

SEQ ID NO: 1170132 - RNA, 15 nt, Mycobacterium bovis subsp bovis AF2122/97
cacgugggccaugcu

SEQ ID NO: 1170133 - RNA, 15 nt, Mycobacterium bovis subsp bovis AF2122/97
cacguggugggcgca

SEQ ID NO: 1170134 - RNA, 17 nt, Mycobacterium bovis subsp bovis AF2122/97
cacguggucggccaccc

SEQ ID NO: 1170135 - RNA, 19 nt, Mycobacterium bovis subsp bovis AF2122/97
cacguggucggccacccca

SEQ ID NO: 1170136 - RNA, 15 nt, Mycobacterium bovis subsp bovis AF2122/97
cacuaccgaucacau

SEQ ID NO: 1170137 - RNA, 18 nt, Mycobacterium bovis subsp bovis AF2122/97
cacuacccgcaacgaggc

SEQ ID NO: 1170138 - RNA, 20 nt, Mycobacterium bovis subsp bovis AF2122/97
cacuacccgcaacgaggcaa

SEQ ID NO: 1170139 - RNA, 15 nt, Mycobacterium bovis subsp bovis AF2122/97
cacuacacaggaagc

SEQ ID NO: 1170140 - RNA, 19 nt, Mycobacterium bovis subsp bovis AF2122/97
cacuaaccgaauuguugua

SEQ ID NO: 1170141 - RNA, 22 nt, Mycobacterium bovis subsp bovis AF2122/97
cacuaaccuggcguagaucauc

SEQ ID NO: 1170142 - RNA, 15 nt, Mycobacterium bovis subsp bovis AF2122/97
cacucgggacuuccc

SEQ ID NO: 1170143 - RNA, 15 nt, Mycobacterium bovis subsp bovis AF2122/97
cacucggcccggcag

SEQ ID NO: 1170144 - RNA, 15 nt, Mycobacterium bovis subsp bovis AF2122/97
cacucgcccgauccg

SEQ ID NO: 1170145 - RNA, 23 nt, Mycobacterium bovis subsp bovis AF2122/97
cacucgccgcgacugcaccuggc

SEQ ID NO: 1170146 - RNA, 19 nt, Mycobacterium bovis subsp bovis AF2122/97
cacucgccggcggacgccc

SEQ ID NO: 1170147 - RNA, 21 nt, Mycobacterium bovis subsp bovis AF2122/97
cacucgccgaaucgcugaccg

SEQ ID NO: 1170148 - RNA, 13 nt, Mycobacterium bovis subsp bovis AF2122/97
cacucuagccggg

SEQ ID NO: 1170149 - RNA, 16 nt, Mycobacterium bovis subsp bovis AF2122/97
cacucguugaccggcc

SEQ ID NO: 1170150 - RNA, 14 nt, Mycobacterium bovis subsp bovis AF2122/97
cacucucgccacgc

SEQ ID NO: 1170151 - RNA, 14 nt, Mycobacterium bovis subsp bovis AF2122/97
cacucucggcgcuc

SEQ ID NO: 1170152 - RNA, 14 nt, Mycobacterium bovis subsp bovis AF2122/97
cacuccgguggcca

SEQ ID NO: 1170153 - RNA, 13 nt, Mycobacterium bovis subsp bovis AF2122/97
cacuccucggugu

SEQ ID NO: 1170154 - RNA, 21 nt, Mycobacterium bovis subsp bovis AF2122/97
cacuccugcacacaggacuug

SEQ ID NO: 1170155 - RNA, 18 nt, Mycobacterium bovis subsp bovis AF2122/97
cacucgauccggauucag

SEQ ID NO: 1170156 - RNA, 19 nt, Mycobacterium bovis subsp bovis AF2122/97
cacucgaccaggaccggcu

SEQ ID NO: 1170157 - RNA, 12 nt, Mycobacterium bovis subsp bovis AF2122/97
cacuccgccaac

SEQ ID NO: 1170158 - RNA, 16 nt, Mycobacterium bovis subsp bovis AF2122/97
cacuccccagccccac

SEQ ID NO: 1170159 - RNA, 17 nt, Mycobacterium bovis subsp bovis AF2122/97
cacuccccagccccacc

SEQ ID NO: 1170160 - RNA, 14 nt, Mycobacterium bovis subsp bovis AF2122/97
cacucccgccccgc

SEQ ID NO: 1170161 - RNA, 15 nt, Mycobacterium bovis subsp bovis AF2122/97
cacucccgccccgcu

SEQ ID NO: 1170162 - RNA, 22 nt, Mycobacterium bovis subsp bovis AF2122/97
cacucugaucuguguuugcggc

SEQ ID NO: 1170163 - RNA, 21 nt, Mycobacterium bovis subsp bovis AF2122/97
cacucucggugaacgccgccc

SEQ ID NO: 1170164 - RNA, 22 nt, Mycobacterium bovis subsp bovis AF2122/97
cacucucggugaacgccgcccc

SEQ ID NO: 1170165 - RNA, 17 nt, Mycobacterium bovis subsp bovis AF2122/97
cacucuucgggcggcgu

SEQ ID NO: 1170166 - RNA, 20 nt, Mycobacterium bovis subsp bovis AF2122/97
cacugacgucucaucaaacc

SEQ ID NO: 1170167 - RNA, 21 nt, Mycobacterium bovis subsp bovis AF2122/97
cacugacgcgcccgacgaaca

SEQ ID NO: 1170168 - RNA, 13 nt, Mycobacterium bovis subsp bovis AF2122/97
cacugagauccag

SEQ ID NO: 1170169 - RNA, 15 nt, Mycobacterium bovis subsp bovis AF2122/97
cacugaccccgccgc

SEQ ID NO: 1170170 - RNA, 22 nt, Mycobacterium bovis subsp bovis AF2122/97
cacugaaccguucgacccagcg

SEQ ID NO: 1170171 - RNA, 20 nt, Mycobacterium bovis subsp bovis AF2122/97
cacucauagaacucgccgcu

SEQ ID NO: 1170172 - RNA, 19 nt, Mycobacterium bovis subsp bovis AF2122/97
cacucaaccugaaccggcc

SEQ ID NO: 1170173 - RNA, 14 nt, Mycobacterium bovis subsp bovis AF2122/97
cacucacccgggca

SEQ ID NO: 1170174 - RNA, 15 nt, Mycobacterium bovis subsp bovis AF2122/97
cacucacauuggcca

SEQ ID NO: 1170175 - RNA, 21 nt, Mycobacterium bovis subsp bovis AF2122/97
cacucacauuggccaggucgg

SEQ ID NO: 1170176 - RNA, 14 nt, Mycobacterium bovis subsp bovis AF2122/97
cacuacggccuggc

SEQ ID NO: 1170177 - RNA, 13 nt, Mycobacterium bovis subsp bovis AF2122/97
cacuacgcagccg

SEQ ID NO: 1170178 - RNA, 21 nt, Mycobacterium bovis subsp bovis AF2122/97
cacuacggccuggccaccugg

SEQ ID NO: 1170179 - RNA, 19 nt, Mycobacterium bovis subsp bovis AF2122/97
cacuacuccggucccgcau

SEQ ID NO: 1170180 - RNA, 22 nt, Mycobacterium bovis subsp bovis AF2122/97
caacgacaggcgcccacaaaua

SEQ ID NO: 1170181 - RNA, 17 nt, Mycobacterium bovis subsp bovis AF2122/97
caacgacaugagcgcca

SEQ ID NO: 1170182 - RNA, 15 nt, Mycobacterium bovis subsp bovis AF2122/97
caacgaccaccacca

SEQ ID NO: 1170183 - RNA, 23 nt, Mycobacterium bovis subsp bovis AF2122/97
caacgacucucaucaacucgacc

SEQ ID NO: 1170184 - RNA, 18 nt, Mycobacterium bovis subsp bovis AF2122/97
caacgacugaucaagugc

SEQ ID NO: 1170185 - RNA, 18 nt, Mycobacterium bovis subsp bovis AF2122/97
caacgacgucgccgaccc

SEQ ID NO: 1170186 - RNA, 12 nt, Mycobacterium bovis subsp bovis AF2122/97
caaccuuuggcc

SEQ ID NO: 1170187 - RNA, 20 nt, Mycobacterium bovis subsp bovis AF2122/97
caacgaaccgcucagcgcag

SEQ ID NO: 1170188 - RNA, 19 nt, Mycobacterium bovis subsp bovis AF2122/97
caacgaagagggcgccgcg

SEQ ID NO: 1170189 - RNA, 18 nt, Mycobacterium bovis subsp bovis AF2122/97
caacgaagccggcgccgg

SEQ ID NO: 1170190 - RNA, 22 nt, Mycobacterium bovis subsp bovis AF2122/97
caacgacaaaccgggcgugcca

SEQ ID NO: 1170191 - RNA, 15 nt, Mycobacterium bovis subsp bovis AF2122/97
caacgacaccagauc

SEQ ID NO: 1170192 - RNA, 17 nt, Mycobacterium bovis subsp bovis AF2122/97
caacgauugcgaagggc

SEQ ID NO: 1170193 - RNA, 21 nt, Mycobacterium bovis subsp bovis AF2122/97
caacgauugcgaagggcaccg

SEQ ID NO: 1170194 - RNA, 13 nt, Mycobacterium bovis subsp bovis AF2122/97
caacgcacacacc

SEQ ID NO: 1170195 - RNA, 15 nt, Mycobacterium bovis subsp bovis AF2122/97
caacaucggaugacc

SEQ ID NO: 1170196 - RNA, 15 nt, Mycobacterium bovis subsp bovis AF2122/97
caaccugccgggcca

SEQ ID NO: 1170197 - RNA, 19 nt, Mycobacterium bovis subsp bovis AF2122/97
caaccugccgggccacggc

SEQ ID NO: 1170198 - RNA, 22 nt, Mycobacterium bovis subsp bovis AF2122/97
caaccugggccaucacggucag

SEQ ID NO: 1170199 - RNA, 13 nt, Mycobacterium bovis subsp bovis AF2122/97
caaccuggggcca

SEQ ID NO: 1170200 - RNA, 15 nt, Mycobacterium bovis subsp bovis AF2122/97
caaccuggggccacc

SEQ ID NO: 1170201 - RNA, 17 nt, Mycobacterium bovis subsp bovis AF2122/97
caaccuggggccaccag

SEQ ID NO: 1170202 - RNA, 16 nt, Mycobacterium bovis subsp bovis AF2122/97
caaccuucgugucuau

SEQ ID NO: 1170203 - RNA, 13 nt, Mycobacterium bovis subsp bovis AF2122/97
caacaucacugcc

SEQ ID NO: 1170204 - RNA, 17 nt, Mycobacterium bovis subsp bovis AF2122/97
caacaucgaaaaccgag

SEQ ID NO: 1170205 - RNA, 23 nt, Mycobacterium bovis subsp bovis AF2122/97
caacgggauccgcgcgcuggacc

SEQ ID NO: 1170206 - RNA, 22 nt, Mycobacterium bovis subsp bovis AF2122/97
caacggggcagucaacucccga

SEQ ID NO: 1170207 - RNA, 17 nt, Mycobacterium bovis subsp bovis AF2122/97
caacggugaucagccac

SEQ ID NO: 1170208 - RNA, 21 nt, Mycobacterium bovis subsp bovis AF2122/97
caacggucaaucccggccagg

SEQ ID NO: 1170209 - RNA, 16 nt, Mycobacterium bovis subsp bovis AF2122/97
caacggugcucuucga

SEQ ID NO: 1170210 - RNA, 15 nt, Mycobacterium bovis subsp bovis AF2122/97
caacgcgacgccgcu

SEQ ID NO: 1170211 - RNA, 21 nt, Mycobacterium bovis subsp bovis AF2122/97
caacgcgacgccgcucccgca

SEQ ID NO: 1170212 - RNA, 13 nt, Mycobacterium bovis subsp bovis AF2122/97
caacucgggcagc

SEQ ID NO: 1170213 - RNA, 17 nt, Mycobacterium bovis subsp bovis AF2122/97
caacucgggcagcgcgg

SEQ ID NO: 1170214 - RNA, 19 nt, Mycobacterium bovis subsp bovis AF2122/97
caacucgggcagcgcggcc

SEQ ID NO: 1170215 - RNA, 19 nt, Mycobacterium bovis subsp bovis AF2122/97
caacucgggcagcuucaac

SEQ ID NO: 1170216 - RNA, 17 nt, Mycobacterium bovis subsp bovis AF2122/97
caacucguccaacugaa

SEQ ID NO: 1170217 - RNA, 13 nt, Mycobacterium bovis subsp bovis AF2122/97
caacuccucgacc

SEQ ID NO: 1170218 - RNA, 12 nt, Mycobacterium bovis subsp bovis AF2122/97
caacuccucagc

SEQ ID NO: 1170219 - RNA, 15 nt, Mycobacterium bovis subsp bovis AF2122/97
caacgugucccaagc

SEQ ID NO: 1170220 - RNA, 18 nt, Mycobacterium bovis subsp bovis AF2122/97
caacguucggcacaacca

SEQ ID NO: 1170221 - RNA, 21 nt, Mycobacterium bovis subsp bovis AF2122/97
caacguucggcacaaccaacg

SEQ ID NO: 1170222 - RNA, 20 nt, Mycobacterium bovis subsp bovis AF2122/97
caacuaucgucgugucgccg

SEQ ID NO: 1170223 - RNA, 21 nt, Mycobacterium bovis subsp bovis AF2122/97
caagaaagacgcuguccaggu

SEQ ID NO: 1170224 - RNA, 17 nt, Mycobacterium bovis subsp bovis AF2122/97
caacucggcauucaccg

SEQ ID NO: 1170225 - RNA, 15 nt, Mycobacterium bovis subsp bovis AF2122/97
caacuugggcccgcu

SEQ ID NO: 1170226 - RNA, 21 nt, Mycobacterium bovis subsp bovis AF2122/97
caacuuggcggccagccgcuc

SEQ ID NO: 1170227 - RNA, 16 nt, Mycobacterium bovis subsp bovis AF2122/97
caacuucuucagcagc

SEQ ID NO: 1170228 - RNA, 17 nt, Mycobacterium bovis subsp bovis AF2122/97
caagaugccugacacga

SEQ ID NO: 1170229 - RNA, 16 nt, Mycobacterium bovis subsp bovis AF2122/97
caagaccgcgccaacu

SEQ ID NO: 1170230 - RNA, 20 nt, Mycobacterium bovis subsp bovis AF2122/97
caagaccgcgccaacuccga

SEQ ID NO: 1170231 - RNA, 21 nt, Mycobacterium bovis subsp bovis AF2122/97
caagagccguccgaccaggga

SEQ ID NO: 1170232 - RNA, 21 nt, Mycobacterium bovis subsp bovis AF2122/97
caauaccgccagcgccaccgu

SEQ ID NO: 1170233 - RNA, 21 nt, Mycobacterium bovis subsp bovis AF2122/97
caaucacauagccggucagua

SEQ ID NO: 1170234 - RNA, 17 nt, Mycobacterium bovis subsp bovis AF2122/97
caaucaccgccgcgacc

SEQ ID NO: 1170235 - RNA, 16 nt, Mycobacterium bovis subsp bovis AF2122/97
caaucaacgucacccc

SEQ ID NO: 1170236 - RNA, 17 nt, Mycobacterium bovis subsp bovis AF2122/97
caagggauccgaagagc

SEQ ID NO: 1170237 - RNA, 19 nt, Mycobacterium bovis subsp bovis AF2122/97
caagggaauccgaacucgc

SEQ ID NO: 1170238 - RNA, 22 nt, Mycobacterium bovis subsp bovis AF2122/97
caaggcgugagcuaugcuggca

SEQ ID NO: 1170239 - RNA, 12 nt, Mycobacterium bovis subsp bovis AF2122/97
caaggccaagcg

SEQ ID NO: 1170240 - RNA, 15 nt, Mycobacterium bovis subsp bovis AF2122/97
caaggccaagcgcca

SEQ ID NO: 1170241 - RNA, 17 nt, Mycobacterium bovis subsp bovis AF2122/97
caaggcucagcagcgcc

SEQ ID NO: 1170242 - RNA, 20 nt, Mycobacterium bovis subsp bovis AF2122/97
caaggcguugguagccaggg

SEQ ID NO: 1170243 - RNA, 15 nt, Mycobacterium bovis subsp bovis AF2122/97
caaggcucagcagcg

SEQ ID NO: 1170244 - RNA, 14 nt, Mycobacterium bovis subsp bovis AF2122/97
caaguccagcagcg

SEQ ID NO: 1170245 - RNA, 14 nt, Mycobacterium bovis subsp bovis AF2122/97
caagucgauguaca

SEQ ID NO: 1170246 - RNA, 14 nt, Mycobacterium bovis subsp bovis AF2122/97
caagucgacacgcc

SEQ ID NO: 1170247 - RNA, 15 nt, Mycobacterium bovis subsp bovis AF2122/97
caagucugcccgacu

SEQ ID NO: 1170248 - RNA, 14 nt, Mycobacterium bovis subsp bovis AF2122/97
caagugguccaagu

SEQ ID NO: 1170249 - RNA, 15 nt, Mycobacterium bovis subsp bovis AF2122/97
caagugucgccgcuc

SEQ ID NO: 1170250 - RNA, 20 nt, Mycobacterium bovis subsp bovis AF2122/97
caaguggucgaugaaccaau

SEQ ID NO: 1170251 - RNA, 23 nt, Mycobacterium bovis subsp bovis AF2122/97
caaguggugguaggccgggagga

SEQ ID NO: 1170252 - RNA, 17 nt, Mycobacterium bovis subsp bovis AF2122/97
caagcaaccggugcgca

SEQ ID NO: 1170253 - RNA, 12 nt, Mycobacterium bovis subsp bovis AF2122/97
caagcacaccgc

SEQ ID NO: 1170254 - RNA, 15 nt, Mycobacterium bovis subsp bovis AF2122/97
caagcuaccggcccg

SEQ ID NO: 1170255 - RNA, 22 nt, Mycobacterium bovis subsp bovis AF2122/97
caagcgccaacaacccaacaaa

SEQ ID NO: 1170256 - RNA, 19 nt, Mycobacterium bovis subsp bovis AF2122/97
caagcgcgcgaaccccagc

SEQ ID NO: 1170257 - RNA, 12 nt, Mycobacterium bovis subsp bovis AF2122/97
caagccugccga

SEQ ID NO: 1170258 - RNA, 14 nt, Mycobacterium bovis subsp bovis AF2122/97
caagcgcagccugg

SEQ ID NO: 1170259 - RNA, 16 nt, Mycobacterium bovis subsp bovis AF2122/97
caagcucgacaacugc

SEQ ID NO: 1170260 - RNA, 16 nt, Mycobacterium bovis subsp bovis AF2122/97
caagcuccaguagucg

SEQ ID NO: 1170261 - RNA, 18 nt, Mycobacterium bovis subsp bovis AF2122/97
caagcucggccaccagcg

SEQ ID NO: 1170262 - RNA, 15 nt, Mycobacterium bovis subsp bovis AF2122/97
caagcucggccagca

SEQ ID NO: 1170263 - RNA, 18 nt, Mycobacterium bovis subsp bovis AF2122/97
caagcucggccagcacgc

SEQ ID NO: 1170264 - RNA, 15 nt, Mycobacterium bovis subsp bovis AF2122/97
caagcucggcccagc

SEQ ID NO: 1170265 - RNA, 16 nt, Mycobacterium bovis subsp bovis AF2122/97
caagcucggcccagcg

SEQ ID NO: 1170266 - RNA, 15 nt, Mycobacterium bovis subsp bovis AF2122/97
caagcugaccgccag

SEQ ID NO: 1170267 - RNA, 19 nt, Mycobacterium bovis subsp bovis AF2122/97
caagcugccccgccaccuc

SEQ ID NO: 1170268 - RNA, 22 nt, Mycobacterium bovis subsp bovis AF2122/97
caagcugggcguaaaccguggc

SEQ ID NO: 1170269 - RNA, 17 nt, Mycobacterium bovis subsp bovis AF2122/97
caagcuggggaacagca

SEQ ID NO: 1170270 - RNA, 14 nt, Mycobacterium bovis subsp bovis AF2122/97
caaacccguugaag

SEQ ID NO: 1170271 - RNA, 19 nt, Mycobacterium bovis subsp bovis AF2122/97
caaacccgccgacaaaagc

SEQ ID NO: 1170272 - RNA, 20 nt, Mycobacterium bovis subsp bovis AF2122/97
caaacccgccgacaaaagcc

SEQ ID NO: 1170273 - RNA, 21 nt, Mycobacterium bovis subsp bovis AF2122/97
caaacccgccgacaaaagcca

SEQ ID NO: 1170274 - RNA, 22 nt, Mycobacterium bovis subsp bovis AF2122/97
caaacccgccgacaaaagccag

SEQ ID NO: 1170275 - RNA, 14 nt, Mycobacterium bovis subsp bovis AF2122/97
caaaccaagcgcgc

SEQ ID NO: 1170276 - RNA, 14 nt, Mycobacterium bovis subsp bovis AF2122/97
caaaccacagacug

SEQ ID NO: 1170277 - RNA, 16 nt, Mycobacterium bovis subsp bovis AF2122/97
caaacaucgcacccac

SEQ ID NO: 1170278 - RNA, 16 nt, Mycobacterium bovis subsp bovis AF2122/97
caaacaccccacacag

SEQ ID NO: 1170279 - RNA, 19 nt, Mycobacterium bovis subsp bovis AF2122/97
caaacuaacggcagccacc

SEQ ID NO: 1170280 - RNA, 20 nt, Mycobacterium bovis subsp bovis AF2122/97
caaacggcuuggcugccucc

SEQ ID NO: 1170281 - RNA, 13 nt, Mycobacterium bovis subsp bovis AF2122/97
caaaccuuugauu

SEQ ID NO: 1170282 - RNA, 21 nt, Mycobacterium bovis subsp bovis AF2122/97
caaacgacagcccuaucagcc

SEQ ID NO: 1170283 - RNA, 16 nt, Mycobacterium bovis subsp bovis AF2122/97
caaaaucgcggccaca

SEQ ID NO: 1170284 - RNA, 17 nt, Mycobacterium bovis subsp bovis AF2122/97
caaaaucgucagcgccg

SEQ ID NO: 1170285 - RNA, 17 nt, Mycobacterium bovis subsp bovis AF2122/97
caaacaagaucagaccc

SEQ ID NO: 1170286 - RNA, 22 nt, Mycobacterium bovis subsp bovis AF2122/97
caacaguucucgcgcuugcgcc

SEQ ID NO: 1170287 - RNA, 16 nt, Mycobacterium bovis subsp bovis AF2122/97
caacaguucacgaccc

SEQ ID NO: 1170288 - RNA, 23 nt, Mycobacterium bovis subsp bovis AF2122/97
caacagccgcucgcacagccgcu

SEQ ID NO: 1170289 - RNA, 14 nt, Mycobacterium bovis subsp bovis AF2122/97
caacagcgcuccag

SEQ ID NO: 1170290 - RNA, 16 nt, Mycobacterium bovis subsp bovis AF2122/97
caacagguccaccggc

SEQ ID NO: 1170291 - RNA, 18 nt, Mycobacterium bovis subsp bovis AF2122/97
caacagaugccacccaga

SEQ ID NO: 1170292 - RNA, 17 nt, Mycobacterium bovis subsp bovis AF2122/97
caacagccgcagccagg

SEQ ID NO: 1170293 - RNA, 12 nt, Mycobacterium bovis subsp bovis AF2122/97
caacagccagcu

SEQ ID NO: 1170294 - RNA, 20 nt, Mycobacterium bovis subsp bovis AF2122/97
caacaccggcugguucaaca

SEQ ID NO: 1170295 - RNA, 13 nt, Mycobacterium bovis subsp bovis AF2122/97
caacaccgcccgc

SEQ ID NO: 1170296 - RNA, 20 nt, Mycobacterium bovis subsp bovis AF2122/97
caacaccgucggcagcagcg

SEQ ID NO: 1170297 - RNA, 16 nt, Mycobacterium bovis subsp bovis AF2122/97
caacaccgugcaccag

SEQ ID NO: 1170298 - RNA, 19 nt, Mycobacterium bovis subsp bovis AF2122/97
caacaccucaaacgccugg

SEQ ID NO: 1170299 - RNA, 16 nt, Mycobacterium bovis subsp bovis AF2122/97
caacaccgccagcaug

SEQ ID NO: 1170300 - RNA, 17 nt, Mycobacterium bovis subsp bovis AF2122/97
caacaccccccccccca

SEQ ID NO: 1170301 - RNA, 17 nt, Mycobacterium bovis subsp bovis AF2122/97
caacacccgcccgggcg

SEQ ID NO: 1170302 - RNA, 19 nt, Mycobacterium bovis subsp bovis AF2122/97
caacacccacgugcugccu

SEQ ID NO: 1170303 - RNA, 16 nt, Mycobacterium bovis subsp bovis AF2122/97
caacacccacugcacg

SEQ ID NO: 1170304 - RNA, 15 nt, Mycobacterium bovis subsp bovis AF2122/97
caacaacuccagcag

SEQ ID NO: 1170305 - RNA, 15 nt, Mycobacterium bovis subsp bovis AF2122/97
caacaacccaacaaa

SEQ ID NO: 1170306 - RNA, 14 nt, Mycobacterium bovis subsp bovis AF2122/97
caacaaaaggccau

SEQ ID NO: 1170307 - RNA, 18 nt, Mycobacterium bovis subsp bovis AF2122/97
caacaaaaggccauccga

SEQ ID NO: 1170308 - RNA, 23 nt, Mycobacterium bovis subsp bovis AF2122/97
caaaugcgggcuuugccaacaaa

SEQ ID NO: 1170309 - RNA, 21 nt, Mycobacterium bovis subsp bovis AF2122/97
caaauggugagcucgcgcaga

SEQ ID NO: 1170310 - RNA, 21 nt, Mycobacterium bovis subsp bovis AF2122/97
caaaugaaccgcacccugaca

SEQ ID NO: 1170311 - RNA, 16 nt, Mycobacterium bovis subsp bovis AF2122/97
caaagaucgccucucg

SEQ ID NO: 1170312 - RNA, 23 nt, Mycobacterium bovis subsp bovis AF2122/97
caaagcugcucgucggcgccggc

SEQ ID NO: 1170313 - RNA, 13 nt, Mycobacterium bovis subsp bovis AF2122/97
caaagcggccucg

SEQ ID NO: 1170314 - RNA, 15 nt, Mycobacterium bovis subsp bovis AF2122/97
caaaggggugugugc

SEQ ID NO: 1170315 - RNA, 21 nt, Mycobacterium bovis subsp bovis AF2122/97
caaaggcuugcggaacgaaag

SEQ ID NO: 1170316 - RNA, 19 nt, Mycobacterium bovis subsp bovis AF2122/97
caaaggcgccgggucacgu

SEQ ID NO: 1170317 - RNA, 16 nt, Mycobacterium bovis subsp bovis AF2122/97
auuuccacauccaacg

SEQ ID NO: 1170318 - RNA, 21 nt, Mycobacterium bovis subsp bovis AF2122/97
auuuccaccacgcgcguuuag

SEQ ID NO: 1170319 - RNA, 16 nt, Mycobacterium bovis subsp bovis AF2122/97
auuucgcugguggaca

SEQ ID NO: 1170320 - RNA, 15 nt, Mycobacterium bovis subsp bovis AF2122/97
auuuccagcagugcg

SEQ ID NO: 1170321 - RNA, 17 nt, Mycobacterium bovis subsp bovis AF2122/97
auuggucaccugcugca

SEQ ID NO: 1170322 - RNA, 19 nt, Mycobacterium bovis subsp bovis AF2122/97
auuggugggccagcagcaa

SEQ ID NO: 1170323 - RNA, 18 nt, Mycobacterium bovis subsp bovis AF2122/97
auuggcgucagcagcaac

SEQ ID NO: 1170324 - RNA, 13 nt, Mycobacterium bovis subsp bovis AF2122/97
auuucggcccacu

SEQ ID NO: 1170325 - RNA, 14 nt, Mycobacterium bovis subsp bovis AF2122/97
auuucugcagccca

SEQ ID NO: 1170326 - RNA, 20 nt, Mycobacterium bovis subsp bovis AF2122/97
auuuuggcaagcugccccgc

SEQ ID NO: 1170327 - RNA, 17 nt, Mycobacterium bovis subsp bovis AF2122/97
auuuuggcugcagucag

SEQ ID NO: 1170328 - RNA, 17 nt, Mycobacterium bovis subsp bovis AF2122/97
auucuucggugaagaac

SEQ ID NO: 1170329 - RNA, 20 nt, Mycobacterium bovis subsp bovis AF2122/97
auucugcgucugcucgccgu

SEQ ID NO: 1170330 - RNA, 21 nt, Mycobacterium bovis subsp bovis AF2122/97
auucgugggaaccaccagcac

SEQ ID NO: 1170331 - RNA, 18 nt, Mycobacterium bovis subsp bovis AF2122/97
auucguggagccggccgu

SEQ ID NO: 1170332 - RNA, 18 nt, Mycobacterium bovis subsp bovis AF2122/97
auucguuggcgaacuggu

SEQ ID NO: 1170333 - RNA, 22 nt, Mycobacterium bovis subsp bovis AF2122/97
auugcggaaacccggccgccga

SEQ ID NO: 1170334 - RNA, 18 nt, Mycobacterium bovis subsp bovis AF2122/97
auugcugcggcuuucagc

SEQ ID NO: 1170335 - RNA, 12 nt, Mycobacterium bovis subsp bovis AF2122/97
auuggcgcagca

SEQ ID NO: 1170336 - RNA, 14 nt, Mycobacterium bovis subsp bovis AF2122/97
auuggcgccgccga

SEQ ID NO: 1170337 - RNA, 24 nt, Mycobacterium bovis subsp bovis AF2122/97
auuggcgccgucaccgaucgaaca

SEQ ID NO: 1170338 - RNA, 18 nt, Mycobacterium bovis subsp bovis AF2122/97
auuggcgaucagcagccg

SEQ ID NO: 1170339 - RNA, 22 nt, Mycobacterium bovis subsp bovis AF2122/97
auugaugucagggaugaucacc

SEQ ID NO: 1170340 - RNA, 20 nt, Mycobacterium bovis subsp bovis AF2122/97
auuccagccggugccgccgu

SEQ ID NO: 1170341 - RNA, 15 nt, Mycobacterium bovis subsp bovis AF2122/97
auuccacugggccug

SEQ ID NO: 1170342 - RNA, 23 nt, Mycobacterium bovis subsp bovis AF2122/97
auuccaugucgucgacaaacagc

SEQ ID NO: 1170343 - RNA, 16 nt, Mycobacterium bovis subsp bovis AF2122/97
auuccacaaauccaaa

SEQ ID NO: 1170344 - RNA, 13 nt, Mycobacterium bovis subsp bovis AF2122/97
auucaucacggga

SEQ ID NO: 1170345 - RNA, 13 nt, Mycobacterium bovis subsp bovis AF2122/97
auucggcugccac

SEQ ID NO: 1170346 - RNA, 22 nt, Mycobacterium bovis subsp bovis AF2122/97
auucggcggcauguucaucgca

SEQ ID NO: 1170347 - RNA, 16 nt, Mycobacterium bovis subsp bovis AF2122/97
auucggcugccaccgc

SEQ ID NO: 1170348 - RNA, 23 nt, Mycobacterium bovis subsp bovis AF2122/97
auucgacucuuucuuugccggag

SEQ ID NO: 1170349 - RNA, 18 nt, Mycobacterium bovis subsp bovis AF2122/97
auucccgccuucucccgc

SEQ ID NO: 1170350 - RNA, 13 nt, Mycobacterium bovis subsp bovis AF2122/97
auucccgcuuggc

SEQ ID NO: 1170351 - RNA, 15 nt, Mycobacterium bovis subsp bovis AF2122/97
auucccggacccacc

SEQ ID NO: 1170352 - RNA, 12 nt, Mycobacterium bovis subsp bovis AF2122/97
auuccccagccg

SEQ ID NO: 1170353 - RNA, 13 nt, Mycobacterium bovis subsp bovis AF2122/97
auuccccagccgc

SEQ ID NO: 1170354 - RNA, 12 nt, Mycobacterium bovis subsp bovis AF2122/97
auucccagucca

SEQ ID NO: 1170355 - RNA, 17 nt, Mycobacterium bovis subsp bovis AF2122/97
auuccgcgucugcucgg

SEQ ID NO: 1170356 - RNA, 17 nt, Mycobacterium bovis subsp bovis AF2122/97
auuccggcggccacgcc

SEQ ID NO: 1170357 - RNA, 12 nt, Mycobacterium bovis subsp bovis AF2122/97
auuccguagccg

SEQ ID NO: 1170358 - RNA, 18 nt, Mycobacterium bovis subsp bovis AF2122/97
auuccgcagagaccaagg

SEQ ID NO: 1170359 - RNA, 18 nt, Mycobacterium bovis subsp bovis AF2122/97
auuccucaaggucggcca

SEQ ID NO: 1170360 - RNA, 21 nt, Mycobacterium bovis subsp bovis AF2122/97
auuccucaaggucggccaggc

SEQ ID NO: 1170361 - RNA, 21 nt, Mycobacterium bovis subsp bovis AF2122/97
aucugguccagugggaugacc

SEQ ID NO: 1170362 - RNA, 13 nt, Mycobacterium bovis subsp bovis AF2122/97
aucugcugcagcg

SEQ ID NO: 1170363 - RNA, 11 nt, Mycobacterium bovis subsp bovis AF2122/97
aucugcugccg

SEQ ID NO: 1170364 - RNA, 23 nt, Mycobacterium bovis subsp bovis AF2122/97
aucugcuccucggucagcggggu

SEQ ID NO: 1170365 - RNA, 15 nt, Mycobacterium bovis subsp bovis AF2122/97
aucugcuuggugacc

SEQ ID NO: 1170366 - RNA, 20 nt, Mycobacterium bovis subsp bovis AF2122/97
aucuggaugucccaugcacg

SEQ ID NO: 1170367 - RNA, 15 nt, Mycobacterium bovis subsp bovis AF2122/97
aucuucaccacgccg

SEQ ID NO: 1170368 - RNA, 19 nt, Mycobacterium bovis subsp bovis AF2122/97
aucuucgacaggccaccgc

SEQ ID NO: 1170369 - RNA, 19 nt, Mycobacterium bovis subsp bovis AF2122/97
aucuucgcgcagccgccgc

SEQ ID NO: 1170370 - RNA, 23 nt, Mycobacterium bovis subsp bovis AF2122/97
aucuucgcgcagccgccgcgccc

SEQ ID NO: 1170371 - RNA, 20 nt, Mycobacterium bovis subsp bovis AF2122/97
aucuuccggaaagcucuugc

SEQ ID NO: 1170372 - RNA, 18 nt, Mycobacterium bovis subsp bovis AF2122/97
aucuugguggccucaucc

SEQ ID NO: 1170373 - RNA, 15 nt, Mycobacterium bovis subsp bovis AF2122/97
aucuuggugggaagc

SEQ ID NO: 1170374 - RNA, 15 nt, Mycobacterium bovis subsp bovis AF2122/97
aucuuggccagcagc

SEQ ID NO: 1170375 - RNA, 13 nt, Mycobacterium bovis subsp bovis AF2122/97
aucuuggccagca

SEQ ID NO: 1170376 - RNA, 15 nt, Mycobacterium bovis subsp bovis AF2122/97
aucuugugccaggcg

SEQ ID NO: 1170377 - RNA, 12 nt, Mycobacterium bovis subsp bovis AF2122/97
aucuugccacuc

SEQ ID NO: 1170378 - RNA, 15 nt, Mycobacterium bovis subsp bovis AF2122/97
aucuugcgcaaugcc

SEQ ID NO: 1170379 - RNA, 18 nt, Mycobacterium bovis subsp bovis AF2122/97
aucuugccgucggccggc

SEQ ID NO: 1170380 - RNA, 16 nt, Mycobacterium bovis subsp bovis AF2122/97
augagccggcgccgcc

SEQ ID NO: 1170381 - RNA, 12 nt, Mycobacterium bovis subsp bovis AF2122/97
augagcccagcc

SEQ ID NO: 1170382 - RNA, 17 nt, Mycobacterium bovis subsp bovis AF2122/97
augagccgcagaugcac

SEQ ID NO: 1170383 - RNA, 18 nt, Mycobacterium bovis subsp bovis AF2122/97
augagcaugcccagcgca

SEQ ID NO: 1170384 - RNA, 12 nt, Mycobacterium bovis subsp bovis AF2122/97
augagcaugccc

SEQ ID NO: 1170385 - RNA, 18 nt, Mycobacterium bovis subsp bovis AF2122/97
augagcgugccgcagcgg

SEQ ID NO: 1170386 - RNA, 20 nt, Mycobacterium bovis subsp bovis AF2122/97
augagcgcgcccaaccuggg

SEQ ID NO: 1170387 - RNA, 19 nt, Mycobacterium bovis subsp bovis AF2122/97
augacucggccgcaccagc

SEQ ID NO: 1170388 - RNA, 23 nt, Mycobacterium bovis subsp bovis AF2122/97
augaggcugccgaaguugaagaa

SEQ ID NO: 1170389 - RNA, 22 nt, Mycobacterium bovis subsp bovis AF2122/97
augaccccggcguugccgccgu

SEQ ID NO: 1170390 - RNA, 15 nt, Mycobacterium bovis subsp bovis AF2122/97
augacccgcggguga

SEQ ID NO: 1170391 - RNA, 17 nt, Mycobacterium bovis subsp bovis AF2122/97
augacccgcgggugaug

SEQ ID NO: 1170392 - RNA, 19 nt, Mycobacterium bovis subsp bovis AF2122/97
augaccgaaccuggucuug

SEQ ID NO: 1170393 - RNA, 22 nt, Mycobacterium bovis subsp bovis AF2122/97
augaccgccagcagcaggccag

SEQ ID NO: 1170394 - RNA, 22 nt, Mycobacterium bovis subsp bovis AF2122/97
augaccgguauuaccgccgugg

SEQ ID NO: 1170395 - RNA, 18 nt, Mycobacterium bovis subsp bovis AF2122/97
augaccguauagccgacg

SEQ ID NO: 1170396 - RNA, 14 nt, Mycobacterium bovis subsp bovis AF2122/97
augacgguguggaa

SEQ ID NO: 1170397 - RNA, 17 nt, Mycobacterium bovis subsp bovis AF2122/97
augaaccacggcaggca

SEQ ID NO: 1170398 - RNA, 15 nt, Mycobacterium bovis subsp bovis AF2122/97
augaacggaaucuug

SEQ ID NO: 1170399 - RNA, 21 nt, Mycobacterium bovis subsp bovis AF2122/97
augacaaaccugcaugcccag

SEQ ID NO: 1170400 - RNA, 22 nt, Mycobacterium bovis subsp bovis AF2122/97
augacaaaccugcaugcccaga

SEQ ID NO: 1170401 - RNA, 22 nt, Mycobacterium bovis subsp bovis AF2122/97
augaucuugccacuccaggagc

SEQ ID NO: 1170402 - RNA, 14 nt, Mycobacterium bovis subsp bovis AF2122/97
augaucuggucccg

SEQ ID NO: 1170403 - RNA, 20 nt, Mycobacterium bovis subsp bovis AF2122/97
augaucucggcgaacgcgaa

SEQ ID NO: 1170404 - RNA, 18 nt, Mycobacterium bovis subsp bovis AF2122/97
augauguuuuccccgccc

SEQ ID NO: 1170405 - RNA, 19 nt, Mycobacterium bovis subsp bovis AF2122/97
augaucccgcugaccuggg

SEQ ID NO: 1170406 - RNA, 19 nt, Mycobacterium bovis subsp bovis AF2122/97
augaucccgccaccgaaca

SEQ ID NO: 1170407 - RNA, 15 nt, Mycobacterium bovis subsp bovis AF2122/97
augaucaugaacgca

SEQ ID NO: 1170408 - RNA, 13 nt, Mycobacterium bovis subsp bovis AF2122/97
augaucaugaacg

SEQ ID NO: 1170409 - RNA, 20 nt, Mycobacterium bovis subsp bovis AF2122/97
augaucgcgaacaucgccag

SEQ ID NO: 1170410 - RNA, 23 nt, Mycobacterium bovis subsp bovis AF2122/97
augaucgcgaacaucgccagcgc

SEQ ID NO: 1170411 - RNA, 16 nt, Mycobacterium bovis subsp bovis AF2122/97
augaucgcggcggcga

SEQ ID NO: 1170412 - RNA, 15 nt, Mycobacterium bovis subsp bovis AF2122/97
augaucucacccagc

SEQ ID NO: 1170413 - RNA, 19 nt, Mycobacterium bovis subsp bovis AF2122/97
augcaccccaugaccggga

SEQ ID NO: 1170414 - RNA, 14 nt, Mycobacterium bovis subsp bovis AF2122/97
augauugccaggac

SEQ ID NO: 1170415 - RNA, 16 nt, Mycobacterium bovis subsp bovis AF2122/97
augcauccagcugcug

SEQ ID NO: 1170416 - RNA, 16 nt, Mycobacterium bovis subsp bovis AF2122/97
auggcgucggccagga

SEQ ID NO: 1170417 - RNA, 13 nt, Mycobacterium bovis subsp bovis AF2122/97
auggcgucggcca

SEQ ID NO: 1170418 - RNA, 21 nt, Mycobacterium bovis subsp bovis AF2122/97
auggcgguggcggucuugccg

SEQ ID NO: 1170419 - RNA, 19 nt, Mycobacterium bovis subsp bovis AF2122/97
auggcggugcgcagcuugg

SEQ ID NO: 1170420 - RNA, 22 nt, Mycobacterium bovis subsp bovis AF2122/97
auggcgagcguuuggacgggcg

SEQ ID NO: 1170421 - RNA, 12 nt, Mycobacterium bovis subsp bovis AF2122/97
auggccgucagc

SEQ ID NO: 1170422 - RNA, 22 nt, Mycobacterium bovis subsp bovis AF2122/97
auggcaccgcccccgucggccu

SEQ ID NO: 1170423 - RNA, 17 nt, Mycobacterium bovis subsp bovis AF2122/97
auggccccugucauguc

SEQ ID NO: 1170424 - RNA, 11 nt, Mycobacterium bovis subsp bovis AF2122/97
auggccgccga

SEQ ID NO: 1170425 - RNA, 13 nt, Mycobacterium bovis subsp bovis AF2122/97
auggccgccgaca

SEQ ID NO: 1170426 - RNA, 21 nt, Mycobacterium bovis subsp bovis AF2122/97
auggcaaccagcuucucagca

SEQ ID NO: 1170427 - RNA, 16 nt, Mycobacterium bovis subsp bovis AF2122/97
auggcaauauccggga

SEQ ID NO: 1170428 - RNA, 21 nt, Mycobacterium bovis subsp bovis AF2122/97
auggauuggcgucagcagcaa

SEQ ID NO: 1170429 - RNA, 15 nt, Mycobacterium bovis subsp bovis AF2122/97
auggugcgccgggcg

SEQ ID NO: 1170430 - RNA, 14 nt, Mycobacterium bovis subsp bovis AF2122/97
auggugauggggga

SEQ ID NO: 1170431 - RNA, 11 nt, Mycobacterium bovis subsp bovis AF2122/97
auggugaaguu

SEQ ID NO: 1170432 - RNA, 21 nt, Mycobacterium bovis subsp bovis AF2122/97
augguggcgguuccggccggc

SEQ ID NO: 1170433 - RNA, 22 nt, Mycobacterium bovis subsp bovis AF2122/97
auggugggaaaugaaguggcgu

SEQ ID NO: 1170434 - RNA, 21 nt, Mycobacterium bovis subsp bovis AF2122/97
augguggcgaucaucggcccc

SEQ ID NO: 1170435 - RNA, 17 nt, Mycobacterium bovis subsp bovis AF2122/97
augguggccgccaccuc

SEQ ID NO: 1170436 - RNA, 20 nt, Mycobacterium bovis subsp bovis AF2122/97
augguggugccgaccugucc

SEQ ID NO: 1170437 - RNA, 21 nt, Mycobacterium bovis subsp bovis AF2122/97
augguucgcacaccuccucga

SEQ ID NO: 1170438 - RNA, 22 nt, Mycobacterium bovis subsp bovis AF2122/97
augguuccguugaugccgccgg

SEQ ID NO: 1170439 - RNA, 20 nt, Mycobacterium bovis subsp bovis AF2122/97
augguucgcacaccuccucg

SEQ ID NO: 1170440 - RNA, 15 nt, Mycobacterium bovis subsp bovis AF2122/97
auggcuugcucugcg

SEQ ID NO: 1170441 - RNA, 21 nt, Mycobacterium bovis subsp bovis AF2122/97
auggguacccgaucacucgga

SEQ ID NO: 1170442 - RNA, 17 nt, Mycobacterium bovis subsp bovis AF2122/97
augggggagccggugac

SEQ ID NO: 1170443 - RNA, 19 nt, Mycobacterium bovis subsp bovis AF2122/97
auggggcccgcaugggcuu

SEQ ID NO: 1170444 - RNA, 15 nt, Mycobacterium bovis subsp bovis AF2122/97
augggguuaggagug

SEQ ID NO: 1170445 - RNA, 22 nt, Mycobacterium bovis subsp bovis AF2122/97
augggucuggcaggccagcaug

SEQ ID NO: 1170446 - RNA, 20 nt, Mycobacterium bovis subsp bovis AF2122/97
augucgauuucgaugacgaa

SEQ ID NO: 1170447 - RNA, 20 nt, Mycobacterium bovis subsp bovis AF2122/97
augucagugaucaccaaccc

SEQ ID NO: 1170448 - RNA, 17 nt, Mycobacterium bovis subsp bovis AF2122/97
augucagugccccgccc

SEQ ID NO: 1170449 - RNA, 21 nt, Mycobacterium bovis subsp bovis AF2122/97
augucgcugccgccgccggcg

SEQ ID NO: 1170450 - RNA, 14 nt, Mycobacterium bovis subsp bovis AF2122/97
augucgcgccaggc

SEQ ID NO: 1170451 - RNA, 16 nt, Mycobacterium bovis subsp bovis AF2122/97
augucgccgccuggcu

SEQ ID NO: 1170452 - RNA, 13 nt, Mycobacterium bovis subsp bovis AF2122/97
augucggccaccg

SEQ ID NO: 1170453 - RNA, 13 nt, Mycobacterium bovis subsp bovis AF2122/97
augucggccaggu

SEQ ID NO: 1170454 - RNA, 17 nt, Mycobacterium bovis subsp bovis AF2122/97
auguauuuggugaugca

SEQ ID NO: 1170455 - RNA, 18 nt, Mycobacterium bovis subsp bovis AF2122/97
augucaccccgcccagcg

SEQ ID NO: 1170456 - RNA, 18 nt, Mycobacterium bovis subsp bovis AF2122/97
augucaaguucgccagca

SEQ ID NO: 1170457 - RNA, 16 nt, Mycobacterium bovis subsp bovis AF2122/97
augucagccaccaucu

SEQ ID NO: 1170458 - RNA, 21 nt, Mycobacterium bovis subsp bovis AF2122/97
augugcggugaccgugaacgg

SEQ ID NO: 1170459 - RNA, 20 nt, Mycobacterium bovis subsp bovis AF2122/97
augucuaccaacaccgcccg

SEQ ID NO: 1170460 - RNA, 21 nt, Mycobacterium bovis subsp bovis AF2122/97
augucuaccaacaccgcccgc

SEQ ID NO: 1170461 - RNA, 17 nt, Mycobacterium bovis subsp bovis AF2122/97
augucgucgaccaggcc

SEQ ID NO: 1170462 - RNA, 21 nt, Mycobacterium bovis subsp bovis AF2122/97
auguucgaaagcaccgaugcu

SEQ ID NO: 1170463 - RNA, 20 nt, Mycobacterium bovis subsp bovis AF2122/97
auguucgccgcgcggaacac

SEQ ID NO: 1170464 - RNA, 23 nt, Mycobacterium bovis subsp bovis AF2122/97
auguuccccgucgccagggccuu

SEQ ID NO: 1170465 - RNA, 18 nt, Mycobacterium bovis subsp bovis AF2122/97
auguguugcgggugguuu

SEQ ID NO: 1170466 - RNA, 16 nt, Mycobacterium bovis subsp bovis AF2122/97
auguguugccagauca

SEQ ID NO: 1170467 - RNA, 14 nt, Mycobacterium bovis subsp bovis AF2122/97
auggacaccaaccc

SEQ ID NO: 1170468 - RNA, 13 nt, Mycobacterium bovis subsp bovis AF2122/97
auggacaccaccu

SEQ ID NO: 1170469 - RNA, 20 nt, Mycobacterium bovis subsp bovis AF2122/97
auggacggcagccagccacc

SEQ ID NO: 1170470 - RNA, 18 nt, Mycobacterium bovis subsp bovis AF2122/97
auggagccgcgaccaugg

SEQ ID NO: 1170471 - RNA, 15 nt, Mycobacterium bovis subsp bovis AF2122/97
auggacaacagcuug

SEQ ID NO: 1170472 - RNA, 19 nt, Mycobacterium bovis subsp bovis AF2122/97
auggaaaacgccaugccgg

SEQ ID NO: 1170473 - RNA, 13 nt, Mycobacterium bovis subsp bovis AF2122/97
augcugcccggca

SEQ ID NO: 1170474 - RNA, 21 nt, Mycobacterium bovis subsp bovis AF2122/97
augcugggcccgccagcccag

SEQ ID NO: 1170475 - RNA, 23 nt, Mycobacterium bovis subsp bovis AF2122/97
augcuggagaaaccacuggaugg

SEQ ID NO: 1170476 - RNA, 17 nt, Mycobacterium bovis subsp bovis AF2122/97
augcugagcgccaggcc

SEQ ID NO: 1170477 - RNA, 12 nt, Mycobacterium bovis subsp bovis AF2122/97
augcugaacacg

SEQ ID NO: 1170478 - RNA, 16 nt, Mycobacterium bovis subsp bovis AF2122/97
augcugaacacgcagc

SEQ ID NO: 1170479 - RNA, 16 nt, Mycobacterium bovis subsp bovis AF2122/97
augcugacgaacaugc

SEQ ID NO: 1170480 - RNA, 13 nt, Mycobacterium bovis subsp bovis AF2122/97
augcugggcgaga

SEQ ID NO: 1170481 - RNA, 20 nt, Mycobacterium bovis subsp bovis AF2122/97
augcuucggagaccgccucg

SEQ ID NO: 1170482 - RNA, 13 nt, Mycobacterium bovis subsp bovis AF2122/97
augcuuccagcau

SEQ ID NO: 1170483 - RNA, 20 nt, Mycobacterium bovis subsp bovis AF2122/97
augcucgucuugggccggga

SEQ ID NO: 1170484 - RNA, 14 nt, Mycobacterium bovis subsp bovis AF2122/97
augcucuugaugcc

SEQ ID NO: 1170485 - RNA, 18 nt, Mycobacterium bovis subsp bovis AF2122/97
augcucgccguugauguc

SEQ ID NO: 1170486 - RNA, 11 nt, Mycobacterium bovis subsp bovis AF2122/97
augcucagguc

SEQ ID NO: 1170487 - RNA, 17 nt, Mycobacterium bovis subsp bovis AF2122/97
augcgugcggcagugcc

SEQ ID NO: 1170488 - RNA, 23 nt, Mycobacterium bovis subsp bovis AF2122/97
augcgugucuccuuguccugccu

SEQ ID NO: 1170489 - RNA, 17 nt, Mycobacterium bovis subsp bovis AF2122/97
augcguucggccgggcc

SEQ ID NO: 1170490 - RNA, 15 nt, Mycobacterium bovis subsp bovis AF2122/97
augcgggcgccccac

SEQ ID NO: 1170491 - RNA, 12 nt, Mycobacterium bovis subsp bovis AF2122/97
augcgggcuggg

SEQ ID NO: 1170492 - RNA, 20 nt, Mycobacterium bovis subsp bovis AF2122/97
augcggggcaauccccugga

SEQ ID NO: 1170493 - RNA, 16 nt, Mycobacterium bovis subsp bovis AF2122/97
augcggucccugauca

SEQ ID NO: 1170494 - RNA, 15 nt, Mycobacterium bovis subsp bovis AF2122/97
augcggucggccaca

SEQ ID NO: 1170495 - RNA, 12 nt, Mycobacterium bovis subsp bovis AF2122/97
augcggccaugg

SEQ ID NO: 1170496 - RNA, 14 nt, Mycobacterium bovis subsp bovis AF2122/97
augcgcuaggugcg

SEQ ID NO: 1170497 - RNA, 20 nt, Mycobacterium bovis subsp bovis AF2122/97
augcgcugcucacgcagcag

SEQ ID NO: 1170498 - RNA, 13 nt, Mycobacterium bovis subsp bovis AF2122/97
augcgccgcaugc

SEQ ID NO: 1170499 - RNA, 15 nt, Mycobacterium bovis subsp bovis AF2122/97
augcgccaucucgac

SEQ ID NO: 1170500 - RNA, 23 nt, Mycobacterium bovis subsp bovis AF2122/97
augcaucgcaacgagucuuucca

SEQ ID NO: 1170501 - RNA, 20 nt, Mycobacterium bovis subsp bovis AF2122/97
augcgaucgacgauccacuu

SEQ ID NO: 1170502 - RNA, 21 nt, Mycobacterium bovis subsp bovis AF2122/97
aucaggucuucgauggccaug

SEQ ID NO: 1170503 - RNA, 23 nt, Mycobacterium bovis subsp bovis AF2122/97
aucaggugcgccuggcuggccag

SEQ ID NO: 1170504 - RNA, 20 nt, Mycobacterium bovis subsp bovis AF2122/97
aucaggugagaccagguucu

SEQ ID NO: 1170505 - RNA, 18 nt, Mycobacterium bovis subsp bovis AF2122/97
aucagguacgccaggugc

SEQ ID NO: 1170506 - RNA, 21 nt, Mycobacterium bovis subsp bovis AF2122/97
aucagugaagacaccaggccc

SEQ ID NO: 1170507 - RNA, 18 nt, Mycobacterium bovis subsp bovis AF2122/97
aucaguucccgaaccccg

SEQ ID NO: 1170508 - RNA, 17 nt, Mycobacterium bovis subsp bovis AF2122/97
aucaguuccuguagccg

SEQ ID NO: 1170509 - RNA, 18 nt, Mycobacterium bovis subsp bovis AF2122/97
aucaucgcugugcgcugg

SEQ ID NO: 1170510 - RNA, 14 nt, Mycobacterium bovis subsp bovis AF2122/97
aucaucgcuuggcc

SEQ ID NO: 1170511 - RNA, 21 nt, Mycobacterium bovis subsp bovis AF2122/97
aucaucucgguggacggcagg

SEQ ID NO: 1170512 - RNA, 16 nt, Mycobacterium bovis subsp bovis AF2122/97
aucaucuggucgacca

SEQ ID NO: 1170513 - RNA, 13 nt, Mycobacterium bovis subsp bovis AF2122/97
aucaugugccagu

SEQ ID NO: 1170514 - RNA, 13 nt, Mycobacterium bovis subsp bovis AF2122/97
aucaugagcagca

SEQ ID NO: 1170515 - RNA, 12 nt, Mycobacterium bovis subsp bovis AF2122/97
aucaugaccauc

SEQ ID NO: 1170516 - RNA, 16 nt, Mycobacterium bovis subsp bovis AF2122/97
aucaugaacgcaagca

SEQ ID NO: 1170517 - RNA, 20 nt, Mycobacterium bovis subsp bovis AF2122/97
aucauggugaaggcaaacac

SEQ ID NO: 1170518 - RNA, 23 nt, Mycobacterium bovis subsp bovis AF2122/97
aucauggcgagcguuuggacggg

SEQ ID NO: 1170519 - RNA, 16 nt, Mycobacterium bovis subsp bovis AF2122/97
aucauggauaauccau

SEQ ID NO: 1170520 - RNA, 17 nt, Mycobacterium bovis subsp bovis AF2122/97
auccagaaacugcucgg

SEQ ID NO: 1170521 - RNA, 16 nt, Mycobacterium bovis subsp bovis AF2122/97
auccagaugcccagca

SEQ ID NO: 1170522 - RNA, 14 nt, Mycobacterium bovis subsp bovis AF2122/97
auccagauaauccu

SEQ ID NO: 1170523 - RNA, 17 nt, Mycobacterium bovis subsp bovis AF2122/97
auccagaugcccagcag

SEQ ID NO: 1170524 - RNA, 13 nt, Mycobacterium bovis subsp bovis AF2122/97
auccacugcggcg

SEQ ID NO: 1170525 - RNA, 18 nt, Mycobacterium bovis subsp bovis AF2122/97
auccaccgguccagggcc

SEQ ID NO: 1170526 - RNA, 15 nt, Mycobacterium bovis subsp bovis AF2122/97
auccaaggcucagca

SEQ ID NO: 1170527 - RNA, 21 nt, Mycobacterium bovis subsp bovis AF2122/97
auccacaccggauaggugguc

SEQ ID NO: 1170528 - RNA, 12 nt, Mycobacterium bovis subsp bovis AF2122/97
auccacccggca

SEQ ID NO: 1170529 - RNA, 15 nt, Mycobacterium bovis subsp bovis AF2122/97
auccaacgaccucca

SEQ ID NO: 1170530 - RNA, 21 nt, Mycobacterium bovis subsp bovis AF2122/97
auccaugauggccgucagcca

SEQ ID NO: 1170531 - RNA, 24 nt, Mycobacterium bovis subsp bovis AF2122/97
aucccaccggcuaugcuggcgcag

SEQ ID NO: 1170532 - RNA, 16 nt, Mycobacterium bovis subsp bovis AF2122/97
aucccagcccgaaggu

SEQ ID NO: 1170533 - RNA, 15 nt, Mycobacterium bovis subsp bovis AF2122/97
aucccaggggcaccg

SEQ ID NO: 1170534 - RNA, 14 nt, Mycobacterium bovis subsp bovis AF2122/97
aucccaacuccucc

SEQ ID NO: 1170535 - RNA, 22 nt, Mycobacterium bovis subsp bovis AF2122/97
auccaggcccagccgagcggcg

SEQ ID NO: 1170536 - RNA, 19 nt, Mycobacterium bovis subsp bovis AF2122/97
auccaggcuguggccagca

SEQ ID NO: 1170537 - RNA, 22 nt, Mycobacterium bovis subsp bovis AF2122/97
auccaggcuguggccagcauca

SEQ ID NO: 1170538 - RNA, 21 nt, Mycobacterium bovis subsp bovis AF2122/97
auccaggggcgcaacucaucg

SEQ ID NO: 1170539 - RNA, 15 nt, Mycobacterium bovis subsp bovis AF2122/97
auccaggcgugcauc

SEQ ID NO: 1170540 - RNA, 22 nt, Mycobacterium bovis subsp bovis AF2122/97
auccagggccgacgcgaaccca

SEQ ID NO: 1170541 - RNA, 19 nt, Mycobacterium bovis subsp bovis AF2122/97
auccagcagccaggagccg

SEQ ID NO: 1170542 - RNA, 22 nt, Mycobacterium bovis subsp bovis AF2122/97
auccagcccuguuugacugcga

SEQ ID NO: 1170543 - RNA, 12 nt, Mycobacterium bovis subsp bovis AF2122/97
auccccagcaca

SEQ ID NO: 1170544 - RNA, 13 nt, Mycobacterium bovis subsp bovis AF2122/97
auccccagcacaa

SEQ ID NO: 1170545 - RNA, 17 nt, Mycobacterium bovis subsp bovis AF2122/97
auccccuggccagcaga

SEQ ID NO: 1170546 - RNA, 17 nt, Mycobacterium bovis subsp bovis AF2122/97
auccccuugguggccag

SEQ ID NO: 1170547 - RNA, 23 nt, Mycobacterium bovis subsp bovis AF2122/97
auccccuugguggccagccagcg

SEQ ID NO: 1170548 - RNA, 19 nt, Mycobacterium bovis subsp bovis AF2122/97
aucccgaaguagaagccca

SEQ ID NO: 1170549 - RNA, 15 nt, Mycobacterium bovis subsp bovis AF2122/97
aucccgacccugcug

SEQ ID NO: 1170550 - RNA, 18 nt, Mycobacterium bovis subsp bovis AF2122/97
aucccgacgaagguggca

SEQ ID NO: 1170551 - RNA, 20 nt, Mycobacterium bovis subsp bovis AF2122/97
auccccgcggcgguaaaccu

SEQ ID NO: 1170552 - RNA, 22 nt, Mycobacterium bovis subsp bovis AF2122/97
auccccgcaauucccaucggcc

SEQ ID NO: 1170553 - RNA, 15 nt, Mycobacterium bovis subsp bovis AF2122/97
auccccgccggcgcc

SEQ ID NO: 1170554 - RNA, 22 nt, Mycobacterium bovis subsp bovis AF2122/97
auccccgaccacugaucggcau

SEQ ID NO: 1170555 - RNA, 14 nt, Mycobacterium bovis subsp bovis AF2122/97
aucccgcaaaccgg

SEQ ID NO: 1170556 - RNA, 14 nt, Mycobacterium bovis subsp bovis AF2122/97
aucccgaugcuggc

SEQ ID NO: 1170557 - RNA, 19 nt, Mycobacterium bovis subsp bovis AF2122/97
aucccgccaucugccugcc

SEQ ID NO: 1170558 - RNA, 22 nt, Mycobacterium bovis subsp bovis AF2122/97
aucccgcccaagguggcggcca

SEQ ID NO: 1170559 - RNA, 19 nt, Mycobacterium bovis subsp bovis AF2122/97
aucccgccgcugccgccgg

SEQ ID NO: 1170560 - RNA, 20 nt, Mycobacterium bovis subsp bovis AF2122/97
aucccgcucccccgccaacc

SEQ ID NO: 1170561 - RNA, 13 nt, Mycobacterium bovis subsp bovis AF2122/97
aucccgucgggca

SEQ ID NO: 1170562 - RNA, 13 nt, Mycobacterium bovis subsp bovis AF2122/97
aucccgguggcag

SEQ ID NO: 1170563 - RNA, 21 nt, Mycobacterium bovis subsp bovis AF2122/97
aucccguagccgugccaauga

SEQ ID NO: 1170564 - RNA, 22 nt, Mycobacterium bovis subsp bovis AF2122/97
aucccggucuuuaauccagcgc

SEQ ID NO: 1170565 - RNA, 21 nt, Mycobacterium bovis subsp bovis AF2122/97
aucccguauugauacugcccg

SEQ ID NO: 1170566 - RNA, 20 nt, Mycobacterium bovis subsp bovis AF2122/97
aucccguucagcgaccaaug

SEQ ID NO: 1170567 - RNA, 13 nt, Mycobacterium bovis subsp bovis AF2122/97
auccgccagaccg

SEQ ID NO: 1170568 - RNA, 15 nt, Mycobacterium bovis subsp bovis AF2122/97
auccgcaggcccgcc

SEQ ID NO: 1170569 - RNA, 19 nt, Mycobacterium bovis subsp bovis AF2122/97
auccgcccuaaugaagccg

SEQ ID NO: 1170570 - RNA, 19 nt, Mycobacterium bovis subsp bovis AF2122/97
auccgcggcaugcaaugcu

SEQ ID NO: 1170571 - RNA, 22 nt, Mycobacterium bovis subsp bovis AF2122/97
auccgcggcaugcaaugcuggc

SEQ ID NO: 1170572 - RNA, 20 nt, Mycobacterium bovis subsp bovis AF2122/97
auccgauaaauggccgauga

SEQ ID NO: 1170573 - RNA, 20 nt, Mycobacterium bovis subsp bovis AF2122/97
auccgacgaccgcauugaac

SEQ ID NO: 1170574 - RNA, 22 nt, Mycobacterium bovis subsp bovis AF2122/97
auccgaacuucgugggggaccu

SEQ ID NO: 1170575 - RNA, 17 nt, Mycobacterium bovis subsp bovis AF2122/97
auccgggcgaccaccac

SEQ ID NO: 1170576 - RNA, 21 nt, Mycobacterium bovis subsp bovis AF2122/97
auccggcgggugccgagcugg

SEQ ID NO: 1170577 - RNA, 14 nt, Mycobacterium bovis subsp bovis AF2122/97
auccggugaugacc

SEQ ID NO: 1170578 - RNA, 15 nt, Mycobacterium bovis subsp bovis AF2122/97
auccgguguugagau

SEQ ID NO: 1170579 - RNA, 13 nt, Mycobacterium bovis subsp bovis AF2122/97
auccggucggcca

SEQ ID NO: 1170580 - RNA, 17 nt, Mycobacterium bovis subsp bovis AF2122/97
auccggucggccaggcc

SEQ ID NO: 1170581 - RNA, 13 nt, Mycobacterium bovis subsp bovis AF2122/97
auccggucggccc

SEQ ID NO: 1170582 - RNA, 17 nt, Mycobacterium bovis subsp bovis AF2122/97
auccggucggcccacac

SEQ ID NO: 1170583 - RNA, 12 nt, Mycobacterium bovis subsp bovis AF2122/97
auccgucccagg

SEQ ID NO: 1170584 - RNA, 20 nt, Mycobacterium bovis subsp bovis AF2122/97
auccucgaugacaucgguca

SEQ ID NO: 1170585 - RNA, 15 nt, Mycobacterium bovis subsp bovis AF2122/97
auccugaccagccag

SEQ ID NO: 1170586 - RNA, 23 nt, Mycobacterium bovis subsp bovis AF2122/97
auccugccgcacgggcccaggac

SEQ ID NO: 1170587 - RNA, 16 nt, Mycobacterium bovis subsp bovis AF2122/97
auccugcgguugaguu

SEQ ID NO: 1170588 - RNA, 19 nt, Mycobacterium bovis subsp bovis AF2122/97
auccugcagcucgggcagg

SEQ ID NO: 1170589 - RNA, 17 nt, Mycobacterium bovis subsp bovis AF2122/97
auccugcaguacggcca

SEQ ID NO: 1170590 - RNA, 13 nt, Mycobacterium bovis subsp bovis AF2122/97
auccuggacaagu

SEQ ID NO: 1170591 - RNA, 14 nt, Mycobacterium bovis subsp bovis AF2122/97
auccuggccgccgc

SEQ ID NO: 1170592 - RNA, 19 nt, Mycobacterium bovis subsp bovis AF2122/97
auccuggccacucccagcc

SEQ ID NO: 1170593 - RNA, 18 nt, Mycobacterium bovis subsp bovis AF2122/97
auccuggccgauggcguc

SEQ ID NO: 1170594 - RNA, 13 nt, Mycobacterium bovis subsp bovis AF2122/97
aucggcggccggc

SEQ ID NO: 1170595 - RNA, 17 nt, Mycobacterium bovis subsp bovis AF2122/97
aucggcggccggcgccg

SEQ ID NO: 1170596 - RNA, 15 nt, Mycobacterium bovis subsp bovis AF2122/97
aucggcgcuagccag

SEQ ID NO: 1170597 - RNA, 18 nt, Mycobacterium bovis subsp bovis AF2122/97
aucggcggcguccagcag

SEQ ID NO: 1170598 - RNA, 21 nt, Mycobacterium bovis subsp bovis AF2122/97
aucggcgggucugggucaggc

SEQ ID NO: 1170599 - RNA, 23 nt, Mycobacterium bovis subsp bovis AF2122/97
aucggcuaccuaacccgcgccgg

SEQ ID NO: 1170600 - RNA, 18 nt, Mycobacterium bovis subsp bovis AF2122/97
aucggcuaggccggccgg

SEQ ID NO: 1170601 - RNA, 17 nt, Mycobacterium bovis subsp bovis AF2122/97
aucgucggccagcagau

SEQ ID NO: 1170602 - RNA, 15 nt, Mycobacterium bovis subsp bovis AF2122/97
aucgucaguaccgca

SEQ ID NO: 1170603 - RNA, 17 nt, Mycobacterium bovis subsp bovis AF2122/97
aucgucauccaggggcg

SEQ ID NO: 1170604 - RNA, 12 nt, Mycobacterium bovis subsp bovis AF2122/97
aucgucaggccc

SEQ ID NO: 1170605 - RNA, 19 nt, Mycobacterium bovis subsp bovis AF2122/97
aucgucgugucgccgccgu

SEQ ID NO: 1170606 - RNA, 14 nt, Mycobacterium bovis subsp bovis AF2122/97
aucgucugguggca

SEQ ID NO: 1170607 - RNA, 19 nt, Mycobacterium bovis subsp bovis AF2122/97
aucgucugguggcagcgca

SEQ ID NO: 1170608 - RNA, 17 nt, Mycobacterium bovis subsp bovis AF2122/97
aucguuggccaugccac

SEQ ID NO: 1170609 - RNA, 20 nt, Mycobacterium bovis subsp bovis AF2122/97
aucgugacguuguaggagaa

SEQ ID NO: 1170610 - RNA, 21 nt, Mycobacterium bovis subsp bovis AF2122/97
aucgcucauucgugcccgggc

SEQ ID NO: 1170611 - RNA, 20 nt, Mycobacterium bovis subsp bovis AF2122/97
aucgccuuggcgcccgcgaa

SEQ ID NO: 1170612 - RNA, 17 nt, Mycobacterium bovis subsp bovis AF2122/97
aucgcuccggcccugcc

SEQ ID NO: 1170613 - RNA, 14 nt, Mycobacterium bovis subsp bovis AF2122/97
aucgcuugaacgca

SEQ ID NO: 1170614 - RNA, 15 nt, Mycobacterium bovis subsp bovis AF2122/97
aucgcuggugaaguc

SEQ ID NO: 1170615 - RNA, 14 nt, Mycobacterium bovis subsp bovis AF2122/97
aucgcuucgagcau

SEQ ID NO: 1170616 - RNA, 12 nt, Mycobacterium bovis subsp bovis AF2122/97
aucggaagaaac

SEQ ID NO: 1170617 - RNA, 21 nt, Mycobacterium bovis subsp bovis AF2122/97
aucggacucggaauucggcgu

SEQ ID NO: 1170618 - RNA, 18 nt, Mycobacterium bovis subsp bovis AF2122/97
aucggcaggguggccagc

SEQ ID NO: 1170619 - RNA, 15 nt, Mycobacterium bovis subsp bovis AF2122/97
aucggcauacccauc

SEQ ID NO: 1170620 - RNA, 17 nt, Mycobacterium bovis subsp bovis AF2122/97
aucggcauacccaucaa

SEQ ID NO: 1170621 - RNA, 20 nt, Mycobacterium bovis subsp bovis AF2122/97
aucggcauacccaucaacau

SEQ ID NO: 1170622 - RNA, 15 nt, Mycobacterium bovis subsp bovis AF2122/97
aucggccaacagguc

SEQ ID NO: 1170623 - RNA, 17 nt, Mycobacterium bovis subsp bovis AF2122/97
aucggcacaggcggcca

SEQ ID NO: 1170624 - RNA, 22 nt, Mycobacterium bovis subsp bovis AF2122/97
aucggcacaggcggccagcauc

SEQ ID NO: 1170625 - RNA, 15 nt, Mycobacterium bovis subsp bovis AF2122/97
aucggcagccccugc

SEQ ID NO: 1170626 - RNA, 15 nt, Mycobacterium bovis subsp bovis AF2122/97
aucggcagcagcgca

SEQ ID NO: 1170627 - RNA, 12 nt, Mycobacterium bovis subsp bovis AF2122/97
aucggcaccccg

SEQ ID NO: 1170628 - RNA, 15 nt, Mycobacterium bovis subsp bovis AF2122/97
aucgccgcuggccag

SEQ ID NO: 1170629 - RNA, 19 nt, Mycobacterium bovis subsp bovis AF2122/97
aucgccgcuaccgucagua

SEQ ID NO: 1170630 - RNA, 17 nt, Mycobacterium bovis subsp bovis AF2122/97
aucgccgcuacgccggc

SEQ ID NO: 1170631 - RNA, 23 nt, Mycobacterium bovis subsp bovis AF2122/97
aucgccugauaugacuugcgcgc

SEQ ID NO: 1170632 - RNA, 11 nt, Mycobacterium bovis subsp bovis AF2122/97
aucgccgccgc

SEQ ID NO: 1170633 - RNA, 21 nt, Mycobacterium bovis subsp bovis AF2122/97
aucgccgcgaagcgcucggca

SEQ ID NO: 1170634 - RNA, 14 nt, Mycobacterium bovis subsp bovis AF2122/97
aucgccagcggcaa

SEQ ID NO: 1170635 - RNA, 21 nt, Mycobacterium bovis subsp bovis AF2122/97
aucgccacuguugaagaagcc

SEQ ID NO: 1170636 - RNA, 11 nt, Mycobacterium bovis subsp bovis AF2122/97
aucgccagcag

SEQ ID NO: 1170637 - RNA, 14 nt, Mycobacterium bovis subsp bovis AF2122/97
aucgccaggcccug

SEQ ID NO: 1170638 - RNA, 16 nt, Mycobacterium bovis subsp bovis AF2122/97
aucgcccaacaacgcu

SEQ ID NO: 1170639 - RNA, 22 nt, Mycobacterium bovis subsp bovis AF2122/97
aucgccaugauggacagcugcg

SEQ ID NO: 1170640 - RNA, 17 nt, Mycobacterium bovis subsp bovis AF2122/97
aucgacguuccagcagu

SEQ ID NO: 1170641 - RNA, 19 nt, Mycobacterium bovis subsp bovis AF2122/97
aucgacggccagcccagca

SEQ ID NO: 1170642 - RNA, 22 nt, Mycobacterium bovis subsp bovis AF2122/97
aucgacuccggauggaacugga

SEQ ID NO: 1170643 - RNA, 20 nt, Mycobacterium bovis subsp bovis AF2122/97
aucgaucguguacugcuccu

SEQ ID NO: 1170644 - RNA, 22 nt, Mycobacterium bovis subsp bovis AF2122/97
aucgccaaauccggugcccgca

SEQ ID NO: 1170645 - RNA, 18 nt, Mycobacterium bovis subsp bovis AF2122/97
aucgccacacccaaaccg

SEQ ID NO: 1170646 - RNA, 11 nt, Mycobacterium bovis subsp bovis AF2122/97
aucgccacagu

SEQ ID NO: 1170647 - RNA, 23 nt, Mycobacterium bovis subsp bovis AF2122/97
aucgauucgucgcggaucagccc

SEQ ID NO: 1170648 - RNA, 18 nt, Mycobacterium bovis subsp bovis AF2122/97
auccuucgcgcucauugc

SEQ ID NO: 1170649 - RNA, 18 nt, Mycobacterium bovis subsp bovis AF2122/97
auccuugacgcggccaca

SEQ ID NO: 1170650 - RNA, 16 nt, Mycobacterium bovis subsp bovis AF2122/97
aucgacgccgccaccc

SEQ ID NO: 1170651 - RNA, 12 nt, Mycobacterium bovis subsp bovis AF2122/97
aucgaccgcccg

SEQ ID NO: 1170652 - RNA, 13 nt, Mycobacterium bovis subsp bovis AF2122/97
aucgaccaugguc

SEQ ID NO: 1170653 - RNA, 14 nt, Mycobacterium bovis subsp bovis AF2122/97
aucgaccauggucg

SEQ ID NO: 1170654 - RNA, 13 nt, Mycobacterium bovis subsp bovis AF2122/97
aucgacagcagcg

SEQ ID NO: 1170655 - RNA, 12 nt, Mycobacterium bovis subsp bovis AF2122/97
aucgacacccuu

SEQ ID NO: 1170656 - RNA, 15 nt, Mycobacterium bovis subsp bovis AF2122/97
aucgacaccgcccga

SEQ ID NO: 1170657 - RNA, 21 nt, Mycobacterium bovis subsp bovis AF2122/97
aucgaauugcguucgccgccc

SEQ ID NO: 1170658 - RNA, 15 nt, Mycobacterium bovis subsp bovis AF2122/97
auccuuugccgccga

SEQ ID NO: 1170659 - RNA, 18 nt, Mycobacterium bovis subsp bovis AF2122/97
auagccguugcgggccag

SEQ ID NO: 1170660 - RNA, 20 nt, Mycobacterium bovis subsp bovis AF2122/97
auagccguugcgggccaggc

SEQ ID NO: 1170661 - RNA, 17 nt, Mycobacterium bovis subsp bovis AF2122/97
auagccggcgcagcugu

SEQ ID NO: 1170662 - RNA, 21 nt, Mycobacterium bovis subsp bovis AF2122/97
auagccgguugucgcagcgca

SEQ ID NO: 1170663 - RNA, 16 nt, Mycobacterium bovis subsp bovis AF2122/97
auagcaucugaugacg

SEQ ID NO: 1170664 - RNA, 20 nt, Mycobacterium bovis subsp bovis AF2122/97
auagccgaccagguagacca

SEQ ID NO: 1170665 - RNA, 13 nt, Mycobacterium bovis subsp bovis AF2122/97
auagcagugcagc

SEQ ID NO: 1170666 - RNA, 19 nt, Mycobacterium bovis subsp bovis AF2122/97
auagacgaccccggugagc

SEQ ID NO: 1170667 - RNA, 15 nt, Mycobacterium bovis subsp bovis AF2122/97
auagaacaacgucgc

SEQ ID NO: 1170668 - RNA, 23 nt, Mycobacterium bovis subsp bovis AF2122/97
auaccagaccggccgacgugaca

SEQ ID NO: 1170669 - RNA, 13 nt, Mycobacterium bovis subsp bovis AF2122/97
auacccagcgccc

SEQ ID NO: 1170670 - RNA, 13 nt, Mycobacterium bovis subsp bovis AF2122/97
auacccaggaugu

SEQ ID NO: 1170671 - RNA, 15 nt, Mycobacterium bovis subsp bovis AF2122/97
auacccgcuggcccg

SEQ ID NO: 1170672 - RNA, 16 nt, Mycobacterium bovis subsp bovis AF2122/97
auaccgaggaucucgc

SEQ ID NO: 1170673 - RNA, 20 nt, Mycobacterium bovis subsp bovis AF2122/97
auacacauuuccaacguaug

SEQ ID NO: 1170674 - RNA, 14 nt, Mycobacterium bovis subsp bovis AF2122/97
auacacccaacuca

SEQ ID NO: 1170675 - RNA, 21 nt, Mycobacterium bovis subsp bovis AF2122/97
auacaggccacgcaccgggug

SEQ ID NO: 1170676 - RNA, 23 nt, Mycobacterium bovis subsp bovis AF2122/97
auacaggccacgcaccgggugca

SEQ ID NO: 1170677 - RNA, 20 nt, Mycobacterium bovis subsp bovis AF2122/97
auacaggcccgccagcaggg

SEQ ID NO: 1170678 - RNA, 17 nt, Mycobacterium bovis subsp bovis AF2122/97
auacagaucuggguucc

SEQ ID NO: 1170679 - RNA, 17 nt, Mycobacterium bovis subsp bovis AF2122/97
auacaucgccuugccca

SEQ ID NO: 1170680 - RNA, 19 nt, Mycobacterium bovis subsp bovis AF2122/97
auacauccaggcuguggcc

SEQ ID NO: 1170681 - RNA, 22 nt, Mycobacterium bovis subsp bovis AF2122/97
auaauucaacagcaccgcgacg

SEQ ID NO: 1170682 - RNA, 19 nt, Mycobacterium bovis subsp bovis AF2122/97
auauagggcuccucgugca

SEQ ID NO: 1170683 - RNA, 16 nt, Mycobacterium bovis subsp bovis AF2122/97
auaguccgaaccgagc

SEQ ID NO: 1170684 - RNA, 18 nt, Mycobacterium bovis subsp bovis AF2122/97
auaguccuugcgccagcg

SEQ ID NO: 1170685 - RNA, 20 nt, Mycobacterium bovis subsp bovis AF2122/97
auauccgggagugcgccggc

SEQ ID NO: 1170686 - RNA, 21 nt, Mycobacterium bovis subsp bovis AF2122/97
auaucgggagcggcugcggca

SEQ ID NO: 1170687 - RNA, 17 nt, Mycobacterium bovis subsp bovis AF2122/97
auauggaccgccgccga

SEQ ID NO: 1170688 - RNA, 16 nt, Mycobacterium bovis subsp bovis AF2122/97
auaucucgccguacau

SEQ ID NO: 1170689 - RNA, 22 nt, Mycobacterium bovis subsp bovis AF2122/97
auauggucaccggacugcgccg

SEQ ID NO: 1170690 - RNA, 16 nt, Mycobacterium bovis subsp bovis AF2122/97
auauuggacgcgcaug

SEQ ID NO: 1170691 - RNA, 21 nt, Mycobacterium bovis subsp bovis AF2122/97
auauuucuaaauaccuuuggc

SEQ ID NO: 1170692 - RNA, 19 nt, Mycobacterium bovis subsp bovis AF2122/97
aucaacaacagccgcagcc

SEQ ID NO: 1170693 - RNA, 21 nt, Mycobacterium bovis subsp bovis AF2122/97
aucaacuuccgcagcgccacc

SEQ ID NO: 1170694 - RNA, 12 nt, Mycobacterium bovis subsp bovis AF2122/97
aucaacaucggc

SEQ ID NO: 1170695 - RNA, 17 nt, Mycobacterium bovis subsp bovis AF2122/97
aucaacaucggcccgcu

SEQ ID NO: 1170696 - RNA, 22 nt, Mycobacterium bovis subsp bovis AF2122/97
agcuggccgcggcgaguacuga

SEQ ID NO: 1170697 - RNA, 16 nt, Mycobacterium bovis subsp bovis AF2122/97
agcuggccgucagcgu

SEQ ID NO: 1170698 - RNA, 16 nt, Mycobacterium bovis subsp bovis AF2122/97
agcugcuggcgcgccu

SEQ ID NO: 1170699 - RNA, 16 nt, Mycobacterium bovis subsp bovis AF2122/97
aguacgcaagcucaag

SEQ ID NO: 1170700 - RNA, 13 nt, Mycobacterium bovis subsp bovis AF2122/97
aguacgugcacag

SEQ ID NO: 1170701 - RNA, 22 nt, Mycobacterium bovis subsp bovis AF2122/97
aguacgggcaggccgcugggcc

SEQ ID NO: 1170702 - RNA, 13 nt, Mycobacterium bovis subsp bovis AF2122/97
aguacgggccucc

SEQ ID NO: 1170703 - RNA, 16 nt, Mycobacterium bovis subsp bovis AF2122/97
aguacgcugcggcuca

SEQ ID NO: 1170704 - RNA, 20 nt, Mycobacterium bovis subsp bovis AF2122/97
aguacucgcgcagguagcca

SEQ ID NO: 1170705 - RNA, 12 nt, Mycobacterium bovis subsp bovis AF2122/97
aguacuccagcc

SEQ ID NO: 1170706 - RNA, 14 nt, Mycobacterium bovis subsp bovis AF2122/97
aguagccguagccg

SEQ ID NO: 1170707 - RNA, 21 nt, Mycobacterium bovis subsp bovis AF2122/97
aguagccggucggcaccacca

SEQ ID NO: 1170708 - RNA, 18 nt, Mycobacterium bovis subsp bovis AF2122/97
aguagccguagccgccgu

SEQ ID NO: 1170709 - RNA, 21 nt, Mycobacterium bovis subsp bovis AF2122/97
aguaggcuucgaccguggugg

SEQ ID NO: 1170710 - RNA, 22 nt, Mycobacterium bovis subsp bovis AF2122/97
aguaggccaccacugcgcccgc

SEQ ID NO: 1170711 - RNA, 14 nt, Mycobacterium bovis subsp bovis AF2122/97
aguagcugaccauc

SEQ ID NO: 1170712 - RNA, 12 nt, Mycobacterium bovis subsp bovis AF2122/97
aguagugguggg

SEQ ID NO: 1170713 - RNA, 16 nt, Mycobacterium bovis subsp bovis AF2122/97
aguaguggugggcgug

SEQ ID NO: 1170714 - RNA, 17 nt, Mycobacterium bovis subsp bovis AF2122/97
aguagucgcuggccaga

SEQ ID NO: 1170715 - RNA, 15 nt, Mycobacterium bovis subsp bovis AF2122/97
aguagugcaggugcc

SEQ ID NO: 1170716 - RNA, 23 nt, Mycobacterium bovis subsp bovis AF2122/97
aguaguggccgccacccgcaacu

SEQ ID NO: 1170717 - RNA, 20 nt, Mycobacterium bovis subsp bovis AF2122/97
agucacgcacucccgagcca

SEQ ID NO: 1170718 - RNA, 21 nt, Mycobacterium bovis subsp bovis AF2122/97
agucacgcagccgcgcgguga

SEQ ID NO: 1170719 - RNA, 18 nt, Mycobacterium bovis subsp bovis AF2122/97
agucaccggguccaccgc

SEQ ID NO: 1170720 - RNA, 21 nt, Mycobacterium bovis subsp bovis AF2122/97
agucaaucgcgucaucaacgu

SEQ ID NO: 1170721 - RNA, 22 nt, Mycobacterium bovis subsp bovis AF2122/97
agucaaucgcgucaucaacguu

SEQ ID NO: 1170722 - RNA, 19 nt, Mycobacterium bovis subsp bovis AF2122/97
agucaaacaaccgugaacu

SEQ ID NO: 1170723 - RNA, 18 nt, Mycobacterium bovis subsp bovis AF2122/97
agucaagauugaccgcgg

SEQ ID NO: 1170724 - RNA, 11 nt, Mycobacterium bovis subsp bovis AF2122/97
agucagaaccg

SEQ ID NO: 1170725 - RNA, 23 nt, Mycobacterium bovis subsp bovis AF2122/97
agucagaacggcggcagcggcgu

SEQ ID NO: 1170726 - RNA, 12 nt, Mycobacterium bovis subsp bovis AF2122/97
aguccgccgccu

SEQ ID NO: 1170727 - RNA, 20 nt, Mycobacterium bovis subsp bovis AF2122/97
aguccgcgccgacggccagc

SEQ ID NO: 1170728 - RNA, 20 nt, Mycobacterium bovis subsp bovis AF2122/97
agucccgccguugccgccgu

SEQ ID NO: 1170729 - RNA, 19 nt, Mycobacterium bovis subsp bovis AF2122/97
agucccgguagaccaugaa

SEQ ID NO: 1170730 - RNA, 15 nt, Mycobacterium bovis subsp bovis AF2122/97
aguccgcauggucag

SEQ ID NO: 1170731 - RNA, 16 nt, Mycobacterium bovis subsp bovis AF2122/97
aguccgcauggucagc

SEQ ID NO: 1170732 - RNA, 22 nt, Mycobacterium bovis subsp bovis AF2122/97
aguccgagggcgucgccgccgu

SEQ ID NO: 1170733 - RNA, 16 nt, Mycobacterium bovis subsp bovis AF2122/97
aguccgagcuuggccg

SEQ ID NO: 1170734 - RNA, 23 nt, Mycobacterium bovis subsp bovis AF2122/97
agucgggccgguacuugaggguc

SEQ ID NO: 1170735 - RNA, 17 nt, Mycobacterium bovis subsp bovis AF2122/97
agucggggugggacagg

SEQ ID NO: 1170736 - RNA, 14 nt, Mycobacterium bovis subsp bovis AF2122/97
agucgcuaagacuu

SEQ ID NO: 1170737 - RNA, 21 nt, Mycobacterium bovis subsp bovis AF2122/97
agucggccgaugaaggccggc

SEQ ID NO: 1170738 - RNA, 13 nt, Mycobacterium bovis subsp bovis AF2122/97
agucgcugggugg

SEQ ID NO: 1170739 - RNA, 14 nt, Mycobacterium bovis subsp bovis AF2122/97
agucggagcgggga

SEQ ID NO: 1170740 - RNA, 21 nt, Mycobacterium bovis subsp bovis AF2122/97
agucggagugguauccaggcc

SEQ ID NO: 1170741 - RNA, 16 nt, Mycobacterium bovis subsp bovis AF2122/97
agucgacggccagugc

SEQ ID NO: 1170742 - RNA, 18 nt, Mycobacterium bovis subsp bovis AF2122/97
agucgcacggugccgccg

SEQ ID NO: 1170743 - RNA, 15 nt, Mycobacterium bovis subsp bovis AF2122/97
agucgcacugcgccg

SEQ ID NO: 1170744 - RNA, 18 nt, Mycobacterium bovis subsp bovis AF2122/97
agucgauuucggcggcga

SEQ ID NO: 1170745 - RNA, 20 nt, Mycobacterium bovis subsp bovis AF2122/97
agucgauuggcugcgccgau

SEQ ID NO: 1170746 - RNA, 15 nt, Mycobacterium bovis subsp bovis AF2122/97
agucgaugucaagga

SEQ ID NO: 1170747 - RNA, 23 nt, Mycobacterium bovis subsp bovis AF2122/97
aguccagcuggccgggugcgugc

SEQ ID NO: 1170748 - RNA, 21 nt, Mycobacterium bovis subsp bovis AF2122/97
aguccacauaugucccaugga

SEQ ID NO: 1170749 - RNA, 22 nt, Mycobacterium bovis subsp bovis AF2122/97
aguccaaucuucucgagccgcc

SEQ ID NO: 1170750 - RNA, 13 nt, Mycobacterium bovis subsp bovis AF2122/97
aguccaccgcgcg

SEQ ID NO: 1170751 - RNA, 14 nt, Mycobacterium bovis subsp bovis AF2122/97
aguccaccaccugg

SEQ ID NO: 1170752 - RNA, 21 nt, Mycobacterium bovis subsp bovis AF2122/97
aguccaccaccuggccggcca

SEQ ID NO: 1170753 - RNA, 20 nt, Mycobacterium bovis subsp bovis AF2122/97
aguccaggccggcagcuugc

SEQ ID NO: 1170754 - RNA, 22 nt, Mycobacterium bovis subsp bovis AF2122/97
aguccaggcugaucccgaugcu

SEQ ID NO: 1170755 - RNA, 20 nt, Mycobacterium bovis subsp bovis AF2122/97
aguccagggcgccacgggug

SEQ ID NO: 1170756 - RNA, 19 nt, Mycobacterium bovis subsp bovis AF2122/97
aguccaugugcccaggucu

SEQ ID NO: 1170757 - RNA, 22 nt, Mycobacterium bovis subsp bovis AF2122/97
agucauccaggucgccuuccca

SEQ ID NO: 1170758 - RNA, 22 nt, Mycobacterium bovis subsp bovis AF2122/97
agucauucgcuccggucggguu

SEQ ID NO: 1170759 - RNA, 13 nt, Mycobacterium bovis subsp bovis AF2122/97
agugcuucuuccc

SEQ ID NO: 1170760 - RNA, 23 nt, Mycobacterium bovis subsp bovis AF2122/97
agugcuuuggguccgggcggccg

SEQ ID NO: 1170761 - RNA, 19 nt, Mycobacterium bovis subsp bovis AF2122/97
agugcggguggugagcuga

SEQ ID NO: 1170762 - RNA, 22 nt, Mycobacterium bovis subsp bovis AF2122/97
agugcggugagauggcggugag

SEQ ID NO: 1170763 - RNA, 22 nt, Mycobacterium bovis subsp bovis AF2122/97
agugcugccuugggaccgcgcc

SEQ ID NO: 1170764 - RNA, 15 nt, Mycobacterium bovis subsp bovis AF2122/97
agugcggcugcaacg

SEQ ID NO: 1170765 - RNA, 22 nt, Mycobacterium bovis subsp bovis AF2122/97
agugccgccaccgccaccgcgg

SEQ ID NO: 1170766 - RNA, 16 nt, Mycobacterium bovis subsp bovis AF2122/97
agugccgccgucgcca

SEQ ID NO: 1170767 - RNA, 18 nt, Mycobacterium bovis subsp bovis AF2122/97
agugcgcggaucaacagg

SEQ ID NO: 1170768 - RNA, 18 nt, Mycobacterium bovis subsp bovis AF2122/97
agugcccgcacugccgcc

SEQ ID NO: 1170769 - RNA, 20 nt, Mycobacterium bovis subsp bovis AF2122/97
agugcccgcacugccgccgg

SEQ ID NO: 1170770 - RNA, 17 nt, Mycobacterium bovis subsp bovis AF2122/97
agugccaguccgauggu

SEQ ID NO: 1170771 - RNA, 24 nt, Mycobacterium bovis subsp bovis AF2122/97
agugccagcguccgucucgcaggc

SEQ ID NO: 1170772 - RNA, 13 nt, Mycobacterium bovis subsp bovis AF2122/97
agugccagguggg

SEQ ID NO: 1170773 - RNA, 17 nt, Mycobacterium bovis subsp bovis AF2122/97
agugccacgaggacccg

SEQ ID NO: 1170774 - RNA, 17 nt, Mycobacterium bovis subsp bovis AF2122/97
agugcacgaaguccugg

SEQ ID NO: 1170775 - RNA, 17 nt, Mycobacterium bovis subsp bovis AF2122/97
agugcacccgggccgcc

SEQ ID NO: 1170776 - RNA, 17 nt, Mycobacterium bovis subsp bovis AF2122/97
agugcaaaauugcuugg

SEQ ID NO: 1170777 - RNA, 19 nt, Mycobacterium bovis subsp bovis AF2122/97
agugaggccgaccagcaca

SEQ ID NO: 1170778 - RNA, 20 nt, Mycobacterium bovis subsp bovis AF2122/97
agugaggcgcuggcccgcca

SEQ ID NO: 1170779 - RNA, 22 nt, Mycobacterium bovis subsp bovis AF2122/97
agugaaguuguuggccagaccg

SEQ ID NO: 1170780 - RNA, 20 nt, Mycobacterium bovis subsp bovis AF2122/97
agugaauaccccagaccgcc

SEQ ID NO: 1170781 - RNA, 14 nt, Mycobacterium bovis subsp bovis AF2122/97
agugaugcgccccg

SEQ ID NO: 1170782 - RNA, 15 nt, Mycobacterium bovis subsp bovis AF2122/97
agugaugcgccccgg

SEQ ID NO: 1170783 - RNA, 14 nt, Mycobacterium bovis subsp bovis AF2122/97
agugaucaccaacc

SEQ ID NO: 1170784 - RNA, 14 nt, Mycobacterium bovis subsp bovis AF2122/97
agucgucgagcuga

SEQ ID NO: 1170785 - RNA, 17 nt, Mycobacterium bovis subsp bovis AF2122/97
agucgucgcuugcuggg

SEQ ID NO: 1170786 - RNA, 24 nt, Mycobacterium bovis subsp bovis AF2122/97
agucgugaucgcguuuguggcugg

SEQ ID NO: 1170787 - RNA, 16 nt, Mycobacterium bovis subsp bovis AF2122/97
agucggucuggaucag

SEQ ID NO: 1170788 - RNA, 19 nt, Mycobacterium bovis subsp bovis AF2122/97
agucguaguaggcgccgcg

SEQ ID NO: 1170789 - RNA, 22 nt, Mycobacterium bovis subsp bovis AF2122/97
agucgucuucgucauggccggc

SEQ ID NO: 1170790 - RNA, 18 nt, Mycobacterium bovis subsp bovis AF2122/97
agucucaagguuucgaca

SEQ ID NO: 1170791 - RNA, 15 nt, Mycobacterium bovis subsp bovis AF2122/97
agucucgacaaagcg

SEQ ID NO: 1170792 - RNA, 22 nt, Mycobacterium bovis subsp bovis AF2122/97
agucucgacaaagcggcugccc

SEQ ID NO: 1170793 - RNA, 19 nt, Mycobacterium bovis subsp bovis AF2122/97
agugaaauccgagccgcga

SEQ ID NO: 1170794 - RNA, 12 nt, Mycobacterium bovis subsp bovis AF2122/97
aguggccgccgg

SEQ ID NO: 1170795 - RNA, 20 nt, Mycobacterium bovis subsp bovis AF2122/97
aguggcgcagcaccguucgc

SEQ ID NO: 1170796 - RNA, 16 nt, Mycobacterium bovis subsp bovis AF2122/97
aguggcgccagggccu

SEQ ID NO: 1170797 - RNA, 19 nt, Mycobacterium bovis subsp bovis AF2122/97
aguggcgcccauggccacc

SEQ ID NO: 1170798 - RNA, 20 nt, Mycobacterium bovis subsp bovis AF2122/97
aguggcgcgcggcgccgcaa

SEQ ID NO: 1170799 - RNA, 19 nt, Mycobacterium bovis subsp bovis AF2122/97
aguucagccaggccgcaau

SEQ ID NO: 1170800 - RNA, 17 nt, Mycobacterium bovis subsp bovis AF2122/97
aguucacccaucaucgc

SEQ ID NO: 1170801 - RNA, 15 nt, Mycobacterium bovis subsp bovis AF2122/97
aguuccgggguggac

SEQ ID NO: 1170802 - RNA, 23 nt, Mycobacterium bovis subsp bovis AF2122/97
aguucccugaugggcgaauugca

SEQ ID NO: 1170803 - RNA, 15 nt, Mycobacterium bovis subsp bovis AF2122/97
aguucgccagcaacg

SEQ ID NO: 1170804 - RNA, 22 nt, Mycobacterium bovis subsp bovis AF2122/97
aguuccggucgacuccagcacc

SEQ ID NO: 1170805 - RNA, 20 nt, Mycobacterium bovis subsp bovis AF2122/97
aguucccgaaacccgaugug

SEQ ID NO: 1170806 - RNA, 21 nt, Mycobacterium bovis subsp bovis AF2122/97
aguucuccagcucgaacaggu

SEQ ID NO: 1170807 - RNA, 16 nt, Mycobacterium bovis subsp bovis AF2122/97
aguucuaccaccuugc

SEQ ID NO: 1170808 - RNA, 13 nt, Mycobacterium bovis subsp bovis AF2122/97
aguucggccacca

SEQ ID NO: 1170809 - RNA, 15 nt, Mycobacterium bovis subsp bovis AF2122/97
aguucgcgccacgca

SEQ ID NO: 1170810 - RNA, 13 nt, Mycobacterium bovis subsp bovis AF2122/97
aguucgcggcugc

SEQ ID NO: 1170811 - RNA, 21 nt, Mycobacterium bovis subsp bovis AF2122/97
aguuggucacgaagaccaggc

SEQ ID NO: 1170812 - RNA, 15 nt, Mycobacterium bovis subsp bovis AF2122/97
aguugggugggugca

SEQ ID NO: 1170813 - RNA, 16 nt, Mycobacterium bovis subsp bovis AF2122/97
aguugugcggccaggc

SEQ ID NO: 1170814 - RNA, 16 nt, Mycobacterium bovis subsp bovis AF2122/97
aguugccggucaggca

SEQ ID NO: 1170815 - RNA, 15 nt, Mycobacterium bovis subsp bovis AF2122/97
aguuggcgaccugcg

SEQ ID NO: 1170816 - RNA, 22 nt, Mycobacterium bovis subsp bovis AF2122/97
aguugcgcggcaguggccagac

SEQ ID NO: 1170817 - RNA, 13 nt, Mycobacterium bovis subsp bovis AF2122/97
aguugcggcuggc

SEQ ID NO: 1170818 - RNA, 15 nt, Mycobacterium bovis subsp bovis AF2122/97
aguugggcguucagg

SEQ ID NO: 1170819 - RNA, 19 nt, Mycobacterium bovis subsp bovis AF2122/97
aguugaccgccgugggugu

SEQ ID NO: 1170820 - RNA, 15 nt, Mycobacterium bovis subsp bovis AF2122/97
aguugagcagcuugg

SEQ ID NO: 1170821 - RNA, 11 nt, Mycobacterium bovis subsp bovis AF2122/97
aguugaggccg

SEQ ID NO: 1170822 - RNA, 19 nt, Mycobacterium bovis subsp bovis AF2122/97
aguuucaccuugcgcacca

SEQ ID NO: 1170823 - RNA, 16 nt, Mycobacterium bovis subsp bovis AF2122/97
aguuuccagaugcacg

SEQ ID NO: 1170824 - RNA, 10 nt, Mycobacterium bovis subsp bovis AF2122/97
auaaaugccg

SEQ ID NO: 1170825 - RNA, 17 nt, Mycobacterium bovis subsp bovis AF2122/97
agcccgauucagcgccc

SEQ ID NO: 1170826 - RNA, 19 nt, Mycobacterium bovis subsp bovis AF2122/97
agcccgaucggcgggcugg

SEQ ID NO: 1170827 - RNA, 14 nt, Mycobacterium bovis subsp bovis AF2122/97
agcccgaugauccc

SEQ ID NO: 1170828 - RNA, 13 nt, Mycobacterium bovis subsp bovis AF2122/97
agcccgaguugaa

SEQ ID NO: 1170829 - RNA, 14 nt, Mycobacterium bovis subsp bovis AF2122/97
agcccgcugcgccg

SEQ ID NO: 1170830 - RNA, 14 nt, Mycobacterium bovis subsp bovis AF2122/97
agcccgccgcgacc

SEQ ID NO: 1170831 - RNA, 19 nt, Mycobacterium bovis subsp bovis AF2122/97
agcccgccggacccgcccu

SEQ ID NO: 1170832 - RNA, 16 nt, Mycobacterium bovis subsp bovis AF2122/97
agcccgcgaucaccau

SEQ ID NO: 1170833 - RNA, 17 nt, Mycobacterium bovis subsp bovis AF2122/97
agccccgcggccagcag

SEQ ID NO: 1170834 - RNA, 12 nt, Mycobacterium bovis subsp bovis AF2122/97
agccccucaccu

SEQ ID NO: 1170835 - RNA, 19 nt, Mycobacterium bovis subsp bovis AF2122/97
agccccugaaggccagcca

SEQ ID NO: 1170836 - RNA, 19 nt, Mycobacterium bovis subsp bovis AF2122/97
agcccgagcucgccgcagc

SEQ ID NO: 1170837 - RNA, 22 nt, Mycobacterium bovis subsp bovis AF2122/97
agcccgacaccguccagcagcu

SEQ ID NO: 1170838 - RNA, 22 nt, Mycobacterium bovis subsp bovis AF2122/97
agccccuuuugccgcagcaucc

SEQ ID NO: 1170839 - RNA, 17 nt, Mycobacterium bovis subsp bovis AF2122/97
agcccggcgcgccgagu

SEQ ID NO: 1170840 - RNA, 16 nt, Mycobacterium bovis subsp bovis AF2122/97
agcccggccgccgagg

SEQ ID NO: 1170841 - RNA, 14 nt, Mycobacterium bovis subsp bovis AF2122/97
agcccggccgcgcc

SEQ ID NO: 1170842 - RNA, 15 nt, Mycobacterium bovis subsp bovis AF2122/97
agcccggcagaugug

SEQ ID NO: 1170843 - RNA, 17 nt, Mycobacterium bovis subsp bovis AF2122/97
agcccgggccugaacca

SEQ ID NO: 1170844 - RNA, 12 nt, Mycobacterium bovis subsp bovis AF2122/97
agcccggggaga

SEQ ID NO: 1170845 - RNA, 18 nt, Mycobacterium bovis subsp bovis AF2122/97
agcccgguacgccgcgcc

SEQ ID NO: 1170846 - RNA, 16 nt, Mycobacterium bovis subsp bovis AF2122/97
agcccggcggcagcug

SEQ ID NO: 1170847 - RNA, 21 nt, Mycobacterium bovis subsp bovis AF2122/97
agcccggcggcaugggucgug

SEQ ID NO: 1170848 - RNA, 19 nt, Mycobacterium bovis subsp bovis AF2122/97
agcccggugcuaccggcuu

SEQ ID NO: 1170849 - RNA, 13 nt, Mycobacterium bovis subsp bovis AF2122/97
agcccggugcuac

SEQ ID NO: 1170850 - RNA, 15 nt, Mycobacterium bovis subsp bovis AF2122/97
agcccggugugcugc

SEQ ID NO: 1170851 - RNA, 14 nt, Mycobacterium bovis subsp bovis AF2122/97
agcccguugcagga

SEQ ID NO: 1170852 - RNA, 18 nt, Mycobacterium bovis subsp bovis AF2122/97
agcccgucggugguguuc

SEQ ID NO: 1170853 - RNA, 17 nt, Mycobacterium bovis subsp bovis AF2122/97
agcccgucgucgugcac

SEQ ID NO: 1170854 - RNA, 16 nt, Mycobacterium bovis subsp bovis AF2122/97
agcccguccggccccc

SEQ ID NO: 1170855 - RNA, 14 nt, Mycobacterium bovis subsp bovis AF2122/97
agcccgucgcggcc

SEQ ID NO: 1170856 - RNA, 18 nt, Mycobacterium bovis subsp bovis AF2122/97
agcccucgacguccaucc

SEQ ID NO: 1170857 - RNA, 19 nt, Mycobacterium bovis subsp bovis AF2122/97
agcccaugccgaugcccau

SEQ ID NO: 1170858 - RNA, 14 nt, Mycobacterium bovis subsp bovis AF2122/97
agcccaucccgauc

SEQ ID NO: 1170859 - RNA, 17 nt, Mycobacterium bovis subsp bovis AF2122/97
agcccaguaagccacgg

SEQ ID NO: 1170860 - RNA, 15 nt, Mycobacterium bovis subsp bovis AF2122/97
agcccaggugggccg

SEQ ID NO: 1170861 - RNA, 14 nt, Mycobacterium bovis subsp bovis AF2122/97
agccccaaaucgua

SEQ ID NO: 1170862 - RNA, 17 nt, Mycobacterium bovis subsp bovis AF2122/97
agccccagcguucccgc

SEQ ID NO: 1170863 - RNA, 15 nt, Mycobacterium bovis subsp bovis AF2122/97
agccccgaccagcag

SEQ ID NO: 1170864 - RNA, 20 nt, Mycobacterium bovis subsp bovis AF2122/97
agcccccgacacgccgugcg

SEQ ID NO: 1170865 - RNA, 13 nt, Mycobacterium bovis subsp bovis AF2122/97
agcccccgcacgc

SEQ ID NO: 1170866 - RNA, 22 nt, Mycobacterium bovis subsp bovis AF2122/97
agccccauugccgucgcgguca

SEQ ID NO: 1170867 - RNA, 17 nt, Mycobacterium bovis subsp bovis AF2122/97
agcccagccgggcaccc

SEQ ID NO: 1170868 - RNA, 12 nt, Mycobacterium bovis subsp bovis AF2122/97
agcccagcgccu

SEQ ID NO: 1170869 - RNA, 12 nt, Mycobacterium bovis subsp bovis AF2122/97
agcccacccggg

SEQ ID NO: 1170870 - RNA, 13 nt, Mycobacterium bovis subsp bovis AF2122/97
agcccaccacuag

SEQ ID NO: 1170871 - RNA, 15 nt, Mycobacterium bovis subsp bovis AF2122/97
agcccacccauggcc

SEQ ID NO: 1170872 - RNA, 18 nt, Mycobacterium bovis subsp bovis AF2122/97
agcccacccauggccucc

SEQ ID NO: 1170873 - RNA, 17 nt, Mycobacterium bovis subsp bovis AF2122/97
agcccaccggcgccgcc

SEQ ID NO: 1170874 - RNA, 14 nt, Mycobacterium bovis subsp bovis AF2122/97
agcccagaucuugc

SEQ ID NO: 1170875 - RNA, 21 nt, Mycobacterium bovis subsp bovis AF2122/97
agcccacacgcucacgggcuc

SEQ ID NO: 1170876 - RNA, 13 nt, Mycobacterium bovis subsp bovis AF2122/97
agcccaaauccca

SEQ ID NO: 1170877 - RNA, 22 nt, Mycobacterium bovis subsp bovis AF2122/97
agccgcgcgggucacgaccugc

SEQ ID NO: 1170878 - RNA, 20 nt, Mycobacterium bovis subsp bovis AF2122/97
agccgcgccuugauggucuc

SEQ ID NO: 1170879 - RNA, 23 nt, Mycobacterium bovis subsp bovis AF2122/97
agccgcgccgaccucaucggcac

SEQ ID NO: 1170880 - RNA, 16 nt, Mycobacterium bovis subsp bovis AF2122/97
agccgcgcaucugucg

SEQ ID NO: 1170881 - RNA, 16 nt, Mycobacterium bovis subsp bovis AF2122/97
agccgccgucgccggu

SEQ ID NO: 1170882 - RNA, 19 nt, Mycobacterium bovis subsp bovis AF2122/97
agccgccggccccgccagc

SEQ ID NO: 1170883 - RNA, 22 nt, Mycobacterium bovis subsp bovis AF2122/97
agccgccggccggcauccgguu

SEQ ID NO: 1170884 - RNA, 17 nt, Mycobacterium bovis subsp bovis AF2122/97
agccgccggugccgccg

SEQ ID NO: 1170885 - RNA, 17 nt, Mycobacterium bovis subsp bovis AF2122/97
agccgccgggugcgccg

SEQ ID NO: 1170886 - RNA, 16 nt, Mycobacterium bovis subsp bovis AF2122/97
agccgccggccccgcc

SEQ ID NO: 1170887 - RNA, 15 nt, Mycobacterium bovis subsp bovis AF2122/97
agccgcgaccgcagc

SEQ ID NO: 1170888 - RNA, 20 nt, Mycobacterium bovis subsp bovis AF2122/97
agccgcgagcacgucggggu

SEQ ID NO: 1170889 - RNA, 16 nt, Mycobacterium bovis subsp bovis AF2122/97
agccgccggcaguggg

SEQ ID NO: 1170890 - RNA, 18 nt, Mycobacterium bovis subsp bovis AF2122/97
agccgccgcgccccgcgg

SEQ ID NO: 1170891 - RNA, 16 nt, Mycobacterium bovis subsp bovis AF2122/97
agccgcccucccuggg

SEQ ID NO: 1170892 - RNA, 13 nt, Mycobacterium bovis subsp bovis AF2122/97
agccgcugccaca

SEQ ID NO: 1170893 - RNA, 21 nt, Mycobacterium bovis subsp bovis AF2122/97
agccgcugccacaggugaccu

SEQ ID NO: 1170894 - RNA, 18 nt, Mycobacterium bovis subsp bovis AF2122/97
agccgcugcgccagguca

SEQ ID NO: 1170895 - RNA, 17 nt, Mycobacterium bovis subsp bovis AF2122/97
agccgcugcacguggcc

SEQ ID NO: 1170896 - RNA, 23 nt, Mycobacterium bovis subsp bovis AF2122/97
agccgcugcacguggccacggca

SEQ ID NO: 1170897 - RNA, 19 nt, Mycobacterium bovis subsp bovis AF2122/97
agccgcucgacggcccgcc

SEQ ID NO: 1170898 - RNA, 21 nt, Mycobacterium bovis subsp bovis AF2122/97
agccgcgugggccgcugcaua

SEQ ID NO: 1170899 - RNA, 23 nt, Mycobacterium bovis subsp bovis AF2122/97
agccgcggucggcgugcaggguc

SEQ ID NO: 1170900 - RNA, 19 nt, Mycobacterium bovis subsp bovis AF2122/97
agccgcgguagacggcacu

SEQ ID NO: 1170901 - RNA, 19 nt, Mycobacterium bovis subsp bovis AF2122/97
agccgcggcaccgccgagc

SEQ ID NO: 1170902 - RNA, 22 nt, Mycobacterium bovis subsp bovis AF2122/97
agccgcggccacaaugcggccg

SEQ ID NO: 1170903 - RNA, 12 nt, Mycobacterium bovis subsp bovis AF2122/97
agccgcggcccu

SEQ ID NO: 1170904 - RNA, 13 nt, Mycobacterium bovis subsp bovis AF2122/97
agccgcggccaca

SEQ ID NO: 1170905 - RNA, 15 nt, Mycobacterium bovis subsp bovis AF2122/97
agccgcggccacaau

SEQ ID NO: 1170906 - RNA, 17 nt, Mycobacterium bovis subsp bovis AF2122/97
agccgcgcgccggccau

SEQ ID NO: 1170907 - RNA, 17 nt, Mycobacterium bovis subsp bovis AF2122/97
agccggacguucuggau

SEQ ID NO: 1170908 - RNA, 18 nt, Mycobacterium bovis subsp bovis AF2122/97
agccgcuuucccggcugg

SEQ ID NO: 1170909 - RNA, 16 nt, Mycobacterium bovis subsp bovis AF2122/97
agccgacgaccagcag

SEQ ID NO: 1170910 - RNA, 14 nt, Mycobacterium bovis subsp bovis AF2122/97
agccgaccggcagc

SEQ ID NO: 1170911 - RNA, 16 nt, Mycobacterium bovis subsp bovis AF2122/97
agccgaccucacggca

SEQ ID NO: 1170912 - RNA, 17 nt, Mycobacterium bovis subsp bovis AF2122/97
agccgacgaccagcaga

SEQ ID NO: 1170913 - RNA, 18 nt, Mycobacterium bovis subsp bovis AF2122/97
agccgacgugcggcggcc

SEQ ID NO: 1170914 - RNA, 19 nt, Mycobacterium bovis subsp bovis AF2122/97
agccgacgugcggcggccu

SEQ ID NO: 1170915 - RNA, 15 nt, Mycobacterium bovis subsp bovis AF2122/97
agccgagcacgggca

SEQ ID NO: 1170916 - RNA, 14 nt, Mycobacterium bovis subsp bovis AF2122/97
agccgagacaccac

SEQ ID NO: 1170917 - RNA, 17 nt, Mycobacterium bovis subsp bovis AF2122/97
agccgagcggcggcacu

SEQ ID NO: 1170918 - RNA, 15 nt, Mycobacterium bovis subsp bovis AF2122/97
agccgagcguggcgu

SEQ ID NO: 1170919 - RNA, 13 nt, Mycobacterium bovis subsp bovis AF2122/97
agccgaccaccgc

SEQ ID NO: 1170920 - RNA, 14 nt, Mycobacterium bovis subsp bovis AF2122/97
agccgaccgaccgc

SEQ ID NO: 1170921 - RNA, 15 nt, Mycobacterium bovis subsp bovis AF2122/97
agccgaccgauggcu

SEQ ID NO: 1170922 - RNA, 16 nt, Mycobacterium bovis subsp bovis AF2122/97
agccgaccgauggcuc

SEQ ID NO: 1170923 - RNA, 15 nt, Mycobacterium bovis subsp bovis AF2122/97
agccgaagaaccggu

SEQ ID NO: 1170924 - RNA, 16 nt, Mycobacterium bovis subsp bovis AF2122/97
agcccuucgcgggaga

SEQ ID NO: 1170925 - RNA, 21 nt, Mycobacterium bovis subsp bovis AF2122/97
agccgcauaggccccgccagc

SEQ ID NO: 1170926 - RNA, 21 nt, Mycobacterium bovis subsp bovis AF2122/97
agccgcagcuuggccucagcc

SEQ ID NO: 1170927 - RNA, 18 nt, Mycobacterium bovis subsp bovis AF2122/97
agccgcagaugcaccugc

SEQ ID NO: 1170928 - RNA, 12 nt, Mycobacterium bovis subsp bovis AF2122/97
agccgcagcacc

SEQ ID NO: 1170929 - RNA, 13 nt, Mycobacterium bovis subsp bovis AF2122/97
agccgcagcaccu

SEQ ID NO: 1170930 - RNA, 14 nt, Mycobacterium bovis subsp bovis AF2122/97
agccgcagcaccuc

SEQ ID NO: 1170931 - RNA, 22 nt, Mycobacterium bovis subsp bovis AF2122/97
agccgcagcccgugacugguga

SEQ ID NO: 1170932 - RNA, 15 nt, Mycobacterium bovis subsp bovis AF2122/97
agccgcagccgcagg

SEQ ID NO: 1170933 - RNA, 13 nt, Mycobacterium bovis subsp bovis AF2122/97
agccgcacgaugc

SEQ ID NO: 1170934 - RNA, 12 nt, Mycobacterium bovis subsp bovis AF2122/97
agccgcaccccg

SEQ ID NO: 1170935 - RNA, 13 nt, Mycobacterium bovis subsp bovis AF2122/97
agccgcagaugca

SEQ ID NO: 1170936 - RNA, 17 nt, Mycobacterium bovis subsp bovis AF2122/97
agccgcagaugcaccug

SEQ ID NO: 1170937 - RNA, 14 nt, Mycobacterium bovis subsp bovis AF2122/97
agccgcacagcaug

SEQ ID NO: 1170938 - RNA, 18 nt, Mycobacterium bovis subsp bovis AF2122/97
agccgcaccaguggcgcc

SEQ ID NO: 1170939 - RNA, 18 nt, Mycobacterium bovis subsp bovis AF2122/97
agccgcaacaccccccgu

SEQ ID NO: 1170940 - RNA, 15 nt, Mycobacterium bovis subsp bovis AF2122/97
agccgcaccccgccc

SEQ ID NO: 1170941 - RNA, 12 nt, Mycobacterium bovis subsp bovis AF2122/97
agccgcaccgcu

SEQ ID NO: 1170942 - RNA, 14 nt, Mycobacterium bovis subsp bovis AF2122/97
agccgagcuugagc

SEQ ID NO: 1170943 - RNA, 22 nt, Mycobacterium bovis subsp bovis AF2122/97
agccgagcucacuucacgccgc

SEQ ID NO: 1170944 - RNA, 23 nt, Mycobacterium bovis subsp bovis AF2122/97
agccgaggacuggaaagcagcag

SEQ ID NO: 1170945 - RNA, 20 nt, Mycobacterium bovis subsp bovis AF2122/97
agccgaucggugccagaaug

SEQ ID NO: 1170946 - RNA, 22 nt, Mycobacterium bovis subsp bovis AF2122/97
agccgaucaguuccuguagccg

SEQ ID NO: 1170947 - RNA, 16 nt, Mycobacterium bovis subsp bovis AF2122/97
agccgauauaccaggg

SEQ ID NO: 1170948 - RNA, 20 nt, Mycobacterium bovis subsp bovis AF2122/97
agccgaugcucgucccagaa

SEQ ID NO: 1170949 - RNA, 15 nt, Mycobacterium bovis subsp bovis AF2122/97
agccgaucgcccgcu

SEQ ID NO: 1170950 - RNA, 20 nt, Mycobacterium bovis subsp bovis AF2122/97
agccgaucaucaccggcaua

SEQ ID NO: 1170951 - RNA, 22 nt, Mycobacterium bovis subsp bovis AF2122/97
agccgaugaucgaacacggcac

SEQ ID NO: 1170952 - RNA, 13 nt, Mycobacterium bovis subsp bovis AF2122/97
agccggcgguggg

SEQ ID NO: 1170953 - RNA, 14 nt, Mycobacterium bovis subsp bovis AF2122/97
agccggcgugcacu

SEQ ID NO: 1170954 - RNA, 15 nt, Mycobacterium bovis subsp bovis AF2122/97
agccggcgugcacuc

SEQ ID NO: 1170955 - RNA, 19 nt, Mycobacterium bovis subsp bovis AF2122/97
agccggcgcgccggaugua

SEQ ID NO: 1170956 - RNA, 14 nt, Mycobacterium bovis subsp bovis AF2122/97
agccggcgcggcgg

SEQ ID NO: 1170957 - RNA, 17 nt, Mycobacterium bovis subsp bovis AF2122/97
agccggccgcuuggccg

SEQ ID NO: 1170958 - RNA, 22 nt, Mycobacterium bovis subsp bovis AF2122/97
agccggccacuacggccuggcc

SEQ ID NO: 1170959 - RNA, 12 nt, Mycobacterium bovis subsp bovis AF2122/97
agccgggcccca

SEQ ID NO: 1170960 - RNA, 15 nt, Mycobacterium bovis subsp bovis AF2122/97
agccgggcggccucg

SEQ ID NO: 1170961 - RNA, 17 nt, Mycobacterium bovis subsp bovis AF2122/97
agccggugacguggugg

SEQ ID NO: 1170962 - RNA, 18 nt, Mycobacterium bovis subsp bovis AF2122/97
agccggugacgugguggg

SEQ ID NO: 1170963 - RNA, 12 nt, Mycobacterium bovis subsp bovis AF2122/97
agccggguggac

SEQ ID NO: 1170964 - RNA, 23 nt, Mycobacterium bovis subsp bovis AF2122/97
agccggguugccugcgcgagugc

SEQ ID NO: 1170965 - RNA, 19 nt, Mycobacterium bovis subsp bovis AF2122/97
agccgguagaucagcgccu

SEQ ID NO: 1170966 - RNA, 21 nt, Mycobacterium bovis subsp bovis AF2122/97
agccgguagaucagcgccugg

SEQ ID NO: 1170967 - RNA, 22 nt, Mycobacterium bovis subsp bovis AF2122/97
agccguugcgggccaggcccuc

SEQ ID NO: 1170968 - RNA, 13 nt, Mycobacterium bovis subsp bovis AF2122/97
agccguuguacau

SEQ ID NO: 1170969 - RNA, 14 nt, Mycobacterium bovis subsp bovis AF2122/97
agccguugccgccg

SEQ ID NO: 1170970 - RNA, 23 nt, Mycobacterium bovis subsp bovis AF2122/97
agccguugccgccacgggcggcc

SEQ ID NO: 1170971 - RNA, 12 nt, Mycobacterium bovis subsp bovis AF2122/97
agccguggcggc

SEQ ID NO: 1170972 - RNA, 22 nt, Mycobacterium bovis subsp bovis AF2122/97
agccguggugguugaucagcca

SEQ ID NO: 1170973 - RNA, 15 nt, Mycobacterium bovis subsp bovis AF2122/97
agccgugccucgagg

SEQ ID NO: 1170974 - RNA, 18 nt, Mycobacterium bovis subsp bovis AF2122/97
agccgugccguggugaaa

SEQ ID NO: 1170975 - RNA, 12 nt, Mycobacterium bovis subsp bovis AF2122/97
agccgugccucg

SEQ ID NO: 1170976 - RNA, 18 nt, Mycobacterium bovis subsp bovis AF2122/97
agccgucucugacgaaug

SEQ ID NO: 1170977 - RNA, 21 nt, Mycobacterium bovis subsp bovis AF2122/97
agccgucaccgcgaccccugg

SEQ ID NO: 1170978 - RNA, 19 nt, Mycobacterium bovis subsp bovis AF2122/97
agccguaguaguggccgcc

SEQ ID NO: 1170979 - RNA, 13 nt, Mycobacterium bovis subsp bovis AF2122/97
agccgucgagcag

SEQ ID NO: 1170980 - RNA, 18 nt, Mycobacterium bovis subsp bovis AF2122/97
agccguccgaccagggau

SEQ ID NO: 1170981 - RNA, 13 nt, Mycobacterium bovis subsp bovis AF2122/97
agccgguguugau

SEQ ID NO: 1170982 - RNA, 20 nt, Mycobacterium bovis subsp bovis AF2122/97
agccguagcugggcaccccg

SEQ ID NO: 1170983 - RNA, 16 nt, Mycobacterium bovis subsp bovis AF2122/97
agccguacgguccgaa

SEQ ID NO: 1170984 - RNA, 19 nt, Mycobacterium bovis subsp bovis AF2122/97
agccugauaaagcccggcg

SEQ ID NO: 1170985 - RNA, 23 nt, Mycobacterium bovis subsp bovis AF2122/97
agccucucuucccaaccgcccgu

SEQ ID NO: 1170986 - RNA, 20 nt, Mycobacterium bovis subsp bovis AF2122/97
agccucggccaucugcucgu

SEQ ID NO: 1170987 - RNA, 22 nt, Mycobacterium bovis subsp bovis AF2122/97
agccucggccaucugcucgugg

SEQ ID NO: 1170988 - RNA, 16 nt, Mycobacterium bovis subsp bovis AF2122/97
agccuccaccaggucg

SEQ ID NO: 1170989 - RNA, 16 nt, Mycobacterium bovis subsp bovis AF2122/97
agccugcggcggcguu

SEQ ID NO: 1170990 - RNA, 19 nt, Mycobacterium bovis subsp bovis AF2122/97
agccugcggcggucauggg

SEQ ID NO: 1170991 - RNA, 21 nt, Mycobacterium bovis subsp bovis AF2122/97
agccugcggcggucaugggcg

SEQ ID NO: 1170992 - RNA, 15 nt, Mycobacterium bovis subsp bovis AF2122/97
agccugcgggccggc

SEQ ID NO: 1170993 - RNA, 12 nt, Mycobacterium bovis subsp bovis AF2122/97
agcgaaaucgga

SEQ ID NO: 1170994 - RNA, 16 nt, Mycobacterium bovis subsp bovis AF2122/97
agccuuguugccgccg

SEQ ID NO: 1170995 - RNA, 23 nt, Mycobacterium bovis subsp bovis AF2122/97
agccuuggacgugcgcgccaagu

SEQ ID NO: 1170996 - RNA, 15 nt, Mycobacterium bovis subsp bovis AF2122/97
agcgaaggugaacga

SEQ ID NO: 1170997 - RNA, 16 nt, Mycobacterium bovis subsp bovis AF2122/97
agcgaagccgggucug

SEQ ID NO: 1170998 - RNA, 17 nt, Mycobacterium bovis subsp bovis AF2122/97
agcgaaccaccggcgcc

SEQ ID NO: 1170999 - RNA, 21 nt, Mycobacterium bovis subsp bovis AF2122/97
agcgaagccagaucgcuagga

SEQ ID NO: 1171000 - RNA, 17 nt, Mycobacterium bovis subsp bovis AF2122/97
agcgaacggccaggaca

SEQ ID NO: 1171001 - RNA, 15 nt, Mycobacterium bovis subsp bovis AF2122/97
agcgaacggccagga

SEQ ID NO: 1171002 - RNA, 17 nt, Mycobacterium bovis subsp bovis AF2122/97
agcgaaccggcugggcg

SEQ ID NO: 1171003 - RNA, 16 nt, Mycobacterium bovis subsp bovis AF2122/97
agcgaauggggcagcu

SEQ ID NO: 1171004 - RNA, 18 nt, Mycobacterium bovis subsp bovis AF2122/97
agcgaaucgcuggugaag

SEQ ID NO: 1171005 - RNA, 14 nt, Mycobacterium bovis subsp bovis AF2122/97
agcgacaacaccac

SEQ ID NO: 1171006 - RNA, 16 nt, Mycobacterium bovis subsp bovis AF2122/97
agcgacagcagcgcca

SEQ ID NO: 1171007 - RNA, 23 nt, Mycobacterium bovis subsp bovis AF2122/97
agcgacuccguaccggguuccau

SEQ ID NO: 1171008 - RNA, 22 nt, Mycobacterium bovis subsp bovis AF2122/97
agcgaccaccgucacgaucagg

SEQ ID NO: 1171009 - RNA, 20 nt, Mycobacterium bovis subsp bovis AF2122/97
agcgaccacgucaagaagaa

SEQ ID NO: 1171010 - RNA, 15 nt, Mycobacterium bovis subsp bovis AF2122/97
agcgaccuggguuuc

SEQ ID NO: 1171011 - RNA, 17 nt, Mycobacterium bovis subsp bovis AF2122/97
agcgacgaagucgcagc

SEQ ID NO: 1171012 - RNA, 15 nt, Mycobacterium bovis subsp bovis AF2122/97
agcgacgcacgcagu

SEQ ID NO: 1171013 - RNA, 19 nt, Mycobacterium bovis subsp bovis AF2122/97
agcgacgcauaaccggcgc

SEQ ID NO: 1171014 - RNA, 16 nt, Mycobacterium bovis subsp bovis AF2122/97
agcgacggccgccagc

SEQ ID NO: 1171015 - RNA, 21 nt, Mycobacterium bovis subsp bovis AF2122/97
agcgacggccgccagcagcuu

SEQ ID NO: 1171016 - RNA, 20 nt, Mycobacterium bovis subsp bovis AF2122/97
agcgagcucagcgaugcggc

SEQ ID NO: 1171017 - RNA, 22 nt, Mycobacterium bovis subsp bovis AF2122/97
agcgagcgcgcguagcggggga

SEQ ID NO: 1171018 - RNA, 19 nt, Mycobacterium bovis subsp bovis AF2122/97
agcgaggaauuccgcuacc

SEQ ID NO: 1171019 - RNA, 16 nt, Mycobacterium bovis subsp bovis AF2122/97
agcgagaaucacgguc

SEQ ID NO: 1171020 - RNA, 21 nt, Mycobacterium bovis subsp bovis AF2122/97
agcugcucgucuuggcggcgg

SEQ ID NO: 1171021 - RNA, 18 nt, Mycobacterium bovis subsp bovis AF2122/97
agcugcguccggaaccaa

SEQ ID NO: 1171022 - RNA, 16 nt, Mycobacterium bovis subsp bovis AF2122/97
agcugcugcugcuuga

SEQ ID NO: 1171023 - RNA, 18 nt, Mycobacterium bovis subsp bovis AF2122/97
agcugcgggucagcgccg

SEQ ID NO: 1171024 - RNA, 17 nt, Mycobacterium bovis subsp bovis AF2122/97
agcugcggauacagccg

SEQ ID NO: 1171025 - RNA, 23 nt, Mycobacterium bovis subsp bovis AF2122/97
agcugcggauuaagucggcggcc

SEQ ID NO: 1171026 - RNA, 14 nt, Mycobacterium bovis subsp bovis AF2122/97
agcugaucuuggca

SEQ ID NO: 1171027 - RNA, 23 nt, Mycobacterium bovis subsp bovis AF2122/97
agcugacgugucggcugcuaugg

SEQ ID NO: 1171028 - RNA, 18 nt, Mycobacterium bovis subsp bovis AF2122/97
agcugagcggccggcaug

SEQ ID NO: 1171029 - RNA, 15 nt, Mycobacterium bovis subsp bovis AF2122/97
agcucggcugcucga

SEQ ID NO: 1171030 - RNA, 22 nt, Mycobacterium bovis subsp bovis AF2122/97
agcucggccugaagcuugucca

SEQ ID NO: 1171031 - RNA, 14 nt, Mycobacterium bovis subsp bovis AF2122/97
agcucggcugcucg

SEQ ID NO: 1171032 - RNA, 15 nt, Mycobacterium bovis subsp bovis AF2122/97
agcucggcggcuacc

SEQ ID NO: 1171033 - RNA, 14 nt, Mycobacterium bovis subsp bovis AF2122/97
agcucggucagcgu

SEQ ID NO: 1171034 - RNA, 23 nt, Mycobacterium bovis subsp bovis AF2122/97
agcucggucagcgucaggugcgc

SEQ ID NO: 1171035 - RNA, 15 nt, Mycobacterium bovis subsp bovis AF2122/97
agcucgugaccgccg

SEQ ID NO: 1171036 - RNA, 16 nt, Mycobacterium bovis subsp bovis AF2122/97
agcucgucgagcgcgu

SEQ ID NO: 1171037 - RNA, 21 nt, Mycobacterium bovis subsp bovis AF2122/97
agcucgucgaggaagaucacc

SEQ ID NO: 1171038 - RNA, 15 nt, Mycobacterium bovis subsp bovis AF2122/97
agcugacgucaccac

SEQ ID NO: 1171039 - RNA, 19 nt, Mycobacterium bovis subsp bovis AF2122/97
agcugacgauggccaggcc

SEQ ID NO: 1171040 - RNA, 13 nt, Mycobacterium bovis subsp bovis AF2122/97
agcugacgcugcu

SEQ ID NO: 1171041 - RNA, 18 nt, Mycobacterium bovis subsp bovis AF2122/97
agcucuugcgggcagccg

SEQ ID NO: 1171042 - RNA, 23 nt, Mycobacterium bovis subsp bovis AF2122/97
agcucuugcgggcagccgcccgc

SEQ ID NO: 1171043 - RNA, 21 nt, Mycobacterium bovis subsp bovis AF2122/97
agcucccgccacgucgccggc

SEQ ID NO: 1171044 - RNA, 21 nt, Mycobacterium bovis subsp bovis AF2122/97
agcucccugggcgucgaccac

SEQ ID NO: 1171045 - RNA, 14 nt, Mycobacterium bovis subsp bovis AF2122/97
agcucccacaggac

SEQ ID NO: 1171046 - RNA, 19 nt, Mycobacterium bovis subsp bovis AF2122/97
agcuccgcgcagccaggga

SEQ ID NO: 1171047 - RNA, 19 nt, Mycobacterium bovis subsp bovis AF2122/97
agcuccgugacaccgggga

SEQ ID NO: 1171048 - RNA, 24 nt, Mycobacterium bovis subsp bovis AF2122/97
agcuccguggugcuagcgccgcca

SEQ ID NO: 1171049 - RNA, 15 nt, Mycobacterium bovis subsp bovis AF2122/97
agcuccaaccaugcg

SEQ ID NO: 1171050 - RNA, 20 nt, Mycobacterium bovis subsp bovis AF2122/97
agcuccagcaaaacccgcuc

SEQ ID NO: 1171051 - RNA, 18 nt, Mycobacterium bovis subsp bovis AF2122/97
agcucgcggugggcuucc

SEQ ID NO: 1171052 - RNA, 16 nt, Mycobacterium bovis subsp bovis AF2122/97
agcucgccgugaccag

SEQ ID NO: 1171053 - RNA, 15 nt, Mycobacterium bovis subsp bovis AF2122/97
agcucggccagcacg

SEQ ID NO: 1171054 - RNA, 19 nt, Mycobacterium bovis subsp bovis AF2122/97
agcucggcgaacggcacca

SEQ ID NO: 1171055 - RNA, 16 nt, Mycobacterium bovis subsp bovis AF2122/97
agcucggcgcccagcu

SEQ ID NO: 1171056 - RNA, 12 nt, Mycobacterium bovis subsp bovis AF2122/97
agcucggccacc

SEQ ID NO: 1171057 - RNA, 15 nt, Mycobacterium bovis subsp bovis AF2122/97
agcuccugcaugccg

SEQ ID NO: 1171058 - RNA, 17 nt, Mycobacterium bovis subsp bovis AF2122/97
agcuccucagccaccgc

SEQ ID NO: 1171059 - RNA, 22 nt, Mycobacterium bovis subsp bovis AF2122/97
agcucgaacagguuggccccgg

SEQ ID NO: 1171060 - RNA, 19 nt, Mycobacterium bovis subsp bovis AF2122/97
agcucgauacccaggaugu

SEQ ID NO: 1171061 - RNA, 15 nt, Mycobacterium bovis subsp bovis AF2122/97
agcucgaggaccacc

SEQ ID NO: 1171062 - RNA, 19 nt, Mycobacterium bovis subsp bovis AF2122/97
agcucgaggaccaccuggu

SEQ ID NO: 1171063 - RNA, 17 nt, Mycobacterium bovis subsp bovis AF2122/97
agcucgacaacugcccg

SEQ ID NO: 1171064 - RNA, 23 nt, Mycobacterium bovis subsp bovis AF2122/97
agcggcaaggucaacgggaggug

SEQ ID NO: 1171065 - RNA, 14 nt, Mycobacterium bovis subsp bovis AF2122/97
agcggcaccaaugc

SEQ ID NO: 1171066 - RNA, 21 nt, Mycobacterium bovis subsp bovis AF2122/97
agcggcaauggccagcaccac

SEQ ID NO: 1171067 - RNA, 16 nt, Mycobacterium bovis subsp bovis AF2122/97
agcgggucgccgggcc

SEQ ID NO: 1171068 - RNA, 20 nt, Mycobacterium bovis subsp bovis AF2122/97
agcggguccccggucaggac

SEQ ID NO: 1171069 - RNA, 20 nt, Mycobacterium bovis subsp bovis AF2122/97
agcggguccuucugccggga

SEQ ID NO: 1171070 - RNA, 22 nt, Mycobacterium bovis subsp bovis AF2122/97
agcgggucgaccccggccagga

SEQ ID NO: 1171071 - RNA, 14 nt, Mycobacterium bovis subsp bovis AF2122/97
agcggggucuugac

SEQ ID NO: 1171072 - RNA, 20 nt, Mycobacterium bovis subsp bovis AF2122/97
agcggguuguggcacccggc

SEQ ID NO: 1171073 - RNA, 20 nt, Mycobacterium bovis subsp bovis AF2122/97
agcgguaagcgcaucgagca

SEQ ID NO: 1171074 - RNA, 16 nt, Mycobacterium bovis subsp bovis AF2122/97
agcgguugccuucuug

SEQ ID NO: 1171075 - RNA, 13 nt, Mycobacterium bovis subsp bovis AF2122/97
agcguccuggcgu

SEQ ID NO: 1171076 - RNA, 15 nt, Mycobacterium bovis subsp bovis AF2122/97
agcgucgacgucagc

SEQ ID NO: 1171077 - RNA, 21 nt, Mycobacterium bovis subsp bovis AF2122/97
agcguccgcggaugcauguca

SEQ ID NO: 1171078 - RNA, 21 nt, Mycobacterium bovis subsp bovis AF2122/97
agcguccgcugcagguccagg

SEQ ID NO: 1171079 - RNA, 21 nt, Mycobacterium bovis subsp bovis AF2122/97
agcguccagcgccugcgccca

SEQ ID NO: 1171080 - RNA, 14 nt, Mycobacterium bovis subsp bovis AF2122/97
agcgugcacgggga

SEQ ID NO: 1171081 - RNA, 14 nt, Mycobacterium bovis subsp bovis AF2122/97
agcgugagugcagc

SEQ ID NO: 1171082 - RNA, 23 nt, Mycobacterium bovis subsp bovis AF2122/97
agcgugagccaugccgcucggca

SEQ ID NO: 1171083 - RNA, 17 nt, Mycobacterium bovis subsp bovis AF2122/97
agcgugagugcagcacg

SEQ ID NO: 1171084 - RNA, 13 nt, Mycobacterium bovis subsp bovis AF2122/97
agcguugggacag

SEQ ID NO: 1171085 - RNA, 20 nt, Mycobacterium bovis subsp bovis AF2122/97
agcuacuaugccaacgacag

SEQ ID NO: 1171086 - RNA, 22 nt, Mycobacterium bovis subsp bovis AF2122/97
agcuagcccggcagcacgugga

SEQ ID NO: 1171087 - RNA, 17 nt, Mycobacterium bovis subsp bovis AF2122/97
agcuagcgcgggcucac

SEQ ID NO: 1171088 - RNA, 20 nt, Mycobacterium bovis subsp bovis AF2122/97
agcgccucgccggccacccg

SEQ ID NO: 1171089 - RNA, 21 nt, Mycobacterium bovis subsp bovis AF2122/97
agcgccucgccggccacccgc

SEQ ID NO: 1171090 - RNA, 16 nt, Mycobacterium bovis subsp bovis AF2122/97
agcgccuccagcacca

SEQ ID NO: 1171091 - RNA, 13 nt, Mycobacterium bovis subsp bovis AF2122/97
agcgccugguccu

SEQ ID NO: 1171092 - RNA, 16 nt, Mycobacterium bovis subsp bovis AF2122/97
agcgccgcgcuugcga

SEQ ID NO: 1171093 - RNA, 13 nt, Mycobacterium bovis subsp bovis AF2122/97
agcgccgcggcga

SEQ ID NO: 1171094 - RNA, 14 nt, Mycobacterium bovis subsp bovis AF2122/97
agcgccggcaccga

SEQ ID NO: 1171095 - RNA, 20 nt, Mycobacterium bovis subsp bovis AF2122/97
agcgccgcguggcuggcggc

SEQ ID NO: 1171096 - RNA, 19 nt, Mycobacterium bovis subsp bovis AF2122/97
agcgccggccgcggcggcc

SEQ ID NO: 1171097 - RNA, 20 nt, Mycobacterium bovis subsp bovis AF2122/97
agcgccggccgcggcggccc

SEQ ID NO: 1171098 - RNA, 15 nt, Mycobacterium bovis subsp bovis AF2122/97
agcgccgucagcaug

SEQ ID NO: 1171099 - RNA, 18 nt, Mycobacterium bovis subsp bovis AF2122/97
agcgccggggugugcggg

SEQ ID NO: 1171100 - RNA, 13 nt, Mycobacterium bovis subsp bovis AF2122/97
agcgccgcacaga

SEQ ID NO: 1171101 - RNA, 14 nt, Mycobacterium bovis subsp bovis AF2122/97
agcgccgagcucgg

SEQ ID NO: 1171102 - RNA, 18 nt, Mycobacterium bovis subsp bovis AF2122/97
agcgccgaaacagcaccc

SEQ ID NO: 1171103 - RNA, 20 nt, Mycobacterium bovis subsp bovis AF2122/97
agcgccgaaacagcacccag

SEQ ID NO: 1171104 - RNA, 13 nt, Mycobacterium bovis subsp bovis AF2122/97
agcgccgccgagg

SEQ ID NO: 1171105 - RNA, 11 nt, Mycobacterium bovis subsp bovis AF2122/97
agcgccgccgg

SEQ ID NO: 1171106 - RNA, 14 nt, Mycobacterium bovis subsp bovis AF2122/97
agcgccgccacccc

SEQ ID NO: 1171107 - RNA, 16 nt, Mycobacterium bovis subsp bovis AF2122/97
agcgcccccagcagcu

SEQ ID NO: 1171108 - RNA, 13 nt, Mycobacterium bovis subsp bovis AF2122/97
agcgcccccgcug

SEQ ID NO: 1171109 - RNA, 17 nt, Mycobacterium bovis subsp bovis AF2122/97
agcgcccgcagguggcu

SEQ ID NO: 1171110 - RNA, 15 nt, Mycobacterium bovis subsp bovis AF2122/97
agcgccccggcgcgu

SEQ ID NO: 1171111 - RNA, 15 nt, Mycobacterium bovis subsp bovis AF2122/97
agcgcccccagcagc

SEQ ID NO: 1171112 - RNA, 17 nt, Mycobacterium bovis subsp bovis AF2122/97
agcgcccgcgagagagu

SEQ ID NO: 1171113 - RNA, 15 nt, Mycobacterium bovis subsp bovis AF2122/97
agcgcccgcgcggcc

SEQ ID NO: 1171114 - RNA, 14 nt, Mycobacterium bovis subsp bovis AF2122/97
agcgcccggccacu

SEQ ID NO: 1171115 - RNA, 20 nt, Mycobacterium bovis subsp bovis AF2122/97
agcgcccggccacuccagua

SEQ ID NO: 1171116 - RNA, 18 nt, Mycobacterium bovis subsp bovis AF2122/97
agcgcguaguccgcaucc

SEQ ID NO: 1171117 - RNA, 20 nt, Mycobacterium bovis subsp bovis AF2122/97
agcgcguagcgggcgcccuu

SEQ ID NO: 1171118 - RNA, 16 nt, Mycobacterium bovis subsp bovis AF2122/97
agcgcgagcccgaacc

SEQ ID NO: 1171119 - RNA, 19 nt, Mycobacterium bovis subsp bovis AF2122/97
agcgcgguuucggcgauga

SEQ ID NO: 1171120 - RNA, 21 nt, Mycobacterium bovis subsp bovis AF2122/97
agcgcguauggcucaccccgg

SEQ ID NO: 1171121 - RNA, 19 nt, Mycobacterium bovis subsp bovis AF2122/97
agcgcgugguaccgcuugu

SEQ ID NO: 1171122 - RNA, 17 nt, Mycobacterium bovis subsp bovis AF2122/97
agcgccuugaccagcag

SEQ ID NO: 1171123 - RNA, 16 nt, Mycobacterium bovis subsp bovis AF2122/97
agcgccuuguggcaca

SEQ ID NO: 1171124 - RNA, 17 nt, Mycobacterium bovis subsp bovis AF2122/97
agcgccuugacgccagu

SEQ ID NO: 1171125 - RNA, 22 nt, Mycobacterium bovis subsp bovis AF2122/97
agcgcgaaccugcucggcgcgc

SEQ ID NO: 1171126 - RNA, 17 nt, Mycobacterium bovis subsp bovis AF2122/97
agcgcgaacgccugcug

SEQ ID NO: 1171127 - RNA, 18 nt, Mycobacterium bovis subsp bovis AF2122/97
agcgcgacguccaccagc

SEQ ID NO: 1171128 - RNA, 13 nt, Mycobacterium bovis subsp bovis AF2122/97
agcgcgacaaagu

SEQ ID NO: 1171129 - RNA, 20 nt, Mycobacterium bovis subsp bovis AF2122/97
agcggauuggccuugugcag

SEQ ID NO: 1171130 - RNA, 11 nt, Mycobacterium bovis subsp bovis AF2122/97
agcggaucugg

SEQ ID NO: 1171131 - RNA, 14 nt, Mycobacterium bovis subsp bovis AF2122/97
agcggaguaaacaa

SEQ ID NO: 1171132 - RNA, 13 nt, Mycobacterium bovis subsp bovis AF2122/97
agcgcuccagcac

SEQ ID NO: 1171133 - RNA, 15 nt, Mycobacterium bovis subsp bovis AF2122/97
agcgcuccagccgcg

SEQ ID NO: 1171134 - RNA, 23 nt, Mycobacterium bovis subsp bovis AF2122/97
agcgcguugagcucaauggcuuc

SEQ ID NO: 1171135 - RNA, 20 nt, Mycobacterium bovis subsp bovis AF2122/97
agcgcucacauaagcgagga

SEQ ID NO: 1171136 - RNA, 20 nt, Mycobacterium bovis subsp bovis AF2122/97
agcgcuugaccccgccgaac

SEQ ID NO: 1171137 - RNA, 21 nt, Mycobacterium bovis subsp bovis AF2122/97
agcgcugucguaccgcggauc

SEQ ID NO: 1171138 - RNA, 14 nt, Mycobacterium bovis subsp bovis AF2122/97
agcgcucgaucagg

SEQ ID NO: 1171139 - RNA, 15 nt, Mycobacterium bovis subsp bovis AF2122/97
agcgccacgccgagg

SEQ ID NO: 1171140 - RNA, 17 nt, Mycobacterium bovis subsp bovis AF2122/97
agcgccaccguuugcgc

SEQ ID NO: 1171141 - RNA, 16 nt, Mycobacterium bovis subsp bovis AF2122/97
agcgccagcgggauga

SEQ ID NO: 1171142 - RNA, 15 nt, Mycobacterium bovis subsp bovis AF2122/97
agcgccagcgccagu

SEQ ID NO: 1171143 - RNA, 22 nt, Mycobacterium bovis subsp bovis AF2122/97
agcgccaggggugugccguggu

SEQ ID NO: 1171144 - RNA, 17 nt, Mycobacterium bovis subsp bovis AF2122/97
agcgccagugccucgcg

SEQ ID NO: 1171145 - RNA, 24 nt, Mycobacterium bovis subsp bovis AF2122/97
agcgccagugccucgcggggucug

SEQ ID NO: 1171146 - RNA, 15 nt, Mycobacterium bovis subsp bovis AF2122/97
agcgccaucgagguc

SEQ ID NO: 1171147 - RNA, 14 nt, Mycobacterium bovis subsp bovis AF2122/97
agcgcaucgagcac

SEQ ID NO: 1171148 - RNA, 21 nt, Mycobacterium bovis subsp bovis AF2122/97
agcgcagcguguugagggcug

SEQ ID NO: 1171149 - RNA, 16 nt, Mycobacterium bovis subsp bovis AF2122/97
agcgcagccugcagcg

SEQ ID NO: 1171150 - RNA, 21 nt, Mycobacterium bovis subsp bovis AF2122/97
agcgcauuuguugcugcugcc

SEQ ID NO: 1171151 - RNA, 16 nt, Mycobacterium bovis subsp bovis AF2122/97
agcgccaaacccggcg

SEQ ID NO: 1171152 - RNA, 17 nt, Mycobacterium bovis subsp bovis AF2122/97
agcgcaucggccagcag

SEQ ID NO: 1171153 - RNA, 22 nt, Mycobacterium bovis subsp bovis AF2122/97
agcgcaucgccgcuggccagca

SEQ ID NO: 1171154 - RNA, 16 nt, Mycobacterium bovis subsp bovis AF2122/97
agcgcaucgagcccgg

SEQ ID NO: 1171155 - RNA, 17 nt, Mycobacterium bovis subsp bovis AF2122/97
agcgcaucgagcccgga

SEQ ID NO: 1171156 - RNA, 12 nt, Mycobacterium bovis subsp bovis AF2122/97
agcgcaacaucg

SEQ ID NO: 1171157 - RNA, 14 nt, Mycobacterium bovis subsp bovis AF2122/97
agcgcaagguugcc

SEQ ID NO: 1171158 - RNA, 19 nt, Mycobacterium bovis subsp bovis AF2122/97
agcgcacgauuucgagcgc

SEQ ID NO: 1171159 - RNA, 14 nt, Mycobacterium bovis subsp bovis AF2122/97
agcgcacgcagccg

SEQ ID NO: 1171160 - RNA, 21 nt, Mycobacterium bovis subsp bovis AF2122/97
agcgcacgcugaguccccagg

SEQ ID NO: 1171161 - RNA, 15 nt, Mycobacterium bovis subsp bovis AF2122/97
agcgcacugcccggg

SEQ ID NO: 1171162 - RNA, 21 nt, Mycobacterium bovis subsp bovis AF2122/97
agcgcacccggucggcggcau

SEQ ID NO: 1171163 - RNA, 20 nt, Mycobacterium bovis subsp bovis AF2122/97
agcgcaccgcugaccgcaac

SEQ ID NO: 1171164 - RNA, 14 nt, Mycobacterium bovis subsp bovis AF2122/97
agcgaguugcaguc

SEQ ID NO: 1171165 - RNA, 20 nt, Mycobacterium bovis subsp bovis AF2122/97
agcgagucgacgucgaucac

SEQ ID NO: 1171166 - RNA, 22 nt, Mycobacterium bovis subsp bovis AF2122/97
agcgagucgacgaacgccucac

SEQ ID NO: 1171167 - RNA, 16 nt, Mycobacterium bovis subsp bovis AF2122/97
agcgagucgaacccgc

SEQ ID NO: 1171168 - RNA, 22 nt, Mycobacterium bovis subsp bovis AF2122/97
agcgauaucggcggcuuggccg

SEQ ID NO: 1171169 - RNA, 21 nt, Mycobacterium bovis subsp bovis AF2122/97
agcgaucuugguggccucauc

SEQ ID NO: 1171170 - RNA, 21 nt, Mycobacterium bovis subsp bovis AF2122/97
agcgaugcaccccaugaccgg

SEQ ID NO: 1171171 - RNA, 18 nt, Mycobacterium bovis subsp bovis AF2122/97
agcgaugggaacggggug

SEQ ID NO: 1171172 - RNA, 18 nt, Mycobacterium bovis subsp bovis AF2122/97
agcgaugcggugucgggc

SEQ ID NO: 1171173 - RNA, 18 nt, Mycobacterium bovis subsp bovis AF2122/97
agcauggugcggcggcgu

SEQ ID NO: 1171174 - RNA, 17 nt, Mycobacterium bovis subsp bovis AF2122/97
agcaugguggacgaggc

SEQ ID NO: 1171175 - RNA, 21 nt, Mycobacterium bovis subsp bovis AF2122/97
agcauggcuuuugcgccgaau

SEQ ID NO: 1171176 - RNA, 18 nt, Mycobacterium bovis subsp bovis AF2122/97
agcaugauccgcugggcc

SEQ ID NO: 1171177 - RNA, 14 nt, Mycobacterium bovis subsp bovis AF2122/97
agcaugaagucccg

SEQ ID NO: 1171178 - RNA, 22 nt, Mycobacterium bovis subsp bovis AF2122/97
agcauguuccccgucgccaggg

SEQ ID NO: 1171179 - RNA, 12 nt, Mycobacterium bovis subsp bovis AF2122/97
agcauugaagaa

SEQ ID NO: 1171180 - RNA, 16 nt, Mycobacterium bovis subsp bovis AF2122/97
agcauugaagaagccc

SEQ ID NO: 1171181 - RNA, 20 nt, Mycobacterium bovis subsp bovis AF2122/97
agcauugaccaauccacuga

SEQ ID NO: 1171182 - RNA, 19 nt, Mycobacterium bovis subsp bovis AF2122/97
agcauugaguucggccacc

SEQ ID NO: 1171183 - RNA, 15 nt, Mycobacterium bovis subsp bovis AF2122/97
agccaaccguccggg

SEQ ID NO: 1171184 - RNA, 17 nt, Mycobacterium bovis subsp bovis AF2122/97
agccaaccugaagccag

SEQ ID NO: 1171185 - RNA, 15 nt, Mycobacterium bovis subsp bovis AF2122/97
agccaacgcaucaug

SEQ ID NO: 1171186 - RNA, 22 nt, Mycobacterium bovis subsp bovis AF2122/97
agccaacgcgucccgccgcacc

SEQ ID NO: 1171187 - RNA, 23 nt, Mycobacterium bovis subsp bovis AF2122/97
agccaaugcccuuggccagcagg

SEQ ID NO: 1171188 - RNA, 17 nt, Mycobacterium bovis subsp bovis AF2122/97
agccaacgucaccaagu

SEQ ID NO: 1171189 - RNA, 15 nt, Mycobacterium bovis subsp bovis AF2122/97
agccagccugcuggc

SEQ ID NO: 1171190 - RNA, 17 nt, Mycobacterium bovis subsp bovis AF2122/97
agccagcguuggcggcg

SEQ ID NO: 1171191 - RNA, 20 nt, Mycobacterium bovis subsp bovis AF2122/97
agccagcgucucaaggccuu

SEQ ID NO: 1171192 - RNA, 22 nt, Mycobacterium bovis subsp bovis AF2122/97
agccagcgguagcugcccagcg

SEQ ID NO: 1171193 - RNA, 15 nt, Mycobacterium bovis subsp bovis AF2122/97
agccagcgcagccag

SEQ ID NO: 1171194 - RNA, 15 nt, Mycobacterium bovis subsp bovis AF2122/97
agccagcggagcagc

SEQ ID NO: 1171195 - RNA, 22 nt, Mycobacterium bovis subsp bovis AF2122/97
agccagcgggcgaugagcgcga

SEQ ID NO: 1171196 - RNA, 13 nt, Mycobacterium bovis subsp bovis AF2122/97
agccagcagcaca

SEQ ID NO: 1171197 - RNA, 18 nt, Mycobacterium bovis subsp bovis AF2122/97
agccagcaacaccagaug

SEQ ID NO: 1171198 - RNA, 20 nt, Mycobacterium bovis subsp bovis AF2122/97
agccagcagcggcgagccaa

SEQ ID NO: 1171199 - RNA, 14 nt, Mycobacterium bovis subsp bovis AF2122/97
agccagcagcacau

SEQ ID NO: 1171200 - RNA, 15 nt, Mycobacterium bovis subsp bovis AF2122/97
agccacggcugccca

SEQ ID NO: 1171201 - RNA, 14 nt, Mycobacterium bovis subsp bovis AF2122/97
agccacggcacugg

SEQ ID NO: 1171202 - RNA, 21 nt, Mycobacterium bovis subsp bovis AF2122/97
agccacgcacaauacggucag

SEQ ID NO: 1171203 - RNA, 14 nt, Mycobacterium bovis subsp bovis AF2122/97
agccacgacccagc

SEQ ID NO: 1171204 - RNA, 13 nt, Mycobacterium bovis subsp bovis AF2122/97
agccacgcaagca

SEQ ID NO: 1171205 - RNA, 12 nt, Mycobacterium bovis subsp bovis AF2122/97
agccacgcaugg

SEQ ID NO: 1171206 - RNA, 17 nt, Mycobacterium bovis subsp bovis AF2122/97
agccacgcaugggccag

SEQ ID NO: 1171207 - RNA, 23 nt, Mycobacterium bovis subsp bovis AF2122/97
agccaccugccgacucaucggcc

SEQ ID NO: 1171208 - RNA, 18 nt, Mycobacterium bovis subsp bovis AF2122/97
agccaccugacaaacggc

SEQ ID NO: 1171209 - RNA, 22 nt, Mycobacterium bovis subsp bovis AF2122/97
agccaccgaucgacugcagccc

SEQ ID NO: 1171210 - RNA, 19 nt, Mycobacterium bovis subsp bovis AF2122/97
agccacguagacaaggcca

SEQ ID NO: 1171211 - RNA, 23 nt, Mycobacterium bovis subsp bovis AF2122/97
agccacguucgcggccaacccau

SEQ ID NO: 1171212 - RNA, 23 nt, Mycobacterium bovis subsp bovis AF2122/97
agccacggcuucgccgcgggaca

SEQ ID NO: 1171213 - RNA, 14 nt, Mycobacterium bovis subsp bovis AF2122/97
agccacucgcgcac

SEQ ID NO: 1171214 - RNA, 13 nt, Mycobacterium bovis subsp bovis AF2122/97
agccacuccucgg

SEQ ID NO: 1171215 - RNA, 14 nt, Mycobacterium bovis subsp bovis AF2122/97
agccacucgaucac

SEQ ID NO: 1171216 - RNA, 23 nt, Mycobacterium bovis subsp bovis AF2122/97
agccacucgccacucagcccgac

SEQ ID NO: 1171217 - RNA, 21 nt, Mycobacterium bovis subsp bovis AF2122/97
agccacugcggcauggcaggc

SEQ ID NO: 1171218 - RNA, 18 nt, Mycobacterium bovis subsp bovis AF2122/97
agccaugggauucggcca

SEQ ID NO: 1171219 - RNA, 18 nt, Mycobacterium bovis subsp bovis AF2122/97
agccaggaagcgguggcc

SEQ ID NO: 1171220 - RNA, 23 nt, Mycobacterium bovis subsp bovis AF2122/97
agccaggcacguccgaucggcgc

SEQ ID NO: 1171221 - RNA, 19 nt, Mycobacterium bovis subsp bovis AF2122/97
agccaggccuuggugcggc

SEQ ID NO: 1171222 - RNA, 21 nt, Mycobacterium bovis subsp bovis AF2122/97
agccaggcgugcacaggucag

SEQ ID NO: 1171223 - RNA, 21 nt, Mycobacterium bovis subsp bovis AF2122/97
agccaggcgcgcuaccagcuc

SEQ ID NO: 1171224 - RNA, 21 nt, Mycobacterium bovis subsp bovis AF2122/97
agccaggccuuggugcggccg

SEQ ID NO: 1171225 - RNA, 21 nt, Mycobacterium bovis subsp bovis AF2122/97
agccagggauuuccagcagug

SEQ ID NO: 1171226 - RNA, 22 nt, Mycobacterium bovis subsp bovis AF2122/97
agccaggucgauaccggcgugc

SEQ ID NO: 1171227 - RNA, 10 nt, Mycobacterium bovis subsp bovis AF2122/97
agccagucca

SEQ ID NO: 1171228 - RNA, 13 nt, Mycobacterium bovis subsp bovis AF2122/97
agccagucggcca

SEQ ID NO: 1171229 - RNA, 14 nt, Mycobacterium bovis subsp bovis AF2122/97
agcaucacgcccac

SEQ ID NO: 1171230 - RNA, 17 nt, Mycobacterium bovis subsp bovis AF2122/97
agcaucacgcccacgau

SEQ ID NO: 1171231 - RNA, 14 nt, Mycobacterium bovis subsp bovis AF2122/97
agcauccagcgcgc

SEQ ID NO: 1171232 - RNA, 18 nt, Mycobacterium bovis subsp bovis AF2122/97
agcaucaccguaaagccg

SEQ ID NO: 1171233 - RNA, 20 nt, Mycobacterium bovis subsp bovis AF2122/97
agcaucaacgaaccagcuug

SEQ ID NO: 1171234 - RNA, 16 nt, Mycobacterium bovis subsp bovis AF2122/97
agcaucucggcggcca

SEQ ID NO: 1171235 - RNA, 15 nt, Mycobacterium bovis subsp bovis AF2122/97
agcaucuuuggcggc

SEQ ID NO: 1171236 - RNA, 21 nt, Mycobacterium bovis subsp bovis AF2122/97
agcaucggcaccccggccacu

SEQ ID NO: 1171237 - RNA, 17 nt, Mycobacterium bovis subsp bovis AF2122/97
agcaguacuaacaacac

SEQ ID NO: 1171238 - RNA, 13 nt, Mycobacterium bovis subsp bovis AF2122/97
agcagugccucgg

SEQ ID NO: 1171239 - RNA, 11 nt, Mycobacterium bovis subsp bovis AF2122/97
agcagugcagc

SEQ ID NO: 1171240 - RNA, 15 nt, Mycobacterium bovis subsp bovis AF2122/97
agcagugcagcaaca

SEQ ID NO: 1171241 - RNA, 23 nt, Mycobacterium bovis subsp bovis AF2122/97
agcagugcgguaaagaucuuguc

SEQ ID NO: 1171242 - RNA, 22 nt, Mycobacterium bovis subsp bovis AF2122/97
agcaguuuccguaguaccaaag

SEQ ID NO: 1171243 - RNA, 18 nt, Mycobacterium bovis subsp bovis AF2122/97
agcauaccgccgcugcca

SEQ ID NO: 1171244 - RNA, 16 nt, Mycobacterium bovis subsp bovis AF2122/97
agcagccagcccagcc

SEQ ID NO: 1171245 - RNA, 18 nt, Mycobacterium bovis subsp bovis AF2122/97
agcagcccggggaugccu

SEQ ID NO: 1171246 - RNA, 14 nt, Mycobacterium bovis subsp bovis AF2122/97
agcagcgaccagca

SEQ ID NO: 1171247 - RNA, 19 nt, Mycobacterium bovis subsp bovis AF2122/97
agcagccgaaccggcacca

SEQ ID NO: 1171248 - RNA, 13 nt, Mycobacterium bovis subsp bovis AF2122/97
agcagcagugcca

SEQ ID NO: 1171249 - RNA, 22 nt, Mycobacterium bovis subsp bovis AF2122/97
agcagcauccggccgucaucug

SEQ ID NO: 1171250 - RNA, 14 nt, Mycobacterium bovis subsp bovis AF2122/97
agcagcaucggcac

SEQ ID NO: 1171251 - RNA, 16 nt, Mycobacterium bovis subsp bovis AF2122/97
agcagcaucugggggu

SEQ ID NO: 1171252 - RNA, 23 nt, Mycobacterium bovis subsp bovis AF2122/97
agcagcaucuggggguagccgcc

SEQ ID NO: 1171253 - RNA, 14 nt, Mycobacterium bovis subsp bovis AF2122/97
agcagccagcaaca

SEQ ID NO: 1171254 - RNA, 18 nt, Mycobacterium bovis subsp bovis AF2122/97
agcagccagcaacaccag

SEQ ID NO: 1171255 - RNA, 23 nt, Mycobacterium bovis subsp bovis AF2122/97
agcagcgggacauccagugcggu

SEQ ID NO: 1171256 - RNA, 19 nt, Mycobacterium bovis subsp bovis AF2122/97
agcagcgugaccaccgccg

SEQ ID NO: 1171257 - RNA, 19 nt, Mycobacterium bovis subsp bovis AF2122/97
agcagcgguugaugcggcc

SEQ ID NO: 1171258 - RNA, 20 nt, Mycobacterium bovis subsp bovis AF2122/97
agcagcgguugaugcggccg

SEQ ID NO: 1171259 - RNA, 14 nt, Mycobacterium bovis subsp bovis AF2122/97
agcagcggugcagc

SEQ ID NO: 1171260 - RNA, 16 nt, Mycobacterium bovis subsp bovis AF2122/97
agcagcggugcagccc

SEQ ID NO: 1171261 - RNA, 20 nt, Mycobacterium bovis subsp bovis AF2122/97
agcagcgccgcguucagggc

SEQ ID NO: 1171262 - RNA, 17 nt, Mycobacterium bovis subsp bovis AF2122/97
agcagcgcgggaucuga

SEQ ID NO: 1171263 - RNA, 16 nt, Mycobacterium bovis subsp bovis AF2122/97
agcagcgccagcagcu

SEQ ID NO: 1171264 - RNA, 15 nt, Mycobacterium bovis subsp bovis AF2122/97
agcagcgccagcagc

SEQ ID NO: 1171265 - RNA, 14 nt, Mycobacterium bovis subsp bovis AF2122/97
agcagcgccacccg

SEQ ID NO: 1171266 - RNA, 22 nt, Mycobacterium bovis subsp bovis AF2122/97
agcagcucggccgaggcggucu

SEQ ID NO: 1171267 - RNA, 22 nt, Mycobacterium bovis subsp bovis AF2122/97
agcagcugcgauauggucacca

SEQ ID NO: 1171268 - RNA, 21 nt, Mycobacterium bovis subsp bovis AF2122/97
agcagcuggucgugggccacc

SEQ ID NO: 1171269 - RNA, 20 nt, Mycobacterium bovis subsp bovis AF2122/97
agcagcugggcaucaccgcc

SEQ ID NO: 1171270 - RNA, 21 nt, Mycobacterium bovis subsp bovis AF2122/97
agcagcguggcgaugggucug

SEQ ID NO: 1171271 - RNA, 13 nt, Mycobacterium bovis subsp bovis AF2122/97
agcaggcgcacca

SEQ ID NO: 1171272 - RNA, 13 nt, Mycobacterium bovis subsp bovis AF2122/97
agcaggcggggga

SEQ ID NO: 1171273 - RNA, 15 nt, Mycobacterium bovis subsp bovis AF2122/97
agcaggcgagugaag

SEQ ID NO: 1171274 - RNA, 20 nt, Mycobacterium bovis subsp bovis AF2122/97
agcaggcgcaccaggcggcc

SEQ ID NO: 1171275 - RNA, 16 nt, Mycobacterium bovis subsp bovis AF2122/97
agcaggcgaugcgcca

SEQ ID NO: 1171276 - RNA, 13 nt, Mycobacterium bovis subsp bovis AF2122/97
agcaggcccauac

SEQ ID NO: 1171277 - RNA, 17 nt, Mycobacterium bovis subsp bovis AF2122/97
agcagcuugacaucggu

SEQ ID NO: 1171278 - RNA, 15 nt, Mycobacterium bovis subsp bovis AF2122/97
agcagcuugacccac

SEQ ID NO: 1171279 - RNA, 12 nt, Mycobacterium bovis subsp bovis AF2122/97
agcaggacaccu

SEQ ID NO: 1171280 - RNA, 22 nt, Mycobacterium bovis subsp bovis AF2122/97
agcagggccggcaccgcagcgg

SEQ ID NO: 1171281 - RNA, 20 nt, Mycobacterium bovis subsp bovis AF2122/97
agcagggccaccaccacggc

SEQ ID NO: 1171282 - RNA, 18 nt, Mycobacterium bovis subsp bovis AF2122/97
agcaggggacgggcggcc

SEQ ID NO: 1171283 - RNA, 15 nt, Mycobacterium bovis subsp bovis AF2122/97
agcaggcuggcugcc

SEQ ID NO: 1171284 - RNA, 14 nt, Mycobacterium bovis subsp bovis AF2122/97
agcagguggggguc

SEQ ID NO: 1171285 - RNA, 15 nt, Mycobacterium bovis subsp bovis AF2122/97
agcaggucgccugcc

SEQ ID NO: 1171286 - RNA, 21 nt, Mycobacterium bovis subsp bovis AF2122/97
agcacccguugaucgcggaca

SEQ ID NO: 1171287 - RNA, 12 nt, Mycobacterium bovis subsp bovis AF2122/97
agcaccgaugcu

SEQ ID NO: 1171288 - RNA, 19 nt, Mycobacterium bovis subsp bovis AF2122/97
agcaccgacgugaugguga

SEQ ID NO: 1171289 - RNA, 18 nt, Mycobacterium bovis subsp bovis AF2122/97
agcaccgcaaccacgccc

SEQ ID NO: 1171290 - RNA, 23 nt, Mycobacterium bovis subsp bovis AF2122/97
agcacccgggccacgucgagcac

SEQ ID NO: 1171291 - RNA, 22 nt, Mycobacterium bovis subsp bovis AF2122/97
agcaccgcuacgaccaauagca

SEQ ID NO: 1171292 - RNA, 20 nt, Mycobacterium bovis subsp bovis AF2122/97
agcaccgcgacgacgagguc

SEQ ID NO: 1171293 - RNA, 21 nt, Mycobacterium bovis subsp bovis AF2122/97
agcaccgccgcgccggcggcc

SEQ ID NO: 1171294 - RNA, 16 nt, Mycobacterium bovis subsp bovis AF2122/97
agcaccgccgcugcca

SEQ ID NO: 1171295 - RNA, 16 nt, Mycobacterium bovis subsp bovis AF2122/97
agcaccgcgacgacga

SEQ ID NO: 1171296 - RNA, 12 nt, Mycobacterium bovis subsp bovis AF2122/97
agcaccgccggu

SEQ ID NO: 1171297 - RNA, 19 nt, Mycobacterium bovis subsp bovis AF2122/97
agcaccggauacagccacg

SEQ ID NO: 1171298 - RNA, 19 nt, Mycobacterium bovis subsp bovis AF2122/97
agcaccggaucgaccaauu

SEQ ID NO: 1171299 - RNA, 14 nt, Mycobacterium bovis subsp bovis AF2122/97
agcaccgugcccug

SEQ ID NO: 1171300 - RNA, 22 nt, Mycobacterium bovis subsp bovis AF2122/97
agcaccgucggcaccagcagcc

SEQ ID NO: 1171301 - RNA, 13 nt, Mycobacterium bovis subsp bovis AF2122/97
agcaccugcaccg

SEQ ID NO: 1171302 - RNA, 21 nt, Mycobacterium bovis subsp bovis AF2122/97
agcaccugccgaucgggcuca

SEQ ID NO: 1171303 - RNA, 17 nt, Mycobacterium bovis subsp bovis AF2122/97
agcaccuagucgcggcc

SEQ ID NO: 1171304 - RNA, 15 nt, Mycobacterium bovis subsp bovis AF2122/97
agcaccagccagccu

SEQ ID NO: 1171305 - RNA, 18 nt, Mycobacterium bovis subsp bovis AF2122/97
agcaccagccagccugcu

SEQ ID NO: 1171306 - RNA, 20 nt, Mycobacterium bovis subsp bovis AF2122/97
agcaccagccagccugcugg

SEQ ID NO: 1171307 - RNA, 16 nt, Mycobacterium bovis subsp bovis AF2122/97
agcaccagcagcacca

SEQ ID NO: 1171308 - RNA, 19 nt, Mycobacterium bovis subsp bovis AF2122/97
agcaccagcacggcaacca

SEQ ID NO: 1171309 - RNA, 12 nt, Mycobacterium bovis subsp bovis AF2122/97
agcaccagcagc

SEQ ID NO: 1171310 - RNA, 13 nt, Mycobacterium bovis subsp bovis AF2122/97
agcaccagcagca

SEQ ID NO: 1171311 - RNA, 19 nt, Mycobacterium bovis subsp bovis AF2122/97
agcacccacaucagccgca

SEQ ID NO: 1171312 - RNA, 17 nt, Mycobacterium bovis subsp bovis AF2122/97
agcacccaacccggcgg

SEQ ID NO: 1171313 - RNA, 13 nt, Mycobacterium bovis subsp bovis AF2122/97
agcacccacgccg

SEQ ID NO: 1171314 - RNA, 16 nt, Mycobacterium bovis subsp bovis AF2122/97
agcaccaguucccuac

SEQ ID NO: 1171315 - RNA, 17 nt, Mycobacterium bovis subsp bovis AF2122/97
agcaccaguucccuaca

SEQ ID NO: 1171316 - RNA, 22 nt, Mycobacterium bovis subsp bovis AF2122/97
agcacccgcucggccgccgggu

SEQ ID NO: 1171317 - RNA, 14 nt, Mycobacterium bovis subsp bovis AF2122/97
agcacccggccacc

SEQ ID NO: 1171318 - RNA, 12 nt, Mycobacterium bovis subsp bovis AF2122/97
agcacccgcucc

SEQ ID NO: 1171319 - RNA, 17 nt, Mycobacterium bovis subsp bovis AF2122/97
agcaccccgccgggggc

SEQ ID NO: 1171320 - RNA, 17 nt, Mycobacterium bovis subsp bovis AF2122/97
agcaccccauggccacc

SEQ ID NO: 1171321 - RNA, 18 nt, Mycobacterium bovis subsp bovis AF2122/97
agcaccccauggccaccg

SEQ ID NO: 1171322 - RNA, 19 nt, Mycobacterium bovis subsp bovis AF2122/97
agcaccccauggccaccga

SEQ ID NO: 1171323 - RNA, 17 nt, Mycobacterium bovis subsp bovis AF2122/97
agcacaccgccagcggc

SEQ ID NO: 1171324 - RNA, 19 nt, Mycobacterium bovis subsp bovis AF2122/97
agcacacccagaugcaggc

SEQ ID NO: 1171325 - RNA, 19 nt, Mycobacterium bovis subsp bovis AF2122/97
agcacacgucgggaguaag

SEQ ID NO: 1171326 - RNA, 13 nt, Mycobacterium bovis subsp bovis AF2122/97
agcacaccgccag

SEQ ID NO: 1171327 - RNA, 14 nt, Mycobacterium bovis subsp bovis AF2122/97
agcacaccgccagc

SEQ ID NO: 1171328 - RNA, 14 nt, Mycobacterium bovis subsp bovis AF2122/97
agcacaauccagac

SEQ ID NO: 1171329 - RNA, 14 nt, Mycobacterium bovis subsp bovis AF2122/97
agcacaaacccagu

SEQ ID NO: 1171330 - RNA, 20 nt, Mycobacterium bovis subsp bovis AF2122/97
agcaccacauccaucuccau

SEQ ID NO: 1171331 - RNA, 19 nt, Mycobacterium bovis subsp bovis AF2122/97
agcaccacaacgucggcac

SEQ ID NO: 1171332 - RNA, 17 nt, Mycobacterium bovis subsp bovis AF2122/97
agcaccaaaugccccga

SEQ ID NO: 1171333 - RNA, 20 nt, Mycobacterium bovis subsp bovis AF2122/97
agcaccaaaugccccgaacc

SEQ ID NO: 1171334 - RNA, 18 nt, Mycobacterium bovis subsp bovis AF2122/97
agcaccaaaagcccggua

SEQ ID NO: 1171335 - RNA, 22 nt, Mycobacterium bovis subsp bovis AF2122/97
agcacauuauucuucgcggcga

SEQ ID NO: 1171336 - RNA, 20 nt, Mycobacterium bovis subsp bovis AF2122/97
agcacagcgcagccugcagc

SEQ ID NO: 1171337 - RNA, 18 nt, Mycobacterium bovis subsp bovis AF2122/97
agcacauccugcagcucg

SEQ ID NO: 1171338 - RNA, 16 nt, Mycobacterium bovis subsp bovis AF2122/97
agcacaucgccggagu

SEQ ID NO: 1171339 - RNA, 15 nt, Mycobacterium bovis subsp bovis AF2122/97
agcacauccugcagc

SEQ ID NO: 1171340 - RNA, 17 nt, Mycobacterium bovis subsp bovis AF2122/97
agcacauccugcagcuc

SEQ ID NO: 1171341 - RNA, 20 nt, Mycobacterium bovis subsp bovis AF2122/97
agcacacccagaugcaggcu

SEQ ID NO: 1171342 - RNA, 15 nt, Mycobacterium bovis subsp bovis AF2122/97
agcacagcagcaacg

SEQ ID NO: 1171343 - RNA, 18 nt, Mycobacterium bovis subsp bovis AF2122/97
agcacgaugucgaugccg

SEQ ID NO: 1171344 - RNA, 23 nt, Mycobacterium bovis subsp bovis AF2122/97
agcacgacgacgucgggggcuuc

SEQ ID NO: 1171345 - RNA, 15 nt, Mycobacterium bovis subsp bovis AF2122/97
agcacgaaagucaau

SEQ ID NO: 1171346 - RNA, 18 nt, Mycobacterium bovis subsp bovis AF2122/97
agcaccugggcgcgcugg

SEQ ID NO: 1171347 - RNA, 23 nt, Mycobacterium bovis subsp bovis AF2122/97
agcacgggcucgcugcaccagcu

SEQ ID NO: 1171348 - RNA, 24 nt, Mycobacterium bovis subsp bovis AF2122/97
agcacgggcucgcugcaccagcug

SEQ ID NO: 1171349 - RNA, 22 nt, Mycobacterium bovis subsp bovis AF2122/97
agcacgggacuucgugccucgg

SEQ ID NO: 1171350 - RNA, 13 nt, Mycobacterium bovis subsp bovis AF2122/97
agcacgcugacca

SEQ ID NO: 1171351 - RNA, 20 nt, Mycobacterium bovis subsp bovis AF2122/97
agcacgcuggcguuguugac

SEQ ID NO: 1171352 - RNA, 16 nt, Mycobacterium bovis subsp bovis AF2122/97
agcacgcccgcgcuga

SEQ ID NO: 1171353 - RNA, 15 nt, Mycobacterium bovis subsp bovis AF2122/97
agcacgccguccagg

SEQ ID NO: 1171354 - RNA, 20 nt, Mycobacterium bovis subsp bovis AF2122/97
agcacgccgccggccgccag

SEQ ID NO: 1171355 - RNA, 16 nt, Mycobacterium bovis subsp bovis AF2122/97
agcacgucgcggccgu

SEQ ID NO: 1171356 - RNA, 19 nt, Mycobacterium bovis subsp bovis AF2122/97
agcacgucuugcugcacgc

SEQ ID NO: 1171357 - RNA, 22 nt, Mycobacterium bovis subsp bovis AF2122/97
agcacguccugaaucgguucgg

SEQ ID NO: 1171358 - RNA, 23 nt, Mycobacterium bovis subsp bovis AF2122/97
agcacgguguugcgcacccgcgg

SEQ ID NO: 1171359 - RNA, 17 nt, Mycobacterium bovis subsp bovis AF2122/97
agcacguucaccgcgcg

SEQ ID NO: 1171360 - RNA, 20 nt, Mycobacterium bovis subsp bovis AF2122/97
agcacgugccccaugcgcag

SEQ ID NO: 1171361 - RNA, 15 nt, Mycobacterium bovis subsp bovis AF2122/97
agcacucgcccaagc

SEQ ID NO: 1171362 - RNA, 12 nt, Mycobacterium bovis subsp bovis AF2122/97
agcagcaccugc

SEQ ID NO: 1171363 - RNA, 19 nt, Mycobacterium bovis subsp bovis AF2122/97
agcagcacuccggcgacga

SEQ ID NO: 1171364 - RNA, 15 nt, Mycobacterium bovis subsp bovis AF2122/97
agcagcaccgcgacc

SEQ ID NO: 1171365 - RNA, 14 nt, Mycobacterium bovis subsp bovis AF2122/97
agcagcacccauac

SEQ ID NO: 1171366 - RNA, 16 nt, Mycobacterium bovis subsp bovis AF2122/97
agcagcaacgacccga

SEQ ID NO: 1171367 - RNA, 15 nt, Mycobacterium bovis subsp bovis AF2122/97
agcagauccaggcgu

SEQ ID NO: 1171368 - RNA, 15 nt, Mycobacterium bovis subsp bovis AF2122/97
agcagaugggcgucg

SEQ ID NO: 1171369 - RNA, 19 nt, Mycobacterium bovis subsp bovis AF2122/97
agcagacgcggaaucgcac

SEQ ID NO: 1171370 - RNA, 19 nt, Mycobacterium bovis subsp bovis AF2122/97
agcagacgacgaucagccc

SEQ ID NO: 1171371 - RNA, 15 nt, Mycobacterium bovis subsp bovis AF2122/97
agcagacacagaauc

SEQ ID NO: 1171372 - RNA, 16 nt, Mycobacterium bovis subsp bovis AF2122/97
agcaaaccagauugcc

SEQ ID NO: 1171373 - RNA, 16 nt, Mycobacterium bovis subsp bovis AF2122/97
agcaaagccagcgcag

SEQ ID NO: 1171374 - RNA, 15 nt, Mycobacterium bovis subsp bovis AF2122/97
agcaaaaacauugcu

SEQ ID NO: 1171375 - RNA, 15 nt, Mycobacterium bovis subsp bovis AF2122/97
agcaacaccagggcc

SEQ ID NO: 1171376 - RNA, 17 nt, Mycobacterium bovis subsp bovis AF2122/97
agcaacgccacccgaau

SEQ ID NO: 1171377 - RNA, 16 nt, Mycobacterium bovis subsp bovis AF2122/97
agcaacggcggcaggc

SEQ ID NO: 1171378 - RNA, 18 nt, Mycobacterium bovis subsp bovis AF2122/97
agcaacggcggcaggccg

SEQ ID NO: 1171379 - RNA, 22 nt, Mycobacterium bovis subsp bovis AF2122/97
agcaacgugugcaccaucauca

SEQ ID NO: 1171380 - RNA, 14 nt, Mycobacterium bovis subsp bovis AF2122/97
agcaacgcugcggc

SEQ ID NO: 1171381 - RNA, 22 nt, Mycobacterium bovis subsp bovis AF2122/97
agcaacucguccagcagugcga

SEQ ID NO: 1171382 - RNA, 17 nt, Mycobacterium bovis subsp bovis AF2122/97
agcaacucguccagcag

SEQ ID NO: 1171383 - RNA, 13 nt, Mycobacterium bovis subsp bovis AF2122/97
agcaaugcccgca

SEQ ID NO: 1171384 - RNA, 22 nt, Mycobacterium bovis subsp bovis AF2122/97
agcaauccaaggcucagcagcg

SEQ ID NO: 1171385 - RNA, 19 nt, Mycobacterium bovis subsp bovis AF2122/97
agcaauaccugagcgcgcg

SEQ ID NO: 1171386 - RNA, 17 nt, Mycobacterium bovis subsp bovis AF2122/97
agcaauccgcacagcga

SEQ ID NO: 1171387 - RNA, 16 nt, Mycobacterium bovis subsp bovis AF2122/97
agcaagccaacccaau

SEQ ID NO: 1171388 - RNA, 20 nt, Mycobacterium bovis subsp bovis AF2122/97
agcaagucgccgaggcaacc

SEQ ID NO: 1171389 - RNA, 15 nt, Mycobacterium bovis subsp bovis AF2122/97
agaaggcgcgggcga

SEQ ID NO: 1171390 - RNA, 14 nt, Mycobacterium bovis subsp bovis AF2122/97
agaaggccagcgaa

SEQ ID NO: 1171391 - RNA, 19 nt, Mycobacterium bovis subsp bovis AF2122/97
agaaguuagccaccuugga

SEQ ID NO: 1171392 - RNA, 15 nt, Mycobacterium bovis subsp bovis AF2122/97
agaaggaucagcgca

SEQ ID NO: 1171393 - RNA, 20 nt, Mycobacterium bovis subsp bovis AF2122/97
agaaggaucagcgcacuggc

SEQ ID NO: 1171394 - RNA, 21 nt, Mycobacterium bovis subsp bovis AF2122/97
agaagcccaggacggcuacca

SEQ ID NO: 1171395 - RNA, 22 nt, Mycobacterium bovis subsp bovis AF2122/97
agaagcccaggacggcuaccac

SEQ ID NO: 1171396 - RNA, 15 nt, Mycobacterium bovis subsp bovis AF2122/97
agaagcccccaaacc

SEQ ID NO: 1171397 - RNA, 22 nt, Mycobacterium bovis subsp bovis AF2122/97
agaaugacaucgucgccagggc

SEQ ID NO: 1171398 - RNA, 13 nt, Mycobacterium bovis subsp bovis AF2122/97
agaaucagcagca

SEQ ID NO: 1171399 - RNA, 15 nt, Mycobacterium bovis subsp bovis AF2122/97
agaaucaggcucgcc

SEQ ID NO: 1171400 - RNA, 14 nt, Mycobacterium bovis subsp bovis AF2122/97
agaaucacggucau

SEQ ID NO: 1171401 - RNA, 13 nt, Mycobacterium bovis subsp bovis AF2122/97
agaauccaggugg

SEQ ID NO: 1171402 - RNA, 18 nt, Mycobacterium bovis subsp bovis AF2122/97
agacaccggcuauauccc

SEQ ID NO: 1171403 - RNA, 23 nt, Mycobacterium bovis subsp bovis AF2122/97
agacaccggcgucgaaggugacc

SEQ ID NO: 1171404 - RNA, 21 nt, Mycobacterium bovis subsp bovis AF2122/97
agacagccguuguacauagcc

SEQ ID NO: 1171405 - RNA, 19 nt, Mycobacterium bovis subsp bovis AF2122/97
agacaggcggcggccuggc

SEQ ID NO: 1171406 - RNA, 14 nt, Mycobacterium bovis subsp bovis AF2122/97
agacagcaccgccg

SEQ ID NO: 1171407 - RNA, 13 nt, Mycobacterium bovis subsp bovis AF2122/97
agacaaaggugcc

SEQ ID NO: 1171408 - RNA, 21 nt, Mycobacterium bovis subsp bovis AF2122/97
agaccggaaaccacagcgcca

SEQ ID NO: 1171409 - RNA, 14 nt, Mycobacterium bovis subsp bovis AF2122/97
agaccgcggccggc

SEQ ID NO: 1171410 - RNA, 15 nt, Mycobacterium bovis subsp bovis AF2122/97
agaccgaacagcggc

SEQ ID NO: 1171411 - RNA, 17 nt, Mycobacterium bovis subsp bovis AF2122/97
agaccgcgagcagcaca

SEQ ID NO: 1171412 - RNA, 15 nt, Mycobacterium bovis subsp bovis AF2122/97
agaccgccgcugccg

SEQ ID NO: 1171413 - RNA, 12 nt, Mycobacterium bovis subsp bovis AF2122/97
agaccgccgcug

SEQ ID NO: 1171414 - RNA, 20 nt, Mycobacterium bovis subsp bovis AF2122/97
agacgaaccgccgacggcgc

SEQ ID NO: 1171415 - RNA, 21 nt, Mycobacterium bovis subsp bovis AF2122/97
agacgacaucgucaucagcgc

SEQ ID NO: 1171416 - RNA, 23 nt, Mycobacterium bovis subsp bovis AF2122/97
agaccugucgguaccgcccaguu

SEQ ID NO: 1171417 - RNA, 12 nt, Mycobacterium bovis subsp bovis AF2122/97
agaccugguuga

SEQ ID NO: 1171418 - RNA, 20 nt, Mycobacterium bovis subsp bovis AF2122/97
agacaugccggcgagggcgc

SEQ ID NO: 1171419 - RNA, 13 nt, Mycobacterium bovis subsp bovis AF2122/97
agacaugggugaa

SEQ ID NO: 1171420 - RNA, 14 nt, Mycobacterium bovis subsp bovis AF2122/97
agacccguccggag

SEQ ID NO: 1171421 - RNA, 22 nt, Mycobacterium bovis subsp bovis AF2122/97
agaccgaaucgggucggccgcu

SEQ ID NO: 1171422 - RNA, 15 nt, Mycobacterium bovis subsp bovis AF2122/97
agaccgaacagcacc

SEQ ID NO: 1171423 - RNA, 20 nt, Mycobacterium bovis subsp bovis AF2122/97
agaccgaacagcaccgaacc

SEQ ID NO: 1171424 - RNA, 13 nt, Mycobacterium bovis subsp bovis AF2122/97
agaccgaacagcg

SEQ ID NO: 1171425 - RNA, 18 nt, Mycobacterium bovis subsp bovis AF2122/97
agaccaaugaccgccagc

SEQ ID NO: 1171426 - RNA, 16 nt, Mycobacterium bovis subsp bovis AF2122/97
agaccaaggcgaaggu

SEQ ID NO: 1171427 - RNA, 17 nt, Mycobacterium bovis subsp bovis AF2122/97
agaccaagugucgccgc

SEQ ID NO: 1171428 - RNA, 15 nt, Mycobacterium bovis subsp bovis AF2122/97
agacgcucgaccugc

SEQ ID NO: 1171429 - RNA, 17 nt, Mycobacterium bovis subsp bovis AF2122/97
agacgcucgaccugccu

SEQ ID NO: 1171430 - RNA, 14 nt, Mycobacterium bovis subsp bovis AF2122/97
agacgcgaaagcac

SEQ ID NO: 1171431 - RNA, 14 nt, Mycobacterium bovis subsp bovis AF2122/97
agacgcugcgcgcc

SEQ ID NO: 1171432 - RNA, 15 nt, Mycobacterium bovis subsp bovis AF2122/97
agacggcaggaauga

SEQ ID NO: 1171433 - RNA, 12 nt, Mycobacterium bovis subsp bovis AF2122/97
agacggcacccc

SEQ ID NO: 1171434 - RNA, 18 nt, Mycobacterium bovis subsp bovis AF2122/97
agacugggcgcuggaggc

SEQ ID NO: 1171435 - RNA, 19 nt, Mycobacterium bovis subsp bovis AF2122/97
agacugggcgcuggaggcc

SEQ ID NO: 1171436 - RNA, 20 nt, Mycobacterium bovis subsp bovis AF2122/97
agacucgauaugcagcucgc

SEQ ID NO: 1171437 - RNA, 20 nt, Mycobacterium bovis subsp bovis AF2122/97
agacuccagcaaggccagca

SEQ ID NO: 1171438 - RNA, 18 nt, Mycobacterium bovis subsp bovis AF2122/97
agacucgcggucgacagc

SEQ ID NO: 1171439 - RNA, 13 nt, Mycobacterium bovis subsp bovis AF2122/97
agacuugccgagu

SEQ ID NO: 1171440 - RNA, 16 nt, Mycobacterium bovis subsp bovis AF2122/97
agacuugcugcuccuu

SEQ ID NO: 1171441 - RNA, 15 nt, Mycobacterium bovis subsp bovis AF2122/97
agacuuucgcccagu

SEQ ID NO: 1171442 - RNA, 23 nt, Mycobacterium bovis subsp bovis AF2122/97
agagaaggcggcgucgagcaccu

SEQ ID NO: 1171443 - RNA, 15 nt, Mycobacterium bovis subsp bovis AF2122/97
agagcaggcccauac

SEQ ID NO: 1171444 - RNA, 12 nt, Mycobacterium bovis subsp bovis AF2122/97
agagcagcagcg

SEQ ID NO: 1171445 - RNA, 12 nt, Mycobacterium bovis subsp bovis AF2122/97
agagccagcaac

SEQ ID NO: 1171446 - RNA, 16 nt, Mycobacterium bovis subsp bovis AF2122/97
agagcaugguccagca

SEQ ID NO: 1171447 - RNA, 18 nt, Mycobacterium bovis subsp bovis AF2122/97
agagcaugccgcccgcgc

SEQ ID NO: 1171448 - RNA, 19 nt, Mycobacterium bovis subsp bovis AF2122/97
agagccccggcaagcgcag

SEQ ID NO: 1171449 - RNA, 19 nt, Mycobacterium bovis subsp bovis AF2122/97
agagccccgaccagcagac

SEQ ID NO: 1171450 - RNA, 19 nt, Mycobacterium bovis subsp bovis AF2122/97
agagccggcggcgaccaga

SEQ ID NO: 1171451 - RNA, 11 nt, Mycobacterium bovis subsp bovis AF2122/97
agagccgccgu

SEQ ID NO: 1171452 - RNA, 14 nt, Mycobacterium bovis subsp bovis AF2122/97
agagccgcgagcac

SEQ ID NO: 1171453 - RNA, 14 nt, Mycobacterium bovis subsp bovis AF2122/97
agaggauggucagc

SEQ ID NO: 1171454 - RNA, 12 nt, Mycobacterium bovis subsp bovis AF2122/97
agaggcccgcgg

SEQ ID NO: 1171455 - RNA, 18 nt, Mycobacterium bovis subsp bovis AF2122/97
agaggacugcggucugga

SEQ ID NO: 1171456 - RNA, 12 nt, Mycobacterium bovis subsp bovis AF2122/97
agaggacugcgg

SEQ ID NO: 1171457 - RNA, 17 nt, Mycobacterium bovis subsp bovis AF2122/97
agagugcucagcgcgcg

SEQ ID NO: 1171458 - RNA, 13 nt, Mycobacterium bovis subsp bovis AF2122/97
agaggcggcuggc

SEQ ID NO: 1171459 - RNA, 19 nt, Mycobacterium bovis subsp bovis AF2122/97
agaaaacggcggcgccggu

SEQ ID NO: 1171460 - RNA, 21 nt, Mycobacterium bovis subsp bovis AF2122/97
agaaaacauugcggcccucga

SEQ ID NO: 1171461 - RNA, 17 nt, Mycobacterium bovis subsp bovis AF2122/97
agaaacacgacagccag

SEQ ID NO: 1171462 - RNA, 13 nt, Mycobacterium bovis subsp bovis AF2122/97
agaaagaucgguu

SEQ ID NO: 1171463 - RNA, 16 nt, Mycobacterium bovis subsp bovis AF2122/97
acuuugagcagaaggc

SEQ ID NO: 1171464 - RNA, 20 nt, Mycobacterium bovis subsp bovis AF2122/97
acuuugagucguuggacggc

SEQ ID NO: 1171465 - RNA, 20 nt, Mycobacterium bovis subsp bovis AF2122/97
acuuguuugucaccgcagcc

SEQ ID NO: 1171466 - RNA, 18 nt, Mycobacterium bovis subsp bovis AF2122/97
acuugucggggugcacac

SEQ ID NO: 1171467 - RNA, 14 nt, Mycobacterium bovis subsp bovis AF2122/97
acuucuccaggcug

SEQ ID NO: 1171468 - RNA, 15 nt, Mycobacterium bovis subsp bovis AF2122/97
acuucuaugacgacc

SEQ ID NO: 1171469 - RNA, 13 nt, Mycobacterium bovis subsp bovis AF2122/97
acuucgugccucg

SEQ ID NO: 1171470 - RNA, 17 nt, Mycobacterium bovis subsp bovis AF2122/97
acuucggggucaccggc

SEQ ID NO: 1171471 - RNA, 18 nt, Mycobacterium bovis subsp bovis AF2122/97
acuucugguaggcggcca

SEQ ID NO: 1171472 - RNA, 17 nt, Mycobacterium bovis subsp bovis AF2122/97
acuucuucgacgcgcau

SEQ ID NO: 1171473 - RNA, 19 nt, Mycobacterium bovis subsp bovis AF2122/97
acuugcaggcgucccagcc

SEQ ID NO: 1171474 - RNA, 14 nt, Mycobacterium bovis subsp bovis AF2122/97
acuugcucacccgu

SEQ ID NO: 1171475 - RNA, 12 nt, Mycobacterium bovis subsp bovis AF2122/97
acuugcugcucc

SEQ ID NO: 1171476 - RNA, 14 nt, Mycobacterium bovis subsp bovis AF2122/97
acuuggacccggcc

SEQ ID NO: 1171477 - RNA, 18 nt, Mycobacterium bovis subsp bovis AF2122/97
acuuggacgacccgggcc

SEQ ID NO: 1171478 - RNA, 23 nt, Mycobacterium bovis subsp bovis AF2122/97
acuuggcccccgacggugaacca

SEQ ID NO: 1171479 - RNA, 19 nt, Mycobacterium bovis subsp bovis AF2122/97
acuuggcggccagccgcuc

SEQ ID NO: 1171480 - RNA, 23 nt, Mycobacterium bovis subsp bovis AF2122/97
acuuggcggucgguuccggugua

SEQ ID NO: 1171481 - RNA, 22 nt, Mycobacterium bovis subsp bovis AF2122/97
acuuggugauccgagaccaugc

SEQ ID NO: 1171482 - RNA, 16 nt, Mycobacterium bovis subsp bovis AF2122/97
acugugcgccgcagcc

SEQ ID NO: 1171483 - RNA, 15 nt, Mycobacterium bovis subsp bovis AF2122/97
acugugcgccugcgu

SEQ ID NO: 1171484 - RNA, 16 nt, Mycobacterium bovis subsp bovis AF2122/97
acuguggcgccgccgg

SEQ ID NO: 1171485 - RNA, 18 nt, Mycobacterium bovis subsp bovis AF2122/97
acuguccugccagaagac

SEQ ID NO: 1171486 - RNA, 18 nt, Mycobacterium bovis subsp bovis AF2122/97
acuguccgcccggaaaaa

SEQ ID NO: 1171487 - RNA, 20 nt, Mycobacterium bovis subsp bovis AF2122/97
acugugccgcugcauccgca

SEQ ID NO: 1171488 - RNA, 17 nt, Mycobacterium bovis subsp bovis AF2122/97
acuguuggugccgccac

SEQ ID NO: 1171489 - RNA, 16 nt, Mycobacterium bovis subsp bovis AF2122/97
acuuaccgagccguca

SEQ ID NO: 1171490 - RNA, 19 nt, Mycobacterium bovis subsp bovis AF2122/97
acuuaccgaggccaugcuc

SEQ ID NO: 1171491 - RNA, 12 nt, Mycobacterium bovis subsp bovis AF2122/97
acgcccgcgaac

SEQ ID NO: 1171492 - RNA, 22 nt, Mycobacterium bovis subsp bovis AF2122/97
acgcccgcucggagaucgccac

SEQ ID NO: 1171493 - RNA, 18 nt, Mycobacterium bovis subsp bovis AF2122/97
acgcccgaguugaagaau

SEQ ID NO: 1171494 - RNA, 12 nt, Mycobacterium bovis subsp bovis AF2122/97
acgcccgcccgc

SEQ ID NO: 1171495 - RNA, 16 nt, Mycobacterium bovis subsp bovis AF2122/97
acgcccgcaucgccuc

SEQ ID NO: 1171496 - RNA, 21 nt, Mycobacterium bovis subsp bovis AF2122/97
acgcccugaagggccgccucg

SEQ ID NO: 1171497 - RNA, 12 nt, Mycobacterium bovis subsp bovis AF2122/97
acgcccuguucu

SEQ ID NO: 1171498 - RNA, 14 nt, Mycobacterium bovis subsp bovis AF2122/97
acgcccguguugaa

SEQ ID NO: 1171499 - RNA, 18 nt, Mycobacterium bovis subsp bovis AF2122/97
acgcccguguugaagaag

SEQ ID NO: 1171500 - RNA, 11 nt, Mycobacterium bovis subsp bovis AF2122/97
acgcccucggg

SEQ ID NO: 1171501 - RNA, 14 nt, Mycobacterium bovis subsp bovis AF2122/97
acgcccacagcuga

SEQ ID NO: 1171502 - RNA, 12 nt, Mycobacterium bovis subsp bovis AF2122/97
acgcccaccacg

SEQ ID NO: 1171503 - RNA, 15 nt, Mycobacterium bovis subsp bovis AF2122/97
acgcccacuccagca

SEQ ID NO: 1171504 - RNA, 17 nt, Mycobacterium bovis subsp bovis AF2122/97
acgccccggcgcggcca

SEQ ID NO: 1171505 - RNA, 19 nt, Mycobacterium bovis subsp bovis AF2122/97
acgcccgacgccagcugcc

SEQ ID NO: 1171506 - RNA, 15 nt, Mycobacterium bovis subsp bovis AF2122/97
acgccgaccagcacc

SEQ ID NO: 1171507 - RNA, 19 nt, Mycobacterium bovis subsp bovis AF2122/97
acgccgaacgcgagguucc

SEQ ID NO: 1171508 - RNA, 22 nt, Mycobacterium bovis subsp bovis AF2122/97
acgccgaaaaugccgcccagcg

SEQ ID NO: 1171509 - RNA, 16 nt, Mycobacterium bovis subsp bovis AF2122/97
acgccgauggcuuggu

SEQ ID NO: 1171510 - RNA, 17 nt, Mycobacterium bovis subsp bovis AF2122/97
acgccgaccggcccgca

SEQ ID NO: 1171511 - RNA, 14 nt, Mycobacterium bovis subsp bovis AF2122/97
acgccgagcacuga

SEQ ID NO: 1171512 - RNA, 14 nt, Mycobacterium bovis subsp bovis AF2122/97
acgccgcgagagcc

SEQ ID NO: 1171513 - RNA, 18 nt, Mycobacterium bovis subsp bovis AF2122/97
acgccgcuggagaucacg

SEQ ID NO: 1171514 - RNA, 19 nt, Mycobacterium bovis subsp bovis AF2122/97
acgccgcuggagaucacgc

SEQ ID NO: 1171515 - RNA, 15 nt, Mycobacterium bovis subsp bovis AF2122/97
acgccgcgccgcaga

SEQ ID NO: 1171516 - RNA, 17 nt, Mycobacterium bovis subsp bovis AF2122/97
acgccgccggcgccacc

SEQ ID NO: 1171517 - RNA, 20 nt, Mycobacterium bovis subsp bovis AF2122/97
acgccgccagcauugaagaa

SEQ ID NO: 1171518 - RNA, 23 nt, Mycobacterium bovis subsp bovis AF2122/97
acgccgcaucggcgggucugggu

SEQ ID NO: 1171519 - RNA, 22 nt, Mycobacterium bovis subsp bovis AF2122/97
acgccgccccugcgcggccacc

SEQ ID NO: 1171520 - RNA, 23 nt, Mycobacterium bovis subsp bovis AF2122/97
acgccgggcuguucggccauggc

SEQ ID NO: 1171521 - RNA, 21 nt, Mycobacterium bovis subsp bovis AF2122/97
acgccggauggucggccacgc

SEQ ID NO: 1171522 - RNA, 14 nt, Mycobacterium bovis subsp bovis AF2122/97
acgccggcaugcca

SEQ ID NO: 1171523 - RNA, 14 nt, Mycobacterium bovis subsp bovis AF2122/97
acgccggccuggcc

SEQ ID NO: 1171524 - RNA, 19 nt, Mycobacterium bovis subsp bovis AF2122/97
acgccggcccggugaugaa

SEQ ID NO: 1171525 - RNA, 23 nt, Mycobacterium bovis subsp bovis AF2122/97
acgccgguggcacggccccugcc

SEQ ID NO: 1171526 - RNA, 21 nt, Mycobacterium bovis subsp bovis AF2122/97
acgccucaccgacgucgccaa

SEQ ID NO: 1171527 - RNA, 18 nt, Mycobacterium bovis subsp bovis AF2122/97
acgccgucggcgcgcacc

SEQ ID NO: 1171528 - RNA, 18 nt, Mycobacterium bovis subsp bovis AF2122/97
acgccucgacagcggcaa

SEQ ID NO: 1171529 - RNA, 15 nt, Mycobacterium bovis subsp bovis AF2122/97
acgccucgccggcca

SEQ ID NO: 1171530 - RNA, 14 nt, Mycobacterium bovis subsp bovis AF2122/97
acgccugagccacc

SEQ ID NO: 1171531 - RNA, 17 nt, Mycobacterium bovis subsp bovis AF2122/97
acgccugcucggagagc

SEQ ID NO: 1171532 - RNA, 19 nt, Mycobacterium bovis subsp bovis AF2122/97
acgccuugaucggcgaggu

SEQ ID NO: 1171533 - RNA, 16 nt, Mycobacterium bovis subsp bovis AF2122/97
acgcgaaccggccauc

SEQ ID NO: 1171534 - RNA, 16 nt, Mycobacterium bovis subsp bovis AF2122/97
acgcgaagcugagcac

SEQ ID NO: 1171535 - RNA, 22 nt, Mycobacterium bovis subsp bovis AF2122/97
acgcgaaugacgauccagccca

SEQ ID NO: 1171536 - RNA, 16 nt, Mycobacterium bovis subsp bovis AF2122/97
acgcgacagccaccuc

SEQ ID NO: 1171537 - RNA, 16 nt, Mycobacterium bovis subsp bovis AF2122/97
accggauccacggaga

SEQ ID NO: 1171538 - RNA, 12 nt, Mycobacterium bovis subsp bovis AF2122/97
accggaguucag

SEQ ID NO: 1171539 - RNA, 23 nt, Mycobacterium bovis subsp bovis AF2122/97
acgcaccacaaacaccccacaca

SEQ ID NO: 1171540 - RNA, 15 nt, Mycobacterium bovis subsp bovis AF2122/97
acgcaccacaaucca

SEQ ID NO: 1171541 - RNA, 17 nt, Mycobacterium bovis subsp bovis AF2122/97
acgcaccgcgguggggu

SEQ ID NO: 1171542 - RNA, 13 nt, Mycobacterium bovis subsp bovis AF2122/97
acgcacccggcaa

SEQ ID NO: 1171543 - RNA, 17 nt, Mycobacterium bovis subsp bovis AF2122/97
acgcacgcagccccucg

SEQ ID NO: 1171544 - RNA, 17 nt, Mycobacterium bovis subsp bovis AF2122/97
acgcacugccccgcauc

SEQ ID NO: 1171545 - RNA, 20 nt, Mycobacterium bovis subsp bovis AF2122/97
acgcacucccgagccacaaa

SEQ ID NO: 1171546 - RNA, 17 nt, Mycobacterium bovis subsp bovis AF2122/97
acgcagaaucgcaugau

SEQ ID NO: 1171547 - RNA, 15 nt, Mycobacterium bovis subsp bovis AF2122/97
acgcagaaucgccua

SEQ ID NO: 1171548 - RNA, 15 nt, Mycobacterium bovis subsp bovis AF2122/97
acgcaggaucacacu

SEQ ID NO: 1171549 - RNA, 22 nt, Mycobacterium bovis subsp bovis AF2122/97
acgcaggaaaaccccggccacc

SEQ ID NO: 1171550 - RNA, 22 nt, Mycobacterium bovis subsp bovis AF2122/97
acgcaggugaacgccggugcgc

SEQ ID NO: 1171551 - RNA, 18 nt, Mycobacterium bovis subsp bovis AF2122/97
acgcagucgggcagcgcu

SEQ ID NO: 1171552 - RNA, 21 nt, Mycobacterium bovis subsp bovis AF2122/97
acgccagugaacgcgcgugca

SEQ ID NO: 1171553 - RNA, 23 nt, Mycobacterium bovis subsp bovis AF2122/97
acgccagugaacgcgcgugcagc

SEQ ID NO: 1171554 - RNA, 16 nt, Mycobacterium bovis subsp bovis AF2122/97
acgccaguguugcgcu

SEQ ID NO: 1171555 - RNA, 22 nt, Mycobacterium bovis subsp bovis AF2122/97
acgccaguguugcgcugcggcc

SEQ ID NO: 1171556 - RNA, 20 nt, Mycobacterium bovis subsp bovis AF2122/97
acgccaggggacccggggcc

SEQ ID NO: 1171557 - RNA, 17 nt, Mycobacterium bovis subsp bovis AF2122/97
acgccagccuggccauc

SEQ ID NO: 1171558 - RNA, 23 nt, Mycobacterium bovis subsp bovis AF2122/97
acgccagaacguggccauccucg

SEQ ID NO: 1171559 - RNA, 13 nt, Mycobacterium bovis subsp bovis AF2122/97
acgccacugccag

SEQ ID NO: 1171560 - RNA, 18 nt, Mycobacterium bovis subsp bovis AF2122/97
acgccacggcaucggcca

SEQ ID NO: 1171561 - RNA, 21 nt, Mycobacterium bovis subsp bovis AF2122/97
acgccaccgccaccacccagg

SEQ ID NO: 1171562 - RNA, 15 nt, Mycobacterium bovis subsp bovis AF2122/97
acgccaccggcaauc

SEQ ID NO: 1171563 - RNA, 17 nt, Mycobacterium bovis subsp bovis AF2122/97
acgccaccaccuccgcg

SEQ ID NO: 1171564 - RNA, 13 nt, Mycobacterium bovis subsp bovis AF2122/97
acgccacccaggg

SEQ ID NO: 1171565 - RNA, 15 nt, Mycobacterium bovis subsp bovis AF2122/97
acgccacccagggcc

SEQ ID NO: 1171566 - RNA, 17 nt, Mycobacterium bovis subsp bovis AF2122/97
acgccaacaccggcauc

SEQ ID NO: 1171567 - RNA, 15 nt, Mycobacterium bovis subsp bovis AF2122/97
acgccaacgccagcg

SEQ ID NO: 1171568 - RNA, 15 nt, Mycobacterium bovis subsp bovis AF2122/97
acgcaugggccaggu

SEQ ID NO: 1171569 - RNA, 13 nt, Mycobacterium bovis subsp bovis AF2122/97
acgcaugagggca

SEQ ID NO: 1171570 - RNA, 20 nt, Mycobacterium bovis subsp bovis AF2122/97
acgcaugcgagaacgucgag

SEQ ID NO: 1171571 - RNA, 19 nt, Mycobacterium bovis subsp bovis AF2122/97
acgcaugucgggccaggcg

SEQ ID NO: 1171572 - RNA, 15 nt, Mycobacterium bovis subsp bovis AF2122/97
acgcugcgcccggac

SEQ ID NO: 1171573 - RNA, 16 nt, Mycobacterium bovis subsp bovis AF2122/97
acgcugacgugaagca

SEQ ID NO: 1171574 - RNA, 22 nt, Mycobacterium bovis subsp bovis AF2122/97
acgcuucggcagcucccgccac

SEQ ID NO: 1171575 - RNA, 22 nt, Mycobacterium bovis subsp bovis AF2122/97
acgcuucuuccgcgcgccggcg

SEQ ID NO: 1171576 - RNA, 18 nt, Mycobacterium bovis subsp bovis AF2122/97
acggaggugccggcgcca

SEQ ID NO: 1171577 - RNA, 22 nt, Mycobacterium bovis subsp bovis AF2122/97
acggcacccgaaaacugacccc

SEQ ID NO: 1171578 - RNA, 17 nt, Mycobacterium bovis subsp bovis AF2122/97
acggauaacccguggcg

SEQ ID NO: 1171579 - RNA, 21 nt, Mycobacterium bovis subsp bovis AF2122/97
acggcaccauguacaggcugu

SEQ ID NO: 1171580 - RNA, 14 nt, Mycobacterium bovis subsp bovis AF2122/97
acggcacuagcccg

SEQ ID NO: 1171581 - RNA, 15 nt, Mycobacterium bovis subsp bovis AF2122/97
acggcagaccauggu

SEQ ID NO: 1171582 - RNA, 14 nt, Mycobacterium bovis subsp bovis AF2122/97
acggcagaccaugg

SEQ ID NO: 1171583 - RNA, 13 nt, Mycobacterium bovis subsp bovis AF2122/97
acggcagccagcc

SEQ ID NO: 1171584 - RNA, 14 nt, Mycobacterium bovis subsp bovis AF2122/97
acggcagcccgggc

SEQ ID NO: 1171585 - RNA, 19 nt, Mycobacterium bovis subsp bovis AF2122/97
acggagccgccggcgguga

SEQ ID NO: 1171586 - RNA, 13 nt, Mycobacterium bovis subsp bovis AF2122/97
acggagggcagga

SEQ ID NO: 1171587 - RNA, 15 nt, Mycobacterium bovis subsp bovis AF2122/97
acggagaccguggau

SEQ ID NO: 1171588 - RNA, 15 nt, Mycobacterium bovis subsp bovis AF2122/97
acggcgauggcgcgc

SEQ ID NO: 1171589 - RNA, 17 nt, Mycobacterium bovis subsp bovis AF2122/97
acggcauguaccgaccg

SEQ ID NO: 1171590 - RNA, 15 nt, Mycobacterium bovis subsp bovis AF2122/97
acggcaucggccacc

SEQ ID NO: 1171591 - RNA, 22 nt, Mycobacterium bovis subsp bovis AF2122/97
acggcaucugaaaauugacccc

SEQ ID NO: 1171592 - RNA, 23 nt, Mycobacterium bovis subsp bovis AF2122/97
acggcgccgaacccgguguugag

SEQ ID NO: 1171593 - RNA, 19 nt, Mycobacterium bovis subsp bovis AF2122/97
acggcgccgacccgaucac

SEQ ID NO: 1171594 - RNA, 14 nt, Mycobacterium bovis subsp bovis AF2122/97
acggcgccgaaccc

SEQ ID NO: 1171595 - RNA, 16 nt, Mycobacterium bovis subsp bovis AF2122/97
acggcgccgaacccgg

SEQ ID NO: 1171596 - RNA, 21 nt, Mycobacterium bovis subsp bovis AF2122/97
acggcgccaggcaccacgacc

SEQ ID NO: 1171597 - RNA, 18 nt, Mycobacterium bovis subsp bovis AF2122/97
acggcgcccauagcaccu

SEQ ID NO: 1171598 - RNA, 19 nt, Mycobacterium bovis subsp bovis AF2122/97
acggcgcucggcgagcuca

SEQ ID NO: 1171599 - RNA, 15 nt, Mycobacterium bovis subsp bovis AF2122/97
acggcguccaagaac

SEQ ID NO: 1171600 - RNA, 19 nt, Mycobacterium bovis subsp bovis AF2122/97
acggcgucggccaccgccu

SEQ ID NO: 1171601 - RNA, 21 nt, Mycobacterium bovis subsp bovis AF2122/97
acggcgucuuccucggccacc

SEQ ID NO: 1171602 - RNA, 19 nt, Mycobacterium bovis subsp bovis AF2122/97
acggcguggucggcaaagc

SEQ ID NO: 1171603 - RNA, 17 nt, Mycobacterium bovis subsp bovis AF2122/97
acggcguugaucagugc

SEQ ID NO: 1171604 - RNA, 16 nt, Mycobacterium bovis subsp bovis AF2122/97
acggcguugccggaga

SEQ ID NO: 1171605 - RNA, 21 nt, Mycobacterium bovis subsp bovis AF2122/97
acggcguugcggaaucagcac

SEQ ID NO: 1171606 - RNA, 20 nt, Mycobacterium bovis subsp bovis AF2122/97
acggcguuuucaauuucacu

SEQ ID NO: 1171607 - RNA, 14 nt, Mycobacterium bovis subsp bovis AF2122/97
acggcuccuccggu

SEQ ID NO: 1171608 - RNA, 17 nt, Mycobacterium bovis subsp bovis AF2122/97
acggcuccuccgguauc

SEQ ID NO: 1171609 - RNA, 21 nt, Mycobacterium bovis subsp bovis AF2122/97
acggcugaccggggucggccu

SEQ ID NO: 1171610 - RNA, 23 nt, Mycobacterium bovis subsp bovis AF2122/97
acggcugaccuucucacgcacca

SEQ ID NO: 1171611 - RNA, 18 nt, Mycobacterium bovis subsp bovis AF2122/97
acggcugcggaacggguc

SEQ ID NO: 1171612 - RNA, 20 nt, Mycobacterium bovis subsp bovis AF2122/97
acggcuuccaacucggcggc

SEQ ID NO: 1171613 - RNA, 20 nt, Mycobacterium bovis subsp bovis AF2122/97
acggcuuggcugccuccauc

SEQ ID NO: 1171614 - RNA, 15 nt, Mycobacterium bovis subsp bovis AF2122/97
acggcuuggcugccu

SEQ ID NO: 1171615 - RNA, 18 nt, Mycobacterium bovis subsp bovis AF2122/97
acgcguugcacagcagcg

SEQ ID NO: 1171616 - RNA, 20 nt, Mycobacterium bovis subsp bovis AF2122/97
acgcguggcauccagcagcg

SEQ ID NO: 1171617 - RNA, 21 nt, Mycobacterium bovis subsp bovis AF2122/97
acgcguucaacaccgccgacc

SEQ ID NO: 1171618 - RNA, 17 nt, Mycobacterium bovis subsp bovis AF2122/97
acgcgucgugccacuuc

SEQ ID NO: 1171619 - RNA, 16 nt, Mycobacterium bovis subsp bovis AF2122/97
acgcguauucggcauc

SEQ ID NO: 1171620 - RNA, 13 nt, Mycobacterium bovis subsp bovis AF2122/97
acgcucacgcugc

SEQ ID NO: 1171621 - RNA, 13 nt, Mycobacterium bovis subsp bovis AF2122/97
acgcuaaagcccc

SEQ ID NO: 1171622 - RNA, 13 nt, Mycobacterium bovis subsp bovis AF2122/97
acgcuaccgccgg

SEQ ID NO: 1171623 - RNA, 17 nt, Mycobacterium bovis subsp bovis AF2122/97
acgcucaguuuggccug

SEQ ID NO: 1171624 - RNA, 14 nt, Mycobacterium bovis subsp bovis AF2122/97
acgcucaugaccgc

SEQ ID NO: 1171625 - RNA, 16 nt, Mycobacterium bovis subsp bovis AF2122/97
acgcucgcugcagcag

SEQ ID NO: 1171626 - RNA, 17 nt, Mycobacterium bovis subsp bovis AF2122/97
acgcucugcgccacagc

SEQ ID NO: 1171627 - RNA, 18 nt, Mycobacterium bovis subsp bovis AF2122/97
acgcugacgcccucauag

SEQ ID NO: 1171628 - RNA, 19 nt, Mycobacterium bovis subsp bovis AF2122/97
acgcucggcguccgcccag

SEQ ID NO: 1171629 - RNA, 21 nt, Mycobacterium bovis subsp bovis AF2122/97
acgcucggcgugucgggggcu

SEQ ID NO: 1171630 - RNA, 18 nt, Mycobacterium bovis subsp bovis AF2122/97
acgcucgggcgcgcucgu

SEQ ID NO: 1171631 - RNA, 16 nt, Mycobacterium bovis subsp bovis AF2122/97
acgcucggcacggagu

SEQ ID NO: 1171632 - RNA, 20 nt, Mycobacterium bovis subsp bovis AF2122/97
acgcucggucgccaccgccg

SEQ ID NO: 1171633 - RNA, 19 nt, Mycobacterium bovis subsp bovis AF2122/97
acgcgaccgcgauccccac

SEQ ID NO: 1171634 - RNA, 17 nt, Mycobacterium bovis subsp bovis AF2122/97
acgcgagugcgugaucu

SEQ ID NO: 1171635 - RNA, 15 nt, Mycobacterium bovis subsp bovis AF2122/97
acgcgaucagcgcgc

SEQ ID NO: 1171636 - RNA, 20 nt, Mycobacterium bovis subsp bovis AF2122/97
acgcgcaacgccgccagccu

SEQ ID NO: 1171637 - RNA, 20 nt, Mycobacterium bovis subsp bovis AF2122/97
acgcgaugaccgcaccgacc

SEQ ID NO: 1171638 - RNA, 11 nt, Mycobacterium bovis subsp bovis AF2122/97
acgcgcaugcc

SEQ ID NO: 1171639 - RNA, 17 nt, Mycobacterium bovis subsp bovis AF2122/97
acgcgcccgcaccaccg

SEQ ID NO: 1171640 - RNA, 14 nt, Mycobacterium bovis subsp bovis AF2122/97
acgcgcucaccgac

SEQ ID NO: 1171641 - RNA, 12 nt, Mycobacterium bovis subsp bovis AF2122/97
acgcgcgcucgc

SEQ ID NO: 1171642 - RNA, 15 nt, Mycobacterium bovis subsp bovis AF2122/97
acgcggaucgggcac

SEQ ID NO: 1171643 - RNA, 12 nt, Mycobacterium bovis subsp bovis AF2122/97
acgcggacaccg

SEQ ID NO: 1171644 - RNA, 21 nt, Mycobacterium bovis subsp bovis AF2122/97
acgcggaucgggcaccccgac

SEQ ID NO: 1171645 - RNA, 21 nt, Mycobacterium bovis subsp bovis AF2122/97
acgcggggcucaaccccgucc

SEQ ID NO: 1171646 - RNA, 20 nt, Mycobacterium bovis subsp bovis AF2122/97
acgcggucugcuccaggcgc

SEQ ID NO: 1171647 - RNA, 16 nt, Mycobacterium bovis subsp bovis AF2122/97
acgcgguccucgagcc

SEQ ID NO: 1171648 - RNA, 13 nt, Mycobacterium bovis subsp bovis AF2122/97
acguguucugguc

SEQ ID NO: 1171649 - RNA, 21 nt, Mycobacterium bovis subsp bovis AF2122/97
acguggggccggggucggccc

SEQ ID NO: 1171650 - RNA, 18 nt, Mycobacterium bovis subsp bovis AF2122/97
acguggucggagcgggug

SEQ ID NO: 1171651 - RNA, 16 nt, Mycobacterium bovis subsp bovis AF2122/97
acguggugggcuuggc

SEQ ID NO: 1171652 - RNA, 17 nt, Mycobacterium bovis subsp bovis AF2122/97
acguggugggcuuggcu

SEQ ID NO: 1171653 - RNA, 15 nt, Mycobacterium bovis subsp bovis AF2122/97
acguguuaaccgggc

SEQ ID NO: 1171654 - RNA, 21 nt, Mycobacterium bovis subsp bovis AF2122/97
acgugugcaccaucaucaccu

SEQ ID NO: 1171655 - RNA, 15 nt, Mycobacterium bovis subsp bovis AF2122/97
acgugucccgcaugc

SEQ ID NO: 1171656 - RNA, 16 nt, Mycobacterium bovis subsp bovis AF2122/97
acguggccacggcauu

SEQ ID NO: 1171657 - RNA, 16 nt, Mycobacterium bovis subsp bovis AF2122/97
acgugcacggcgaggu

SEQ ID NO: 1171658 - RNA, 19 nt, Mycobacterium bovis subsp bovis AF2122/97
acgugauguagcugcaggu

SEQ ID NO: 1171659 - RNA, 15 nt, Mycobacterium bovis subsp bovis AF2122/97
acgugcacaggcauc

SEQ ID NO: 1171660 - RNA, 21 nt, Mycobacterium bovis subsp bovis AF2122/97
acgugcaaccacggcggcauc

SEQ ID NO: 1171661 - RNA, 23 nt, Mycobacterium bovis subsp bovis AF2122/97
acgugaucgcgguccaacagcgc

SEQ ID NO: 1171662 - RNA, 16 nt, Mycobacterium bovis subsp bovis AF2122/97
acgugaguuucaccac

SEQ ID NO: 1171663 - RNA, 15 nt, Mycobacterium bovis subsp bovis AF2122/97
acgucuggguugcgu

SEQ ID NO: 1171664 - RNA, 14 nt, Mycobacterium bovis subsp bovis AF2122/97
acguccaacagcgc

SEQ ID NO: 1171665 - RNA, 15 nt, Mycobacterium bovis subsp bovis AF2122/97
acgucugccaggcgc

SEQ ID NO: 1171666 - RNA, 18 nt, Mycobacterium bovis subsp bovis AF2122/97
acgugaauuaaggugacc

SEQ ID NO: 1171667 - RNA, 20 nt, Mycobacterium bovis subsp bovis AF2122/97
acgggaucgcccaggcgcga

SEQ ID NO: 1171668 - RNA, 14 nt, Mycobacterium bovis subsp bovis AF2122/97
acgggcagugaaca

SEQ ID NO: 1171669 - RNA, 19 nt, Mycobacterium bovis subsp bovis AF2122/97
acgggcacccgagccgcac

SEQ ID NO: 1171670 - RNA, 20 nt, Mycobacterium bovis subsp bovis AF2122/97
acgggauaaaacccggaauc

SEQ ID NO: 1171671 - RNA, 19 nt, Mycobacterium bovis subsp bovis AF2122/97
acguaggcggcggcccgca

SEQ ID NO: 1171672 - RNA, 15 nt, Mycobacterium bovis subsp bovis AF2122/97
acguaggcgcugaag

SEQ ID NO: 1171673 - RNA, 18 nt, Mycobacterium bovis subsp bovis AF2122/97
acguagcagcgccggcac

SEQ ID NO: 1171674 - RNA, 16 nt, Mycobacterium bovis subsp bovis AF2122/97
acguagacaaggccaa

SEQ ID NO: 1171675 - RNA, 15 nt, Mycobacterium bovis subsp bovis AF2122/97
acguaggacugccag

SEQ ID NO: 1171676 - RNA, 23 nt, Mycobacterium bovis subsp bovis AF2122/97
acguagccguacgguccgaacac

SEQ ID NO: 1171677 - RNA, 15 nt, Mycobacterium bovis subsp bovis AF2122/97
acguagauguugccg

SEQ ID NO: 1171678 - RNA, 13 nt, Mycobacterium bovis subsp bovis AF2122/97
acgucagugcccc

SEQ ID NO: 1171679 - RNA, 13 nt, Mycobacterium bovis subsp bovis AF2122/97
acgucaugcaggg

SEQ ID NO: 1171680 - RNA, 21 nt, Mycobacterium bovis subsp bovis AF2122/97
acgucauaucucgagcccucg

SEQ ID NO: 1171681 - RNA, 21 nt, Mycobacterium bovis subsp bovis AF2122/97
acgucacgucgacggcggccg

SEQ ID NO: 1171682 - RNA, 18 nt, Mycobacterium bovis subsp bovis AF2122/97
acgucacguggucggcca

SEQ ID NO: 1171683 - RNA, 20 nt, Mycobacterium bovis subsp bovis AF2122/97
acgucacccccuucacccuc

SEQ ID NO: 1171684 - RNA, 16 nt, Mycobacterium bovis subsp bovis AF2122/97
acguauuucgcccccu

SEQ ID NO: 1171685 - RNA, 16 nt, Mycobacterium bovis subsp bovis AF2122/97
acgucaaacgcaaaga

SEQ ID NO: 1171686 - RNA, 12 nt, Mycobacterium bovis subsp bovis AF2122/97
acguugcagccg

SEQ ID NO: 1171687 - RNA, 21 nt, Mycobacterium bovis subsp bovis AF2122/97
acguugacguccaacagcgcu

SEQ ID NO: 1171688 - RNA, 14 nt, Mycobacterium bovis subsp bovis AF2122/97
acguucggcacaac

SEQ ID NO: 1171689 - RNA, 17 nt, Mycobacterium bovis subsp bovis AF2122/97
acguucggcacaaccaa

SEQ ID NO: 1171690 - RNA, 14 nt, Mycobacterium bovis subsp bovis AF2122/97
acuaacaacaccac

SEQ ID NO: 1171691 - RNA, 16 nt, Mycobacterium bovis subsp bovis AF2122/97
acuaacaacaccacca

SEQ ID NO: 1171692 - RNA, 16 nt, Mycobacterium bovis subsp bovis AF2122/97
acuaacggcagccacc

SEQ ID NO: 1171693 - RNA, 16 nt, Mycobacterium bovis subsp bovis AF2122/97
acuaagggcacuccac

SEQ ID NO: 1171694 - RNA, 19 nt, Mycobacterium bovis subsp bovis AF2122/97
acuagccgauccagcaggc

SEQ ID NO: 1171695 - RNA, 16 nt, Mycobacterium bovis subsp bovis AF2122/97
acuagguucagcgacu

SEQ ID NO: 1171696 - RNA, 21 nt, Mycobacterium bovis subsp bovis AF2122/97
acuaggcuuuccggggaauga

SEQ ID NO: 1171697 - RNA, 14 nt, Mycobacterium bovis subsp bovis AF2122/97
acuaggcccagcac

SEQ ID NO: 1171698 - RNA, 14 nt, Mycobacterium bovis subsp bovis AF2122/97
acuagcagcgggcu

SEQ ID NO: 1171699 - RNA, 16 nt, Mycobacterium bovis subsp bovis AF2122/97
acuagcagcgggcugc

SEQ ID NO: 1171700 - RNA, 20 nt, Mycobacterium bovis subsp bovis AF2122/97
acuagacgccgccgcugccg

SEQ ID NO: 1171701 - RNA, 14 nt, Mycobacterium bovis subsp bovis AF2122/97
acuacggugcccug

SEQ ID NO: 1171702 - RNA, 21 nt, Mycobacterium bovis subsp bovis AF2122/97
acuccaguccuaucagugagc

SEQ ID NO: 1171703 - RNA, 21 nt, Mycobacterium bovis subsp bovis AF2122/97
acuccaugaaucgcgcuucag

SEQ ID NO: 1171704 - RNA, 22 nt, Mycobacterium bovis subsp bovis AF2122/97
acuccaugaaucgcgcuucagg

SEQ ID NO: 1171705 - RNA, 22 nt, Mycobacterium bovis subsp bovis AF2122/97
acuccaugagccguagugcaau

SEQ ID NO: 1171706 - RNA, 13 nt, Mycobacterium bovis subsp bovis AF2122/97
acuccauggcauu

SEQ ID NO: 1171707 - RNA, 15 nt, Mycobacterium bovis subsp bovis AF2122/97
acuccagcacccgcu

SEQ ID NO: 1171708 - RNA, 11 nt, Mycobacterium bovis subsp bovis AF2122/97
acuccagcacc

SEQ ID NO: 1171709 - RNA, 19 nt, Mycobacterium bovis subsp bovis AF2122/97
acuccagcaaggccagcac

SEQ ID NO: 1171710 - RNA, 14 nt, Mycobacterium bovis subsp bovis AF2122/97
acuccagcaccagc

SEQ ID NO: 1171711 - RNA, 16 nt, Mycobacterium bovis subsp bovis AF2122/97
acuccagcaccagcac

SEQ ID NO: 1171712 - RNA, 20 nt, Mycobacterium bovis subsp bovis AF2122/97
acuccaagucacagcucacc

SEQ ID NO: 1171713 - RNA, 20 nt, Mycobacterium bovis subsp bovis AF2122/97
acuccacgaucggcccagcc

SEQ ID NO: 1171714 - RNA, 17 nt, Mycobacterium bovis subsp bovis AF2122/97
acuccaccgcuggcccg

SEQ ID NO: 1171715 - RNA, 16 nt, Mycobacterium bovis subsp bovis AF2122/97
acuccaccccacccag

SEQ ID NO: 1171716 - RNA, 13 nt, Mycobacterium bovis subsp bovis AF2122/97
acucauagaccag

SEQ ID NO: 1171717 - RNA, 17 nt, Mycobacterium bovis subsp bovis AF2122/97
acucaucagagcgcugg

SEQ ID NO: 1171718 - RNA, 18 nt, Mycobacterium bovis subsp bovis AF2122/97
acucaucgugguaaccau

SEQ ID NO: 1171719 - RNA, 14 nt, Mycobacterium bovis subsp bovis AF2122/97
acucacggugaucg

SEQ ID NO: 1171720 - RNA, 22 nt, Mycobacterium bovis subsp bovis AF2122/97
acucacgaggcacaaucaccgc

SEQ ID NO: 1171721 - RNA, 22 nt, Mycobacterium bovis subsp bovis AF2122/97
acucacucgguguuucgugcca

SEQ ID NO: 1171722 - RNA, 19 nt, Mycobacterium bovis subsp bovis AF2122/97
acucagaacguggccguua

SEQ ID NO: 1171723 - RNA, 14 nt, Mycobacterium bovis subsp bovis AF2122/97
acucagucugggga

SEQ ID NO: 1171724 - RNA, 17 nt, Mycobacterium bovis subsp bovis AF2122/97
acucaguguuccgccac

SEQ ID NO: 1171725 - RNA, 12 nt, Mycobacterium bovis subsp bovis AF2122/97
acuaugccaacg

SEQ ID NO: 1171726 - RNA, 15 nt, Mycobacterium bovis subsp bovis AF2122/97
acucacauuggccag

SEQ ID NO: 1171727 - RNA, 18 nt, Mycobacterium bovis subsp bovis AF2122/97
acucacauuggccagguc

SEQ ID NO: 1171728 - RNA, 13 nt, Mycobacterium bovis subsp bovis AF2122/97
acucaccagcacc

SEQ ID NO: 1171729 - RNA, 22 nt, Mycobacterium bovis subsp bovis AF2122/97
acucacccgagccaucaccgca

SEQ ID NO: 1171730 - RNA, 22 nt, Mycobacterium bovis subsp bovis AF2122/97
acucacccgggcagccugcugc

SEQ ID NO: 1171731 - RNA, 15 nt, Mycobacterium bovis subsp bovis AF2122/97
acucaccgugaaccg

SEQ ID NO: 1171732 - RNA, 12 nt, Mycobacterium bovis subsp bovis AF2122/97
acucgcgcagga

SEQ ID NO: 1171733 - RNA, 15 nt, Mycobacterium bovis subsp bovis AF2122/97
acucgcgcagguagc

SEQ ID NO: 1171734 - RNA, 21 nt, Mycobacterium bovis subsp bovis AF2122/97
acucgccggcgaauccgcaca

SEQ ID NO: 1171735 - RNA, 15 nt, Mycobacterium bovis subsp bovis AF2122/97
acuccgaucgggccc

SEQ ID NO: 1171736 - RNA, 18 nt, Mycobacterium bovis subsp bovis AF2122/97
acucgccacucagcccga

SEQ ID NO: 1171737 - RNA, 20 nt, Mycobacterium bovis subsp bovis AF2122/97
acuccgccgauagcaccgga

SEQ ID NO: 1171738 - RNA, 12 nt, Mycobacterium bovis subsp bovis AF2122/97
acuccccagaca

SEQ ID NO: 1171739 - RNA, 14 nt, Mycobacterium bovis subsp bovis AF2122/97
acuccccagcccca

SEQ ID NO: 1171740 - RNA, 16 nt, Mycobacterium bovis subsp bovis AF2122/97
acucccggcucggcca

SEQ ID NO: 1171741 - RNA, 24 nt, Mycobacterium bovis subsp bovis AF2122/97
acucccggcucggccagccagcgg

SEQ ID NO: 1171742 - RNA, 15 nt, Mycobacterium bovis subsp bovis AF2122/97
acucccgagccacaa

SEQ ID NO: 1171743 - RNA, 23 nt, Mycobacterium bovis subsp bovis AF2122/97
acucccucgaucacggcggcccc

SEQ ID NO: 1171744 - RNA, 18 nt, Mycobacterium bovis subsp bovis AF2122/97
acucccuggccgcuucga

SEQ ID NO: 1171745 - RNA, 12 nt, Mycobacterium bovis subsp bovis AF2122/97
acucggugaucg

SEQ ID NO: 1171746 - RNA, 15 nt, Mycobacterium bovis subsp bovis AF2122/97
acucgggcaaugucg

SEQ ID NO: 1171747 - RNA, 14 nt, Mycobacterium bovis subsp bovis AF2122/97
acucgcggccggcg

SEQ ID NO: 1171748 - RNA, 17 nt, Mycobacterium bovis subsp bovis AF2122/97
acucgggcaggccccac

SEQ ID NO: 1171749 - RNA, 15 nt, Mycobacterium bovis subsp bovis AF2122/97
acucggcggaagacc

SEQ ID NO: 1171750 - RNA, 14 nt, Mycobacterium bovis subsp bovis AF2122/97
acucggcggccacc

SEQ ID NO: 1171751 - RNA, 14 nt, Mycobacterium bovis subsp bovis AF2122/97
acucgucgcugccc

SEQ ID NO: 1171752 - RNA, 12 nt, Mycobacterium bovis subsp bovis AF2122/97
acucguagaacg

SEQ ID NO: 1171753 - RNA, 14 nt, Mycobacterium bovis subsp bovis AF2122/97
acucuccccuggcc

SEQ ID NO: 1171754 - RNA, 18 nt, Mycobacterium bovis subsp bovis AF2122/97
acucuuguccagaaucca

SEQ ID NO: 1171755 - RNA, 16 nt, Mycobacterium bovis subsp bovis AF2122/97
acucuucggaccggcu

SEQ ID NO: 1171756 - RNA, 23 nt, Mycobacterium bovis subsp bovis AF2122/97
acugaccgucugcgacccgggcc

SEQ ID NO: 1171757 - RNA, 14 nt, Mycobacterium bovis subsp bovis AF2122/97
acugaccaggucug

SEQ ID NO: 1171758 - RNA, 15 nt, Mycobacterium bovis subsp bovis AF2122/97
acugaccaggucugc

SEQ ID NO: 1171759 - RNA, 14 nt, Mycobacterium bovis subsp bovis AF2122/97
acaaaggugccgac

SEQ ID NO: 1171760 - RNA, 12 nt, Mycobacterium bovis subsp bovis AF2122/97
acaaagaagugg

SEQ ID NO: 1171761 - RNA, 21 nt, Mycobacterium bovis subsp bovis AF2122/97
acaaacggcuuggcugccucc

SEQ ID NO: 1171762 - RNA, 15 nt, Mycobacterium bovis subsp bovis AF2122/97
acaaacggcgaccca

SEQ ID NO: 1171763 - RNA, 16 nt, Mycobacterium bovis subsp bovis AF2122/97
acaaacaucgcaccca

SEQ ID NO: 1171764 - RNA, 17 nt, Mycobacterium bovis subsp bovis AF2122/97
acaaaccugcaugccca

SEQ ID NO: 1171765 - RNA, 15 nt, Mycobacterium bovis subsp bovis AF2122/97
acaaacccgaugacu

SEQ ID NO: 1171766 - RNA, 23 nt, Mycobacterium bovis subsp bovis AF2122/97
acaaaccgugcacgucagcggau

SEQ ID NO: 1171767 - RNA, 23 nt, Mycobacterium bovis subsp bovis AF2122/97
acaaacaucgcacccaccacacc

SEQ ID NO: 1171768 - RNA, 20 nt, Mycobacterium bovis subsp bovis AF2122/97
acaaacaucgcacccaccac

SEQ ID NO: 1171769 - RNA, 12 nt, Mycobacterium bovis subsp bovis AF2122/97
acaacuccagca

SEQ ID NO: 1171770 - RNA, 13 nt, Mycobacterium bovis subsp bovis AF2122/97
acaacuccagcag

SEQ ID NO: 1171771 - RNA, 24 nt, Mycobacterium bovis subsp bovis AF2122/97
acaagcggcccgcuguggucuuca

SEQ ID NO: 1171772 - RNA, 17 nt, Mycobacterium bovis subsp bovis AF2122/97
acaagcgauggcaccac

SEQ ID NO: 1171773 - RNA, 12 nt, Mycobacterium bovis subsp bovis AF2122/97
acaagcccagcc

SEQ ID NO: 1171774 - RNA, 22 nt, Mycobacterium bovis subsp bovis AF2122/97
acaagaccggcgggcagauggu

SEQ ID NO: 1171775 - RNA, 14 nt, Mycobacterium bovis subsp bovis AF2122/97
acaacgcccaccac

SEQ ID NO: 1171776 - RNA, 18 nt, Mycobacterium bovis subsp bovis AF2122/97
acaacgcgugaccagggc

SEQ ID NO: 1171777 - RNA, 19 nt, Mycobacterium bovis subsp bovis AF2122/97
acaacgcgugaccagggcc

SEQ ID NO: 1171778 - RNA, 20 nt, Mycobacterium bovis subsp bovis AF2122/97
acaaccgugagcaccagcag

SEQ ID NO: 1171779 - RNA, 15 nt, Mycobacterium bovis subsp bovis AF2122/97
acaaccgcugcugcu

SEQ ID NO: 1171780 - RNA, 23 nt, Mycobacterium bovis subsp bovis AF2122/97
acaacccggcgucgacgauuccc

SEQ ID NO: 1171781 - RNA, 17 nt, Mycobacterium bovis subsp bovis AF2122/97
acaaccuggggccacca

SEQ ID NO: 1171782 - RNA, 14 nt, Mycobacterium bovis subsp bovis AF2122/97
acaacaucacugcc

SEQ ID NO: 1171783 - RNA, 10 nt, Mycobacterium bovis subsp bovis AF2122/97
acaacaugcu

SEQ ID NO: 1171784 - RNA, 13 nt, Mycobacterium bovis subsp bovis AF2122/97
acaaccacccacc

SEQ ID NO: 1171785 - RNA, 20 nt, Mycobacterium bovis subsp bovis AF2122/97
acaaccacggcagauugacg

SEQ ID NO: 1171786 - RNA, 12 nt, Mycobacterium bovis subsp bovis AF2122/97
acaaaaucagca

SEQ ID NO: 1171787 - RNA, 14 nt, Mycobacterium bovis subsp bovis AF2122/97
acaaaaucagcagc

SEQ ID NO: 1171788 - RNA, 16 nt, Mycobacterium bovis subsp bovis AF2122/97
acaaacaccccacaca

SEQ ID NO: 1171789 - RNA, 17 nt, Mycobacterium bovis subsp bovis AF2122/97
aauuucgauuucccaug

SEQ ID NO: 1171790 - RNA, 20 nt, Mycobacterium bovis subsp bovis AF2122/97
aauuucgauuucccaugcaa

SEQ ID NO: 1171791 - RNA, 18 nt, Mycobacterium bovis subsp bovis AF2122/97
aauuucguuggauccaca

SEQ ID NO: 1171792 - RNA, 14 nt, Mycobacterium bovis subsp bovis AF2122/97
acacagcaugguua

SEQ ID NO: 1171793 - RNA, 22 nt, Mycobacterium bovis subsp bovis AF2122/97
acacagcggcgggucccgccac

SEQ ID NO: 1171794 - RNA, 15 nt, Mycobacterium bovis subsp bovis AF2122/97
acacagccgcgcugc

SEQ ID NO: 1171795 - RNA, 14 nt, Mycobacterium bovis subsp bovis AF2122/97
acacagccgguggc

SEQ ID NO: 1171796 - RNA, 19 nt, Mycobacterium bovis subsp bovis AF2122/97
acacagccgucgcaccaga

SEQ ID NO: 1171797 - RNA, 13 nt, Mycobacterium bovis subsp bovis AF2122/97
acacaggacuugu

SEQ ID NO: 1171798 - RNA, 22 nt, Mycobacterium bovis subsp bovis AF2122/97
acacaggacuuguccaucacau

SEQ ID NO: 1171799 - RNA, 17 nt, Mycobacterium bovis subsp bovis AF2122/97
acacaucgucacugcca

SEQ ID NO: 1171800 - RNA, 18 nt, Mycobacterium bovis subsp bovis AF2122/97
acaauuccacaaauccaa

SEQ ID NO: 1171801 - RNA, 19 nt, Mycobacterium bovis subsp bovis AF2122/97
acaauuccacaaauccaaa

SEQ ID NO: 1171802 - RNA, 20 nt, Mycobacterium bovis subsp bovis AF2122/97
acaauucacgcaccacaaac

SEQ ID NO: 1171803 - RNA, 14 nt, Mycobacterium bovis subsp bovis AF2122/97
acaaugccagcugu

SEQ ID NO: 1171804 - RNA, 22 nt, Mycobacterium bovis subsp bovis AF2122/97
acaaggcaaaggaugaugaaca

SEQ ID NO: 1171805 - RNA, 12 nt, Mycobacterium bovis subsp bovis AF2122/97
acaagcugacac

SEQ ID NO: 1171806 - RNA, 15 nt, Mycobacterium bovis subsp bovis AF2122/97
acaaguuuauggucu

SEQ ID NO: 1171807 - RNA, 16 nt, Mycobacterium bovis subsp bovis AF2122/97
acaaucgcacgcugcu

SEQ ID NO: 1171808 - RNA, 16 nt, Mycobacterium bovis subsp bovis AF2122/97
acaauaggcuccagcg

SEQ ID NO: 1171809 - RNA, 17 nt, Mycobacterium bovis subsp bovis AF2122/97
acaauaggcuccagcgc

SEQ ID NO: 1171810 - RNA, 12 nt, Mycobacterium bovis subsp bovis AF2122/97
acaccugcggcu

SEQ ID NO: 1171811 - RNA, 18 nt, Mycobacterium bovis subsp bovis AF2122/97
acaccucgggguuacguu

SEQ ID NO: 1171812 - RNA, 14 nt, Mycobacterium bovis subsp bovis AF2122/97
acaccuccucgagc

SEQ ID NO: 1171813 - RNA, 19 nt, Mycobacterium bovis subsp bovis AF2122/97
acaccuccgucagcgccgc

SEQ ID NO: 1171814 - RNA, 14 nt, Mycobacterium bovis subsp bovis AF2122/97
acaccuuucuccac

SEQ ID NO: 1171815 - RNA, 12 nt, Mycobacterium bovis subsp bovis AF2122/97
acacgccaggug

SEQ ID NO: 1171816 - RNA, 14 nt, Mycobacterium bovis subsp bovis AF2122/97
acacgaugcccggc

SEQ ID NO: 1171817 - RNA, 13 nt, Mycobacterium bovis subsp bovis AF2122/97
acacgaccucuug

SEQ ID NO: 1171818 - RNA, 17 nt, Mycobacterium bovis subsp bovis AF2122/97
acacgaauccggccacu

SEQ ID NO: 1171819 - RNA, 13 nt, Mycobacterium bovis subsp bovis AF2122/97
acaccggcaagcc

SEQ ID NO: 1171820 - RNA, 13 nt, Mycobacterium bovis subsp bovis AF2122/97
acaccgggcacca

SEQ ID NO: 1171821 - RNA, 14 nt, Mycobacterium bovis subsp bovis AF2122/97
acaccggggcggcc

SEQ ID NO: 1171822 - RNA, 16 nt, Mycobacterium bovis subsp bovis AF2122/97
acaccggcuggaaucu

SEQ ID NO: 1171823 - RNA, 17 nt, Mycobacterium bovis subsp bovis AF2122/97
acaccggcuuugcuugc

SEQ ID NO: 1171824 - RNA, 21 nt, Mycobacterium bovis subsp bovis AF2122/97
acaccggccugcgcgaccgac

SEQ ID NO: 1171825 - RNA, 24 nt, Mycobacterium bovis subsp bovis AF2122/97
acaccggccugcgcgaccgaccag

SEQ ID NO: 1171826 - RNA, 18 nt, Mycobacterium bovis subsp bovis AF2122/97
acaccgucggcagcagcg

SEQ ID NO: 1171827 - RNA, 16 nt, Mycobacterium bovis subsp bovis AF2122/97
acaccgugcgccgaau

SEQ ID NO: 1171828 - RNA, 17 nt, Mycobacterium bovis subsp bovis AF2122/97
acaccggugucggccag

SEQ ID NO: 1171829 - RNA, 20 nt, Mycobacterium bovis subsp bovis AF2122/97
acaccggugucggccagcaa

SEQ ID NO: 1171830 - RNA, 23 nt, Mycobacterium bovis subsp bovis AF2122/97
acaccgccagcggcaauggccag

SEQ ID NO: 1171831 - RNA, 17 nt, Mycobacterium bovis subsp bovis AF2122/97
acaccgacgccgccagg

SEQ ID NO: 1171832 - RNA, 24 nt, Mycobacterium bovis subsp bovis AF2122/97
acaccgagaagcugugccuucgcc

SEQ ID NO: 1171833 - RNA, 14 nt, Mycobacterium bovis subsp bovis AF2122/97
acaccgacacgccg

SEQ ID NO: 1171834 - RNA, 14 nt, Mycobacterium bovis subsp bovis AF2122/97
acaccgaguuccuc

SEQ ID NO: 1171835 - RNA, 18 nt, Mycobacterium bovis subsp bovis AF2122/97
acacccuugcccacggcg

SEQ ID NO: 1171836 - RNA, 15 nt, Mycobacterium bovis subsp bovis AF2122/97
acaccgaaccgccgc

SEQ ID NO: 1171837 - RNA, 22 nt, Mycobacterium bovis subsp bovis AF2122/97
acacccgucaugcccaccgccu

SEQ ID NO: 1171838 - RNA, 12 nt, Mycobacterium bovis subsp bovis AF2122/97
acacccugcagc

SEQ ID NO: 1171839 - RNA, 19 nt, Mycobacterium bovis subsp bovis AF2122/97
acaccccggccuugccacc

SEQ ID NO: 1171840 - RNA, 18 nt, Mycobacterium bovis subsp bovis AF2122/97
acacccccccccccaccc

SEQ ID NO: 1171841 - RNA, 19 nt, Mycobacterium bovis subsp bovis AF2122/97
acacccccccccccaccca

SEQ ID NO: 1171842 - RNA, 21 nt, Mycobacterium bovis subsp bovis AF2122/97
acacccauuacugagcuucca

SEQ ID NO: 1171843 - RNA, 14 nt, Mycobacterium bovis subsp bovis AF2122/97
acacccgcaccgga

SEQ ID NO: 1171844 - RNA, 12 nt, Mycobacterium bovis subsp bovis AF2122/97
acacccgccggu

SEQ ID NO: 1171845 - RNA, 22 nt, Mycobacterium bovis subsp bovis AF2122/97
acacccgccggucaaacugcca

SEQ ID NO: 1171846 - RNA, 15 nt, Mycobacterium bovis subsp bovis AF2122/97
acacccagcgugccc

SEQ ID NO: 1171847 - RNA, 23 nt, Mycobacterium bovis subsp bovis AF2122/97
acacccacgugcugccuuugcga

SEQ ID NO: 1171848 - RNA, 21 nt, Mycobacterium bovis subsp bovis AF2122/97
acaccagcuuguagcgcucgu

SEQ ID NO: 1171849 - RNA, 17 nt, Mycobacterium bovis subsp bovis AF2122/97
acaccagcaggcggcuc

SEQ ID NO: 1171850 - RNA, 16 nt, Mycobacterium bovis subsp bovis AF2122/97
acaccacgguuggcca

SEQ ID NO: 1171851 - RNA, 13 nt, Mycobacterium bovis subsp bovis AF2122/97
acaccaccauucc

SEQ ID NO: 1171852 - RNA, 14 nt, Mycobacterium bovis subsp bovis AF2122/97
acaccaccauuccc

SEQ ID NO: 1171853 - RNA, 14 nt, Mycobacterium bovis subsp bovis AF2122/97
acaccaacccaccc

SEQ ID NO: 1171854 - RNA, 21 nt, Mycobacterium bovis subsp bovis AF2122/97
acacauuucuuugggcggccc

SEQ ID NO: 1171855 - RNA, 13 nt, Mycobacterium bovis subsp bovis AF2122/97
acacggccuugcc

SEQ ID NO: 1171856 - RNA, 20 nt, Mycobacterium bovis subsp bovis AF2122/97
acacggcgcugcccacgccg

SEQ ID NO: 1171857 - RNA, 23 nt, Mycobacterium bovis subsp bovis AF2122/97
acacggcgucuuccucggccacc

SEQ ID NO: 1171858 - RNA, 12 nt, Mycobacterium bovis subsp bovis AF2122/97
acacggcagcug

SEQ ID NO: 1171859 - RNA, 18 nt, Mycobacterium bovis subsp bovis AF2122/97
acacggauacccuuugca

SEQ ID NO: 1171860 - RNA, 20 nt, Mycobacterium bovis subsp bovis AF2122/97
acacgcccuaacccugcccu

SEQ ID NO: 1171861 - RNA, 13 nt, Mycobacterium bovis subsp bovis AF2122/97
acacgccgccggu

SEQ ID NO: 1171862 - RNA, 21 nt, Mycobacterium bovis subsp bovis AF2122/97
acacgccggcccggugaugaa

SEQ ID NO: 1171863 - RNA, 13 nt, Mycobacterium bovis subsp bovis AF2122/97
acacgcgugcacc

SEQ ID NO: 1171864 - RNA, 19 nt, Mycobacterium bovis subsp bovis AF2122/97
acacguccgcgcaccgcag

SEQ ID NO: 1171865 - RNA, 23 nt, Mycobacterium bovis subsp bovis AF2122/97
acacgucgcggguaaccggcucc

SEQ ID NO: 1171866 - RNA, 20 nt, Mycobacterium bovis subsp bovis AF2122/97
acacgucgcgguaggcggga

SEQ ID NO: 1171867 - RNA, 12 nt, Mycobacterium bovis subsp bovis AF2122/97
acacgucggcca

SEQ ID NO: 1171868 - RNA, 13 nt, Mycobacterium bovis subsp bovis AF2122/97
acacguccagugg

SEQ ID NO: 1171869 - RNA, 14 nt, Mycobacterium bovis subsp bovis AF2122/97
acagcagcgcgaca

SEQ ID NO: 1171870 - RNA, 15 nt, Mycobacterium bovis subsp bovis AF2122/97
acagcaggcauuccc

SEQ ID NO: 1171871 - RNA, 16 nt, Mycobacterium bovis subsp bovis AF2122/97
acagcagguugccgaa

SEQ ID NO: 1171872 - RNA, 15 nt, Mycobacterium bovis subsp bovis AF2122/97
acagauaaggaccau

SEQ ID NO: 1171873 - RNA, 18 nt, Mycobacterium bovis subsp bovis AF2122/97
acagaccgggcaccagaa

SEQ ID NO: 1171874 - RNA, 15 nt, Mycobacterium bovis subsp bovis AF2122/97
acaguuuucaccgcg

SEQ ID NO: 1171875 - RNA, 21 nt, Mycobacterium bovis subsp bovis AF2122/97
acauaccccgaacauugcgcc

SEQ ID NO: 1171876 - RNA, 16 nt, Mycobacterium bovis subsp bovis AF2122/97
acauacgaaacaugcg

SEQ ID NO: 1171877 - RNA, 17 nt, Mycobacterium bovis subsp bovis AF2122/97
acauagaccucgccggu

SEQ ID NO: 1171878 - RNA, 17 nt, Mycobacterium bovis subsp bovis AF2122/97
acauagccggucauuuc

SEQ ID NO: 1171879 - RNA, 17 nt, Mycobacterium bovis subsp bovis AF2122/97
acauaggucacaaacgg

SEQ ID NO: 1171880 - RNA, 17 nt, Mycobacterium bovis subsp bovis AF2122/97
acauccgacagcagccg

SEQ ID NO: 1171881 - RNA, 19 nt, Mycobacterium bovis subsp bovis AF2122/97
acaucccccggcuggucac

SEQ ID NO: 1171882 - RNA, 18 nt, Mycobacterium bovis subsp bovis AF2122/97
acauccgcggcaugcaau

SEQ ID NO: 1171883 - RNA, 22 nt, Mycobacterium bovis subsp bovis AF2122/97
acauccgcggcaugcaaugcug

SEQ ID NO: 1171884 - RNA, 13 nt, Mycobacterium bovis subsp bovis AF2122/97
acauccugcagcu

SEQ ID NO: 1171885 - RNA, 22 nt, Mycobacterium bovis subsp bovis AF2122/97
acaucauggugaaggcaaacac

SEQ ID NO: 1171886 - RNA, 18 nt, Mycobacterium bovis subsp bovis AF2122/97
acaucauggugaaggcaa

SEQ ID NO: 1171887 - RNA, 15 nt, Mycobacterium bovis subsp bovis AF2122/97
acauccaucgccagu

SEQ ID NO: 1171888 - RNA, 14 nt, Mycobacterium bovis subsp bovis AF2122/97
acauccaucuccau

SEQ ID NO: 1171889 - RNA, 15 nt, Mycobacterium bovis subsp bovis AF2122/97
acaucaacuugccgc

SEQ ID NO: 1171890 - RNA, 14 nt, Mycobacterium bovis subsp bovis AF2122/97
acaucguucugacg

SEQ ID NO: 1171891 - RNA, 23 nt, Mycobacterium bovis subsp bovis AF2122/97
acaucgguggcgccgaacgccag

SEQ ID NO: 1171892 - RNA, 21 nt, Mycobacterium bovis subsp bovis AF2122/97
acaucggguucuucaacuccg

SEQ ID NO: 1171893 - RNA, 18 nt, Mycobacterium bovis subsp bovis AF2122/97
acaucgggaucugggcuc

SEQ ID NO: 1171894 - RNA, 15 nt, Mycobacterium bovis subsp bovis AF2122/97
acaucgucacugcca

SEQ ID NO: 1171895 - RNA, 16 nt, Mycobacterium bovis subsp bovis AF2122/97
acaucgugauccccgc

SEQ ID NO: 1171896 - RNA, 21 nt, Mycobacterium bovis subsp bovis AF2122/97
acaucggcccgaucaccaucc

SEQ ID NO: 1171897 - RNA, 14 nt, Mycobacterium bovis subsp bovis AF2122/97
acaucggcggcguc

SEQ ID NO: 1171898 - RNA, 15 nt, Mycobacterium bovis subsp bovis AF2122/97
acaucggaacgugac

SEQ ID NO: 1171899 - RNA, 18 nt, Mycobacterium bovis subsp bovis AF2122/97
acauguuuucgagcccaa

SEQ ID NO: 1171900 - RNA, 22 nt, Mycobacterium bovis subsp bovis AF2122/97
acauguuuucgagcccaagggg

SEQ ID NO: 1171901 - RNA, 16 nt, Mycobacterium bovis subsp bovis AF2122/97
acaugcgcaccauggg

SEQ ID NO: 1171902 - RNA, 20 nt, Mycobacterium bovis subsp bovis AF2122/97
acauucugcagcgucuccuu

SEQ ID NO: 1171903 - RNA, 18 nt, Mycobacterium bovis subsp bovis AF2122/97
acauugaccaggugcccg

SEQ ID NO: 1171904 - RNA, 23 nt, Mycobacterium bovis subsp bovis AF2122/97
acauucgggcgugcucgccgggu

SEQ ID NO: 1171905 - RNA, 15 nt, Mycobacterium bovis subsp bovis AF2122/97
acauugccggccacc

SEQ ID NO: 1171906 - RNA, 21 nt, Mycobacterium bovis subsp bovis AF2122/97
acauucauccaccccugagcu

SEQ ID NO: 1171907 - RNA, 22 nt, Mycobacterium bovis subsp bovis AF2122/97
acauucauccaccccugagcuc

SEQ ID NO: 1171908 - RNA, 22 nt, Mycobacterium bovis subsp bovis AF2122/97
accaaacccgaugguacucagg

SEQ ID NO: 1171909 - RNA, 20 nt, Mycobacterium bovis subsp bovis AF2122/97
accaaaccgcuguaaccggu

SEQ ID NO: 1171910 - RNA, 16 nt, Mycobacterium bovis subsp bovis AF2122/97
accaaacggauugcuc

SEQ ID NO: 1171911 - RNA, 20 nt, Mycobacterium bovis subsp bovis AF2122/97
accaaauccgcaaggaccug

SEQ ID NO: 1171912 - RNA, 14 nt, Mycobacterium bovis subsp bovis AF2122/97
acauuggccgucau

SEQ ID NO: 1171913 - RNA, 21 nt, Mycobacterium bovis subsp bovis AF2122/97
acauuggccgucaucgccggg

SEQ ID NO: 1171914 - RNA, 22 nt, Mycobacterium bovis subsp bovis AF2122/97
acauugguguggaauacgcugc

SEQ ID NO: 1171915 - RNA, 21 nt, Mycobacterium bovis subsp bovis AF2122/97
acauuggugcugacauuucca

SEQ ID NO: 1171916 - RNA, 13 nt, Mycobacterium bovis subsp bovis AF2122/97
acauugugcucgc

SEQ ID NO: 1171917 - RNA, 23 nt, Mycobacterium bovis subsp bovis AF2122/97
acauuucuuugggcggcccaccg

SEQ ID NO: 1171918 - RNA, 15 nt, Mycobacterium bovis subsp bovis AF2122/97
accacagugaaaucc

SEQ ID NO: 1171919 - RNA, 12 nt, Mycobacterium bovis subsp bovis AF2122/97
accacaccuucg

SEQ ID NO: 1171920 - RNA, 14 nt, Mycobacterium bovis subsp bovis AF2122/97
accacaccggcagc

SEQ ID NO: 1171921 - RNA, 16 nt, Mycobacterium bovis subsp bovis AF2122/97
accaaugucagugccc

SEQ ID NO: 1171922 - RNA, 13 nt, Mycobacterium bovis subsp bovis AF2122/97
accacaacgccag

SEQ ID NO: 1171923 - RNA, 14 nt, Mycobacterium bovis subsp bovis AF2122/97
accacaauccacgc

SEQ ID NO: 1171924 - RNA, 13 nt, Mycobacterium bovis subsp bovis AF2122/97
accaagcgcgcca

SEQ ID NO: 1171925 - RNA, 21 nt, Mycobacterium bovis subsp bovis AF2122/97
accaacacccccccccccacc

SEQ ID NO: 1171926 - RNA, 18 nt, Mycobacterium bovis subsp bovis AF2122/97
accaauaccgcacccgcu

SEQ ID NO: 1171927 - RNA, 19 nt, Mycobacterium bovis subsp bovis AF2122/97
accaaugaccgccagcagc

SEQ ID NO: 1171928 - RNA, 15 nt, Mycobacterium bovis subsp bovis AF2122/97
accagcagccagccc

SEQ ID NO: 1171929 - RNA, 16 nt, Mycobacterium bovis subsp bovis AF2122/97
accagcagcaccaacu

SEQ ID NO: 1171930 - RNA, 12 nt, Mycobacterium bovis subsp bovis AF2122/97
accagcagcacu

SEQ ID NO: 1171931 - RNA, 17 nt, Mycobacterium bovis subsp bovis AF2122/97
accagcaccgccgcgcc

SEQ ID NO: 1171932 - RNA, 19 nt, Mycobacterium bovis subsp bovis AF2122/97
accagcaccgccgcugcca

SEQ ID NO: 1171933 - RNA, 20 nt, Mycobacterium bovis subsp bovis AF2122/97
accagcaccgccgcugccau

SEQ ID NO: 1171934 - RNA, 18 nt, Mycobacterium bovis subsp bovis AF2122/97
accagcacggcaaccagc

SEQ ID NO: 1171935 - RNA, 23 nt, Mycobacterium bovis subsp bovis AF2122/97
accacuguuggugccgccaccac

SEQ ID NO: 1171936 - RNA, 17 nt, Mycobacterium bovis subsp bovis AF2122/97
accacuugcagcacaac

SEQ ID NO: 1171937 - RNA, 18 nt, Mycobacterium bovis subsp bovis AF2122/97
accacuugcagcacaacg

SEQ ID NO: 1171938 - RNA, 20 nt, Mycobacterium bovis subsp bovis AF2122/97
accagauugccgagcccagg

SEQ ID NO: 1171939 - RNA, 12 nt, Mycobacterium bovis subsp bovis AF2122/97
accagcaacagc

SEQ ID NO: 1171940 - RNA, 22 nt, Mycobacterium bovis subsp bovis AF2122/97
accagcaccaaaagcccgguac

SEQ ID NO: 1171941 - RNA, 17 nt, Mycobacterium bovis subsp bovis AF2122/97
accagcacaccgcccgc

SEQ ID NO: 1171942 - RNA, 19 nt, Mycobacterium bovis subsp bovis AF2122/97
accagcacaccgcccgcac

SEQ ID NO: 1171943 - RNA, 17 nt, Mycobacterium bovis subsp bovis AF2122/97
accagcaaccaccccag

SEQ ID NO: 1171944 - RNA, 21 nt, Mycobacterium bovis subsp bovis AF2122/97
accagcaaccaccccagggca

SEQ ID NO: 1171945 - RNA, 17 nt, Mycobacterium bovis subsp bovis AF2122/97
accagccgguccagcag

SEQ ID NO: 1171946 - RNA, 13 nt, Mycobacterium bovis subsp bovis AF2122/97
accagccggugag

SEQ ID NO: 1171947 - RNA, 20 nt, Mycobacterium bovis subsp bovis AF2122/97
accagcggccgaccgcgacc

SEQ ID NO: 1171948 - RNA, 18 nt, Mycobacterium bovis subsp bovis AF2122/97
accagccgcggaucaucc

SEQ ID NO: 1171949 - RNA, 22 nt, Mycobacterium bovis subsp bovis AF2122/97
accagcccggcggcggucacca

SEQ ID NO: 1171950 - RNA, 15 nt, Mycobacterium bovis subsp bovis AF2122/97
accagccccaacccu

SEQ ID NO: 1171951 - RNA, 18 nt, Mycobacterium bovis subsp bovis AF2122/97
accagcucggugaucacc

SEQ ID NO: 1171952 - RNA, 13 nt, Mycobacterium bovis subsp bovis AF2122/97
accagcuccugca

SEQ ID NO: 1171953 - RNA, 20 nt, Mycobacterium bovis subsp bovis AF2122/97
accacuuccggcguggcccc

SEQ ID NO: 1171954 - RNA, 20 nt, Mycobacterium bovis subsp bovis AF2122/97
accacgcccgacgaggaugu

SEQ ID NO: 1171955 - RNA, 16 nt, Mycobacterium bovis subsp bovis AF2122/97
accacgcuccccagcg

SEQ ID NO: 1171956 - RNA, 15 nt, Mycobacterium bovis subsp bovis AF2122/97
accacgcgcccgcac

SEQ ID NO: 1171957 - RNA, 17 nt, Mycobacterium bovis subsp bovis AF2122/97
accacgcgcccgcacca

SEQ ID NO: 1171958 - RNA, 22 nt, Mycobacterium bovis subsp bovis AF2122/97
accacgucgacgaugucgaaga

SEQ ID NO: 1171959 - RNA, 20 nt, Mycobacterium bovis subsp bovis AF2122/97
accacgucgagguccaccac

SEQ ID NO: 1171960 - RNA, 20 nt, Mycobacterium bovis subsp bovis AF2122/97
accaccagggcaacggccgc

SEQ ID NO: 1171961 - RNA, 17 nt, Mycobacterium bovis subsp bovis AF2122/97
accacccacccgcacca

SEQ ID NO: 1171962 - RNA, 14 nt, Mycobacterium bovis subsp bovis AF2122/97
accacccaacagcc

SEQ ID NO: 1171963 - RNA, 19 nt, Mycobacterium bovis subsp bovis AF2122/97
accacccaacagcccaccg

SEQ ID NO: 1171964 - RNA, 21 nt, Mycobacterium bovis subsp bovis AF2122/97
accacaucgguguggcccaac

SEQ ID NO: 1171965 - RNA, 14 nt, Mycobacterium bovis subsp bovis AF2122/97
accaccucagcugc

SEQ ID NO: 1171966 - RNA, 15 nt, Mycobacterium bovis subsp bovis AF2122/97
accaccucgugggcc

SEQ ID NO: 1171967 - RNA, 18 nt, Mycobacterium bovis subsp bovis AF2122/97
accaccguuugagcggcc

SEQ ID NO: 1171968 - RNA, 14 nt, Mycobacterium bovis subsp bovis AF2122/97
accacgcaccgccc

SEQ ID NO: 1171969 - RNA, 18 nt, Mycobacterium bovis subsp bovis AF2122/97
accacgcaccgccccgcc

SEQ ID NO: 1171970 - RNA, 14 nt, Mycobacterium bovis subsp bovis AF2122/97
accaccugguuugu

SEQ ID NO: 1171971 - RNA, 14 nt, Mycobacterium bovis subsp bovis AF2122/97
accaucaccgcgcc

SEQ ID NO: 1171972 - RNA, 22 nt, Mycobacterium bovis subsp bovis AF2122/97
accaucaccgcgccagccucca

SEQ ID NO: 1171973 - RNA, 17 nt, Mycobacterium bovis subsp bovis AF2122/97
accaucaccacggccgc

SEQ ID NO: 1171974 - RNA, 18 nt, Mycobacterium bovis subsp bovis AF2122/97
accaggacccaucgccag

SEQ ID NO: 1171975 - RNA, 18 nt, Mycobacterium bovis subsp bovis AF2122/97
accaggacguggucggga

SEQ ID NO: 1171976 - RNA, 21 nt, Mycobacterium bovis subsp bovis AF2122/97
accaggaaugucuccaguagc

SEQ ID NO: 1171977 - RNA, 17 nt, Mycobacterium bovis subsp bovis AF2122/97
accaugaccaccaaggu

SEQ ID NO: 1171978 - RNA, 12 nt, Mycobacterium bovis subsp bovis AF2122/97
accaugaagaac

SEQ ID NO: 1171979 - RNA, 20 nt, Mycobacterium bovis subsp bovis AF2122/97
accaugaagaacuggcugcu

SEQ ID NO: 1171980 - RNA, 17 nt, Mycobacterium bovis subsp bovis AF2122/97
accaugauugccaggac

SEQ ID NO: 1171981 - RNA, 16 nt, Mycobacterium bovis subsp bovis AF2122/97
accaugaucacaccga

SEQ ID NO: 1171982 - RNA, 20 nt, Mycobacterium bovis subsp bovis AF2122/97
accaucugaucgggcccguc

SEQ ID NO: 1171983 - RNA, 23 nt, Mycobacterium bovis subsp bovis AF2122/97
accauccgggcaaccgaugacgc

SEQ ID NO: 1171984 - RNA, 23 nt, Mycobacterium bovis subsp bovis AF2122/97
acccaaaaugccuuggcagccca

SEQ ID NO: 1171985 - RNA, 13 nt, Mycobacterium bovis subsp bovis AF2122/97
acccacccgcacc

SEQ ID NO: 1171986 - RNA, 16 nt, Mycobacterium bovis subsp bovis AF2122/97
acccagcucgcgcacc

SEQ ID NO: 1171987 - RNA, 22 nt, Mycobacterium bovis subsp bovis AF2122/97
acccagcucgcgcacccagccc

SEQ ID NO: 1171988 - RNA, 15 nt, Mycobacterium bovis subsp bovis AF2122/97
acccacugcacggag

SEQ ID NO: 1171989 - RNA, 16 nt, Mycobacterium bovis subsp bovis AF2122/97
acccacugcacggagc

SEQ ID NO: 1171990 - RNA, 13 nt, Mycobacterium bovis subsp bovis AF2122/97
acccacugcaggc

SEQ ID NO: 1171991 - RNA, 20 nt, Mycobacterium bovis subsp bovis AF2122/97
acccaccggccaccagggcc

SEQ ID NO: 1171992 - RNA, 14 nt, Mycobacterium bovis subsp bovis AF2122/97
acccaccggccacc

SEQ ID NO: 1171993 - RNA, 14 nt, Mycobacterium bovis subsp bovis AF2122/97
acccacgccgacua

SEQ ID NO: 1171994 - RNA, 19 nt, Mycobacterium bovis subsp bovis AF2122/97
acccaggcgccgaugucgu

SEQ ID NO: 1171995 - RNA, 16 nt, Mycobacterium bovis subsp bovis AF2122/97
acccagugccacgccu

SEQ ID NO: 1171996 - RNA, 17 nt, Mycobacterium bovis subsp bovis AF2122/97
acccagugccacgccug

SEQ ID NO: 1171997 - RNA, 17 nt, Mycobacterium bovis subsp bovis AF2122/97
acccagugucagcaaga

SEQ ID NO: 1171998 - RNA, 22 nt, Mycobacterium bovis subsp bovis AF2122/97
acccauaucgauaaccgcgacc

SEQ ID NO: 1171999 - RNA, 13 nt, Mycobacterium bovis subsp bovis AF2122/97
acccgcagcugcg

SEQ ID NO: 1172000 - RNA, 14 nt, Mycobacterium bovis subsp bovis AF2122/97
acccgcagcugugg

SEQ ID NO: 1172001 - RNA, 17 nt, Mycobacterium bovis subsp bovis AF2122/97
acccgcagcuguggccc

SEQ ID NO: 1172002 - RNA, 21 nt, Mycobacterium bovis subsp bovis AF2122/97
acccgcauaccguucacccag

SEQ ID NO: 1172003 - RNA, 22 nt, Mycobacterium bovis subsp bovis AF2122/97
acccgcccgagaguggacgugu

SEQ ID NO: 1172004 - RNA, 14 nt, Mycobacterium bovis subsp bovis AF2122/97
acccgcacggccuc

SEQ ID NO: 1172005 - RNA, 14 nt, Mycobacterium bovis subsp bovis AF2122/97
acccgcagccgcgc

SEQ ID NO: 1172006 - RNA, 11 nt, Mycobacterium bovis subsp bovis AF2122/97
acccgcagacc

SEQ ID NO: 1172007 - RNA, 17 nt, Mycobacterium bovis subsp bovis AF2122/97
acccgcagaccgccacc

SEQ ID NO: 1172008 - RNA, 23 nt, Mycobacterium bovis subsp bovis AF2122/97
acccgcaccggugacgcacagca

SEQ ID NO: 1172009 - RNA, 13 nt, Mycobacterium bovis subsp bovis AF2122/97
acccgcaccgccg

SEQ ID NO: 1172010 - RNA, 13 nt, Mycobacterium bovis subsp bovis AF2122/97
acccgaccgccau

SEQ ID NO: 1172011 - RNA, 17 nt, Mycobacterium bovis subsp bovis AF2122/97
acccgacacggcucgcc

SEQ ID NO: 1172012 - RNA, 14 nt, Mycobacterium bovis subsp bovis AF2122/97
acccgaaacaccgu

SEQ ID NO: 1172013 - RNA, 15 nt, Mycobacterium bovis subsp bovis AF2122/97
acccgaauccaccag

SEQ ID NO: 1172014 - RNA, 16 nt, Mycobacterium bovis subsp bovis AF2122/97
acccgacaacgcuggg

SEQ ID NO: 1172015 - RNA, 17 nt, Mycobacterium bovis subsp bovis AF2122/97
acccgaugacccacugc

SEQ ID NO: 1172016 - RNA, 13 nt, Mycobacterium bovis subsp bovis AF2122/97
acccgaccagcac

SEQ ID NO: 1172017 - RNA, 23 nt, Mycobacterium bovis subsp bovis AF2122/97
accccuugccuuccgacccaacg

SEQ ID NO: 1172018 - RNA, 15 nt, Mycobacterium bovis subsp bovis AF2122/97
accccguaggugcac

SEQ ID NO: 1172019 - RNA, 14 nt, Mycobacterium bovis subsp bovis AF2122/97
accccggucggccc

SEQ ID NO: 1172020 - RNA, 16 nt, Mycobacterium bovis subsp bovis AF2122/97
accccggugcccgcgg

SEQ ID NO: 1172021 - RNA, 16 nt, Mycobacterium bovis subsp bovis AF2122/97
accccggcgguaccgc

SEQ ID NO: 1172022 - RNA, 18 nt, Mycobacterium bovis subsp bovis AF2122/97
accccggcgguaccgccg

SEQ ID NO: 1172023 - RNA, 12 nt, Mycobacterium bovis subsp bovis AF2122/97
accccggcucga

SEQ ID NO: 1172024 - RNA, 18 nt, Mycobacterium bovis subsp bovis AF2122/97
accccggcucggccaccg

SEQ ID NO: 1172025 - RNA, 18 nt, Mycobacterium bovis subsp bovis AF2122/97
accccggccuugccaccg

SEQ ID NO: 1172026 - RNA, 21 nt, Mycobacterium bovis subsp bovis AF2122/97
accccggccuuggcggcggca

SEQ ID NO: 1172027 - RNA, 12 nt, Mycobacterium bovis subsp bovis AF2122/97
accccggccacc

SEQ ID NO: 1172028 - RNA, 13 nt, Mycobacterium bovis subsp bovis AF2122/97
accccggccggcu

SEQ ID NO: 1172029 - RNA, 18 nt, Mycobacterium bovis subsp bovis AF2122/97
accccggaauccccaagc

SEQ ID NO: 1172030 - RNA, 20 nt, Mycobacterium bovis subsp bovis AF2122/97
accccggcauacaacuggug

SEQ ID NO: 1172031 - RNA, 19 nt, Mycobacterium bovis subsp bovis AF2122/97
accccgcgcggugcccugc

SEQ ID NO: 1172032 - RNA, 21 nt, Mycobacterium bovis subsp bovis AF2122/97
acccaucccguucagcgacca

SEQ ID NO: 1172033 - RNA, 15 nt, Mycobacterium bovis subsp bovis AF2122/97
acccaucgaccgccc

SEQ ID NO: 1172034 - RNA, 15 nt, Mycobacterium bovis subsp bovis AF2122/97
acccaucgccacacc

SEQ ID NO: 1172035 - RNA, 16 nt, Mycobacterium bovis subsp bovis AF2122/97
acccaucccguucagc

SEQ ID NO: 1172036 - RNA, 16 nt, Mycobacterium bovis subsp bovis AF2122/97
acccaucaccgccagc

SEQ ID NO: 1172037 - RNA, 21 nt, Mycobacterium bovis subsp bovis AF2122/97
acccauggccucccacucacc

SEQ ID NO: 1172038 - RNA, 18 nt, Mycobacterium bovis subsp bovis AF2122/97
acccauggccucccacuc

SEQ ID NO: 1172039 - RNA, 22 nt, Mycobacterium bovis subsp bovis AF2122/97
acccggccgccgaaacucacca

SEQ ID NO: 1172040 - RNA, 14 nt, Mycobacterium bovis subsp bovis AF2122/97
acccggccuucucc

SEQ ID NO: 1172041 - RNA, 14 nt, Mycobacterium bovis subsp bovis AF2122/97
acccggcagcccgg

SEQ ID NO: 1172042 - RNA, 21 nt, Mycobacterium bovis subsp bovis AF2122/97
acccggcgggcggugggcagc

SEQ ID NO: 1172043 - RNA, 19 nt, Mycobacterium bovis subsp bovis AF2122/97
acccggcgugagcuccgca

SEQ ID NO: 1172044 - RNA, 15 nt, Mycobacterium bovis subsp bovis AF2122/97
acccggcgaccacgg

SEQ ID NO: 1172045 - RNA, 16 nt, Mycobacterium bovis subsp bovis AF2122/97
acccggcgaccacggc

SEQ ID NO: 1172046 - RNA, 21 nt, Mycobacterium bovis subsp bovis AF2122/97
acccggcgaccacggcaccga

SEQ ID NO: 1172047 - RNA, 13 nt, Mycobacterium bovis subsp bovis AF2122/97
acccgggccacgu

SEQ ID NO: 1172048 - RNA, 18 nt, Mycobacterium bovis subsp bovis AF2122/97
acccgggccaggcugcgc

SEQ ID NO: 1172049 - RNA, 14 nt, Mycobacterium bovis subsp bovis AF2122/97
acccggucgccggg

SEQ ID NO: 1172050 - RNA, 20 nt, Mycobacterium bovis subsp bovis AF2122/97
acccggugacccgcugggcc

SEQ ID NO: 1172051 - RNA, 20 nt, Mycobacterium bovis subsp bovis AF2122/97
acccgggccggucggugagc

SEQ ID NO: 1172052 - RNA, 14 nt, Mycobacterium bovis subsp bovis AF2122/97
acccgggccucggc

SEQ ID NO: 1172053 - RNA, 15 nt, Mycobacterium bovis subsp bovis AF2122/97
acccgggccugggac

SEQ ID NO: 1172054 - RNA, 20 nt, Mycobacterium bovis subsp bovis AF2122/97
acccgggcgagcgcggccug

SEQ ID NO: 1172055 - RNA, 14 nt, Mycobacterium bovis subsp bovis AF2122/97
acccgggucggcac

SEQ ID NO: 1172056 - RNA, 22 nt, Mycobacterium bovis subsp bovis AF2122/97
acccgggcgugggugucggcga

SEQ ID NO: 1172057 - RNA, 16 nt, Mycobacterium bovis subsp bovis AF2122/97
acccggggugcccggc

SEQ ID NO: 1172058 - RNA, 17 nt, Mycobacterium bovis subsp bovis AF2122/97
acccggggugcccggcc

SEQ ID NO: 1172059 - RNA, 22 nt, Mycobacterium bovis subsp bovis AF2122/97
acccgguguugagcgaacccgc

SEQ ID NO: 1172060 - RNA, 14 nt, Mycobacterium bovis subsp bovis AF2122/97
acccgguugugcgc

SEQ ID NO: 1172061 - RNA, 18 nt, Mycobacterium bovis subsp bovis AF2122/97
acccggucggccauccac

SEQ ID NO: 1172062 - RNA, 17 nt, Mycobacterium bovis subsp bovis AF2122/97
acccggugagaagaagc

SEQ ID NO: 1172063 - RNA, 18 nt, Mycobacterium bovis subsp bovis AF2122/97
acccggugagaagaagcc

SEQ ID NO: 1172064 - RNA, 20 nt, Mycobacterium bovis subsp bovis AF2122/97
acccggugauggugugcagc

SEQ ID NO: 1172065 - RNA, 18 nt, Mycobacterium bovis subsp bovis AF2122/97
acccgucacaagcugaca

SEQ ID NO: 1172066 - RNA, 14 nt, Mycobacterium bovis subsp bovis AF2122/97
acccgucaccgccg

SEQ ID NO: 1172067 - RNA, 17 nt, Mycobacterium bovis subsp bovis AF2122/97
acccgucaugcccaccg

SEQ ID NO: 1172068 - RNA, 20 nt, Mycobacterium bovis subsp bovis AF2122/97
acccgucaugcccaccgccu

SEQ ID NO: 1172069 - RNA, 19 nt, Mycobacterium bovis subsp bovis AF2122/97
acccguauugccaaagccc

SEQ ID NO: 1172070 - RNA, 19 nt, Mycobacterium bovis subsp bovis AF2122/97
acccguccaacuacgccag

SEQ ID NO: 1172071 - RNA, 17 nt, Mycobacterium bovis subsp bovis AF2122/97
acccgucgagcagcaug

SEQ ID NO: 1172072 - RNA, 21 nt, Mycobacterium bovis subsp bovis AF2122/97
acccgcgagaucgggccggcc

SEQ ID NO: 1172073 - RNA, 21 nt, Mycobacterium bovis subsp bovis AF2122/97
acccgcgagguugaccaccag

SEQ ID NO: 1172074 - RNA, 19 nt, Mycobacterium bovis subsp bovis AF2122/97
acccgcgggugauguucgu

SEQ ID NO: 1172075 - RNA, 21 nt, Mycobacterium bovis subsp bovis AF2122/97
acccgcggugacgccagccug

SEQ ID NO: 1172076 - RNA, 22 nt, Mycobacterium bovis subsp bovis AF2122/97
acccgcggcgaaccgucucgcc

SEQ ID NO: 1172077 - RNA, 22 nt, Mycobacterium bovis subsp bovis AF2122/97
acccgcgcgucgcccagugcgc

SEQ ID NO: 1172078 - RNA, 13 nt, Mycobacterium bovis subsp bovis AF2122/97
acccgccgcccca

SEQ ID NO: 1172079 - RNA, 14 nt, Mycobacterium bovis subsp bovis AF2122/97
acccgccgccccac

SEQ ID NO: 1172080 - RNA, 16 nt, Mycobacterium bovis subsp bovis AF2122/97
acccgccgccgcccgg

SEQ ID NO: 1172081 - RNA, 18 nt, Mycobacterium bovis subsp bovis AF2122/97
acccgccgcgcccggcgc

SEQ ID NO: 1172082 - RNA, 18 nt, Mycobacterium bovis subsp bovis AF2122/97
acccgccgacgccgccgg

SEQ ID NO: 1172083 - RNA, 17 nt, Mycobacterium bovis subsp bovis AF2122/97
acccgccgaugcugccg

SEQ ID NO: 1172084 - RNA, 15 nt, Mycobacterium bovis subsp bovis AF2122/97
acccgcuggcccgcc

SEQ ID NO: 1172085 - RNA, 19 nt, Mycobacterium bovis subsp bovis AF2122/97
acccgcucggcggucggga

SEQ ID NO: 1172086 - RNA, 15 nt, Mycobacterium bovis subsp bovis AF2122/97
acccgcuccaccccu

SEQ ID NO: 1172087 - RNA, 21 nt, Mycobacterium bovis subsp bovis AF2122/97
acccguguucgccacacccgu

SEQ ID NO: 1172088 - RNA, 16 nt, Mycobacterium bovis subsp bovis AF2122/97
acccgucggcccgcuc

SEQ ID NO: 1172089 - RNA, 18 nt, Mycobacterium bovis subsp bovis AF2122/97
acccgucggcguggcugc

SEQ ID NO: 1172090 - RNA, 17 nt, Mycobacterium bovis subsp bovis AF2122/97
acccgucgggugcugau

SEQ ID NO: 1172091 - RNA, 23 nt, Mycobacterium bovis subsp bovis AF2122/97
acccgucuuaucggcgucguaga

SEQ ID NO: 1172092 - RNA, 17 nt, Mycobacterium bovis subsp bovis AF2122/97
acccuaaaccagccacc

SEQ ID NO: 1172093 - RNA, 15 nt, Mycobacterium bovis subsp bovis AF2122/97
acccguuccacgccg

SEQ ID NO: 1172094 - RNA, 20 nt, Mycobacterium bovis subsp bovis AF2122/97
acccguugaucgcggacacu

SEQ ID NO: 1172095 - RNA, 17 nt, Mycobacterium bovis subsp bovis AF2122/97
acccuccacagcggcca

SEQ ID NO: 1172096 - RNA, 21 nt, Mycobacterium bovis subsp bovis AF2122/97
acccuccggacccacccgcac

SEQ ID NO: 1172097 - RNA, 23 nt, Mycobacterium bovis subsp bovis AF2122/97
acccucgcguagggccagcgccu

SEQ ID NO: 1172098 - RNA, 21 nt, Mycobacterium bovis subsp bovis AF2122/97
acccuucgggcuggucgguca

SEQ ID NO: 1172099 - RNA, 14 nt, Mycobacterium bovis subsp bovis AF2122/97
acccuugccgccgg

SEQ ID NO: 1172100 - RNA, 20 nt, Mycobacterium bovis subsp bovis AF2122/97
acccugguggucagucacca

SEQ ID NO: 1172101 - RNA, 23 nt, Mycobacterium bovis subsp bovis AF2122/97
acccuguuugcccaacagacauu

SEQ ID NO: 1172102 - RNA, 14 nt, Mycobacterium bovis subsp bovis AF2122/97
acccugauggggcc

SEQ ID NO: 1172103 - RNA, 15 nt, Mycobacterium bovis subsp bovis AF2122/97
acccugcggugcagg

SEQ ID NO: 1172104 - RNA, 13 nt, Mycobacterium bovis subsp bovis AF2122/97
acccugcccggcc

SEQ ID NO: 1172105 - RNA, 11 nt, Mycobacterium bovis subsp bovis AF2122/97
acccugcugcg

SEQ ID NO: 1172106 - RNA, 14 nt, Mycobacterium bovis subsp bovis AF2122/97
acccugaugaucgu

SEQ ID NO: 1172107 - RNA, 20 nt, Mycobacterium bovis subsp bovis AF2122/97
accgacggccagcaagacga

SEQ ID NO: 1172108 - RNA, 21 nt, Mycobacterium bovis subsp bovis AF2122/97
accgaccuaccgucgaccacu

SEQ ID NO: 1172109 - RNA, 22 nt, Mycobacterium bovis subsp bovis AF2122/97
accgaccgggucgcaaccgccg

SEQ ID NO: 1172110 - RNA, 21 nt, Mycobacterium bovis subsp bovis AF2122/97
accgaccccggaacgacccca

SEQ ID NO: 1172111 - RNA, 20 nt, Mycobacterium bovis subsp bovis AF2122/97
accgacagcacccggccacc

SEQ ID NO: 1172112 - RNA, 14 nt, Mycobacterium bovis subsp bovis AF2122/97
accgacaccaccag

SEQ ID NO: 1172113 - RNA, 17 nt, Mycobacterium bovis subsp bovis AF2122/97
accgacaccguguugcu

SEQ ID NO: 1172114 - RNA, 23 nt, Mycobacterium bovis subsp bovis AF2122/97
accgagcccuccagggcccugcu

SEQ ID NO: 1172115 - RNA, 20 nt, Mycobacterium bovis subsp bovis AF2122/97
accgagcccuccagggcccu

SEQ ID NO: 1172116 - RNA, 21 nt, Mycobacterium bovis subsp bovis AF2122/97
accgagccacgacccagcaug

SEQ ID NO: 1172117 - RNA, 13 nt, Mycobacterium bovis subsp bovis AF2122/97
accgagaugcgca

SEQ ID NO: 1172118 - RNA, 21 nt, Mycobacterium bovis subsp bovis AF2122/97
accgagaugcggaccacaccg

SEQ ID NO: 1172119 - RNA, 16 nt, Mycobacterium bovis subsp bovis AF2122/97
accgacgguaggcccg

SEQ ID NO: 1172120 - RNA, 16 nt, Mycobacterium bovis subsp bovis AF2122/97
accgagaaagugcagu

SEQ ID NO: 1172121 - RNA, 17 nt, Mycobacterium bovis subsp bovis AF2122/97
accgaacuugcggaccu

SEQ ID NO: 1172122 - RNA, 18 nt, Mycobacterium bovis subsp bovis AF2122/97
accgaagagcgcgcgcaa

SEQ ID NO: 1172123 - RNA, 14 nt, Mycobacterium bovis subsp bovis AF2122/97
accgaagccgccgg

SEQ ID NO: 1172124 - RNA, 14 nt, Mycobacterium bovis subsp bovis AF2122/97
accgaaccuggucu

SEQ ID NO: 1172125 - RNA, 23 nt, Mycobacterium bovis subsp bovis AF2122/97
accgaaccgcguuaugccaggcg

SEQ ID NO: 1172126 - RNA, 15 nt, Mycobacterium bovis subsp bovis AF2122/97
accgaauugaacuga

SEQ ID NO: 1172127 - RNA, 16 nt, Mycobacterium bovis subsp bovis AF2122/97
accgaacgcggccacc

SEQ ID NO: 1172128 - RNA, 17 nt, Mycobacterium bovis subsp bovis AF2122/97
accgaaagccgcaccag

SEQ ID NO: 1172129 - RNA, 16 nt, Mycobacterium bovis subsp bovis AF2122/97
accgaaauggucguuc

SEQ ID NO: 1172130 - RNA, 20 nt, Mycobacterium bovis subsp bovis AF2122/97
accgaacagucgcagccagg

SEQ ID NO: 1172131 - RNA, 19 nt, Mycobacterium bovis subsp bovis AF2122/97
accgaacagcaccuccgua

SEQ ID NO: 1172132 - RNA, 19 nt, Mycobacterium bovis subsp bovis AF2122/97
accgccgcgucgagcaccu

SEQ ID NO: 1172133 - RNA, 13 nt, Mycobacterium bovis subsp bovis AF2122/97
accgccgcugccg

SEQ ID NO: 1172134 - RNA, 18 nt, Mycobacterium bovis subsp bovis AF2122/97
accgccgcgaccgccucg

SEQ ID NO: 1172135 - RNA, 17 nt, Mycobacterium bovis subsp bovis AF2122/97
accgccgcgaccgcgag

SEQ ID NO: 1172136 - RNA, 13 nt, Mycobacterium bovis subsp bovis AF2122/97
accgccgccgccc

SEQ ID NO: 1172137 - RNA, 16 nt, Mycobacterium bovis subsp bovis AF2122/97
accgccggcgccaccg

SEQ ID NO: 1172138 - RNA, 17 nt, Mycobacterium bovis subsp bovis AF2122/97
accgccggcgccaccgu

SEQ ID NO: 1172139 - RNA, 13 nt, Mycobacterium bovis subsp bovis AF2122/97
accgccggcgccg

SEQ ID NO: 1172140 - RNA, 17 nt, Mycobacterium bovis subsp bovis AF2122/97
accgcgaucaccaccgg

SEQ ID NO: 1172141 - RNA, 14 nt, Mycobacterium bovis subsp bovis AF2122/97
accgcggccuuggc

SEQ ID NO: 1172142 - RNA, 18 nt, Mycobacterium bovis subsp bovis AF2122/97
accgcggcgaucugcgac

SEQ ID NO: 1172143 - RNA, 20 nt, Mycobacterium bovis subsp bovis AF2122/97
accgcggcgauuacggccag

SEQ ID NO: 1172144 - RNA, 14 nt, Mycobacterium bovis subsp bovis AF2122/97
accgcggcccggac

SEQ ID NO: 1172145 - RNA, 21 nt, Mycobacterium bovis subsp bovis AF2122/97
accgcgggucgugccagcagc

SEQ ID NO: 1172146 - RNA, 18 nt, Mycobacterium bovis subsp bovis AF2122/97
accgcgggcggcaucgcc

SEQ ID NO: 1172147 - RNA, 21 nt, Mycobacterium bovis subsp bovis AF2122/97
accgcgggcgccuuccaggcg

SEQ ID NO: 1172148 - RNA, 15 nt, Mycobacterium bovis subsp bovis AF2122/97
accgcgcccuucagc

SEQ ID NO: 1172149 - RNA, 14 nt, Mycobacterium bovis subsp bovis AF2122/97
accgcggccccgac

SEQ ID NO: 1172150 - RNA, 13 nt, Mycobacterium bovis subsp bovis AF2122/97
accgcgccagccu

SEQ ID NO: 1172151 - RNA, 15 nt, Mycobacterium bovis subsp bovis AF2122/97
accgcuaccagcugg

SEQ ID NO: 1172152 - RNA, 22 nt, Mycobacterium bovis subsp bovis AF2122/97
accgcggggcagcgggccgccc

SEQ ID NO: 1172153 - RNA, 17 nt, Mycobacterium bovis subsp bovis AF2122/97
accgcgguacgccgguc

SEQ ID NO: 1172154 - RNA, 17 nt, Mycobacterium bovis subsp bovis AF2122/97
accggacgaucagggug

SEQ ID NO: 1172155 - RNA, 21 nt, Mycobacterium bovis subsp bovis AF2122/97
accgcuugugacaccacaucg

SEQ ID NO: 1172156 - RNA, 19 nt, Mycobacterium bovis subsp bovis AF2122/97
accggaaaccacagcgcca

SEQ ID NO: 1172157 - RNA, 16 nt, Mycobacterium bovis subsp bovis AF2122/97
accggaaaugucuccu

SEQ ID NO: 1172158 - RNA, 17 nt, Mycobacterium bovis subsp bovis AF2122/97
accgcccggcccggcuc

SEQ ID NO: 1172159 - RNA, 16 nt, Mycobacterium bovis subsp bovis AF2122/97
accgccagcguggaga

SEQ ID NO: 1172160 - RNA, 15 nt, Mycobacterium bovis subsp bovis AF2122/97
accgcccgcgccacc

SEQ ID NO: 1172161 - RNA, 15 nt, Mycobacterium bovis subsp bovis AF2122/97
accgccccgugggcc

SEQ ID NO: 1172162 - RNA, 15 nt, Mycobacterium bovis subsp bovis AF2122/97
accgccagcgccacc

SEQ ID NO: 1172163 - RNA, 16 nt, Mycobacterium bovis subsp bovis AF2122/97
accgccagcgccaccg

SEQ ID NO: 1172164 - RNA, 13 nt, Mycobacterium bovis subsp bovis AF2122/97
accgccagcccgg

SEQ ID NO: 1172165 - RNA, 22 nt, Mycobacterium bovis subsp bovis AF2122/97
accgccgaucggccacagugca

SEQ ID NO: 1172166 - RNA, 12 nt, Mycobacterium bovis subsp bovis AF2122/97
accgcccuugcc

SEQ ID NO: 1172167 - RNA, 15 nt, Mycobacterium bovis subsp bovis AF2122/97
accgccacggcggcu

SEQ ID NO: 1172168 - RNA, 11 nt, Mycobacterium bovis subsp bovis AF2122/97
accgccacccc

SEQ ID NO: 1172169 - RNA, 15 nt, Mycobacterium bovis subsp bovis AF2122/97
accgccaccgccagc

SEQ ID NO: 1172170 - RNA, 18 nt, Mycobacterium bovis subsp bovis AF2122/97
accgccagcagcaggcca

SEQ ID NO: 1172171 - RNA, 23 nt, Mycobacterium bovis subsp bovis AF2122/97
accgcagcggaacugggccccca

SEQ ID NO: 1172172 - RNA, 16 nt, Mycobacterium bovis subsp bovis AF2122/97
accgcaggugccaccu

SEQ ID NO: 1172173 - RNA, 13 nt, Mycobacterium bovis subsp bovis AF2122/97
accgaggaucucg

SEQ ID NO: 1172174 - RNA, 23 nt, Mycobacterium bovis subsp bovis AF2122/97
accgagucgacggccagugcgca

SEQ ID NO: 1172175 - RNA, 23 nt, Mycobacterium bovis subsp bovis AF2122/97
accgaggucggccagcagcagug

SEQ ID NO: 1172176 - RNA, 13 nt, Mycobacterium bovis subsp bovis AF2122/97
accgaguaccgau

SEQ ID NO: 1172177 - RNA, 17 nt, Mycobacterium bovis subsp bovis AF2122/97
accgagucgacggccag

SEQ ID NO: 1172178 - RNA, 22 nt, Mycobacterium bovis subsp bovis AF2122/97
accgagucgacggccagugcgc

SEQ ID NO: 1172179 - RNA, 15 nt, Mycobacterium bovis subsp bovis AF2122/97
accgauccaguucac

SEQ ID NO: 1172180 - RNA, 17 nt, Mycobacterium bovis subsp bovis AF2122/97
accgauucggccagcgc

SEQ ID NO: 1172181 - RNA, 19 nt, Mycobacterium bovis subsp bovis AF2122/97
accgauucggccagcgccc

SEQ ID NO: 1172182 - RNA, 20 nt, Mycobacterium bovis subsp bovis AF2122/97
accgauucggccagcgcccg

SEQ ID NO: 1172183 - RNA, 20 nt, Mycobacterium bovis subsp bovis AF2122/97
accgauuucuuuaccagcac

SEQ ID NO: 1172184 - RNA, 18 nt, Mycobacterium bovis subsp bovis AF2122/97
accgcaaaggagaagaca

SEQ ID NO: 1172185 - RNA, 15 nt, Mycobacterium bovis subsp bovis AF2122/97
accgcaauggcggcc

SEQ ID NO: 1172186 - RNA, 16 nt, Mycobacterium bovis subsp bovis AF2122/97
accgcaaucggauacc

SEQ ID NO: 1172187 - RNA, 22 nt, Mycobacterium bovis subsp bovis AF2122/97
accgcaaucggauacccagccg

SEQ ID NO: 1172188 - RNA, 18 nt, Mycobacterium bovis subsp bovis AF2122/97
accgcagauccccgccac

SEQ ID NO: 1172189 - RNA, 19 nt, Mycobacterium bovis subsp bovis AF2122/97
accgcagauccccgccacc

SEQ ID NO: 1172190 - RNA, 13 nt, Mycobacterium bovis subsp bovis AF2122/97
aaucagccaggcc

SEQ ID NO: 1172191 - RNA, 13 nt, Mycobacterium bovis subsp bovis AF2122/97
aaucagcacccca

SEQ ID NO: 1172192 - RNA, 15 nt, Mycobacterium bovis subsp bovis AF2122/97
aaucacggucaucuc

SEQ ID NO: 1172193 - RNA, 21 nt, Mycobacterium bovis subsp bovis AF2122/97
aaucaccgccgcgaccgccuc

SEQ ID NO: 1172194 - RNA, 12 nt, Mycobacterium bovis subsp bovis AF2122/97
aaucacaucgcc

SEQ ID NO: 1172195 - RNA, 12 nt, Mycobacterium bovis subsp bovis AF2122/97
aaucaagcacag

SEQ ID NO: 1172196 - RNA, 14 nt, Mycobacterium bovis subsp bovis AF2122/97
aaucaagcacagcc

SEQ ID NO: 1172197 - RNA, 16 nt, Mycobacterium bovis subsp bovis AF2122/97
aauacaccuccugccu

SEQ ID NO: 1172198 - RNA, 22 nt, Mycobacterium bovis subsp bovis AF2122/97
aauacacccaacucaugggcca

SEQ ID NO: 1172199 - RNA, 17 nt, Mycobacterium bovis subsp bovis AF2122/97
aauacacuccugagaug

SEQ ID NO: 1172200 - RNA, 21 nt, Mycobacterium bovis subsp bovis AF2122/97
aauacuuggaaaagcuguuga

SEQ ID NO: 1172201 - RNA, 19 nt, Mycobacterium bovis subsp bovis AF2122/97
aauagcuguuggccagccg

SEQ ID NO: 1172202 - RNA, 21 nt, Mycobacterium bovis subsp bovis AF2122/97
aauagcugcgcgaagccacca

SEQ ID NO: 1172203 - RNA, 19 nt, Mycobacterium bovis subsp bovis AF2122/97
aaucucgcccccagugcac

SEQ ID NO: 1172204 - RNA, 17 nt, Mycobacterium bovis subsp bovis AF2122/97
aaucggcggcacccggg

SEQ ID NO: 1172205 - RNA, 16 nt, Mycobacterium bovis subsp bovis AF2122/97
aaucggcaagacgcgg

SEQ ID NO: 1172206 - RNA, 19 nt, Mycobacterium bovis subsp bovis AF2122/97
aaucggcggcguccagcag

SEQ ID NO: 1172207 - RNA, 14 nt, Mycobacterium bovis subsp bovis AF2122/97
aaucguguaccucc

SEQ ID NO: 1172208 - RNA, 22 nt, Mycobacterium bovis subsp bovis AF2122/97
aaucgugucgccucgaugccaa

SEQ ID NO: 1172209 - RNA, 21 nt, Mycobacterium bovis subsp bovis AF2122/97
aaucguguugucaggacaugc

SEQ ID NO: 1172210 - RNA, 21 nt, Mycobacterium bovis subsp bovis AF2122/97
aaucgaucgaauuaaagccac

SEQ ID NO: 1172211 - RNA, 14 nt, Mycobacterium bovis subsp bovis AF2122/97
aaucgacagcagcg

SEQ ID NO: 1172212 - RNA, 19 nt, Mycobacterium bovis subsp bovis AF2122/97
aaugcacaccgggcaccag

SEQ ID NO: 1172213 - RNA, 16 nt, Mycobacterium bovis subsp bovis AF2122/97
aaugacuuggccagca

SEQ ID NO: 1172214 - RNA, 19 nt, Mycobacterium bovis subsp bovis AF2122/97
aauggcggccuugcucagc

SEQ ID NO: 1172215 - RNA, 15 nt, Mycobacterium bovis subsp bovis AF2122/97
aaugcugcugcagca

SEQ ID NO: 1172216 - RNA, 12 nt, Mycobacterium bovis subsp bovis AF2122/97
aaugcugcaggu

SEQ ID NO: 1172217 - RNA, 13 nt, Mycobacterium bovis subsp bovis AF2122/97
aauguaguccagc

SEQ ID NO: 1172218 - RNA, 16 nt, Mycobacterium bovis subsp bovis AF2122/97
aauguccgcagacgac

SEQ ID NO: 1172219 - RNA, 20 nt, Mycobacterium bovis subsp bovis AF2122/97
aaugucagugccccgcccgg

SEQ ID NO: 1172220 - RNA, 19 nt, Mycobacterium bovis subsp bovis AF2122/97
aaugucuuuggucgccgga

SEQ ID NO: 1172221 - RNA, 18 nt, Mycobacterium bovis subsp bovis AF2122/97
aaugucgauuucgaugac

SEQ ID NO: 1172222 - RNA, 15 nt, Mycobacterium bovis subsp bovis AF2122/97
aagcguccgcugcag

SEQ ID NO: 1172223 - RNA, 15 nt, Mycobacterium bovis subsp bovis AF2122/97
aagccacgcagaaca

SEQ ID NO: 1172224 - RNA, 16 nt, Mycobacterium bovis subsp bovis AF2122/97
aagcuaccgaucgcca

SEQ ID NO: 1172225 - RNA, 15 nt, Mycobacterium bovis subsp bovis AF2122/97
aagcgugcugccgcc

SEQ ID NO: 1172226 - RNA, 15 nt, Mycobacterium bovis subsp bovis AF2122/97
aaggaucaacgugcg

SEQ ID NO: 1172227 - RNA, 17 nt, Mycobacterium bovis subsp bovis AF2122/97
aaggaucagcgcacugg

SEQ ID NO: 1172228 - RNA, 15 nt, Mycobacterium bovis subsp bovis AF2122/97
aagcugugcccggcg

SEQ ID NO: 1172229 - RNA, 14 nt, Mycobacterium bovis subsp bovis AF2122/97
aagcugcugcugcu

SEQ ID NO: 1172230 - RNA, 14 nt, Mycobacterium bovis subsp bovis AF2122/97
aaggugcgccgcca

SEQ ID NO: 1172231 - RNA, 19 nt, Mycobacterium bovis subsp bovis AF2122/97
aaggugcgcugggugauga

SEQ ID NO: 1172232 - RNA, 12 nt, Mycobacterium bovis subsp bovis AF2122/97
aaggugccggcg

SEQ ID NO: 1172233 - RNA, 19 nt, Mycobacterium bovis subsp bovis AF2122/97
aaggugugcgucuccagcu

SEQ ID NO: 1172234 - RNA, 22 nt, Mycobacterium bovis subsp bovis AF2122/97
aagguggccaccaaacgcugcu

SEQ ID NO: 1172235 - RNA, 22 nt, Mycobacterium bovis subsp bovis AF2122/97
aagguugaacgccgccagcaga

SEQ ID NO: 1172236 - RNA, 14 nt, Mycobacterium bovis subsp bovis AF2122/97
aaggcuugugccag

SEQ ID NO: 1172237 - RNA, 14 nt, Mycobacterium bovis subsp bovis AF2122/97
aaggcgcgcugggc

SEQ ID NO: 1172238 - RNA, 15 nt, Mycobacterium bovis subsp bovis AF2122/97
aaggccgccaaccgu

SEQ ID NO: 1172239 - RNA, 19 nt, Mycobacterium bovis subsp bovis AF2122/97
aaggcccuggccgcgccgg

SEQ ID NO: 1172240 - RNA, 14 nt, Mycobacterium bovis subsp bovis AF2122/97
aaggccgagcgcga

SEQ ID NO: 1172241 - RNA, 18 nt, Mycobacterium bovis subsp bovis AF2122/97
aaggccgauguacugugc

SEQ ID NO: 1172242 - RNA, 16 nt, Mycobacterium bovis subsp bovis AF2122/97
aaggccgcaauacccg

SEQ ID NO: 1172243 - RNA, 13 nt, Mycobacterium bovis subsp bovis AF2122/97
aaggcacgggugu

SEQ ID NO: 1172244 - RNA, 16 nt, Mycobacterium bovis subsp bovis AF2122/97
aaggcaaacaccagcc

SEQ ID NO: 1172245 - RNA, 23 nt, Mycobacterium bovis subsp bovis AF2122/97
aaguuggcuugcgcgcaggugcu

SEQ ID NO: 1172246 - RNA, 15 nt, Mycobacterium bovis subsp bovis AF2122/97
aaguuggccgcccga

SEQ ID NO: 1172247 - RNA, 22 nt, Mycobacterium bovis subsp bovis AF2122/97
aaguugugcgcacucuuuccuu

SEQ ID NO: 1172248 - RNA, 14 nt, Mycobacterium bovis subsp bovis AF2122/97
aagugggugccggc

SEQ ID NO: 1172249 - RNA, 19 nt, Mycobacterium bovis subsp bovis AF2122/97
aagugcacugcgaacccug

SEQ ID NO: 1172250 - RNA, 11 nt, Mycobacterium bovis subsp bovis AF2122/97
aagugcagggc

SEQ ID NO: 1172251 - RNA, 20 nt, Mycobacterium bovis subsp bovis AF2122/97
aagugaauaccccagaccgc

SEQ ID NO: 1172252 - RNA, 18 nt, Mycobacterium bovis subsp bovis AF2122/97
aagucuugaccgcaccgg

SEQ ID NO: 1172253 - RNA, 18 nt, Mycobacterium bovis subsp bovis AF2122/97
aaguccgccgccugcgca

SEQ ID NO: 1172254 - RNA, 13 nt, Mycobacterium bovis subsp bovis AF2122/97
aagucucccggcc

SEQ ID NO: 1172255 - RNA, 23 nt, Mycobacterium bovis subsp bovis AF2122/97
aaguccacgcaccacgagcagcc

SEQ ID NO: 1172256 - RNA, 21 nt, Mycobacterium bovis subsp bovis AF2122/97
aaguccgagucggcaaacaac

SEQ ID NO: 1172257 - RNA, 20 nt, Mycobacterium bovis subsp bovis AF2122/97
aagaccgcgucggcggccag

SEQ ID NO: 1172258 - RNA, 17 nt, Mycobacterium bovis subsp bovis AF2122/97
aagaccgccuccaccgc

SEQ ID NO: 1172259 - RNA, 22 nt, Mycobacterium bovis subsp bovis AF2122/97
aagaccucgucgcgucgccaga

SEQ ID NO: 1172260 - RNA, 14 nt, Mycobacterium bovis subsp bovis AF2122/97
aagacaacccgcuc

SEQ ID NO: 1172261 - RNA, 20 nt, Mycobacterium bovis subsp bovis AF2122/97
aagacggugcgggcuaggcg

SEQ ID NO: 1172262 - RNA, 15 nt, Mycobacterium bovis subsp bovis AF2122/97
aagacgucggacggc

SEQ ID NO: 1172263 - RNA, 17 nt, Mycobacterium bovis subsp bovis AF2122/97
aagacgcccgaguuugc

SEQ ID NO: 1172264 - RNA, 19 nt, Mycobacterium bovis subsp bovis AF2122/97
aagacuuagcgggugccag

SEQ ID NO: 1172265 - RNA, 20 nt, Mycobacterium bovis subsp bovis AF2122/97
aagacuuagcgggugccagc

SEQ ID NO: 1172266 - RNA, 16 nt, Mycobacterium bovis subsp bovis AF2122/97
aagagguggggcagga

SEQ ID NO: 1172267 - RNA, 16 nt, Mycobacterium bovis subsp bovis AF2122/97
aagaggcgcaccuccu

SEQ ID NO: 1172268 - RNA, 11 nt, Mycobacterium bovis subsp bovis AF2122/97
aagcaauucca

SEQ ID NO: 1172269 - RNA, 10 nt, Mycobacterium bovis subsp bovis AF2122/97
aagcaccagc

SEQ ID NO: 1172270 - RNA, 15 nt, Mycobacterium bovis subsp bovis AF2122/97
aagcaccagccagcc

SEQ ID NO: 1172271 - RNA, 14 nt, Mycobacterium bovis subsp bovis AF2122/97
aagcaccgaugcug

SEQ ID NO: 1172272 - RNA, 17 nt, Mycobacterium bovis subsp bovis AF2122/97
aagcaagcguguuguuu

SEQ ID NO: 1172273 - RNA, 14 nt, Mycobacterium bovis subsp bovis AF2122/97
aagcagccagcaac

SEQ ID NO: 1172274 - RNA, 15 nt, Mycobacterium bovis subsp bovis AF2122/97
aagaucagacccagc

SEQ ID NO: 1172275 - RNA, 21 nt, Mycobacterium bovis subsp bovis AF2122/97
aagaucagcaugguccacagc

SEQ ID NO: 1172276 - RNA, 18 nt, Mycobacterium bovis subsp bovis AF2122/97
aagaucagcggauccaga

SEQ ID NO: 1172277 - RNA, 14 nt, Mycobacterium bovis subsp bovis AF2122/97
aagaucuucgccga

SEQ ID NO: 1172278 - RNA, 18 nt, Mycobacterium bovis subsp bovis AF2122/97
aagaucgcgugccacagc

SEQ ID NO: 1172279 - RNA, 19 nt, Mycobacterium bovis subsp bovis AF2122/97
aagaucgcgugccacagca

SEQ ID NO: 1172280 - RNA, 15 nt, Mycobacterium bovis subsp bovis AF2122/97
aagaucggugccagc

SEQ ID NO: 1172281 - RNA, 15 nt, Mycobacterium bovis subsp bovis AF2122/97
aagaugccugcuagc

SEQ ID NO: 1172282 - RNA, 19 nt, Mycobacterium bovis subsp bovis AF2122/97
aagaugccugcuagcagca

SEQ ID NO: 1172283 - RNA, 20 nt, Mycobacterium bovis subsp bovis AF2122/97
aagaugccugcuagcagcag

SEQ ID NO: 1172284 - RNA, 19 nt, Mycobacterium bovis subsp bovis AF2122/97
aagauuauggcgagcgcgc

SEQ ID NO: 1172285 - RNA, 20 nt, Mycobacterium bovis subsp bovis AF2122/97
uuugucgcggagucugcuga

SEQ ID NO: 1172286 - RNA, 13 nt, Mycobacterium bovis subsp bovis AF2122/97
uuuggguuuuguu

SEQ ID NO: 1172287 - RNA, 22 nt, Mycobacterium bovis subsp bovis AF2122/97
uuugguugcccgcauugccaac

SEQ ID NO: 1172288 - RNA, 20 nt, Mycobacterium bovis subsp bovis AF2122/97
uuuucgaucgcuugccccgc

SEQ ID NO: 1172289 - RNA, 13 nt, Mycobacterium bovis subsp bovis AF2122/97
uuuugcugcaugc

SEQ ID NO: 1172290 - RNA, 19 nt, Mycobacterium bovis subsp bovis AF2122/97
uuuccgccgccgccgccau

SEQ ID NO: 1172291 - RNA, 17 nt, Mycobacterium bovis subsp bovis AF2122/97
uuuccggcauugccgcc

SEQ ID NO: 1172292 - RNA, 19 nt, Mycobacterium bovis subsp bovis AF2122/97
uuuccggcauugccgccgu

SEQ ID NO: 1172293 - RNA, 17 nt, Mycobacterium bovis subsp bovis AF2122/97
uuucgccgugaugaugu

SEQ ID NO: 1172294 - RNA, 19 nt, Mycobacterium bovis subsp bovis AF2122/97
uuucgcgugcggcugccag

SEQ ID NO: 1172295 - RNA, 21 nt, Mycobacterium bovis subsp bovis AF2122/97
uuuccuugcgcgccauuggcg

SEQ ID NO: 1172296 - RNA, 16 nt, Mycobacterium bovis subsp bovis AF2122/97
uuucgauauagccgcc

SEQ ID NO: 1172297 - RNA, 12 nt, Mycobacterium bovis subsp bovis AF2122/97
uuucggcugccg

SEQ ID NO: 1172298 - RNA, 15 nt, Mycobacterium bovis subsp bovis AF2122/97
uuucuccgccgccca

SEQ ID NO: 1172299 - RNA, 14 nt, Mycobacterium bovis subsp bovis AF2122/97
uuugagcgcacuca

SEQ ID NO: 1172300 - RNA, 21 nt, Mycobacterium bovis subsp bovis AF2122/97
uuugcacgcaccacaauccac

SEQ ID NO: 1172301 - RNA, 20 nt, Mycobacterium bovis subsp bovis AF2122/97
uuugcaggcccgaguuguug

SEQ ID NO: 1172302 - RNA, 20 nt, Mycobacterium bovis subsp bovis AF2122/97
uuugccccguugagcagcac

SEQ ID NO: 1172303 - RNA, 11 nt, Mycobacterium bovis subsp bovis AF2122/97
uuugccgccgg

SEQ ID NO: 1172304 - RNA, 20 nt, Mycobacterium bovis subsp bovis AF2122/97
uuugcguucccaucccucag

SEQ ID NO: 1172305 - RNA, 13 nt, Mycobacterium bovis subsp bovis AF2122/97
uuugcgaagccca

SEQ ID NO: 1172306 - RNA, 21 nt, Mycobacterium bovis subsp bovis AF2122/97
uuugcgccaggaguggccacg

SEQ ID NO: 1172307 - RNA, 16 nt, Mycobacterium bovis subsp bovis AF2122/97
uuugaccaccugguuu

SEQ ID NO: 1172308 - RNA, 20 nt, Mycobacterium bovis subsp bovis AF2122/97
uuugacguccagggccacga

SEQ ID NO: 1172309 - RNA, 22 nt, Mycobacterium bovis subsp bovis AF2122/97
uuugacgacaaacggcgaccca

SEQ ID NO: 1172310 - RNA, 13 nt, Mycobacterium bovis subsp bovis AF2122/97
uuugagaacaacg

SEQ ID NO: 1172311 - RNA, 19 nt, Mycobacterium bovis subsp bovis AF2122/97
uuuccacaccagcuuguag

SEQ ID NO: 1172312 - RNA, 12 nt, Mycobacterium bovis subsp bovis AF2122/97
uuuaggcagccc

SEQ ID NO: 1172313 - RNA, 16 nt, Mycobacterium bovis subsp bovis AF2122/97
uuguuuuugcacugaa

SEQ ID NO: 1172314 - RNA, 23 nt, Mycobacterium bovis subsp bovis AF2122/97
uuguugccgacgaucgacgccgc

SEQ ID NO: 1172315 - RNA, 15 nt, Mycobacterium bovis subsp bovis AF2122/97
uuguugcugcugccg

SEQ ID NO: 1172316 - RNA, 20 nt, Mycobacterium bovis subsp bovis AF2122/97
uugcugcggcuuucagcgcu

SEQ ID NO: 1172317 - RNA, 16 nt, Mycobacterium bovis subsp bovis AF2122/97
uguggaauacgcugcu

SEQ ID NO: 1172318 - RNA, 22 nt, Mycobacterium bovis subsp bovis AF2122/97
uguggacgcccgaguugaagaa

SEQ ID NO: 1172319 - RNA, 19 nt, Mycobacterium bovis subsp bovis AF2122/97
ugugccgggcgaugcuggg

SEQ ID NO: 1172320 - RNA, 21 nt, Mycobacterium bovis subsp bovis AF2122/97
ugugcccucaacgucccagcc

SEQ ID NO: 1172321 - RNA, 17 nt, Mycobacterium bovis subsp bovis AF2122/97
uuaacuacggugcccug

SEQ ID NO: 1172322 - RNA, 22 nt, Mycobacterium bovis subsp bovis AF2122/97
uuaagcgaacccgagccgccgu

SEQ ID NO: 1172323 - RNA, 19 nt, Mycobacterium bovis subsp bovis AF2122/97
uuacccaucgccacaccca

SEQ ID NO: 1172324 - RNA, 18 nt, Mycobacterium bovis subsp bovis AF2122/97
uuagcccacccauggccu

SEQ ID NO: 1172325 - RNA, 11 nt, Mycobacterium bovis subsp bovis AF2122/97
uuagccagguc

SEQ ID NO: 1172326 - RNA, 15 nt, Mycobacterium bovis subsp bovis AF2122/97
uuagcagcacccggg

SEQ ID NO: 1172327 - RNA, 19 nt, Mycobacterium bovis subsp bovis AF2122/97
uuagcaccaguucccuaca

SEQ ID NO: 1172328 - RNA, 13 nt, Mycobacterium bovis subsp bovis AF2122/97
uuacucaacaguu

SEQ ID NO: 1172329 - RNA, 17 nt, Mycobacterium bovis subsp bovis AF2122/97
uuaguuucguccccaga

SEQ ID NO: 1172330 - RNA, 21 nt, Mycobacterium bovis subsp bovis AF2122/97
uucacccgggcugcuugcgcc

SEQ ID NO: 1172331 - RNA, 20 nt, Mycobacterium bovis subsp bovis AF2122/97
uucagcacggugaucagcag

SEQ ID NO: 1172332 - RNA, 22 nt, Mycobacterium bovis subsp bovis AF2122/97
uucagcaggcccuucaguucga

SEQ ID NO: 1172333 - RNA, 15 nt, Mycobacterium bovis subsp bovis AF2122/97
uuauugagucggcug

SEQ ID NO: 1172334 - RNA, 20 nt, Mycobacterium bovis subsp bovis AF2122/97
uuaucgacaccaccauuccc

SEQ ID NO: 1172335 - RNA, 14 nt, Mycobacterium bovis subsp bovis AF2122/97
uuaucgaagcccga

SEQ ID NO: 1172336 - RNA, 15 nt, Mycobacterium bovis subsp bovis AF2122/97
uuauccggccaguga

SEQ ID NO: 1172337 - RNA, 16 nt, Mycobacterium bovis subsp bovis AF2122/97
uugaaauugaugaucu

SEQ ID NO: 1172338 - RNA, 20 nt, Mycobacterium bovis subsp bovis AF2122/97
uugaaauugaugaucugcag

SEQ ID NO: 1172339 - RNA, 15 nt, Mycobacterium bovis subsp bovis AF2122/97
uucuuuaaaccccug

SEQ ID NO: 1172340 - RNA, 21 nt, Mycobacterium bovis subsp bovis AF2122/97
uucugccaucaacaggccucg

SEQ ID NO: 1172341 - RNA, 13 nt, Mycobacterium bovis subsp bovis AF2122/97
uucugccuuggcc

SEQ ID NO: 1172342 - RNA, 21 nt, Mycobacterium bovis subsp bovis AF2122/97
uucuuugccggcgccuugguc

SEQ ID NO: 1172343 - RNA, 17 nt, Mycobacterium bovis subsp bovis AF2122/97
uugaaggcuugugccag

SEQ ID NO: 1172344 - RNA, 14 nt, Mycobacterium bovis subsp bovis AF2122/97
uugaagaggcgcac

SEQ ID NO: 1172345 - RNA, 13 nt, Mycobacterium bovis subsp bovis AF2122/97
uugaagaagcccg

SEQ ID NO: 1172346 - RNA, 14 nt, Mycobacterium bovis subsp bovis AF2122/97
uugaacgccgccag

SEQ ID NO: 1172347 - RNA, 12 nt, Mycobacterium bovis subsp bovis AF2122/97
uugaacugugcg

SEQ ID NO: 1172348 - RNA, 15 nt, Mycobacterium bovis subsp bovis AF2122/97
uugacguccagggcc

SEQ ID NO: 1172349 - RNA, 17 nt, Mycobacterium bovis subsp bovis AF2122/97
uugacggucagccgcgg

SEQ ID NO: 1172350 - RNA, 15 nt, Mycobacterium bovis subsp bovis AF2122/97
uugacugcugggggu

SEQ ID NO: 1172351 - RNA, 19 nt, Mycobacterium bovis subsp bovis AF2122/97
uugacugaacucaacacca

SEQ ID NO: 1172352 - RNA, 24 nt, Mycobacterium bovis subsp bovis AF2122/97
uugacccccucguccugcgagagg

SEQ ID NO: 1172353 - RNA, 13 nt, Mycobacterium bovis subsp bovis AF2122/97
uugacccacagca

SEQ ID NO: 1172354 - RNA, 23 nt, Mycobacterium bovis subsp bovis AF2122/97
uugacccacgagagcgcuguccc

SEQ ID NO: 1172355 - RNA, 13 nt, Mycobacterium bovis subsp bovis AF2122/97
uugacagacacag

SEQ ID NO: 1172356 - RNA, 14 nt, Mycobacterium bovis subsp bovis AF2122/97
uugcgcagccgcag

SEQ ID NO: 1172357 - RNA, 14 nt, Mycobacterium bovis subsp bovis AF2122/97
uugcgcagcaccag

SEQ ID NO: 1172358 - RNA, 23 nt, Mycobacterium bovis subsp bovis AF2122/97
uugcgcaggauguucaaucccuc

SEQ ID NO: 1172359 - RNA, 14 nt, Mycobacterium bovis subsp bovis AF2122/97
uugccuuccgaccc

SEQ ID NO: 1172360 - RNA, 23 nt, Mycobacterium bovis subsp bovis AF2122/97
uugcuccuggacuuccgguucau

SEQ ID NO: 1172361 - RNA, 16 nt, Mycobacterium bovis subsp bovis AF2122/97
uugcuccacaucggcu

SEQ ID NO: 1172362 - RNA, 16 nt, Mycobacterium bovis subsp bovis AF2122/97
uugcucagccggcccu

SEQ ID NO: 1172363 - RNA, 13 nt, Mycobacterium bovis subsp bovis AF2122/97
uugccgaagccgg

SEQ ID NO: 1172364 - RNA, 21 nt, Mycobacterium bovis subsp bovis AF2122/97
uugcccguguuaaagaagccu

SEQ ID NO: 1172365 - RNA, 23 nt, Mycobacterium bovis subsp bovis AF2122/97
uugcccgguuguggaaccacggc

SEQ ID NO: 1172366 - RNA, 19 nt, Mycobacterium bovis subsp bovis AF2122/97
uugccgccggccaugugca

SEQ ID NO: 1172367 - RNA, 10 nt, Mycobacterium bovis subsp bovis AF2122/97
uugccgccgg

SEQ ID NO: 1172368 - RNA, 13 nt, Mycobacterium bovis subsp bovis AF2122/97
uugccgccgacgc

SEQ ID NO: 1172369 - RNA, 15 nt, Mycobacterium bovis subsp bovis AF2122/97
uugccgccuuggccc

SEQ ID NO: 1172370 - RNA, 23 nt, Mycobacterium bovis subsp bovis AF2122/97
uugccgccggccccgccagcgcc

SEQ ID NO: 1172371 - RNA, 19 nt, Mycobacterium bovis subsp bovis AF2122/97
uugccgccggucaucccaa

SEQ ID NO: 1172372 - RNA, 10 nt, Mycobacterium bovis subsp bovis AF2122/97
uugccgccgu

SEQ ID NO: 1172373 - RNA, 23 nt, Mycobacterium bovis subsp bovis AF2122/97
uugccgccgucaccgccguugcc

SEQ ID NO: 1172374 - RNA, 23 nt, Mycobacterium bovis subsp bovis AF2122/97
uugccgccgucgccgccguugcc

SEQ ID NO: 1172375 - RNA, 14 nt, Mycobacterium bovis subsp bovis AF2122/97
uugccgccuuggcc

SEQ ID NO: 1172376 - RNA, 15 nt, Mycobacterium bovis subsp bovis AF2122/97
uugccaccagaaaca

SEQ ID NO: 1172377 - RNA, 13 nt, Mycobacterium bovis subsp bovis AF2122/97
uugcccauccccg

SEQ ID NO: 1172378 - RNA, 12 nt, Mycobacterium bovis subsp bovis AF2122/97
uugcccagguga

SEQ ID NO: 1172379 - RNA, 13 nt, Mycobacterium bovis subsp bovis AF2122/97
uugcccccagggc

SEQ ID NO: 1172380 - RNA, 16 nt, Mycobacterium bovis subsp bovis AF2122/97
uugccccgccuuggcc

SEQ ID NO: 1172381 - RNA, 22 nt, Mycobacterium bovis subsp bovis AF2122/97
uugccccguugagcagcaccca

SEQ ID NO: 1172382 - RNA, 13 nt, Mycobacterium bovis subsp bovis AF2122/97
uugcacagcggca

SEQ ID NO: 1172383 - RNA, 13 nt, Mycobacterium bovis subsp bovis AF2122/97
uugccaaagccca

SEQ ID NO: 1172384 - RNA, 13 nt, Mycobacterium bovis subsp bovis AF2122/97
uugccaaagcccg

SEQ ID NO: 1172385 - RNA, 20 nt, Mycobacterium bovis subsp bovis AF2122/97
uugcacaccggcacugccca

SEQ ID NO: 1172386 - RNA, 19 nt, Mycobacterium bovis subsp bovis AF2122/97
uugaugaucugcagcucca

SEQ ID NO: 1172387 - RNA, 14 nt, Mycobacterium bovis subsp bovis AF2122/97
uugauugaccugcu

SEQ ID NO: 1172388 - RNA, 21 nt, Mycobacterium bovis subsp bovis AF2122/97
uugagacgccggggaaccuug

SEQ ID NO: 1172389 - RNA, 16 nt, Mycobacterium bovis subsp bovis AF2122/97
uuccuggguugugccg

SEQ ID NO: 1172390 - RNA, 18 nt, Mycobacterium bovis subsp bovis AF2122/97
uuccuggcgggcgccuug

SEQ ID NO: 1172391 - RNA, 21 nt, Mycobacterium bovis subsp bovis AF2122/97
uuccuggcgggcgccuugguc

SEQ ID NO: 1172392 - RNA, 16 nt, Mycobacterium bovis subsp bovis AF2122/97
uuccgcuaccgcacag

SEQ ID NO: 1172393 - RNA, 19 nt, Mycobacterium bovis subsp bovis AF2122/97
uuccgcucguucgugcagc

SEQ ID NO: 1172394 - RNA, 15 nt, Mycobacterium bovis subsp bovis AF2122/97
uuccgcggguuugau

SEQ ID NO: 1172395 - RNA, 19 nt, Mycobacterium bovis subsp bovis AF2122/97
uuccucaaggucggccagg

SEQ ID NO: 1172396 - RNA, 15 nt, Mycobacterium bovis subsp bovis AF2122/97
uuccuccggcagcag

SEQ ID NO: 1172397 - RNA, 13 nt, Mycobacterium bovis subsp bovis AF2122/97
uucccgaaccccg

SEQ ID NO: 1172398 - RNA, 17 nt, Mycobacterium bovis subsp bovis AF2122/97
uucccgccauugccgcc

SEQ ID NO: 1172399 - RNA, 19 nt, Mycobacterium bovis subsp bovis AF2122/97
uucccgaguugcccucugg

SEQ ID NO: 1172400 - RNA, 17 nt, Mycobacterium bovis subsp bovis AF2122/97
uucccgcggacagcccg

SEQ ID NO: 1172401 - RNA, 13 nt, Mycobacterium bovis subsp bovis AF2122/97
uuccgaagcccgg

SEQ ID NO: 1172402 - RNA, 12 nt, Mycobacterium bovis subsp bovis AF2122/97
uucccaccacca

SEQ ID NO: 1172403 - RNA, 18 nt, Mycobacterium bovis subsp bovis AF2122/97
uucccaccaccaccgccg

SEQ ID NO: 1172404 - RNA, 19 nt, Mycobacterium bovis subsp bovis AF2122/97
uucccaugcgggucugaca

SEQ ID NO: 1172405 - RNA, 15 nt, Mycobacterium bovis subsp bovis AF2122/97
uucccaucggccugg

SEQ ID NO: 1172406 - RNA, 23 nt, Mycobacterium bovis subsp bovis AF2122/97
uucccaucggccuggugcucaac

SEQ ID NO: 1172407 - RNA, 14 nt, Mycobacterium bovis subsp bovis AF2122/97
uucccacuggaggu

SEQ ID NO: 1172408 - RNA, 17 nt, Mycobacterium bovis subsp bovis AF2122/97
uuccaugcgacuucauc

SEQ ID NO: 1172409 - RNA, 16 nt, Mycobacterium bovis subsp bovis AF2122/97
uuccauacagccgccg

SEQ ID NO: 1172410 - RNA, 21 nt, Mycobacterium bovis subsp bovis AF2122/97
uuccagcaucaguuugacgcc

SEQ ID NO: 1172411 - RNA, 15 nt, Mycobacterium bovis subsp bovis AF2122/97
uuccagcaguacacc

SEQ ID NO: 1172412 - RNA, 15 nt, Mycobacterium bovis subsp bovis AF2122/97
uuccagccacagccc

SEQ ID NO: 1172413 - RNA, 14 nt, Mycobacterium bovis subsp bovis AF2122/97
uuccagccaggccu

SEQ ID NO: 1172414 - RNA, 22 nt, Mycobacterium bovis subsp bovis AF2122/97
uuccagaguucccgaaacccga

SEQ ID NO: 1172415 - RNA, 15 nt, Mycobacterium bovis subsp bovis AF2122/97
uuccaccguuagcca

SEQ ID NO: 1172416 - RNA, 22 nt, Mycobacterium bovis subsp bovis AF2122/97
uuccacuccccagccccacccg

SEQ ID NO: 1172417 - RNA, 17 nt, Mycobacterium bovis subsp bovis AF2122/97
uucaggcccugccgacg

SEQ ID NO: 1172418 - RNA, 15 nt, Mycobacterium bovis subsp bovis AF2122/97
uuccacaccaggccg

SEQ ID NO: 1172419 - RNA, 20 nt, Mycobacterium bovis subsp bovis AF2122/97
uucagggcgucgaacucauc

SEQ ID NO: 1172420 - RNA, 14 nt, Mycobacterium bovis subsp bovis AF2122/97
uucugcaccagcuc

SEQ ID NO: 1172421 - RNA, 18 nt, Mycobacterium bovis subsp bovis AF2122/97
uucucguagucaaccaag

SEQ ID NO: 1172422 - RNA, 17 nt, Mycobacterium bovis subsp bovis AF2122/97
uucucgguaccaccggc

SEQ ID NO: 1172423 - RNA, 17 nt, Mycobacterium bovis subsp bovis AF2122/97
uucggugagcgggagga

SEQ ID NO: 1172424 - RNA, 14 nt, Mycobacterium bovis subsp bovis AF2122/97
uucggagucacgca

SEQ ID NO: 1172425 - RNA, 21 nt, Mycobacterium bovis subsp bovis AF2122/97
uucguagggauagcagugcag

SEQ ID NO: 1172426 - RNA, 13 nt, Mycobacterium bovis subsp bovis AF2122/97
uucggugucgccg

SEQ ID NO: 1172427 - RNA, 14 nt, Mycobacterium bovis subsp bovis AF2122/97
uucggugccagcag

SEQ ID NO: 1172428 - RNA, 16 nt, Mycobacterium bovis subsp bovis AF2122/97
uucgguggagggcgag

SEQ ID NO: 1172429 - RNA, 14 nt, Mycobacterium bovis subsp bovis AF2122/97
uucgguggcggcag

SEQ ID NO: 1172430 - RNA, 15 nt, Mycobacterium bovis subsp bovis AF2122/97
uucguggccuugaca

SEQ ID NO: 1172431 - RNA, 23 nt, Mycobacterium bovis subsp bovis AF2122/97
uucgccgccguuggcucgagccg

SEQ ID NO: 1172432 - RNA, 18 nt, Mycobacterium bovis subsp bovis AF2122/97
uucgccgaguugaccgcc

SEQ ID NO: 1172433 - RNA, 14 nt, Mycobacterium bovis subsp bovis AF2122/97
uucgcuaauacacc

SEQ ID NO: 1172434 - RNA, 15 nt, Mycobacterium bovis subsp bovis AF2122/97
uucgcuaccuucuug

SEQ ID NO: 1172435 - RNA, 17 nt, Mycobacterium bovis subsp bovis AF2122/97
uucgcagccgcaccggg

SEQ ID NO: 1172436 - RNA, 20 nt, Mycobacterium bovis subsp bovis AF2122/97
uggagaaguuagccaccuug

SEQ ID NO: 1172437 - RNA, 20 nt, Mycobacterium bovis subsp bovis AF2122/97
uggagaagauuuucucggug

SEQ ID NO: 1172438 - RNA, 20 nt, Mycobacterium bovis subsp bovis AF2122/97
uggacuuuauggcuagugcu

SEQ ID NO: 1172439 - RNA, 22 nt, Mycobacterium bovis subsp bovis AF2122/97
uggacuuagcgcuugacccgcg

SEQ ID NO: 1172440 - RNA, 22 nt, Mycobacterium bovis subsp bovis AF2122/97
uggacuccggucagcgcggcga

SEQ ID NO: 1172441 - RNA, 16 nt, Mycobacterium bovis subsp bovis AF2122/97
uggacgcgcaugcccc

SEQ ID NO: 1172442 - RNA, 19 nt, Mycobacterium bovis subsp bovis AF2122/97
uggacgccuugcacaagcu

SEQ ID NO: 1172443 - RNA, 20 nt, Mycobacterium bovis subsp bovis AF2122/97
uggacgcccgaguugaagaa

SEQ ID NO: 1172444 - RNA, 21 nt, Mycobacterium bovis subsp bovis AF2122/97
uggacgccuugcacaagcuga

SEQ ID NO: 1172445 - RNA, 16 nt, Mycobacterium bovis subsp bovis AF2122/97
uggacgcgggccgacc

SEQ ID NO: 1172446 - RNA, 12 nt, Mycobacterium bovis subsp bovis AF2122/97
uggacggccucc

SEQ ID NO: 1172447 - RNA, 23 nt, Mycobacterium bovis subsp bovis AF2122/97
uggacgugucaucacggucagcc

SEQ ID NO: 1172448 - RNA, 19 nt, Mycobacterium bovis subsp bovis AF2122/97
uggagcucaucgacgagcc

SEQ ID NO: 1172449 - RNA, 24 nt, Mycobacterium bovis subsp bovis AF2122/97
uggagcgccagccgcugccacagg

SEQ ID NO: 1172450 - RNA, 21 nt, Mycobacterium bovis subsp bovis AF2122/97
uggagcgcgccucgcccagca

SEQ ID NO: 1172451 - RNA, 21 nt, Mycobacterium bovis subsp bovis AF2122/97
uggagcuuggcccagcguguc

SEQ ID NO: 1172452 - RNA, 14 nt, Mycobacterium bovis subsp bovis AF2122/97
uggaggcgaucugc

SEQ ID NO: 1172453 - RNA, 13 nt, Mycobacterium bovis subsp bovis AF2122/97
uggagccggugac

SEQ ID NO: 1172454 - RNA, 19 nt, Mycobacterium bovis subsp bovis AF2122/97
uggagcgccagccgcugcc

SEQ ID NO: 1172455 - RNA, 15 nt, Mycobacterium bovis subsp bovis AF2122/97
uggagaucgccgccg

SEQ ID NO: 1172456 - RNA, 16 nt, Mycobacterium bovis subsp bovis AF2122/97
uggagaucuccucgag

SEQ ID NO: 1172457 - RNA, 14 nt, Mycobacterium bovis subsp bovis AF2122/97
uggaucugccucuc

SEQ ID NO: 1172458 - RNA, 19 nt, Mycobacterium bovis subsp bovis AF2122/97
uggaucgucucgcgcaccu

SEQ ID NO: 1172459 - RNA, 21 nt, Mycobacterium bovis subsp bovis AF2122/97
uggaugaccgaaccuggucuu

SEQ ID NO: 1172460 - RNA, 13 nt, Mycobacterium bovis subsp bovis AF2122/97
uggaucuucaccu

SEQ ID NO: 1172461 - RNA, 15 nt, Mycobacterium bovis subsp bovis AF2122/97
uggaucuuggccagc

SEQ ID NO: 1172462 - RNA, 19 nt, Mycobacterium bovis subsp bovis AF2122/97
uggaucuuggccagcagcg

SEQ ID NO: 1172463 - RNA, 22 nt, Mycobacterium bovis subsp bovis AF2122/97
uggaugcccguagacgccgagc

SEQ ID NO: 1172464 - RNA, 15 nt, Mycobacterium bovis subsp bovis AF2122/97
uggauggcgcccugc

SEQ ID NO: 1172465 - RNA, 16 nt, Mycobacterium bovis subsp bovis AF2122/97
uggauggcgcucacaa

SEQ ID NO: 1172466 - RNA, 15 nt, Mycobacterium bovis subsp bovis AF2122/97
uggauccggccacca

SEQ ID NO: 1172467 - RNA, 16 nt, Mycobacterium bovis subsp bovis AF2122/97
uggauccggccaccac

SEQ ID NO: 1172468 - RNA, 20 nt, Mycobacterium bovis subsp bovis AF2122/97
uggaguggugauccagccgu

SEQ ID NO: 1172469 - RNA, 16 nt, Mycobacterium bovis subsp bovis AF2122/97
uggagugaggcugugc

SEQ ID NO: 1172470 - RNA, 13 nt, Mycobacterium bovis subsp bovis AF2122/97
uggaguuggcugc

SEQ ID NO: 1172471 - RNA, 18 nt, Mycobacterium bovis subsp bovis AF2122/97
uggaguuuccgaagcccg

SEQ ID NO: 1172472 - RNA, 14 nt, Mycobacterium bovis subsp bovis AF2122/97
uggccaccgcccag

SEQ ID NO: 1172473 - RNA, 19 nt, Mycobacterium bovis subsp bovis AF2122/97
uggccacccggccgcgcgg

SEQ ID NO: 1172474 - RNA, 19 nt, Mycobacterium bovis subsp bovis AF2122/97
uggccaccgaacgcggcca

SEQ ID NO: 1172475 - RNA, 22 nt, Mycobacterium bovis subsp bovis AF2122/97
uggccagacccgaauccaccag

SEQ ID NO: 1172476 - RNA, 23 nt, Mycobacterium bovis subsp bovis AF2122/97
uggccagaccgcgcgcauaccua

SEQ ID NO: 1172477 - RNA, 21 nt, Mycobacterium bovis subsp bovis AF2122/97
uggccagcaacugccgcaccc

SEQ ID NO: 1172478 - RNA, 14 nt, Mycobacterium bovis subsp bovis AF2122/97
uggccagcacaccg

SEQ ID NO: 1172479 - RNA, 23 nt, Mycobacterium bovis subsp bovis AF2122/97
uggccagaucgaacgcagccagc

SEQ ID NO: 1172480 - RNA, 16 nt, Mycobacterium bovis subsp bovis AF2122/97
uggccagcaccacggc

SEQ ID NO: 1172481 - RNA, 16 nt, Mycobacterium bovis subsp bovis AF2122/97
uggccauguccaccag

SEQ ID NO: 1172482 - RNA, 18 nt, Mycobacterium bovis subsp bovis AF2122/97
uggccauguccaccagcg

SEQ ID NO: 1172483 - RNA, 17 nt, Mycobacterium bovis subsp bovis AF2122/97
uggcccaucuugaccaa

SEQ ID NO: 1172484 - RNA, 21 nt, Mycobacterium bovis subsp bovis AF2122/97
uggccauguccaccagcgugu

SEQ ID NO: 1172485 - RNA, 23 nt, Mycobacterium bovis subsp bovis AF2122/97
uggcccgaguuggcgaagcccga

SEQ ID NO: 1172486 - RNA, 17 nt, Mycobacterium bovis subsp bovis AF2122/97
uggccccgguggugcug

SEQ ID NO: 1172487 - RNA, 22 nt, Mycobacterium bovis subsp bovis AF2122/97
uggcccccgacggugaaccacc

SEQ ID NO: 1172488 - RNA, 13 nt, Mycobacterium bovis subsp bovis AF2122/97
uggccccagggga

SEQ ID NO: 1172489 - RNA, 13 nt, Mycobacterium bovis subsp bovis AF2122/97
uggccaccaucac

SEQ ID NO: 1172490 - RNA, 18 nt, Mycobacterium bovis subsp bovis AF2122/97
uggccaccaucgccgccg

SEQ ID NO: 1172491 - RNA, 12 nt, Mycobacterium bovis subsp bovis AF2122/97
uggccacccggc

SEQ ID NO: 1172492 - RNA, 16 nt, Mycobacterium bovis subsp bovis AF2122/97
uggcauugcgcccacc

SEQ ID NO: 1172493 - RNA, 16 nt, Mycobacterium bovis subsp bovis AF2122/97
uggccaccagcuggcg

SEQ ID NO: 1172494 - RNA, 20 nt, Mycobacterium bovis subsp bovis AF2122/97
uggccaccaggggaccgcgg

SEQ ID NO: 1172495 - RNA, 19 nt, Mycobacterium bovis subsp bovis AF2122/97
uggcaugccggcgugcggc

SEQ ID NO: 1172496 - RNA, 19 nt, Mycobacterium bovis subsp bovis AF2122/97
uggcaucgaacgcccugac

SEQ ID NO: 1172497 - RNA, 16 nt, Mycobacterium bovis subsp bovis AF2122/97
uggcaucggccaucuc

SEQ ID NO: 1172498 - RNA, 14 nt, Mycobacterium bovis subsp bovis AF2122/97
uggcaucgccucca

SEQ ID NO: 1172499 - RNA, 15 nt, Mycobacterium bovis subsp bovis AF2122/97
uggcauccagcagcg

SEQ ID NO: 1172500 - RNA, 19 nt, Mycobacterium bovis subsp bovis AF2122/97
uggcauccaaaaucgccug

SEQ ID NO: 1172501 - RNA, 18 nt, Mycobacterium bovis subsp bovis AF2122/97
uggcaggugccuucuucg

SEQ ID NO: 1172502 - RNA, 13 nt, Mycobacterium bovis subsp bovis AF2122/97
uggcaguccagcc

SEQ ID NO: 1172503 - RNA, 14 nt, Mycobacterium bovis subsp bovis AF2122/97
uggcaguggcgcgg

SEQ ID NO: 1172504 - RNA, 20 nt, Mycobacterium bovis subsp bovis AF2122/97
uggcagaccggugagcaccg

SEQ ID NO: 1172505 - RNA, 22 nt, Mycobacterium bovis subsp bovis AF2122/97
uggcagagccgccguugccgcc

SEQ ID NO: 1172506 - RNA, 12 nt, Mycobacterium bovis subsp bovis AF2122/97
uggcacugccgg

SEQ ID NO: 1172507 - RNA, 21 nt, Mycobacterium bovis subsp bovis AF2122/97
uggcacgggucgucaugccag

SEQ ID NO: 1172508 - RNA, 18 nt, Mycobacterium bovis subsp bovis AF2122/97
uggcacggccccugccac

SEQ ID NO: 1172509 - RNA, 16 nt, Mycobacterium bovis subsp bovis AF2122/97
uggauggccgccaggc

SEQ ID NO: 1172510 - RNA, 22 nt, Mycobacterium bovis subsp bovis AF2122/97
uggauguaguuggcgaccugcg

SEQ ID NO: 1172511 - RNA, 21 nt, Mycobacterium bovis subsp bovis AF2122/97
ugggccaugcuaggaccacca

SEQ ID NO: 1172512 - RNA, 21 nt, Mycobacterium bovis subsp bovis AF2122/97
ugggcccccaaucagugcagc

SEQ ID NO: 1172513 - RNA, 15 nt, Mycobacterium bovis subsp bovis AF2122/97
ugggccccgccgaug

SEQ ID NO: 1172514 - RNA, 16 nt, Mycobacterium bovis subsp bovis AF2122/97
ugggcccgccagccca

SEQ ID NO: 1172515 - RNA, 21 nt, Mycobacterium bovis subsp bovis AF2122/97
ugggcccugcacagcagcguc

SEQ ID NO: 1172516 - RNA, 17 nt, Mycobacterium bovis subsp bovis AF2122/97
ugggcccgccagcccag

SEQ ID NO: 1172517 - RNA, 20 nt, Mycobacterium bovis subsp bovis AF2122/97
ugggccgacgugaccagcuu

SEQ ID NO: 1172518 - RNA, 21 nt, Mycobacterium bovis subsp bovis AF2122/97
ugggccgacugggcgcgaccc

SEQ ID NO: 1172519 - RNA, 14 nt, Mycobacterium bovis subsp bovis AF2122/97
ugggccgagcgcgc

SEQ ID NO: 1172520 - RNA, 19 nt, Mycobacterium bovis subsp bovis AF2122/97
ugggccgcccaaagaaaug

SEQ ID NO: 1172521 - RNA, 12 nt, Mycobacterium bovis subsp bovis AF2122/97
ugggccgcucca

SEQ ID NO: 1172522 - RNA, 14 nt, Mycobacterium bovis subsp bovis AF2122/97
ugggccgcugauca

SEQ ID NO: 1172523 - RNA, 21 nt, Mycobacterium bovis subsp bovis AF2122/97
ugggccgcugggauucugggc

SEQ ID NO: 1172524 - RNA, 21 nt, Mycobacterium bovis subsp bovis AF2122/97
ugggccgggaugaagccaccc

SEQ ID NO: 1172525 - RNA, 15 nt, Mycobacterium bovis subsp bovis AF2122/97
ugggccugccagucc

SEQ ID NO: 1172526 - RNA, 23 nt, Mycobacterium bovis subsp bovis AF2122/97
ugggccuccaccgcguccaggug

SEQ ID NO: 1172527 - RNA, 16 nt, Mycobacterium bovis subsp bovis AF2122/97
ugggcauugcggcgcg

SEQ ID NO: 1172528 - RNA, 15 nt, Mycobacterium bovis subsp bovis AF2122/97
ugggcaucaccgccg

SEQ ID NO: 1172529 - RNA, 21 nt, Mycobacterium bovis subsp bovis AF2122/97
ugggcauugcggcgcgggugc

SEQ ID NO: 1172530 - RNA, 21 nt, Mycobacterium bovis subsp bovis AF2122/97
ugggcagcgcgcccgacaccc

SEQ ID NO: 1172531 - RNA, 22 nt, Mycobacterium bovis subsp bovis AF2122/97
ugggagccacugcggcauggca

SEQ ID NO: 1172532 - RNA, 18 nt, Mycobacterium bovis subsp bovis AF2122/97
ugggagcuacccgggcca

SEQ ID NO: 1172533 - RNA, 11 nt, Mycobacterium bovis subsp bovis AF2122/97
ugggagcagcc

SEQ ID NO: 1172534 - RNA, 23 nt, Mycobacterium bovis subsp bovis AF2122/97
ugggcugcgcgucgagcagcacc

SEQ ID NO: 1172535 - RNA, 22 nt, Mycobacterium bovis subsp bovis AF2122/97
ugggcgaagcccagaucuugca

SEQ ID NO: 1172536 - RNA, 13 nt, Mycobacterium bovis subsp bovis AF2122/97
ugggcgagaccgc

SEQ ID NO: 1172537 - RNA, 14 nt, Mycobacterium bovis subsp bovis AF2122/97
uggggucgcugccg

SEQ ID NO: 1172538 - RNA, 18 nt, Mycobacterium bovis subsp bovis AF2122/97
uggggaacagcagcgcac

SEQ ID NO: 1172539 - RNA, 14 nt, Mycobacterium bovis subsp bovis AF2122/97
ugggcuuucagcac

SEQ ID NO: 1172540 - RNA, 14 nt, Mycobacterium bovis subsp bovis AF2122/97
ugggguuguuggcg

SEQ ID NO: 1172541 - RNA, 19 nt, Mycobacterium bovis subsp bovis AF2122/97
uggcugcuguugguauuag

SEQ ID NO: 1172542 - RNA, 19 nt, Mycobacterium bovis subsp bovis AF2122/97
uggcugcgguaguugcagu

SEQ ID NO: 1172543 - RNA, 22 nt, Mycobacterium bovis subsp bovis AF2122/97
uggcucuguagcgucgcaccca

SEQ ID NO: 1172544 - RNA, 18 nt, Mycobacterium bovis subsp bovis AF2122/97
uggcucccuuuuccaaag

SEQ ID NO: 1172545 - RNA, 13 nt, Mycobacterium bovis subsp bovis AF2122/97
uggcucgagccgc

SEQ ID NO: 1172546 - RNA, 14 nt, Mycobacterium bovis subsp bovis AF2122/97
ugggacuggcguga

SEQ ID NO: 1172547 - RNA, 21 nt, Mycobacterium bovis subsp bovis AF2122/97
ugggaccagugcgguggcagg

SEQ ID NO: 1172548 - RNA, 21 nt, Mycobacterium bovis subsp bovis AF2122/97
ugggacaaagacgccgucggc

SEQ ID NO: 1172549 - RNA, 15 nt, Mycobacterium bovis subsp bovis AF2122/97
uggcgcgcagcgcga

SEQ ID NO: 1172550 - RNA, 15 nt, Mycobacterium bovis subsp bovis AF2122/97
uggcgccccaggugg

SEQ ID NO: 1172551 - RNA, 13 nt, Mycobacterium bovis subsp bovis AF2122/97
uggcgcccgccgg

SEQ ID NO: 1172552 - RNA, 17 nt, Mycobacterium bovis subsp bovis AF2122/97
uggcgcggcgagcacgc

SEQ ID NO: 1172553 - RNA, 15 nt, Mycobacterium bovis subsp bovis AF2122/97
uggcgcggggccgcc

SEQ ID NO: 1172554 - RNA, 18 nt, Mycobacterium bovis subsp bovis AF2122/97
uggcgcggguccagccac

SEQ ID NO: 1172555 - RNA, 11 nt, Mycobacterium bovis subsp bovis AF2122/97
uggcgcggccg

SEQ ID NO: 1172556 - RNA, 14 nt, Mycobacterium bovis subsp bovis AF2122/97
uggcgcggacccgc

SEQ ID NO: 1172557 - RNA, 22 nt, Mycobacterium bovis subsp bovis AF2122/97
uggcgcgcccacagcccgggcg

SEQ ID NO: 1172558 - RNA, 13 nt, Mycobacterium bovis subsp bovis AF2122/97
uggcggcgccggu

SEQ ID NO: 1172559 - RNA, 23 nt, Mycobacterium bovis subsp bovis AF2122/97
uggcggcgaucaacucgggcagc

SEQ ID NO: 1172560 - RNA, 23 nt, Mycobacterium bovis subsp bovis AF2122/97
uggcggccucgccggcgcgcagc

SEQ ID NO: 1172561 - RNA, 18 nt, Mycobacterium bovis subsp bovis AF2122/97
uggcggccuugcucagca

SEQ ID NO: 1172562 - RNA, 19 nt, Mycobacterium bovis subsp bovis AF2122/97
uggcggccuccuccccgac

SEQ ID NO: 1172563 - RNA, 19 nt, Mycobacterium bovis subsp bovis AF2122/97
uggcgcguggucgggaacc

SEQ ID NO: 1172564 - RNA, 17 nt, Mycobacterium bovis subsp bovis AF2122/97
uggcggcgguggccagc

SEQ ID NO: 1172565 - RNA, 13 nt, Mycobacterium bovis subsp bovis AF2122/97
uggcggcgggggc

SEQ ID NO: 1172566 - RNA, 16 nt, Mycobacterium bovis subsp bovis AF2122/97
uggcggcgccgcagau

SEQ ID NO: 1172567 - RNA, 15 nt, Mycobacterium bovis subsp bovis AF2122/97
uggcgguuccggccg

SEQ ID NO: 1172568 - RNA, 17 nt, Mycobacterium bovis subsp bovis AF2122/97
uggcgguuccggccggc

SEQ ID NO: 1172569 - RNA, 13 nt, Mycobacterium bovis subsp bovis AF2122/97
uggcgucaccgcc

SEQ ID NO: 1172570 - RNA, 21 nt, Mycobacterium bovis subsp bovis AF2122/97
uggcguuugaugcgggcggca

SEQ ID NO: 1172571 - RNA, 14 nt, Mycobacterium bovis subsp bovis AF2122/97
uggcucaucgaugc

SEQ ID NO: 1172572 - RNA, 18 nt, Mycobacterium bovis subsp bovis AF2122/97
uggcucaccgacaugacg

SEQ ID NO: 1172573 - RNA, 22 nt, Mycobacterium bovis subsp bovis AF2122/97
uggcuagcagguacucgcccca

SEQ ID NO: 1172574 - RNA, 19 nt, Mycobacterium bovis subsp bovis AF2122/97
uggcuacgccccacugccg

SEQ ID NO: 1172575 - RNA, 21 nt, Mycobacterium bovis subsp bovis AF2122/97
uggcuacgggccgcgguaccc

SEQ ID NO: 1172576 - RNA, 21 nt, Mycobacterium bovis subsp bovis AF2122/97
uggcuauccaccugcuggggc

SEQ ID NO: 1172577 - RNA, 22 nt, Mycobacterium bovis subsp bovis AF2122/97
uggcuaguugggugggugcagc

SEQ ID NO: 1172578 - RNA, 18 nt, Mycobacterium bovis subsp bovis AF2122/97
uggcgcaucagcuuuugc

SEQ ID NO: 1172579 - RNA, 16 nt, Mycobacterium bovis subsp bovis AF2122/97
uggcgccaaaaaggau

SEQ ID NO: 1172580 - RNA, 15 nt, Mycobacterium bovis subsp bovis AF2122/97
uggcgccaccggccg

SEQ ID NO: 1172581 - RNA, 16 nt, Mycobacterium bovis subsp bovis AF2122/97
uggcgccaccggcguu

SEQ ID NO: 1172582 - RNA, 14 nt, Mycobacterium bovis subsp bovis AF2122/97
uggcgccagggccu

SEQ ID NO: 1172583 - RNA, 15 nt, Mycobacterium bovis subsp bovis AF2122/97
uggcgcaccggcguc

SEQ ID NO: 1172584 - RNA, 22 nt, Mycobacterium bovis subsp bovis AF2122/97
uggcgaccaccgcgucgggccg

SEQ ID NO: 1172585 - RNA, 20 nt, Mycobacterium bovis subsp bovis AF2122/97
uggcgacucgugucugccuc

SEQ ID NO: 1172586 - RNA, 18 nt, Mycobacterium bovis subsp bovis AF2122/97
uggccgaacgacgggucc

SEQ ID NO: 1172587 - RNA, 15 nt, Mycobacterium bovis subsp bovis AF2122/97
uggccgaacaggaug

SEQ ID NO: 1172588 - RNA, 18 nt, Mycobacterium bovis subsp bovis AF2122/97
uggccgaacaggaugaug

SEQ ID NO: 1172589 - RNA, 17 nt, Mycobacterium bovis subsp bovis AF2122/97
uggccgaacauucccau

SEQ ID NO: 1172590 - RNA, 21 nt, Mycobacterium bovis subsp bovis AF2122/97
uggccgaacagcaggccucca

SEQ ID NO: 1172591 - RNA, 16 nt, Mycobacterium bovis subsp bovis AF2122/97
uggccgacgcugcuga

SEQ ID NO: 1172592 - RNA, 21 nt, Mycobacterium bovis subsp bovis AF2122/97
uggccgaacuaccgacgcacc

SEQ ID NO: 1172593 - RNA, 12 nt, Mycobacterium bovis subsp bovis AF2122/97
uggcccugggcc

SEQ ID NO: 1172594 - RNA, 13 nt, Mycobacterium bovis subsp bovis AF2122/97
uggcccugcuccu

SEQ ID NO: 1172595 - RNA, 21 nt, Mycobacterium bovis subsp bovis AF2122/97
uggcccgggcccgcgggauca

SEQ ID NO: 1172596 - RNA, 12 nt, Mycobacterium bovis subsp bovis AF2122/97
uggcccgggccc

SEQ ID NO: 1172597 - RNA, 22 nt, Mycobacterium bovis subsp bovis AF2122/97
uggcccgcggugacgcaacauc

SEQ ID NO: 1172598 - RNA, 22 nt, Mycobacterium bovis subsp bovis AF2122/97
uggcccgcucccugcacccagc

SEQ ID NO: 1172599 - RNA, 19 nt, Mycobacterium bovis subsp bovis AF2122/97
uggccccuuucugaagcug

SEQ ID NO: 1172600 - RNA, 21 nt, Mycobacterium bovis subsp bovis AF2122/97
uggcccggacaugcgggcagc

SEQ ID NO: 1172601 - RNA, 21 nt, Mycobacterium bovis subsp bovis AF2122/97
uggccugauuccacugggccu

SEQ ID NO: 1172602 - RNA, 23 nt, Mycobacterium bovis subsp bovis AF2122/97
uggccugcagcgcgacccguagc

SEQ ID NO: 1172603 - RNA, 13 nt, Mycobacterium bovis subsp bovis AF2122/97
uggccugcccagc

SEQ ID NO: 1172604 - RNA, 16 nt, Mycobacterium bovis subsp bovis AF2122/97
uggccugcccagcacc

SEQ ID NO: 1172605 - RNA, 19 nt, Mycobacterium bovis subsp bovis AF2122/97
uggccugcccagcaccacc

SEQ ID NO: 1172606 - RNA, 15 nt, Mycobacterium bovis subsp bovis AF2122/97
uggcgaccaccgcgu

SEQ ID NO: 1172607 - RNA, 16 nt, Mycobacterium bovis subsp bovis AF2122/97
uggcgaccaccgcguc

SEQ ID NO: 1172608 - RNA, 16 nt, Mycobacterium bovis subsp bovis AF2122/97
ugguuccagaggcccg

SEQ ID NO: 1172609 - RNA, 17 nt, Mycobacterium bovis subsp bovis AF2122/97
ugguugaaccgguacaa

SEQ ID NO: 1172610 - RNA, 14 nt, Mycobacterium bovis subsp bovis AF2122/97
ugguugaaccggua

SEQ ID NO: 1172611 - RNA, 23 nt, Mycobacterium bovis subsp bovis AF2122/97
ugguucggcgucgacccagaaca

SEQ ID NO: 1172612 - RNA, 13 nt, Mycobacterium bovis subsp bovis AF2122/97
ugguucgcacacc

SEQ ID NO: 1172613 - RNA, 19 nt, Mycobacterium bovis subsp bovis AF2122/97
ugguucgcacaccuccucg

SEQ ID NO: 1172614 - RNA, 15 nt, Mycobacterium bovis subsp bovis AF2122/97
ugguuggugcuggcc

SEQ ID NO: 1172615 - RNA, 13 nt, Mycobacterium bovis subsp bovis AF2122/97
ugguuggcucgcu

SEQ ID NO: 1172616 - RNA, 18 nt, Mycobacterium bovis subsp bovis AF2122/97
ugguugcgccaggaaccg

SEQ ID NO: 1172617 - RNA, 14 nt, Mycobacterium bovis subsp bovis AF2122/97
uguacgcccgcucg

SEQ ID NO: 1172618 - RNA, 16 nt, Mycobacterium bovis subsp bovis AF2122/97
uguacauugccgaccc

SEQ ID NO: 1172619 - RNA, 16 nt, Mycobacterium bovis subsp bovis AF2122/97
uggugggccagcagca

SEQ ID NO: 1172620 - RNA, 17 nt, Mycobacterium bovis subsp bovis AF2122/97
uggugggccagcagcaa

SEQ ID NO: 1172621 - RNA, 21 nt, Mycobacterium bovis subsp bovis AF2122/97
uggugggggagcggccgccgc

SEQ ID NO: 1172622 - RNA, 23 nt, Mycobacterium bovis subsp bovis AF2122/97
uggugggaggggacccagcggcg

SEQ ID NO: 1172623 - RNA, 23 nt, Mycobacterium bovis subsp bovis AF2122/97
ugguggccgggucgaucaccgac

SEQ ID NO: 1172624 - RNA, 11 nt, Mycobacterium bovis subsp bovis AF2122/97
ugguggccagc

SEQ ID NO: 1172625 - RNA, 15 nt, Mycobacterium bovis subsp bovis AF2122/97
ugguggcgaccccgc

SEQ ID NO: 1172626 - RNA, 18 nt, Mycobacterium bovis subsp bovis AF2122/97
ugguggcguaucgggccc

SEQ ID NO: 1172627 - RNA, 17 nt, Mycobacterium bovis subsp bovis AF2122/97
ugguggcccgggccacc

SEQ ID NO: 1172628 - RNA, 16 nt, Mycobacterium bovis subsp bovis AF2122/97
ugguggcagcgcaccc

SEQ ID NO: 1172629 - RNA, 23 nt, Mycobacterium bovis subsp bovis AF2122/97
ugguggaccucacugugguaggc

SEQ ID NO: 1172630 - RNA, 18 nt, Mycobacterium bovis subsp bovis AF2122/97
uggugggaucgcagcgcc

SEQ ID NO: 1172631 - RNA, 12 nt, Mycobacterium bovis subsp bovis AF2122/97
ugguggucagca

SEQ ID NO: 1172632 - RNA, 22 nt, Mycobacterium bovis subsp bovis AF2122/97
ugguguacccgccucgggccgg

SEQ ID NO: 1172633 - RNA, 15 nt, Mycobacterium bovis subsp bovis AF2122/97
ugguggugccgaccu

SEQ ID NO: 1172634 - RNA, 12 nt, Mycobacterium bovis subsp bovis AF2122/97
uggugguggagu

SEQ ID NO: 1172635 - RNA, 13 nt, Mycobacterium bovis subsp bovis AF2122/97
ugguguggggcgg

SEQ ID NO: 1172636 - RNA, 15 nt, Mycobacterium bovis subsp bovis AF2122/97
uggugucgcucaguu

SEQ ID NO: 1172637 - RNA, 14 nt, Mycobacterium bovis subsp bovis AF2122/97
ugguguccaccacc

SEQ ID NO: 1172638 - RNA, 17 nt, Mycobacterium bovis subsp bovis AF2122/97
ugguuagaggaugguca

SEQ ID NO: 1172639 - RNA, 15 nt, Mycobacterium bovis subsp bovis AF2122/97
uggugccgccugugc

SEQ ID NO: 1172640 - RNA, 16 nt, Mycobacterium bovis subsp bovis AF2122/97
uggugccgccugugcc

SEQ ID NO: 1172641 - RNA, 16 nt, Mycobacterium bovis subsp bovis AF2122/97
uggugccgccaccacc

SEQ ID NO: 1172642 - RNA, 14 nt, Mycobacterium bovis subsp bovis AF2122/97
uggugccgagcagc

SEQ ID NO: 1172643 - RNA, 19 nt, Mycobacterium bovis subsp bovis AF2122/97
uggugccggucaccucgcc

SEQ ID NO: 1172644 - RNA, 17 nt, Mycobacterium bovis subsp bovis AF2122/97
uggugccgucagguucu

SEQ ID NO: 1172645 - RNA, 17 nt, Mycobacterium bovis subsp bovis AF2122/97
uggugcccgugugcagc

SEQ ID NO: 1172646 - RNA, 19 nt, Mycobacterium bovis subsp bovis AF2122/97
uggugcccaaggcagaccc

SEQ ID NO: 1172647 - RNA, 16 nt, Mycobacterium bovis subsp bovis AF2122/97
uggugcccuugaagaa

SEQ ID NO: 1172648 - RNA, 21 nt, Mycobacterium bovis subsp bovis AF2122/97
uggugcccgugugcagccagc

SEQ ID NO: 1172649 - RNA, 14 nt, Mycobacterium bovis subsp bovis AF2122/97
uggugccgacccgc

SEQ ID NO: 1172650 - RNA, 17 nt, Mycobacterium bovis subsp bovis AF2122/97
uggugcuagcgccgcca

SEQ ID NO: 1172651 - RNA, 14 nt, Mycobacterium bovis subsp bovis AF2122/97
uggugcggcccugc

SEQ ID NO: 1172652 - RNA, 14 nt, Mycobacterium bovis subsp bovis AF2122/97
uggugccgcggcca

SEQ ID NO: 1172653 - RNA, 18 nt, Mycobacterium bovis subsp bovis AF2122/97
uggugccugcggguggau

SEQ ID NO: 1172654 - RNA, 16 nt, Mycobacterium bovis subsp bovis AF2122/97
uggugauccgagacca

SEQ ID NO: 1172655 - RNA, 22 nt, Mycobacterium bovis subsp bovis AF2122/97
uggugaguaccaauccaggcca

SEQ ID NO: 1172656 - RNA, 10 nt, Mycobacterium bovis subsp bovis AF2122/97
uggugccaac

SEQ ID NO: 1172657 - RNA, 14 nt, Mycobacterium bovis subsp bovis AF2122/97
uggugccaacugcg

SEQ ID NO: 1172658 - RNA, 14 nt, Mycobacterium bovis subsp bovis AF2122/97
uggugcagcgcagg

SEQ ID NO: 1172659 - RNA, 16 nt, Mycobacterium bovis subsp bovis AF2122/97
uggugcagcgugcagc

SEQ ID NO: 1172660 - RNA, 15 nt, Mycobacterium bovis subsp bovis AF2122/97
uggucucgguaggcg

SEQ ID NO: 1172661 - RNA, 16 nt, Mycobacterium bovis subsp bovis AF2122/97
uggucucuagcaaagc

SEQ ID NO: 1172662 - RNA, 17 nt, Mycobacterium bovis subsp bovis AF2122/97
uggucgugggccaccac

SEQ ID NO: 1172663 - RNA, 16 nt, Mycobacterium bovis subsp bovis AF2122/97
uggguaugcacccagg

SEQ ID NO: 1172664 - RNA, 16 nt, Mycobacterium bovis subsp bovis AF2122/97
uggguagcggaucaag

SEQ ID NO: 1172665 - RNA, 23 nt, Mycobacterium bovis subsp bovis AF2122/97
uggguagcugacgugucggcugc

SEQ ID NO: 1172666 - RNA, 20 nt, Mycobacterium bovis subsp bovis AF2122/97
uggguccccucccaccagcg

SEQ ID NO: 1172667 - RNA, 18 nt, Mycobacterium bovis subsp bovis AF2122/97
ugggucgauccggugccg

SEQ ID NO: 1172668 - RNA, 14 nt, Mycobacterium bovis subsp bovis AF2122/97
ugggucgcaauauc

SEQ ID NO: 1172669 - RNA, 13 nt, Mycobacterium bovis subsp bovis AF2122/97
ugggucgugcagg

SEQ ID NO: 1172670 - RNA, 14 nt, Mycobacterium bovis subsp bovis AF2122/97
ugggucagguuguc

SEQ ID NO: 1172671 - RNA, 21 nt, Mycobacterium bovis subsp bovis AF2122/97
ugggucaucgagucgaagaac

SEQ ID NO: 1172672 - RNA, 14 nt, Mycobacterium bovis subsp bovis AF2122/97
uguaucugcugccg

SEQ ID NO: 1172673 - RNA, 14 nt, Mycobacterium bovis subsp bovis AF2122/97
uguagccgagcacg

SEQ ID NO: 1172674 - RNA, 20 nt, Mycobacterium bovis subsp bovis AF2122/97
uguagccgagcacgggcaga

SEQ ID NO: 1172675 - RNA, 19 nt, Mycobacterium bovis subsp bovis AF2122/97
uguagcagcgccagcagcu

SEQ ID NO: 1172676 - RNA, 20 nt, Mycobacterium bovis subsp bovis AF2122/97
uguagccagcggcugcccau

SEQ ID NO: 1172677 - RNA, 13 nt, Mycobacterium bovis subsp bovis AF2122/97
uguagaucagcaa

SEQ ID NO: 1172678 - RNA, 13 nt, Mycobacterium bovis subsp bovis AF2122/97
uguacugcugcuu

SEQ ID NO: 1172679 - RNA, 16 nt, Mycobacterium bovis subsp bovis AF2122/97
uguagaucugggcugg

SEQ ID NO: 1172680 - RNA, 12 nt, Mycobacterium bovis subsp bovis AF2122/97
uguagcacaccg

SEQ ID NO: 1172681 - RNA, 15 nt, Mycobacterium bovis subsp bovis AF2122/97
ugucacccucgggcg

SEQ ID NO: 1172682 - RNA, 23 nt, Mycobacterium bovis subsp bovis AF2122/97
ugucagcaagaucggcagcgugg

SEQ ID NO: 1172683 - RNA, 14 nt, Mycobacterium bovis subsp bovis AF2122/97
ugucagcagcccau

SEQ ID NO: 1172684 - RNA, 17 nt, Mycobacterium bovis subsp bovis AF2122/97
ugucagcgcugagccgc

SEQ ID NO: 1172685 - RNA, 21 nt, Mycobacterium bovis subsp bovis AF2122/97
ugucagcgaacggccaggaca

SEQ ID NO: 1172686 - RNA, 19 nt, Mycobacterium bovis subsp bovis AF2122/97
ugucaggauauuucuaaau

SEQ ID NO: 1172687 - RNA, 21 nt, Mycobacterium bovis subsp bovis AF2122/97
ugucccgcgggccagcaccuc

SEQ ID NO: 1172688 - RNA, 15 nt, Mycobacterium bovis subsp bovis AF2122/97
ugucccaacgccacu

SEQ ID NO: 1172689 - RNA, 20 nt, Mycobacterium bovis subsp bovis AF2122/97
uguccgguccgccagcgcga

SEQ ID NO: 1172690 - RNA, 22 nt, Mycobacterium bovis subsp bovis AF2122/97
uguccggcccuacgcagcgcgg

SEQ ID NO: 1172691 - RNA, 21 nt, Mycobacterium bovis subsp bovis AF2122/97
uguccgccgugugcucuugcg

SEQ ID NO: 1172692 - RNA, 14 nt, Mycobacterium bovis subsp bovis AF2122/97
uguccgcagcaccg

SEQ ID NO: 1172693 - RNA, 21 nt, Mycobacterium bovis subsp bovis AF2122/97
uguccugcggauagugguugc

SEQ ID NO: 1172694 - RNA, 15 nt, Mycobacterium bovis subsp bovis AF2122/97
uguccuacuuuucca

SEQ ID NO: 1172695 - RNA, 22 nt, Mycobacterium bovis subsp bovis AF2122/97
ugucgaucagaaucugccucuc

SEQ ID NO: 1172696 - RNA, 15 nt, Mycobacterium bovis subsp bovis AF2122/97
ugucgaucagcgcga

SEQ ID NO: 1172697 - RNA, 19 nt, Mycobacterium bovis subsp bovis AF2122/97
ugucgauagcccgccaccc

SEQ ID NO: 1172698 - RNA, 16 nt, Mycobacterium bovis subsp bovis AF2122/97
ugucgacggugucuug

SEQ ID NO: 1172699 - RNA, 21 nt, Mycobacterium bovis subsp bovis AF2122/97
ugucgacgacaacgaugucac

SEQ ID NO: 1172700 - RNA, 15 nt, Mycobacterium bovis subsp bovis AF2122/97
ugucgaagaaccggc

SEQ ID NO: 1172701 - RNA, 19 nt, Mycobacterium bovis subsp bovis AF2122/97
uguccuugaaccagcgcgu

SEQ ID NO: 1172702 - RNA, 17 nt, Mycobacterium bovis subsp bovis AF2122/97
uguccuuguuggccagu

SEQ ID NO: 1172703 - RNA, 14 nt, Mycobacterium bovis subsp bovis AF2122/97
ugucgucgccgccg

SEQ ID NO: 1172704 - RNA, 14 nt, Mycobacterium bovis subsp bovis AF2122/97
ugucgucgcggccg

SEQ ID NO: 1172705 - RNA, 21 nt, Mycobacterium bovis subsp bovis AF2122/97
ugucgggaacgaguacgggca

SEQ ID NO: 1172706 - RNA, 18 nt, Mycobacterium bovis subsp bovis AF2122/97
ugucgugcaaugcuucca

SEQ ID NO: 1172707 - RNA, 19 nt, Mycobacterium bovis subsp bovis AF2122/97
ugucguggcgggugaugca

SEQ ID NO: 1172708 - RNA, 14 nt, Mycobacterium bovis subsp bovis AF2122/97
ugucuccggcaaca

SEQ ID NO: 1172709 - RNA, 16 nt, Mycobacterium bovis subsp bovis AF2122/97
ugucuccuuguccugc

SEQ ID NO: 1172710 - RNA, 18 nt, Mycobacterium bovis subsp bovis AF2122/97
ugucuccuuguccugccu

SEQ ID NO: 1172711 - RNA, 22 nt, Mycobacterium bovis subsp bovis AF2122/97
ugucguucgcgucacaccagcg

SEQ ID NO: 1172712 - RNA, 15 nt, Mycobacterium bovis subsp bovis AF2122/97
ugucucccuugccgc

SEQ ID NO: 1172713 - RNA, 18 nt, Mycobacterium bovis subsp bovis AF2122/97
ugugccgcugcauccgca

SEQ ID NO: 1172714 - RNA, 19 nt, Mycobacterium bovis subsp bovis AF2122/97
ugugccgauuggccugcca

SEQ ID NO: 1172715 - RNA, 24 nt, Mycobacterium bovis subsp bovis AF2122/97
ugugauccgguggugggccguggg

SEQ ID NO: 1172716 - RNA, 15 nt, Mycobacterium bovis subsp bovis AF2122/97
ugugaacugucccac

SEQ ID NO: 1172717 - RNA, 15 nt, Mycobacterium bovis subsp bovis AF2122/97
ugcucggucucgucg

SEQ ID NO: 1172718 - RNA, 19 nt, Mycobacterium bovis subsp bovis AF2122/97
ugcucggggaggaaaucca

SEQ ID NO: 1172719 - RNA, 20 nt, Mycobacterium bovis subsp bovis AF2122/97
ugcucgggggccgaccaguc

SEQ ID NO: 1172720 - RNA, 16 nt, Mycobacterium bovis subsp bovis AF2122/97
ugcucgucgagcaugc

SEQ ID NO: 1172721 - RNA, 20 nt, Mycobacterium bovis subsp bovis AF2122/97
ugcucguccaggucggccgc

SEQ ID NO: 1172722 - RNA, 23 nt, Mycobacterium bovis subsp bovis AF2122/97
ugcucgucauccauccgggccgc

SEQ ID NO: 1172723 - RNA, 14 nt, Mycobacterium bovis subsp bovis AF2122/97
ugcucggccugcuu

SEQ ID NO: 1172724 - RNA, 20 nt, Mycobacterium bovis subsp bovis AF2122/97
ugcucgcgccggugaggcga

SEQ ID NO: 1172725 - RNA, 15 nt, Mycobacterium bovis subsp bovis AF2122/97
ugcucggagagcagu

SEQ ID NO: 1172726 - RNA, 18 nt, Mycobacterium bovis subsp bovis AF2122/97
ugcucgccggaucuugcc

SEQ ID NO: 1172727 - RNA, 23 nt, Mycobacterium bovis subsp bovis AF2122/97
ugcucgccgggucagcccggcgc

SEQ ID NO: 1172728 - RNA, 22 nt, Mycobacterium bovis subsp bovis AF2122/97
ugcucgccaggcaagccagcac

SEQ ID NO: 1172729 - RNA, 13 nt, Mycobacterium bovis subsp bovis AF2122/97
ugcucgccaggcc

SEQ ID NO: 1172730 - RNA, 14 nt, Mycobacterium bovis subsp bovis AF2122/97
ugcucgccaggccu

SEQ ID NO: 1172731 - RNA, 18 nt, Mycobacterium bovis subsp bovis AF2122/97
ugcucgccaggccuaggc

SEQ ID NO: 1172732 - RNA, 23 nt, Mycobacterium bovis subsp bovis AF2122/97
ugcucgcgaggcucgcguggccg

SEQ ID NO: 1172733 - RNA, 22 nt, Mycobacterium bovis subsp bovis AF2122/97
ugcucgcaaucguuggccaugc

SEQ ID NO: 1172734 - RNA, 23 nt, Mycobacterium bovis subsp bovis AF2122/97
ugcucgcaaucguuggccaugcc

SEQ ID NO: 1172735 - RNA, 15 nt, Mycobacterium bovis subsp bovis AF2122/97
ugcucgauguccucg

SEQ ID NO: 1172736 - RNA, 16 nt, Mycobacterium bovis subsp bovis AF2122/97
ugcucgcacagcacca

SEQ ID NO: 1172737 - RNA, 20 nt, Mycobacterium bovis subsp bovis AF2122/97
ugcucgagcagaucagcacg

SEQ ID NO: 1172738 - RNA, 16 nt, Mycobacterium bovis subsp bovis AF2122/97
ugcucgauccacugcc

SEQ ID NO: 1172739 - RNA, 19 nt, Mycobacterium bovis subsp bovis AF2122/97
ugcucgucggcgccggcgg

SEQ ID NO: 1172740 - RNA, 18 nt, Mycobacterium bovis subsp bovis AF2122/97
ugcucgucuuggcggcgg

SEQ ID NO: 1172741 - RNA, 20 nt, Mycobacterium bovis subsp bovis AF2122/97
ugcugacgacgagggccagc

SEQ ID NO: 1172742 - RNA, 18 nt, Mycobacterium bovis subsp bovis AF2122/97
ugcugagcguaggccagc

SEQ ID NO: 1172743 - RNA, 18 nt, Mycobacterium bovis subsp bovis AF2122/97
ugcugagcgccaggccgc

SEQ ID NO: 1172744 - RNA, 15 nt, Mycobacterium bovis subsp bovis AF2122/97
ugcugaugcccuugc

SEQ ID NO: 1172745 - RNA, 21 nt, Mycobacterium bovis subsp bovis AF2122/97
ugcugcaccguuuccggcgcu

SEQ ID NO: 1172746 - RNA, 17 nt, Mycobacterium bovis subsp bovis AF2122/97
ugcugcagcgucaaggg

SEQ ID NO: 1172747 - RNA, 17 nt, Mycobacterium bovis subsp bovis AF2122/97
ugcugcagcaauugcac

SEQ ID NO: 1172748 - RNA, 20 nt, Mycobacterium bovis subsp bovis AF2122/97
ugcugcagcgaugcggcguu

SEQ ID NO: 1172749 - RNA, 17 nt, Mycobacterium bovis subsp bovis AF2122/97
ugcugcagaucggccgg

SEQ ID NO: 1172750 - RNA, 14 nt, Mycobacterium bovis subsp bovis AF2122/97
ugcugccgccgccg

SEQ ID NO: 1172751 - RNA, 18 nt, Mycobacterium bovis subsp bovis AF2122/97
ugcugccgauagcgcggc

SEQ ID NO: 1172752 - RNA, 21 nt, Mycobacterium bovis subsp bovis AF2122/97
ugcugccggagacacccgcca

SEQ ID NO: 1172753 - RNA, 22 nt, Mycobacterium bovis subsp bovis AF2122/97
ugcugccggagacacccgccag

SEQ ID NO: 1172754 - RNA, 17 nt, Mycobacterium bovis subsp bovis AF2122/97
ugcugcccggcaaccug

SEQ ID NO: 1172755 - RNA, 15 nt, Mycobacterium bovis subsp bovis AF2122/97
ugcugcccaucccgg

SEQ ID NO: 1172756 - RNA, 15 nt, Mycobacterium bovis subsp bovis AF2122/97
ugcugcccgacaccc

SEQ ID NO: 1172757 - RNA, 14 nt, Mycobacterium bovis subsp bovis AF2122/97
ugcugcaugccgac

SEQ ID NO: 1172758 - RNA, 17 nt, Mycobacterium bovis subsp bovis AF2122/97
ugcugcagggccuggcc

SEQ ID NO: 1172759 - RNA, 18 nt, Mycobacterium bovis subsp bovis AF2122/97
ugcugcagggccuggcca

SEQ ID NO: 1172760 - RNA, 15 nt, Mycobacterium bovis subsp bovis AF2122/97
ugcugccagccaugg

SEQ ID NO: 1172761 - RNA, 16 nt, Mycobacterium bovis subsp bovis AF2122/97
ugcugccagccauggc

SEQ ID NO: 1172762 - RNA, 14 nt, Mycobacterium bovis subsp bovis AF2122/97
ugcuggcagcggcc

SEQ ID NO: 1172763 - RNA, 16 nt, Mycobacterium bovis subsp bovis AF2122/97
ugcuggcgcaaccaau

SEQ ID NO: 1172764 - RNA, 14 nt, Mycobacterium bovis subsp bovis AF2122/97
ugcuggccuuguug

SEQ ID NO: 1172765 - RNA, 19 nt, Mycobacterium bovis subsp bovis AF2122/97
ugcuggcgcgccugugcca

SEQ ID NO: 1172766 - RNA, 14 nt, Mycobacterium bovis subsp bovis AF2122/97
ugcuggcggccagc

SEQ ID NO: 1172767 - RNA, 24 nt, Mycobacterium bovis subsp bovis AF2122/97
aaauguaccugguugcugacgacu

SEQ ID NO: 1172768 - RNA, 17 nt, Mycobacterium bovis subsp bovis AF2122/97
ugcuggaacagguugaa

SEQ ID NO: 1172769 - RNA, 14 nt, Mycobacterium bovis subsp bovis AF2122/97
ugcuggcaccagca

SEQ ID NO: 1172770 - RNA, 14 nt, Mycobacterium bovis subsp bovis AF2122/97
ugcuggaacagguu

SEQ ID NO: 1172771 - RNA, 15 nt, Mycobacterium bovis subsp bovis AF2122/97
ugcugcugccguggc

SEQ ID NO: 1172772 - RNA, 16 nt, Mycobacterium bovis subsp bovis AF2122/97
ugcugcggcuuucagc

SEQ ID NO: 1172773 - RNA, 17 nt, Mycobacterium bovis subsp bovis AF2122/97
ugcugccgggggcccga

SEQ ID NO: 1172774 - RNA, 20 nt, Mycobacterium bovis subsp bovis AF2122/97
ugcugcgcaauagcgacagc

SEQ ID NO: 1172775 - RNA, 21 nt, Mycobacterium bovis subsp bovis AF2122/97
ugcugcgcgcggcggccgcgg

SEQ ID NO: 1172776 - RNA, 20 nt, Mycobacterium bovis subsp bovis AF2122/97
ugcugcgcggugccggccgu

SEQ ID NO: 1172777 - RNA, 17 nt, Mycobacterium bovis subsp bovis AF2122/97
ugcuggggguaccuccc

SEQ ID NO: 1172778 - RNA, 19 nt, Mycobacterium bovis subsp bovis AF2122/97
ugcugguaccgggcuccaa

SEQ ID NO: 1172779 - RNA, 13 nt, Mycobacterium bovis subsp bovis AF2122/97
aaaugucuccucc

SEQ ID NO: 1172780 - RNA, 15 nt, Mycobacterium bovis subsp bovis AF2122/97
ugcuggggguaccuc

SEQ ID NO: 1172781 - RNA, 17 nt, Mycobacterium bovis subsp bovis AF2122/97
ugcuggugucggcucga

SEQ ID NO: 1172782 - RNA, 17 nt, Mycobacterium bovis subsp bovis AF2122/97
ugcugucgaagugguag

SEQ ID NO: 1172783 - RNA, 12 nt, Mycobacterium bovis subsp bovis AF2122/97
ugcuuacgugau

SEQ ID NO: 1172784 - RNA, 12 nt, Mycobacterium bovis subsp bovis AF2122/97
ugcuuccagcau

SEQ ID NO: 1172785 - RNA, 16 nt, Mycobacterium bovis subsp bovis AF2122/97
ugcuucgcgucgaccc

SEQ ID NO: 1172786 - RNA, 14 nt, Mycobacterium bovis subsp bovis AF2122/97
ugcuugcagggcca

SEQ ID NO: 1172787 - RNA, 15 nt, Mycobacterium bovis subsp bovis AF2122/97
ugcuugcagggccac

SEQ ID NO: 1172788 - RNA, 19 nt, Mycobacterium bovis subsp bovis AF2122/97
ugcuugcgcaucgccgaca

SEQ ID NO: 1172789 - RNA, 18 nt, Mycobacterium bovis subsp bovis AF2122/97
ugcuuggucgcccagcca

SEQ ID NO: 1172790 - RNA, 17 nt, Mycobacterium bovis subsp bovis AF2122/97
ugcuuggucgcccagcc

SEQ ID NO: 1172791 - RNA, 13 nt, Mycobacterium bovis subsp bovis AF2122/97
ugcuuggccgcgc

SEQ ID NO: 1172792 - RNA, 17 nt, Mycobacterium bovis subsp bovis AF2122/97
ugcuuggccacuugcuc

SEQ ID NO: 1172793 - RNA, 21 nt, Mycobacterium bovis subsp bovis AF2122/97
ugcuuuccagaguucccgaaa

SEQ ID NO: 1172794 - RNA, 15 nt, Mycobacterium bovis subsp bovis AF2122/97
uggaacucacccuau

SEQ ID NO: 1172795 - RNA, 22 nt, Mycobacterium bovis subsp bovis AF2122/97
uggaagauguugccgccgguca

SEQ ID NO: 1172796 - RNA, 19 nt, Mycobacterium bovis subsp bovis AF2122/97
uggaagccgaccaccgccg

SEQ ID NO: 1172797 - RNA, 15 nt, Mycobacterium bovis subsp bovis AF2122/97
uggaaggcggccagg

SEQ ID NO: 1172798 - RNA, 16 nt, Mycobacterium bovis subsp bovis AF2122/97
uggaaggcggccaggu

SEQ ID NO: 1172799 - RNA, 15 nt, Mycobacterium bovis subsp bovis AF2122/97
uggaagcggcgacua

SEQ ID NO: 1172800 - RNA, 21 nt, Mycobacterium bovis subsp bovis AF2122/97
uggaagaguuggggcacaacc

SEQ ID NO: 1172801 - RNA, 16 nt, Mycobacterium bovis subsp bovis AF2122/97
uggaacugaugaacca

SEQ ID NO: 1172802 - RNA, 20 nt, Mycobacterium bovis subsp bovis AF2122/97
uggaaaaagcccgacacgaa

SEQ ID NO: 1172803 - RNA, 22 nt, Mycobacterium bovis subsp bovis AF2122/97
uggaaaagccacggcugcccau

SEQ ID NO: 1172804 - RNA, 20 nt, Mycobacterium bovis subsp bovis AF2122/97
uggaaaaucgggucacacuc

SEQ ID NO: 1172805 - RNA, 15 nt, Mycobacterium bovis subsp bovis AF2122/97
uggaaacugaugucg

SEQ ID NO: 1172806 - RNA, 16 nt, Mycobacterium bovis subsp bovis AF2122/97
uggaccagcgggcggc

SEQ ID NO: 1172807 - RNA, 16 nt, Mycobacterium bovis subsp bovis AF2122/97
uggaccgcacugacaa

SEQ ID NO: 1172808 - RNA, 15 nt, Mycobacterium bovis subsp bovis AF2122/97
uggaccggugccagc

SEQ ID NO: 1172809 - RNA, 16 nt, Mycobacterium bovis subsp bovis AF2122/97
uggacgacccgggccg

SEQ ID NO: 1172810 - RNA, 20 nt, Mycobacterium bovis subsp bovis AF2122/97
uggacgcagagucaacagau

SEQ ID NO: 1172811 - RNA, 17 nt, Mycobacterium bovis subsp bovis AF2122/97
uggaccguugccgaugg

SEQ ID NO: 1172812 - RNA, 18 nt, Mycobacterium bovis subsp bovis AF2122/97
uggacaggucaauggucu

SEQ ID NO: 1172813 - RNA, 12 nt, Mycobacterium bovis subsp bovis AF2122/97
uggacaccaacc

SEQ ID NO: 1172814 - RNA, 14 nt, Mycobacterium bovis subsp bovis AF2122/97
uggacaaccucguc

SEQ ID NO: 1172815 - RNA, 16 nt, Mycobacterium bovis subsp bovis AF2122/97
uggacaccaccucguc

SEQ ID NO: 1172816 - RNA, 23 nt, Mycobacterium bovis subsp bovis AF2122/97
uggacaacguugguccgcugcag

SEQ ID NO: 1172817 - RNA, 12 nt, Mycobacterium bovis subsp bovis AF2122/97
uggacaacagca

SEQ ID NO: 1172818 - RNA, 13 nt, Mycobacterium bovis subsp bovis AF2122/97
uggacaacagcuu

SEQ ID NO: 1172819 - RNA, 18 nt, Mycobacterium bovis subsp bovis AF2122/97
uggaagcagacuccggug

SEQ ID NO: 1172820 - RNA, 22 nt, Mycobacterium bovis subsp bovis AF2122/97
uggaauggcgccggccggcagg

SEQ ID NO: 1172821 - RNA, 17 nt, Mycobacterium bovis subsp bovis AF2122/97
uggaauggaucucggcg

SEQ ID NO: 1172822 - RNA, 20 nt, Mycobacterium bovis subsp bovis AF2122/97
uggaaugccgccacaaagaa

SEQ ID NO: 1172823 - RNA, 18 nt, Mycobacterium bovis subsp bovis AF2122/97
uggaauccggccagaccc

SEQ ID NO: 1172824 - RNA, 15 nt, Mycobacterium bovis subsp bovis AF2122/97
ugcguccgcaacagg

SEQ ID NO: 1172825 - RNA, 16 nt, Mycobacterium bovis subsp bovis AF2122/97
ugcgucgauugccgcg

SEQ ID NO: 1172826 - RNA, 19 nt, Mycobacterium bovis subsp bovis AF2122/97
ugcgucagccgacaagguc

SEQ ID NO: 1172827 - RNA, 20 nt, Mycobacterium bovis subsp bovis AF2122/97
ugcgucguucggagcccuga

SEQ ID NO: 1172828 - RNA, 12 nt, Mycobacterium bovis subsp bovis AF2122/97
ugcgucucggug

SEQ ID NO: 1172829 - RNA, 16 nt, Mycobacterium bovis subsp bovis AF2122/97
ugcgugcauaggccgc

SEQ ID NO: 1172830 - RNA, 14 nt, Mycobacterium bovis subsp bovis AF2122/97
ugcguuggaugaag

SEQ ID NO: 1172831 - RNA, 16 nt, Mycobacterium bovis subsp bovis AF2122/97
ugcguuguccaccauc

SEQ ID NO: 1172832 - RNA, 15 nt, Mycobacterium bovis subsp bovis AF2122/97
ugcggucggccacau

SEQ ID NO: 1172833 - RNA, 14 nt, Mycobacterium bovis subsp bovis AF2122/97
ugcggugaguccgc

SEQ ID NO: 1172834 - RNA, 21 nt, Mycobacterium bovis subsp bovis AF2122/97
ugcggcugguguccagccagg

SEQ ID NO: 1172835 - RNA, 14 nt, Mycobacterium bovis subsp bovis AF2122/97
ugcgggaaccccag

SEQ ID NO: 1172836 - RNA, 18 nt, Mycobacterium bovis subsp bovis AF2122/97
ugcgggaaguugcccagg

SEQ ID NO: 1172837 - RNA, 15 nt, Mycobacterium bovis subsp bovis AF2122/97
ugcgguccgcugcca

SEQ ID NO: 1172838 - RNA, 16 nt, Mycobacterium bovis subsp bovis AF2122/97
ugcgguccaggccggc

SEQ ID NO: 1172839 - RNA, 15 nt, Mycobacterium bovis subsp bovis AF2122/97
ugcggucgcccaggc

SEQ ID NO: 1172840 - RNA, 16 nt, Mycobacterium bovis subsp bovis AF2122/97
ugcggucgcccaggcc

SEQ ID NO: 1172841 - RNA, 19 nt, Mycobacterium bovis subsp bovis AF2122/97
ugcgggacuugucggggug

SEQ ID NO: 1172842 - RNA, 15 nt, Mycobacterium bovis subsp bovis AF2122/97
ugcgggacgccgaau

SEQ ID NO: 1172843 - RNA, 17 nt, Mycobacterium bovis subsp bovis AF2122/97
ugcggugucgggcuggg

SEQ ID NO: 1172844 - RNA, 14 nt, Mycobacterium bovis subsp bovis AF2122/97
ugcggugggugaag

SEQ ID NO: 1172845 - RNA, 15 nt, Mycobacterium bovis subsp bovis AF2122/97
ugcgguggccagugc

SEQ ID NO: 1172846 - RNA, 23 nt, Mycobacterium bovis subsp bovis AF2122/97
ugcgguugcauaccgccgggccc

SEQ ID NO: 1172847 - RNA, 21 nt, Mycobacterium bovis subsp bovis AF2122/97
ugcgguucggacacacaggcg

SEQ ID NO: 1172848 - RNA, 21 nt, Mycobacterium bovis subsp bovis AF2122/97
ugcgguucucguagucaacca

SEQ ID NO: 1172849 - RNA, 14 nt, Mycobacterium bovis subsp bovis AF2122/97
ugcgguuagcagcc

SEQ ID NO: 1172850 - RNA, 14 nt, Mycobacterium bovis subsp bovis AF2122/97
ugcgguuguucgug

SEQ ID NO: 1172851 - RNA, 21 nt, Mycobacterium bovis subsp bovis AF2122/97
ugcgguugcauccauccugcc

SEQ ID NO: 1172852 - RNA, 20 nt, Mycobacterium bovis subsp bovis AF2122/97
ugcguaaggcugugccggcc

SEQ ID NO: 1172853 - RNA, 19 nt, Mycobacterium bovis subsp bovis AF2122/97
ugcgucaaguccgagucgg

SEQ ID NO: 1172854 - RNA, 16 nt, Mycobacterium bovis subsp bovis AF2122/97
ugcgccgucagcccag

SEQ ID NO: 1172855 - RNA, 11 nt, Mycobacterium bovis subsp bovis AF2122/97
ugcgcuggagg

SEQ ID NO: 1172856 - RNA, 22 nt, Mycobacterium bovis subsp bovis AF2122/97
ugcgcuggaggcuccuggucgc

SEQ ID NO: 1172857 - RNA, 15 nt, Mycobacterium bovis subsp bovis AF2122/97
ugcgcuggcacacuc

SEQ ID NO: 1172858 - RNA, 17 nt, Mycobacterium bovis subsp bovis AF2122/97
ugcgccggcuggcggcc

SEQ ID NO: 1172859 - RNA, 19 nt, Mycobacterium bovis subsp bovis AF2122/97
ugcgccgccagcgccgccg

SEQ ID NO: 1172860 - RNA, 14 nt, Mycobacterium bovis subsp bovis AF2122/97
ugcgcugggccagg

SEQ ID NO: 1172861 - RNA, 15 nt, Mycobacterium bovis subsp bovis AF2122/97
ugcgcugggccaggg

SEQ ID NO: 1172862 - RNA, 14 nt, Mycobacterium bovis subsp bovis AF2122/97
ugcggaacaccgcc

SEQ ID NO: 1172863 - RNA, 21 nt, Mycobacterium bovis subsp bovis AF2122/97
ugcggaacaccgcccggcccg

SEQ ID NO: 1172864 - RNA, 23 nt, Mycobacterium bovis subsp bovis AF2122/97
ugcggaacaccgcccggcccggc

SEQ ID NO: 1172865 - RNA, 21 nt, Mycobacterium bovis subsp bovis AF2122/97
ugcggaacaccaccaggcugu

SEQ ID NO: 1172866 - RNA, 22 nt, Mycobacterium bovis subsp bovis AF2122/97
ugcggaacaccaccaggcuguc

SEQ ID NO: 1172867 - RNA, 18 nt, Mycobacterium bovis subsp bovis AF2122/97
ugcggaacaccagcaggc

SEQ ID NO: 1172868 - RNA, 17 nt, Mycobacterium bovis subsp bovis AF2122/97
ugcggcaagcgcacgcu

SEQ ID NO: 1172869 - RNA, 22 nt, Mycobacterium bovis subsp bovis AF2122/97
ugcggaagaagugcucacaucc

SEQ ID NO: 1172870 - RNA, 15 nt, Mycobacterium bovis subsp bovis AF2122/97
ugcggaaucagcacc

SEQ ID NO: 1172871 - RNA, 19 nt, Mycobacterium bovis subsp bovis AF2122/97
ugcggaaucagcaccccau

SEQ ID NO: 1172872 - RNA, 17 nt, Mycobacterium bovis subsp bovis AF2122/97
ugcggaaaccgcugggg

SEQ ID NO: 1172873 - RNA, 15 nt, Mycobacterium bovis subsp bovis AF2122/97
ugcggcagugccaug

SEQ ID NO: 1172874 - RNA, 23 nt, Mycobacterium bovis subsp bovis AF2122/97
ugcggcgaccgucaaccugcugc

SEQ ID NO: 1172875 - RNA, 15 nt, Mycobacterium bovis subsp bovis AF2122/97
ugcggcauggcaggc

SEQ ID NO: 1172876 - RNA, 18 nt, Mycobacterium bovis subsp bovis AF2122/97
ugcggcagcuggcgcagc

SEQ ID NO: 1172877 - RNA, 19 nt, Mycobacterium bovis subsp bovis AF2122/97
ugcggcagcuggcgcagcc

SEQ ID NO: 1172878 - RNA, 23 nt, Mycobacterium bovis subsp bovis AF2122/97
ugcggcaacgaggucugcggccg

SEQ ID NO: 1172879 - RNA, 14 nt, Mycobacterium bovis subsp bovis AF2122/97
ugcggcgggcucgc

SEQ ID NO: 1172880 - RNA, 19 nt, Mycobacterium bovis subsp bovis AF2122/97
ugcggcggccucggggccg

SEQ ID NO: 1172881 - RNA, 16 nt, Mycobacterium bovis subsp bovis AF2122/97
ugcggcgcuggccagc

SEQ ID NO: 1172882 - RNA, 14 nt, Mycobacterium bovis subsp bovis AF2122/97
ugcggcugccagug

SEQ ID NO: 1172883 - RNA, 17 nt, Mycobacterium bovis subsp bovis AF2122/97
ugcggcuuggccaucac

SEQ ID NO: 1172884 - RNA, 19 nt, Mycobacterium bovis subsp bovis AF2122/97
ugcuagcuuggcggccagc

SEQ ID NO: 1172885 - RNA, 17 nt, Mycobacterium bovis subsp bovis AF2122/97
ugcuaggaccaccagcg

SEQ ID NO: 1172886 - RNA, 16 nt, Mycobacterium bovis subsp bovis AF2122/97
ugcuagcagcagcccg

SEQ ID NO: 1172887 - RNA, 19 nt, Mycobacterium bovis subsp bovis AF2122/97
ugcuaggaccaccagcgcu

SEQ ID NO: 1172888 - RNA, 17 nt, Mycobacterium bovis subsp bovis AF2122/97
ugcuauucgccagcgcc

SEQ ID NO: 1172889 - RNA, 19 nt, Mycobacterium bovis subsp bovis AF2122/97
ugcuacacccguagaccuu

SEQ ID NO: 1172890 - RNA, 21 nt, Mycobacterium bovis subsp bovis AF2122/97
ugcuccucgcgguaguugucc

SEQ ID NO: 1172891 - RNA, 15 nt, Mycobacterium bovis subsp bovis AF2122/97
ugcuccuugggucgg

SEQ ID NO: 1172892 - RNA, 20 nt, Mycobacterium bovis subsp bovis AF2122/97
ugcuccgguuggcgcgggcg

SEQ ID NO: 1172893 - RNA, 17 nt, Mycobacterium bovis subsp bovis AF2122/97
ugcuccgguuggcgcgg

SEQ ID NO: 1172894 - RNA, 17 nt, Mycobacterium bovis subsp bovis AF2122/97
ugcucccggccgccgag

SEQ ID NO: 1172895 - RNA, 21 nt, Mycobacterium bovis subsp bovis AF2122/97
ugcuccaggcgcgccgcaccc

SEQ ID NO: 1172896 - RNA, 21 nt, Mycobacterium bovis subsp bovis AF2122/97
ugcucagccguucgcagcuga

SEQ ID NO: 1172897 - RNA, 18 nt, Mycobacterium bovis subsp bovis AF2122/97
ugcucaucgcgcccgcca

SEQ ID NO: 1172898 - RNA, 21 nt, Mycobacterium bovis subsp bovis AF2122/97
ugcucaccaaucugcgggccg

SEQ ID NO: 1172899 - RNA, 13 nt, Mycobacterium bovis subsp bovis AF2122/97
ugcucaccaucuc

SEQ ID NO: 1172900 - RNA, 18 nt, Mycobacterium bovis subsp bovis AF2122/97
ugcucacauccggucaga

SEQ ID NO: 1172901 - RNA, 15 nt, Mycobacterium bovis subsp bovis AF2122/97
ugcgcacaccgaccc

SEQ ID NO: 1172902 - RNA, 13 nt, Mycobacterium bovis subsp bovis AF2122/97
ugcgcaccaaggc

SEQ ID NO: 1172903 - RNA, 17 nt, Mycobacterium bovis subsp bovis AF2122/97
ugcgcaccaccgagccg

SEQ ID NO: 1172904 - RNA, 19 nt, Mycobacterium bovis subsp bovis AF2122/97
ugcgcaaggccgcguugcc

SEQ ID NO: 1172905 - RNA, 19 nt, Mycobacterium bovis subsp bovis AF2122/97
ugcgcaauagcgacagcag

SEQ ID NO: 1172906 - RNA, 19 nt, Mycobacterium bovis subsp bovis AF2122/97
ugcgcaaugccgacgccaa

SEQ ID NO: 1172907 - RNA, 18 nt, Mycobacterium bovis subsp bovis AF2122/97
ugcgcacaccgacccgcu

SEQ ID NO: 1172908 - RNA, 15 nt, Mycobacterium bovis subsp bovis AF2122/97
ugcgcaccagcaccu

SEQ ID NO: 1172909 - RNA, 23 nt, Mycobacterium bovis subsp bovis AF2122/97
ugcgcaccaugggucuggcaggc

SEQ ID NO: 1172910 - RNA, 20 nt, Mycobacterium bovis subsp bovis AF2122/97
ugcgaugcacaaccgcugcu

SEQ ID NO: 1172911 - RNA, 18 nt, Mycobacterium bovis subsp bovis AF2122/97
ugcgcacggcgccgaccc

SEQ ID NO: 1172912 - RNA, 14 nt, Mycobacterium bovis subsp bovis AF2122/97
ugcgccggaccagc

SEQ ID NO: 1172913 - RNA, 19 nt, Mycobacterium bovis subsp bovis AF2122/97
ugcgccgcccaugccucca

SEQ ID NO: 1172914 - RNA, 16 nt, Mycobacterium bovis subsp bovis AF2122/97
ugcgccgcacacucuc

SEQ ID NO: 1172915 - RNA, 15 nt, Mycobacterium bovis subsp bovis AF2122/97
ugcgccgccacagca

SEQ ID NO: 1172916 - RNA, 19 nt, Mycobacterium bovis subsp bovis AF2122/97
ugcgccgacccgcgcgccg

SEQ ID NO: 1172917 - RNA, 22 nt, Mycobacterium bovis subsp bovis AF2122/97
ugcgccgagauccacgccagag

SEQ ID NO: 1172918 - RNA, 22 nt, Mycobacterium bovis subsp bovis AF2122/97
ugcgccgcacgccgaccggccc

SEQ ID NO: 1172919 - RNA, 23 nt, Mycobacterium bovis subsp bovis AF2122/97
ugcgccgcacgccgaccggcccg

SEQ ID NO: 1172920 - RNA, 14 nt, Mycobacterium bovis subsp bovis AF2122/97
ugcgccgcacggcg

SEQ ID NO: 1172921 - RNA, 19 nt, Mycobacterium bovis subsp bovis AF2122/97
ugcgccgaacaccacaccg

SEQ ID NO: 1172922 - RNA, 16 nt, Mycobacterium bovis subsp bovis AF2122/97
ugcgcccugagcagau

SEQ ID NO: 1172923 - RNA, 13 nt, Mycobacterium bovis subsp bovis AF2122/97
ugcgccauucccg

SEQ ID NO: 1172924 - RNA, 19 nt, Mycobacterium bovis subsp bovis AF2122/97
ugcgccauaauauugccgc

SEQ ID NO: 1172925 - RNA, 15 nt, Mycobacterium bovis subsp bovis AF2122/97
ugcgaacccugcgca

SEQ ID NO: 1172926 - RNA, 17 nt, Mycobacterium bovis subsp bovis AF2122/97
ugcgaacaaguggccag

SEQ ID NO: 1172927 - RNA, 19 nt, Mycobacterium bovis subsp bovis AF2122/97
ugcgaacagcgaagcaacg

SEQ ID NO: 1172928 - RNA, 17 nt, Mycobacterium bovis subsp bovis AF2122/97
ugcgaaacaucucggcg

SEQ ID NO: 1172929 - RNA, 19 nt, Mycobacterium bovis subsp bovis AF2122/97
ugcgaaacgcuggccacuc

SEQ ID NO: 1172930 - RNA, 19 nt, Mycobacterium bovis subsp bovis AF2122/97
ugccuuuauuaauacuggg

SEQ ID NO: 1172931 - RNA, 14 nt, Mycobacterium bovis subsp bovis AF2122/97
ugccuuggcagccc

SEQ ID NO: 1172932 - RNA, 16 nt, Mycobacterium bovis subsp bovis AF2122/97
ugcgagcgcagcgcau

SEQ ID NO: 1172933 - RNA, 19 nt, Mycobacterium bovis subsp bovis AF2122/97
ugcgagugagcucagcaag

SEQ ID NO: 1172934 - RNA, 17 nt, Mycobacterium bovis subsp bovis AF2122/97
ugcgagguucagccuga

SEQ ID NO: 1172935 - RNA, 15 nt, Mycobacterium bovis subsp bovis AF2122/97
ugcgauaacccgcau

SEQ ID NO: 1172936 - RNA, 17 nt, Mycobacterium bovis subsp bovis AF2122/97
ugcgaucaacccuaccc

SEQ ID NO: 1172937 - RNA, 18 nt, Mycobacterium bovis subsp bovis AF2122/97
ugcgauauggucaccaag

SEQ ID NO: 1172938 - RNA, 13 nt, Mycobacterium bovis subsp bovis AF2122/97
ugcgaucccaccc

SEQ ID NO: 1172939 - RNA, 14 nt, Mycobacterium bovis subsp bovis AF2122/97
ugcgaucccacccu

SEQ ID NO: 1172940 - RNA, 16 nt, Mycobacterium bovis subsp bovis AF2122/97
ugcgaucgcaacaccg

SEQ ID NO: 1172941 - RNA, 22 nt, Mycobacterium bovis subsp bovis AF2122/97
ugcgaucgccgcgcuggucgga

SEQ ID NO: 1172942 - RNA, 13 nt, Mycobacterium bovis subsp bovis AF2122/97
ugcgacaagaccg

SEQ ID NO: 1172943 - RNA, 23 nt, Mycobacterium bovis subsp bovis AF2122/97
ugcgaaugcugggcccgccagcc

SEQ ID NO: 1172944 - RNA, 18 nt, Mycobacterium bovis subsp bovis AF2122/97
ugcgaagaguccuuaaac

SEQ ID NO: 1172945 - RNA, 22 nt, Mycobacterium bovis subsp bovis AF2122/97
ugcgaagcuguagaccuggccg

SEQ ID NO: 1172946 - RNA, 18 nt, Mycobacterium bovis subsp bovis AF2122/97
ugccgggguuggucgucg

SEQ ID NO: 1172947 - RNA, 16 nt, Mycobacterium bovis subsp bovis AF2122/97
ugccggggcugccgcc

SEQ ID NO: 1172948 - RNA, 16 nt, Mycobacterium bovis subsp bovis AF2122/97
ugccggggccccaugc

SEQ ID NO: 1172949 - RNA, 16 nt, Mycobacterium bovis subsp bovis AF2122/97
ugccggcgagggccac

SEQ ID NO: 1172950 - RNA, 20 nt, Mycobacterium bovis subsp bovis AF2122/97
ugccgguagcacagcagcaa

SEQ ID NO: 1172951 - RNA, 13 nt, Mycobacterium bovis subsp bovis AF2122/97
ugccggucaggca

SEQ ID NO: 1172952 - RNA, 21 nt, Mycobacterium bovis subsp bovis AF2122/97
ugccgguguuguaggccgggc

SEQ ID NO: 1172953 - RNA, 17 nt, Mycobacterium bovis subsp bovis AF2122/97
ugccggucauccgggcg

SEQ ID NO: 1172954 - RNA, 24 nt, Mycobacterium bovis subsp bovis AF2122/97
ugccggucgagugccucgaccugg

SEQ ID NO: 1172955 - RNA, 19 nt, Mycobacterium bovis subsp bovis AF2122/97
ugccgucgccuccagcagg

SEQ ID NO: 1172956 - RNA, 18 nt, Mycobacterium bovis subsp bovis AF2122/97
ugccgucgaguccaggcc

SEQ ID NO: 1172957 - RNA, 20 nt, Mycobacterium bovis subsp bovis AF2122/97
ugccgucggagaccagcucg

SEQ ID NO: 1172958 - RNA, 17 nt, Mycobacterium bovis subsp bovis AF2122/97
ugccggcgagcaggccg

SEQ ID NO: 1172959 - RNA, 19 nt, Mycobacterium bovis subsp bovis AF2122/97
ugccggcgaacucgcgccg

SEQ ID NO: 1172960 - RNA, 22 nt, Mycobacterium bovis subsp bovis AF2122/97
ugccggcgaaccccagcgcauc

SEQ ID NO: 1172961 - RNA, 12 nt, Mycobacterium bovis subsp bovis AF2122/97
ugccggcccugc

SEQ ID NO: 1172962 - RNA, 22 nt, Mycobacterium bovis subsp bovis AF2122/97
ugccggccaaguugacccccuc

SEQ ID NO: 1172963 - RNA, 19 nt, Mycobacterium bovis subsp bovis AF2122/97
ugccggccaccagccuggc

SEQ ID NO: 1172964 - RNA, 14 nt, Mycobacterium bovis subsp bovis AF2122/97
ugccagaccagggc

SEQ ID NO: 1172965 - RNA, 21 nt, Mycobacterium bovis subsp bovis AF2122/97
ugccagaacccggacagggug

SEQ ID NO: 1172966 - RNA, 22 nt, Mycobacterium bovis subsp bovis AF2122/97
ugccaccgcuugaccccuggcc

SEQ ID NO: 1172967 - RNA, 13 nt, Mycobacterium bovis subsp bovis AF2122/97
ugccacccuugcc

SEQ ID NO: 1172968 - RNA, 16 nt, Mycobacterium bovis subsp bovis AF2122/97
ugccacccuugccgcc

SEQ ID NO: 1172969 - RNA, 19 nt, Mycobacterium bovis subsp bovis AF2122/97
ugccacgaucggcgggggu

SEQ ID NO: 1172970 - RNA, 23 nt, Mycobacterium bovis subsp bovis AF2122/97
ugccacgacgaacaccagcgcgc

SEQ ID NO: 1172971 - RNA, 11 nt, Mycobacterium bovis subsp bovis AF2122/97
ugccugccacc

SEQ ID NO: 1172972 - RNA, 12 nt, Mycobacterium bovis subsp bovis AF2122/97
ugccugcaacgc

SEQ ID NO: 1172973 - RNA, 14 nt, Mycobacterium bovis subsp bovis AF2122/97
ugccucggcggccu

SEQ ID NO: 1172974 - RNA, 16 nt, Mycobacterium bovis subsp bovis AF2122/97
ugccucgauggucucc

SEQ ID NO: 1172975 - RNA, 23 nt, Mycobacterium bovis subsp bovis AF2122/97
ugccgucggcgugcagcagcuug

SEQ ID NO: 1172976 - RNA, 13 nt, Mycobacterium bovis subsp bovis AF2122/97
ugccuuagcccgg

SEQ ID NO: 1172977 - RNA, 18 nt, Mycobacterium bovis subsp bovis AF2122/97
ugccuuacacgccuggcu

SEQ ID NO: 1172978 - RNA, 20 nt, Mycobacterium bovis subsp bovis AF2122/97
ugccuuaucgagauauugcg

SEQ ID NO: 1172979 - RNA, 16 nt, Mycobacterium bovis subsp bovis AF2122/97
ugccuucuaccgaaua

SEQ ID NO: 1172980 - RNA, 17 nt, Mycobacterium bovis subsp bovis AF2122/97
ugccuucguagaaggac

SEQ ID NO: 1172981 - RNA, 23 nt, Mycobacterium bovis subsp bovis AF2122/97
ugccuugaccgcggucuucuuca

SEQ ID NO: 1172982 - RNA, 21 nt, Mycobacterium bovis subsp bovis AF2122/97
ugccuucuuugccggcgccuu

SEQ ID NO: 1172983 - RNA, 18 nt, Mycobacterium bovis subsp bovis AF2122/97
ugaugacguugcagccgg

SEQ ID NO: 1172984 - RNA, 21 nt, Mycobacterium bovis subsp bovis AF2122/97
ugaugacguugcagccggcau

SEQ ID NO: 1172985 - RNA, 21 nt, Mycobacterium bovis subsp bovis AF2122/97
ugaugacuugagcggcuuggg

SEQ ID NO: 1172986 - RNA, 18 nt, Mycobacterium bovis subsp bovis AF2122/97
ugaugaccaggucgguca

SEQ ID NO: 1172987 - RNA, 22 nt, Mycobacterium bovis subsp bovis AF2122/97
ugaugaccgccaucgccaacac

SEQ ID NO: 1172988 - RNA, 13 nt, Mycobacterium bovis subsp bovis AF2122/97
ugaugaccgccgc

SEQ ID NO: 1172989 - RNA, 21 nt, Mycobacterium bovis subsp bovis AF2122/97
ugaugaccguauagccgacgc

SEQ ID NO: 1172990 - RNA, 23 nt, Mycobacterium bovis subsp bovis AF2122/97
ugaugacgccgucggcgcgcacc

SEQ ID NO: 1172991 - RNA, 14 nt, Mycobacterium bovis subsp bovis AF2122/97
ugaugaugaccaca

SEQ ID NO: 1172992 - RNA, 12 nt, Mycobacterium bovis subsp bovis AF2122/97
ugauuccggguc

SEQ ID NO: 1172993 - RNA, 17 nt, Mycobacterium bovis subsp bovis AF2122/97
ugaugcaacgccaaaau

SEQ ID NO: 1172994 - RNA, 13 nt, Mycobacterium bovis subsp bovis AF2122/97
ugauugacugcuu

SEQ ID NO: 1172995 - RNA, 22 nt, Mycobacterium bovis subsp bovis AF2122/97
ugauugacugcuugguggucuu

SEQ ID NO: 1172996 - RNA, 19 nt, Mycobacterium bovis subsp bovis AF2122/97
ugauuuuucgcagugacgu

SEQ ID NO: 1172997 - RNA, 18 nt, Mycobacterium bovis subsp bovis AF2122/97
ugcaaugcuggcggcgcg

SEQ ID NO: 1172998 - RNA, 22 nt, Mycobacterium bovis subsp bovis AF2122/97
ugcacaaaauacuccgcgagcc

SEQ ID NO: 1172999 - RNA, 14 nt, Mycobacterium bovis subsp bovis AF2122/97
ugcaauuucagccu

SEQ ID NO: 1173000 - RNA, 17 nt, Mycobacterium bovis subsp bovis AF2122/97
ugcaagccgacaucggc

SEQ ID NO: 1173001 - RNA, 16 nt, Mycobacterium bovis subsp bovis AF2122/97
ugcaagcuaagcgccu

SEQ ID NO: 1173002 - RNA, 20 nt, Mycobacterium bovis subsp bovis AF2122/97
ugcaagaccguuacaccauc

SEQ ID NO: 1173003 - RNA, 22 nt, Mycobacterium bovis subsp bovis AF2122/97
ugcaacggugaaucgaagcccg

SEQ ID NO: 1173004 - RNA, 13 nt, Mycobacterium bovis subsp bovis AF2122/97
ugcaacgcgccuu

SEQ ID NO: 1173005 - RNA, 15 nt, Mycobacterium bovis subsp bovis AF2122/97
ugcaacgccaaaaug

SEQ ID NO: 1173006 - RNA, 18 nt, Mycobacterium bovis subsp bovis AF2122/97
ugcaaccgccggugccga

SEQ ID NO: 1173007 - RNA, 14 nt, Mycobacterium bovis subsp bovis AF2122/97
ugcaaccagcggca

SEQ ID NO: 1173008 - RNA, 21 nt, Mycobacterium bovis subsp bovis AF2122/97
ugcaacacgccggcccgguga

SEQ ID NO: 1173009 - RNA, 13 nt, Mycobacterium bovis subsp bovis AF2122/97
ugcaacacaccgc

SEQ ID NO: 1173010 - RNA, 16 nt, Mycobacterium bovis subsp bovis AF2122/97
ugcagcggcgccgcca

SEQ ID NO: 1173011 - RNA, 13 nt, Mycobacterium bovis subsp bovis AF2122/97
ugcagcggcuugc

SEQ ID NO: 1173012 - RNA, 17 nt, Mycobacterium bovis subsp bovis AF2122/97
ugcagcggcuugcccag

SEQ ID NO: 1173013 - RNA, 18 nt, Mycobacterium bovis subsp bovis AF2122/97
ugcagcccugcgcagccg

SEQ ID NO: 1173014 - RNA, 17 nt, Mycobacterium bovis subsp bovis AF2122/97
ugcagcccugcgcagcc

SEQ ID NO: 1173015 - RNA, 22 nt, Mycobacterium bovis subsp bovis AF2122/97
ugcagccgaccgaaucagcacg

SEQ ID NO: 1173016 - RNA, 19 nt, Mycobacterium bovis subsp bovis AF2122/97
ugcagcacccccucggcuu

SEQ ID NO: 1173017 - RNA, 19 nt, Mycobacterium bovis subsp bovis AF2122/97
ugcagcaauugcaccuucu

SEQ ID NO: 1173018 - RNA, 18 nt, Mycobacterium bovis subsp bovis AF2122/97
ugcagcaauugcaccuuc

SEQ ID NO: 1173019 - RNA, 17 nt, Mycobacterium bovis subsp bovis AF2122/97
ugcagcccgggcagcac

SEQ ID NO: 1173020 - RNA, 20 nt, Mycobacterium bovis subsp bovis AF2122/97
ugcagcccgggcagcaccag

SEQ ID NO: 1173021 - RNA, 22 nt, Mycobacterium bovis subsp bovis AF2122/97
ugcagcccgccggauccgccag

SEQ ID NO: 1173022 - RNA, 18 nt, Mycobacterium bovis subsp bovis AF2122/97
ugcagcacuuggccagcu

SEQ ID NO: 1173023 - RNA, 21 nt, Mycobacterium bovis subsp bovis AF2122/97
ugcagcacuuccaagccgacc

SEQ ID NO: 1173024 - RNA, 13 nt, Mycobacterium bovis subsp bovis AF2122/97
ugcagcacggcuu

SEQ ID NO: 1173025 - RNA, 15 nt, Mycobacterium bovis subsp bovis AF2122/97
ugcacuacaggguug

SEQ ID NO: 1173026 - RNA, 18 nt, Mycobacterium bovis subsp bovis AF2122/97
ugcacugcgaacccugcg

SEQ ID NO: 1173027 - RNA, 19 nt, Mycobacterium bovis subsp bovis AF2122/97
ugcacugcgaacccugcgc

SEQ ID NO: 1173028 - RNA, 20 nt, Mycobacterium bovis subsp bovis AF2122/97
ugcacguggccacggcauuc

SEQ ID NO: 1173029 - RNA, 15 nt, Mycobacterium bovis subsp bovis AF2122/97
ugcacugcugguuga

SEQ ID NO: 1173030 - RNA, 13 nt, Mycobacterium bovis subsp bovis AF2122/97
ugcaccagcucac

SEQ ID NO: 1173031 - RNA, 21 nt, Mycobacterium bovis subsp bovis AF2122/97
ugcaccagcucacccggagca

SEQ ID NO: 1173032 - RNA, 20 nt, Mycobacterium bovis subsp bovis AF2122/97
ugcaccggcuugggccaggc

SEQ ID NO: 1173033 - RNA, 13 nt, Mycobacterium bovis subsp bovis AF2122/97
ugcacgucagcgg

SEQ ID NO: 1173034 - RNA, 23 nt, Mycobacterium bovis subsp bovis AF2122/97
ugcacgucaucggcuggccgcgc

SEQ ID NO: 1173035 - RNA, 17 nt, Mycobacterium bovis subsp bovis AF2122/97
ugcaccuccgacggccg

SEQ ID NO: 1173036 - RNA, 23 nt, Mycobacterium bovis subsp bovis AF2122/97
ugcaccucgagcguggcaacgag

SEQ ID NO: 1173037 - RNA, 20 nt, Mycobacterium bovis subsp bovis AF2122/97
ugcaccuggaucagggcuuu

SEQ ID NO: 1173038 - RNA, 19 nt, Mycobacterium bovis subsp bovis AF2122/97
ugcaccugcgaggugccgg

SEQ ID NO: 1173039 - RNA, 17 nt, Mycobacterium bovis subsp bovis AF2122/97
ugcacaggauuggccgc

SEQ ID NO: 1173040 - RNA, 18 nt, Mycobacterium bovis subsp bovis AF2122/97
ugcacaggcaucguccgc

SEQ ID NO: 1173041 - RNA, 14 nt, Mycobacterium bovis subsp bovis AF2122/97
ugcacagcagcggu

SEQ ID NO: 1173042 - RNA, 21 nt, Mycobacterium bovis subsp bovis AF2122/97
ugcacagacacggcagcugca

SEQ ID NO: 1173043 - RNA, 15 nt, Mycobacterium bovis subsp bovis AF2122/97
ugcacagacagacag

SEQ ID NO: 1173044 - RNA, 20 nt, Mycobacterium bovis subsp bovis AF2122/97
ugcagcuccccgccggaacu

SEQ ID NO: 1173045 - RNA, 16 nt, Mycobacterium bovis subsp bovis AF2122/97
ugcagguugccaagaa

SEQ ID NO: 1173046 - RNA, 13 nt, Mycobacterium bovis subsp bovis AF2122/97
ugcagguggccgu

SEQ ID NO: 1173047 - RNA, 18 nt, Mycobacterium bovis subsp bovis AF2122/97
ugcagguuaggguccagg

SEQ ID NO: 1173048 - RNA, 20 nt, Mycobacterium bovis subsp bovis AF2122/97
ugcaggugaacaacagcgcu

SEQ ID NO: 1173049 - RNA, 19 nt, Mycobacterium bovis subsp bovis AF2122/97
ugcagucgcgaggugaagc

SEQ ID NO: 1173050 - RNA, 14 nt, Mycobacterium bovis subsp bovis AF2122/97
ugcagugcgccagc

SEQ ID NO: 1173051 - RNA, 20 nt, Mycobacterium bovis subsp bovis AF2122/97
ugcaguguuuuugcagacuc

SEQ ID NO: 1173052 - RNA, 22 nt, Mycobacterium bovis subsp bovis AF2122/97
ugcaguggauccggcagcagcc

SEQ ID NO: 1173053 - RNA, 20 nt, Mycobacterium bovis subsp bovis AF2122/97
ugccacccagaugcagcggu

SEQ ID NO: 1173054 - RNA, 16 nt, Mycobacterium bovis subsp bovis AF2122/97
ugccaaugcugcaggu

SEQ ID NO: 1173055 - RNA, 15 nt, Mycobacterium bovis subsp bovis AF2122/97
ugccaaucgccguca

SEQ ID NO: 1173056 - RNA, 18 nt, Mycobacterium bovis subsp bovis AF2122/97
ugcaucaugccgcccauc

SEQ ID NO: 1173057 - RNA, 17 nt, Mycobacterium bovis subsp bovis AF2122/97
ugcaucggucagcgccg

SEQ ID NO: 1173058 - RNA, 17 nt, Mycobacterium bovis subsp bovis AF2122/97
ugcaucggugcagcccg

SEQ ID NO: 1173059 - RNA, 20 nt, Mycobacterium bovis subsp bovis AF2122/97
ugcaucaugccgcccaucac

SEQ ID NO: 1173060 - RNA, 16 nt, Mycobacterium bovis subsp bovis AF2122/97
ugcaucauggccguga

SEQ ID NO: 1173061 - RNA, 16 nt, Mycobacterium bovis subsp bovis AF2122/97
ugcauucccgccuucu

SEQ ID NO: 1173062 - RNA, 20 nt, Mycobacterium bovis subsp bovis AF2122/97
ugagaucaugaggugagcug

SEQ ID NO: 1173063 - RNA, 18 nt, Mycobacterium bovis subsp bovis AF2122/97
ugagcaaaauggccaccg

SEQ ID NO: 1173064 - RNA, 22 nt, Mycobacterium bovis subsp bovis AF2122/97
ugagcggggauguccgcggcca

SEQ ID NO: 1173065 - RNA, 17 nt, Mycobacterium bovis subsp bovis AF2122/97
ugagcgguaccccccag

SEQ ID NO: 1173066 - RNA, 19 nt, Mycobacterium bovis subsp bovis AF2122/97
ugagcgggcaacugcagca

SEQ ID NO: 1173067 - RNA, 22 nt, Mycobacterium bovis subsp bovis AF2122/97
ugagcgggcaacugcagcaugg

SEQ ID NO: 1173068 - RNA, 22 nt, Mycobacterium bovis subsp bovis AF2122/97
ugagcggagcaauuccacgauc

SEQ ID NO: 1173069 - RNA, 21 nt, Mycobacterium bovis subsp bovis AF2122/97
ugagcggccaccguagccagc

SEQ ID NO: 1173070 - RNA, 16 nt, Mycobacterium bovis subsp bovis AF2122/97
ugagcggccagcaucg

SEQ ID NO: 1173071 - RNA, 21 nt, Mycobacterium bovis subsp bovis AF2122/97
ugagcgcuucgagguggcugc

SEQ ID NO: 1173072 - RNA, 16 nt, Mycobacterium bovis subsp bovis AF2122/97
ugagcaaguccugcag

SEQ ID NO: 1173073 - RNA, 15 nt, Mycobacterium bovis subsp bovis AF2122/97
ugaggcgcagcgcca

SEQ ID NO: 1173074 - RNA, 15 nt, Mycobacterium bovis subsp bovis AF2122/97
ugaggcgcuggcccg

SEQ ID NO: 1173075 - RNA, 18 nt, Mycobacterium bovis subsp bovis AF2122/97
ugaggagaugagcaccaa

SEQ ID NO: 1173076 - RNA, 22 nt, Mycobacterium bovis subsp bovis AF2122/97
ugaggacuugcacgucggcugc

SEQ ID NO: 1173077 - RNA, 21 nt, Mycobacterium bovis subsp bovis AF2122/97
ugagcuagccguucggcugcc

SEQ ID NO: 1173078 - RNA, 23 nt, Mycobacterium bovis subsp bovis AF2122/97
ugaguggcucgcucugcgcggcu

SEQ ID NO: 1173079 - RNA, 17 nt, Mycobacterium bovis subsp bovis AF2122/97
ugaggcugccgaaguug

SEQ ID NO: 1173080 - RNA, 13 nt, Mycobacterium bovis subsp bovis AF2122/97
ugaggcuggucug

SEQ ID NO: 1173081 - RNA, 16 nt, Mycobacterium bovis subsp bovis AF2122/97
ugaggcugugccccag

SEQ ID NO: 1173082 - RNA, 21 nt, Mycobacterium bovis subsp bovis AF2122/97
ugagggcgucgucgaguuggc

SEQ ID NO: 1173083 - RNA, 15 nt, Mycobacterium bovis subsp bovis AF2122/97
ugagguagccgaggu

SEQ ID NO: 1173084 - RNA, 22 nt, Mycobacterium bovis subsp bovis AF2122/97
ugagugcggacaucguugaccc

SEQ ID NO: 1173085 - RNA, 16 nt, Mycobacterium bovis subsp bovis AF2122/97
ugagugcgucucggug

SEQ ID NO: 1173086 - RNA, 15 nt, Mycobacterium bovis subsp bovis AF2122/97
ugauagcggcgcagc

SEQ ID NO: 1173087 - RNA, 15 nt, Mycobacterium bovis subsp bovis AF2122/97
ugauauccguacagu

SEQ ID NO: 1173088 - RNA, 14 nt, Mycobacterium bovis subsp bovis AF2122/97
ugauauacggaucc

SEQ ID NO: 1173089 - RNA, 15 nt, Mycobacterium bovis subsp bovis AF2122/97
ugaucggcgcggccg

SEQ ID NO: 1173090 - RNA, 22 nt, Mycobacterium bovis subsp bovis AF2122/97
ugaucggcggcaaccgccgcca

SEQ ID NO: 1173091 - RNA, 23 nt, Mycobacterium bovis subsp bovis AF2122/97
ugaucgccggcuucgcccagagc

SEQ ID NO: 1173092 - RNA, 14 nt, Mycobacterium bovis subsp bovis AF2122/97
ugaucgccauggug

SEQ ID NO: 1173093 - RNA, 17 nt, Mycobacterium bovis subsp bovis AF2122/97
ugaucgccgaggccucg

SEQ ID NO: 1173094 - RNA, 15 nt, Mycobacterium bovis subsp bovis AF2122/97
ugaucgccacccggu

SEQ ID NO: 1173095 - RNA, 16 nt, Mycobacterium bovis subsp bovis AF2122/97
ugaucgaccgccuccu

SEQ ID NO: 1173096 - RNA, 18 nt, Mycobacterium bovis subsp bovis AF2122/97
ugaucgacggccagccca

SEQ ID NO: 1173097 - RNA, 14 nt, Mycobacterium bovis subsp bovis AF2122/97
ugaucgagcaguuc

SEQ ID NO: 1173098 - RNA, 21 nt, Mycobacterium bovis subsp bovis AF2122/97
ugaucgagcaguuccagcucg

SEQ ID NO: 1173099 - RNA, 16 nt, Mycobacterium bovis subsp bovis AF2122/97
ugaucugugccgcuag

SEQ ID NO: 1173100 - RNA, 13 nt, Mycobacterium bovis subsp bovis AF2122/97
ugaucuggccacg

SEQ ID NO: 1173101 - RNA, 19 nt, Mycobacterium bovis subsp bovis AF2122/97
ugaucuugccacuccagga

SEQ ID NO: 1173102 - RNA, 18 nt, Mycobacterium bovis subsp bovis AF2122/97
ugaucgaauacaccugcu

SEQ ID NO: 1173103 - RNA, 13 nt, Mycobacterium bovis subsp bovis AF2122/97
ugauccgcugggc

SEQ ID NO: 1173104 - RNA, 15 nt, Mycobacterium bovis subsp bovis AF2122/97
ugauccgcaccccau

SEQ ID NO: 1173105 - RNA, 17 nt, Mycobacterium bovis subsp bovis AF2122/97
ugaucagugccaggugg

SEQ ID NO: 1173106 - RNA, 12 nt, Mycobacterium bovis subsp bovis AF2122/97
ugacgugguggg

SEQ ID NO: 1173107 - RNA, 14 nt, Mycobacterium bovis subsp bovis AF2122/97
ugacguugugccuu

SEQ ID NO: 1173108 - RNA, 15 nt, Mycobacterium bovis subsp bovis AF2122/97
ugacguugugccuua

SEQ ID NO: 1173109 - RNA, 22 nt, Mycobacterium bovis subsp bovis AF2122/97
ugacguuuggauggcuggccag

SEQ ID NO: 1173110 - RNA, 23 nt, Mycobacterium bovis subsp bovis AF2122/97
ugacggcgucgaccucgcgggcg

SEQ ID NO: 1173111 - RNA, 22 nt, Mycobacterium bovis subsp bovis AF2122/97
ugacggaguucaagguguucug

SEQ ID NO: 1173112 - RNA, 15 nt, Mycobacterium bovis subsp bovis AF2122/97
ugacguccagggcca

SEQ ID NO: 1173113 - RNA, 22 nt, Mycobacterium bovis subsp bovis AF2122/97
ugacguagggcagcgccaggcc

SEQ ID NO: 1173114 - RNA, 20 nt, Mycobacterium bovis subsp bovis AF2122/97
ugacggugaauucacgaugc

SEQ ID NO: 1173115 - RNA, 15 nt, Mycobacterium bovis subsp bovis AF2122/97
ugacuugagcggcuu

SEQ ID NO: 1173116 - RNA, 21 nt, Mycobacterium bovis subsp bovis AF2122/97
ugacucgaucaccaugaugua

SEQ ID NO: 1173117 - RNA, 17 nt, Mycobacterium bovis subsp bovis AF2122/97
ugacucggccuccgccg

SEQ ID NO: 1173118 - RNA, 21 nt, Mycobacterium bovis subsp bovis AF2122/97
ugacucagaacguggccguua

SEQ ID NO: 1173119 - RNA, 12 nt, Mycobacterium bovis subsp bovis AF2122/97
ugagaagaagcc

SEQ ID NO: 1173120 - RNA, 22 nt, Mycobacterium bovis subsp bovis AF2122/97
ugagacugccgccgcuuucgcc

SEQ ID NO: 1173121 - RNA, 16 nt, Mycobacterium bovis subsp bovis AF2122/97
ugagacugggcgcugg

SEQ ID NO: 1173122 - RNA, 12 nt, Mycobacterium bovis subsp bovis AF2122/97
ugagagaugguc

SEQ ID NO: 1173123 - RNA, 16 nt, Mycobacterium bovis subsp bovis AF2122/97
ugacgcccaucucaug

SEQ ID NO: 1173124 - RNA, 18 nt, Mycobacterium bovis subsp bovis AF2122/97
ugacgccgaugaagccaa

SEQ ID NO: 1173125 - RNA, 15 nt, Mycobacterium bovis subsp bovis AF2122/97
ugacgccguugccgc

SEQ ID NO: 1173126 - RNA, 24 nt, Mycobacterium bovis subsp bovis AF2122/97
ugacgcgcaacgccgccagccugg

SEQ ID NO: 1173127 - RNA, 15 nt, Mycobacterium bovis subsp bovis AF2122/97
ugacgcggccgggcg

SEQ ID NO: 1173128 - RNA, 12 nt, Mycobacterium bovis subsp bovis AF2122/97
ugacgaugccgc

SEQ ID NO: 1173129 - RNA, 19 nt, Mycobacterium bovis subsp bovis AF2122/97
ugacgaucagcgugaucug

SEQ ID NO: 1173130 - RNA, 18 nt, Mycobacterium bovis subsp bovis AF2122/97
ugacgaucgacagccccg

SEQ ID NO: 1173131 - RNA, 13 nt, Mycobacterium bovis subsp bovis AF2122/97
ugacgagccacca

SEQ ID NO: 1173132 - RNA, 14 nt, Mycobacterium bovis subsp bovis AF2122/97
ugacgagccaccac

SEQ ID NO: 1173133 - RNA, 16 nt, Mycobacterium bovis subsp bovis AF2122/97
ugacgagccaccaccg

SEQ ID NO: 1173134 - RNA, 23 nt, Mycobacterium bovis subsp bovis AF2122/97
ugacgagcagcuagcccggcagc

SEQ ID NO: 1173135 - RNA, 21 nt, Mycobacterium bovis subsp bovis AF2122/97
ugacgaggcgagcggccaguc

SEQ ID NO: 1173136 - RNA, 22 nt, Mycobacterium bovis subsp bovis AF2122/97
ugacgacaaacggcgacccagc

SEQ ID NO: 1173137 - RNA, 17 nt, Mycobacterium bovis subsp bovis AF2122/97
ugaccgaagaagcccga

SEQ ID NO: 1173138 - RNA, 13 nt, Mycobacterium bovis subsp bovis AF2122/97
ugaccgaguugaa

SEQ ID NO: 1173139 - RNA, 14 nt, Mycobacterium bovis subsp bovis AF2122/97
ugaccuauugaacc

SEQ ID NO: 1173140 - RNA, 22 nt, Mycobacterium bovis subsp bovis AF2122/97
ugaccgucugcgacccgggccg

SEQ ID NO: 1173141 - RNA, 14 nt, Mycobacterium bovis subsp bovis AF2122/97
ugacaucgggccgc

SEQ ID NO: 1173142 - RNA, 20 nt, Mycobacterium bovis subsp bovis AF2122/97
ugacaucgucgccagggccg

SEQ ID NO: 1173143 - RNA, 23 nt, Mycobacterium bovis subsp bovis AF2122/97
ugaccaaugucagugccccgccc

SEQ ID NO: 1173144 - RNA, 17 nt, Mycobacterium bovis subsp bovis AF2122/97
ugacccgggccgggccg

SEQ ID NO: 1173145 - RNA, 15 nt, Mycobacterium bovis subsp bovis AF2122/97
ugacccggcagcccg

SEQ ID NO: 1173146 - RNA, 22 nt, Mycobacterium bovis subsp bovis AF2122/97
ugacccggcagcccggcggccg

SEQ ID NO: 1173147 - RNA, 15 nt, Mycobacterium bovis subsp bovis AF2122/97
ugacccucagcaccg

SEQ ID NO: 1173148 - RNA, 21 nt, Mycobacterium bovis subsp bovis AF2122/97
ugacccguucagcgacggccg

SEQ ID NO: 1173149 - RNA, 16 nt, Mycobacterium bovis subsp bovis AF2122/97
ugacccguuccacgcc

SEQ ID NO: 1173150 - RNA, 12 nt, Mycobacterium bovis subsp bovis AF2122/97
ugacccuggggu

SEQ ID NO: 1173151 - RNA, 21 nt, Mycobacterium bovis subsp bovis AF2122/97
ugacccuugugccccgagcug

SEQ ID NO: 1173152 - RNA, 22 nt, Mycobacterium bovis subsp bovis AF2122/97
ugacccccggguagaccaccug

SEQ ID NO: 1173153 - RNA, 14 nt, Mycobacterium bovis subsp bovis AF2122/97
ugacccccuagacc

SEQ ID NO: 1173154 - RNA, 17 nt, Mycobacterium bovis subsp bovis AF2122/97
ugacccaucucgucguc

SEQ ID NO: 1173155 - RNA, 18 nt, Mycobacterium bovis subsp bovis AF2122/97
ugacccccagcagggugu

SEQ ID NO: 1173156 - RNA, 22 nt, Mycobacterium bovis subsp bovis AF2122/97
ugaccacgaacgcgcgcagccg

SEQ ID NO: 1173157 - RNA, 17 nt, Mycobacterium bovis subsp bovis AF2122/97
ugaccacgcugcuggug

SEQ ID NO: 1173158 - RNA, 12 nt, Mycobacterium bovis subsp bovis AF2122/97
ugaccaccgccg

SEQ ID NO: 1173159 - RNA, 19 nt, Mycobacterium bovis subsp bovis AF2122/97
ugaccaccgccgacaggcc

SEQ ID NO: 1173160 - RNA, 16 nt, Mycobacterium bovis subsp bovis AF2122/97
ucucggcguugccgcc

SEQ ID NO: 1173161 - RNA, 19 nt, Mycobacterium bovis subsp bovis AF2122/97
ucucggcguugccgccguu

SEQ ID NO: 1173162 - RNA, 22 nt, Mycobacterium bovis subsp bovis AF2122/97
ucgcauuuguacugguuagaga

SEQ ID NO: 1173163 - RNA, 23 nt, Mycobacterium bovis subsp bovis AF2122/97
ucgccaaaaguacuggcguugcc

SEQ ID NO: 1173164 - RNA, 22 nt, Mycobacterium bovis subsp bovis AF2122/97
ucucgucgucgauuagcccacc

SEQ ID NO: 1173165 - RNA, 17 nt, Mycobacterium bovis subsp bovis AF2122/97
ucucgucgucgcggccg

SEQ ID NO: 1173166 - RNA, 14 nt, Mycobacterium bovis subsp bovis AF2122/97
ucucgucaaccugc

SEQ ID NO: 1173167 - RNA, 14 nt, Mycobacterium bovis subsp bovis AF2122/97
ucgcauggcggcug

SEQ ID NO: 1173168 - RNA, 22 nt, Mycobacterium bovis subsp bovis AF2122/97
ucgcaugucggacacguggcgu

SEQ ID NO: 1173169 - RNA, 20 nt, Mycobacterium bovis subsp bovis AF2122/97
ucucuucgcgcgcugggcgc

SEQ ID NO: 1173170 - RNA, 11 nt, Mycobacterium bovis subsp bovis AF2122/97
ucugaagcccg

SEQ ID NO: 1173171 - RNA, 17 nt, Mycobacterium bovis subsp bovis AF2122/97
ucuggcgcugcuggcag

SEQ ID NO: 1173172 - RNA, 17 nt, Mycobacterium bovis subsp bovis AF2122/97
ucugggcuuucagcacc

SEQ ID NO: 1173173 - RNA, 22 nt, Mycobacterium bovis subsp bovis AF2122/97
ucugggcuuucgcgugcggcug

SEQ ID NO: 1173174 - RNA, 18 nt, Mycobacterium bovis subsp bovis AF2122/97
ucugggguuggcucggcg

SEQ ID NO: 1173175 - RNA, 15 nt, Mycobacterium bovis subsp bovis AF2122/97
ucuggcgaacaguga

SEQ ID NO: 1173176 - RNA, 19 nt, Mycobacterium bovis subsp bovis AF2122/97
ucuggcgacgauucacggc

SEQ ID NO: 1173177 - RNA, 24 nt, Mycobacterium bovis subsp bovis AF2122/97
ucuggcgagggcuaccggcgccgc

SEQ ID NO: 1173178 - RNA, 16 nt, Mycobacterium bovis subsp bovis AF2122/97
ucuggaaccccgagcu

SEQ ID NO: 1173179 - RNA, 17 nt, Mycobacterium bovis subsp bovis AF2122/97
ucuggaauccggccaga

SEQ ID NO: 1173180 - RNA, 21 nt, Mycobacterium bovis subsp bovis AF2122/97
ucugcggccgcgugccgcccg

SEQ ID NO: 1173181 - RNA, 17 nt, Mycobacterium bovis subsp bovis AF2122/97
ucugcguauaggucaga

SEQ ID NO: 1173182 - RNA, 12 nt, Mycobacterium bovis subsp bovis AF2122/97
ucugcgggccgg

SEQ ID NO: 1173183 - RNA, 14 nt, Mycobacterium bovis subsp bovis AF2122/97
ucugcgugggccug

SEQ ID NO: 1173184 - RNA, 17 nt, Mycobacterium bovis subsp bovis AF2122/97
ucugcgucugcucggcg

SEQ ID NO: 1173185 - RNA, 17 nt, Mycobacterium bovis subsp bovis AF2122/97
ucugcucgccagccggc

SEQ ID NO: 1173186 - RNA, 18 nt, Mycobacterium bovis subsp bovis AF2122/97
ucugcucgccgggcagcu

SEQ ID NO: 1173187 - RNA, 17 nt, Mycobacterium bovis subsp bovis AF2122/97
ucugcucggcaucggaa

SEQ ID NO: 1173188 - RNA, 21 nt, Mycobacterium bovis subsp bovis AF2122/97
ucugcucggcgcgguggggcg

SEQ ID NO: 1173189 - RNA, 13 nt, Mycobacterium bovis subsp bovis AF2122/97
ucugcuccgcagc

SEQ ID NO: 1173190 - RNA, 16 nt, Mycobacterium bovis subsp bovis AF2122/97
ucugcugaccggaguu

SEQ ID NO: 1173191 - RNA, 23 nt, Mycobacterium bovis subsp bovis AF2122/97
ucugcugggcacgauggcucuca

SEQ ID NO: 1173192 - RNA, 17 nt, Mycobacterium bovis subsp bovis AF2122/97
ucugccuuggccggcuu

SEQ ID NO: 1173193 - RNA, 20 nt, Mycobacterium bovis subsp bovis AF2122/97
ucugcgagauguccucccau

SEQ ID NO: 1173194 - RNA, 15 nt, Mycobacterium bovis subsp bovis AF2122/97
ucugcgacaagaccg

SEQ ID NO: 1173195 - RNA, 14 nt, Mycobacterium bovis subsp bovis AF2122/97
ucugccgggagacg

SEQ ID NO: 1173196 - RNA, 19 nt, Mycobacterium bovis subsp bovis AF2122/97
ucugcgccaggggcaccau

SEQ ID NO: 1173197 - RNA, 15 nt, Mycobacterium bovis subsp bovis AF2122/97
ucugcgcccacccgc

SEQ ID NO: 1173198 - RNA, 19 nt, Mycobacterium bovis subsp bovis AF2122/97
ucugcgccagaaagcccag

SEQ ID NO: 1173199 - RNA, 18 nt, Mycobacterium bovis subsp bovis AF2122/97
ucugcgccacagcagcgu

SEQ ID NO: 1173200 - RNA, 14 nt, Mycobacterium bovis subsp bovis AF2122/97
ucugcgccaaaauc

SEQ ID NO: 1173201 - RNA, 17 nt, Mycobacterium bovis subsp bovis AF2122/97
ucugcgcgaugcccacg

SEQ ID NO: 1173202 - RNA, 12 nt, Mycobacterium bovis subsp bovis AF2122/97
ucugcgccgccg

SEQ ID NO: 1173203 - RNA, 19 nt, Mycobacterium bovis subsp bovis AF2122/97
ucugcgccuucgccagcgg

SEQ ID NO: 1173204 - RNA, 21 nt, Mycobacterium bovis subsp bovis AF2122/97
ucugcgccuucgccagcggcg

SEQ ID NO: 1173205 - RNA, 20 nt, Mycobacterium bovis subsp bovis AF2122/97
ucugcgcggugcccgcgaac

SEQ ID NO: 1173206 - RNA, 23 nt, Mycobacterium bovis subsp bovis AF2122/97
ucugcccgagguccgcccucagu

SEQ ID NO: 1173207 - RNA, 15 nt, Mycobacterium bovis subsp bovis AF2122/97
ucugcccugcacuuc

SEQ ID NO: 1173208 - RNA, 18 nt, Mycobacterium bovis subsp bovis AF2122/97
ucuuccccucggccgccc

SEQ ID NO: 1173209 - RNA, 20 nt, Mycobacterium bovis subsp bovis AF2122/97
ucugguaggcggccauguca

SEQ ID NO: 1173210 - RNA, 13 nt, Mycobacterium bovis subsp bovis AF2122/97
ucuuagccagcag

SEQ ID NO: 1173211 - RNA, 21 nt, Mycobacterium bovis subsp bovis AF2122/97
ucuucugccaucaacaggccu

SEQ ID NO: 1173212 - RNA, 14 nt, Mycobacterium bovis subsp bovis AF2122/97
ucuucuucuugacc

SEQ ID NO: 1173213 - RNA, 20 nt, Mycobacterium bovis subsp bovis AF2122/97
ucuucgccgucggcgacucc

SEQ ID NO: 1173214 - RNA, 19 nt, Mycobacterium bovis subsp bovis AF2122/97
ucuugcagugcgccagcga

SEQ ID NO: 1173215 - RNA, 15 nt, Mycobacterium bovis subsp bovis AF2122/97
ucuuggcgggugacu

SEQ ID NO: 1173216 - RNA, 19 nt, Mycobacterium bovis subsp bovis AF2122/97
ucuuggcgaggauguaguu

SEQ ID NO: 1173217 - RNA, 21 nt, Mycobacterium bovis subsp bovis AF2122/97
ucuuggcguugaugucggcca

SEQ ID NO: 1173218 - RNA, 19 nt, Mycobacterium bovis subsp bovis AF2122/97
ucuuggcgcccgccggcaa

SEQ ID NO: 1173219 - RNA, 15 nt, Mycobacterium bovis subsp bovis AF2122/97
ucuuggcgggagccu

SEQ ID NO: 1173220 - RNA, 16 nt, Mycobacterium bovis subsp bovis AF2122/97
ucuuggcgggcgccuu

SEQ ID NO: 1173221 - RNA, 16 nt, Mycobacterium bovis subsp bovis AF2122/97
ucuuggacagcagcag

SEQ ID NO: 1173222 - RNA, 19 nt, Mycobacterium bovis subsp bovis AF2122/97
ucuuguugugcugcaccgu

SEQ ID NO: 1173223 - RNA, 20 nt, Mycobacterium bovis subsp bovis AF2122/97
ucuuguuggcagcgggacug

SEQ ID NO: 1173224 - RNA, 16 nt, Mycobacterium bovis subsp bovis AF2122/97
ucuuugccggcgccuu

SEQ ID NO: 1173225 - RNA, 17 nt, Mycobacterium bovis subsp bovis AF2122/97
ucuuucccgccaccaaa

SEQ ID NO: 1173226 - RNA, 22 nt, Mycobacterium bovis subsp bovis AF2122/97
ucuuucccgccaccaaacccca

SEQ ID NO: 1173227 - RNA, 23 nt, Mycobacterium bovis subsp bovis AF2122/97
ucuuuggucgccggaccagagcc

SEQ ID NO: 1173228 - RNA, 18 nt, Mycobacterium bovis subsp bovis AF2122/97
ugaaaucuguugauacac

SEQ ID NO: 1173229 - RNA, 21 nt, Mycobacterium bovis subsp bovis AF2122/97
ugaaauccuaggguggcgauc

SEQ ID NO: 1173230 - RNA, 17 nt, Mycobacterium bovis subsp bovis AF2122/97
ugaacaguugcacaccg

SEQ ID NO: 1173231 - RNA, 14 nt, Mycobacterium bovis subsp bovis AF2122/97
ugaacaguugcaca

SEQ ID NO: 1173232 - RNA, 19 nt, Mycobacterium bovis subsp bovis AF2122/97
ugaacauacgaaacaugcg

SEQ ID NO: 1173233 - RNA, 23 nt, Mycobacterium bovis subsp bovis AF2122/97
ugaaccgguugacacccgggcca

SEQ ID NO: 1173234 - RNA, 22 nt, Mycobacterium bovis subsp bovis AF2122/97
ugaaccguagcgcccacuccaa

SEQ ID NO: 1173235 - RNA, 15 nt, Mycobacterium bovis subsp bovis AF2122/97
ugaaccgggacacca

SEQ ID NO: 1173236 - RNA, 18 nt, Mycobacterium bovis subsp bovis AF2122/97
ugaacucgaguugcucga

SEQ ID NO: 1173237 - RNA, 14 nt, Mycobacterium bovis subsp bovis AF2122/97
ugaacggcaccagc

SEQ ID NO: 1173238 - RNA, 22 nt, Mycobacterium bovis subsp bovis AF2122/97
ugaacggcaacguuuacgaugc

SEQ ID NO: 1173239 - RNA, 18 nt, Mycobacterium bovis subsp bovis AF2122/97
ugaacgcuguaagcaugc

SEQ ID NO: 1173240 - RNA, 16 nt, Mycobacterium bovis subsp bovis AF2122/97
ugaacgcguagucgcg

SEQ ID NO: 1173241 - RNA, 16 nt, Mycobacterium bovis subsp bovis AF2122/97
ugaagacaccggcguc

SEQ ID NO: 1173242 - RNA, 20 nt, Mycobacterium bovis subsp bovis AF2122/97
ugaagcacacuguucccaca

SEQ ID NO: 1173243 - RNA, 19 nt, Mycobacterium bovis subsp bovis AF2122/97
ugaagccagcgcagcaccg

SEQ ID NO: 1173244 - RNA, 15 nt, Mycobacterium bovis subsp bovis AF2122/97
ugaagacaccaggcc

SEQ ID NO: 1173245 - RNA, 18 nt, Mycobacterium bovis subsp bovis AF2122/97
ugaagaccaccgcccaca

SEQ ID NO: 1173246 - RNA, 19 nt, Mycobacterium bovis subsp bovis AF2122/97
ugaagucggugccgagcgc

SEQ ID NO: 1173247 - RNA, 17 nt, Mycobacterium bovis subsp bovis AF2122/97
ugaaggcaaacaccagc

SEQ ID NO: 1173248 - RNA, 14 nt, Mycobacterium bovis subsp bovis AF2122/97
ugaagcuuguccag

SEQ ID NO: 1173249 - RNA, 12 nt, Mycobacterium bovis subsp bovis AF2122/97
ugaaggagaucc

SEQ ID NO: 1173250 - RNA, 23 nt, Mycobacterium bovis subsp bovis AF2122/97
ugaaacgauugcugcggcuuuca

SEQ ID NO: 1173251 - RNA, 20 nt, Mycobacterium bovis subsp bovis AF2122/97
ugaaaaacgcccgcgcugcc

SEQ ID NO: 1173252 - RNA, 14 nt, Mycobacterium bovis subsp bovis AF2122/97
ugaaaaagcaucaa

SEQ ID NO: 1173253 - RNA, 13 nt, Mycobacterium bovis subsp bovis AF2122/97
ucaguugugcguu

SEQ ID NO: 1173254 - RNA, 23 nt, Mycobacterium bovis subsp bovis AF2122/97
ucaguugcgcuccaacaacucca

SEQ ID NO: 1173255 - RNA, 22 nt, Mycobacterium bovis subsp bovis AF2122/97
ucaguuuagggaaaaucacaau

SEQ ID NO: 1173256 - RNA, 17 nt, Mycobacterium bovis subsp bovis AF2122/97
ucaguugauagcuguug

SEQ ID NO: 1173257 - RNA, 17 nt, Mycobacterium bovis subsp bovis AF2122/97
uccaaagaccccuaccg

SEQ ID NO: 1173258 - RNA, 19 nt, Mycobacterium bovis subsp bovis AF2122/97
uccaacaacuccagcaggu

SEQ ID NO: 1173259 - RNA, 15 nt, Mycobacterium bovis subsp bovis AF2122/97
uccaaccgggccggc

SEQ ID NO: 1173260 - RNA, 14 nt, Mycobacterium bovis subsp bovis AF2122/97
uccaacgaucaguc

SEQ ID NO: 1173261 - RNA, 22 nt, Mycobacterium bovis subsp bovis AF2122/97
uccaaccaccgguccagcgccg

SEQ ID NO: 1173262 - RNA, 19 nt, Mycobacterium bovis subsp bovis AF2122/97
uccaacaguucucgcgcuu

SEQ ID NO: 1173263 - RNA, 13 nt, Mycobacterium bovis subsp bovis AF2122/97
uccaacagcgcca

SEQ ID NO: 1173264 - RNA, 14 nt, Mycobacterium bovis subsp bovis AF2122/97
uccaacgcggcgcg

SEQ ID NO: 1173265 - RNA, 19 nt, Mycobacterium bovis subsp bovis AF2122/97
uccaacuggccgcgucgcu

SEQ ID NO: 1173266 - RNA, 14 nt, Mycobacterium bovis subsp bovis AF2122/97
uccaagacagccug

SEQ ID NO: 1173267 - RNA, 16 nt, Mycobacterium bovis subsp bovis AF2122/97
uccaagcaauuccacc

SEQ ID NO: 1173268 - RNA, 23 nt, Mycobacterium bovis subsp bovis AF2122/97
uccaagcggagacugguugcgga

SEQ ID NO: 1173269 - RNA, 17 nt, Mycobacterium bovis subsp bovis AF2122/97
uccaagcucgacaacug

SEQ ID NO: 1173270 - RNA, 18 nt, Mycobacterium bovis subsp bovis AF2122/97
uccacgccgggcaaggcc

SEQ ID NO: 1173271 - RNA, 16 nt, Mycobacterium bovis subsp bovis AF2122/97
uccacgaucacccgga

SEQ ID NO: 1173272 - RNA, 18 nt, Mycobacterium bovis subsp bovis AF2122/97
uccacgaucggcccagcc

SEQ ID NO: 1173273 - RNA, 23 nt, Mycobacterium bovis subsp bovis AF2122/97
uccacgcacucgucgggguugau

SEQ ID NO: 1173274 - RNA, 20 nt, Mycobacterium bovis subsp bovis AF2122/97
uccacggcgaugcagccaca

SEQ ID NO: 1173275 - RNA, 14 nt, Mycobacterium bovis subsp bovis AF2122/97
uccacgucuccugu

SEQ ID NO: 1173276 - RNA, 18 nt, Mycobacterium bovis subsp bovis AF2122/97
uccacccagugccacgcc

SEQ ID NO: 1173277 - RNA, 23 nt, Mycobacterium bovis subsp bovis AF2122/97
uccacccaggccgaugugucgau

SEQ ID NO: 1173278 - RNA, 19 nt, Mycobacterium bovis subsp bovis AF2122/97
uccacccauagacccggcu

SEQ ID NO: 1173279 - RNA, 17 nt, Mycobacterium bovis subsp bovis AF2122/97
uccaccagccgguagcc

SEQ ID NO: 1173280 - RNA, 22 nt, Mycobacterium bovis subsp bovis AF2122/97
uccaccagcguguagcgaugcc

SEQ ID NO: 1173281 - RNA, 12 nt, Mycobacterium bovis subsp bovis AF2122/97
uccacaccaggc

SEQ ID NO: 1173282 - RNA, 13 nt, Mycobacterium bovis subsp bovis AF2122/97
uccacaccaggcc

SEQ ID NO: 1173283 - RNA, 12 nt, Mycobacterium bovis subsp bovis AF2122/97
uccacacccaca

SEQ ID NO: 1173284 - RNA, 14 nt, Mycobacterium bovis subsp bovis AF2122/97
uccacaauccugaa

SEQ ID NO: 1173285 - RNA, 24 nt, Mycobacterium bovis subsp bovis AF2122/97
uccacaaguaccgcaucgaguccg

SEQ ID NO: 1173286 - RNA, 22 nt, Mycobacterium bovis subsp bovis AF2122/97
uccagaaccgaagccucggcau

SEQ ID NO: 1173287 - RNA, 18 nt, Mycobacterium bovis subsp bovis AF2122/97
uccacuuggggcgccagg

SEQ ID NO: 1173288 - RNA, 13 nt, Mycobacterium bovis subsp bovis AF2122/97
uccagaaggccgc

SEQ ID NO: 1173289 - RNA, 20 nt, Mycobacterium bovis subsp bovis AF2122/97
uccagaaguaggcgaccgcc

SEQ ID NO: 1173290 - RNA, 18 nt, Mycobacterium bovis subsp bovis AF2122/97
uccagcaggucgccugcc

SEQ ID NO: 1173291 - RNA, 17 nt, Mycobacterium bovis subsp bovis AF2122/97
uccagcaguacaccgcc

SEQ ID NO: 1173292 - RNA, 18 nt, Mycobacterium bovis subsp bovis AF2122/97
uccagccaacgggaacaa

SEQ ID NO: 1173293 - RNA, 15 nt, Mycobacterium bovis subsp bovis AF2122/97
uccagcaugcccgcc

SEQ ID NO: 1173294 - RNA, 21 nt, Mycobacterium bovis subsp bovis AF2122/97
uccagcggaucgucguuguca

SEQ ID NO: 1173295 - RNA, 21 nt, Mycobacterium bovis subsp bovis AF2122/97
uccagcgcguaguccgcaucc

SEQ ID NO: 1173296 - RNA, 17 nt, Mycobacterium bovis subsp bovis AF2122/97
uccagcgcgcgccgcag

SEQ ID NO: 1173297 - RNA, 22 nt, Mycobacterium bovis subsp bovis AF2122/97
uccagcgcgacguccaccagcc

SEQ ID NO: 1173298 - RNA, 21 nt, Mycobacterium bovis subsp bovis AF2122/97
uccagcgcgccacccagcacc

SEQ ID NO: 1173299 - RNA, 19 nt, Mycobacterium bovis subsp bovis AF2122/97
uccaggcacuccagcggcg

SEQ ID NO: 1173300 - RNA, 21 nt, Mycobacterium bovis subsp bovis AF2122/97
uccaggagccccagguagucg

SEQ ID NO: 1173301 - RNA, 18 nt, Mycobacterium bovis subsp bovis AF2122/97
uccaguggcgccagggcc

SEQ ID NO: 1173302 - RNA, 14 nt, Mycobacterium bovis subsp bovis AF2122/97
uccagugcggccuu

SEQ ID NO: 1173303 - RNA, 20 nt, Mycobacterium bovis subsp bovis AF2122/97
uccagugcgguggccagugc

SEQ ID NO: 1173304 - RNA, 23 nt, Mycobacterium bovis subsp bovis AF2122/97
uccaguccuaucagugagccgcc

SEQ ID NO: 1173305 - RNA, 21 nt, Mycobacterium bovis subsp bovis AF2122/97
uccaggcguuggaucccagcc

SEQ ID NO: 1173306 - RNA, 23 nt, Mycobacterium bovis subsp bovis AF2122/97
uccaggccuaguccggcacugcg

SEQ ID NO: 1173307 - RNA, 20 nt, Mycobacterium bovis subsp bovis AF2122/97
uccagguccaaguccuccac

SEQ ID NO: 1173308 - RNA, 21 nt, Mycobacterium bovis subsp bovis AF2122/97
uccagguucuucuccaccacc

SEQ ID NO: 1173309 - RNA, 14 nt, Mycobacterium bovis subsp bovis AF2122/97
uccaucaaggucau

SEQ ID NO: 1173310 - RNA, 14 nt, Mycobacterium bovis subsp bovis AF2122/97
uccaucagggccuu

SEQ ID NO: 1173311 - RNA, 19 nt, Mycobacterium bovis subsp bovis AF2122/97
uccaucagagacagcagcg

SEQ ID NO: 1173312 - RNA, 19 nt, Mycobacterium bovis subsp bovis AF2122/97
uccaucacggaccaggccu

SEQ ID NO: 1173313 - RNA, 14 nt, Mycobacterium bovis subsp bovis AF2122/97
uccaucgcgcugcg

SEQ ID NO: 1173314 - RNA, 12 nt, Mycobacterium bovis subsp bovis AF2122/97
uccaugucgucg

SEQ ID NO: 1173315 - RNA, 15 nt, Mycobacterium bovis subsp bovis AF2122/97
uccaugugcccaggu

SEQ ID NO: 1173316 - RNA, 19 nt, Mycobacterium bovis subsp bovis AF2122/97
uccauguuuugcugcaugc

SEQ ID NO: 1173317 - RNA, 17 nt, Mycobacterium bovis subsp bovis AF2122/97
uccauggacggccaggu

SEQ ID NO: 1173318 - RNA, 22 nt, Mycobacterium bovis subsp bovis AF2122/97
uccaugauggccgucagccagg

SEQ ID NO: 1173319 - RNA, 22 nt, Mycobacterium bovis subsp bovis AF2122/97
ucccacagguuugcgccgcgca

SEQ ID NO: 1173320 - RNA, 17 nt, Mycobacterium bovis subsp bovis AF2122/97
ucccaccaccgcucguc

SEQ ID NO: 1173321 - RNA, 20 nt, Mycobacterium bovis subsp bovis AF2122/97
ucccaccagcggcggcccuu

SEQ ID NO: 1173322 - RNA, 11 nt, Mycobacterium bovis subsp bovis AF2122/97
ucccaccagcc

SEQ ID NO: 1173323 - RNA, 18 nt, Mycobacterium bovis subsp bovis AF2122/97
ucccaccgcuuccagguu

SEQ ID NO: 1173324 - RNA, 21 nt, Mycobacterium bovis subsp bovis AF2122/97
ucccacaacucggcauucacc

SEQ ID NO: 1173325 - RNA, 18 nt, Mycobacterium bovis subsp bovis AF2122/97
ucccaaucgucggccagc

SEQ ID NO: 1173326 - RNA, 15 nt, Mycobacterium bovis subsp bovis AF2122/97
ucccaacgccacugc

SEQ ID NO: 1173327 - RNA, 17 nt, Mycobacterium bovis subsp bovis AF2122/97
uccauugugggacgcga

SEQ ID NO: 1173328 - RNA, 14 nt, Mycobacterium bovis subsp bovis AF2122/97
uccccaccgucguc

SEQ ID NO: 1173329 - RNA, 15 nt, Mycobacterium bovis subsp bovis AF2122/97
ucccauucguagucg

SEQ ID NO: 1173330 - RNA, 17 nt, Mycobacterium bovis subsp bovis AF2122/97
ucccauucccaacacag

SEQ ID NO: 1173331 - RNA, 17 nt, Mycobacterium bovis subsp bovis AF2122/97
uccccagccccacccgc

SEQ ID NO: 1173332 - RNA, 13 nt, Mycobacterium bovis subsp bovis AF2122/97
uccccauugcgcc

SEQ ID NO: 1173333 - RNA, 14 nt, Mycobacterium bovis subsp bovis AF2122/97
uccccaggccgcuu

SEQ ID NO: 1173334 - RNA, 12 nt, Mycobacterium bovis subsp bovis AF2122/97
uccccagcacca

SEQ ID NO: 1173335 - RNA, 12 nt, Mycobacterium bovis subsp bovis AF2122/97
ucccccgcgaag

SEQ ID NO: 1173336 - RNA, 22 nt, Mycobacterium bovis subsp bovis AF2122/97
ucccccagaugcugguguugau

SEQ ID NO: 1173337 - RNA, 14 nt, Mycobacterium bovis subsp bovis AF2122/97
ucccccacacaccc

SEQ ID NO: 1173338 - RNA, 19 nt, Mycobacterium bovis subsp bovis AF2122/97
ucccaucaguugcacaccg

SEQ ID NO: 1173339 - RNA, 15 nt, Mycobacterium bovis subsp bovis AF2122/97
ucccaucccaugucg

SEQ ID NO: 1173340 - RNA, 21 nt, Mycobacterium bovis subsp bovis AF2122/97
ucccagucgcggcgcgaggag

SEQ ID NO: 1173341 - RNA, 19 nt, Mycobacterium bovis subsp bovis AF2122/97
ucccaggcguuuggcgugc

SEQ ID NO: 1173342 - RNA, 13 nt, Mycobacterium bovis subsp bovis AF2122/97
ucccagccaaccc

SEQ ID NO: 1173343 - RNA, 16 nt, Mycobacterium bovis subsp bovis AF2122/97
ucccagauaugcagga

SEQ ID NO: 1173344 - RNA, 14 nt, Mycobacterium bovis subsp bovis AF2122/97
ucccacucacccag

SEQ ID NO: 1173345 - RNA, 14 nt, Mycobacterium bovis subsp bovis AF2122/97
ucccacucgucguc

SEQ ID NO: 1173346 - RNA, 22 nt, Mycobacterium bovis subsp bovis AF2122/97
ucccacggccggccgcugccac

SEQ ID NO: 1173347 - RNA, 19 nt, Mycobacterium bovis subsp bovis AF2122/97
ucccacggcgguugccccg

SEQ ID NO: 1173348 - RNA, 21 nt, Mycobacterium bovis subsp bovis AF2122/97
ucccacggccggccgcugcca

SEQ ID NO: 1173349 - RNA, 17 nt, Mycobacterium bovis subsp bovis AF2122/97
ucccacgaguuggccaa

SEQ ID NO: 1173350 - RNA, 16 nt, Mycobacterium bovis subsp bovis AF2122/97
ucccacgccagcgcga

SEQ ID NO: 1173351 - RNA, 23 nt, Mycobacterium bovis subsp bovis AF2122/97
ucccacgcccggccccgcggcca

SEQ ID NO: 1173352 - RNA, 21 nt, Mycobacterium bovis subsp bovis AF2122/97
uccccgccggcggguuuugau

SEQ ID NO: 1173353 - RNA, 16 nt, Mycobacterium bovis subsp bovis AF2122/97
uccccgcgcugagcac

SEQ ID NO: 1173354 - RNA, 20 nt, Mycobacterium bovis subsp bovis AF2122/97
uccccgcggcgguaaaccug

SEQ ID NO: 1173355 - RNA, 13 nt, Mycobacterium bovis subsp bovis AF2122/97
uccccgccggcgg

SEQ ID NO: 1173356 - RNA, 14 nt, Mycobacterium bovis subsp bovis AF2122/97
uccccgcccuugcc

SEQ ID NO: 1173357 - RNA, 22 nt, Mycobacterium bovis subsp bovis AF2122/97
uccccgacaacgaaaccgaccu

SEQ ID NO: 1173358 - RNA, 13 nt, Mycobacterium bovis subsp bovis AF2122/97
uccccgaccugca

SEQ ID NO: 1173359 - RNA, 20 nt, Mycobacterium bovis subsp bovis AF2122/97
uccccgacggacuccggccg

SEQ ID NO: 1173360 - RNA, 20 nt, Mycobacterium bovis subsp bovis AF2122/97
uccccggcggcagcauaucc

SEQ ID NO: 1173361 - RNA, 18 nt, Mycobacterium bovis subsp bovis AF2122/97
uccccguccugccagucc

SEQ ID NO: 1173362 - RNA, 21 nt, Mycobacterium bovis subsp bovis AF2122/97
uccccgguucugcgcccaccc

SEQ ID NO: 1173363 - RNA, 20 nt, Mycobacterium bovis subsp bovis AF2122/97
ucccgagcccgucagcuccc

SEQ ID NO: 1173364 - RNA, 23 nt, Mycobacterium bovis subsp bovis AF2122/97
ucccgaacaacucggugccuguc

SEQ ID NO: 1173365 - RNA, 23 nt, Mycobacterium bovis subsp bovis AF2122/97
ucccgaacaauucacgcaccaca

SEQ ID NO: 1173366 - RNA, 15 nt, Mycobacterium bovis subsp bovis AF2122/97
ucccgaggcgcccaa

SEQ ID NO: 1173367 - RNA, 19 nt, Mycobacterium bovis subsp bovis AF2122/97
ucccgauccugcccaccau

SEQ ID NO: 1173368 - RNA, 17 nt, Mycobacterium bovis subsp bovis AF2122/97
uccccuugguggccagc

SEQ ID NO: 1173369 - RNA, 16 nt, Mycobacterium bovis subsp bovis AF2122/97
uccccugcgcugcagc

SEQ ID NO: 1173370 - RNA, 23 nt, Mycobacterium bovis subsp bovis AF2122/97
ucccgggcccgcugggcuugggg

SEQ ID NO: 1173371 - RNA, 19 nt, Mycobacterium bovis subsp bovis AF2122/97
ucccgggcggcggccuggg

SEQ ID NO: 1173372 - RNA, 14 nt, Mycobacterium bovis subsp bovis AF2122/97
ucccgggccgccgc

SEQ ID NO: 1173373 - RNA, 22 nt, Mycobacterium bovis subsp bovis AF2122/97
ucccggcgaccggguccggcgu

SEQ ID NO: 1173374 - RNA, 19 nt, Mycobacterium bovis subsp bovis AF2122/97
ucccggcucgagcucggcg

SEQ ID NO: 1173375 - RNA, 19 nt, Mycobacterium bovis subsp bovis AF2122/97
ucccggcggucagcggcuc

SEQ ID NO: 1173376 - RNA, 12 nt, Mycobacterium bovis subsp bovis AF2122/97
ucccggccaggc

SEQ ID NO: 1173377 - RNA, 19 nt, Mycobacterium bovis subsp bovis AF2122/97
ucccggccaggggcgcagc

SEQ ID NO: 1173378 - RNA, 14 nt, Mycobacterium bovis subsp bovis AF2122/97
ucccgguccagccc

SEQ ID NO: 1173379 - RNA, 18 nt, Mycobacterium bovis subsp bovis AF2122/97
ucccggugaccacuugca

SEQ ID NO: 1173380 - RNA, 13 nt, Mycobacterium bovis subsp bovis AF2122/97
ucccgguagcggc

SEQ ID NO: 1173381 - RNA, 18 nt, Mycobacterium bovis subsp bovis AF2122/97
ucccgugcgcgcgcagcu

SEQ ID NO: 1173382 - RNA, 18 nt, Mycobacterium bovis subsp bovis AF2122/97
ucccgucacucaccccaa

SEQ ID NO: 1173383 - RNA, 18 nt, Mycobacterium bovis subsp bovis AF2122/97
ucccgccgugccgcggcg

SEQ ID NO: 1173384 - RNA, 15 nt, Mycobacterium bovis subsp bovis AF2122/97
ucccgccguugccgc

SEQ ID NO: 1173385 - RNA, 16 nt, Mycobacterium bovis subsp bovis AF2122/97
ucccgccguugccgcc

SEQ ID NO: 1173386 - RNA, 14 nt, Mycobacterium bovis subsp bovis AF2122/97
ucccgccgcugccg

SEQ ID NO: 1173387 - RNA, 20 nt, Mycobacterium bovis subsp bovis AF2122/97
ucccgcaggcucaccgagcc

SEQ ID NO: 1173388 - RNA, 21 nt, Mycobacterium bovis subsp bovis AF2122/97
ucccgcaggcucaccgagccg

SEQ ID NO: 1173389 - RNA, 20 nt, Mycobacterium bovis subsp bovis AF2122/97
ucccgcucgcaggccggcgg

SEQ ID NO: 1173390 - RNA, 17 nt, Mycobacterium bovis subsp bovis AF2122/97
ucccgcucuggucgucg

SEQ ID NO: 1173391 - RNA, 17 nt, Mycobacterium bovis subsp bovis AF2122/97
ucccggaauauggcggc

SEQ ID NO: 1173392 - RNA, 13 nt, Mycobacterium bovis subsp bovis AF2122/97
ucccggacccacc

SEQ ID NO: 1173393 - RNA, 21 nt, Mycobacterium bovis subsp bovis AF2122/97
ucccgcgaugcgcaccagcgg

SEQ ID NO: 1173394 - RNA, 13 nt, Mycobacterium bovis subsp bovis AF2122/97
ucccgcgcgggcg

SEQ ID NO: 1173395 - RNA, 14 nt, Mycobacterium bovis subsp bovis AF2122/97
ucccgcggcaccuu

SEQ ID NO: 1173396 - RNA, 16 nt, Mycobacterium bovis subsp bovis AF2122/97
ucccgcucagcauuca

SEQ ID NO: 1173397 - RNA, 21 nt, Mycobacterium bovis subsp bovis AF2122/97
ucccgcucgagcagcgcgccg

SEQ ID NO: 1173398 - RNA, 16 nt, Mycobacterium bovis subsp bovis AF2122/97
ucccgcucgcaggccg

SEQ ID NO: 1173399 - RNA, 13 nt, Mycobacterium bovis subsp bovis AF2122/97
ucccuccgccaag

SEQ ID NO: 1173400 - RNA, 15 nt, Mycobacterium bovis subsp bovis AF2122/97
uccgaccagcggccg

SEQ ID NO: 1173401 - RNA, 17 nt, Mycobacterium bovis subsp bovis AF2122/97
uccgacacccgaagccu

SEQ ID NO: 1173402 - RNA, 20 nt, Mycobacterium bovis subsp bovis AF2122/97
uccgaacucgcgggcgacca

SEQ ID NO: 1173403 - RNA, 21 nt, Mycobacterium bovis subsp bovis AF2122/97
uccgaacuggucgacgccgag

SEQ ID NO: 1173404 - RNA, 18 nt, Mycobacterium bovis subsp bovis AF2122/97
uccgaaggccgccagucc

SEQ ID NO: 1173405 - RNA, 17 nt, Mycobacterium bovis subsp bovis AF2122/97
uccgaagagccagcaac

SEQ ID NO: 1173406 - RNA, 23 nt, Mycobacterium bovis subsp bovis AF2122/97
ucccuuguggucugccagcaccc

SEQ ID NO: 1173407 - RNA, 13 nt, Mycobacterium bovis subsp bovis AF2122/97
ucccuuguucccg

SEQ ID NO: 1173408 - RNA, 16 nt, Mycobacterium bovis subsp bovis AF2122/97
ucccuuguucccgaaa

SEQ ID NO: 1173409 - RNA, 19 nt, Mycobacterium bovis subsp bovis AF2122/97
ucccuuuguggggccgggc

SEQ ID NO: 1173410 - RNA, 19 nt, Mycobacterium bovis subsp bovis AF2122/97
uccgaaaucgucaguaccg

SEQ ID NO: 1173411 - RNA, 11 nt, Mycobacterium bovis subsp bovis AF2122/97
uccgacggugu

SEQ ID NO: 1173412 - RNA, 15 nt, Mycobacterium bovis subsp bovis AF2122/97
uccgacgucggugac

SEQ ID NO: 1173413 - RNA, 15 nt, Mycobacterium bovis subsp bovis AF2122/97
uccgacgggccacga

SEQ ID NO: 1173414 - RNA, 17 nt, Mycobacterium bovis subsp bovis AF2122/97
uccgacggccgcggcgu

SEQ ID NO: 1173415 - RNA, 21 nt, Mycobacterium bovis subsp bovis AF2122/97
uccgacgcgugucugggaccc

SEQ ID NO: 1173416 - RNA, 14 nt, Mycobacterium bovis subsp bovis AF2122/97
uccgacggccgcgg

SEQ ID NO: 1173417 - RNA, 20 nt, Mycobacterium bovis subsp bovis AF2122/97
uccgaccucugcguccagca

SEQ ID NO: 1173418 - RNA, 20 nt, Mycobacterium bovis subsp bovis AF2122/97
uccgagcuuggccgccgcca

SEQ ID NO: 1173419 - RNA, 17 nt, Mycobacterium bovis subsp bovis AF2122/97
uccgaggaauacagcuu

SEQ ID NO: 1173420 - RNA, 18 nt, Mycobacterium bovis subsp bovis AF2122/97
uccgaggaauacagcuug

SEQ ID NO: 1173421 - RNA, 17 nt, Mycobacterium bovis subsp bovis AF2122/97
uccgacuggccccgcca

SEQ ID NO: 1173422 - RNA, 21 nt, Mycobacterium bovis subsp bovis AF2122/97
uccgacuggccccgccagcgg

SEQ ID NO: 1173423 - RNA, 15 nt, Mycobacterium bovis subsp bovis AF2122/97
uccgaccgguacccg

SEQ ID NO: 1173424 - RNA, 17 nt, Mycobacterium bovis subsp bovis AF2122/97
uccgccccgcccgcacc

SEQ ID NO: 1173425 - RNA, 20 nt, Mycobacterium bovis subsp bovis AF2122/97
uccgccccgcccgcacccau

SEQ ID NO: 1173426 - RNA, 23 nt, Mycobacterium bovis subsp bovis AF2122/97
uccgcccauucccagaggcccgc

SEQ ID NO: 1173427 - RNA, 15 nt, Mycobacterium bovis subsp bovis AF2122/97
uccgcccagccgcag

SEQ ID NO: 1173428 - RNA, 14 nt, Mycobacterium bovis subsp bovis AF2122/97
uccgcccagcaccc

SEQ ID NO: 1173429 - RNA, 15 nt, Mycobacterium bovis subsp bovis AF2122/97
uccgcccuugccgcc

SEQ ID NO: 1173430 - RNA, 18 nt, Mycobacterium bovis subsp bovis AF2122/97
uccgccgaggccgccguu

SEQ ID NO: 1173431 - RNA, 13 nt, Mycobacterium bovis subsp bovis AF2122/97
uccgccgaacacc

SEQ ID NO: 1173432 - RNA, 14 nt, Mycobacterium bovis subsp bovis AF2122/97
uccgccgaggccgc

SEQ ID NO: 1173433 - RNA, 13 nt, Mycobacterium bovis subsp bovis AF2122/97
uccgccgccgccg

SEQ ID NO: 1173434 - RNA, 20 nt, Mycobacterium bovis subsp bovis AF2122/97
uccgccgcagacgccgacuc

SEQ ID NO: 1173435 - RNA, 15 nt, Mycobacterium bovis subsp bovis AF2122/97
uccgccgccugcgca

SEQ ID NO: 1173436 - RNA, 13 nt, Mycobacterium bovis subsp bovis AF2122/97
uccgccggcccca

SEQ ID NO: 1173437 - RNA, 16 nt, Mycobacterium bovis subsp bovis AF2122/97
uccgccgggccaggcc

SEQ ID NO: 1173438 - RNA, 17 nt, Mycobacterium bovis subsp bovis AF2122/97
uccgccguugccgaucc

SEQ ID NO: 1173439 - RNA, 20 nt, Mycobacterium bovis subsp bovis AF2122/97
uccgcgaucugcagcgcgga

SEQ ID NO: 1173440 - RNA, 23 nt, Mycobacterium bovis subsp bovis AF2122/97
uccgcgcaacuuccauuuucgcc

SEQ ID NO: 1173441 - RNA, 23 nt, Mycobacterium bovis subsp bovis AF2122/97
uccgcgcaccgcaggguccacac

SEQ ID NO: 1173442 - RNA, 14 nt, Mycobacterium bovis subsp bovis AF2122/97
uccgcgaugugggc

SEQ ID NO: 1173443 - RNA, 18 nt, Mycobacterium bovis subsp bovis AF2122/97
uccgcgccaguggccacc

SEQ ID NO: 1173444 - RNA, 15 nt, Mycobacterium bovis subsp bovis AF2122/97
uccgcgcccgagccg

SEQ ID NO: 1173445 - RNA, 23 nt, Mycobacterium bovis subsp bovis AF2122/97
uccgcggaucaccaucgccgccg

SEQ ID NO: 1173446 - RNA, 17 nt, Mycobacterium bovis subsp bovis AF2122/97
uccgcgcuucacagcca

SEQ ID NO: 1173447 - RNA, 12 nt, Mycobacterium bovis subsp bovis AF2122/97
uccgcggaaccc

SEQ ID NO: 1173448 - RNA, 13 nt, Mycobacterium bovis subsp bovis AF2122/97
uccgcggcacgcu

SEQ ID NO: 1173449 - RNA, 24 nt, Mycobacterium bovis subsp bovis AF2122/97
uccgcgcgcaagucgauguacacc

SEQ ID NO: 1173450 - RNA, 19 nt, Mycobacterium bovis subsp bovis AF2122/97
uccgcggcgcagcacggcg

SEQ ID NO: 1173451 - RNA, 21 nt, Mycobacterium bovis subsp bovis AF2122/97
uccgcgucggcggcgaccgcc

SEQ ID NO: 1173452 - RNA, 19 nt, Mycobacterium bovis subsp bovis AF2122/97
uccgcguagagcagcagcg

SEQ ID NO: 1173453 - RNA, 23 nt, Mycobacterium bovis subsp bovis AF2122/97
uccgcgguguuggacgcgggccg

SEQ ID NO: 1173454 - RNA, 14 nt, Mycobacterium bovis subsp bovis AF2122/97
uccgcguccaaggc

SEQ ID NO: 1173455 - RNA, 16 nt, Mycobacterium bovis subsp bovis AF2122/97
uccgcguggugcugac

SEQ ID NO: 1173456 - RNA, 11 nt, Mycobacterium bovis subsp bovis AF2122/97
uccgccacgaa

SEQ ID NO: 1173457 - RNA, 21 nt, Mycobacterium bovis subsp bovis AF2122/97
uccgccagaauugccggcgau

SEQ ID NO: 1173458 - RNA, 20 nt, Mycobacterium bovis subsp bovis AF2122/97
uccgccacggcgggcgaccc

SEQ ID NO: 1173459 - RNA, 17 nt, Mycobacterium bovis subsp bovis AF2122/97
uccgccagaccgcggcg

SEQ ID NO: 1173460 - RNA, 19 nt, Mycobacterium bovis subsp bovis AF2122/97
uccgccaggccgaccgcgc

SEQ ID NO: 1173461 - RNA, 15 nt, Mycobacterium bovis subsp bovis AF2122/97
uccgcagcggugcgc

SEQ ID NO: 1173462 - RNA, 19 nt, Mycobacterium bovis subsp bovis AF2122/97
uccgccacccgccaacgcc

SEQ ID NO: 1173463 - RNA, 23 nt, Mycobacterium bovis subsp bovis AF2122/97
uccgcagugagcaaugccaacgg

SEQ ID NO: 1173464 - RNA, 22 nt, Mycobacterium bovis subsp bovis AF2122/97
uccgcaccacgcccgacgagga

SEQ ID NO: 1173465 - RNA, 14 nt, Mycobacterium bovis subsp bovis AF2122/97
uccgcacccggccg

SEQ ID NO: 1173466 - RNA, 12 nt, Mycobacterium bovis subsp bovis AF2122/97
uccgcacaacga

SEQ ID NO: 1173467 - RNA, 14 nt, Mycobacterium bovis subsp bovis AF2122/97
uccgcaaggaccug

SEQ ID NO: 1173468 - RNA, 22 nt, Mycobacterium bovis subsp bovis AF2122/97
uccgauuuugugagccaggcgg

SEQ ID NO: 1173469 - RNA, 19 nt, Mycobacterium bovis subsp bovis AF2122/97
uccgaucaugucggccggg

SEQ ID NO: 1173470 - RNA, 12 nt, Mycobacterium bovis subsp bovis AF2122/97
uccgauccggug

SEQ ID NO: 1173471 - RNA, 20 nt, Mycobacterium bovis subsp bovis AF2122/97
uccgaucgcguuagccaggu

SEQ ID NO: 1173472 - RNA, 18 nt, Mycobacterium bovis subsp bovis AF2122/97
uccgaugcgcgcggcgcg

SEQ ID NO: 1173473 - RNA, 22 nt, Mycobacterium bovis subsp bovis AF2122/97
uccgauggcccggcucacagca

SEQ ID NO: 1173474 - RNA, 15 nt, Mycobacterium bovis subsp bovis AF2122/97
uccgaugggaaucag

SEQ ID NO: 1173475 - RNA, 15 nt, Mycobacterium bovis subsp bovis AF2122/97
uccgaggccgccauc

SEQ ID NO: 1173476 - RNA, 19 nt, Mycobacterium bovis subsp bovis AF2122/97
uccgagggcgucgccgccg

SEQ ID NO: 1173477 - RNA, 19 nt, Mycobacterium bovis subsp bovis AF2122/97
uccuucuuguuggucccga

SEQ ID NO: 1173478 - RNA, 20 nt, Mycobacterium bovis subsp bovis AF2122/97
uccuugaacguucuuaaacg

SEQ ID NO: 1173479 - RNA, 21 nt, Mycobacterium bovis subsp bovis AF2122/97
uccuugagccgggcaaccagc

SEQ ID NO: 1173480 - RNA, 18 nt, Mycobacterium bovis subsp bovis AF2122/97
uccuucgcguuggcccgc

SEQ ID NO: 1173481 - RNA, 17 nt, Mycobacterium bovis subsp bovis AF2122/97
uccuugggcgucaagca

SEQ ID NO: 1173482 - RNA, 21 nt, Mycobacterium bovis subsp bovis AF2122/97
uccuugaucaaggugucgacg

SEQ ID NO: 1173483 - RNA, 19 nt, Mycobacterium bovis subsp bovis AF2122/97
uccuugcgccagcgggcug

SEQ ID NO: 1173484 - RNA, 18 nt, Mycobacterium bovis subsp bovis AF2122/97
uccuugcgguccaggccg

SEQ ID NO: 1173485 - RNA, 16 nt, Mycobacterium bovis subsp bovis AF2122/97
ucgaacagcaccgccg

SEQ ID NO: 1173486 - RNA, 13 nt, Mycobacterium bovis subsp bovis AF2122/97
ucgaacaccgucc

SEQ ID NO: 1173487 - RNA, 21 nt, Mycobacterium bovis subsp bovis AF2122/97
ucgaacaccguccaauuggcg

SEQ ID NO: 1173488 - RNA, 21 nt, Mycobacterium bovis subsp bovis AF2122/97
ucgaacagcgaaccggcuggg

SEQ ID NO: 1173489 - RNA, 19 nt, Mycobacterium bovis subsp bovis AF2122/97
ucgaaauccugguggcaga

SEQ ID NO: 1173490 - RNA, 20 nt, Mycobacterium bovis subsp bovis AF2122/97
ucgaaagcgauauuggaugc

SEQ ID NO: 1173491 - RNA, 14 nt, Mycobacterium bovis subsp bovis AF2122/97
ucgaagcggcugcu

SEQ ID NO: 1173492 - RNA, 12 nt, Mycobacterium bovis subsp bovis AF2122/97
ucgaagcgggcu

SEQ ID NO: 1173493 - RNA, 13 nt, Mycobacterium bovis subsp bovis AF2122/97
ucgaagcccggcg

SEQ ID NO: 1173494 - RNA, 15 nt, Mycobacterium bovis subsp bovis AF2122/97
ucgaagucgcccagu

SEQ ID NO: 1173495 - RNA, 14 nt, Mycobacterium bovis subsp bovis AF2122/97
ucgaacgcccugac

SEQ ID NO: 1173496 - RNA, 20 nt, Mycobacterium bovis subsp bovis AF2122/97
ucgaacgcagccagcgccau

SEQ ID NO: 1173497 - RNA, 15 nt, Mycobacterium bovis subsp bovis AF2122/97
ucgaacgcugaggaa

SEQ ID NO: 1173498 - RNA, 12 nt, Mycobacterium bovis subsp bovis AF2122/97
ucgaagaauaug

SEQ ID NO: 1173499 - RNA, 17 nt, Mycobacterium bovis subsp bovis AF2122/97
ucgaacugggggccggc

SEQ ID NO: 1173500 - RNA, 15 nt, Mycobacterium bovis subsp bovis AF2122/97
ucgacacccguugag

SEQ ID NO: 1173501 - RNA, 18 nt, Mycobacterium bovis subsp bovis AF2122/97
ucgacaccgagccacgac

SEQ ID NO: 1173502 - RNA, 15 nt, Mycobacterium bovis subsp bovis AF2122/97
ucgacaaagcggcug

SEQ ID NO: 1173503 - RNA, 16 nt, Mycobacterium bovis subsp bovis AF2122/97
ucgacaaagcggcugc

SEQ ID NO: 1173504 - RNA, 15 nt, Mycobacterium bovis subsp bovis AF2122/97
ucgacgccggccagc

SEQ ID NO: 1173505 - RNA, 13 nt, Mycobacterium bovis subsp bovis AF2122/97
ucgacgccgacca

SEQ ID NO: 1173506 - RNA, 18 nt, Mycobacterium bovis subsp bovis AF2122/97
ucgacgccgccacccggc

SEQ ID NO: 1173507 - RNA, 16 nt, Mycobacterium bovis subsp bovis AF2122/97
ucgacgccgcgcagcc

SEQ ID NO: 1173508 - RNA, 14 nt, Mycobacterium bovis subsp bovis AF2122/97
ucgacgcggcaggc

SEQ ID NO: 1173509 - RNA, 16 nt, Mycobacterium bovis subsp bovis AF2122/97
ucgacggcgucgacug

SEQ ID NO: 1173510 - RNA, 22 nt, Mycobacterium bovis subsp bovis AF2122/97
ucgacggcgucgacugcgugcc

SEQ ID NO: 1173511 - RNA, 21 nt, Mycobacterium bovis subsp bovis AF2122/97
ucgacguccaucccggcgccg

SEQ ID NO: 1173512 - RNA, 19 nt, Mycobacterium bovis subsp bovis AF2122/97
ucgacguauuggcgcagca

SEQ ID NO: 1173513 - RNA, 14 nt, Mycobacterium bovis subsp bovis AF2122/97
ucgacguagucgcg

SEQ ID NO: 1173514 - RNA, 14 nt, Mycobacterium bovis subsp bovis AF2122/97
ucgacgucaugcag

SEQ ID NO: 1173515 - RNA, 16 nt, Mycobacterium bovis subsp bovis AF2122/97
ucgacgucaugcaggg

SEQ ID NO: 1173516 - RNA, 16 nt, Mycobacterium bovis subsp bovis AF2122/97
ucgacggguucacccu

SEQ ID NO: 1173517 - RNA, 14 nt, Mycobacterium bovis subsp bovis AF2122/97
ucgacggucauccc

SEQ ID NO: 1173518 - RNA, 18 nt, Mycobacterium bovis subsp bovis AF2122/97
ucgacguaggacugccag

SEQ ID NO: 1173519 - RNA, 21 nt, Mycobacterium bovis subsp bovis AF2122/97
ucgacgaucgucuugucgccg

SEQ ID NO: 1173520 - RNA, 15 nt, Mycobacterium bovis subsp bovis AF2122/97
ucgacgaccaccuuc

SEQ ID NO: 1173521 - RNA, 20 nt, Mycobacterium bovis subsp bovis AF2122/97
ucgacgccccaggacaccuu

SEQ ID NO: 1173522 - RNA, 23 nt, Mycobacterium bovis subsp bovis AF2122/97
ucgacgcccucgguagcauccag

SEQ ID NO: 1173523 - RNA, 13 nt, Mycobacterium bovis subsp bovis AF2122/97
ucgacgcacaccc

SEQ ID NO: 1173524 - RNA, 18 nt, Mycobacterium bovis subsp bovis AF2122/97
ucgacgaucugcagcacu

SEQ ID NO: 1173525 - RNA, 22 nt, Mycobacterium bovis subsp bovis AF2122/97
ucgaccucagacagcugcacac

SEQ ID NO: 1173526 - RNA, 21 nt, Mycobacterium bovis subsp bovis AF2122/97
ucgacgacuccuauugcagca

SEQ ID NO: 1173527 - RNA, 19 nt, Mycobacterium bovis subsp bovis AF2122/97
ucgacgaacaccccgggcg

SEQ ID NO: 1173528 - RNA, 19 nt, Mycobacterium bovis subsp bovis AF2122/97
ucgacgaagaucgcgugcc

SEQ ID NO: 1173529 - RNA, 20 nt, Mycobacterium bovis subsp bovis AF2122/97
ucgacccggccaagggugcu

SEQ ID NO: 1173530 - RNA, 21 nt, Mycobacterium bovis subsp bovis AF2122/97
ucgacccgaugacccacugca

SEQ ID NO: 1173531 - RNA, 22 nt, Mycobacterium bovis subsp bovis AF2122/97
ucgaccgcggccggguggcccg

SEQ ID NO: 1173532 - RNA, 21 nt, Mycobacterium bovis subsp bovis AF2122/97
ucgaccggaaugcccgggccc

SEQ ID NO: 1173533 - RNA, 20 nt, Mycobacterium bovis subsp bovis AF2122/97
ucgaccguccgggucaccag

SEQ ID NO: 1173534 - RNA, 23 nt, Mycobacterium bovis subsp bovis AF2122/97
ucgaccagcgccgauaccagcca

SEQ ID NO: 1173535 - RNA, 20 nt, Mycobacterium bovis subsp bovis AF2122/97
ucgaccaagguguccagcac

SEQ ID NO: 1173536 - RNA, 15 nt, Mycobacterium bovis subsp bovis AF2122/97
ucgacagguuucccg

SEQ ID NO: 1173537 - RNA, 12 nt, Mycobacterium bovis subsp bovis AF2122/97
ucgacagcauca

SEQ ID NO: 1173538 - RNA, 21 nt, Mycobacterium bovis subsp bovis AF2122/97
ucgacagccccgcggccagca

SEQ ID NO: 1173539 - RNA, 15 nt, Mycobacterium bovis subsp bovis AF2122/97
ucgacuucagcggcc

SEQ ID NO: 1173540 - RNA, 17 nt, Mycobacterium bovis subsp bovis AF2122/97
ucgacguuccagcagua

SEQ ID NO: 1173541 - RNA, 16 nt, Mycobacterium bovis subsp bovis AF2122/97
ucgacuccagcaccag

SEQ ID NO: 1173542 - RNA, 13 nt, Mycobacterium bovis subsp bovis AF2122/97
ucgacucacacac

SEQ ID NO: 1173543 - RNA, 14 nt, Mycobacterium bovis subsp bovis AF2122/97
ucgacucacacacc

SEQ ID NO: 1173544 - RNA, 21 nt, Mycobacterium bovis subsp bovis AF2122/97
ucgagaccccgacgaugcgca

SEQ ID NO: 1173545 - RNA, 16 nt, Mycobacterium bovis subsp bovis AF2122/97
ucgagaaucggcauuc

SEQ ID NO: 1173546 - RNA, 22 nt, Mycobacterium bovis subsp bovis AF2122/97
ucgagaaugcugacggugcagg

SEQ ID NO: 1173547 - RNA, 17 nt, Mycobacterium bovis subsp bovis AF2122/97
ucgagacgcuuuccgcc

SEQ ID NO: 1173548 - RNA, 22 nt, Mycobacterium bovis subsp bovis AF2122/97
ucgagaagaucucguagccgcc

SEQ ID NO: 1173549 - RNA, 17 nt, Mycobacterium bovis subsp bovis AF2122/97
ucgagauaaccaccauc

SEQ ID NO: 1173550 - RNA, 18 nt, Mycobacterium bovis subsp bovis AF2122/97
ucgagagccucuaaacca

SEQ ID NO: 1173551 - RNA, 17 nt, Mycobacterium bovis subsp bovis AF2122/97
ucgagagggaucacgcc

SEQ ID NO: 1173552 - RNA, 12 nt, Mycobacterium bovis subsp bovis AF2122/97
ucgagcacaccg

SEQ ID NO: 1173553 - RNA, 15 nt, Mycobacterium bovis subsp bovis AF2122/97
ucgagcaccacccgg

SEQ ID NO: 1173554 - RNA, 22 nt, Mycobacterium bovis subsp bovis AF2122/97
ucgagcaacggacgaagcaccu

SEQ ID NO: 1173555 - RNA, 17 nt, Mycobacterium bovis subsp bovis AF2122/97
ucgagccacccaccgac

SEQ ID NO: 1173556 - RNA, 15 nt, Mycobacterium bovis subsp bovis AF2122/97
ucgagcaugcccagc

SEQ ID NO: 1173557 - RNA, 19 nt, Mycobacterium bovis subsp bovis AF2122/97
ucgagcccgucgaguaggu

SEQ ID NO: 1173558 - RNA, 12 nt, Mycobacterium bovis subsp bovis AF2122/97
ucgagccagcgg

SEQ ID NO: 1173559 - RNA, 21 nt, Mycobacterium bovis subsp bovis AF2122/97
ucgagcgccgcggacucgggc

SEQ ID NO: 1173560 - RNA, 22 nt, Mycobacterium bovis subsp bovis AF2122/97
ucgagcgacguuguuuuugcac

SEQ ID NO: 1173561 - RNA, 23 nt, Mycobacterium bovis subsp bovis AF2122/97
ucgagccggauucggcugccacc

SEQ ID NO: 1173562 - RNA, 18 nt, Mycobacterium bovis subsp bovis AF2122/97
ucgagcaccucgaaggcc

SEQ ID NO: 1173563 - RNA, 14 nt, Mycobacterium bovis subsp bovis AF2122/97
ucgagcaccggcug

SEQ ID NO: 1173564 - RNA, 15 nt, Mycobacterium bovis subsp bovis AF2122/97
ucgagcaccgcgaac

SEQ ID NO: 1173565 - RNA, 13 nt, Mycobacterium bovis subsp bovis AF2122/97
ucgagcagcgcgc

SEQ ID NO: 1173566 - RNA, 14 nt, Mycobacterium bovis subsp bovis AF2122/97
ucgagcagcauguc

SEQ ID NO: 1173567 - RNA, 23 nt, Mycobacterium bovis subsp bovis AF2122/97
ucgagcguaacgguaaccggccc

SEQ ID NO: 1173568 - RNA, 14 nt, Mycobacterium bovis subsp bovis AF2122/97
ucgagcgugaaccu

SEQ ID NO: 1173569 - RNA, 13 nt, Mycobacterium bovis subsp bovis AF2122/97
ucgagcgugcgca

SEQ ID NO: 1173570 - RNA, 17 nt, Mycobacterium bovis subsp bovis AF2122/97
ucgagcucguccucguc

SEQ ID NO: 1173571 - RNA, 19 nt, Mycobacterium bovis subsp bovis AF2122/97
ucgagcucguccucgucuu

SEQ ID NO: 1173572 - RNA, 19 nt, Mycobacterium bovis subsp bovis AF2122/97
ucgaggaguuggugcagcg

SEQ ID NO: 1173573 - RNA, 14 nt, Mycobacterium bovis subsp bovis AF2122/97
ucgaggaccaccac

SEQ ID NO: 1173574 - RNA, 19 nt, Mycobacterium bovis subsp bovis AF2122/97
ucgaggaagaucaccuccc

SEQ ID NO: 1173575 - RNA, 11 nt, Mycobacterium bovis subsp bovis AF2122/97
ucgagggcuuu

SEQ ID NO: 1173576 - RNA, 18 nt, Mycobacterium bovis subsp bovis AF2122/97
ucgagguccaccacccug

SEQ ID NO: 1173577 - RNA, 15 nt, Mycobacterium bovis subsp bovis AF2122/97
ucgagggugaccccc

SEQ ID NO: 1173578 - RNA, 22 nt, Mycobacterium bovis subsp bovis AF2122/97
ucgaguccugguaccccagcac

SEQ ID NO: 1173579 - RNA, 18 nt, Mycobacterium bovis subsp bovis AF2122/97
ucgaguaguucgucgacg

SEQ ID NO: 1173580 - RNA, 17 nt, Mycobacterium bovis subsp bovis AF2122/97
ucgaguccaggcagcuu

SEQ ID NO: 1173581 - RNA, 22 nt, Mycobacterium bovis subsp bovis AF2122/97
ucgagguguagcccuccgagca

SEQ ID NO: 1173582 - RNA, 14 nt, Mycobacterium bovis subsp bovis AF2122/97
ucgaguuuggccag

SEQ ID NO: 1173583 - RNA, 19 nt, Mycobacterium bovis subsp bovis AF2122/97
ucgaguugcucgacacugg

SEQ ID NO: 1173584 - RNA, 21 nt, Mycobacterium bovis subsp bovis AF2122/97
ucgagugugaacuggucgacg

SEQ ID NO: 1173585 - RNA, 14 nt, Mycobacterium bovis subsp bovis AF2122/97
ucgaguuccggccg

SEQ ID NO: 1173586 - RNA, 17 nt, Mycobacterium bovis subsp bovis AF2122/97
ucgaucacguggugcgg

SEQ ID NO: 1173587 - RNA, 19 nt, Mycobacterium bovis subsp bovis AF2122/97
ucgaucagaaucugccucu

SEQ ID NO: 1173588 - RNA, 22 nt, Mycobacterium bovis subsp bovis AF2122/97
ucgaucagacgcucgaccugcc

SEQ ID NO: 1173589 - RNA, 19 nt, Mycobacterium bovis subsp bovis AF2122/97
ucgaucagcaacucggcca

SEQ ID NO: 1173590 - RNA, 13 nt, Mycobacterium bovis subsp bovis AF2122/97
ucgaucagcuccu

SEQ ID NO: 1173591 - RNA, 18 nt, Mycobacterium bovis subsp bovis AF2122/97
ucgaucaggggcccaccc

SEQ ID NO: 1173592 - RNA, 14 nt, Mycobacterium bovis subsp bovis AF2122/97
ucgauaccggcgug

SEQ ID NO: 1173593 - RNA, 17 nt, Mycobacterium bovis subsp bovis AF2122/97
ucgauagcccgccaccc

SEQ ID NO: 1173594 - RNA, 21 nt, Mycobacterium bovis subsp bovis AF2122/97
ucgaugaccagcacaccgccc

SEQ ID NO: 1173595 - RNA, 19 nt, Mycobacterium bovis subsp bovis AF2122/97
ucgaugaccccgguggucu

SEQ ID NO: 1173596 - RNA, 19 nt, Mycobacterium bovis subsp bovis AF2122/97
ucgaugaucucgccccagu

SEQ ID NO: 1173597 - RNA, 17 nt, Mycobacterium bovis subsp bovis AF2122/97
ucgaugcgcgccggcuu

SEQ ID NO: 1173598 - RNA, 13 nt, Mycobacterium bovis subsp bovis AF2122/97
ucgaugcgcugcu

SEQ ID NO: 1173599 - RNA, 16 nt, Mycobacterium bovis subsp bovis AF2122/97
ucgaucgagcaggccg

SEQ ID NO: 1173600 - RNA, 18 nt, Mycobacterium bovis subsp bovis AF2122/97
ucgaucggcagccagggc

SEQ ID NO: 1173601 - RNA, 22 nt, Mycobacterium bovis subsp bovis AF2122/97
ucgauccucgcccgcaccagcu

SEQ ID NO: 1173602 - RNA, 18 nt, Mycobacterium bovis subsp bovis AF2122/97
ucgaucugcacgagugcg

SEQ ID NO: 1173603 - RNA, 16 nt, Mycobacterium bovis subsp bovis AF2122/97
ucgauggcaugggcua

SEQ ID NO: 1173604 - RNA, 20 nt, Mycobacterium bovis subsp bovis AF2122/97
ucgauggcguagggcugucc

SEQ ID NO: 1173605 - RNA, 13 nt, Mycobacterium bovis subsp bovis AF2122/97
ucgauggugugcc

SEQ ID NO: 1173606 - RNA, 15 nt, Mycobacterium bovis subsp bovis AF2122/97
ucgauggugugcccg

SEQ ID NO: 1173607 - RNA, 18 nt, Mycobacterium bovis subsp bovis AF2122/97
ucgauggucagcagaucc

SEQ ID NO: 1173608 - RNA, 17 nt, Mycobacterium bovis subsp bovis AF2122/97
ucgauguccgcagcacc

SEQ ID NO: 1173609 - RNA, 20 nt, Mycobacterium bovis subsp bovis AF2122/97
ucgaugucgagguagugguc

SEQ ID NO: 1173610 - RNA, 14 nt, Mycobacterium bovis subsp bovis AF2122/97
ucgauugucgccgc

SEQ ID NO: 1173611 - RNA, 15 nt, Mycobacterium bovis subsp bovis AF2122/97
ucgauuguggccagc

SEQ ID NO: 1173612 - RNA, 20 nt, Mycobacterium bovis subsp bovis AF2122/97
ucgauugaugcgugguuggc

SEQ ID NO: 1173613 - RNA, 15 nt, Mycobacterium bovis subsp bovis AF2122/97
ucgauuggcugcgcc

SEQ ID NO: 1173614 - RNA, 16 nt, Mycobacterium bovis subsp bovis AF2122/97
ucgcaccgugggcccu

SEQ ID NO: 1173615 - RNA, 23 nt, Mycobacterium bovis subsp bovis AF2122/97
ucgcaacgauuuuagcggcugcc

SEQ ID NO: 1173616 - RNA, 14 nt, Mycobacterium bovis subsp bovis AF2122/97
ucgcaaucagcugg

SEQ ID NO: 1173617 - RNA, 12 nt, Mycobacterium bovis subsp bovis AF2122/97
ucgcaaugaccu

SEQ ID NO: 1173618 - RNA, 16 nt, Mycobacterium bovis subsp bovis AF2122/97
ucgcaaccgccgccau

SEQ ID NO: 1173619 - RNA, 13 nt, Mycobacterium bovis subsp bovis AF2122/97
ucgcaaaagcccc

SEQ ID NO: 1173620 - RNA, 22 nt, Mycobacterium bovis subsp bovis AF2122/97
ucgcaaacagauucggugccag

SEQ ID NO: 1173621 - RNA, 15 nt, Mycobacterium bovis subsp bovis AF2122/97
ucgcagccaggcacg

SEQ ID NO: 1173622 - RNA, 11 nt, Mycobacterium bovis subsp bovis AF2122/97
ucgcagcagca

SEQ ID NO: 1173623 - RNA, 13 nt, Mycobacterium bovis subsp bovis AF2122/97
ucgcagcaccaca

SEQ ID NO: 1173624 - RNA, 11 nt, Mycobacterium bovis subsp bovis AF2122/97
ucgcagcaugu

SEQ ID NO: 1173625 - RNA, 17 nt, Mycobacterium bovis subsp bovis AF2122/97
ucgcacgggccaccagc

SEQ ID NO: 1173626 - RNA, 18 nt, Mycobacterium bovis subsp bovis AF2122/97
ucgcacgggccaccagcg

SEQ ID NO: 1173627 - RNA, 19 nt, Mycobacterium bovis subsp bovis AF2122/97
ucgcacucguugccgacca

SEQ ID NO: 1173628 - RNA, 20 nt, Mycobacterium bovis subsp bovis AF2122/97
ucgcaggauucccaguccag

SEQ ID NO: 1173629 - RNA, 22 nt, Mycobacterium bovis subsp bovis AF2122/97
ucgcagcgccauuccaagacgu

SEQ ID NO: 1173630 - RNA, 21 nt, Mycobacterium bovis subsp bovis AF2122/97
ucgcagggaucaccccggccg

SEQ ID NO: 1173631 - RNA, 18 nt, Mycobacterium bovis subsp bovis AF2122/97
ucgcaggccagggucagc

SEQ ID NO: 1173632 - RNA, 18 nt, Mycobacterium bovis subsp bovis AF2122/97
ucgcauagugcggcugca

SEQ ID NO: 1173633 - RNA, 21 nt, Mycobacterium bovis subsp bovis AF2122/97
ucgcaguggagggcccggccg

SEQ ID NO: 1173634 - RNA, 22 nt, Mycobacterium bovis subsp bovis AF2122/97
uccucuugcaccagggccucga

SEQ ID NO: 1173635 - RNA, 14 nt, Mycobacterium bovis subsp bovis AF2122/97
uccugaaaacaccg

SEQ ID NO: 1173636 - RNA, 21 nt, Mycobacterium bovis subsp bovis AF2122/97
uccugaaucgguucggccaga

SEQ ID NO: 1173637 - RNA, 14 nt, Mycobacterium bovis subsp bovis AF2122/97
uccucgacacccau

SEQ ID NO: 1173638 - RNA, 16 nt, Mycobacterium bovis subsp bovis AF2122/97
uccucgagguccucgu

SEQ ID NO: 1173639 - RNA, 22 nt, Mycobacterium bovis subsp bovis AF2122/97
uccucgagugccgccgucgcca

SEQ ID NO: 1173640 - RNA, 17 nt, Mycobacterium bovis subsp bovis AF2122/97
uccucgauagcggcgcc

SEQ ID NO: 1173641 - RNA, 22 nt, Mycobacterium bovis subsp bovis AF2122/97
uccucgcgguaguugucccgcc

SEQ ID NO: 1173642 - RNA, 20 nt, Mycobacterium bovis subsp bovis AF2122/97
uccucggacugaagagcaau

SEQ ID NO: 1173643 - RNA, 18 nt, Mycobacterium bovis subsp bovis AF2122/97
uccucgcccgcaccagcu

SEQ ID NO: 1173644 - RNA, 17 nt, Mycobacterium bovis subsp bovis AF2122/97
uccucgaugcgggcgcc

SEQ ID NO: 1173645 - RNA, 20 nt, Mycobacterium bovis subsp bovis AF2122/97
uccucgggcaggcggccagc

SEQ ID NO: 1173646 - RNA, 19 nt, Mycobacterium bovis subsp bovis AF2122/97
uccucggcgguaaaugccu

SEQ ID NO: 1173647 - RNA, 15 nt, Mycobacterium bovis subsp bovis AF2122/97
uccucggcaggaagg

SEQ ID NO: 1173648 - RNA, 21 nt, Mycobacterium bovis subsp bovis AF2122/97
uccucgucgaggucagcuccc

SEQ ID NO: 1173649 - RNA, 13 nt, Mycobacterium bovis subsp bovis AF2122/97
uccucgugcagca

SEQ ID NO: 1173650 - RNA, 20 nt, Mycobacterium bovis subsp bovis AF2122/97
uccucguagacgaaacggcc

SEQ ID NO: 1173651 - RNA, 18 nt, Mycobacterium bovis subsp bovis AF2122/97
uccucccauucccaacac

SEQ ID NO: 1173652 - RNA, 16 nt, Mycobacterium bovis subsp bovis AF2122/97
uccucccaucccaugu

SEQ ID NO: 1173653 - RNA, 20 nt, Mycobacterium bovis subsp bovis AF2122/97
uccuccagagacagcgccau

SEQ ID NO: 1173654 - RNA, 17 nt, Mycobacterium bovis subsp bovis AF2122/97
uccuccggaaagcucuc

SEQ ID NO: 1173655 - RNA, 15 nt, Mycobacterium bovis subsp bovis AF2122/97
uccuccugcgccgca

SEQ ID NO: 1173656 - RNA, 21 nt, Mycobacterium bovis subsp bovis AF2122/97
uccucagccaccgcggucagc

SEQ ID NO: 1173657 - RNA, 19 nt, Mycobacterium bovis subsp bovis AF2122/97
uccugggauccggcggcag

SEQ ID NO: 1173658 - RNA, 14 nt, Mycobacterium bovis subsp bovis AF2122/97
uccuggguugugcc

SEQ ID NO: 1173659 - RNA, 17 nt, Mycobacterium bovis subsp bovis AF2122/97
uccugguaggugucgug

SEQ ID NO: 1173660 - RNA, 13 nt, Mycobacterium bovis subsp bovis AF2122/97
uccuggucgccgu

SEQ ID NO: 1173661 - RNA, 16 nt, Mycobacterium bovis subsp bovis AF2122/97
uccuggucgagcacgc

SEQ ID NO: 1173662 - RNA, 17 nt, Mycobacterium bovis subsp bovis AF2122/97
uccugugcggagccgcc

SEQ ID NO: 1173663 - RNA, 18 nt, Mycobacterium bovis subsp bovis AF2122/97
uccugugcggagccgcca

SEQ ID NO: 1173664 - RNA, 15 nt, Mycobacterium bovis subsp bovis AF2122/97
uccuucagccagucc

SEQ ID NO: 1173665 - RNA, 13 nt, Mycobacterium bovis subsp bovis AF2122/97
uccugcagcuggc

SEQ ID NO: 1173666 - RNA, 16 nt, Mycobacterium bovis subsp bovis AF2122/97
uccugcaggaucaaaa

SEQ ID NO: 1173667 - RNA, 19 nt, Mycobacterium bovis subsp bovis AF2122/97
uccugcaggaucaaaaccu

SEQ ID NO: 1173668 - RNA, 17 nt, Mycobacterium bovis subsp bovis AF2122/97
uccugcagcucgggcag

SEQ ID NO: 1173669 - RNA, 19 nt, Mycobacterium bovis subsp bovis AF2122/97
uccugcacacaggacuugu

SEQ ID NO: 1173670 - RNA, 17 nt, Mycobacterium bovis subsp bovis AF2122/97
uccugccagaagaccug

SEQ ID NO: 1173671 - RNA, 20 nt, Mycobacterium bovis subsp bovis AF2122/97
uccugcgccgguaacugucc

SEQ ID NO: 1173672 - RNA, 14 nt, Mycobacterium bovis subsp bovis AF2122/97
uccugcgcugcacc

SEQ ID NO: 1173673 - RNA, 17 nt, Mycobacterium bovis subsp bovis AF2122/97
uccugcggcaccgcuga

SEQ ID NO: 1173674 - RNA, 20 nt, Mycobacterium bovis subsp bovis AF2122/97
uccuggcccgauaaaugccg

SEQ ID NO: 1173675 - RNA, 22 nt, Mycobacterium bovis subsp bovis AF2122/97
uccuggccgccgccccggcgcu

SEQ ID NO: 1173676 - RNA, 17 nt, Mycobacterium bovis subsp bovis AF2122/97
uccuggccacucccagc

SEQ ID NO: 1173677 - RNA, 18 nt, Mycobacterium bovis subsp bovis AF2122/97
uccuggccacucccagcc

SEQ ID NO: 1173678 - RNA, 20 nt, Mycobacterium bovis subsp bovis AF2122/97
uccuggaaaggacggccggc

SEQ ID NO: 1173679 - RNA, 14 nt, Mycobacterium bovis subsp bovis AF2122/97
uccuacggugcagu

SEQ ID NO: 1173680 - RNA, 15 nt, Mycobacterium bovis subsp bovis AF2122/97
uccgugccagcugcc

SEQ ID NO: 1173681 - RNA, 23 nt, Mycobacterium bovis subsp bovis AF2122/97
uccgugaauggcagcacgaccug

SEQ ID NO: 1173682 - RNA, 20 nt, Mycobacterium bovis subsp bovis AF2122/97
uccgugagccggaccggcuu

SEQ ID NO: 1173683 - RNA, 19 nt, Mycobacterium bovis subsp bovis AF2122/97
uccgucggggacauccgcu

SEQ ID NO: 1173684 - RNA, 13 nt, Mycobacterium bovis subsp bovis AF2122/97
uccgucgccgaac

SEQ ID NO: 1173685 - RNA, 13 nt, Mycobacterium bovis subsp bovis AF2122/97
uccgucgcggccg

SEQ ID NO: 1173686 - RNA, 14 nt, Mycobacterium bovis subsp bovis AF2122/97
uccgucggccaggc

SEQ ID NO: 1173687 - RNA, 16 nt, Mycobacterium bovis subsp bovis AF2122/97
uccggugaucaccgac

SEQ ID NO: 1173688 - RNA, 14 nt, Mycobacterium bovis subsp bovis AF2122/97
uccgguggaccgcc

SEQ ID NO: 1173689 - RNA, 20 nt, Mycobacterium bovis subsp bovis AF2122/97
uccgguggccaacaccgcca

SEQ ID NO: 1173690 - RNA, 20 nt, Mycobacterium bovis subsp bovis AF2122/97
uccggugcgaucccacccuc

SEQ ID NO: 1173691 - RNA, 21 nt, Mycobacterium bovis subsp bovis AF2122/97
uccggugcgccgaucccgccc

SEQ ID NO: 1173692 - RNA, 21 nt, Mycobacterium bovis subsp bovis AF2122/97
uccgguguaggccugcccccg

SEQ ID NO: 1173693 - RNA, 16 nt, Mycobacterium bovis subsp bovis AF2122/97
uccggucggccaggcc

SEQ ID NO: 1173694 - RNA, 16 nt, Mycobacterium bovis subsp bovis AF2122/97
uccgguucaucggcau

SEQ ID NO: 1173695 - RNA, 12 nt, Mycobacterium bovis subsp bovis AF2122/97
uccgguguugag

SEQ ID NO: 1173696 - RNA, 16 nt, Mycobacterium bovis subsp bovis AF2122/97
uccguacuugccaccc

SEQ ID NO: 1173697 - RNA, 16 nt, Mycobacterium bovis subsp bovis AF2122/97
uccguaggccacagcc

SEQ ID NO: 1173698 - RNA, 17 nt, Mycobacterium bovis subsp bovis AF2122/97
uccguaggccacagccc

SEQ ID NO: 1173699 - RNA, 14 nt, Mycobacterium bovis subsp bovis AF2122/97
uccggcggcagcgg

SEQ ID NO: 1173700 - RNA, 21 nt, Mycobacterium bovis subsp bovis AF2122/97
uccggcggacccucgccgaag

SEQ ID NO: 1173701 - RNA, 17 nt, Mycobacterium bovis subsp bovis AF2122/97
uccggccgaugcgaccc

SEQ ID NO: 1173702 - RNA, 19 nt, Mycobacterium bovis subsp bovis AF2122/97
uccggccgguccgggaagu

SEQ ID NO: 1173703 - RNA, 15 nt, Mycobacterium bovis subsp bovis AF2122/97
uccggcgccauucgc

SEQ ID NO: 1173704 - RNA, 22 nt, Mycobacterium bovis subsp bovis AF2122/97
uccggcuggugggacgcggccg

SEQ ID NO: 1173705 - RNA, 23 nt, Mycobacterium bovis subsp bovis AF2122/97
uccggcuucggcgaacccuccgc

SEQ ID NO: 1173706 - RNA, 16 nt, Mycobacterium bovis subsp bovis AF2122/97
uccggcuucguccacc

SEQ ID NO: 1173707 - RNA, 17 nt, Mycobacterium bovis subsp bovis AF2122/97
uccggcuggaagcggcg

SEQ ID NO: 1173708 - RNA, 23 nt, Mycobacterium bovis subsp bovis AF2122/97
uccggcuggaagcggcgacuacc

SEQ ID NO: 1173709 - RNA, 22 nt, Mycobacterium bovis subsp bovis AF2122/97
uccggcggugccgucgccgccc

SEQ ID NO: 1173710 - RNA, 14 nt, Mycobacterium bovis subsp bovis AF2122/97
uccggcggcaggaa

SEQ ID NO: 1173711 - RNA, 17 nt, Mycobacterium bovis subsp bovis AF2122/97
uccggcggccacgccgg

SEQ ID NO: 1173712 - RNA, 19 nt, Mycobacterium bovis subsp bovis AF2122/97
uccggcgugcagcaccccc

SEQ ID NO: 1173713 - RNA, 13 nt, Mycobacterium bovis subsp bovis AF2122/97
uccgguccagcgg

SEQ ID NO: 1173714 - RNA, 21 nt, Mycobacterium bovis subsp bovis AF2122/97
uccggucccgccgugccgcgg

SEQ ID NO: 1173715 - RNA, 17 nt, Mycobacterium bovis subsp bovis AF2122/97
uccggucgccucaccgg

SEQ ID NO: 1173716 - RNA, 17 nt, Mycobacterium bovis subsp bovis AF2122/97
uccgguagcuguggugg

SEQ ID NO: 1173717 - RNA, 17 nt, Mycobacterium bovis subsp bovis AF2122/97
uccggucaacacccgcc

SEQ ID NO: 1173718 - RNA, 14 nt, Mycobacterium bovis subsp bovis AF2122/97
uccggguccaggaa

SEQ ID NO: 1173719 - RNA, 20 nt, Mycobacterium bovis subsp bovis AF2122/97
uccggguagcggcgccgccc

SEQ ID NO: 1173720 - RNA, 14 nt, Mycobacterium bovis subsp bovis AF2122/97
uccggguagcggcg

SEQ ID NO: 1173721 - RNA, 12 nt, Mycobacterium bovis subsp bovis AF2122/97
uccgggugcaga

SEQ ID NO: 1173722 - RNA, 19 nt, Mycobacterium bovis subsp bovis AF2122/97
uccggggccgcggcccacu

SEQ ID NO: 1173723 - RNA, 17 nt, Mycobacterium bovis subsp bovis AF2122/97
uccggggggauccagca

SEQ ID NO: 1173724 - RNA, 20 nt, Mycobacterium bovis subsp bovis AF2122/97
uccgggccgagcgcaccacg

SEQ ID NO: 1173725 - RNA, 16 nt, Mycobacterium bovis subsp bovis AF2122/97
uccgggccccacggcg

SEQ ID NO: 1173726 - RNA, 19 nt, Mycobacterium bovis subsp bovis AF2122/97
uccggcacugcggccaguc

SEQ ID NO: 1173727 - RNA, 21 nt, Mycobacterium bovis subsp bovis AF2122/97
uccggcacugcggccagucag

SEQ ID NO: 1173728 - RNA, 17 nt, Mycobacterium bovis subsp bovis AF2122/97
uccggcaccggucuugg

SEQ ID NO: 1173729 - RNA, 21 nt, Mycobacterium bovis subsp bovis AF2122/97
uccggcaccaacgccaccguc

SEQ ID NO: 1173730 - RNA, 14 nt, Mycobacterium bovis subsp bovis AF2122/97
uccggcaccaacgc

SEQ ID NO: 1173731 - RNA, 19 nt, Mycobacterium bovis subsp bovis AF2122/97
uccggcaagcacaccgcca

SEQ ID NO: 1173732 - RNA, 23 nt, Mycobacterium bovis subsp bovis AF2122/97
uccggcaagcacaccgccagcgg

SEQ ID NO: 1173733 - RNA, 19 nt, Mycobacterium bovis subsp bovis AF2122/97
uccggcccguagcugcgca

SEQ ID NO: 1173734 - RNA, 23 nt, Mycobacterium bovis subsp bovis AF2122/97
uccggcccuacgcagcgcggcug

SEQ ID NO: 1173735 - RNA, 17 nt, Mycobacterium bovis subsp bovis AF2122/97
uccggccgggcccucca

SEQ ID NO: 1173736 - RNA, 15 nt, Mycobacterium bovis subsp bovis AF2122/97
uccggcccaccagcg

SEQ ID NO: 1173737 - RNA, 15 nt, Mycobacterium bovis subsp bovis AF2122/97
uccggccaguccaag

SEQ ID NO: 1173738 - RNA, 13 nt, Mycobacterium bovis subsp bovis AF2122/97
uccggccacacuc

SEQ ID NO: 1173739 - RNA, 22 nt, Mycobacterium bovis subsp bovis AF2122/97
uccggccacacucgccagggcc

SEQ ID NO: 1173740 - RNA, 23 nt, Mycobacterium bovis subsp bovis AF2122/97
uccggccagacccuggccguccc

SEQ ID NO: 1173741 - RNA, 18 nt, Mycobacterium bovis subsp bovis AF2122/97
uccggauugaagucgucg

SEQ ID NO: 1173742 - RNA, 17 nt, Mycobacterium bovis subsp bovis AF2122/97
uccggcaacagcaccag

SEQ ID NO: 1173743 - RNA, 15 nt, Mycobacterium bovis subsp bovis AF2122/97
uccggcaaccaccgg

SEQ ID NO: 1173744 - RNA, 20 nt, Mycobacterium bovis subsp bovis AF2122/97
uccggaucccaccaccgcuc

SEQ ID NO: 1173745 - RNA, 15 nt, Mycobacterium bovis subsp bovis AF2122/97
uccggaucgccgaau

SEQ ID NO: 1173746 - RNA, 19 nt, Mycobacterium bovis subsp bovis AF2122/97
uccggauaacccagcggcg

SEQ ID NO: 1173747 - RNA, 14 nt, Mycobacterium bovis subsp bovis AF2122/97
uccgcugacccgcc

SEQ ID NO: 1173748 - RNA, 21 nt, Mycobacterium bovis subsp bovis AF2122/97
uccgcugucgagccggugccg

SEQ ID NO: 1173749 - RNA, 20 nt, Mycobacterium bovis subsp bovis AF2122/97
uccgcugucgagccggugcc

SEQ ID NO: 1173750 - RNA, 15 nt, Mycobacterium bovis subsp bovis AF2122/97
uccgcugcaggucca

SEQ ID NO: 1173751 - RNA, 22 nt, Mycobacterium bovis subsp bovis AF2122/97
uccgcugccaucggcaccagcg

SEQ ID NO: 1173752 - RNA, 16 nt, Mycobacterium bovis subsp bovis AF2122/97
uccgcugcgccgaggc

SEQ ID NO: 1173753 - RNA, 15 nt, Mycobacterium bovis subsp bovis AF2122/97
uccgcugcggcccgu

SEQ ID NO: 1173754 - RNA, 21 nt, Mycobacterium bovis subsp bovis AF2122/97
uccggaaccgguaucgccaaa

SEQ ID NO: 1173755 - RNA, 16 nt, Mycobacterium bovis subsp bovis AF2122/97
uagucggcggugcaga

SEQ ID NO: 1173756 - RNA, 22 nt, Mycobacterium bovis subsp bovis AF2122/97
uagucggccgaugaaggccggc

SEQ ID NO: 1173757 - RNA, 17 nt, Mycobacterium bovis subsp bovis AF2122/97
uagucggccuccucguc

SEQ ID NO: 1173758 - RNA, 16 nt, Mycobacterium bovis subsp bovis AF2122/97
uagucgccggucaggc

SEQ ID NO: 1173759 - RNA, 15 nt, Mycobacterium bovis subsp bovis AF2122/97
uagucgauuggcugc

SEQ ID NO: 1173760 - RNA, 18 nt, Mycobacterium bovis subsp bovis AF2122/97
uagucgaauggcaacaca

SEQ ID NO: 1173761 - RNA, 19 nt, Mycobacterium bovis subsp bovis AF2122/97
uagucucgacaaagcggcu

SEQ ID NO: 1173762 - RNA, 23 nt, Mycobacterium bovis subsp bovis AF2122/97
uagucucgacaaagcggcugccc

SEQ ID NO: 1173763 - RNA, 18 nt, Mycobacterium bovis subsp bovis AF2122/97
uagugacugguauuuccc

SEQ ID NO: 1173764 - RNA, 12 nt, Mycobacterium bovis subsp bovis AF2122/97
uagucagaaccg

SEQ ID NO: 1173765 - RNA, 13 nt, Mycobacterium bovis subsp bovis AF2122/97
uaggugggcucgu

SEQ ID NO: 1173766 - RNA, 23 nt, Mycobacterium bovis subsp bovis AF2122/97
uaggugcucgcgaucugcucgua

SEQ ID NO: 1173767 - RNA, 21 nt, Mycobacterium bovis subsp bovis AF2122/97
uacuuucacgcucguuugcga

SEQ ID NO: 1173768 - RNA, 19 nt, Mycobacterium bovis subsp bovis AF2122/97
uaucccgaaucucacccac

SEQ ID NO: 1173769 - RNA, 20 nt, Mycobacterium bovis subsp bovis AF2122/97
uauccgugaauggcagcacg

SEQ ID NO: 1173770 - RNA, 20 nt, Mycobacterium bovis subsp bovis AF2122/97
uaucggcaaucaggucgucg

SEQ ID NO: 1173771 - RNA, 21 nt, Mycobacterium bovis subsp bovis AF2122/97
uaucggugcuggucgccgcgg

SEQ ID NO: 1173772 - RNA, 13 nt, Mycobacterium bovis subsp bovis AF2122/97
uaucgccgggaac

SEQ ID NO: 1173773 - RNA, 16 nt, Mycobacterium bovis subsp bovis AF2122/97
uaucgacaccaccauu

SEQ ID NO: 1173774 - RNA, 20 nt, Mycobacterium bovis subsp bovis AF2122/97
uaucgcagcguuggccgcug

SEQ ID NO: 1173775 - RNA, 13 nt, Mycobacterium bovis subsp bovis AF2122/97
uaucacccggaga

SEQ ID NO: 1173776 - RNA, 14 nt, Mycobacterium bovis subsp bovis AF2122/97
uauauggugcgcca

SEQ ID NO: 1173777 - RNA, 24 nt, Mycobacterium bovis subsp bovis AF2122/97
uaucuauggaugaccgaaccuggu

SEQ ID NO: 1173778 - RNA, 19 nt, Mycobacterium bovis subsp bovis AF2122/97
uaucuguugacucugcguc

SEQ ID NO: 1173779 - RNA, 13 nt, Mycobacterium bovis subsp bovis AF2122/97
uaugcuggcagcu

SEQ ID NO: 1173780 - RNA, 22 nt, Mycobacterium bovis subsp bovis AF2122/97
uauggcccgggccgaagcgcgc

SEQ ID NO: 1173781 - RNA, 12 nt, Mycobacterium bovis subsp bovis AF2122/97
uaugccacaggc

SEQ ID NO: 1173782 - RNA, 14 nt, Mycobacterium bovis subsp bovis AF2122/97
uauucguuggcgaa

SEQ ID NO: 1173783 - RNA, 13 nt, Mycobacterium bovis subsp bovis AF2122/97
uauuggacugcag

SEQ ID NO: 1173784 - RNA, 16 nt, Mycobacterium bovis subsp bovis AF2122/97
uauugggguggcagcu

SEQ ID NO: 1173785 - RNA, 18 nt, Mycobacterium bovis subsp bovis AF2122/97
uauugaacccguguucug

SEQ ID NO: 1173786 - RNA, 19 nt, Mycobacterium bovis subsp bovis AF2122/97
uauguucggcgguguccua

SEQ ID NO: 1173787 - RNA, 14 nt, Mycobacterium bovis subsp bovis AF2122/97
ucagcgccagcgcc

SEQ ID NO: 1173788 - RNA, 16 nt, Mycobacterium bovis subsp bovis AF2122/97
ucagccgaccgaccug

SEQ ID NO: 1173789 - RNA, 15 nt, Mycobacterium bovis subsp bovis AF2122/97
ucagcccggcgcgcc

SEQ ID NO: 1173790 - RNA, 16 nt, Mycobacterium bovis subsp bovis AF2122/97
ucagcgaugcggcccu

SEQ ID NO: 1173791 - RNA, 21 nt, Mycobacterium bovis subsp bovis AF2122/97
ucagcgcacuggccgcuaucc

SEQ ID NO: 1173792 - RNA, 16 nt, Mycobacterium bovis subsp bovis AF2122/97
ucagcccgccggaccc

SEQ ID NO: 1173793 - RNA, 13 nt, Mycobacterium bovis subsp bovis AF2122/97
ucagcccgcgcag

SEQ ID NO: 1173794 - RNA, 14 nt, Mycobacterium bovis subsp bovis AF2122/97
ucagccacgcagca

SEQ ID NO: 1173795 - RNA, 19 nt, Mycobacterium bovis subsp bovis AF2122/97
ucagccacgcagcacggca

SEQ ID NO: 1173796 - RNA, 14 nt, Mycobacterium bovis subsp bovis AF2122/97
ucagccaccgguga

SEQ ID NO: 1173797 - RNA, 14 nt, Mycobacterium bovis subsp bovis AF2122/97
ucagccccagugug

SEQ ID NO: 1173798 - RNA, 16 nt, Mycobacterium bovis subsp bovis AF2122/97
ucagccccaugaucug

SEQ ID NO: 1173799 - RNA, 19 nt, Mycobacterium bovis subsp bovis AF2122/97
ucagccaccaucuggaugg

SEQ ID NO: 1173800 - RNA, 22 nt, Mycobacterium bovis subsp bovis AF2122/97
ucagcucgucggcgauggccag

SEQ ID NO: 1173801 - RNA, 15 nt, Mycobacterium bovis subsp bovis AF2122/97
ucagcucggcagcau

SEQ ID NO: 1173802 - RNA, 15 nt, Mycobacterium bovis subsp bovis AF2122/97
ucagcucgcuugcau

SEQ ID NO: 1173803 - RNA, 18 nt, Mycobacterium bovis subsp bovis AF2122/97
ucagcgucggcgcaucac

SEQ ID NO: 1173804 - RNA, 21 nt, Mycobacterium bovis subsp bovis AF2122/97
ucagcgucaggccuccaaaau

SEQ ID NO: 1173805 - RNA, 23 nt, Mycobacterium bovis subsp bovis AF2122/97
ucagcguauuggacgcugccgca

SEQ ID NO: 1173806 - RNA, 20 nt, Mycobacterium bovis subsp bovis AF2122/97
ucagcguauuggacgcugcc

SEQ ID NO: 1173807 - RNA, 15 nt, Mycobacterium bovis subsp bovis AF2122/97
ucagcggccaaccca

SEQ ID NO: 1173808 - RNA, 16 nt, Mycobacterium bovis subsp bovis AF2122/97
ucagcggccagcagug

SEQ ID NO: 1173809 - RNA, 17 nt, Mycobacterium bovis subsp bovis AF2122/97
ucagcggccagcagugc

SEQ ID NO: 1173810 - RNA, 21 nt, Mycobacterium bovis subsp bovis AF2122/97
ucagcggcggguagauccgcc

SEQ ID NO: 1173811 - RNA, 17 nt, Mycobacterium bovis subsp bovis AF2122/97
ucagcaugguccacagc

SEQ ID NO: 1173812 - RNA, 18 nt, Mycobacterium bovis subsp bovis AF2122/97
ucagcaugguccacagcc

SEQ ID NO: 1173813 - RNA, 18 nt, Mycobacterium bovis subsp bovis AF2122/97
ucagcauucaccaaaccg

SEQ ID NO: 1173814 - RNA, 21 nt, Mycobacterium bovis subsp bovis AF2122/97
ucagcaggcccuucaguucga

SEQ ID NO: 1173815 - RNA, 18 nt, Mycobacterium bovis subsp bovis AF2122/97
ucagcaggaucggcagca

SEQ ID NO: 1173816 - RNA, 12 nt, Mycobacterium bovis subsp bovis AF2122/97
ucagcagcucca

SEQ ID NO: 1173817 - RNA, 23 nt, Mycobacterium bovis subsp bovis AF2122/97
ucagcagugggaugaagaacgcg

SEQ ID NO: 1173818 - RNA, 14 nt, Mycobacterium bovis subsp bovis AF2122/97
ucagcaggcccagc

SEQ ID NO: 1173819 - RNA, 15 nt, Mycobacterium bovis subsp bovis AF2122/97
ucagcacgcugacca

SEQ ID NO: 1173820 - RNA, 17 nt, Mycobacterium bovis subsp bovis AF2122/97
ucagcacgccgggugcc

SEQ ID NO: 1173821 - RNA, 17 nt, Mycobacterium bovis subsp bovis AF2122/97
ucagcacggugggcgcu

SEQ ID NO: 1173822 - RNA, 20 nt, Mycobacterium bovis subsp bovis AF2122/97
ucagcagaauccugcgcugc

SEQ ID NO: 1173823 - RNA, 22 nt, Mycobacterium bovis subsp bovis AF2122/97
ucagcaccgcuacgaccaauag

SEQ ID NO: 1173824 - RNA, 16 nt, Mycobacterium bovis subsp bovis AF2122/97
ucagcaccaccagcag

SEQ ID NO: 1173825 - RNA, 20 nt, Mycobacterium bovis subsp bovis AF2122/97
ucagcaagaucggcagcgug

SEQ ID NO: 1173826 - RNA, 14 nt, Mycobacterium bovis subsp bovis AF2122/97
ucaggccccgggaa

SEQ ID NO: 1173827 - RNA, 21 nt, Mycobacterium bovis subsp bovis AF2122/97
ucaggcccugccgacgcucca

SEQ ID NO: 1173828 - RNA, 17 nt, Mycobacterium bovis subsp bovis AF2122/97
ucaggccgucgccggag

SEQ ID NO: 1173829 - RNA, 14 nt, Mycobacterium bovis subsp bovis AF2122/97
ucaggacaugcagg

SEQ ID NO: 1173830 - RNA, 14 nt, Mycobacterium bovis subsp bovis AF2122/97
ucaggccagcgcuc

SEQ ID NO: 1173831 - RNA, 18 nt, Mycobacterium bovis subsp bovis AF2122/97
ucaggcccauggcagccc

SEQ ID NO: 1173832 - RNA, 13 nt, Mycobacterium bovis subsp bovis AF2122/97
ucaggccagggug

SEQ ID NO: 1173833 - RNA, 16 nt, Mycobacterium bovis subsp bovis AF2122/97
ucagugccaaagcggc

SEQ ID NO: 1173834 - RNA, 19 nt, Mycobacterium bovis subsp bovis AF2122/97
ucagugccaaagcggcaug

SEQ ID NO: 1173835 - RNA, 16 nt, Mycobacterium bovis subsp bovis AF2122/97
ucagugaucaccaacc

SEQ ID NO: 1173836 - RNA, 18 nt, Mycobacterium bovis subsp bovis AF2122/97
ucagugaagacaccaggc

SEQ ID NO: 1173837 - RNA, 20 nt, Mycobacterium bovis subsp bovis AF2122/97
ucaguauucguaguccgguc

SEQ ID NO: 1173838 - RNA, 13 nt, Mycobacterium bovis subsp bovis AF2122/97
ucaggcgggagcg

SEQ ID NO: 1173839 - RNA, 23 nt, Mycobacterium bovis subsp bovis AF2122/97
ucaggcggcagguucgaggguga

SEQ ID NO: 1173840 - RNA, 14 nt, Mycobacterium bovis subsp bovis AF2122/97
ucagguccggggaa

SEQ ID NO: 1173841 - RNA, 19 nt, Mycobacterium bovis subsp bovis AF2122/97
ucagguccuggguguagca

SEQ ID NO: 1173842 - RNA, 15 nt, Mycobacterium bovis subsp bovis AF2122/97
ucaggucaccggccg

SEQ ID NO: 1173843 - RNA, 15 nt, Mycobacterium bovis subsp bovis AF2122/97
ucaguagccacgccc

SEQ ID NO: 1173844 - RNA, 22 nt, Mycobacterium bovis subsp bovis AF2122/97
ucaguagccacgcccacagggg

SEQ ID NO: 1173845 - RNA, 18 nt, Mycobacterium bovis subsp bovis AF2122/97
ucagacgcucgaccugcc

SEQ ID NO: 1173846 - RNA, 20 nt, Mycobacterium bovis subsp bovis AF2122/97
ucagacgcucgaccugccuu

SEQ ID NO: 1173847 - RNA, 18 nt, Mycobacterium bovis subsp bovis AF2122/97
ucagacggcgaguaggcg

SEQ ID NO: 1173848 - RNA, 22 nt, Mycobacterium bovis subsp bovis AF2122/97
ucagaaggaucagcgcacuggc

SEQ ID NO: 1173849 - RNA, 22 nt, Mycobacterium bovis subsp bovis AF2122/97
ucagaacuuguuugucaccgca

SEQ ID NO: 1173850 - RNA, 23 nt, Mycobacterium bovis subsp bovis AF2122/97
ucagaacuuguuugucaccgcag

SEQ ID NO: 1173851 - RNA, 13 nt, Mycobacterium bovis subsp bovis AF2122/97
ucagaacggcggc

SEQ ID NO: 1173852 - RNA, 17 nt, Mycobacterium bovis subsp bovis AF2122/97
ucagaacgugacggucc

SEQ ID NO: 1173853 - RNA, 22 nt, Mycobacterium bovis subsp bovis AF2122/97
ucagaaucaggcucgccgaugc

SEQ ID NO: 1173854 - RNA, 23 nt, Mycobacterium bovis subsp bovis AF2122/97
ucagaauugugugcagcagcauc

SEQ ID NO: 1173855 - RNA, 18 nt, Mycobacterium bovis subsp bovis AF2122/97
ucagaauugugugcagca

SEQ ID NO: 1173856 - RNA, 14 nt, Mycobacterium bovis subsp bovis AF2122/97
ucagacaacaacac

SEQ ID NO: 1173857 - RNA, 17 nt, Mycobacterium bovis subsp bovis AF2122/97
ucagaaugccuggcccg

SEQ ID NO: 1173858 - RNA, 13 nt, Mycobacterium bovis subsp bovis AF2122/97
ucagaaucugccu

SEQ ID NO: 1173859 - RNA, 14 nt, Mycobacterium bovis subsp bovis AF2122/97
ucagcaacagcagg

SEQ ID NO: 1173860 - RNA, 18 nt, Mycobacterium bovis subsp bovis AF2122/97
ucagcaacaacgucugca

SEQ ID NO: 1173861 - RNA, 21 nt, Mycobacterium bovis subsp bovis AF2122/97
ucagcaacaacgucugcagcc

SEQ ID NO: 1173862 - RNA, 17 nt, Mycobacterium bovis subsp bovis AF2122/97
ucagcaacucggccacg

SEQ ID NO: 1173863 - RNA, 17 nt, Mycobacterium bovis subsp bovis AF2122/97
ucagaacaccggccagg

SEQ ID NO: 1173864 - RNA, 14 nt, Mycobacterium bovis subsp bovis AF2122/97
ucacugcgagcgca

SEQ ID NO: 1173865 - RNA, 17 nt, Mycobacterium bovis subsp bovis AF2122/97
ucacgccgccggcgaag

SEQ ID NO: 1173866 - RNA, 13 nt, Mycobacterium bovis subsp bovis AF2122/97
ucacgcccaccac

SEQ ID NO: 1173867 - RNA, 20 nt, Mycobacterium bovis subsp bovis AF2122/97
ucacccggucaacgugaacu

SEQ ID NO: 1173868 - RNA, 21 nt, Mycobacterium bovis subsp bovis AF2122/97
ucacccgguguccagugcauu

SEQ ID NO: 1173869 - RNA, 18 nt, Mycobacterium bovis subsp bovis AF2122/97
ucacccgggcagccugcu

SEQ ID NO: 1173870 - RNA, 18 nt, Mycobacterium bovis subsp bovis AF2122/97
ucacccugucgcgcaccg

SEQ ID NO: 1173871 - RNA, 20 nt, Mycobacterium bovis subsp bovis AF2122/97
ucacccuguuugcccaacag

SEQ ID NO: 1173872 - RNA, 21 nt, Mycobacterium bovis subsp bovis AF2122/97
ucacccuguuugcccaacaga

SEQ ID NO: 1173873 - RNA, 19 nt, Mycobacterium bovis subsp bovis AF2122/97
ucacccugccagagaucag

SEQ ID NO: 1173874 - RNA, 16 nt, Mycobacterium bovis subsp bovis AF2122/97
ucacggcgcgagccug

SEQ ID NO: 1173875 - RNA, 13 nt, Mycobacterium bovis subsp bovis AF2122/97
ucacggcggggau

SEQ ID NO: 1173876 - RNA, 21 nt, Mycobacterium bovis subsp bovis AF2122/97
ucacggcaggcggugaacacc

SEQ ID NO: 1173877 - RNA, 12 nt, Mycobacterium bovis subsp bovis AF2122/97
ucaaagcggccu

SEQ ID NO: 1173878 - RNA, 16 nt, Mycobacterium bovis subsp bovis AF2122/97
ucaaccugcgcaucac

SEQ ID NO: 1173879 - RNA, 19 nt, Mycobacterium bovis subsp bovis AF2122/97
ucaacgacgacgacaagug

SEQ ID NO: 1173880 - RNA, 22 nt, Mycobacterium bovis subsp bovis AF2122/97
ucaacgacgacgacaagugccc

SEQ ID NO: 1173881 - RNA, 14 nt, Mycobacterium bovis subsp bovis AF2122/97
ucaacgacaccaga

SEQ ID NO: 1173882 - RNA, 16 nt, Mycobacterium bovis subsp bovis AF2122/97
ucaaccugcugcagaa

SEQ ID NO: 1173883 - RNA, 19 nt, Mycobacterium bovis subsp bovis AF2122/97
ucaacgcaucgguggcacg

SEQ ID NO: 1173884 - RNA, 18 nt, Mycobacterium bovis subsp bovis AF2122/97
ucaacgccucugcucagc

SEQ ID NO: 1173885 - RNA, 17 nt, Mycobacterium bovis subsp bovis AF2122/97
ucaacggcgacaucggc

SEQ ID NO: 1173886 - RNA, 23 nt, Mycobacterium bovis subsp bovis AF2122/97
ucaacucccgaacacuuugcgca

SEQ ID NO: 1173887 - RNA, 20 nt, Mycobacterium bovis subsp bovis AF2122/97
ucaacucgggcagcgcggcc

SEQ ID NO: 1173888 - RNA, 19 nt, Mycobacterium bovis subsp bovis AF2122/97
ucaacuucuuggugcccau

SEQ ID NO: 1173889 - RNA, 16 nt, Mycobacterium bovis subsp bovis AF2122/97
ucaacaccagcaagug

SEQ ID NO: 1173890 - RNA, 21 nt, Mycobacterium bovis subsp bovis AF2122/97
ucaacaccggcugguucaaca

SEQ ID NO: 1173891 - RNA, 12 nt, Mycobacterium bovis subsp bovis AF2122/97
ucaacagcaccg

SEQ ID NO: 1173892 - RNA, 15 nt, Mycobacterium bovis subsp bovis AF2122/97
ucaaccaagcgugcc

SEQ ID NO: 1173893 - RNA, 17 nt, Mycobacterium bovis subsp bovis AF2122/97
ucacaggccgccugggg

SEQ ID NO: 1173894 - RNA, 21 nt, Mycobacterium bovis subsp bovis AF2122/97
ucacaggcgacacauugguau

SEQ ID NO: 1173895 - RNA, 22 nt, Mycobacterium bovis subsp bovis AF2122/97
ucacagccggguuuggugcagc

SEQ ID NO: 1173896 - RNA, 16 nt, Mycobacterium bovis subsp bovis AF2122/97
ucacagcacagcgcag

SEQ ID NO: 1173897 - RNA, 12 nt, Mycobacterium bovis subsp bovis AF2122/97
ucacaaacccag

SEQ ID NO: 1173898 - RNA, 15 nt, Mycobacterium bovis subsp bovis AF2122/97
ucacaguucugccuu

SEQ ID NO: 1173899 - RNA, 15 nt, Mycobacterium bovis subsp bovis AF2122/97
ucacauacagcaggc

SEQ ID NO: 1173900 - RNA, 16 nt, Mycobacterium bovis subsp bovis AF2122/97
ucaccagcggucagcc

SEQ ID NO: 1173901 - RNA, 13 nt, Mycobacterium bovis subsp bovis AF2122/97
ucaccagcuccuc

SEQ ID NO: 1173902 - RNA, 22 nt, Mycobacterium bovis subsp bovis AF2122/97
ucaccacgccggucgaggugac

SEQ ID NO: 1173903 - RNA, 13 nt, Mycobacterium bovis subsp bovis AF2122/97
ucaccauccagcc

SEQ ID NO: 1173904 - RNA, 15 nt, Mycobacterium bovis subsp bovis AF2122/97
ucacauccacgcacu

SEQ ID NO: 1173905 - RNA, 18 nt, Mycobacterium bovis subsp bovis AF2122/97
ucacaugcccgcaccguc

SEQ ID NO: 1173906 - RNA, 15 nt, Mycobacterium bovis subsp bovis AF2122/97
ucacaugcgccgaaa

SEQ ID NO: 1173907 - RNA, 21 nt, Mycobacterium bovis subsp bovis AF2122/97
ucacaugcgccgaaacucaag

SEQ ID NO: 1173908 - RNA, 13 nt, Mycobacterium bovis subsp bovis AF2122/97
ucaccaccgaccc

SEQ ID NO: 1173909 - RNA, 16 nt, Mycobacterium bovis subsp bovis AF2122/97
ucaccaccgccagcga

SEQ ID NO: 1173910 - RNA, 11 nt, Mycobacterium bovis subsp bovis AF2122/97
ucaccaccgga

SEQ ID NO: 1173911 - RNA, 16 nt, Mycobacterium bovis subsp bovis AF2122/97
ucaauaguguguuugg

SEQ ID NO: 1173912 - RNA, 22 nt, Mycobacterium bovis subsp bovis AF2122/97
ucaauaauggcaaccagcuucu

SEQ ID NO: 1173913 - RNA, 16 nt, Mycobacterium bovis subsp bovis AF2122/97
ucaauuggaagacacg

SEQ ID NO: 1173914 - RNA, 19 nt, Mycobacterium bovis subsp bovis AF2122/97
ucaauuccaugcaguuguc

SEQ ID NO: 1173915 - RNA, 23 nt, Mycobacterium bovis subsp bovis AF2122/97
ucaauuccgcgaguagaucaucg

SEQ ID NO: 1173916 - RNA, 15 nt, Mycobacterium bovis subsp bovis AF2122/97
uaaagcucaccacau

SEQ ID NO: 1173917 - RNA, 19 nt, Mycobacterium bovis subsp bovis AF2122/97
uaaaccagccaccaccagg

SEQ ID NO: 1173918 - RNA, 16 nt, Mycobacterium bovis subsp bovis AF2122/97
uaaacagcgcgccggc

SEQ ID NO: 1173919 - RNA, 13 nt, Mycobacterium bovis subsp bovis AF2122/97
uaaacgcggcgcg

SEQ ID NO: 1173920 - RNA, 16 nt, Mycobacterium bovis subsp bovis AF2122/97
uaaccacgacgacgac

SEQ ID NO: 1173921 - RNA, 19 nt, Mycobacterium bovis subsp bovis AF2122/97
uaacccggcuccagcaccg

SEQ ID NO: 1173922 - RNA, 21 nt, Mycobacterium bovis subsp bovis AF2122/97
uaacccuggcggaacagcuuc

SEQ ID NO: 1173923 - RNA, 21 nt, Mycobacterium bovis subsp bovis AF2122/97
uaacgccaagcucggcccagc

SEQ ID NO: 1173924 - RNA, 14 nt, Mycobacterium bovis subsp bovis AF2122/97
uaacgcaggcagug

SEQ ID NO: 1173925 - RNA, 16 nt, Mycobacterium bovis subsp bovis AF2122/97
uaacggcggccauggc

SEQ ID NO: 1173926 - RNA, 21 nt, Mycobacterium bovis subsp bovis AF2122/97
uaaauggccgaugagcccagc

SEQ ID NO: 1173927 - RNA, 18 nt, Mycobacterium bovis subsp bovis AF2122/97
uaagcccccgcacgcacg

SEQ ID NO: 1173928 - RNA, 18 nt, Mycobacterium bovis subsp bovis AF2122/97
uaagcggauguccccgac

SEQ ID NO: 1173929 - RNA, 20 nt, Mycobacterium bovis subsp bovis AF2122/97
uaaggcacguucagccaggc

SEQ ID NO: 1173930 - RNA, 19 nt, Mycobacterium bovis subsp bovis AF2122/97
uaaggcugcagugccgcac

SEQ ID NO: 1173931 - RNA, 23 nt, Mycobacterium bovis subsp bovis AF2122/97
uaaggagccgggccguccgggua

SEQ ID NO: 1173932 - RNA, 15 nt, Mycobacterium bovis subsp bovis AF2122/97
uaagucuggagugag

SEQ ID NO: 1173933 - RNA, 15 nt, Mycobacterium bovis subsp bovis AF2122/97
uaagggacaccagcu

SEQ ID NO: 1173934 - RNA, 20 nt, Mycobacterium bovis subsp bovis AF2122/97
uaagguguggucggcugugg

SEQ ID NO: 1173935 - RNA, 22 nt, Mycobacterium bovis subsp bovis AF2122/97
aaauccgacguggaacugcagc

SEQ ID NO: 1173936 - RNA, 20 nt, Mycobacterium bovis subsp bovis AF2122/97
aaauccccucgcaaccggcg

SEQ ID NO: 1173937 - RNA, 21 nt, Mycobacterium bovis subsp bovis AF2122/97
uacaacacagaacucaccgac

SEQ ID NO: 1173938 - RNA, 18 nt, Mycobacterium bovis subsp bovis AF2122/97
uaauccagcgccgaccuc

SEQ ID NO: 1173939 - RNA, 12 nt, Mycobacterium bovis subsp bovis AF2122/97
uacaggugcagg

SEQ ID NO: 1173940 - RNA, 15 nt, Mycobacterium bovis subsp bovis AF2122/97
uacaggucgccgggg

SEQ ID NO: 1173941 - RNA, 18 nt, Mycobacterium bovis subsp bovis AF2122/97
uacaggucggcccacggu

SEQ ID NO: 1173942 - RNA, 22 nt, Mycobacterium bovis subsp bovis AF2122/97
uacagucgaccggacacuccug

SEQ ID NO: 1173943 - RNA, 19 nt, Mycobacterium bovis subsp bovis AF2122/97
uacaucgccuugcccagcg

SEQ ID NO: 1173944 - RNA, 15 nt, Mycobacterium bovis subsp bovis AF2122/97
uacaucgccuugccc

SEQ ID NO: 1173945 - RNA, 22 nt, Mycobacterium bovis subsp bovis AF2122/97
uaccagcuggccacuuucagau

SEQ ID NO: 1173946 - RNA, 15 nt, Mycobacterium bovis subsp bovis AF2122/97
uaccagcugggcgac

SEQ ID NO: 1173947 - RNA, 19 nt, Mycobacterium bovis subsp bovis AF2122/97
uaccagccgaagaaccggu

SEQ ID NO: 1173948 - RNA, 11 nt, Mycobacterium bovis subsp bovis AF2122/97
uaccagcaccg

SEQ ID NO: 1173949 - RNA, 15 nt, Mycobacterium bovis subsp bovis AF2122/97
uaccaccacguggcc

SEQ ID NO: 1173950 - RNA, 22 nt, Mycobacterium bovis subsp bovis AF2122/97
uaccacuuugcguucccauccc

SEQ ID NO: 1173951 - RNA, 19 nt, Mycobacterium bovis subsp bovis AF2122/97
uaccaaccugcgcggcgau

SEQ ID NO: 1173952 - RNA, 20 nt, Mycobacterium bovis subsp bovis AF2122/97
uaccaacaggauggugcggc

SEQ ID NO: 1173953 - RNA, 13 nt, Mycobacterium bovis subsp bovis AF2122/97
uaccccagcacaa

SEQ ID NO: 1173954 - RNA, 17 nt, Mycobacterium bovis subsp bovis AF2122/97
uaccccagccggcagca

SEQ ID NO: 1173955 - RNA, 15 nt, Mycobacterium bovis subsp bovis AF2122/97
uaccccagcgcuguc

SEQ ID NO: 1173956 - RNA, 16 nt, Mycobacterium bovis subsp bovis AF2122/97
uacccaucgccacacc

SEQ ID NO: 1173957 - RNA, 13 nt, Mycobacterium bovis subsp bovis AF2122/97
uacccaccagggu

SEQ ID NO: 1173958 - RNA, 12 nt, Mycobacterium bovis subsp bovis AF2122/97
uacccagcgccc

SEQ ID NO: 1173959 - RNA, 21 nt, Mycobacterium bovis subsp bovis AF2122/97
uaccaggucggaacuagccag

SEQ ID NO: 1173960 - RNA, 15 nt, Mycobacterium bovis subsp bovis AF2122/97
uaccaggcgcggccc

SEQ ID NO: 1173961 - RNA, 16 nt, Mycobacterium bovis subsp bovis AF2122/97
uacccgccucgggccg

SEQ ID NO: 1173962 - RNA, 16 nt, Mycobacterium bovis subsp bovis AF2122/97
uacccggaccgucgug

SEQ ID NO: 1173963 - RNA, 23 nt, Mycobacterium bovis subsp bovis AF2122/97
uaccccuccgaucacgcuguucc

SEQ ID NO: 1173964 - RNA, 15 nt, Mycobacterium bovis subsp bovis AF2122/97
uaccgaacagcaccu

SEQ ID NO: 1173965 - RNA, 11 nt, Mycobacterium bovis subsp bovis AF2122/97
uacccuuugca

SEQ ID NO: 1173966 - RNA, 14 nt, Mycobacterium bovis subsp bovis AF2122/97
uaccgaucagcagg

SEQ ID NO: 1173967 - RNA, 13 nt, Mycobacterium bovis subsp bovis AF2122/97
uaccgagcagcag

SEQ ID NO: 1173968 - RNA, 13 nt, Mycobacterium bovis subsp bovis AF2122/97
uaccgaacagugg

SEQ ID NO: 1173969 - RNA, 17 nt, Mycobacterium bovis subsp bovis AF2122/97
uaccgaaccgguguagc

SEQ ID NO: 1173970 - RNA, 14 nt, Mycobacterium bovis subsp bovis AF2122/97
uaccgacaccgugu

SEQ ID NO: 1173971 - RNA, 18 nt, Mycobacterium bovis subsp bovis AF2122/97
uaccgcuggaaaaucggg

SEQ ID NO: 1173972 - RNA, 18 nt, Mycobacterium bovis subsp bovis AF2122/97
uaccgcaauggcggccuu

SEQ ID NO: 1173973 - RNA, 17 nt, Mycobacterium bovis subsp bovis AF2122/97
uaccgcucagggugcgc

SEQ ID NO: 1173974 - RNA, 11 nt, Mycobacterium bovis subsp bovis AF2122/97
uacugcugcuu

SEQ ID NO: 1173975 - RNA, 18 nt, Mycobacterium bovis subsp bovis AF2122/97
uacuggcguugccaccgg

SEQ ID NO: 1173976 - RNA, 22 nt, Mycobacterium bovis subsp bovis AF2122/97
uacugucgucgcccugacacaa

SEQ ID NO: 1173977 - RNA, 14 nt, Mycobacterium bovis subsp bovis AF2122/97
uacucgugaugaau

SEQ ID NO: 1173978 - RNA, 18 nt, Mycobacterium bovis subsp bovis AF2122/97
uacucggcgacugcgucg

SEQ ID NO: 1173979 - RNA, 17 nt, Mycobacterium bovis subsp bovis AF2122/97
uacucgcggcgcggccg

SEQ ID NO: 1173980 - RNA, 22 nt, Mycobacterium bovis subsp bovis AF2122/97
uacucgcggcgcggccgcagcc

SEQ ID NO: 1173981 - RNA, 17 nt, Mycobacterium bovis subsp bovis AF2122/97
uacuaggccccuggccg

SEQ ID NO: 1173982 - RNA, 22 nt, Mycobacterium bovis subsp bovis AF2122/97
uacgcgaucagcgcgcacacgg

SEQ ID NO: 1173983 - RNA, 17 nt, Mycobacterium bovis subsp bovis AF2122/97
uacggcccggcacccgg

SEQ ID NO: 1173984 - RNA, 15 nt, Mycobacterium bovis subsp bovis AF2122/97
uacgcggcugcgucg

SEQ ID NO: 1173985 - RNA, 13 nt, Mycobacterium bovis subsp bovis AF2122/97
uacguacagggug

SEQ ID NO: 1173986 - RNA, 12 nt, Mycobacterium bovis subsp bovis AF2122/97
uacgggcaggcc

SEQ ID NO: 1173987 - RNA, 16 nt, Mycobacterium bovis subsp bovis AF2122/97
uacgucguccagcacc

SEQ ID NO: 1173988 - RNA, 20 nt, Mycobacterium bovis subsp bovis AF2122/97
uacgccccacugccgugccg

SEQ ID NO: 1173989 - RNA, 14 nt, Mycobacterium bovis subsp bovis AF2122/97
uacgccggccgcgc

SEQ ID NO: 1173990 - RNA, 16 nt, Mycobacterium bovis subsp bovis AF2122/97
uacgcaccgaggccgc

SEQ ID NO: 1173991 - RNA, 14 nt, Mycobacterium bovis subsp bovis AF2122/97
uacgaggcgggcag

SEQ ID NO: 1173992 - RNA, 16 nt, Mycobacterium bovis subsp bovis AF2122/97
uacgacuuggugcagc

SEQ ID NO: 1173993 - RNA, 11 nt, Mycobacterium bovis subsp bovis AF2122/97
uacgaccaaua

SEQ ID NO: 1173994 - RNA, 22 nt, Mycobacterium bovis subsp bovis AF2122/97
uacgacgucgcuguaggccagc

SEQ ID NO: 1173995 - RNA, 19 nt, Mycobacterium bovis subsp bovis AF2122/97
uaccguguaugcauccacu

SEQ ID NO: 1173996 - RNA, 23 nt, Mycobacterium bovis subsp bovis AF2122/97
uaccguucgggccguccucccac

SEQ ID NO: 1173997 - RNA, 12 nt, Mycobacterium bovis subsp bovis AF2122/97
uaccgcuggggc

SEQ ID NO: 1173998 - RNA, 15 nt, Mycobacterium bovis subsp bovis AF2122/97
guccaggcgcugcag

SEQ ID NO: 1173999 - RNA, 18 nt, Mycobacterium bovis subsp bovis AF2122/97
guccaggagugcgggcau

SEQ ID NO: 1174000 - RNA, 20 nt, Mycobacterium bovis subsp bovis AF2122/97
guccaggcacuccagcggcg

SEQ ID NO: 1174001 - RNA, 19 nt, Mycobacterium bovis subsp bovis AF2122/97
guccaggcacuccagcggc

SEQ ID NO: 1174002 - RNA, 16 nt, Mycobacterium bovis subsp bovis AF2122/97
guccaggcccuggcca

SEQ ID NO: 1174003 - RNA, 13 nt, Mycobacterium bovis subsp bovis AF2122/97
guccaggccggca

SEQ ID NO: 1174004 - RNA, 21 nt, Mycobacterium bovis subsp bovis AF2122/97
guccaggaucgcguggcgcac

SEQ ID NO: 1174005 - RNA, 17 nt, Mycobacterium bovis subsp bovis AF2122/97
guccagcuggccgggug

SEQ ID NO: 1174006 - RNA, 20 nt, Mycobacterium bovis subsp bovis AF2122/97
gucccacugcgcgucgagcg

SEQ ID NO: 1174007 - RNA, 15 nt, Mycobacterium bovis subsp bovis AF2122/97
gucccagagaaucag

SEQ ID NO: 1174008 - RNA, 19 nt, Mycobacterium bovis subsp bovis AF2122/97
gucccagcugaccagcguc

SEQ ID NO: 1174009 - RNA, 15 nt, Mycobacterium bovis subsp bovis AF2122/97
gucccagcugaccag

SEQ ID NO: 1174010 - RNA, 20 nt, Mycobacterium bovis subsp bovis AF2122/97
gucccagcgguagccgagcu

SEQ ID NO: 1174011 - RNA, 21 nt, Mycobacterium bovis subsp bovis AF2122/97
guccaucgcgcggcugugccc

SEQ ID NO: 1174012 - RNA, 12 nt, Mycobacterium bovis subsp bovis AF2122/97
guccagcccaga

SEQ ID NO: 1174013 - RNA, 14 nt, Mycobacterium bovis subsp bovis AF2122/97
guccagcccagcgc

SEQ ID NO: 1174014 - RNA, 17 nt, Mycobacterium bovis subsp bovis AF2122/97
guccagccgggugccgg

SEQ ID NO: 1174015 - RNA, 21 nt, Mycobacterium bovis subsp bovis AF2122/97
guccagccggugacguggugg

SEQ ID NO: 1174016 - RNA, 20 nt, Mycobacterium bovis subsp bovis AF2122/97
guccagccguggcggcgggc

SEQ ID NO: 1174017 - RNA, 20 nt, Mycobacterium bovis subsp bovis AF2122/97
guccagcgcgccacccagca

SEQ ID NO: 1174018 - RNA, 16 nt, Mycobacterium bovis subsp bovis AF2122/97
guccagcgaucccggu

SEQ ID NO: 1174019 - RNA, 20 nt, Mycobacterium bovis subsp bovis AF2122/97
guccagcgaggagcagggcu

SEQ ID NO: 1174020 - RNA, 20 nt, Mycobacterium bovis subsp bovis AF2122/97
guccacauccagggugccgg

SEQ ID NO: 1174021 - RNA, 21 nt, Mycobacterium bovis subsp bovis AF2122/97
guccaccacaccugcggcugc

SEQ ID NO: 1174022 - RNA, 18 nt, Mycobacterium bovis subsp bovis AF2122/97
guccaccagccgguuggc

SEQ ID NO: 1174023 - RNA, 14 nt, Mycobacterium bovis subsp bovis AF2122/97
guccaccccgccga

SEQ ID NO: 1174024 - RNA, 23 nt, Mycobacterium bovis subsp bovis AF2122/97
guccaccgacguggccagcccgc

SEQ ID NO: 1174025 - RNA, 14 nt, Mycobacterium bovis subsp bovis AF2122/97
guccacaccauggu

SEQ ID NO: 1174026 - RNA, 13 nt, Mycobacterium bovis subsp bovis AF2122/97
guccacagccggc

SEQ ID NO: 1174027 - RNA, 22 nt, Mycobacterium bovis subsp bovis AF2122/97
guccaagccggcugcauccucc

SEQ ID NO: 1174028 - RNA, 17 nt, Mycobacterium bovis subsp bovis AF2122/97
guccaaccgggccggcu

SEQ ID NO: 1174029 - RNA, 17 nt, Mycobacterium bovis subsp bovis AF2122/97
guccaauacucgccauc

SEQ ID NO: 1174030 - RNA, 20 nt, Mycobacterium bovis subsp bovis AF2122/97
gucaggucugacagaccggg

SEQ ID NO: 1174031 - RNA, 14 nt, Mycobacterium bovis subsp bovis AF2122/97
gucaggugauucgc

SEQ ID NO: 1174032 - RNA, 21 nt, Mycobacterium bovis subsp bovis AF2122/97
gucaggugauucgcgcagcgc

SEQ ID NO: 1174033 - RNA, 16 nt, Mycobacterium bovis subsp bovis AF2122/97
gucagguugucggcga

SEQ ID NO: 1174034 - RNA, 19 nt, Mycobacterium bovis subsp bovis AF2122/97
gucaggugcguuugcacug

SEQ ID NO: 1174035 - RNA, 21 nt, Mycobacterium bovis subsp bovis AF2122/97
gucaucccuuucgcgccgcga

SEQ ID NO: 1174036 - RNA, 16 nt, Mycobacterium bovis subsp bovis AF2122/97
gucauccgacaagcug

SEQ ID NO: 1174037 - RNA, 20 nt, Mycobacterium bovis subsp bovis AF2122/97
gucaucaugucgagguucca

SEQ ID NO: 1174038 - RNA, 15 nt, Mycobacterium bovis subsp bovis AF2122/97
gucauccuugagguc

SEQ ID NO: 1174039 - RNA, 21 nt, Mycobacterium bovis subsp bovis AF2122/97
gucaugggaucaggcugggca

SEQ ID NO: 1174040 - RNA, 22 nt, Mycobacterium bovis subsp bovis AF2122/97
gucaugggaucaggcugggcag

SEQ ID NO: 1174041 - RNA, 23 nt, Mycobacterium bovis subsp bovis AF2122/97
gucaugggcggcuucgaugucgu

SEQ ID NO: 1174042 - RNA, 13 nt, Mycobacterium bovis subsp bovis AF2122/97
gucaucuggaagu

SEQ ID NO: 1174043 - RNA, 15 nt, Mycobacterium bovis subsp bovis AF2122/97
gucaucuggcgcugc

SEQ ID NO: 1174044 - RNA, 17 nt, Mycobacterium bovis subsp bovis AF2122/97
gucaucggaucaaagcc

SEQ ID NO: 1174045 - RNA, 23 nt, Mycobacterium bovis subsp bovis AF2122/97
gucaucgcgggugaucuccaccg

SEQ ID NO: 1174046 - RNA, 13 nt, Mycobacterium bovis subsp bovis AF2122/97
gucauguccgucc

SEQ ID NO: 1174047 - RNA, 10 nt, Mycobacterium bovis subsp bovis AF2122/97
gucagccggu

SEQ ID NO: 1174048 - RNA, 20 nt, Mycobacterium bovis subsp bovis AF2122/97
gucagccgugccguggugaa

SEQ ID NO: 1174049 - RNA, 15 nt, Mycobacterium bovis subsp bovis AF2122/97
gucagccgcggcggc

SEQ ID NO: 1174050 - RNA, 17 nt, Mycobacterium bovis subsp bovis AF2122/97
gucagccugccagguac

SEQ ID NO: 1174051 - RNA, 15 nt, Mycobacterium bovis subsp bovis AF2122/97
gucaggccgccgcgg

SEQ ID NO: 1174052 - RNA, 16 nt, Mycobacterium bovis subsp bovis AF2122/97
gucaggccgccgcggc

SEQ ID NO: 1174053 - RNA, 21 nt, Mycobacterium bovis subsp bovis AF2122/97
gucaggcagcuccgccgccga

SEQ ID NO: 1174054 - RNA, 20 nt, Mycobacterium bovis subsp bovis AF2122/97
gucagcgcgccgucggguuc

SEQ ID NO: 1174055 - RNA, 13 nt, Mycobacterium bovis subsp bovis AF2122/97
gucagcgccgcgc

SEQ ID NO: 1174056 - RNA, 18 nt, Mycobacterium bovis subsp bovis AF2122/97
gucagguaauucguccac

SEQ ID NO: 1174057 - RNA, 15 nt, Mycobacterium bovis subsp bovis AF2122/97
gucaggcggccgucg

SEQ ID NO: 1174058 - RNA, 14 nt, Mycobacterium bovis subsp bovis AF2122/97
gucaggcggcggac

SEQ ID NO: 1174059 - RNA, 16 nt, Mycobacterium bovis subsp bovis AF2122/97
gucaggcguagguccu

SEQ ID NO: 1174060 - RNA, 12 nt, Mycobacterium bovis subsp bovis AF2122/97
gucaggccagcg

SEQ ID NO: 1174061 - RNA, 20 nt, Mycobacterium bovis subsp bovis AF2122/97
gucaggcucauccgccgggc

SEQ ID NO: 1174062 - RNA, 11 nt, Mycobacterium bovis subsp bovis AF2122/97
gucacugcccu

SEQ ID NO: 1174063 - RNA, 23 nt, Mycobacterium bovis subsp bovis AF2122/97
gucacugcccugauugaagcccc

SEQ ID NO: 1174064 - RNA, 16 nt, Mycobacterium bovis subsp bovis AF2122/97
gucagcagacugccga

SEQ ID NO: 1174065 - RNA, 13 nt, Mycobacterium bovis subsp bovis AF2122/97
gucagccaccuga

SEQ ID NO: 1174066 - RNA, 21 nt, Mycobacterium bovis subsp bovis AF2122/97
gucagccaccaucuggauggc

SEQ ID NO: 1174067 - RNA, 13 nt, Mycobacterium bovis subsp bovis AF2122/97
gucagcccagcca

SEQ ID NO: 1174068 - RNA, 12 nt, Mycobacterium bovis subsp bovis AF2122/97
gucacggugcgu

SEQ ID NO: 1174069 - RNA, 20 nt, Mycobacterium bovis subsp bovis AF2122/97
gucacggugcguucgugcug

SEQ ID NO: 1174070 - RNA, 20 nt, Mycobacterium bovis subsp bovis AF2122/97
gucacguggucggccacccc

SEQ ID NO: 1174071 - RNA, 18 nt, Mycobacterium bovis subsp bovis AF2122/97
gucaccggaggccgccgc

SEQ ID NO: 1174072 - RNA, 18 nt, Mycobacterium bovis subsp bovis AF2122/97
gucaccgacacggugcug

SEQ ID NO: 1174073 - RNA, 17 nt, Mycobacterium bovis subsp bovis AF2122/97
gucaccgcgcuggucag

SEQ ID NO: 1174074 - RNA, 19 nt, Mycobacterium bovis subsp bovis AF2122/97
gucacggaccgccaccuug

SEQ ID NO: 1174075 - RNA, 14 nt, Mycobacterium bovis subsp bovis AF2122/97
gucacggaccugga

SEQ ID NO: 1174076 - RNA, 13 nt, Mycobacterium bovis subsp bovis AF2122/97
gucacgcccgcga

SEQ ID NO: 1174077 - RNA, 17 nt, Mycobacterium bovis subsp bovis AF2122/97
gucaccgauucggccag

SEQ ID NO: 1174078 - RNA, 22 nt, Mycobacterium bovis subsp bovis AF2122/97
gucaccgauucggccagcgccc

SEQ ID NO: 1174079 - RNA, 18 nt, Mycobacterium bovis subsp bovis AF2122/97
gucaccgcaaccgagcug

SEQ ID NO: 1174080 - RNA, 16 nt, Mycobacterium bovis subsp bovis AF2122/97
gucaccccgcccagcg

SEQ ID NO: 1174081 - RNA, 20 nt, Mycobacterium bovis subsp bovis AF2122/97
gucaccccggcucggccacc

SEQ ID NO: 1174082 - RNA, 17 nt, Mycobacterium bovis subsp bovis AF2122/97
gucaccccuucgccagc

SEQ ID NO: 1174083 - RNA, 20 nt, Mycobacterium bovis subsp bovis AF2122/97
gucaccccuucgccagcgcc

SEQ ID NO: 1174084 - RNA, 16 nt, Mycobacterium bovis subsp bovis AF2122/97
gucaaucgcgucauca

SEQ ID NO: 1174085 - RNA, 17 nt, Mycobacterium bovis subsp bovis AF2122/97
gucaaugcgcuggcgcc

SEQ ID NO: 1174086 - RNA, 15 nt, Mycobacterium bovis subsp bovis AF2122/97
ggugaacgccugcgg

SEQ ID NO: 1174087 - RNA, 19 nt, Mycobacterium bovis subsp bovis AF2122/97
ggugaacccgauuggggug

SEQ ID NO: 1174088 - RNA, 21 nt, Mycobacterium bovis subsp bovis AF2122/97
ggugaacggcagcacggucug

SEQ ID NO: 1174089 - RNA, 19 nt, Mycobacterium bovis subsp bovis AF2122/97
ggugaacaccgccucugca

SEQ ID NO: 1174090 - RNA, 14 nt, Mycobacterium bovis subsp bovis AF2122/97
gucaacgugaacug

SEQ ID NO: 1174091 - RNA, 15 nt, Mycobacterium bovis subsp bovis AF2122/97
gucaacguggauguc

SEQ ID NO: 1174092 - RNA, 22 nt, Mycobacterium bovis subsp bovis AF2122/97
ggugaaguugccggucaggcag

SEQ ID NO: 1174093 - RNA, 16 nt, Mycobacterium bovis subsp bovis AF2122/97
ggugaagccgagcgcc

SEQ ID NO: 1174094 - RNA, 17 nt, Mycobacterium bovis subsp bovis AF2122/97
gucaagccgggcacggg

SEQ ID NO: 1174095 - RNA, 16 nt, Mycobacterium bovis subsp bovis AF2122/97
gucaagcaaguccacc

SEQ ID NO: 1174096 - RNA, 19 nt, Mycobacterium bovis subsp bovis AF2122/97
gucaaucgcaaugaccugc

SEQ ID NO: 1174097 - RNA, 23 nt, Mycobacterium bovis subsp bovis AF2122/97
gucaaucgcaaugaccugcagcg

SEQ ID NO: 1174098 - RNA, 20 nt, Mycobacterium bovis subsp bovis AF2122/97
guccggcccaccagcgcagc

SEQ ID NO: 1174099 - RNA, 19 nt, Mycobacterium bovis subsp bovis AF2122/97
guccggcacgcgucuggaa

SEQ ID NO: 1174100 - RNA, 12 nt, Mycobacterium bovis subsp bovis AF2122/97
guccggccacgg

SEQ ID NO: 1174101 - RNA, 19 nt, Mycobacterium bovis subsp bovis AF2122/97
guccggaaauuccggcgcg

SEQ ID NO: 1174102 - RNA, 13 nt, Mycobacterium bovis subsp bovis AF2122/97
guccggauggccc

SEQ ID NO: 1174103 - RNA, 17 nt, Mycobacterium bovis subsp bovis AF2122/97
guccggaugcgcaaccg

SEQ ID NO: 1174104 - RNA, 12 nt, Mycobacterium bovis subsp bovis AF2122/97
guccgcucgccg

SEQ ID NO: 1174105 - RNA, 16 nt, Mycobacterium bovis subsp bovis AF2122/97
guccgcugagcgggca

SEQ ID NO: 1174106 - RNA, 18 nt, Mycobacterium bovis subsp bovis AF2122/97
guccgcugguggucagca

SEQ ID NO: 1174107 - RNA, 22 nt, Mycobacterium bovis subsp bovis AF2122/97
guccgcggucgcagcagaccac

SEQ ID NO: 1174108 - RNA, 17 nt, Mycobacterium bovis subsp bovis AF2122/97
guccgcggaugcauguc

SEQ ID NO: 1174109 - RNA, 16 nt, Mycobacterium bovis subsp bovis AF2122/97
gucccaucgcgucggc

SEQ ID NO: 1174110 - RNA, 23 nt, Mycobacterium bovis subsp bovis AF2122/97
gucccaugcacggccgagcaggu

SEQ ID NO: 1174111 - RNA, 16 nt, Mycobacterium bovis subsp bovis AF2122/97
guccccgucgcuggcc

SEQ ID NO: 1174112 - RNA, 20 nt, Mycobacterium bovis subsp bovis AF2122/97
guccccgucgcuggccggca

SEQ ID NO: 1174113 - RNA, 21 nt, Mycobacterium bovis subsp bovis AF2122/97
guccccguugagauaccccga

SEQ ID NO: 1174114 - RNA, 15 nt, Mycobacterium bovis subsp bovis AF2122/97
gucccgcucuggucg

SEQ ID NO: 1174115 - RNA, 19 nt, Mycobacterium bovis subsp bovis AF2122/97
gucccgccgcaccgccgca

SEQ ID NO: 1174116 - RNA, 16 nt, Mycobacterium bovis subsp bovis AF2122/97
gucccgcgagcagccc

SEQ ID NO: 1174117 - RNA, 19 nt, Mycobacterium bovis subsp bovis AF2122/97
gucccgcgagcagcccggc

SEQ ID NO: 1174118 - RNA, 19 nt, Mycobacterium bovis subsp bovis AF2122/97
guccccucggugccacugc

SEQ ID NO: 1174119 - RNA, 15 nt, Mycobacterium bovis subsp bovis AF2122/97
guccccucggugcca

SEQ ID NO: 1174120 - RNA, 20 nt, Mycobacterium bovis subsp bovis AF2122/97
guccggccgggggaacggga

SEQ ID NO: 1174121 - RNA, 16 nt, Mycobacterium bovis subsp bovis AF2122/97
guccggcccguagcug

SEQ ID NO: 1174122 - RNA, 23 nt, Mycobacterium bovis subsp bovis AF2122/97
guccggcuuguccucacaugccc

SEQ ID NO: 1174123 - RNA, 18 nt, Mycobacterium bovis subsp bovis AF2122/97
guccggcuuaccggcggg

SEQ ID NO: 1174124 - RNA, 20 nt, Mycobacterium bovis subsp bovis AF2122/97
guccuauccgggccccugau

SEQ ID NO: 1174125 - RNA, 19 nt, Mycobacterium bovis subsp bovis AF2122/97
guccucacaugcccggacg

SEQ ID NO: 1174126 - RNA, 14 nt, Mycobacterium bovis subsp bovis AF2122/97
guccggggcgcagg

SEQ ID NO: 1174127 - RNA, 19 nt, Mycobacterium bovis subsp bovis AF2122/97
guccugccaaugcugcagg

SEQ ID NO: 1174128 - RNA, 19 nt, Mycobacterium bovis subsp bovis AF2122/97
guccugccaguccgcagcg

SEQ ID NO: 1174129 - RNA, 19 nt, Mycobacterium bovis subsp bovis AF2122/97
guccugcgagaggugcugc

SEQ ID NO: 1174130 - RNA, 12 nt, Mycobacterium bovis subsp bovis AF2122/97
guccuccgggcu

SEQ ID NO: 1174131 - RNA, 19 nt, Mycobacterium bovis subsp bovis AF2122/97
guccuccuucggugguggg

SEQ ID NO: 1174132 - RNA, 14 nt, Mycobacterium bovis subsp bovis AF2122/97
guccucaucgagcg

SEQ ID NO: 1174133 - RNA, 19 nt, Mycobacterium bovis subsp bovis AF2122/97
gucgacgggcacgcggcga

SEQ ID NO: 1174134 - RNA, 21 nt, Mycobacterium bovis subsp bovis AF2122/97
gucgacggucuggcccgcgac

SEQ ID NO: 1174135 - RNA, 17 nt, Mycobacterium bovis subsp bovis AF2122/97
gucgacgggcacgcggc

SEQ ID NO: 1174136 - RNA, 19 nt, Mycobacterium bovis subsp bovis AF2122/97
gucgacggaaucgucggcg

SEQ ID NO: 1174137 - RNA, 15 nt, Mycobacterium bovis subsp bovis AF2122/97
gucgacggccacccc

SEQ ID NO: 1174138 - RNA, 13 nt, Mycobacterium bovis subsp bovis AF2122/97
gucgacggcggcc

SEQ ID NO: 1174139 - RNA, 15 nt, Mycobacterium bovis subsp bovis AF2122/97
gucgacgccgcagcg

SEQ ID NO: 1174140 - RNA, 14 nt, Mycobacterium bovis subsp bovis AF2122/97
gucgacgcaugggu

SEQ ID NO: 1174141 - RNA, 18 nt, Mycobacterium bovis subsp bovis AF2122/97
gucgacgaucucgccggc

SEQ ID NO: 1174142 - RNA, 14 nt, Mycobacterium bovis subsp bovis AF2122/97
gucgagcgccgcgg

SEQ ID NO: 1174143 - RNA, 15 nt, Mycobacterium bovis subsp bovis AF2122/97
gucgagcgcccacug

SEQ ID NO: 1174144 - RNA, 13 nt, Mycobacterium bovis subsp bovis AF2122/97
gucgagcagccgc

SEQ ID NO: 1174145 - RNA, 11 nt, Mycobacterium bovis subsp bovis AF2122/97
gucgagcagcc

SEQ ID NO: 1174146 - RNA, 14 nt, Mycobacterium bovis subsp bovis AF2122/97
gucgagcagcgcca

SEQ ID NO: 1174147 - RNA, 13 nt, Mycobacterium bovis subsp bovis AF2122/97
gucgaucucccag

SEQ ID NO: 1174148 - RNA, 14 nt, Mycobacterium bovis subsp bovis AF2122/97
gucgaucaccugca

SEQ ID NO: 1174149 - RNA, 12 nt, Mycobacterium bovis subsp bovis AF2122/97
gucgaucaacaa

SEQ ID NO: 1174150 - RNA, 19 nt, Mycobacterium bovis subsp bovis AF2122/97
gucgagcgcuucgucgccg

SEQ ID NO: 1174151 - RNA, 13 nt, Mycobacterium bovis subsp bovis AF2122/97
gucgagcgccggc

SEQ ID NO: 1174152 - RNA, 18 nt, Mycobacterium bovis subsp bovis AF2122/97
gucgacagcgucucgccg

SEQ ID NO: 1174153 - RNA, 20 nt, Mycobacterium bovis subsp bovis AF2122/97
gucgacaggugccagaccag

SEQ ID NO: 1174154 - RNA, 22 nt, Mycobacterium bovis subsp bovis AF2122/97
gucgacagucaacagggccagg

SEQ ID NO: 1174155 - RNA, 14 nt, Mycobacterium bovis subsp bovis AF2122/97
gucgaccaggccac

SEQ ID NO: 1174156 - RNA, 15 nt, Mycobacterium bovis subsp bovis AF2122/97
gucgaccaggccacu

SEQ ID NO: 1174157 - RNA, 19 nt, Mycobacterium bovis subsp bovis AF2122/97
gucgacccccugccacagc

SEQ ID NO: 1174158 - RNA, 22 nt, Mycobacterium bovis subsp bovis AF2122/97
gucgacgacauacgagcaguga

SEQ ID NO: 1174159 - RNA, 21 nt, Mycobacterium bovis subsp bovis AF2122/97
gucgacccacucaucagagcg

SEQ ID NO: 1174160 - RNA, 13 nt, Mycobacterium bovis subsp bovis AF2122/97
gucgacgagaucc

SEQ ID NO: 1174161 - RNA, 14 nt, Mycobacterium bovis subsp bovis AF2122/97
gucgacgagcgccu

SEQ ID NO: 1174162 - RNA, 20 nt, Mycobacterium bovis subsp bovis AF2122/97
gucgaccuucucgaugcuga

SEQ ID NO: 1174163 - RNA, 17 nt, Mycobacterium bovis subsp bovis AF2122/97
gucgacgaacucgccca

SEQ ID NO: 1174164 - RNA, 14 nt, Mycobacterium bovis subsp bovis AF2122/97
gucgaccuccucga

SEQ ID NO: 1174165 - RNA, 21 nt, Mycobacterium bovis subsp bovis AF2122/97
gucgaccucggcaaccaccuc

SEQ ID NO: 1174166 - RNA, 14 nt, Mycobacterium bovis subsp bovis AF2122/97
guccuugcgcagca

SEQ ID NO: 1174167 - RNA, 15 nt, Mycobacterium bovis subsp bovis AF2122/97
guccuuguuggccag

SEQ ID NO: 1174168 - RNA, 16 nt, Mycobacterium bovis subsp bovis AF2122/97
guccuuguuguggugg

SEQ ID NO: 1174169 - RNA, 17 nt, Mycobacterium bovis subsp bovis AF2122/97
guccuuguuguggugga

SEQ ID NO: 1174170 - RNA, 16 nt, Mycobacterium bovis subsp bovis AF2122/97
guccugcucgcacagc

SEQ ID NO: 1174171 - RNA, 20 nt, Mycobacterium bovis subsp bovis AF2122/97
gucgccggucaggccgccgc

SEQ ID NO: 1174172 - RNA, 15 nt, Mycobacterium bovis subsp bovis AF2122/97
gucgccggcggcggu

SEQ ID NO: 1174173 - RNA, 18 nt, Mycobacterium bovis subsp bovis AF2122/97
gucgccggcgucgagccg

SEQ ID NO: 1174174 - RNA, 14 nt, Mycobacterium bovis subsp bovis AF2122/97
gucgccggaugcug

SEQ ID NO: 1174175 - RNA, 14 nt, Mycobacterium bovis subsp bovis AF2122/97
gucgccggcaccgg

SEQ ID NO: 1174176 - RNA, 16 nt, Mycobacterium bovis subsp bovis AF2122/97
gucgcgauagccgccg

SEQ ID NO: 1174177 - RNA, 17 nt, Mycobacterium bovis subsp bovis AF2122/97
gucgcgauagccgccgc

SEQ ID NO: 1174178 - RNA, 22 nt, Mycobacterium bovis subsp bovis AF2122/97
gucgcgaaauagcugcggaggg

SEQ ID NO: 1174179 - RNA, 18 nt, Mycobacterium bovis subsp bovis AF2122/97
gucgcugagcacggcgcg

SEQ ID NO: 1174180 - RNA, 17 nt, Mycobacterium bovis subsp bovis AF2122/97
gucgcggcgcuggcugc

SEQ ID NO: 1174181 - RNA, 22 nt, Mycobacterium bovis subsp bovis AF2122/97
gucgcgggagaaaacggcggcg

SEQ ID NO: 1174182 - RNA, 19 nt, Mycobacterium bovis subsp bovis AF2122/97
gucgcggcuauggcgccgc

SEQ ID NO: 1174183 - RNA, 16 nt, Mycobacterium bovis subsp bovis AF2122/97
gucgcggccggcggcc

SEQ ID NO: 1174184 - RNA, 15 nt, Mycobacterium bovis subsp bovis AF2122/97
gucgcggccagcagg

SEQ ID NO: 1174185 - RNA, 22 nt, Mycobacterium bovis subsp bovis AF2122/97
gucgcggaucagcccgcgcagc

SEQ ID NO: 1174186 - RNA, 20 nt, Mycobacterium bovis subsp bovis AF2122/97
gucgcggaguagccgcagcu

SEQ ID NO: 1174187 - RNA, 14 nt, Mycobacterium bovis subsp bovis AF2122/97
gucgcgaugacgau

SEQ ID NO: 1174188 - RNA, 15 nt, Mycobacterium bovis subsp bovis AF2122/97
gucgcgaugcuuccc

SEQ ID NO: 1174189 - RNA, 21 nt, Mycobacterium bovis subsp bovis AF2122/97
gucgccgcccgugccgcccuc

SEQ ID NO: 1174190 - RNA, 20 nt, Mycobacterium bovis subsp bovis AF2122/97
gucgccgcccuggccgccgg

SEQ ID NO: 1174191 - RNA, 16 nt, Mycobacterium bovis subsp bovis AF2122/97
gucgccgccgcgggcg

SEQ ID NO: 1174192 - RNA, 19 nt, Mycobacterium bovis subsp bovis AF2122/97
gucgccgaccacucgagcg

SEQ ID NO: 1174193 - RNA, 17 nt, Mycobacterium bovis subsp bovis AF2122/97
gucgcccuguucggccc

SEQ ID NO: 1174194 - RNA, 18 nt, Mycobacterium bovis subsp bovis AF2122/97
gucgccgaacaccgagug

SEQ ID NO: 1174195 - RNA, 20 nt, Mycobacterium bovis subsp bovis AF2122/97
gucgccgaguaccggccagc

SEQ ID NO: 1174196 - RNA, 23 nt, Mycobacterium bovis subsp bovis AF2122/97
gucgccgaguaccggccagccgc

SEQ ID NO: 1174197 - RNA, 20 nt, Mycobacterium bovis subsp bovis AF2122/97
gucgccgaucgagacuucuu

SEQ ID NO: 1174198 - RNA, 13 nt, Mycobacterium bovis subsp bovis AF2122/97
gucgccgacggcg

SEQ ID NO: 1174199 - RNA, 22 nt, Mycobacterium bovis subsp bovis AF2122/97
gucgccgcucauuagcccccgc

SEQ ID NO: 1174200 - RNA, 15 nt, Mycobacterium bovis subsp bovis AF2122/97
gucgccggccggccc

SEQ ID NO: 1174201 - RNA, 14 nt, Mycobacterium bovis subsp bovis AF2122/97
gucgccggccuuga

SEQ ID NO: 1174202 - RNA, 15 nt, Mycobacterium bovis subsp bovis AF2122/97
gucgccgcuuucuug

SEQ ID NO: 1174203 - RNA, 21 nt, Mycobacterium bovis subsp bovis AF2122/97
gucgccggacgacaacaggcc

SEQ ID NO: 1174204 - RNA, 15 nt, Mycobacterium bovis subsp bovis AF2122/97
gucgccgcgggcagc

SEQ ID NO: 1174205 - RNA, 16 nt, Mycobacterium bovis subsp bovis AF2122/97
gucgccgcgggcagcg

SEQ ID NO: 1174206 - RNA, 22 nt, Mycobacterium bovis subsp bovis AF2122/97
gucgccgccuuccuggcgggcg

SEQ ID NO: 1174207 - RNA, 19 nt, Mycobacterium bovis subsp bovis AF2122/97
gucgcacugcgccggccgg

SEQ ID NO: 1174208 - RNA, 22 nt, Mycobacterium bovis subsp bovis AF2122/97
gucgcacucauagaacucgccg

SEQ ID NO: 1174209 - RNA, 21 nt, Mycobacterium bovis subsp bovis AF2122/97
gucgcaauauccggccgagcc

SEQ ID NO: 1174210 - RNA, 22 nt, Mycobacterium bovis subsp bovis AF2122/97
gucgauccccgcaauucccauc

SEQ ID NO: 1174211 - RNA, 14 nt, Mycobacterium bovis subsp bovis AF2122/97
gucgaucgccgcga

SEQ ID NO: 1174212 - RNA, 17 nt, Mycobacterium bovis subsp bovis AF2122/97
gucgauuggcucgccga

SEQ ID NO: 1174213 - RNA, 18 nt, Mycobacterium bovis subsp bovis AF2122/97
gucgauuggcugcgccga

SEQ ID NO: 1174214 - RNA, 16 nt, Mycobacterium bovis subsp bovis AF2122/97
gucgauuucggcggcg

SEQ ID NO: 1174215 - RNA, 23 nt, Mycobacterium bovis subsp bovis AF2122/97
gucggcaugacauacagcgggcg

SEQ ID NO: 1174216 - RNA, 17 nt, Mycobacterium bovis subsp bovis AF2122/97
gucggcaugggccggcg

SEQ ID NO: 1174217 - RNA, 22 nt, Mycobacterium bovis subsp bovis AF2122/97
gucggccagcagcagugccacc

SEQ ID NO: 1174218 - RNA, 15 nt, Mycobacterium bovis subsp bovis AF2122/97
gucggcgucauccac

SEQ ID NO: 1174219 - RNA, 12 nt, Mycobacterium bovis subsp bovis AF2122/97
gucggccaggcu

SEQ ID NO: 1174220 - RNA, 22 nt, Mycobacterium bovis subsp bovis AF2122/97
gucggcggguagaaccagcccg

SEQ ID NO: 1174221 - RNA, 15 nt, Mycobacterium bovis subsp bovis AF2122/97
gucggcggugccgug

SEQ ID NO: 1174222 - RNA, 12 nt, Mycobacterium bovis subsp bovis AF2122/97
gucggccaggcc

SEQ ID NO: 1174223 - RNA, 14 nt, Mycobacterium bovis subsp bovis AF2122/97
gucggccaggccac

SEQ ID NO: 1174224 - RNA, 14 nt, Mycobacterium bovis subsp bovis AF2122/97
gucggcaccgguuu

SEQ ID NO: 1174225 - RNA, 14 nt, Mycobacterium bovis subsp bovis AF2122/97
gucggcgugcaggg

SEQ ID NO: 1174226 - RNA, 13 nt, Mycobacterium bovis subsp bovis AF2122/97
gucggcguggcug

SEQ ID NO: 1174227 - RNA, 18 nt, Mycobacterium bovis subsp bovis AF2122/97
gucggcguugaucgacau

SEQ ID NO: 1174228 - RNA, 14 nt, Mycobacterium bovis subsp bovis AF2122/97
gucggcuuccuccu

SEQ ID NO: 1174229 - RNA, 14 nt, Mycobacterium bovis subsp bovis AF2122/97
gucggcugccgcaa

SEQ ID NO: 1174230 - RNA, 18 nt, Mycobacterium bovis subsp bovis AF2122/97
gucggcugccgcggcugc

SEQ ID NO: 1174231 - RNA, 15 nt, Mycobacterium bovis subsp bovis AF2122/97
gucggcugguccucc

SEQ ID NO: 1174232 - RNA, 23 nt, Mycobacterium bovis subsp bovis AF2122/97
gucggcauccucugaaccagcug

SEQ ID NO: 1174233 - RNA, 22 nt, Mycobacterium bovis subsp bovis AF2122/97
gucggcagguaccaccgcggug

SEQ ID NO: 1174234 - RNA, 14 nt, Mycobacterium bovis subsp bovis AF2122/97
gucggcaucgcgag

SEQ ID NO: 1174235 - RNA, 15 nt, Mycobacterium bovis subsp bovis AF2122/97
gucggcaucgcgagc

SEQ ID NO: 1174236 - RNA, 17 nt, Mycobacterium bovis subsp bovis AF2122/97
gucggcagcgacgccgg

SEQ ID NO: 1174237 - RNA, 19 nt, Mycobacterium bovis subsp bovis AF2122/97
gucgcugccgccgucgccg

SEQ ID NO: 1174238 - RNA, 14 nt, Mycobacterium bovis subsp bovis AF2122/97
gucgcugccgccgc

SEQ ID NO: 1174239 - RNA, 14 nt, Mycobacterium bovis subsp bovis AF2122/97
gucgcuggccggca

SEQ ID NO: 1174240 - RNA, 13 nt, Mycobacterium bovis subsp bovis AF2122/97
gucgcuggccagg

SEQ ID NO: 1174241 - RNA, 14 nt, Mycobacterium bovis subsp bovis AF2122/97
gucgggcggcgucg

SEQ ID NO: 1174242 - RNA, 17 nt, Mycobacterium bovis subsp bovis AF2122/97
gucgggcuccgugguug

SEQ ID NO: 1174243 - RNA, 16 nt, Mycobacterium bovis subsp bovis AF2122/97
gucggggaacgcggcg

SEQ ID NO: 1174244 - RNA, 20 nt, Mycobacterium bovis subsp bovis AF2122/97
gucggggaagacgaccgugc

SEQ ID NO: 1174245 - RNA, 22 nt, Mycobacterium bovis subsp bovis AF2122/97
gucggggaagacgaccgugcug

SEQ ID NO: 1174246 - RNA, 20 nt, Mycobacterium bovis subsp bovis AF2122/97
gucggggagcugcggcggcc

SEQ ID NO: 1174247 - RNA, 15 nt, Mycobacterium bovis subsp bovis AF2122/97
gucggugaaguccuc

SEQ ID NO: 1174248 - RNA, 19 nt, Mycobacterium bovis subsp bovis AF2122/97
gucgggguacaggcugcug

SEQ ID NO: 1174249 - RNA, 16 nt, Mycobacterium bovis subsp bovis AF2122/97
gucgggguccgcggca

SEQ ID NO: 1174250 - RNA, 21 nt, Mycobacterium bovis subsp bovis AF2122/97
gucgggcacaccgacgccgcc

SEQ ID NO: 1174251 - RNA, 16 nt, Mycobacterium bovis subsp bovis AF2122/97
gucgggcauggcggcg

SEQ ID NO: 1174252 - RNA, 18 nt, Mycobacterium bovis subsp bovis AF2122/97
gucgggcccccggcagca

SEQ ID NO: 1174253 - RNA, 16 nt, Mycobacterium bovis subsp bovis AF2122/97
gucgggccgcaacugc

SEQ ID NO: 1174254 - RNA, 17 nt, Mycobacterium bovis subsp bovis AF2122/97
gucgggaucgccaugua

SEQ ID NO: 1174255 - RNA, 22 nt, Mycobacterium bovis subsp bovis AF2122/97
gucgucggugaucaccgcggcg

SEQ ID NO: 1174256 - RNA, 22 nt, Mycobacterium bovis subsp bovis AF2122/97
gucguacaccucgagcgcggcg

SEQ ID NO: 1174257 - RNA, 17 nt, Mycobacterium bovis subsp bovis AF2122/97
gucgucuugguugugga

SEQ ID NO: 1174258 - RNA, 21 nt, Mycobacterium bovis subsp bovis AF2122/97
gucgucguuucgccagccggc

SEQ ID NO: 1174259 - RNA, 16 nt, Mycobacterium bovis subsp bovis AF2122/97
gucgugaggaaccccg

SEQ ID NO: 1174260 - RNA, 14 nt, Mycobacterium bovis subsp bovis AF2122/97
gucgugaucagcag

SEQ ID NO: 1174261 - RNA, 19 nt, Mycobacterium bovis subsp bovis AF2122/97
gucggugguaccggcggcg

SEQ ID NO: 1174262 - RNA, 21 nt, Mycobacterium bovis subsp bovis AF2122/97
gucgguggccgcggcggucug

SEQ ID NO: 1174263 - RNA, 15 nt, Mycobacterium bovis subsp bovis AF2122/97
gucgguggcggggaa

SEQ ID NO: 1174264 - RNA, 22 nt, Mycobacterium bovis subsp bovis AF2122/97
gucggugaugguuucggcggga

SEQ ID NO: 1174265 - RNA, 23 nt, Mycobacterium bovis subsp bovis AF2122/97
gucggugguuuucccgucgccgc

SEQ ID NO: 1174266 - RNA, 19 nt, Mycobacterium bovis subsp bovis AF2122/97
gucggugccgccgccggcg

SEQ ID NO: 1174267 - RNA, 12 nt, Mycobacterium bovis subsp bovis AF2122/97
gucggugccggg

SEQ ID NO: 1174268 - RNA, 17 nt, Mycobacterium bovis subsp bovis AF2122/97
gucggugcgcgcagacu

SEQ ID NO: 1174269 - RNA, 18 nt, Mycobacterium bovis subsp bovis AF2122/97
gucgguguuccgccgcgc

SEQ ID NO: 1174270 - RNA, 20 nt, Mycobacterium bovis subsp bovis AF2122/97
gucgguguucggugguccug

SEQ ID NO: 1174271 - RNA, 21 nt, Mycobacterium bovis subsp bovis AF2122/97
gucgguucagccacgcagcac

SEQ ID NO: 1174272 - RNA, 16 nt, Mycobacterium bovis subsp bovis AF2122/97
gucugcccgcccagcc

SEQ ID NO: 1174273 - RNA, 14 nt, Mycobacterium bovis subsp bovis AF2122/97
gucugcgccgccgg

SEQ ID NO: 1174274 - RNA, 14 nt, Mycobacterium bovis subsp bovis AF2122/97
gucugccagcaccc

SEQ ID NO: 1174275 - RNA, 12 nt, Mycobacterium bovis subsp bovis AF2122/97
gucugccaggcg

SEQ ID NO: 1174276 - RNA, 16 nt, Mycobacterium bovis subsp bovis AF2122/97
gucugccaggcgcagc

SEQ ID NO: 1174277 - RNA, 21 nt, Mycobacterium bovis subsp bovis AF2122/97
gucugcccgacugccguucag

SEQ ID NO: 1174278 - RNA, 19 nt, Mycobacterium bovis subsp bovis AF2122/97
gucugcccgauacccggug

SEQ ID NO: 1174279 - RNA, 19 nt, Mycobacterium bovis subsp bovis AF2122/97
gucugaccgguucccgggc

SEQ ID NO: 1174280 - RNA, 16 nt, Mycobacterium bovis subsp bovis AF2122/97
gucugcucgccaggcc

SEQ ID NO: 1174281 - RNA, 19 nt, Mycobacterium bovis subsp bovis AF2122/97
gucugcucgccgggcagcu

SEQ ID NO: 1174282 - RNA, 23 nt, Mycobacterium bovis subsp bovis AF2122/97
gucugcucgcgccggugaggcga

SEQ ID NO: 1174283 - RNA, 19 nt, Mycobacterium bovis subsp bovis AF2122/97
gucugcucggcgcgguggg

SEQ ID NO: 1174284 - RNA, 20 nt, Mycobacterium bovis subsp bovis AF2122/97
gucugcucggcggagaaaag

SEQ ID NO: 1174285 - RNA, 15 nt, Mycobacterium bovis subsp bovis AF2122/97
gucugcucgccaggc

SEQ ID NO: 1174286 - RNA, 13 nt, Mycobacterium bovis subsp bovis AF2122/97
gucugcucaccag

SEQ ID NO: 1174287 - RNA, 23 nt, Mycobacterium bovis subsp bovis AF2122/97
gucugcgccuucgccagcggcgc

SEQ ID NO: 1174288 - RNA, 15 nt, Mycobacterium bovis subsp bovis AF2122/97
gucuggcaggccagc

SEQ ID NO: 1174289 - RNA, 17 nt, Mycobacterium bovis subsp bovis AF2122/97
gucuggccugccccaga

SEQ ID NO: 1174290 - RNA, 21 nt, Mycobacterium bovis subsp bovis AF2122/97
gucugguauuuguccggcgga

SEQ ID NO: 1174291 - RNA, 23 nt, Mycobacterium bovis subsp bovis AF2122/97
gucuggucggcuacggccagugc

SEQ ID NO: 1174292 - RNA, 20 nt, Mycobacterium bovis subsp bovis AF2122/97
gucucgacaaagcggcugcc

SEQ ID NO: 1174293 - RNA, 16 nt, Mycobacterium bovis subsp bovis AF2122/97
gucucgacacugcagu

SEQ ID NO: 1174294 - RNA, 16 nt, Mycobacterium bovis subsp bovis AF2122/97
gucuccgccggcucgu

SEQ ID NO: 1174295 - RNA, 14 nt, Mycobacterium bovis subsp bovis AF2122/97
gucucgcggugcgg

SEQ ID NO: 1174296 - RNA, 21 nt, Mycobacterium bovis subsp bovis AF2122/97
gucucggaaacggaccuccuc

SEQ ID NO: 1174297 - RNA, 13 nt, Mycobacterium bovis subsp bovis AF2122/97
gucucggccacga

SEQ ID NO: 1174298 - RNA, 23 nt, Mycobacterium bovis subsp bovis AF2122/97
gucucgagcgcgccgcgcucgcc

SEQ ID NO: 1174299 - RNA, 15 nt, Mycobacterium bovis subsp bovis AF2122/97
gucucggcguuccgg

SEQ ID NO: 1174300 - RNA, 21 nt, Mycobacterium bovis subsp bovis AF2122/97
gucucggcguuccggacggga

SEQ ID NO: 1174301 - RNA, 15 nt, Mycobacterium bovis subsp bovis AF2122/97
gucucgucaaccugc

SEQ ID NO: 1174302 - RNA, 14 nt, Mycobacterium bovis subsp bovis AF2122/97
gucucucgcagcuc

SEQ ID NO: 1174303 - RNA, 17 nt, Mycobacterium bovis subsp bovis AF2122/97
gucguuguuagugacgu

SEQ ID NO: 1174304 - RNA, 16 nt, Mycobacterium bovis subsp bovis AF2122/97
gucucagugcucgccc

SEQ ID NO: 1174305 - RNA, 16 nt, Mycobacterium bovis subsp bovis AF2122/97
gucuccagcuggguga

SEQ ID NO: 1174306 - RNA, 21 nt, Mycobacterium bovis subsp bovis AF2122/97
gucucccagaggucgagcgcc

SEQ ID NO: 1174307 - RNA, 22 nt, Mycobacterium bovis subsp bovis AF2122/97
gucuccagcaccaaaaggauca

SEQ ID NO: 1174308 - RNA, 21 nt, Mycobacterium bovis subsp bovis AF2122/97
gucguggugcaacacgccggc

SEQ ID NO: 1174309 - RNA, 20 nt, Mycobacterium bovis subsp bovis AF2122/97
gucgugucgccacaccgggg

SEQ ID NO: 1174310 - RNA, 21 nt, Mycobacterium bovis subsp bovis AF2122/97
gucguggacuuuauggcuagu

SEQ ID NO: 1174311 - RNA, 14 nt, Mycobacterium bovis subsp bovis AF2122/97
gucguggagcucac

SEQ ID NO: 1174312 - RNA, 17 nt, Mycobacterium bovis subsp bovis AF2122/97
gucguucccgccggcac

SEQ ID NO: 1174313 - RNA, 17 nt, Mycobacterium bovis subsp bovis AF2122/97
gucguugaggaagcccg

SEQ ID NO: 1174314 - RNA, 18 nt, Mycobacterium bovis subsp bovis AF2122/97
gucguugaggaagcccga

SEQ ID NO: 1174315 - RNA, 13 nt, Mycobacterium bovis subsp bovis AF2122/97
gucgugucgccgc

SEQ ID NO: 1174316 - RNA, 17 nt, Mycobacterium bovis subsp bovis AF2122/97
gucuuggcggcggugca

SEQ ID NO: 1174317 - RNA, 21 nt, Mycobacterium bovis subsp bovis AF2122/97
gucuuggcccgguccgccauu

SEQ ID NO: 1174318 - RNA, 21 nt, Mycobacterium bovis subsp bovis AF2122/97
gucuugggucaggaucgcaau

SEQ ID NO: 1174319 - RNA, 18 nt, Mycobacterium bovis subsp bovis AF2122/97
gucuuggcggcggugcag

SEQ ID NO: 1174320 - RNA, 22 nt, Mycobacterium bovis subsp bovis AF2122/97
gucuuggcggcggugcagcagg

SEQ ID NO: 1174321 - RNA, 16 nt, Mycobacterium bovis subsp bovis AF2122/97
gucuugccgcaggccu

SEQ ID NO: 1174322 - RNA, 18 nt, Mycobacterium bovis subsp bovis AF2122/97
gucuugcaguaacuucac

SEQ ID NO: 1174323 - RNA, 21 nt, Mycobacterium bovis subsp bovis AF2122/97
gucuugcguccauccgcagca

SEQ ID NO: 1174324 - RNA, 13 nt, Mycobacterium bovis subsp bovis AF2122/97
gucuugauguaau

SEQ ID NO: 1174325 - RNA, 19 nt, Mycobacterium bovis subsp bovis AF2122/97
gucuugacggcgccaggca

SEQ ID NO: 1174326 - RNA, 16 nt, Mycobacterium bovis subsp bovis AF2122/97
gucuuccagccaggcc

SEQ ID NO: 1174327 - RNA, 19 nt, Mycobacterium bovis subsp bovis AF2122/97
gucuucgggcucguccagc

SEQ ID NO: 1174328 - RNA, 18 nt, Mycobacterium bovis subsp bovis AF2122/97
gucuucaggccgcgcaug

SEQ ID NO: 1174329 - RNA, 17 nt, Mycobacterium bovis subsp bovis AF2122/97
gucuucagguccaccgc

SEQ ID NO: 1174330 - RNA, 15 nt, Mycobacterium bovis subsp bovis AF2122/97
gucugucuggcccca

SEQ ID NO: 1174331 - RNA, 17 nt, Mycobacterium bovis subsp bovis AF2122/97
gucugucuggccccagg

SEQ ID NO: 1174332 - RNA, 14 nt, Mycobacterium bovis subsp bovis AF2122/97
gucugugcucacgg

SEQ ID NO: 1174333 - RNA, 15 nt, Mycobacterium bovis subsp bovis AF2122/97
gucugugcaugcaug

SEQ ID NO: 1174334 - RNA, 17 nt, Mycobacterium bovis subsp bovis AF2122/97
gugaaauucgcggcggu

SEQ ID NO: 1174335 - RNA, 12 nt, Mycobacterium bovis subsp bovis AF2122/97
gugaacaccccu

SEQ ID NO: 1174336 - RNA, 12 nt, Mycobacterium bovis subsp bovis AF2122/97
gugaacaacuca

SEQ ID NO: 1174337 - RNA, 14 nt, Mycobacterium bovis subsp bovis AF2122/97
gugaaaugccgaga

SEQ ID NO: 1174338 - RNA, 12 nt, Mycobacterium bovis subsp bovis AF2122/97
gugaaaguucau

SEQ ID NO: 1174339 - RNA, 16 nt, Mycobacterium bovis subsp bovis AF2122/97
gugaaaccggccuucu

SEQ ID NO: 1174340 - RNA, 14 nt, Mycobacterium bovis subsp bovis AF2122/97
gugaaaaucgccau

SEQ ID NO: 1174341 - RNA, 23 nt, Mycobacterium bovis subsp bovis AF2122/97
gugaaaaaggcgacucggugcgg

SEQ ID NO: 1174342 - RNA, 22 nt, Mycobacterium bovis subsp bovis AF2122/97
gucuuugguuguuggugccagc

SEQ ID NO: 1174343 - RNA, 22 nt, Mycobacterium bovis subsp bovis AF2122/97
gucuuugcucucggucugcaug

SEQ ID NO: 1174344 - RNA, 23 nt, Mycobacterium bovis subsp bovis AF2122/97
gucuuugcucucggucugcaugc

SEQ ID NO: 1174345 - RNA, 13 nt, Mycobacterium bovis subsp bovis AF2122/97
gugagcgccgcgg

SEQ ID NO: 1174346 - RNA, 14 nt, Mycobacterium bovis subsp bovis AF2122/97
gugagcgagcgcgc

SEQ ID NO: 1174347 - RNA, 19 nt, Mycobacterium bovis subsp bovis AF2122/97
gugagcgcagcuugauccc

SEQ ID NO: 1174348 - RNA, 17 nt, Mycobacterium bovis subsp bovis AF2122/97
gugagccgguggcccgc

SEQ ID NO: 1174349 - RNA, 20 nt, Mycobacterium bovis subsp bovis AF2122/97
gugagccgguggcccgccgg

SEQ ID NO: 1174350 - RNA, 15 nt, Mycobacterium bovis subsp bovis AF2122/97
gugagccgggcggcc

SEQ ID NO: 1174351 - RNA, 21 nt, Mycobacterium bovis subsp bovis AF2122/97
gugagacugggcgcuggaggc

SEQ ID NO: 1174352 - RNA, 18 nt, Mycobacterium bovis subsp bovis AF2122/97
gugagcaauggcgcgacc

SEQ ID NO: 1174353 - RNA, 22 nt, Mycobacterium bovis subsp bovis AF2122/97
gugagcagcgggacauccagug

SEQ ID NO: 1174354 - RNA, 15 nt, Mycobacterium bovis subsp bovis AF2122/97
gugagcauggcuagg

SEQ ID NO: 1174355 - RNA, 19 nt, Mycobacterium bovis subsp bovis AF2122/97
gugagcccguugaccugcg

SEQ ID NO: 1174356 - RNA, 19 nt, Mycobacterium bovis subsp bovis AF2122/97
gugacguuggcaggcaggu

SEQ ID NO: 1174357 - RNA, 17 nt, Mycobacterium bovis subsp bovis AF2122/97
gugacuccggcuggaag

SEQ ID NO: 1174358 - RNA, 13 nt, Mycobacterium bovis subsp bovis AF2122/97
gugacuggugaac

SEQ ID NO: 1174359 - RNA, 15 nt, Mycobacterium bovis subsp bovis AF2122/97
gugagaagaagccca

SEQ ID NO: 1174360 - RNA, 24 nt, Mycobacterium bovis subsp bovis AF2122/97
gugagaucaugaggugagcugcgg

SEQ ID NO: 1174361 - RNA, 22 nt, Mycobacterium bovis subsp bovis AF2122/97
gugagaauagugaaagugguug

SEQ ID NO: 1174362 - RNA, 23 nt, Mycobacterium bovis subsp bovis AF2122/97
gugagaccuagcagggugccggc

SEQ ID NO: 1174363 - RNA, 15 nt, Mycobacterium bovis subsp bovis AF2122/97
gugaggccaaccaca

SEQ ID NO: 1174364 - RNA, 12 nt, Mycobacterium bovis subsp bovis AF2122/97
gugaggcccccc

SEQ ID NO: 1174365 - RNA, 14 nt, Mycobacterium bovis subsp bovis AF2122/97
gugaggcgaccgga

SEQ ID NO: 1174366 - RNA, 19 nt, Mycobacterium bovis subsp bovis AF2122/97
gugaggcguugaacugugc

SEQ ID NO: 1174367 - RNA, 14 nt, Mycobacterium bovis subsp bovis AF2122/97
gugagggccgggug

SEQ ID NO: 1174368 - RNA, 20 nt, Mycobacterium bovis subsp bovis AF2122/97
gugagcuuuaucugcaugcc

SEQ ID NO: 1174369 - RNA, 23 nt, Mycobacterium bovis subsp bovis AF2122/97
gugagcuuagcgcaugggccuug

SEQ ID NO: 1174370 - RNA, 18 nt, Mycobacterium bovis subsp bovis AF2122/97
gugaggaaccccggucgg

SEQ ID NO: 1174371 - RNA, 15 nt, Mycobacterium bovis subsp bovis AF2122/97
gugagcgccgcggcg

SEQ ID NO: 1174372 - RNA, 16 nt, Mycobacterium bovis subsp bovis AF2122/97
gugagcucggcugcuc

SEQ ID NO: 1174373 - RNA, 19 nt, Mycobacterium bovis subsp bovis AF2122/97
gugaguaccaauccaggcc

SEQ ID NO: 1174374 - RNA, 21 nt, Mycobacterium bovis subsp bovis AF2122/97
gugaggucauagccguugcgg

SEQ ID NO: 1174375 - RNA, 15 nt, Mycobacterium bovis subsp bovis AF2122/97
gugagucacccggcc

SEQ ID NO: 1174376 - RNA, 14 nt, Mycobacterium bovis subsp bovis AF2122/97
gugagucccacgcc

SEQ ID NO: 1174377 - RNA, 22 nt, Mycobacterium bovis subsp bovis AF2122/97
gugcacuacaggguuggcagcc

SEQ ID NO: 1174378 - RNA, 20 nt, Mycobacterium bovis subsp bovis AF2122/97
gugcacggcgaggccgaacu

SEQ ID NO: 1174379 - RNA, 14 nt, Mycobacterium bovis subsp bovis AF2122/97
gugcacggcggcca

SEQ ID NO: 1174380 - RNA, 13 nt, Mycobacterium bovis subsp bovis AF2122/97
gugcagacaggcg

SEQ ID NO: 1174381 - RNA, 17 nt, Mycobacterium bovis subsp bovis AF2122/97
gugcagacaggcggcgg

SEQ ID NO: 1174382 - RNA, 20 nt, Mycobacterium bovis subsp bovis AF2122/97
gugcaaugcuuccagcauca

SEQ ID NO: 1174383 - RNA, 20 nt, Mycobacterium bovis subsp bovis AF2122/97
gugcagggcauugcggcccg

SEQ ID NO: 1174384 - RNA, 23 nt, Mycobacterium bovis subsp bovis AF2122/97
gugcaggcggccgccaguucggc

SEQ ID NO: 1174385 - RNA, 12 nt, Mycobacterium bovis subsp bovis AF2122/97
gugcaggcggga

SEQ ID NO: 1174386 - RNA, 16 nt, Mycobacterium bovis subsp bovis AF2122/97
gugcagggacccggcg

SEQ ID NO: 1174387 - RNA, 14 nt, Mycobacterium bovis subsp bovis AF2122/97
gugcaggaccagaa

SEQ ID NO: 1174388 - RNA, 19 nt, Mycobacterium bovis subsp bovis AF2122/97
gugcaggccgcggagaagg

SEQ ID NO: 1174389 - RNA, 17 nt, Mycobacterium bovis subsp bovis AF2122/97
gugcagcgugggcagcg

SEQ ID NO: 1174390 - RNA, 21 nt, Mycobacterium bovis subsp bovis AF2122/97
gugcagcugcaaugacuggac

SEQ ID NO: 1174391 - RNA, 17 nt, Mycobacterium bovis subsp bovis AF2122/97
gugcagcgugcagcggc

SEQ ID NO: 1174392 - RNA, 22 nt, Mycobacterium bovis subsp bovis AF2122/97
gugcagaagacaagugguggua

SEQ ID NO: 1174393 - RNA, 20 nt, Mycobacterium bovis subsp bovis AF2122/97
gugcagaucgucgccgauca

SEQ ID NO: 1174394 - RNA, 21 nt, Mycobacterium bovis subsp bovis AF2122/97
gugcagagccaacucccgcgg

SEQ ID NO: 1174395 - RNA, 16 nt, Mycobacterium bovis subsp bovis AF2122/97
gugaucgaggcggcgg

SEQ ID NO: 1174396 - RNA, 22 nt, Mycobacterium bovis subsp bovis AF2122/97
gugaucgaucgcggcgcccagg

SEQ ID NO: 1174397 - RNA, 16 nt, Mycobacterium bovis subsp bovis AF2122/97
gugaucgggcagcacg

SEQ ID NO: 1174398 - RNA, 20 nt, Mycobacterium bovis subsp bovis AF2122/97
gugaucgggcagcacgccag

SEQ ID NO: 1174399 - RNA, 15 nt, Mycobacterium bovis subsp bovis AF2122/97
gugauucgcgcagcg

SEQ ID NO: 1174400 - RNA, 15 nt, Mycobacterium bovis subsp bovis AF2122/97
gugaccugggcgccc

SEQ ID NO: 1174401 - RNA, 20 nt, Mycobacterium bovis subsp bovis AF2122/97
gugaccuguuuggggcugug

SEQ ID NO: 1174402 - RNA, 15 nt, Mycobacterium bovis subsp bovis AF2122/97
gugacgagcacaugc

SEQ ID NO: 1174403 - RNA, 14 nt, Mycobacterium bovis subsp bovis AF2122/97
gugacgcacagcag

SEQ ID NO: 1174404 - RNA, 16 nt, Mycobacterium bovis subsp bovis AF2122/97
gugacgcacagcagca

SEQ ID NO: 1174405 - RNA, 17 nt, Mycobacterium bovis subsp bovis AF2122/97
gugacgccgccagcacc

SEQ ID NO: 1174406 - RNA, 18 nt, Mycobacterium bovis subsp bovis AF2122/97
gugacgcccgcuccgcgg

SEQ ID NO: 1174407 - RNA, 23 nt, Mycobacterium bovis subsp bovis AF2122/97
gugacgcgccguaacagccggcc

SEQ ID NO: 1174408 - RNA, 18 nt, Mycobacterium bovis subsp bovis AF2122/97
gugacggccggcggucgg

SEQ ID NO: 1174409 - RNA, 17 nt, Mycobacterium bovis subsp bovis AF2122/97
gugacguggugggcuug

SEQ ID NO: 1174410 - RNA, 20 nt, Mycobacterium bovis subsp bovis AF2122/97
gugacguaucgccgcgggcg

SEQ ID NO: 1174411 - RNA, 16 nt, Mycobacterium bovis subsp bovis AF2122/97
gugacguagggcagcg

SEQ ID NO: 1174412 - RNA, 13 nt, Mycobacterium bovis subsp bovis AF2122/97
gugaccggcggga

SEQ ID NO: 1174413 - RNA, 23 nt, Mycobacterium bovis subsp bovis AF2122/97
gugaccggcgaucgggcggguga

SEQ ID NO: 1174414 - RNA, 13 nt, Mycobacterium bovis subsp bovis AF2122/97
gugaccgcuggug

SEQ ID NO: 1174415 - RNA, 22 nt, Mycobacterium bovis subsp bovis AF2122/97
gugaccgcuggugugucccggg

SEQ ID NO: 1174416 - RNA, 17 nt, Mycobacterium bovis subsp bovis AF2122/97
gugaccgcagucccagc

SEQ ID NO: 1174417 - RNA, 15 nt, Mycobacterium bovis subsp bovis AF2122/97
gugaccucggcgacc

SEQ ID NO: 1174418 - RNA, 14 nt, Mycobacterium bovis subsp bovis AF2122/97
gugacccgcugggc

SEQ ID NO: 1174419 - RNA, 13 nt, Mycobacterium bovis subsp bovis AF2122/97
gugaccaggugcc

SEQ ID NO: 1174420 - RNA, 23 nt, Mycobacterium bovis subsp bovis AF2122/97
gugacccugggguugcaucaugc

SEQ ID NO: 1174421 - RNA, 12 nt, Mycobacterium bovis subsp bovis AF2122/97
gugaccagcagg

SEQ ID NO: 1174422 - RNA, 17 nt, Mycobacterium bovis subsp bovis AF2122/97
gugaccaggaucgacag

SEQ ID NO: 1174423 - RNA, 20 nt, Mycobacterium bovis subsp bovis AF2122/97
gugacagugcgucgagcauc

SEQ ID NO: 1174424 - RNA, 16 nt, Mycobacterium bovis subsp bovis AF2122/97
gugacaccaacaccgg

SEQ ID NO: 1174425 - RNA, 23 nt, Mycobacterium bovis subsp bovis AF2122/97
gugaagaaguucggguagccggg

SEQ ID NO: 1174426 - RNA, 15 nt, Mycobacterium bovis subsp bovis AF2122/97
gugaacuguccgggu

SEQ ID NO: 1174427 - RNA, 19 nt, Mycobacterium bovis subsp bovis AF2122/97
gugaacugcuggccgaugu

SEQ ID NO: 1174428 - RNA, 14 nt, Mycobacterium bovis subsp bovis AF2122/97
gugaacuguccggg

SEQ ID NO: 1174429 - RNA, 14 nt, Mycobacterium bovis subsp bovis AF2122/97
gugaacggcucggg

SEQ ID NO: 1174430 - RNA, 23 nt, Mycobacterium bovis subsp bovis AF2122/97
gugaacggugccucgcagccaac

SEQ ID NO: 1174431 - RNA, 15 nt, Mycobacterium bovis subsp bovis AF2122/97
gugaacggcagcacg

SEQ ID NO: 1174432 - RNA, 13 nt, Mycobacterium bovis subsp bovis AF2122/97
aaauagcugcgga

SEQ ID NO: 1174433 - RNA, 12 nt, Mycobacterium bovis subsp bovis AF2122/97
gugaaccgcgcg

SEQ ID NO: 1174434 - RNA, 17 nt, Mycobacterium bovis subsp bovis AF2122/97
gugaaccgggcaccacu

SEQ ID NO: 1174435 - RNA, 15 nt, Mycobacterium bovis subsp bovis AF2122/97
gugaagucggugccg

SEQ ID NO: 1174436 - RNA, 17 nt, Mycobacterium bovis subsp bovis AF2122/97
gugaagucggugccgag

SEQ ID NO: 1174437 - RNA, 16 nt, Mycobacterium bovis subsp bovis AF2122/97
gugaagggauccggaa

SEQ ID NO: 1174438 - RNA, 19 nt, Mycobacterium bovis subsp bovis AF2122/97
gugaagcccuggccagcga

SEQ ID NO: 1174439 - RNA, 20 nt, Mycobacterium bovis subsp bovis AF2122/97
gugaaguggcgcaccaccuc

SEQ ID NO: 1174440 - RNA, 20 nt, Mycobacterium bovis subsp bovis AF2122/97
gugacaacugcgccggugcc

SEQ ID NO: 1174441 - RNA, 19 nt, Mycobacterium bovis subsp bovis AF2122/97
gugacaaggugcgcugggu

SEQ ID NO: 1174442 - RNA, 23 nt, Mycobacterium bovis subsp bovis AF2122/97
gugacaaccguuguaccccagca

SEQ ID NO: 1174443 - RNA, 16 nt, Mycobacterium bovis subsp bovis AF2122/97
gugacaaauggggugu

SEQ ID NO: 1174444 - RNA, 16 nt, Mycobacterium bovis subsp bovis AF2122/97
gugaauccgugcaggg

SEQ ID NO: 1174445 - RNA, 12 nt, Mycobacterium bovis subsp bovis AF2122/97
guggcagccagc

SEQ ID NO: 1174446 - RNA, 14 nt, Mycobacterium bovis subsp bovis AF2122/97
guggcagccugcug

SEQ ID NO: 1174447 - RNA, 15 nt, Mycobacterium bovis subsp bovis AF2122/97
guggcagccugcugc

SEQ ID NO: 1174448 - RNA, 22 nt, Mycobacterium bovis subsp bovis AF2122/97
guggcacccggcugaaacgucc

SEQ ID NO: 1174449 - RNA, 19 nt, Mycobacterium bovis subsp bovis AF2122/97
guggcaccggcggcgacgg

SEQ ID NO: 1174450 - RNA, 14 nt, Mycobacterium bovis subsp bovis AF2122/97
guggcagagccgcc

SEQ ID NO: 1174451 - RNA, 19 nt, Mycobacterium bovis subsp bovis AF2122/97
guggcaguacaccggcgug

SEQ ID NO: 1174452 - RNA, 22 nt, Mycobacterium bovis subsp bovis AF2122/97
guggcaguacaccggcgugcug

SEQ ID NO: 1174453 - RNA, 20 nt, Mycobacterium bovis subsp bovis AF2122/97
guggccaacaccgccagcau

SEQ ID NO: 1174454 - RNA, 22 nt, Mycobacterium bovis subsp bovis AF2122/97
guggccagaucgaacgcagcca

SEQ ID NO: 1174455 - RNA, 20 nt, Mycobacterium bovis subsp bovis AF2122/97
guggccaccaaacgcugcug

SEQ ID NO: 1174456 - RNA, 23 nt, Mycobacterium bovis subsp bovis AF2122/97
guggccaccaccgugaagcccug

SEQ ID NO: 1174457 - RNA, 12 nt, Mycobacterium bovis subsp bovis AF2122/97
guggccaccagc

SEQ ID NO: 1174458 - RNA, 16 nt, Mycobacterium bovis subsp bovis AF2122/97
guggcaucgccuccag

SEQ ID NO: 1174459 - RNA, 14 nt, Mycobacterium bovis subsp bovis AF2122/97
guggccagcccgcc

SEQ ID NO: 1174460 - RNA, 18 nt, Mycobacterium bovis subsp bovis AF2122/97
guggccagcaggcggcug

SEQ ID NO: 1174461 - RNA, 18 nt, Mycobacterium bovis subsp bovis AF2122/97
guggccagcgcggcgagg

SEQ ID NO: 1174462 - RNA, 16 nt, Mycobacterium bovis subsp bovis AF2122/97
guggccagcgcuugug

SEQ ID NO: 1174463 - RNA, 13 nt, Mycobacterium bovis subsp bovis AF2122/97
guggccagccagc

SEQ ID NO: 1174464 - RNA, 18 nt, Mycobacterium bovis subsp bovis AF2122/97
guggcccgccggcaguga

SEQ ID NO: 1174465 - RNA, 14 nt, Mycobacterium bovis subsp bovis AF2122/97
guggcccgcgggca

SEQ ID NO: 1174466 - RNA, 22 nt, Mycobacterium bovis subsp bovis AF2122/97
guggcgaaucuuugguagucug

SEQ ID NO: 1174467 - RNA, 21 nt, Mycobacterium bovis subsp bovis AF2122/97
guggccuugacagcuuucuug

SEQ ID NO: 1174468 - RNA, 13 nt, Mycobacterium bovis subsp bovis AF2122/97
guggcguguggcu

SEQ ID NO: 1174469 - RNA, 24 nt, Mycobacterium bovis subsp bovis AF2122/97
guggcggucuugccgcaggccugu

SEQ ID NO: 1174470 - RNA, 13 nt, Mycobacterium bovis subsp bovis AF2122/97
guggcgcaccacc

SEQ ID NO: 1174471 - RNA, 19 nt, Mycobacterium bovis subsp bovis AF2122/97
guggcgacggcgucgauga

SEQ ID NO: 1174472 - RNA, 21 nt, Mycobacterium bovis subsp bovis AF2122/97
guggcgccaugaagccgggcg

SEQ ID NO: 1174473 - RNA, 14 nt, Mycobacterium bovis subsp bovis AF2122/97
gugggccagcagca

SEQ ID NO: 1174474 - RNA, 18 nt, Mycobacterium bovis subsp bovis AF2122/97
gugggccgcccaaagaaa

SEQ ID NO: 1174475 - RNA, 16 nt, Mycobacterium bovis subsp bovis AF2122/97
gugggcuuggugccca

SEQ ID NO: 1174476 - RNA, 21 nt, Mycobacterium bovis subsp bovis AF2122/97
gugggagcuacccgggccagg

SEQ ID NO: 1174477 - RNA, 11 nt, Mycobacterium bovis subsp bovis AF2122/97
gugggcagcag

SEQ ID NO: 1174478 - RNA, 18 nt, Mycobacterium bovis subsp bovis AF2122/97
gugggacaaagacgccgu

SEQ ID NO: 1174479 - RNA, 19 nt, Mycobacterium bovis subsp bovis AF2122/97
guggcuacgcgaucagcug

SEQ ID NO: 1174480 - RNA, 19 nt, Mycobacterium bovis subsp bovis AF2122/97
guggcuccaucgucuggug

SEQ ID NO: 1174481 - RNA, 17 nt, Mycobacterium bovis subsp bovis AF2122/97
guggaucuuggccagca

SEQ ID NO: 1174482 - RNA, 23 nt, Mycobacterium bovis subsp bovis AF2122/97
guggaucauguucggccaccaga

SEQ ID NO: 1174483 - RNA, 23 nt, Mycobacterium bovis subsp bovis AF2122/97
guggauugugucccauggugagc

SEQ ID NO: 1174484 - RNA, 15 nt, Mycobacterium bovis subsp bovis AF2122/97
guggcaaucccgcca

SEQ ID NO: 1174485 - RNA, 16 nt, Mycobacterium bovis subsp bovis AF2122/97
guggcaaucccgccau

SEQ ID NO: 1174486 - RNA, 14 nt, Mycobacterium bovis subsp bovis AF2122/97
guggaacaccgcgg

SEQ ID NO: 1174487 - RNA, 14 nt, Mycobacterium bovis subsp bovis AF2122/97
guggaagccgacca

SEQ ID NO: 1174488 - RNA, 16 nt, Mycobacterium bovis subsp bovis AF2122/97
guggaacagucgaggu

SEQ ID NO: 1174489 - RNA, 23 nt, Mycobacterium bovis subsp bovis AF2122/97
guggagacguuuugcggcccggg

SEQ ID NO: 1174490 - RNA, 20 nt, Mycobacterium bovis subsp bovis AF2122/97
guggaguuggcugccggaga

SEQ ID NO: 1174491 - RNA, 21 nt, Mycobacterium bovis subsp bovis AF2122/97
guggaguuuccgaagcccggg

SEQ ID NO: 1174492 - RNA, 16 nt, Mycobacterium bovis subsp bovis AF2122/97
guggaggucaaaucaa

SEQ ID NO: 1174493 - RNA, 14 nt, Mycobacterium bovis subsp bovis AF2122/97
gugcugguaaccaa

SEQ ID NO: 1174494 - RNA, 20 nt, Mycobacterium bovis subsp bovis AF2122/97
gugcuguggaugccgacggc

SEQ ID NO: 1174495 - RNA, 21 nt, Mycobacterium bovis subsp bovis AF2122/97
gugcuguggucggugccagca

SEQ ID NO: 1174496 - RNA, 18 nt, Mycobacterium bovis subsp bovis AF2122/97
gugcagggugagcacgua

SEQ ID NO: 1174497 - RNA, 22 nt, Mycobacterium bovis subsp bovis AF2122/97
gugucagcugauuaccgacacc

SEQ ID NO: 1174498 - RNA, 16 nt, Mycobacterium bovis subsp bovis AF2122/97
guguagcagcgccagc

SEQ ID NO: 1174499 - RNA, 20 nt, Mycobacterium bovis subsp bovis AF2122/97
guguagcagcgccagcagcu

SEQ ID NO: 1174500 - RNA, 12 nt, Mycobacterium bovis subsp bovis AF2122/97
guguagcccagc

SEQ ID NO: 1174501 - RNA, 18 nt, Mycobacterium bovis subsp bovis AF2122/97
guguagcgaugccguuga

SEQ ID NO: 1174502 - RNA, 20 nt, Mycobacterium bovis subsp bovis AF2122/97
guguagcuucgaugggcauc

SEQ ID NO: 1174503 - RNA, 22 nt, Mycobacterium bovis subsp bovis AF2122/97
guguaggcaaccuuuggccgcu

SEQ ID NO: 1174504 - RNA, 18 nt, Mycobacterium bovis subsp bovis AF2122/97
guguaggccucggcagca

SEQ ID NO: 1174505 - RNA, 23 nt, Mycobacterium bovis subsp bovis AF2122/97
guguaggccugcccccggcgcgg

SEQ ID NO: 1174506 - RNA, 16 nt, Mycobacterium bovis subsp bovis AF2122/97
gugucacagugguggg

SEQ ID NO: 1174507 - RNA, 18 nt, Mycobacterium bovis subsp bovis AF2122/97
gugucgucggaccucgcc

SEQ ID NO: 1174508 - RNA, 21 nt, Mycobacterium bovis subsp bovis AF2122/97
gugucggcuggucgcugcugc

SEQ ID NO: 1174509 - RNA, 12 nt, Mycobacterium bovis subsp bovis AF2122/97
gugucggugcgc

SEQ ID NO: 1174510 - RNA, 14 nt, Mycobacterium bovis subsp bovis AF2122/97
gugucggugcgcgc

SEQ ID NO: 1174511 - RNA, 16 nt, Mycobacterium bovis subsp bovis AF2122/97
gugucggcgagggcgc

SEQ ID NO: 1174512 - RNA, 22 nt, Mycobacterium bovis subsp bovis AF2122/97
gugucugcccgagguccgcccu

SEQ ID NO: 1174513 - RNA, 17 nt, Mycobacterium bovis subsp bovis AF2122/97
guggggguccggcggcc

SEQ ID NO: 1174514 - RNA, 21 nt, Mycobacterium bovis subsp bovis AF2122/97
gugggggugguaccggcggcg

SEQ ID NO: 1174515 - RNA, 19 nt, Mycobacterium bovis subsp bovis AF2122/97
guggggccggcgucgauga

SEQ ID NO: 1174516 - RNA, 17 nt, Mycobacterium bovis subsp bovis AF2122/97
gugggugaagagaaguc

SEQ ID NO: 1174517 - RNA, 13 nt, Mycobacterium bovis subsp bovis AF2122/97
gugggugaggcca

SEQ ID NO: 1174518 - RNA, 18 nt, Mycobacterium bovis subsp bovis AF2122/97
guggugguugaucagcca

SEQ ID NO: 1174519 - RNA, 20 nt, Mycobacterium bovis subsp bovis AF2122/97
gugguguaucgacggcggcc

SEQ ID NO: 1174520 - RNA, 17 nt, Mycobacterium bovis subsp bovis AF2122/97
gugguguuccaggucau

SEQ ID NO: 1174521 - RNA, 15 nt, Mycobacterium bovis subsp bovis AF2122/97
gugguguucuccugc

SEQ ID NO: 1174522 - RNA, 18 nt, Mycobacterium bovis subsp bovis AF2122/97
gugguuguaccagccgaa

SEQ ID NO: 1174523 - RNA, 16 nt, Mycobacterium bovis subsp bovis AF2122/97
gugguuguccacggcg

SEQ ID NO: 1174524 - RNA, 15 nt, Mycobacterium bovis subsp bovis AF2122/97
gugugggggucaggg

SEQ ID NO: 1174525 - RNA, 21 nt, Mycobacterium bovis subsp bovis AF2122/97
guguggcuuugacugcugggg

SEQ ID NO: 1174526 - RNA, 22 nt, Mycobacterium bovis subsp bovis AF2122/97
guguggcuuugacugcuggggg

SEQ ID NO: 1174527 - RNA, 18 nt, Mycobacterium bovis subsp bovis AF2122/97
guguggccuugcgucauc

SEQ ID NO: 1174528 - RNA, 16 nt, Mycobacterium bovis subsp bovis AF2122/97
guguggugacagagcg

SEQ ID NO: 1174529 - RNA, 16 nt, Mycobacterium bovis subsp bovis AF2122/97
guguggucgguggcgg

SEQ ID NO: 1174530 - RNA, 20 nt, Mycobacterium bovis subsp bovis AF2122/97
guguguacacacgaugacgu

SEQ ID NO: 1174531 - RNA, 20 nt, Mycobacterium bovis subsp bovis AF2122/97
guguguggcgccggggacca

SEQ ID NO: 1174532 - RNA, 19 nt, Mycobacterium bovis subsp bovis AF2122/97
guguucuggcaacccccgc

SEQ ID NO: 1174533 - RNA, 20 nt, Mycobacterium bovis subsp bovis AF2122/97
guguucuaccugcacccagg

SEQ ID NO: 1174534 - RNA, 13 nt, Mycobacterium bovis subsp bovis AF2122/97
guguucuccugcc

SEQ ID NO: 1174535 - RNA, 13 nt, Mycobacterium bovis subsp bovis AF2122/97
guguucgccacac

SEQ ID NO: 1174536 - RNA, 17 nt, Mycobacterium bovis subsp bovis AF2122/97
guguucggagcugggcu

SEQ ID NO: 1174537 - RNA, 17 nt, Mycobacterium bovis subsp bovis AF2122/97
guguuauugaugcccga

SEQ ID NO: 1174538 - RNA, 15 nt, Mycobacterium bovis subsp bovis AF2122/97
gugugcgucuccagc

SEQ ID NO: 1174539 - RNA, 15 nt, Mycobacterium bovis subsp bovis AF2122/97
gugugcacgcgggcg

SEQ ID NO: 1174540 - RNA, 13 nt, Mycobacterium bovis subsp bovis AF2122/97
gugugcagcagca

SEQ ID NO: 1174541 - RNA, 19 nt, Mycobacterium bovis subsp bovis AF2122/97
gugugagucccacgccagc

SEQ ID NO: 1174542 - RNA, 15 nt, Mycobacterium bovis subsp bovis AF2122/97
gugugcuucgagcac

SEQ ID NO: 1174543 - RNA, 23 nt, Mycobacterium bovis subsp bovis AF2122/97
guguugcacguacgggcaguggu

SEQ ID NO: 1174544 - RNA, 14 nt, Mycobacterium bovis subsp bovis AF2122/97
guguugaccggguc

SEQ ID NO: 1174545 - RNA, 22 nt, Mycobacterium bovis subsp bovis AF2122/97
guguugagaucgcccgaguuga

SEQ ID NO: 1174546 - RNA, 20 nt, Mycobacterium bovis subsp bovis AF2122/97
guguugaggcguaccagcug

SEQ ID NO: 1174547 - RNA, 22 nt, Mycobacterium bovis subsp bovis AF2122/97
guguugauguugccggaguuga

SEQ ID NO: 1174548 - RNA, 16 nt, Mycobacterium bovis subsp bovis AF2122/97
guguugccgaagcccg

SEQ ID NO: 1174549 - RNA, 17 nt, Mycobacterium bovis subsp bovis AF2122/97
guguugagggugcccga

SEQ ID NO: 1174550 - RNA, 14 nt, Mycobacterium bovis subsp bovis AF2122/97
guguugagggugcc

SEQ ID NO: 1174551 - RNA, 18 nt, Mycobacterium bovis subsp bovis AF2122/97
guuaacacccugggcaaa

SEQ ID NO: 1174552 - RNA, 18 nt, Mycobacterium bovis subsp bovis AF2122/97
guuaaugacgccauuguu

SEQ ID NO: 1174553 - RNA, 15 nt, Mycobacterium bovis subsp bovis AF2122/97
guuacuggagauacc

SEQ ID NO: 1174554 - RNA, 22 nt, Mycobacterium bovis subsp bovis AF2122/97
guuaggcgauaucgcacaugga

SEQ ID NO: 1174555 - RNA, 21 nt, Mycobacterium bovis subsp bovis AF2122/97
guuaccgccaaacgcugcgcc

SEQ ID NO: 1174556 - RNA, 21 nt, Mycobacterium bovis subsp bovis AF2122/97
guuaccgccggcgccggugcc

SEQ ID NO: 1174557 - RNA, 13 nt, Mycobacterium bovis subsp bovis AF2122/97
guuacccaucgcc

SEQ ID NO: 1174558 - RNA, 14 nt, Mycobacterium bovis subsp bovis AF2122/97
guuaggguccaggu

SEQ ID NO: 1174559 - RNA, 22 nt, Mycobacterium bovis subsp bovis AF2122/97
guuaugacgugaguuucaccac

SEQ ID NO: 1174560 - RNA, 19 nt, Mycobacterium bovis subsp bovis AF2122/97
guuccgaucgcguuagcca

SEQ ID NO: 1174561 - RNA, 13 nt, Mycobacterium bovis subsp bovis AF2122/97
guuccgcaaugac

SEQ ID NO: 1174562 - RNA, 19 nt, Mycobacterium bovis subsp bovis AF2122/97
guuccaucacggaccaggc

SEQ ID NO: 1174563 - RNA, 21 nt, Mycobacterium bovis subsp bovis AF2122/97
guuccaguuggaacugaugaa

SEQ ID NO: 1174564 - RNA, 16 nt, Mycobacterium bovis subsp bovis AF2122/97
guuccugcaagaacca

SEQ ID NO: 1174565 - RNA, 19 nt, Mycobacterium bovis subsp bovis AF2122/97
guuccgcugcggugccggc

SEQ ID NO: 1174566 - RNA, 21 nt, Mycobacterium bovis subsp bovis AF2122/97
guuccgcugcggugccggccc

SEQ ID NO: 1174567 - RNA, 16 nt, Mycobacterium bovis subsp bovis AF2122/97
guuccgccggccccac

SEQ ID NO: 1174568 - RNA, 21 nt, Mycobacterium bovis subsp bovis AF2122/97
guuccgccaggccgaccgcgc

SEQ ID NO: 1174569 - RNA, 22 nt, Mycobacterium bovis subsp bovis AF2122/97
guuccgccaggccgaccgcgca

SEQ ID NO: 1174570 - RNA, 11 nt, Mycobacterium bovis subsp bovis AF2122/97
guuccgccauu

SEQ ID NO: 1174571 - RNA, 15 nt, Mycobacterium bovis subsp bovis AF2122/97
guucgcgcaaaugcc

SEQ ID NO: 1174572 - RNA, 15 nt, Mycobacterium bovis subsp bovis AF2122/97
guucggcgugucggg

SEQ ID NO: 1174573 - RNA, 12 nt, Mycobacterium bovis subsp bovis AF2122/97
guucgggacgcg

SEQ ID NO: 1174574 - RNA, 20 nt, Mycobacterium bovis subsp bovis AF2122/97
guucggcgagcacaugcugc

SEQ ID NO: 1174575 - RNA, 16 nt, Mycobacterium bovis subsp bovis AF2122/97
guucggcggcugccag

SEQ ID NO: 1174576 - RNA, 14 nt, Mycobacterium bovis subsp bovis AF2122/97
guucggucuugccg

SEQ ID NO: 1174577 - RNA, 14 nt, Mycobacterium bovis subsp bovis AF2122/97
guucgggcagcacc

SEQ ID NO: 1174578 - RNA, 14 nt, Mycobacterium bovis subsp bovis AF2122/97
guucggucggggag

SEQ ID NO: 1174579 - RNA, 20 nt, Mycobacterium bovis subsp bovis AF2122/97
guucgggagcugaucacgca

SEQ ID NO: 1174580 - RNA, 14 nt, Mycobacterium bovis subsp bovis AF2122/97
guucgggguggugg

SEQ ID NO: 1174581 - RNA, 21 nt, Mycobacterium bovis subsp bovis AF2122/97
guucacgccagucccacuggg

SEQ ID NO: 1174582 - RNA, 17 nt, Mycobacterium bovis subsp bovis AF2122/97
guucacggggaccagau

SEQ ID NO: 1174583 - RNA, 20 nt, Mycobacterium bovis subsp bovis AF2122/97
guucagcgcuggcaggccgg

SEQ ID NO: 1174584 - RNA, 17 nt, Mycobacterium bovis subsp bovis AF2122/97
guucagcgaccaaugca

SEQ ID NO: 1174585 - RNA, 15 nt, Mycobacterium bovis subsp bovis AF2122/97
guucaccgaggugcc

SEQ ID NO: 1174586 - RNA, 21 nt, Mycobacterium bovis subsp bovis AF2122/97
guucaccgaggugccgcgcag

SEQ ID NO: 1174587 - RNA, 19 nt, Mycobacterium bovis subsp bovis AF2122/97
guucagcgcuggcaggccg

SEQ ID NO: 1174588 - RNA, 18 nt, Mycobacterium bovis subsp bovis AF2122/97
guucauccgcaguccggg

SEQ ID NO: 1174589 - RNA, 21 nt, Mycobacterium bovis subsp bovis AF2122/97
guucaucgcagucauguccau

SEQ ID NO: 1174590 - RNA, 20 nt, Mycobacterium bovis subsp bovis AF2122/97
guuccacccggugccgcagc

SEQ ID NO: 1174591 - RNA, 15 nt, Mycobacterium bovis subsp bovis AF2122/97
guuccacaccaggcc

SEQ ID NO: 1174592 - RNA, 19 nt, Mycobacterium bovis subsp bovis AF2122/97
guuccacaccaggccgagc

SEQ ID NO: 1174593 - RNA, 15 nt, Mycobacterium bovis subsp bovis AF2122/97
guucaugcggcggcg

SEQ ID NO: 1174594 - RNA, 17 nt, Mycobacterium bovis subsp bovis AF2122/97
guuccaguccccgccgg

SEQ ID NO: 1174595 - RNA, 19 nt, Mycobacterium bovis subsp bovis AF2122/97
guuccaccgcgcaggugcc

SEQ ID NO: 1174596 - RNA, 21 nt, Mycobacterium bovis subsp bovis AF2122/97
guuccacgagucgucguccga

SEQ ID NO: 1174597 - RNA, 20 nt, Mycobacterium bovis subsp bovis AF2122/97
guugaggccggugaacggua

SEQ ID NO: 1174598 - RNA, 20 nt, Mycobacterium bovis subsp bovis AF2122/97
guugaggccgucgaacggua

SEQ ID NO: 1174599 - RNA, 15 nt, Mycobacterium bovis subsp bovis AF2122/97
guugagcauaugacg

SEQ ID NO: 1174600 - RNA, 13 nt, Mycobacterium bovis subsp bovis AF2122/97
guucucggugcgc

SEQ ID NO: 1174601 - RNA, 16 nt, Mycobacterium bovis subsp bovis AF2122/97
guugcgcaagcuggua

SEQ ID NO: 1174602 - RNA, 17 nt, Mycobacterium bovis subsp bovis AF2122/97
guugcgaccauccgagu

SEQ ID NO: 1174603 - RNA, 19 nt, Mycobacterium bovis subsp bovis AF2122/97
guugccugcgcgagugcca

SEQ ID NO: 1174604 - RNA, 14 nt, Mycobacterium bovis subsp bovis AF2122/97
guugccggcggcga

SEQ ID NO: 1174605 - RNA, 20 nt, Mycobacterium bovis subsp bovis AF2122/97
guugccgcugaauuggcgcc

SEQ ID NO: 1174606 - RNA, 22 nt, Mycobacterium bovis subsp bovis AF2122/97
guugccgcgaucgggcccagca

SEQ ID NO: 1174607 - RNA, 15 nt, Mycobacterium bovis subsp bovis AF2122/97
guugcagaccgggug

SEQ ID NO: 1174608 - RNA, 15 nt, Mycobacterium bovis subsp bovis AF2122/97
guugcacggccggga

SEQ ID NO: 1174609 - RNA, 21 nt, Mycobacterium bovis subsp bovis AF2122/97
guugcacugcucguugaugaa

SEQ ID NO: 1174610 - RNA, 18 nt, Mycobacterium bovis subsp bovis AF2122/97
guugcuggcgcccccgcc

SEQ ID NO: 1174611 - RNA, 15 nt, Mycobacterium bovis subsp bovis AF2122/97
guugcuggucgccgu

SEQ ID NO: 1174612 - RNA, 16 nt, Mycobacterium bovis subsp bovis AF2122/97
guugcguuccaguccc

SEQ ID NO: 1174613 - RNA, 14 nt, Mycobacterium bovis subsp bovis AF2122/97
guugcggugugccg

SEQ ID NO: 1174614 - RNA, 17 nt, Mycobacterium bovis subsp bovis AF2122/97
guugcgcgaugggagcc

SEQ ID NO: 1174615 - RNA, 21 nt, Mycobacterium bovis subsp bovis AF2122/97
guugcgccauaacaccgggua

SEQ ID NO: 1174616 - RNA, 21 nt, Mycobacterium bovis subsp bovis AF2122/97
guugcggcugcguuggcuggu

SEQ ID NO: 1174617 - RNA, 15 nt, Mycobacterium bovis subsp bovis AF2122/97
guugcggcuggcgcc

SEQ ID NO: 1174618 - RNA, 13 nt, Mycobacterium bovis subsp bovis AF2122/97
guugcgggccagg

SEQ ID NO: 1174619 - RNA, 15 nt, Mycobacterium bovis subsp bovis AF2122/97
guugcgggccaggcc

SEQ ID NO: 1174620 - RNA, 16 nt, Mycobacterium bovis subsp bovis AF2122/97
guugcgggccaggccc

SEQ ID NO: 1174621 - RNA, 16 nt, Mycobacterium bovis subsp bovis AF2122/97
guuggugcuggccuug

SEQ ID NO: 1174622 - RNA, 21 nt, Mycobacterium bovis subsp bovis AF2122/97
guugguucagcucgaggacca

SEQ ID NO: 1174623 - RNA, 13 nt, Mycobacterium bovis subsp bovis AF2122/97
guuggugaugccg

SEQ ID NO: 1174624 - RNA, 19 nt, Mycobacterium bovis subsp bovis AF2122/97
guuggugcagaccaccgcc

SEQ ID NO: 1174625 - RNA, 18 nt, Mycobacterium bovis subsp bovis AF2122/97
guuguaaaucuccucgga

SEQ ID NO: 1174626 - RNA, 14 nt, Mycobacterium bovis subsp bovis AF2122/97
guuggcucgcuggg

SEQ ID NO: 1174627 - RNA, 21 nt, Mycobacterium bovis subsp bovis AF2122/97
guugguagagcaccagguugu

SEQ ID NO: 1174628 - RNA, 18 nt, Mycobacterium bovis subsp bovis AF2122/97
guugguauuagggccggc

SEQ ID NO: 1174629 - RNA, 19 nt, Mycobacterium bovis subsp bovis AF2122/97
guuggucggcugauuggcc

SEQ ID NO: 1174630 - RNA, 14 nt, Mycobacterium bovis subsp bovis AF2122/97
guuggucggugcug

SEQ ID NO: 1174631 - RNA, 16 nt, Mycobacterium bovis subsp bovis AF2122/97
guuggcgugcaccgca

SEQ ID NO: 1174632 - RNA, 22 nt, Mycobacterium bovis subsp bovis AF2122/97
guuggcggccucgggcucaaac

SEQ ID NO: 1174633 - RNA, 21 nt, Mycobacterium bovis subsp bovis AF2122/97
guuggcggcggucggcugggc

SEQ ID NO: 1174634 - RNA, 12 nt, Mycobacterium bovis subsp bovis AF2122/97
guuggcggcugc

SEQ ID NO: 1174635 - RNA, 16 nt, Mycobacterium bovis subsp bovis AF2122/97
guuggcgaucaucagg

SEQ ID NO: 1174636 - RNA, 14 nt, Mycobacterium bovis subsp bovis AF2122/97
guuggcgaagcccg

SEQ ID NO: 1174637 - RNA, 18 nt, Mycobacterium bovis subsp bovis AF2122/97
guuggccgagcagggccg

SEQ ID NO: 1174638 - RNA, 14 nt, Mycobacterium bovis subsp bovis AF2122/97
guuggccucgagcg

SEQ ID NO: 1174639 - RNA, 19 nt, Mycobacterium bovis subsp bovis AF2122/97
guuggccucgagcgcugug

SEQ ID NO: 1174640 - RNA, 20 nt, Mycobacterium bovis subsp bovis AF2122/97
guugucagcgaacggccagg

SEQ ID NO: 1174641 - RNA, 17 nt, Mycobacterium bovis subsp bovis AF2122/97
guuuacggcccggcacc

SEQ ID NO: 1174642 - RNA, 20 nt, Mycobacterium bovis subsp bovis AF2122/97
guuuccaagucggagcgggg

SEQ ID NO: 1174643 - RNA, 16 nt, Mycobacterium bovis subsp bovis AF2122/97
guuucacauuuuuguu

SEQ ID NO: 1174644 - RNA, 17 nt, Mycobacterium bovis subsp bovis AF2122/97
guuucacauuuuuguug

SEQ ID NO: 1174645 - RNA, 22 nt, Mycobacterium bovis subsp bovis AF2122/97
aaauauuggcccgucacgcccg

SEQ ID NO: 1174646 - RNA, 15 nt, Mycobacterium bovis subsp bovis AF2122/97
guuuccucagcugcu

SEQ ID NO: 1174647 - RNA, 16 nt, Mycobacterium bovis subsp bovis AF2122/97
guuuccucagcugcuc

SEQ ID NO: 1174648 - RNA, 14 nt, Mycobacterium bovis subsp bovis AF2122/97
guuuccgaagcccg

SEQ ID NO: 1174649 - RNA, 14 nt, Mycobacterium bovis subsp bovis AF2122/97
guuucgaucucgag

SEQ ID NO: 1174650 - RNA, 20 nt, Mycobacterium bovis subsp bovis AF2122/97
guuucggcgcaugugaaaga

SEQ ID NO: 1174651 - RNA, 20 nt, Mycobacterium bovis subsp bovis AF2122/97
aaaucaagcacagcccggcu

SEQ ID NO: 1174652 - RNA, 12 nt, Mycobacterium bovis subsp bovis AF2122/97
aaaucaagcaca

SEQ ID NO: 1174653 - RNA, 20 nt, Mycobacterium bovis subsp bovis AF2122/97
guuugaucaccgugguggcg

SEQ ID NO: 1174654 - RNA, 20 nt, Mycobacterium bovis subsp bovis AF2122/97
guuugagcgcacucaccuug

SEQ ID NO: 1174655 - RNA, 23 nt, Mycobacterium bovis subsp bovis AF2122/97
guuugaggcagcguagugcugcg

SEQ ID NO: 1174656 - RNA, 14 nt, Mycobacterium bovis subsp bovis AF2122/97
guuugccgguucgg

SEQ ID NO: 1174657 - RNA, 15 nt, Mycobacterium bovis subsp bovis AF2122/97
guuugacgccgauga

SEQ ID NO: 1174658 - RNA, 19 nt, Mycobacterium bovis subsp bovis AF2122/97
guuugacguccagggccac

SEQ ID NO: 1174659 - RNA, 21 nt, Mycobacterium bovis subsp bovis AF2122/97
guuugacugcgaccgguucgg

SEQ ID NO: 1174660 - RNA, 15 nt, Mycobacterium bovis subsp bovis AF2122/97
guuugagaccccaac

SEQ ID NO: 1174661 - RNA, 14 nt, Mycobacterium bovis subsp bovis AF2122/97
guuucugaagcccg

SEQ ID NO: 1174662 - RNA, 15 nt, Mycobacterium bovis subsp bovis AF2122/97
guuucugaagcccga

SEQ ID NO: 1174663 - RNA, 14 nt, Mycobacterium bovis subsp bovis AF2122/97
guuugcgaagccca

SEQ ID NO: 1174664 - RNA, 19 nt, Mycobacterium bovis subsp bovis AF2122/97
guuuggaccgcugaugacc

SEQ ID NO: 1174665 - RNA, 23 nt, Mycobacterium bovis subsp bovis AF2122/97
aaauccaaaccuuugauucuaac

SEQ ID NO: 1174666 - RNA, 22 nt, Mycobacterium bovis subsp bovis AF2122/97
gcggucagcagcgccgucagca

SEQ ID NO: 1174667 - RNA, 13 nt, Mycobacterium bovis subsp bovis AF2122/97
gcgguaucggcau

SEQ ID NO: 1174668 - RNA, 17 nt, Mycobacterium bovis subsp bovis AF2122/97
gcucaucgaccgcggcc

SEQ ID NO: 1174669 - RNA, 20 nt, Mycobacterium bovis subsp bovis AF2122/97
gcucaucgaccgcggccggg

SEQ ID NO: 1174670 - RNA, 18 nt, Mycobacterium bovis subsp bovis AF2122/97
gcucauccagcgcgugga

SEQ ID NO: 1174671 - RNA, 17 nt, Mycobacterium bovis subsp bovis AF2122/97
gcggucaccgacgcaga

SEQ ID NO: 1174672 - RNA, 19 nt, Mycobacterium bovis subsp bovis AF2122/97
gcggucaaauccagcagcc

SEQ ID NO: 1174673 - RNA, 22 nt, Mycobacterium bovis subsp bovis AF2122/97
gcgguaguugucccgccgcgcg

SEQ ID NO: 1174674 - RNA, 19 nt, Mycobacterium bovis subsp bovis AF2122/97
gcgguaguugucccgccgc

SEQ ID NO: 1174675 - RNA, 16 nt, Mycobacterium bovis subsp bovis AF2122/97
gcgguaagggcgggcu

SEQ ID NO: 1174676 - RNA, 17 nt, Mycobacterium bovis subsp bovis AF2122/97
gcgguaaugccagcggc

SEQ ID NO: 1174677 - RNA, 21 nt, Mycobacterium bovis subsp bovis AF2122/97
gcuccaacgauggaacgggcg

SEQ ID NO: 1174678 - RNA, 18 nt, Mycobacterium bovis subsp bovis AF2122/97
gcuccaauugcggccgcg

SEQ ID NO: 1174679 - RNA, 22 nt, Mycobacterium bovis subsp bovis AF2122/97
gcuccaauccuuugccagccac

SEQ ID NO: 1174680 - RNA, 20 nt, Mycobacterium bovis subsp bovis AF2122/97
gcucaucuguaaccuccucg

SEQ ID NO: 1174681 - RNA, 17 nt, Mycobacterium bovis subsp bovis AF2122/97
gcucaucgaccggggcu

SEQ ID NO: 1174682 - RNA, 21 nt, Mycobacterium bovis subsp bovis AF2122/97
gcucaucgaccggggcuuggg

SEQ ID NO: 1174683 - RNA, 14 nt, Mycobacterium bovis subsp bovis AF2122/97
gcucaucgaucccg

SEQ ID NO: 1174684 - RNA, 17 nt, Mycobacterium bovis subsp bovis AF2122/97
gcuccaaaagccucagc

SEQ ID NO: 1174685 - RNA, 22 nt, Mycobacterium bovis subsp bovis AF2122/97
gcuccaacagguaagccacaua

SEQ ID NO: 1174686 - RNA, 19 nt, Mycobacterium bovis subsp bovis AF2122/97
gcuccaugacaaaccugca

SEQ ID NO: 1174687 - RNA, 23 nt, Mycobacterium bovis subsp bovis AF2122/97
gcucccggcgucuuaccugaagc

SEQ ID NO: 1174688 - RNA, 17 nt, Mycobacterium bovis subsp bovis AF2122/97
gcuccgcccauucccag

SEQ ID NO: 1174689 - RNA, 15 nt, Mycobacterium bovis subsp bovis AF2122/97
gcuccgauuccgaac

SEQ ID NO: 1174690 - RNA, 17 nt, Mycobacterium bovis subsp bovis AF2122/97
gcucccuauugcugcgg

SEQ ID NO: 1174691 - RNA, 23 nt, Mycobacterium bovis subsp bovis AF2122/97
gcucccgguugggguggcggugc

SEQ ID NO: 1174692 - RNA, 16 nt, Mycobacterium bovis subsp bovis AF2122/97
gcucccguacgccggc

SEQ ID NO: 1174693 - RNA, 15 nt, Mycobacterium bovis subsp bovis AF2122/97
gcuccgaccgguggc

SEQ ID NO: 1174694 - RNA, 20 nt, Mycobacterium bovis subsp bovis AF2122/97
gcuccgacgaaacucucccg

SEQ ID NO: 1174695 - RNA, 18 nt, Mycobacterium bovis subsp bovis AF2122/97
gcuccuccgguaucggcg

SEQ ID NO: 1174696 - RNA, 13 nt, Mycobacterium bovis subsp bovis AF2122/97
gcuccucagccac

SEQ ID NO: 1174697 - RNA, 23 nt, Mycobacterium bovis subsp bovis AF2122/97
gcuccuaucacuggacucuucgg

SEQ ID NO: 1174698 - RNA, 20 nt, Mycobacterium bovis subsp bovis AF2122/97
gcuccuauggcaagcggccg

SEQ ID NO: 1174699 - RNA, 13 nt, Mycobacterium bovis subsp bovis AF2122/97
gcuccgucgccga

SEQ ID NO: 1174700 - RNA, 23 nt, Mycobacterium bovis subsp bovis AF2122/97
gcuccgucgccgaacagugcggu

SEQ ID NO: 1174701 - RNA, 21 nt, Mycobacterium bovis subsp bovis AF2122/97
gcuccguggugcuagcgccgc

SEQ ID NO: 1174702 - RNA, 17 nt, Mycobacterium bovis subsp bovis AF2122/97
gcuccguuguccagcgc

SEQ ID NO: 1174703 - RNA, 18 nt, Mycobacterium bovis subsp bovis AF2122/97
gcuccgcgcagccaggga

SEQ ID NO: 1174704 - RNA, 22 nt, Mycobacterium bovis subsp bovis AF2122/97
gcuccgccggguuggcgccggc

SEQ ID NO: 1174705 - RNA, 21 nt, Mycobacterium bovis subsp bovis AF2122/97
gcuccggacaccccgcacgga

SEQ ID NO: 1174706 - RNA, 14 nt, Mycobacterium bovis subsp bovis AF2122/97
gcuccggauugcug

SEQ ID NO: 1174707 - RNA, 14 nt, Mycobacterium bovis subsp bovis AF2122/97
gcuccggccgcguu

SEQ ID NO: 1174708 - RNA, 16 nt, Mycobacterium bovis subsp bovis AF2122/97
gcuccggccggccagc

SEQ ID NO: 1174709 - RNA, 20 nt, Mycobacterium bovis subsp bovis AF2122/97
gcuccggccggccagcaccc

SEQ ID NO: 1174710 - RNA, 22 nt, Mycobacterium bovis subsp bovis AF2122/97
gcuccggcccugccgccggccc

SEQ ID NO: 1174711 - RNA, 17 nt, Mycobacterium bovis subsp bovis AF2122/97
gcuccggccgcacgccu

SEQ ID NO: 1174712 - RNA, 19 nt, Mycobacterium bovis subsp bovis AF2122/97
gcuccucggucagcggggu

SEQ ID NO: 1174713 - RNA, 18 nt, Mycobacterium bovis subsp bovis AF2122/97
gcuccucgugcacgcaca

SEQ ID NO: 1174714 - RNA, 20 nt, Mycobacterium bovis subsp bovis AF2122/97
gcuccuguaacugcuccugg

SEQ ID NO: 1174715 - RNA, 16 nt, Mycobacterium bovis subsp bovis AF2122/97
gcuccugcguccagau

SEQ ID NO: 1174716 - RNA, 22 nt, Mycobacterium bovis subsp bovis AF2122/97
gcucgaacuccccggucgccgc

SEQ ID NO: 1174717 - RNA, 21 nt, Mycobacterium bovis subsp bovis AF2122/97
gcucgaaauccugguggcaga

SEQ ID NO: 1174718 - RNA, 24 nt, Mycobacterium bovis subsp bovis AF2122/97
gcucgaaauccugguggcagacau

SEQ ID NO: 1174719 - RNA, 16 nt, Mycobacterium bovis subsp bovis AF2122/97
gcuccuuggcccagcg

SEQ ID NO: 1174720 - RNA, 24 nt, Mycobacterium bovis subsp bovis AF2122/97
gcuccuuggcuaacaccgcaggca

SEQ ID NO: 1174721 - RNA, 13 nt, Mycobacterium bovis subsp bovis AF2122/97
gcucgaccaggaa

SEQ ID NO: 1174722 - RNA, 15 nt, Mycobacterium bovis subsp bovis AF2122/97
gcucgacgacgggcg

SEQ ID NO: 1174723 - RNA, 13 nt, Mycobacterium bovis subsp bovis AF2122/97
gcucgacaacugc

SEQ ID NO: 1174724 - RNA, 14 nt, Mycobacterium bovis subsp bovis AF2122/97
gcucgaagcccgga

SEQ ID NO: 1174725 - RNA, 17 nt, Mycobacterium bovis subsp bovis AF2122/97
gcucgacggcccgccgu

SEQ ID NO: 1174726 - RNA, 20 nt, Mycobacterium bovis subsp bovis AF2122/97
gcucgacguauuggcgcagc

SEQ ID NO: 1174727 - RNA, 15 nt, Mycobacterium bovis subsp bovis AF2122/97
gcucgauacggcccu

SEQ ID NO: 1174728 - RNA, 20 nt, Mycobacterium bovis subsp bovis AF2122/97
gcucgaucugucgcgccggu

SEQ ID NO: 1174729 - RNA, 20 nt, Mycobacterium bovis subsp bovis AF2122/97
gcucgaucaucgggagccgc

SEQ ID NO: 1174730 - RNA, 15 nt, Mycobacterium bovis subsp bovis AF2122/97
gcucgaucagccggg

SEQ ID NO: 1174731 - RNA, 21 nt, Mycobacterium bovis subsp bovis AF2122/97
gcucgcccgcuacggcagccc

SEQ ID NO: 1174732 - RNA, 13 nt, Mycobacterium bovis subsp bovis AF2122/97
gcucgcccgccgc

SEQ ID NO: 1174733 - RNA, 14 nt, Mycobacterium bovis subsp bovis AF2122/97
gcucgcccagugaa

SEQ ID NO: 1174734 - RNA, 23 nt, Mycobacterium bovis subsp bovis AF2122/97
gcucgccaggcaagccagcacug

SEQ ID NO: 1174735 - RNA, 17 nt, Mycobacterium bovis subsp bovis AF2122/97
gcucgcauucggcgagc

SEQ ID NO: 1174736 - RNA, 13 nt, Mycobacterium bovis subsp bovis AF2122/97
gcucgccaggcaa

SEQ ID NO: 1174737 - RNA, 17 nt, Mycobacterium bovis subsp bovis AF2122/97
gcucgcaggccggcggc

SEQ ID NO: 1174738 - RNA, 23 nt, Mycobacterium bovis subsp bovis AF2122/97
gcucgaugucagcggccgcgacg

SEQ ID NO: 1174739 - RNA, 21 nt, Mycobacterium bovis subsp bovis AF2122/97
gcucgcacccgcucggcgcgc

SEQ ID NO: 1174740 - RNA, 21 nt, Mycobacterium bovis subsp bovis AF2122/97
gcucgcacucguugccgacca

SEQ ID NO: 1174741 - RNA, 13 nt, Mycobacterium bovis subsp bovis AF2122/97
gcucgccguggug

SEQ ID NO: 1174742 - RNA, 15 nt, Mycobacterium bovis subsp bovis AF2122/97
gcucgccguggugga

SEQ ID NO: 1174743 - RNA, 16 nt, Mycobacterium bovis subsp bovis AF2122/97
gcucgccgggucagcc

SEQ ID NO: 1174744 - RNA, 19 nt, Mycobacterium bovis subsp bovis AF2122/97
gcucgccgguguccuuggc

SEQ ID NO: 1174745 - RNA, 21 nt, Mycobacterium bovis subsp bovis AF2122/97
gcucgccgguguccuuggccg

SEQ ID NO: 1174746 - RNA, 23 nt, Mycobacterium bovis subsp bovis AF2122/97
gcucgccguaagcaccagccagc

SEQ ID NO: 1174747 - RNA, 15 nt, Mycobacterium bovis subsp bovis AF2122/97
gcucgcgaaggggcg

SEQ ID NO: 1174748 - RNA, 21 nt, Mycobacterium bovis subsp bovis AF2122/97
gcucgcgaggcucgcguggcc

SEQ ID NO: 1174749 - RNA, 21 nt, Mycobacterium bovis subsp bovis AF2122/97
gcucgccuaucgacucaguca

SEQ ID NO: 1174750 - RNA, 13 nt, Mycobacterium bovis subsp bovis AF2122/97
gcucgcggugggc

SEQ ID NO: 1174751 - RNA, 18 nt, Mycobacterium bovis subsp bovis AF2122/97
gcucgccggccaacuggg

SEQ ID NO: 1174752 - RNA, 23 nt, Mycobacterium bovis subsp bovis AF2122/97
gcucgccgggcuuaggccgcggc

SEQ ID NO: 1174753 - RNA, 15 nt, Mycobacterium bovis subsp bovis AF2122/97
gcucgccgagcugug

SEQ ID NO: 1174754 - RNA, 18 nt, Mycobacterium bovis subsp bovis AF2122/97
gcucgguccccgcagcuc

SEQ ID NO: 1174755 - RNA, 16 nt, Mycobacterium bovis subsp bovis AF2122/97
gcucgggucgugcgug

SEQ ID NO: 1174756 - RNA, 16 nt, Mycobacterium bovis subsp bovis AF2122/97
gcucgggggcgccggc

SEQ ID NO: 1174757 - RNA, 21 nt, Mycobacterium bovis subsp bovis AF2122/97
gcucgcugaucuggggcacca

SEQ ID NO: 1174758 - RNA, 15 nt, Mycobacterium bovis subsp bovis AF2122/97
gcucgcugcgcgccc

SEQ ID NO: 1174759 - RNA, 23 nt, Mycobacterium bovis subsp bovis AF2122/97
gcucgcugcgcgcccaccgggcg

SEQ ID NO: 1174760 - RNA, 14 nt, Mycobacterium bovis subsp bovis AF2122/97
gcucgcugcaccag

SEQ ID NO: 1174761 - RNA, 18 nt, Mycobacterium bovis subsp bovis AF2122/97
gcucguggguaccgagca

SEQ ID NO: 1174762 - RNA, 15 nt, Mycobacterium bovis subsp bovis AF2122/97
gcucguggcgacggc

SEQ ID NO: 1174763 - RNA, 17 nt, Mycobacterium bovis subsp bovis AF2122/97
gcucguggucgacguga

SEQ ID NO: 1174764 - RNA, 17 nt, Mycobacterium bovis subsp bovis AF2122/97
gcucggugcacggcgcu

SEQ ID NO: 1174765 - RNA, 15 nt, Mycobacterium bovis subsp bovis AF2122/97
gcucgucgagcgcgu

SEQ ID NO: 1174766 - RNA, 22 nt, Mycobacterium bovis subsp bovis AF2122/97
gcucgucgagcgcgucggucac

SEQ ID NO: 1174767 - RNA, 16 nt, Mycobacterium bovis subsp bovis AF2122/97
gcucgucgaucuccuc

SEQ ID NO: 1174768 - RNA, 20 nt, Mycobacterium bovis subsp bovis AF2122/97
gcucggugaugcccagcgcc

SEQ ID NO: 1174769 - RNA, 19 nt, Mycobacterium bovis subsp bovis AF2122/97
gcucgguccuugccguaga

SEQ ID NO: 1174770 - RNA, 17 nt, Mycobacterium bovis subsp bovis AF2122/97
gcucggucuccaccacc

SEQ ID NO: 1174771 - RNA, 16 nt, Mycobacterium bovis subsp bovis AF2122/97
gcucgugagccccagc

SEQ ID NO: 1174772 - RNA, 20 nt, Mycobacterium bovis subsp bovis AF2122/97
gcucgugagccccagcgacg

SEQ ID NO: 1174773 - RNA, 21 nt, Mycobacterium bovis subsp bovis AF2122/97
gcucgucggcgauggccagca

SEQ ID NO: 1174774 - RNA, 23 nt, Mycobacterium bovis subsp bovis AF2122/97
gcucgucgcugaacagacggcuc

SEQ ID NO: 1174775 - RNA, 13 nt, Mycobacterium bovis subsp bovis AF2122/97
gcucgucgcggcc

SEQ ID NO: 1174776 - RNA, 20 nt, Mycobacterium bovis subsp bovis AF2122/97
gcucgucguacaugggcaga

SEQ ID NO: 1174777 - RNA, 21 nt, Mycobacterium bovis subsp bovis AF2122/97
gcucgucgucgauccagccca

SEQ ID NO: 1174778 - RNA, 22 nt, Mycobacterium bovis subsp bovis AF2122/97
gcucgucuaccccgagccuuga

SEQ ID NO: 1174779 - RNA, 20 nt, Mycobacterium bovis subsp bovis AF2122/97
gcugagcccguuuccucagc

SEQ ID NO: 1174780 - RNA, 18 nt, Mycobacterium bovis subsp bovis AF2122/97
gcugagccgcaucuggcc

SEQ ID NO: 1174781 - RNA, 20 nt, Mycobacterium bovis subsp bovis AF2122/97
gcugagccgcaucuggccgg

SEQ ID NO: 1174782 - RNA, 17 nt, Mycobacterium bovis subsp bovis AF2122/97
gcugagcaccugagccu

SEQ ID NO: 1174783 - RNA, 19 nt, Mycobacterium bovis subsp bovis AF2122/97
gcugagcaccugagccuca

SEQ ID NO: 1174784 - RNA, 21 nt, Mycobacterium bovis subsp bovis AF2122/97
gcugauagcggucggucacca

SEQ ID NO: 1174785 - RNA, 17 nt, Mycobacterium bovis subsp bovis AF2122/97
gcugagccgucggcgcc

SEQ ID NO: 1174786 - RNA, 12 nt, Mycobacterium bovis subsp bovis AF2122/97
gcugauccaagu

SEQ ID NO: 1174787 - RNA, 22 nt, Mycobacterium bovis subsp bovis AF2122/97
gcugaucaggucuucgauggcc

SEQ ID NO: 1174788 - RNA, 15 nt, Mycobacterium bovis subsp bovis AF2122/97
gcugaucgcgcgcac

SEQ ID NO: 1174789 - RNA, 16 nt, Mycobacterium bovis subsp bovis AF2122/97
gcugauccgggcgccg

SEQ ID NO: 1174790 - RNA, 17 nt, Mycobacterium bovis subsp bovis AF2122/97
gcugaucccggccaggc

SEQ ID NO: 1174791 - RNA, 23 nt, Mycobacterium bovis subsp bovis AF2122/97
gcugauugcgaccgcgccaacag

SEQ ID NO: 1174792 - RNA, 14 nt, Mycobacterium bovis subsp bovis AF2122/97
gcugcagcagaccc

SEQ ID NO: 1174793 - RNA, 12 nt, Mycobacterium bovis subsp bovis AF2122/97
gcugcagcgaga

SEQ ID NO: 1174794 - RNA, 15 nt, Mycobacterium bovis subsp bovis AF2122/97
gcugcaaugacugga

SEQ ID NO: 1174795 - RNA, 15 nt, Mycobacterium bovis subsp bovis AF2122/97
gcugcacguggccac

SEQ ID NO: 1174796 - RNA, 19 nt, Mycobacterium bovis subsp bovis AF2122/97
gcugcagacccguucgccg

SEQ ID NO: 1174797 - RNA, 14 nt, Mycobacterium bovis subsp bovis AF2122/97
gcugccacccaucg

SEQ ID NO: 1174798 - RNA, 15 nt, Mycobacterium bovis subsp bovis AF2122/97
gcugccacccaucgc

SEQ ID NO: 1174799 - RNA, 20 nt, Mycobacterium bovis subsp bovis AF2122/97
gcugccaaacuaacggcagc

SEQ ID NO: 1174800 - RNA, 22 nt, Mycobacterium bovis subsp bovis AF2122/97
gcugcaaccgacuucgauggug

SEQ ID NO: 1174801 - RNA, 23 nt, Mycobacterium bovis subsp bovis AF2122/97
gcugcaacgauugaacucuggug

SEQ ID NO: 1174802 - RNA, 17 nt, Mycobacterium bovis subsp bovis AF2122/97
gcugcaacggagcgagc

SEQ ID NO: 1174803 - RNA, 13 nt, Mycobacterium bovis subsp bovis AF2122/97
gcugaacgcgagc

SEQ ID NO: 1174804 - RNA, 19 nt, Mycobacterium bovis subsp bovis AF2122/97
gcugaacgggaugaauuca

SEQ ID NO: 1174805 - RNA, 22 nt, Mycobacterium bovis subsp bovis AF2122/97
gcugaagcuguaggcgaccaga

SEQ ID NO: 1174806 - RNA, 22 nt, Mycobacterium bovis subsp bovis AF2122/97
gcugaaggccgguagcgcgggu

SEQ ID NO: 1174807 - RNA, 21 nt, Mycobacterium bovis subsp bovis AF2122/97
gcugaaguggcacaagcuggg

SEQ ID NO: 1174808 - RNA, 21 nt, Mycobacterium bovis subsp bovis AF2122/97
gcucucguguaucgagcggca

SEQ ID NO: 1174809 - RNA, 21 nt, Mycobacterium bovis subsp bovis AF2122/97
gcucucggucaguuccucuac

SEQ ID NO: 1174810 - RNA, 18 nt, Mycobacterium bovis subsp bovis AF2122/97
gcucucguggauggccgc

SEQ ID NO: 1174811 - RNA, 22 nt, Mycobacterium bovis subsp bovis AF2122/97
gcucucguggauggccgccagg

SEQ ID NO: 1174812 - RNA, 16 nt, Mycobacterium bovis subsp bovis AF2122/97
gcucucggucaguucc

SEQ ID NO: 1174813 - RNA, 14 nt, Mycobacterium bovis subsp bovis AF2122/97
gcucucgaguccag

SEQ ID NO: 1174814 - RNA, 20 nt, Mycobacterium bovis subsp bovis AF2122/97
gcugaccguggcgccggucg

SEQ ID NO: 1174815 - RNA, 16 nt, Mycobacterium bovis subsp bovis AF2122/97
gcugacgauggccagg

SEQ ID NO: 1174816 - RNA, 14 nt, Mycobacterium bovis subsp bovis AF2122/97
gcugacgcccuccu

SEQ ID NO: 1174817 - RNA, 16 nt, Mycobacterium bovis subsp bovis AF2122/97
gcugacgcccuccugg

SEQ ID NO: 1174818 - RNA, 15 nt, Mycobacterium bovis subsp bovis AF2122/97
gcugacgauggccag

SEQ ID NO: 1174819 - RNA, 16 nt, Mycobacterium bovis subsp bovis AF2122/97
gcugaccuucaggccc

SEQ ID NO: 1174820 - RNA, 16 nt, Mycobacterium bovis subsp bovis AF2122/97
gcugaccugaaaaucc

SEQ ID NO: 1174821 - RNA, 14 nt, Mycobacterium bovis subsp bovis AF2122/97
gcugaccucccacc

SEQ ID NO: 1174822 - RNA, 21 nt, Mycobacterium bovis subsp bovis AF2122/97
gcugaccggggucggccugcg

SEQ ID NO: 1174823 - RNA, 23 nt, Mycobacterium bovis subsp bovis AF2122/97
gcugaauguugguuugccggcgg

SEQ ID NO: 1174824 - RNA, 16 nt, Mycobacterium bovis subsp bovis AF2122/97
gcugaauucggcgagc

SEQ ID NO: 1174825 - RNA, 18 nt, Mycobacterium bovis subsp bovis AF2122/97
gcugccgguggcggcggc

SEQ ID NO: 1174826 - RNA, 13 nt, Mycobacterium bovis subsp bovis AF2122/97
gcugccguaucca

SEQ ID NO: 1174827 - RNA, 19 nt, Mycobacterium bovis subsp bovis AF2122/97
gcugccuugauugccgcgu

SEQ ID NO: 1174828 - RNA, 19 nt, Mycobacterium bovis subsp bovis AF2122/97
gcugccuuggcgcggcacc

SEQ ID NO: 1174829 - RNA, 15 nt, Mycobacterium bovis subsp bovis AF2122/97
gcugcgagagcaccg

SEQ ID NO: 1174830 - RNA, 21 nt, Mycobacterium bovis subsp bovis AF2122/97
gcugcgagaucgcggcgaccc

SEQ ID NO: 1174831 - RNA, 19 nt, Mycobacterium bovis subsp bovis AF2122/97
gcugcgcaacaccaucagc

SEQ ID NO: 1174832 - RNA, 18 nt, Mycobacterium bovis subsp bovis AF2122/97
gcugcgaaagccacucgc

SEQ ID NO: 1174833 - RNA, 19 nt, Mycobacterium bovis subsp bovis AF2122/97
gcugcgcaccgccgcgcga

SEQ ID NO: 1174834 - RNA, 16 nt, Mycobacterium bovis subsp bovis AF2122/97
gcugcgcaacaccauc

SEQ ID NO: 1174835 - RNA, 18 nt, Mycobacterium bovis subsp bovis AF2122/97
gcugccagccauggccgc

SEQ ID NO: 1174836 - RNA, 12 nt, Mycobacterium bovis subsp bovis AF2122/97
gcugccagcggc

SEQ ID NO: 1174837 - RNA, 19 nt, Mycobacterium bovis subsp bovis AF2122/97
gcugccgcaccaaggccgc

SEQ ID NO: 1174838 - RNA, 23 nt, Mycobacterium bovis subsp bovis AF2122/97
gcugccgcaccaaggccgccugc

SEQ ID NO: 1174839 - RNA, 16 nt, Mycobacterium bovis subsp bovis AF2122/97
gcugccgagaucccag

SEQ ID NO: 1174840 - RNA, 23 nt, Mycobacterium bovis subsp bovis AF2122/97
gcugccgauacagcacauccagc

SEQ ID NO: 1174841 - RNA, 19 nt, Mycobacterium bovis subsp bovis AF2122/97
gcugccgaagcggccaccg

SEQ ID NO: 1174842 - RNA, 17 nt, Mycobacterium bovis subsp bovis AF2122/97
gcugccgauagcgcggc

SEQ ID NO: 1174843 - RNA, 18 nt, Mycobacterium bovis subsp bovis AF2122/97
gcugccgauagcgcggca

SEQ ID NO: 1174844 - RNA, 18 nt, Mycobacterium bovis subsp bovis AF2122/97
gcugccagaaugggcggc

SEQ ID NO: 1174845 - RNA, 16 nt, Mycobacterium bovis subsp bovis AF2122/97
gcugccacuuggacga

SEQ ID NO: 1174846 - RNA, 21 nt, Mycobacterium bovis subsp bovis AF2122/97
gcugccacccaucgcacggau

SEQ ID NO: 1174847 - RNA, 10 nt, Mycobacterium bovis subsp bovis AF2122/97
gcugccaccg

SEQ ID NO: 1174848 - RNA, 11 nt, Mycobacterium bovis subsp bovis AF2122/97
gcugccaccgg

SEQ ID NO: 1174849 - RNA, 13 nt, Mycobacterium bovis subsp bovis AF2122/97
gcugccaccggcc

SEQ ID NO: 1174850 - RNA, 15 nt, Mycobacterium bovis subsp bovis AF2122/97
gcugccaccggccgg

SEQ ID NO: 1174851 - RNA, 23 nt, Mycobacterium bovis subsp bovis AF2122/97
gcugccgcggccggcgugccagc

SEQ ID NO: 1174852 - RNA, 16 nt, Mycobacterium bovis subsp bovis AF2122/97
gcugccgcggcugcca

SEQ ID NO: 1174853 - RNA, 17 nt, Mycobacterium bovis subsp bovis AF2122/97
gcugccgccgagcuggc

SEQ ID NO: 1174854 - RNA, 14 nt, Mycobacterium bovis subsp bovis AF2122/97
gcugccgcgcgcug

SEQ ID NO: 1174855 - RNA, 22 nt, Mycobacterium bovis subsp bovis AF2122/97
gcugccgcugcgccgucgcagc

SEQ ID NO: 1174856 - RNA, 19 nt, Mycobacterium bovis subsp bovis AF2122/97
gcugccggcaacagcucgc

SEQ ID NO: 1174857 - RNA, 22 nt, Mycobacterium bovis subsp bovis AF2122/97
gcugccggccagacggugcagc

SEQ ID NO: 1174858 - RNA, 14 nt, Mycobacterium bovis subsp bovis AF2122/97
gcugccggcaccaa

SEQ ID NO: 1174859 - RNA, 20 nt, Mycobacterium bovis subsp bovis AF2122/97
gcugccggcacgcaugccgg

SEQ ID NO: 1174860 - RNA, 16 nt, Mycobacterium bovis subsp bovis AF2122/97
gcugccggcccaccag

SEQ ID NO: 1174861 - RNA, 15 nt, Mycobacterium bovis subsp bovis AF2122/97
gcugcuggcagacca

SEQ ID NO: 1174862 - RNA, 15 nt, Mycobacterium bovis subsp bovis AF2122/97
gcugcuggcgcgccu

SEQ ID NO: 1174863 - RNA, 14 nt, Mycobacterium bovis subsp bovis AF2122/97
gcugcugcgcggug

SEQ ID NO: 1174864 - RNA, 16 nt, Mycobacterium bovis subsp bovis AF2122/97
gcugcugcucggccug

SEQ ID NO: 1174865 - RNA, 17 nt, Mycobacterium bovis subsp bovis AF2122/97
gcugcuggcaugcaggu

SEQ ID NO: 1174866 - RNA, 22 nt, Mycobacterium bovis subsp bovis AF2122/97
gcuggaaaccucuucgggugca

SEQ ID NO: 1174867 - RNA, 19 nt, Mycobacterium bovis subsp bovis AF2122/97
gcugcgcggugccggccgu

SEQ ID NO: 1174868 - RNA, 11 nt, Mycobacterium bovis subsp bovis AF2122/97
gcugcgcuggu

SEQ ID NO: 1174869 - RNA, 13 nt, Mycobacterium bovis subsp bovis AF2122/97
gcugcgcgcggcg

SEQ ID NO: 1174870 - RNA, 15 nt, Mycobacterium bovis subsp bovis AF2122/97
gcugcgcgcucggcc

SEQ ID NO: 1174871 - RNA, 16 nt, Mycobacterium bovis subsp bovis AF2122/97
gcugcgcgaucccaac

SEQ ID NO: 1174872 - RNA, 18 nt, Mycobacterium bovis subsp bovis AF2122/97
gcugcgccgaacaccaca

SEQ ID NO: 1174873 - RNA, 23 nt, Mycobacterium bovis subsp bovis AF2122/97
gcugcgccgauacccagcggguc

SEQ ID NO: 1174874 - RNA, 14 nt, Mycobacterium bovis subsp bovis AF2122/97
gcugcgcgaagggg

SEQ ID NO: 1174875 - RNA, 12 nt, Mycobacterium bovis subsp bovis AF2122/97
gcugcuccugga

SEQ ID NO: 1174876 - RNA, 22 nt, Mycobacterium bovis subsp bovis AF2122/97
gcugcucaucgcgcccgccauc

SEQ ID NO: 1174877 - RNA, 14 nt, Mycobacterium bovis subsp bovis AF2122/97
gcugcuaugggucg

SEQ ID NO: 1174878 - RNA, 19 nt, Mycobacterium bovis subsp bovis AF2122/97
gcuggcaacgccgcgccgu

SEQ ID NO: 1174879 - RNA, 22 nt, Mycobacterium bovis subsp bovis AF2122/97
gcuggcaacgccgcgccguucc

SEQ ID NO: 1174880 - RNA, 13 nt, Mycobacterium bovis subsp bovis AF2122/97
gcuggcacacucc

SEQ ID NO: 1174881 - RNA, 22 nt, Mycobacterium bovis subsp bovis AF2122/97
gcuggucagccgugccguggug

SEQ ID NO: 1174882 - RNA, 22 nt, Mycobacterium bovis subsp bovis AF2122/97
gcugguccuccuucgguggugg

SEQ ID NO: 1174883 - RNA, 15 nt, Mycobacterium bovis subsp bovis AF2122/97
gcuggucagcggcgc

SEQ ID NO: 1174884 - RNA, 21 nt, Mycobacterium bovis subsp bovis AF2122/97
gcugguccuccuucgguggug

SEQ ID NO: 1174885 - RNA, 14 nt, Mycobacterium bovis subsp bovis AF2122/97
gcuggucggugggc

SEQ ID NO: 1174886 - RNA, 19 nt, Mycobacterium bovis subsp bovis AF2122/97
gcuggucgugggccaccac

SEQ ID NO: 1174887 - RNA, 14 nt, Mycobacterium bovis subsp bovis AF2122/97
gcuggucgccgcgg

SEQ ID NO: 1174888 - RNA, 23 nt, Mycobacterium bovis subsp bovis AF2122/97
gcuggugaucugcugggcaagau

SEQ ID NO: 1174889 - RNA, 14 nt, Mycobacterium bovis subsp bovis AF2122/97
aaaggaagaccucg

SEQ ID NO: 1174890 - RNA, 23 nt, Mycobacterium bovis subsp bovis AF2122/97
gcuguauuucaauucucgagcaa

SEQ ID NO: 1174891 - RNA, 20 nt, Mycobacterium bovis subsp bovis AF2122/97
gcugucaauccgcccuaaug

SEQ ID NO: 1174892 - RNA, 18 nt, Mycobacterium bovis subsp bovis AF2122/97
gcugucacaagccugccg

SEQ ID NO: 1174893 - RNA, 16 nt, Mycobacterium bovis subsp bovis AF2122/97
gcugucacgccugcca

SEQ ID NO: 1174894 - RNA, 22 nt, Mycobacterium bovis subsp bovis AF2122/97
gcuggugcguagcccacccggg

SEQ ID NO: 1174895 - RNA, 17 nt, Mycobacterium bovis subsp bovis AF2122/97
gcuguccaggucugggc

SEQ ID NO: 1174896 - RNA, 21 nt, Mycobacterium bovis subsp bovis AF2122/97
gcugucccgcgggccagcacc

SEQ ID NO: 1174897 - RNA, 21 nt, Mycobacterium bovis subsp bovis AF2122/97
gcugugguggugaugggcaug

SEQ ID NO: 1174898 - RNA, 13 nt, Mycobacterium bovis subsp bovis AF2122/97
gcuguggugguga

SEQ ID NO: 1174899 - RNA, 16 nt, Mycobacterium bovis subsp bovis AF2122/97
gcuguggucggugcca

SEQ ID NO: 1174900 - RNA, 18 nt, Mycobacterium bovis subsp bovis AF2122/97
gcuguccgacuucuccag

SEQ ID NO: 1174901 - RNA, 15 nt, Mycobacterium bovis subsp bovis AF2122/97
gcuguugcggggugc

SEQ ID NO: 1174902 - RNA, 18 nt, Mycobacterium bovis subsp bovis AF2122/97
gcuguugcggggugcuca

SEQ ID NO: 1174903 - RNA, 20 nt, Mycobacterium bovis subsp bovis AF2122/97
gcuguuugguugcgccagga

SEQ ID NO: 1174904 - RNA, 12 nt, Mycobacterium bovis subsp bovis AF2122/97
gcuucaaugucg

SEQ ID NO: 1174905 - RNA, 15 nt, Mycobacterium bovis subsp bovis AF2122/97
gcuuacaugcccugc

SEQ ID NO: 1174906 - RNA, 14 nt, Mycobacterium bovis subsp bovis AF2122/97
gcuuaccggcgggc

SEQ ID NO: 1174907 - RNA, 19 nt, Mycobacterium bovis subsp bovis AF2122/97
gcuuacuuaaccaggcgag

SEQ ID NO: 1174908 - RNA, 17 nt, Mycobacterium bovis subsp bovis AF2122/97
gcuuagaacgugcuggu

SEQ ID NO: 1174909 - RNA, 17 nt, Mycobacterium bovis subsp bovis AF2122/97
gcuuagcuuccggguuc

SEQ ID NO: 1174910 - RNA, 18 nt, Mycobacterium bovis subsp bovis AF2122/97
gcuuagggcgcccgcccc

SEQ ID NO: 1174911 - RNA, 18 nt, Mycobacterium bovis subsp bovis AF2122/97
gcuuagcgcgaaagcgcc

SEQ ID NO: 1174912 - RNA, 23 nt, Mycobacterium bovis subsp bovis AF2122/97
gcuuagcugccgucggugccggg

SEQ ID NO: 1174913 - RNA, 14 nt, Mycobacterium bovis subsp bovis AF2122/97
gcuucccgcuggug

SEQ ID NO: 1174914 - RNA, 16 nt, Mycobacterium bovis subsp bovis AF2122/97
gcuucccggaagcgcc

SEQ ID NO: 1174915 - RNA, 20 nt, Mycobacterium bovis subsp bovis AF2122/97
gcuuccccgguagcguucgg

SEQ ID NO: 1174916 - RNA, 14 nt, Mycobacterium bovis subsp bovis AF2122/97
gcuucccccggucc

SEQ ID NO: 1174917 - RNA, 16 nt, Mycobacterium bovis subsp bovis AF2122/97
gcuuccagccacagcc

SEQ ID NO: 1174918 - RNA, 12 nt, Mycobacterium bovis subsp bovis AF2122/97
gcuuccagcauc

SEQ ID NO: 1174919 - RNA, 17 nt, Mycobacterium bovis subsp bovis AF2122/97
gcuuccaucgccacugu

SEQ ID NO: 1174920 - RNA, 23 nt, Mycobacterium bovis subsp bovis AF2122/97
gcuuccgcgacgcucgcugcagc

SEQ ID NO: 1174921 - RNA, 17 nt, Mycobacterium bovis subsp bovis AF2122/97
gcuuccgguccagcggc

SEQ ID NO: 1174922 - RNA, 12 nt, Mycobacterium bovis subsp bovis AF2122/97
gcuuccguggcc

SEQ ID NO: 1174923 - RNA, 15 nt, Mycobacterium bovis subsp bovis AF2122/97
gcuucgacggcggcc

SEQ ID NO: 1174924 - RNA, 20 nt, Mycobacterium bovis subsp bovis AF2122/97
gcuuccuggguuggcaucca

SEQ ID NO: 1174925 - RNA, 15 nt, Mycobacterium bovis subsp bovis AF2122/97
gcuucaugagccgcu

SEQ ID NO: 1174926 - RNA, 16 nt, Mycobacterium bovis subsp bovis AF2122/97
gcuucugcgucugcuc

SEQ ID NO: 1174927 - RNA, 17 nt, Mycobacterium bovis subsp bovis AF2122/97
gcuucuccuccagagac

SEQ ID NO: 1174928 - RNA, 19 nt, Mycobacterium bovis subsp bovis AF2122/97
gcuucucccgccacugcug

SEQ ID NO: 1174929 - RNA, 15 nt, Mycobacterium bovis subsp bovis AF2122/97
gcuucgugcaccaca

SEQ ID NO: 1174930 - RNA, 16 nt, Mycobacterium bovis subsp bovis AF2122/97
gcuucgucggccggca

SEQ ID NO: 1174931 - RNA, 22 nt, Mycobacterium bovis subsp bovis AF2122/97
gcuucgucggccggcaccccac

SEQ ID NO: 1174932 - RNA, 17 nt, Mycobacterium bovis subsp bovis AF2122/97
gcuucguggcggcgcgc

SEQ ID NO: 1174933 - RNA, 16 nt, Mycobacterium bovis subsp bovis AF2122/97
gcuucggugagcgggc

SEQ ID NO: 1174934 - RNA, 18 nt, Mycobacterium bovis subsp bovis AF2122/97
gcuucgucggccagcagc

SEQ ID NO: 1174935 - RNA, 20 nt, Mycobacterium bovis subsp bovis AF2122/97
gcuucgucggccagcagcaa

SEQ ID NO: 1174936 - RNA, 14 nt, Mycobacterium bovis subsp bovis AF2122/97
gcuucggagaccgc

SEQ ID NO: 1174937 - RNA, 18 nt, Mycobacterium bovis subsp bovis AF2122/97
gcuucggcaccgacugcu

SEQ ID NO: 1174938 - RNA, 20 nt, Mycobacterium bovis subsp bovis AF2122/97
gcuucggcgaacccuccgca

SEQ ID NO: 1174939 - RNA, 14 nt, Mycobacterium bovis subsp bovis AF2122/97
gcuucggcggucag

SEQ ID NO: 1174940 - RNA, 20 nt, Mycobacterium bovis subsp bovis AF2122/97
gcuucggcggccgagcgcac

SEQ ID NO: 1174941 - RNA, 15 nt, Mycobacterium bovis subsp bovis AF2122/97
gcuucggccagauca

SEQ ID NO: 1174942 - RNA, 21 nt, Mycobacterium bovis subsp bovis AF2122/97
gcuucgccgcgcagccuucuc

SEQ ID NO: 1174943 - RNA, 14 nt, Mycobacterium bovis subsp bovis AF2122/97
gcuucgcgguuggc

SEQ ID NO: 1174944 - RNA, 20 nt, Mycobacterium bovis subsp bovis AF2122/97
gcuucgccagguggccgcuc

SEQ ID NO: 1174945 - RNA, 19 nt, Mycobacterium bovis subsp bovis AF2122/97
gcuucgcaagucauccagg

SEQ ID NO: 1174946 - RNA, 17 nt, Mycobacterium bovis subsp bovis AF2122/97
gcuucgccaacugcggc

SEQ ID NO: 1174947 - RNA, 13 nt, Mycobacterium bovis subsp bovis AF2122/97
gcuucgagcaccg

SEQ ID NO: 1174948 - RNA, 13 nt, Mycobacterium bovis subsp bovis AF2122/97
gcuucgauagaag

SEQ ID NO: 1174949 - RNA, 16 nt, Mycobacterium bovis subsp bovis AF2122/97
gcuugccggggugugc

SEQ ID NO: 1174950 - RNA, 18 nt, Mycobacterium bovis subsp bovis AF2122/97
gcuugcgcagccgcagcc

SEQ ID NO: 1174951 - RNA, 21 nt, Mycobacterium bovis subsp bovis AF2122/97
gcuugcgaucggcacuuagcc

SEQ ID NO: 1174952 - RNA, 17 nt, Mycobacterium bovis subsp bovis AF2122/97
gcuugcgcagccgcagc

SEQ ID NO: 1174953 - RNA, 15 nt, Mycobacterium bovis subsp bovis AF2122/97
gcuugcgccgcagcg

SEQ ID NO: 1174954 - RNA, 15 nt, Mycobacterium bovis subsp bovis AF2122/97
gcuugcgcguggcag

SEQ ID NO: 1174955 - RNA, 19 nt, Mycobacterium bovis subsp bovis AF2122/97
gcuugccccaucguucguu

SEQ ID NO: 1174956 - RNA, 14 nt, Mycobacterium bovis subsp bovis AF2122/97
gcuugccccgccuu

SEQ ID NO: 1174957 - RNA, 18 nt, Mycobacterium bovis subsp bovis AF2122/97
gcuugccccgccuuggcc

SEQ ID NO: 1174958 - RNA, 19 nt, Mycobacterium bovis subsp bovis AF2122/97
gcuugccccgccuuggcca

SEQ ID NO: 1174959 - RNA, 14 nt, Mycobacterium bovis subsp bovis AF2122/97
gcuugcagggccac

SEQ ID NO: 1174960 - RNA, 22 nt, Mycobacterium bovis subsp bovis AF2122/97
gcuugaggucccgugcgcgcgc

SEQ ID NO: 1174961 - RNA, 16 nt, Mycobacterium bovis subsp bovis AF2122/97
gcuugacugcacacca

SEQ ID NO: 1174962 - RNA, 17 nt, Mycobacterium bovis subsp bovis AF2122/97
gcuugacugcacaccac

SEQ ID NO: 1174963 - RNA, 16 nt, Mycobacterium bovis subsp bovis AF2122/97
gcuugacaacccuguu

SEQ ID NO: 1174964 - RNA, 15 nt, Mycobacterium bovis subsp bovis AF2122/97
gcuugaccccgccga

SEQ ID NO: 1174965 - RNA, 14 nt, Mycobacterium bovis subsp bovis AF2122/97
gcuugacccgcgga

SEQ ID NO: 1174966 - RNA, 18 nt, Mycobacterium bovis subsp bovis AF2122/97
gcuugaccgccuggaagg

SEQ ID NO: 1174967 - RNA, 23 nt, Mycobacterium bovis subsp bovis AF2122/97
gcuugaacgcauacagcgcccgg

SEQ ID NO: 1174968 - RNA, 19 nt, Mycobacterium bovis subsp bovis AF2122/97
gcuugacccacgagagcgc

SEQ ID NO: 1174969 - RNA, 22 nt, Mycobacterium bovis subsp bovis AF2122/97
gcuucuucggacagcagccggc

SEQ ID NO: 1174970 - RNA, 18 nt, Mycobacterium bovis subsp bovis AF2122/97
gcuucuuaccgcgggccg

SEQ ID NO: 1174971 - RNA, 14 nt, Mycobacterium bovis subsp bovis AF2122/97
gcuuggccgcgcag

SEQ ID NO: 1174972 - RNA, 21 nt, Mycobacterium bovis subsp bovis AF2122/97
gcuuggcaaucaucucccgac

SEQ ID NO: 1174973 - RNA, 23 nt, Mycobacterium bovis subsp bovis AF2122/97
gcuuggcgacgaugcaggugaca

SEQ ID NO: 1174974 - RNA, 13 nt, Mycobacterium bovis subsp bovis AF2122/97
gcuuggcggccag

SEQ ID NO: 1174975 - RNA, 15 nt, Mycobacterium bovis subsp bovis AF2122/97
gcuuggcgugaccua

SEQ ID NO: 1174976 - RNA, 17 nt, Mycobacterium bovis subsp bovis AF2122/97
gcuuggcgggaccguga

SEQ ID NO: 1174977 - RNA, 17 nt, Mycobacterium bovis subsp bovis AF2122/97
gcuugggauuugggcga

SEQ ID NO: 1174978 - RNA, 21 nt, Mycobacterium bovis subsp bovis AF2122/97
gcuuggcgugaccuaccuccu

SEQ ID NO: 1174979 - RNA, 19 nt, Mycobacterium bovis subsp bovis AF2122/97
gcuuggugcccaaggcaga

SEQ ID NO: 1174980 - RNA, 18 nt, Mycobacterium bovis subsp bovis AF2122/97
gcuuggucgcccagccac

SEQ ID NO: 1174981 - RNA, 16 nt, Mycobacterium bovis subsp bovis AF2122/97
gcuuggucgccgggca

SEQ ID NO: 1174982 - RNA, 22 nt, Mycobacterium bovis subsp bovis AF2122/97
gcuugguggucuuggccggugc

SEQ ID NO: 1174983 - RNA, 23 nt, Mycobacterium bovis subsp bovis AF2122/97
gcuugggugccucgccaaccuuu

SEQ ID NO: 1174984 - RNA, 16 nt, Mycobacterium bovis subsp bovis AF2122/97
gcuugggguugggcgg

SEQ ID NO: 1174985 - RNA, 15 nt, Mycobacterium bovis subsp bovis AF2122/97
gcuugucgccccaug

SEQ ID NO: 1174986 - RNA, 14 nt, Mycobacterium bovis subsp bovis AF2122/97
gcuugucgcggugc

SEQ ID NO: 1174987 - RNA, 12 nt, Mycobacterium bovis subsp bovis AF2122/97
gcuuucagcacc

SEQ ID NO: 1174988 - RNA, 16 nt, Mycobacterium bovis subsp bovis AF2122/97
gcuuuaaucguggcac

SEQ ID NO: 1174989 - RNA, 16 nt, Mycobacterium bovis subsp bovis AF2122/97
ggaacaccgcccggcc

SEQ ID NO: 1174990 - RNA, 19 nt, Mycobacterium bovis subsp bovis AF2122/97
ggaacaccgcccggcccgg

SEQ ID NO: 1174991 - RNA, 19 nt, Mycobacterium bovis subsp bovis AF2122/97
gcuuucgauauagccgccg

SEQ ID NO: 1174992 - RNA, 17 nt, Mycobacterium bovis subsp bovis AF2122/97
ggaagccugcgggccgg

SEQ ID NO: 1174993 - RNA, 13 nt, Mycobacterium bovis subsp bovis AF2122/97
ggaagcgagcagc

SEQ ID NO: 1174994 - RNA, 21 nt, Mycobacterium bovis subsp bovis AF2122/97
ggaagcgcaaugcgcgacggu

SEQ ID NO: 1174995 - RNA, 14 nt, Mycobacterium bovis subsp bovis AF2122/97
ggaagcgguggccu

SEQ ID NO: 1174996 - RNA, 19 nt, Mycobacterium bovis subsp bovis AF2122/97
ggaaggucgacaugggucg

SEQ ID NO: 1174997 - RNA, 15 nt, Mycobacterium bovis subsp bovis AF2122/97
ggaaggucagcgccc

SEQ ID NO: 1174998 - RNA, 15 nt, Mycobacterium bovis subsp bovis AF2122/97
ggaaguagccgagcc

SEQ ID NO: 1174999 - RNA, 19 nt, Mycobacterium bovis subsp bovis AF2122/97
ggaaguaaggcacgggugu

SEQ ID NO: 1175000 - RNA, 17 nt, Mycobacterium bovis subsp bovis AF2122/97
ggaaguacacggcggcc

SEQ ID NO: 1175001 - RNA, 19 nt, Mycobacterium bovis subsp bovis AF2122/97
ggaagcccggcagaugcag

SEQ ID NO: 1175002 - RNA, 17 nt, Mycobacterium bovis subsp bovis AF2122/97
ggaagccgacgaccagc

SEQ ID NO: 1175003 - RNA, 16 nt, Mycobacterium bovis subsp bovis AF2122/97
ggaacuccgcgauccg

SEQ ID NO: 1175004 - RNA, 19 nt, Mycobacterium bovis subsp bovis AF2122/97
ggaacucgucgcugcccau

SEQ ID NO: 1175005 - RNA, 19 nt, Mycobacterium bovis subsp bovis AF2122/97
ggaacguccagccguggcg

SEQ ID NO: 1175006 - RNA, 21 nt, Mycobacterium bovis subsp bovis AF2122/97
ggaacgugacccccagcaggg

SEQ ID NO: 1175007 - RNA, 21 nt, Mycobacterium bovis subsp bovis AF2122/97
ggaacguuccugcacagacag

SEQ ID NO: 1175008 - RNA, 14 nt, Mycobacterium bovis subsp bovis AF2122/97
ggaacccagcacug

SEQ ID NO: 1175009 - RNA, 17 nt, Mycobacterium bovis subsp bovis AF2122/97
ggaacggugcacagcag

SEQ ID NO: 1175010 - RNA, 20 nt, Mycobacterium bovis subsp bovis AF2122/97
ggaacggugcacagcaguga

SEQ ID NO: 1175011 - RNA, 19 nt, Mycobacterium bovis subsp bovis AF2122/97
ggacaccguggaucggcag

SEQ ID NO: 1175012 - RNA, 23 nt, Mycobacterium bovis subsp bovis AF2122/97
ggacaccguggaucggcagcccg

SEQ ID NO: 1175013 - RNA, 16 nt, Mycobacterium bovis subsp bovis AF2122/97
ggacaccggcaccacg

SEQ ID NO: 1175014 - RNA, 19 nt, Mycobacterium bovis subsp bovis AF2122/97
ggacaccaucuccgccguc

SEQ ID NO: 1175015 - RNA, 22 nt, Mycobacterium bovis subsp bovis AF2122/97
ggacacuccugcacacaggacu

SEQ ID NO: 1175016 - RNA, 13 nt, Mycobacterium bovis subsp bovis AF2122/97
ggacaccagccag

SEQ ID NO: 1175017 - RNA, 19 nt, Mycobacterium bovis subsp bovis AF2122/97
ggacaccaacccacccccc

SEQ ID NO: 1175018 - RNA, 14 nt, Mycobacterium bovis subsp bovis AF2122/97
ggacacacaggcgg

SEQ ID NO: 1175019 - RNA, 17 nt, Mycobacterium bovis subsp bovis AF2122/97
ggacacauugaccaggu

SEQ ID NO: 1175020 - RNA, 18 nt, Mycobacterium bovis subsp bovis AF2122/97
ggacaauggacaccaacc

SEQ ID NO: 1175021 - RNA, 13 nt, Mycobacterium bovis subsp bovis AF2122/97
ggacaagcuccuc

SEQ ID NO: 1175022 - RNA, 14 nt, Mycobacterium bovis subsp bovis AF2122/97
ggaauucccgcagg

SEQ ID NO: 1175023 - RNA, 19 nt, Mycobacterium bovis subsp bovis AF2122/97
ggaauuccgcuaccgcaca

SEQ ID NO: 1175024 - RNA, 23 nt, Mycobacterium bovis subsp bovis AF2122/97
ggaauuccgcuaccgcacaggca

SEQ ID NO: 1175025 - RNA, 14 nt, Mycobacterium bovis subsp bovis AF2122/97
ggacaaagcugcuc

SEQ ID NO: 1175026 - RNA, 16 nt, Mycobacterium bovis subsp bovis AF2122/97
ggacaaagcugcucgu

SEQ ID NO: 1175027 - RNA, 20 nt, Mycobacterium bovis subsp bovis AF2122/97
ggacaaaaucagcagccccc

SEQ ID NO: 1175028 - RNA, 22 nt, Mycobacterium bovis subsp bovis AF2122/97
ggacaaacaucgcacccaccac

SEQ ID NO: 1175029 - RNA, 16 nt, Mycobacterium bovis subsp bovis AF2122/97
ggacaaccccuugccu

SEQ ID NO: 1175030 - RNA, 22 nt, Mycobacterium bovis subsp bovis AF2122/97
ggaauggacaggucgggcagca

SEQ ID NO: 1175031 - RNA, 17 nt, Mycobacterium bovis subsp bovis AF2122/97
ggaauggaccagcgccc

SEQ ID NO: 1175032 - RNA, 13 nt, Mycobacterium bovis subsp bovis AF2122/97
ggaaugcuggggc

SEQ ID NO: 1175033 - RNA, 16 nt, Mycobacterium bovis subsp bovis AF2122/97
ggaaugccgucgccgg

SEQ ID NO: 1175034 - RNA, 18 nt, Mycobacterium bovis subsp bovis AF2122/97
ggaauacgcgccgccggc

SEQ ID NO: 1175035 - RNA, 14 nt, Mycobacterium bovis subsp bovis AF2122/97
ggaauggucccggg

SEQ ID NO: 1175036 - RNA, 17 nt, Mycobacterium bovis subsp bovis AF2122/97
ggaauggcgccggccgg

SEQ ID NO: 1175037 - RNA, 13 nt, Mycobacterium bovis subsp bovis AF2122/97
ggaauacagcuug

SEQ ID NO: 1175038 - RNA, 17 nt, Mycobacterium bovis subsp bovis AF2122/97
ggaauacaacagcuggg

SEQ ID NO: 1175039 - RNA, 13 nt, Mycobacterium bovis subsp bovis AF2122/97
ggaagucgagcag

SEQ ID NO: 1175040 - RNA, 15 nt, Mycobacterium bovis subsp bovis AF2122/97
ggaagugcaccugga

SEQ ID NO: 1175041 - RNA, 17 nt, Mycobacterium bovis subsp bovis AF2122/97
ggaaguugcccagguga

SEQ ID NO: 1175042 - RNA, 19 nt, Mycobacterium bovis subsp bovis AF2122/97
ggaccgccccggccaggac

SEQ ID NO: 1175043 - RNA, 20 nt, Mycobacterium bovis subsp bovis AF2122/97
ggacccggugacccgcuggg

SEQ ID NO: 1175044 - RNA, 13 nt, Mycobacterium bovis subsp bovis AF2122/97
ggaccgcucugcg

SEQ ID NO: 1175045 - RNA, 15 nt, Mycobacterium bovis subsp bovis AF2122/97
ggaccgcgcccagac

SEQ ID NO: 1175046 - RNA, 20 nt, Mycobacterium bovis subsp bovis AF2122/97
ggaccggcaauuuucugcug

SEQ ID NO: 1175047 - RNA, 22 nt, Mycobacterium bovis subsp bovis AF2122/97
ggaccgucuuuggugccgagca

SEQ ID NO: 1175048 - RNA, 14 nt, Mycobacterium bovis subsp bovis AF2122/97
ggaccguggcagcu

SEQ ID NO: 1175049 - RNA, 14 nt, Mycobacterium bovis subsp bovis AF2122/97
ggaccggcuccggu

SEQ ID NO: 1175050 - RNA, 15 nt, Mycobacterium bovis subsp bovis AF2122/97
ggacagcuguugauu

SEQ ID NO: 1175051 - RNA, 18 nt, Mycobacterium bovis subsp bovis AF2122/97
ggacagcagccgccggcc

SEQ ID NO: 1175052 - RNA, 18 nt, Mycobacterium bovis subsp bovis AF2122/97
ggacaggcuugacugcac

SEQ ID NO: 1175053 - RNA, 13 nt, Mycobacterium bovis subsp bovis AF2122/97
ggacagggcggca

SEQ ID NO: 1175054 - RNA, 22 nt, Mycobacterium bovis subsp bovis AF2122/97
ggaccuuggcgaccaugcuccu

SEQ ID NO: 1175055 - RNA, 23 nt, Mycobacterium bovis subsp bovis AF2122/97
ggacgaacaacgcgacgaagcag

SEQ ID NO: 1175056 - RNA, 19 nt, Mycobacterium bovis subsp bovis AF2122/97
ggacgaccgcgcggcacuu

SEQ ID NO: 1175057 - RNA, 15 nt, Mycobacterium bovis subsp bovis AF2122/97
ggacgacggcaagaa

SEQ ID NO: 1175058 - RNA, 17 nt, Mycobacterium bovis subsp bovis AF2122/97
ggacgaacugcugauga

SEQ ID NO: 1175059 - RNA, 17 nt, Mycobacterium bovis subsp bovis AF2122/97
ggacgacgaucaagccu

SEQ ID NO: 1175060 - RNA, 15 nt, Mycobacterium bovis subsp bovis AF2122/97
ggacgacgccgacga

SEQ ID NO: 1175061 - RNA, 12 nt, Mycobacterium bovis subsp bovis AF2122/97
ggacgcuccggg

SEQ ID NO: 1175062 - RNA, 21 nt, Mycobacterium bovis subsp bovis AF2122/97
ggagaccggccgggugaacca

SEQ ID NO: 1175063 - RNA, 19 nt, Mycobacterium bovis subsp bovis AF2122/97
ggagacgaucgccaggccg

SEQ ID NO: 1175064 - RNA, 21 nt, Mycobacterium bovis subsp bovis AF2122/97
ggacuuccggggagcagagaa

SEQ ID NO: 1175065 - RNA, 14 nt, Mycobacterium bovis subsp bovis AF2122/97
ggacuucgggggcc

SEQ ID NO: 1175066 - RNA, 23 nt, Mycobacterium bovis subsp bovis AF2122/97
ggacuucggugagcagggcggcg

SEQ ID NO: 1175067 - RNA, 16 nt, Mycobacterium bovis subsp bovis AF2122/97
ggagaaaacggcggcg

SEQ ID NO: 1175068 - RNA, 11 nt, Mycobacterium bovis subsp bovis AF2122/97
ggagagccggu

SEQ ID NO: 1175069 - RNA, 16 nt, Mycobacterium bovis subsp bovis AF2122/97
ggagcaccgaccaggg

SEQ ID NO: 1175070 - RNA, 21 nt, Mycobacterium bovis subsp bovis AF2122/97
ggagcaccucgaagugcaggu

SEQ ID NO: 1175071 - RNA, 14 nt, Mycobacterium bovis subsp bovis AF2122/97
ggacugcgccgggu

SEQ ID NO: 1175072 - RNA, 11 nt, Mycobacterium bovis subsp bovis AF2122/97
ggacugcagcg

SEQ ID NO: 1175073 - RNA, 14 nt, Mycobacterium bovis subsp bovis AF2122/97
ggacugcagcgcgg

SEQ ID NO: 1175074 - RNA, 13 nt, Mycobacterium bovis subsp bovis AF2122/97
ggacugccgcagg

SEQ ID NO: 1175075 - RNA, 20 nt, Mycobacterium bovis subsp bovis AF2122/97
ggacugcgaagaguccuuaa

SEQ ID NO: 1175076 - RNA, 21 nt, Mycobacterium bovis subsp bovis AF2122/97
ggacuggcaccgccagccacc

SEQ ID NO: 1175077 - RNA, 17 nt, Mycobacterium bovis subsp bovis AF2122/97
ggacucuucagcuaccu

SEQ ID NO: 1175078 - RNA, 22 nt, Mycobacterium bovis subsp bovis AF2122/97
ggacucuucagcuaccuccgcc

SEQ ID NO: 1175079 - RNA, 18 nt, Mycobacterium bovis subsp bovis AF2122/97
ggacugaacaguugcaca

SEQ ID NO: 1175080 - RNA, 23 nt, Mycobacterium bovis subsp bovis AF2122/97
ggacugaucgcgauccacccggc

SEQ ID NO: 1175081 - RNA, 19 nt, Mycobacterium bovis subsp bovis AF2122/97
ggacuucagcaggcccagc

SEQ ID NO: 1175082 - RNA, 23 nt, Mycobacterium bovis subsp bovis AF2122/97
ggauacccuuugcacgguggcaa

SEQ ID NO: 1175083 - RNA, 13 nt, Mycobacterium bovis subsp bovis AF2122/97
ggauaccggucag

SEQ ID NO: 1175084 - RNA, 22 nt, Mycobacterium bovis subsp bovis AF2122/97
ggauacccagcgcccggccacu

SEQ ID NO: 1175085 - RNA, 23 nt, Mycobacterium bovis subsp bovis AF2122/97
ggauaacccagcggcgccacgug

SEQ ID NO: 1175086 - RNA, 17 nt, Mycobacterium bovis subsp bovis AF2122/97
ggaucaaaaccucgugc

SEQ ID NO: 1175087 - RNA, 14 nt, Mycobacterium bovis subsp bovis AF2122/97
ggaucaacccggcc

SEQ ID NO: 1175088 - RNA, 17 nt, Mycobacterium bovis subsp bovis AF2122/97
ggaucaaccggcccucc

SEQ ID NO: 1175089 - RNA, 15 nt, Mycobacterium bovis subsp bovis AF2122/97
ggaucaacgcacggc

SEQ ID NO: 1175090 - RNA, 19 nt, Mycobacterium bovis subsp bovis AF2122/97
ggauacgccccugguccac

SEQ ID NO: 1175091 - RNA, 15 nt, Mycobacterium bovis subsp bovis AF2122/97
ggagccgccggcggu

SEQ ID NO: 1175092 - RNA, 12 nt, Mycobacterium bovis subsp bovis AF2122/97
ggagccgcccaa

SEQ ID NO: 1175093 - RNA, 15 nt, Mycobacterium bovis subsp bovis AF2122/97
ggagccgcccaagcc

SEQ ID NO: 1175094 - RNA, 22 nt, Mycobacterium bovis subsp bovis AF2122/97
ggagccgcccaagccgccggcg

SEQ ID NO: 1175095 - RNA, 16 nt, Mycobacterium bovis subsp bovis AF2122/97
ggagccgaucacgcug

SEQ ID NO: 1175096 - RNA, 22 nt, Mycobacterium bovis subsp bovis AF2122/97
ggagccccugucaacgccgcgg

SEQ ID NO: 1175097 - RNA, 18 nt, Mycobacterium bovis subsp bovis AF2122/97
ggagcccguccaggcccg

SEQ ID NO: 1175098 - RNA, 22 nt, Mycobacterium bovis subsp bovis AF2122/97
ggagccgggccguccggguaga

SEQ ID NO: 1175099 - RNA, 22 nt, Mycobacterium bovis subsp bovis AF2122/97
ggagccggccaccucggugcgg

SEQ ID NO: 1175100 - RNA, 16 nt, Mycobacterium bovis subsp bovis AF2122/97
ggagccgucgagcagc

SEQ ID NO: 1175101 - RNA, 19 nt, Mycobacterium bovis subsp bovis AF2122/97
ggagugucgaugcgcgccg

SEQ ID NO: 1175102 - RNA, 21 nt, Mycobacterium bovis subsp bovis AF2122/97
ggagcccaguaagccacgggc

SEQ ID NO: 1175103 - RNA, 15 nt, Mycobacterium bovis subsp bovis AF2122/97
ggagcccgagcucac

SEQ ID NO: 1175104 - RNA, 21 nt, Mycobacterium bovis subsp bovis AF2122/97
ggagcccgagcucaccgcaca

SEQ ID NO: 1175105 - RNA, 16 nt, Mycobacterium bovis subsp bovis AF2122/97
ggagccaacggccaag

SEQ ID NO: 1175106 - RNA, 23 nt, Mycobacterium bovis subsp bovis AF2122/97
ggagccacucggcccggcaggac

SEQ ID NO: 1175107 - RNA, 16 nt, Mycobacterium bovis subsp bovis AF2122/97
ggagccaggacgacgc

SEQ ID NO: 1175108 - RNA, 15 nt, Mycobacterium bovis subsp bovis AF2122/97
ggaguucgcgcagca

SEQ ID NO: 1175109 - RNA, 15 nt, Mycobacterium bovis subsp bovis AF2122/97
ggaguugaagaagcc

SEQ ID NO: 1175110 - RNA, 18 nt, Mycobacterium bovis subsp bovis AF2122/97
ggaguugaagaagcccga

SEQ ID NO: 1175111 - RNA, 15 nt, Mycobacterium bovis subsp bovis AF2122/97
ggaguugaucuccac

SEQ ID NO: 1175112 - RNA, 16 nt, Mycobacterium bovis subsp bovis AF2122/97
ggaguugucgacggcc

SEQ ID NO: 1175113 - RNA, 18 nt, Mycobacterium bovis subsp bovis AF2122/97
ggaucgguuucugcggcc

SEQ ID NO: 1175114 - RNA, 22 nt, Mycobacterium bovis subsp bovis AF2122/97
ggaucgguuucugcggccccga

SEQ ID NO: 1175115 - RNA, 17 nt, Mycobacterium bovis subsp bovis AF2122/97
ggaucguccggccgggg

SEQ ID NO: 1175116 - RNA, 15 nt, Mycobacterium bovis subsp bovis AF2122/97
ggaucgucgugcacg

SEQ ID NO: 1175117 - RNA, 14 nt, Mycobacterium bovis subsp bovis AF2122/97
ggaucgucgcugug

SEQ ID NO: 1175118 - RNA, 21 nt, Mycobacterium bovis subsp bovis AF2122/97
ggaucgucgggagcacacaag

SEQ ID NO: 1175119 - RNA, 23 nt, Mycobacterium bovis subsp bovis AF2122/97
ggaucguggcgcccgucuccagc

SEQ ID NO: 1175120 - RNA, 21 nt, Mycobacterium bovis subsp bovis AF2122/97
ggaucgucgugcacggcggcc

SEQ ID NO: 1175121 - RNA, 14 nt, Mycobacterium bovis subsp bovis AF2122/97
ggaucggcucgcca

SEQ ID NO: 1175122 - RNA, 24 nt, Mycobacterium bovis subsp bovis AF2122/97
ggaucggcugcgcgcucggccagc

SEQ ID NO: 1175123 - RNA, 23 nt, Mycobacterium bovis subsp bovis AF2122/97
ggaucggauuuuccgccuguacg

SEQ ID NO: 1175124 - RNA, 14 nt, Mycobacterium bovis subsp bovis AF2122/97
ggaucggggcacug

SEQ ID NO: 1175125 - RNA, 19 nt, Mycobacterium bovis subsp bovis AF2122/97
ggaucggcggaccgcagcg

SEQ ID NO: 1175126 - RNA, 16 nt, Mycobacterium bovis subsp bovis AF2122/97
ggaucggcggccggca

SEQ ID NO: 1175127 - RNA, 16 nt, Mycobacterium bovis subsp bovis AF2122/97
ggauccaggcccagcc

SEQ ID NO: 1175128 - RNA, 20 nt, Mycobacterium bovis subsp bovis AF2122/97
ggauccaggcccagccgagc

SEQ ID NO: 1175129 - RNA, 15 nt, Mycobacterium bovis subsp bovis AF2122/97
ggauccagcaggccg

SEQ ID NO: 1175130 - RNA, 16 nt, Mycobacterium bovis subsp bovis AF2122/97
ggauccacccagugcc

SEQ ID NO: 1175131 - RNA, 16 nt, Mycobacterium bovis subsp bovis AF2122/97
ggaucggauggcggcc

SEQ ID NO: 1175132 - RNA, 14 nt, Mycobacterium bovis subsp bovis AF2122/97
ggaucgcugccagc

SEQ ID NO: 1175133 - RNA, 15 nt, Mycobacterium bovis subsp bovis AF2122/97
ggaucggcagcagag

SEQ ID NO: 1175134 - RNA, 13 nt, Mycobacterium bovis subsp bovis AF2122/97
ggaucaucgccgc

SEQ ID NO: 1175135 - RNA, 14 nt, Mycobacterium bovis subsp bovis AF2122/97
ggaucagcgcacug

SEQ ID NO: 1175136 - RNA, 18 nt, Mycobacterium bovis subsp bovis AF2122/97
ggaucugguugaaccggu

SEQ ID NO: 1175137 - RNA, 15 nt, Mycobacterium bovis subsp bovis AF2122/97
ggaucuggcgcagca

SEQ ID NO: 1175138 - RNA, 14 nt, Mycobacterium bovis subsp bovis AF2122/97
ggaucuuggccagc

SEQ ID NO: 1175139 - RNA, 15 nt, Mycobacterium bovis subsp bovis AF2122/97
ggaucuuggccagca

SEQ ID NO: 1175140 - RNA, 15 nt, Mycobacterium bovis subsp bovis AF2122/97
ggaucugacggcgcc

SEQ ID NO: 1175141 - RNA, 22 nt, Mycobacterium bovis subsp bovis AF2122/97
ggaucguucgcgugccagcgcc

SEQ ID NO: 1175142 - RNA, 15 nt, Mycobacterium bovis subsp bovis AF2122/97
ggaugacgacgguga

SEQ ID NO: 1175143 - RNA, 14 nt, Mycobacterium bovis subsp bovis AF2122/97
ggaugacgcccagg

SEQ ID NO: 1175144 - RNA, 21 nt, Mycobacterium bovis subsp bovis AF2122/97
ggaugaguucgucguggagcu

SEQ ID NO: 1175145 - RNA, 13 nt, Mycobacterium bovis subsp bovis AF2122/97
ggauggcggccac

SEQ ID NO: 1175146 - RNA, 19 nt, Mycobacterium bovis subsp bovis AF2122/97
ggauggccccgccaaaccu

SEQ ID NO: 1175147 - RNA, 15 nt, Mycobacterium bovis subsp bovis AF2122/97
ggaugcucaggucac

SEQ ID NO: 1175148 - RNA, 15 nt, Mycobacterium bovis subsp bovis AF2122/97
ggauggaaggcggcc

SEQ ID NO: 1175149 - RNA, 22 nt, Mycobacterium bovis subsp bovis AF2122/97
ggaugcccguagacgccgagca

SEQ ID NO: 1175150 - RNA, 13 nt, Mycobacterium bovis subsp bovis AF2122/97
ggaugccggucgg

SEQ ID NO: 1175151 - RNA, 14 nt, Mycobacterium bovis subsp bovis AF2122/97
ggaugccguuggcg

SEQ ID NO: 1175152 - RNA, 14 nt, Mycobacterium bovis subsp bovis AF2122/97
ggaugcgaggcgua

SEQ ID NO: 1175153 - RNA, 18 nt, Mycobacterium bovis subsp bovis AF2122/97
ggaugcgcuuccaucgcc

SEQ ID NO: 1175154 - RNA, 16 nt, Mycobacterium bovis subsp bovis AF2122/97
aaaguacgcccuggaa

SEQ ID NO: 1175155 - RNA, 22 nt, Mycobacterium bovis subsp bovis AF2122/97
ggaugggaccuugaucgagcag

SEQ ID NO: 1175156 - RNA, 13 nt, Mycobacterium bovis subsp bovis AF2122/97
ggauggcucgccg

SEQ ID NO: 1175157 - RNA, 20 nt, Mycobacterium bovis subsp bovis AF2122/97
ggauggcgucgaccacaggc

SEQ ID NO: 1175158 - RNA, 13 nt, Mycobacterium bovis subsp bovis AF2122/97
ggaugucgugcgg

SEQ ID NO: 1175159 - RNA, 15 nt, Mycobacterium bovis subsp bovis AF2122/97
ggaugucgugcgggc

SEQ ID NO: 1175160 - RNA, 19 nt, Mycobacterium bovis subsp bovis AF2122/97
ggaugucgucgaccaggcc

SEQ ID NO: 1175161 - RNA, 15 nt, Mycobacterium bovis subsp bovis AF2122/97
ggauuccagcagccu

SEQ ID NO: 1175162 - RNA, 17 nt, Mycobacterium bovis subsp bovis AF2122/97
ggauuccagcagccugc

SEQ ID NO: 1175163 - RNA, 15 nt, Mycobacterium bovis subsp bovis AF2122/97
ggauucggcugccac

SEQ ID NO: 1175164 - RNA, 16 nt, Mycobacterium bovis subsp bovis AF2122/97
ggauucgggcgccgca

SEQ ID NO: 1175165 - RNA, 12 nt, Mycobacterium bovis subsp bovis AF2122/97
ggauucuucagc

SEQ ID NO: 1175166 - RNA, 21 nt, Mycobacterium bovis subsp bovis AF2122/97
ggauucagcgcagcaacuggg

SEQ ID NO: 1175167 - RNA, 16 nt, Mycobacterium bovis subsp bovis AF2122/97
ggauucacgcaccggc

SEQ ID NO: 1175168 - RNA, 15 nt, Mycobacterium bovis subsp bovis AF2122/97
ggcaagcccaaaaag

SEQ ID NO: 1175169 - RNA, 18 nt, Mycobacterium bovis subsp bovis AF2122/97
ggcaagaccgaacagcgg

SEQ ID NO: 1175170 - RNA, 22 nt, Mycobacterium bovis subsp bovis AF2122/97
ggcaaccgucccaaugcaacaa

SEQ ID NO: 1175171 - RNA, 12 nt, Mycobacterium bovis subsp bovis AF2122/97
ggcaaccgccgc

SEQ ID NO: 1175172 - RNA, 17 nt, Mycobacterium bovis subsp bovis AF2122/97
ggcaaccgccgccacca

SEQ ID NO: 1175173 - RNA, 21 nt, Mycobacterium bovis subsp bovis AF2122/97
ggcaaccgccgccaccagggc

SEQ ID NO: 1175174 - RNA, 21 nt, Mycobacterium bovis subsp bovis AF2122/97
ggcaaccccgagcggagccgc

SEQ ID NO: 1175175 - RNA, 22 nt, Mycobacterium bovis subsp bovis AF2122/97
ggcaaccccgagcggagccgcc

SEQ ID NO: 1175176 - RNA, 19 nt, Mycobacterium bovis subsp bovis AF2122/97
ggcaacagcaccagugugg

SEQ ID NO: 1175177 - RNA, 14 nt, Mycobacterium bovis subsp bovis AF2122/97
ggcaacacagcuga

SEQ ID NO: 1175178 - RNA, 18 nt, Mycobacterium bovis subsp bovis AF2122/97
ggcaacauccuccgggca

SEQ ID NO: 1175179 - RNA, 20 nt, Mycobacterium bovis subsp bovis AF2122/97
ggcaaccagcgagcccagcu

SEQ ID NO: 1175180 - RNA, 13 nt, Mycobacterium bovis subsp bovis AF2122/97
ggcaaccagcuuc

SEQ ID NO: 1175181 - RNA, 17 nt, Mycobacterium bovis subsp bovis AF2122/97
ggccgaacgccucgccg

SEQ ID NO: 1175182 - RNA, 18 nt, Mycobacterium bovis subsp bovis AF2122/97
ggccgaagacgugccggc

SEQ ID NO: 1175183 - RNA, 20 nt, Mycobacterium bovis subsp bovis AF2122/97
ggccgaacgggucggcgacc

SEQ ID NO: 1175184 - RNA, 20 nt, Mycobacterium bovis subsp bovis AF2122/97
ggccgaagcucacacuggcu

SEQ ID NO: 1175185 - RNA, 15 nt, Mycobacterium bovis subsp bovis AF2122/97
ggccgaacagcaggc

SEQ ID NO: 1175186 - RNA, 18 nt, Mycobacterium bovis subsp bovis AF2122/97
ggccgaacacaccgggcg

SEQ ID NO: 1175187 - RNA, 22 nt, Mycobacterium bovis subsp bovis AF2122/97
ggccgaaacuucgcccgggccg

SEQ ID NO: 1175188 - RNA, 19 nt, Mycobacterium bovis subsp bovis AF2122/97
ggccgaaagagccagcggc

SEQ ID NO: 1175189 - RNA, 21 nt, Mycobacterium bovis subsp bovis AF2122/97
ggccgaaagagccagcggcac

SEQ ID NO: 1175190 - RNA, 15 nt, Mycobacterium bovis subsp bovis AF2122/97
ggccgaaagccaggc

SEQ ID NO: 1175191 - RNA, 18 nt, Mycobacterium bovis subsp bovis AF2122/97
ggcccuugcucguccagg

SEQ ID NO: 1175192 - RNA, 19 nt, Mycobacterium bovis subsp bovis AF2122/97
ggcccugagcugccgagcg

SEQ ID NO: 1175193 - RNA, 23 nt, Mycobacterium bovis subsp bovis AF2122/97
ggcccugcuccucgcgggcggcg

SEQ ID NO: 1175194 - RNA, 22 nt, Mycobacterium bovis subsp bovis AF2122/97
ggcccugcuccucgcgggcggc

SEQ ID NO: 1175195 - RNA, 21 nt, Mycobacterium bovis subsp bovis AF2122/97
ggcccugcggccacgguggcg

SEQ ID NO: 1175196 - RNA, 11 nt, Mycobacterium bovis subsp bovis AF2122/97
ggcccugcugg

SEQ ID NO: 1175197 - RNA, 16 nt, Mycobacterium bovis subsp bovis AF2122/97
ggcccugcuggcccaa

SEQ ID NO: 1175198 - RNA, 19 nt, Mycobacterium bovis subsp bovis AF2122/97
ggcccugccgacgcuccag

SEQ ID NO: 1175199 - RNA, 15 nt, Mycobacterium bovis subsp bovis AF2122/97
ggcccuggccagccc

SEQ ID NO: 1175200 - RNA, 15 nt, Mycobacterium bovis subsp bovis AF2122/97
ggcccuggccgcgcc

SEQ ID NO: 1175201 - RNA, 16 nt, Mycobacterium bovis subsp bovis AF2122/97
ggcccuggccgcgccg

SEQ ID NO: 1175202 - RNA, 16 nt, Mycobacterium bovis subsp bovis AF2122/97
ggcccuggcgaccagc

SEQ ID NO: 1175203 - RNA, 14 nt, Mycobacterium bovis subsp bovis AF2122/97
ggcccugggcccuu

SEQ ID NO: 1175204 - RNA, 13 nt, Mycobacterium bovis subsp bovis AF2122/97
ggcccggcgagcu

SEQ ID NO: 1175205 - RNA, 18 nt, Mycobacterium bovis subsp bovis AF2122/97
ggcccggcccuccgggcc

SEQ ID NO: 1175206 - RNA, 14 nt, Mycobacterium bovis subsp bovis AF2122/97
ggcccgggccaccg

SEQ ID NO: 1175207 - RNA, 12 nt, Mycobacterium bovis subsp bovis AF2122/97
ggcccgggcccg

SEQ ID NO: 1175208 - RNA, 23 nt, Mycobacterium bovis subsp bovis AF2122/97
ggcccgggucuccggcgcaccug

SEQ ID NO: 1175209 - RNA, 22 nt, Mycobacterium bovis subsp bovis AF2122/97
ggcccggguugagguaggggca

SEQ ID NO: 1175210 - RNA, 14 nt, Mycobacterium bovis subsp bovis AF2122/97
ggcccggcucacag

SEQ ID NO: 1175211 - RNA, 19 nt, Mycobacterium bovis subsp bovis AF2122/97
ggcccggcucggugcgcca

SEQ ID NO: 1175212 - RNA, 17 nt, Mycobacterium bovis subsp bovis AF2122/97
ggcccgggccgaagcgc

SEQ ID NO: 1175213 - RNA, 19 nt, Mycobacterium bovis subsp bovis AF2122/97
ggcccggggacgcccucgg

SEQ ID NO: 1175214 - RNA, 20 nt, Mycobacterium bovis subsp bovis AF2122/97
ggcccggggacgcccucggg

SEQ ID NO: 1175215 - RNA, 12 nt, Mycobacterium bovis subsp bovis AF2122/97
ggcccgggcggc

SEQ ID NO: 1175216 - RNA, 16 nt, Mycobacterium bovis subsp bovis AF2122/97
ggcccgggcggccagc

SEQ ID NO: 1175217 - RNA, 20 nt, Mycobacterium bovis subsp bovis AF2122/97
ggcccucgggacugcgcggc

SEQ ID NO: 1175218 - RNA, 20 nt, Mycobacterium bovis subsp bovis AF2122/97
ggcccuccgggcccaucgcc

SEQ ID NO: 1175219 - RNA, 19 nt, Mycobacterium bovis subsp bovis AF2122/97
ggcccuagccggcgcgccc

SEQ ID NO: 1175220 - RNA, 21 nt, Mycobacterium bovis subsp bovis AF2122/97
ggcccgucacaaugcccaggc

SEQ ID NO: 1175221 - RNA, 19 nt, Mycobacterium bovis subsp bovis AF2122/97
ggcccggucuugggcgcgg

SEQ ID NO: 1175222 - RNA, 18 nt, Mycobacterium bovis subsp bovis AF2122/97
ggcccggucuugggcgcg

SEQ ID NO: 1175223 - RNA, 12 nt, Mycobacterium bovis subsp bovis AF2122/97
ggcccggugcuc

SEQ ID NO: 1175224 - RNA, 15 nt, Mycobacterium bovis subsp bovis AF2122/97
ggcccguccugcggg

SEQ ID NO: 1175225 - RNA, 19 nt, Mycobacterium bovis subsp bovis AF2122/97
ggcccguagcguccgcgcc

SEQ ID NO: 1175226 - RNA, 20 nt, Mycobacterium bovis subsp bovis AF2122/97
ggcccgccaucauggcggcc

SEQ ID NO: 1175227 - RNA, 21 nt, Mycobacterium bovis subsp bovis AF2122/97
ggcccgcccguagacccacag

SEQ ID NO: 1175228 - RNA, 21 nt, Mycobacterium bovis subsp bovis AF2122/97
ggcccgccaucauggcggccc

SEQ ID NO: 1175229 - RNA, 19 nt, Mycobacterium bovis subsp bovis AF2122/97
ggcccgcccguagacccac

SEQ ID NO: 1175230 - RNA, 14 nt, Mycobacterium bovis subsp bovis AF2122/97
ggcccgccggcccc

SEQ ID NO: 1175231 - RNA, 12 nt, Mycobacterium bovis subsp bovis AF2122/97
ggcccgcgcggc

SEQ ID NO: 1175232 - RNA, 12 nt, Mycobacterium bovis subsp bovis AF2122/97
ggcccgcgcgua

SEQ ID NO: 1175233 - RNA, 15 nt, Mycobacterium bovis subsp bovis AF2122/97
ggcccgcggucgcga

SEQ ID NO: 1175234 - RNA, 12 nt, Mycobacterium bovis subsp bovis AF2122/97
ggcccgcgguga

SEQ ID NO: 1175235 - RNA, 13 nt, Mycobacterium bovis subsp bovis AF2122/97
ggcccgcucccug

SEQ ID NO: 1175236 - RNA, 13 nt, Mycobacterium bovis subsp bovis AF2122/97
ggcccgcucaccu

SEQ ID NO: 1175237 - RNA, 14 nt, Mycobacterium bovis subsp bovis AF2122/97
ggcccgcucagccg

SEQ ID NO: 1175238 - RNA, 15 nt, Mycobacterium bovis subsp bovis AF2122/97
ggcccggcaccgcgu

SEQ ID NO: 1175239 - RNA, 14 nt, Mycobacterium bovis subsp bovis AF2122/97
ggcccggcacccgg

SEQ ID NO: 1175240 - RNA, 19 nt, Mycobacterium bovis subsp bovis AF2122/97
ggcccggacgucggcggcc

SEQ ID NO: 1175241 - RNA, 20 nt, Mycobacterium bovis subsp bovis AF2122/97
ggcccggacaugcgggcagc

SEQ ID NO: 1175242 - RNA, 23 nt, Mycobacterium bovis subsp bovis AF2122/97
ggcccggacaugcgggcagcacu

SEQ ID NO: 1175243 - RNA, 16 nt, Mycobacterium bovis subsp bovis AF2122/97
ggcccgcuguggucuu

SEQ ID NO: 1175244 - RNA, 15 nt, Mycobacterium bovis subsp bovis AF2122/97
ggcccgcucagccgu

SEQ ID NO: 1175245 - RNA, 17 nt, Mycobacterium bovis subsp bovis AF2122/97
ggcccgcucccugcacc

SEQ ID NO: 1175246 - RNA, 21 nt, Mycobacterium bovis subsp bovis AF2122/97
ggcccgaugucgucgacgagg

SEQ ID NO: 1175247 - RNA, 22 nt, Mycobacterium bovis subsp bovis AF2122/97
ggcccgauugaguucggcggcc

SEQ ID NO: 1175248 - RNA, 13 nt, Mycobacterium bovis subsp bovis AF2122/97
ggcccgcagcagc

SEQ ID NO: 1175249 - RNA, 20 nt, Mycobacterium bovis subsp bovis AF2122/97
ggcccgauagaucgcgugga

SEQ ID NO: 1175250 - RNA, 13 nt, Mycobacterium bovis subsp bovis AF2122/97
ggcccgauccagu

SEQ ID NO: 1175251 - RNA, 15 nt, Mycobacterium bovis subsp bovis AF2122/97
ggcccgaucaccauc

SEQ ID NO: 1175252 - RNA, 12 nt, Mycobacterium bovis subsp bovis AF2122/97
ggcccgauccag

SEQ ID NO: 1175253 - RNA, 23 nt, Mycobacterium bovis subsp bovis AF2122/97
ggcccgauaaaugccgcgugggc

SEQ ID NO: 1175254 - RNA, 23 nt, Mycobacterium bovis subsp bovis AF2122/97
ggcccgaggugccggggccccau

SEQ ID NO: 1175255 - RNA, 15 nt, Mycobacterium bovis subsp bovis AF2122/97
ggcccgagaagcguu

SEQ ID NO: 1175256 - RNA, 19 nt, Mycobacterium bovis subsp bovis AF2122/97
ggcccgaccgggaaccacg

SEQ ID NO: 1175257 - RNA, 20 nt, Mycobacterium bovis subsp bovis AF2122/97
ggcccgaaaugccgggcccg

SEQ ID NO: 1175258 - RNA, 21 nt, Mycobacterium bovis subsp bovis AF2122/97
ggcccgaaaugccgggcccga

SEQ ID NO: 1175259 - RNA, 17 nt, Mycobacterium bovis subsp bovis AF2122/97
ggccagcucggccagcu

SEQ ID NO: 1175260 - RNA, 19 nt, Mycobacterium bovis subsp bovis AF2122/97
ggccagcugcggcuccggc

SEQ ID NO: 1175261 - RNA, 15 nt, Mycobacterium bovis subsp bovis AF2122/97
ggccagcugcggcuc

SEQ ID NO: 1175262 - RNA, 21 nt, Mycobacterium bovis subsp bovis AF2122/97
ggccagcuugcggagccgccg

SEQ ID NO: 1175263 - RNA, 22 nt, Mycobacterium bovis subsp bovis AF2122/97
ggccagcuugcggagccgccgc

SEQ ID NO: 1175264 - RNA, 17 nt, Mycobacterium bovis subsp bovis AF2122/97
ggccaggaagucccggg

SEQ ID NO: 1175265 - RNA, 22 nt, Mycobacterium bovis subsp bovis AF2122/97
ggccaggcgguacgggucgccg

SEQ ID NO: 1175266 - RNA, 17 nt, Mycobacterium bovis subsp bovis AF2122/97
ggccaggcuggccaacu

SEQ ID NO: 1175267 - RNA, 20 nt, Mycobacterium bovis subsp bovis AF2122/97
ggccagcacgcccgcgcuga

SEQ ID NO: 1175268 - RNA, 16 nt, Mycobacterium bovis subsp bovis AF2122/97
ggccagcagaucaggu

SEQ ID NO: 1175269 - RNA, 14 nt, Mycobacterium bovis subsp bovis AF2122/97
ggccagcucggcca

SEQ ID NO: 1175270 - RNA, 15 nt, Mycobacterium bovis subsp bovis AF2122/97
ggccagcagcaacga

SEQ ID NO: 1175271 - RNA, 22 nt, Mycobacterium bovis subsp bovis AF2122/97
ggccagcacccgcuccagcucg

SEQ ID NO: 1175272 - RNA, 20 nt, Mycobacterium bovis subsp bovis AF2122/97
ggccagcaccacggccagcg

SEQ ID NO: 1175273 - RNA, 22 nt, Mycobacterium bovis subsp bovis AF2122/97
ggccagcaacugccgcacccgg

SEQ ID NO: 1175274 - RNA, 23 nt, Mycobacterium bovis subsp bovis AF2122/97
ggccagaucgaagcgcagcaccu

SEQ ID NO: 1175275 - RNA, 23 nt, Mycobacterium bovis subsp bovis AF2122/97
ggccagggucagcucggugaugu

SEQ ID NO: 1175276 - RNA, 23 nt, Mycobacterium bovis subsp bovis AF2122/97
ggccaggucgagcaccggcugcg

SEQ ID NO: 1175277 - RNA, 23 nt, Mycobacterium bovis subsp bovis AF2122/97
ggccauagugaggccgaccagca

SEQ ID NO: 1175278 - RNA, 20 nt, Mycobacterium bovis subsp bovis AF2122/97
ggcccacacggucgucgcga

SEQ ID NO: 1175279 - RNA, 14 nt, Mycobacterium bovis subsp bovis AF2122/97
ggccauggcggcgc

SEQ ID NO: 1175280 - RNA, 22 nt, Mycobacterium bovis subsp bovis AF2122/97
ggcccacacggucgucgcgagc

SEQ ID NO: 1175281 - RNA, 13 nt, Mycobacterium bovis subsp bovis AF2122/97
ggcccaccagcgc

SEQ ID NO: 1175282 - RNA, 21 nt, Mycobacterium bovis subsp bovis AF2122/97
ggccauggacgccauggugaa

SEQ ID NO: 1175283 - RNA, 21 nt, Mycobacterium bovis subsp bovis AF2122/97
ggccaugcuaggaccaccagc

SEQ ID NO: 1175284 - RNA, 14 nt, Mycobacterium bovis subsp bovis AF2122/97
ggccaucugcucgu

SEQ ID NO: 1175285 - RNA, 14 nt, Mycobacterium bovis subsp bovis AF2122/97
ggccaucgucagga

SEQ ID NO: 1175286 - RNA, 13 nt, Mycobacterium bovis subsp bovis AF2122/97
ggccaucguccag

SEQ ID NO: 1175287 - RNA, 19 nt, Mycobacterium bovis subsp bovis AF2122/97
ggccaucgugcggcacucc

SEQ ID NO: 1175288 - RNA, 21 nt, Mycobacterium bovis subsp bovis AF2122/97
ggccaucgugcggcacucccu

SEQ ID NO: 1175289 - RNA, 19 nt, Mycobacterium bovis subsp bovis AF2122/97
ggcccacauguccagcguc

SEQ ID NO: 1175290 - RNA, 18 nt, Mycobacterium bovis subsp bovis AF2122/97
ggcccacggcgaccagga

SEQ ID NO: 1175291 - RNA, 22 nt, Mycobacterium bovis subsp bovis AF2122/97
ggcccagccggaccgcgacggc

SEQ ID NO: 1175292 - RNA, 19 nt, Mycobacterium bovis subsp bovis AF2122/97
ggcccagccgagcggcggc

SEQ ID NO: 1175293 - RNA, 17 nt, Mycobacterium bovis subsp bovis AF2122/97
ggcccagcgcgccagcu

SEQ ID NO: 1175294 - RNA, 12 nt, Mycobacterium bovis subsp bovis AF2122/97
ggcccagcgcgc

SEQ ID NO: 1175295 - RNA, 16 nt, Mycobacterium bovis subsp bovis AF2122/97
ggcccagguugccuug

SEQ ID NO: 1175296 - RNA, 22 nt, Mycobacterium bovis subsp bovis AF2122/97
ggcccagguccgcgugcugccg

SEQ ID NO: 1175297 - RNA, 20 nt, Mycobacterium bovis subsp bovis AF2122/97
ggcccagugggacuggcgug

SEQ ID NO: 1175298 - RNA, 21 nt, Mycobacterium bovis subsp bovis AF2122/97
ggcccagugggacuggcguga

SEQ ID NO: 1175299 - RNA, 18 nt, Mycobacterium bovis subsp bovis AF2122/97
ggcccauacgugccgccg

SEQ ID NO: 1175300 - RNA, 19 nt, Mycobacterium bovis subsp bovis AF2122/97
ggccccgccgaugccgccg

SEQ ID NO: 1175301 - RNA, 22 nt, Mycobacterium bovis subsp bovis AF2122/97
ggccccgccgaugccgccggcc

SEQ ID NO: 1175302 - RNA, 15 nt, Mycobacterium bovis subsp bovis AF2122/97
ggccccgccggcgcc

SEQ ID NO: 1175303 - RNA, 14 nt, Mycobacterium bovis subsp bovis AF2122/97
ggccccgcgccggc

SEQ ID NO: 1175304 - RNA, 15 nt, Mycobacterium bovis subsp bovis AF2122/97
ggccccgcgccggcc

SEQ ID NO: 1175305 - RNA, 16 nt, Mycobacterium bovis subsp bovis AF2122/97
ggccccgccgguggcc

SEQ ID NO: 1175306 - RNA, 15 nt, Mycobacterium bovis subsp bovis AF2122/97
ggccccgccgucacc

SEQ ID NO: 1175307 - RNA, 15 nt, Mycobacterium bovis subsp bovis AF2122/97
ggccccgccgucgcc

SEQ ID NO: 1175308 - RNA, 16 nt, Mycobacterium bovis subsp bovis AF2122/97
ggccccgccgucgccg

SEQ ID NO: 1175309 - RNA, 20 nt, Mycobacterium bovis subsp bovis AF2122/97
ggccccgccgucgccgccgg

SEQ ID NO: 1175310 - RNA, 22 nt, Mycobacterium bovis subsp bovis AF2122/97
ggccccgccguuuccgccgccg

SEQ ID NO: 1175311 - RNA, 15 nt, Mycobacterium bovis subsp bovis AF2122/97
ggccccggccgcguc

SEQ ID NO: 1175312 - RNA, 15 nt, Mycobacterium bovis subsp bovis AF2122/97
ggccccgcggcgccg

SEQ ID NO: 1175313 - RNA, 15 nt, Mycobacterium bovis subsp bovis AF2122/97
ggccccgcggccagc

SEQ ID NO: 1175314 - RNA, 19 nt, Mycobacterium bovis subsp bovis AF2122/97
ggccccgguggugcugccg

SEQ ID NO: 1175315 - RNA, 17 nt, Mycobacterium bovis subsp bovis AF2122/97
ggccccggggugccccc

SEQ ID NO: 1175316 - RNA, 19 nt, Mycobacterium bovis subsp bovis AF2122/97
ggccccgggggaagcgcca

SEQ ID NO: 1175317 - RNA, 17 nt, Mycobacterium bovis subsp bovis AF2122/97
ggccccguucgccaggc

SEQ ID NO: 1175318 - RNA, 18 nt, Mycobacterium bovis subsp bovis AF2122/97
ggccccguucgccaggcc

SEQ ID NO: 1175319 - RNA, 20 nt, Mycobacterium bovis subsp bovis AF2122/97
ggccccucccuggcucguga

SEQ ID NO: 1175320 - RNA, 13 nt, Mycobacterium bovis subsp bovis AF2122/97
ggccccaggggca

SEQ ID NO: 1175321 - RNA, 18 nt, Mycobacterium bovis subsp bovis AF2122/97
ggccccgacacagcggcg

SEQ ID NO: 1175322 - RNA, 23 nt, Mycobacterium bovis subsp bovis AF2122/97
ggccccgacauacgucggggccg

SEQ ID NO: 1175323 - RNA, 15 nt, Mycobacterium bovis subsp bovis AF2122/97
ggccccgccagcggc

SEQ ID NO: 1175324 - RNA, 19 nt, Mycobacterium bovis subsp bovis AF2122/97
ggccccgccagcggcagcg

SEQ ID NO: 1175325 - RNA, 21 nt, Mycobacterium bovis subsp bovis AF2122/97
ggccccgcccgcgcgguggcg

SEQ ID NO: 1175326 - RNA, 20 nt, Mycobacterium bovis subsp bovis AF2122/97
ggccccacuggugcagcgcc

SEQ ID NO: 1175327 - RNA, 23 nt, Mycobacterium bovis subsp bovis AF2122/97
ggccccaagcgugcugccgccuu

SEQ ID NO: 1175328 - RNA, 19 nt, Mycobacterium bovis subsp bovis AF2122/97
ggcagccgcccgcccaccu

SEQ ID NO: 1175329 - RNA, 18 nt, Mycobacterium bovis subsp bovis AF2122/97
ggcagcccggcggccgcu

SEQ ID NO: 1175330 - RNA, 13 nt, Mycobacterium bovis subsp bovis AF2122/97
ggcagcccgucgg

SEQ ID NO: 1175331 - RNA, 13 nt, Mycobacterium bovis subsp bovis AF2122/97
ggcagcccgcugg

SEQ ID NO: 1175332 - RNA, 16 nt, Mycobacterium bovis subsp bovis AF2122/97
ggcagcccgcuggccu

SEQ ID NO: 1175333 - RNA, 21 nt, Mycobacterium bovis subsp bovis AF2122/97
ggcagcccgcuggccuccugg

SEQ ID NO: 1175334 - RNA, 14 nt, Mycobacterium bovis subsp bovis AF2122/97
ggcagccccuccgc

SEQ ID NO: 1175335 - RNA, 12 nt, Mycobacterium bovis subsp bovis AF2122/97
ggcagcccccgg

SEQ ID NO: 1175336 - RNA, 19 nt, Mycobacterium bovis subsp bovis AF2122/97
ggcagccggguugguaccc

SEQ ID NO: 1175337 - RNA, 14 nt, Mycobacterium bovis subsp bovis AF2122/97
ggcagccgggcguc

SEQ ID NO: 1175338 - RNA, 12 nt, Mycobacterium bovis subsp bovis AF2122/97
ggcagccugcug

SEQ ID NO: 1175339 - RNA, 19 nt, Mycobacterium bovis subsp bovis AF2122/97
ggcagcgaccgucguccag

SEQ ID NO: 1175340 - RNA, 12 nt, Mycobacterium bovis subsp bovis AF2122/97
ggcagcaacagg

SEQ ID NO: 1175341 - RNA, 13 nt, Mycobacterium bovis subsp bovis AF2122/97
ggcagcaacaggc

SEQ ID NO: 1175342 - RNA, 12 nt, Mycobacterium bovis subsp bovis AF2122/97
ggcagccagggc

SEQ ID NO: 1175343 - RNA, 13 nt, Mycobacterium bovis subsp bovis AF2122/97
ggcagccagcggc

SEQ ID NO: 1175344 - RNA, 18 nt, Mycobacterium bovis subsp bovis AF2122/97
ggcagaugaauugccggg

SEQ ID NO: 1175345 - RNA, 22 nt, Mycobacterium bovis subsp bovis AF2122/97
ggcagauacucggcgacugcgu

SEQ ID NO: 1175346 - RNA, 16 nt, Mycobacterium bovis subsp bovis AF2122/97
ggcagaucgauaccgu

SEQ ID NO: 1175347 - RNA, 17 nt, Mycobacterium bovis subsp bovis AF2122/97
ggcagauguguccggca

SEQ ID NO: 1175348 - RNA, 21 nt, Mycobacterium bovis subsp bovis AF2122/97
ggcagaucccacgccaggauc

SEQ ID NO: 1175349 - RNA, 13 nt, Mycobacterium bovis subsp bovis AF2122/97
ggcagagccgccg

SEQ ID NO: 1175350 - RNA, 20 nt, Mycobacterium bovis subsp bovis AF2122/97
ggcagaccgaucggcaggcc

SEQ ID NO: 1175351 - RNA, 19 nt, Mycobacterium bovis subsp bovis AF2122/97
ggcaagcugaccgccagcg

SEQ ID NO: 1175352 - RNA, 21 nt, Mycobacterium bovis subsp bovis AF2122/97
ggcaaggcggcggccagccgu

SEQ ID NO: 1175353 - RNA, 21 nt, Mycobacterium bovis subsp bovis AF2122/97
ggcaagucgcccagccgagcg

SEQ ID NO: 1175354 - RNA, 14 nt, Mycobacterium bovis subsp bovis AF2122/97
ggcaggcggccgcc

SEQ ID NO: 1175355 - RNA, 15 nt, Mycobacterium bovis subsp bovis AF2122/97
ggcaggccucggcgc

SEQ ID NO: 1175356 - RNA, 20 nt, Mycobacterium bovis subsp bovis AF2122/97
ggcaggccucggcgccgccc

SEQ ID NO: 1175357 - RNA, 23 nt, Mycobacterium bovis subsp bovis AF2122/97
ggcaggccucggcgccgcccagc

SEQ ID NO: 1175358 - RNA, 13 nt, Mycobacterium bovis subsp bovis AF2122/97
ggcaggcgaaggc

SEQ ID NO: 1175359 - RNA, 16 nt, Mycobacterium bovis subsp bovis AF2122/97
ggcaggcgaaggcggc

SEQ ID NO: 1175360 - RNA, 18 nt, Mycobacterium bovis subsp bovis AF2122/97
ggcaggcgaaggcggcuu

SEQ ID NO: 1175361 - RNA, 14 nt, Mycobacterium bovis subsp bovis AF2122/97
ggcaggcucgggca

SEQ ID NO: 1175362 - RNA, 21 nt, Mycobacterium bovis subsp bovis AF2122/97
ggcaggcagcucggcaacgug

SEQ ID NO: 1175363 - RNA, 18 nt, Mycobacterium bovis subsp bovis AF2122/97
ggcaggccccacuggugc

SEQ ID NO: 1175364 - RNA, 14 nt, Mycobacterium bovis subsp bovis AF2122/97
ggcaggccagcaug

SEQ ID NO: 1175365 - RNA, 12 nt, Mycobacterium bovis subsp bovis AF2122/97
ggcaggccggcg

SEQ ID NO: 1175366 - RNA, 12 nt, Mycobacterium bovis subsp bovis AF2122/97
ggcaggccgggc

SEQ ID NO: 1175367 - RNA, 14 nt, Mycobacterium bovis subsp bovis AF2122/97
ggcaggccgcuggg

SEQ ID NO: 1175368 - RNA, 21 nt, Mycobacterium bovis subsp bovis AF2122/97
ggcaggccgcugggccgaccg

SEQ ID NO: 1175369 - RNA, 14 nt, Mycobacterium bovis subsp bovis AF2122/97
ggcaggcagggcag

SEQ ID NO: 1175370 - RNA, 12 nt, Mycobacterium bovis subsp bovis AF2122/97
ggcaggacuugg

SEQ ID NO: 1175371 - RNA, 16 nt, Mycobacterium bovis subsp bovis AF2122/97
ggcaggagaacacauc

SEQ ID NO: 1175372 - RNA, 12 nt, Mycobacterium bovis subsp bovis AF2122/97
ggcaggagcagc

SEQ ID NO: 1175373 - RNA, 16 nt, Mycobacterium bovis subsp bovis AF2122/97
ggcaggagcagcacgu

SEQ ID NO: 1175374 - RNA, 19 nt, Mycobacterium bovis subsp bovis AF2122/97
ggcaggaaucgggucagca

SEQ ID NO: 1175375 - RNA, 15 nt, Mycobacterium bovis subsp bovis AF2122/97
ggcagcuucucgccg

SEQ ID NO: 1175376 - RNA, 15 nt, Mycobacterium bovis subsp bovis AF2122/97
ggcagcuacggggcg

SEQ ID NO: 1175377 - RNA, 13 nt, Mycobacterium bovis subsp bovis AF2122/97
ggcagcuccacca

SEQ ID NO: 1175378 - RNA, 22 nt, Mycobacterium bovis subsp bovis AF2122/97
ggcagcgcacccggucggcggc

SEQ ID NO: 1175379 - RNA, 14 nt, Mycobacterium bovis subsp bovis AF2122/97
ggcagcgcccccgg

SEQ ID NO: 1175380 - RNA, 20 nt, Mycobacterium bovis subsp bovis AF2122/97
ggcagcgaugcggugucggg

SEQ ID NO: 1175381 - RNA, 15 nt, Mycobacterium bovis subsp bovis AF2122/97
ggcaggugaucccga

SEQ ID NO: 1175382 - RNA, 22 nt, Mycobacterium bovis subsp bovis AF2122/97
ggcagguguuggugcgggguug

SEQ ID NO: 1175383 - RNA, 16 nt, Mycobacterium bovis subsp bovis AF2122/97
ggcaggugcggcggca

SEQ ID NO: 1175384 - RNA, 20 nt, Mycobacterium bovis subsp bovis AF2122/97
ggcagguuggccaccgccca

SEQ ID NO: 1175385 - RNA, 18 nt, Mycobacterium bovis subsp bovis AF2122/97
ggcaggguggccagcagg

SEQ ID NO: 1175386 - RNA, 21 nt, Mycobacterium bovis subsp bovis AF2122/97
ggcaucgcgagccagcugcuc

SEQ ID NO: 1175387 - RNA, 23 nt, Mycobacterium bovis subsp bovis AF2122/97
ggcaucgcgaauauagcggcguu

SEQ ID NO: 1175388 - RNA, 19 nt, Mycobacterium bovis subsp bovis AF2122/97
ggcaucgcgagccagcugc

SEQ ID NO: 1175389 - RNA, 14 nt, Mycobacterium bovis subsp bovis AF2122/97
ggcauccagcagcg

SEQ ID NO: 1175390 - RNA, 17 nt, Mycobacterium bovis subsp bovis AF2122/97
ggcauccagcagcgccu

SEQ ID NO: 1175391 - RNA, 21 nt, Mycobacterium bovis subsp bovis AF2122/97
ggcaucaucagcggcgccgca

SEQ ID NO: 1175392 - RNA, 18 nt, Mycobacterium bovis subsp bovis AF2122/97
ggcaucagcagagccccg

SEQ ID NO: 1175393 - RNA, 21 nt, Mycobacterium bovis subsp bovis AF2122/97
ggcaucaccgccgcggccgcc

SEQ ID NO: 1175394 - RNA, 22 nt, Mycobacterium bovis subsp bovis AF2122/97
ggcaucaccgacgcgucggcga

SEQ ID NO: 1175395 - RNA, 23 nt, Mycobacterium bovis subsp bovis AF2122/97
ggcaucggaggaaccccgcgcgg

SEQ ID NO: 1175396 - RNA, 17 nt, Mycobacterium bovis subsp bovis AF2122/97
ggcaucgcgggcggcgc

SEQ ID NO: 1175397 - RNA, 11 nt, Mycobacterium bovis subsp bovis AF2122/97
ggcaucggcca

SEQ ID NO: 1175398 - RNA, 14 nt, Mycobacterium bovis subsp bovis AF2122/97
ggcaucggccagcc

SEQ ID NO: 1175399 - RNA, 23 nt, Mycobacterium bovis subsp bovis AF2122/97
ggcaucuccaccgucgccgccgg

SEQ ID NO: 1175400 - RNA, 15 nt, Mycobacterium bovis subsp bovis AF2122/97
ggcaugcgugccggc

SEQ ID NO: 1175401 - RNA, 16 nt, Mycobacterium bovis subsp bovis AF2122/97
ggcaugcucuggcaau

SEQ ID NO: 1175402 - RNA, 22 nt, Mycobacterium bovis subsp bovis AF2122/97
ggccaccguaaacagcgcgccg

SEQ ID NO: 1175403 - RNA, 17 nt, Mycobacterium bovis subsp bovis AF2122/97
ggccaccguagccagca

SEQ ID NO: 1175404 - RNA, 22 nt, Mycobacterium bovis subsp bovis AF2122/97
ggccaccgucccugugucgccg

SEQ ID NO: 1175405 - RNA, 12 nt, Mycobacterium bovis subsp bovis AF2122/97
ggccaccgucgc

SEQ ID NO: 1175406 - RNA, 18 nt, Mycobacterium bovis subsp bovis AF2122/97
ggccaccgucgcggcggc

SEQ ID NO: 1175407 - RNA, 23 nt, Mycobacterium bovis subsp bovis AF2122/97
ggccaccggcugcaaccagcggc

SEQ ID NO: 1175408 - RNA, 13 nt, Mycobacterium bovis subsp bovis AF2122/97
ggccaccggcggu

SEQ ID NO: 1175409 - RNA, 18 nt, Mycobacterium bovis subsp bovis AF2122/97
ggccaccgccgccugccc

SEQ ID NO: 1175410 - RNA, 18 nt, Mycobacterium bovis subsp bovis AF2122/97
ggccaccgccgccgccga

SEQ ID NO: 1175411 - RNA, 17 nt, Mycobacterium bovis subsp bovis AF2122/97
ggccacgaugaucccaa

SEQ ID NO: 1175412 - RNA, 18 nt, Mycobacterium bovis subsp bovis AF2122/97
ggccacgaugaucccaag

SEQ ID NO: 1175413 - RNA, 15 nt, Mycobacterium bovis subsp bovis AF2122/97
ggccacgaccucggg

SEQ ID NO: 1175414 - RNA, 19 nt, Mycobacterium bovis subsp bovis AF2122/97
ggccaccguagccagcagg

SEQ ID NO: 1175415 - RNA, 13 nt, Mycobacterium bovis subsp bovis AF2122/97
ggccaccggcgcc

SEQ ID NO: 1175416 - RNA, 19 nt, Mycobacterium bovis subsp bovis AF2122/97
ggccaccugaaaccacugc

SEQ ID NO: 1175417 - RNA, 16 nt, Mycobacterium bovis subsp bovis AF2122/97
ggccaccugcucgucg

SEQ ID NO: 1175418 - RNA, 16 nt, Mycobacterium bovis subsp bovis AF2122/97
ggccaccugcuggccg

SEQ ID NO: 1175419 - RNA, 13 nt, Mycobacterium bovis subsp bovis AF2122/97
ggccagagccgcg

SEQ ID NO: 1175420 - RNA, 15 nt, Mycobacterium bovis subsp bovis AF2122/97
ggccagagccgcgcg

SEQ ID NO: 1175421 - RNA, 18 nt, Mycobacterium bovis subsp bovis AF2122/97
ggccagagccgcgcgccg

SEQ ID NO: 1175422 - RNA, 13 nt, Mycobacterium bovis subsp bovis AF2122/97
ggccagaucgccg

SEQ ID NO: 1175423 - RNA, 20 nt, Mycobacterium bovis subsp bovis AF2122/97
ggccagacggugcagcuccc

SEQ ID NO: 1175424 - RNA, 15 nt, Mycobacterium bovis subsp bovis AF2122/97
ggccagacccaccac

SEQ ID NO: 1175425 - RNA, 20 nt, Mycobacterium bovis subsp bovis AF2122/97
ggccagacccgaauccacca

SEQ ID NO: 1175426 - RNA, 22 nt, Mycobacterium bovis subsp bovis AF2122/97
ggccagacccgaauccaccagc

SEQ ID NO: 1175427 - RNA, 22 nt, Mycobacterium bovis subsp bovis AF2122/97
ggccacugcguuccaucgccga

SEQ ID NO: 1175428 - RNA, 18 nt, Mycobacterium bovis subsp bovis AF2122/97
ggccacuugcucggugag

SEQ ID NO: 1175429 - RNA, 21 nt, Mycobacterium bovis subsp bovis AF2122/97
ggccacgcgcacucgacgcca

SEQ ID NO: 1175430 - RNA, 16 nt, Mycobacterium bovis subsp bovis AF2122/97
ggcauggccuggguug

SEQ ID NO: 1175431 - RNA, 18 nt, Mycobacterium bovis subsp bovis AF2122/97
ggcauucgagcacgucgg

SEQ ID NO: 1175432 - RNA, 17 nt, Mycobacterium bovis subsp bovis AF2122/97
ggcauuucagcgcgccg

SEQ ID NO: 1175433 - RNA, 13 nt, Mycobacterium bovis subsp bovis AF2122/97
ggccaagggugcu

SEQ ID NO: 1175434 - RNA, 16 nt, Mycobacterium bovis subsp bovis AF2122/97
ggccaagguggccacc

SEQ ID NO: 1175435 - RNA, 15 nt, Mycobacterium bovis subsp bovis AF2122/97
ggccaaucagcccgc

SEQ ID NO: 1175436 - RNA, 17 nt, Mycobacterium bovis subsp bovis AF2122/97
ggccaaucagcccgccg

SEQ ID NO: 1175437 - RNA, 15 nt, Mycobacterium bovis subsp bovis AF2122/97
ggccaauccggcggc

SEQ ID NO: 1175438 - RNA, 12 nt, Mycobacterium bovis subsp bovis AF2122/97
ggccaauccggg

SEQ ID NO: 1175439 - RNA, 15 nt, Mycobacterium bovis subsp bovis AF2122/97
ggccaauccggggcc

SEQ ID NO: 1175440 - RNA, 22 nt, Mycobacterium bovis subsp bovis AF2122/97
ggccaaugccuugagcaaaaug

SEQ ID NO: 1175441 - RNA, 18 nt, Mycobacterium bovis subsp bovis AF2122/97
ggccaauggccugcagcg

SEQ ID NO: 1175442 - RNA, 14 nt, Mycobacterium bovis subsp bovis AF2122/97
ggcgccggcuugga

SEQ ID NO: 1175443 - RNA, 14 nt, Mycobacterium bovis subsp bovis AF2122/97
ggcgccggucgccg

SEQ ID NO: 1175444 - RNA, 20 nt, Mycobacterium bovis subsp bovis AF2122/97
ggcgccggucgccggcuggg

SEQ ID NO: 1175445 - RNA, 12 nt, Mycobacterium bovis subsp bovis AF2122/97
ggcgccgggggc

SEQ ID NO: 1175446 - RNA, 19 nt, Mycobacterium bovis subsp bovis AF2122/97
ggcgccgggggcgccgccg

SEQ ID NO: 1175447 - RNA, 20 nt, Mycobacterium bovis subsp bovis AF2122/97
ggcgccgggucacgugggcc

SEQ ID NO: 1175448 - RNA, 22 nt, Mycobacterium bovis subsp bovis AF2122/97
ggcgccggugguaccggcggcg

SEQ ID NO: 1175449 - RNA, 14 nt, Mycobacterium bovis subsp bovis AF2122/97
ggcgccggugggcg

SEQ ID NO: 1175450 - RNA, 17 nt, Mycobacterium bovis subsp bovis AF2122/97
ggcgccggugcggcggg

SEQ ID NO: 1175451 - RNA, 17 nt, Mycobacterium bovis subsp bovis AF2122/97
ggcgccgucgcccagcg

SEQ ID NO: 1175452 - RNA, 18 nt, Mycobacterium bovis subsp bovis AF2122/97
ggcgccgucggagccggc

SEQ ID NO: 1175453 - RNA, 22 nt, Mycobacterium bovis subsp bovis AF2122/97
ggcgccuugguccguagcgcgg

SEQ ID NO: 1175454 - RNA, 16 nt, Mycobacterium bovis subsp bovis AF2122/97
ggcgccuuggucgccg

SEQ ID NO: 1175455 - RNA, 17 nt, Mycobacterium bovis subsp bovis AF2122/97
ggcgcgcaucugcucgg

SEQ ID NO: 1175456 - RNA, 18 nt, Mycobacterium bovis subsp bovis AF2122/97
ggcgcgcagguagcgcuc

SEQ ID NO: 1175457 - RNA, 15 nt, Mycobacterium bovis subsp bovis AF2122/97
ggcgcgcaggaccug

SEQ ID NO: 1175458 - RNA, 15 nt, Mycobacterium bovis subsp bovis AF2122/97
ggcgcgaccgcggcg

SEQ ID NO: 1175459 - RNA, 20 nt, Mycobacterium bovis subsp bovis AF2122/97
aaauaccuuuggcucccuuu

SEQ ID NO: 1175460 - RNA, 23 nt, Mycobacterium bovis subsp bovis AF2122/97
ggcgccgccguccagcgccgcgg

SEQ ID NO: 1175461 - RNA, 19 nt, Mycobacterium bovis subsp bovis AF2122/97
ggcgccgccgugcggguuc

SEQ ID NO: 1175462 - RNA, 22 nt, Mycobacterium bovis subsp bovis AF2122/97
ggcgccgcgccgauuccaccgc

SEQ ID NO: 1175463 - RNA, 21 nt, Mycobacterium bovis subsp bovis AF2122/97
ggcgccgccuggacgccgccg

SEQ ID NO: 1175464 - RNA, 17 nt, Mycobacterium bovis subsp bovis AF2122/97
ggcgccgccggcaccgg

SEQ ID NO: 1175465 - RNA, 21 nt, Mycobacterium bovis subsp bovis AF2122/97
ggcgcggccgugaacggcgcg

SEQ ID NO: 1175466 - RNA, 15 nt, Mycobacterium bovis subsp bovis AF2122/97
ggcgcggcccaccuc

SEQ ID NO: 1175467 - RNA, 19 nt, Mycobacterium bovis subsp bovis AF2122/97
ggcgcggccgcagccagca

SEQ ID NO: 1175468 - RNA, 23 nt, Mycobacterium bovis subsp bovis AF2122/97
ggcgcgccccaccgcgccgagca

SEQ ID NO: 1175469 - RNA, 15 nt, Mycobacterium bovis subsp bovis AF2122/97
ggcgcgcggggccuc

SEQ ID NO: 1175470 - RNA, 18 nt, Mycobacterium bovis subsp bovis AF2122/97
ggcgcguccgggcucgcg

SEQ ID NO: 1175471 - RNA, 18 nt, Mycobacterium bovis subsp bovis AF2122/97
ggcgcgucauggcgagua

SEQ ID NO: 1175472 - RNA, 20 nt, Mycobacterium bovis subsp bovis AF2122/97
ggcgcguccgggcucgcgcu

SEQ ID NO: 1175473 - RNA, 22 nt, Mycobacterium bovis subsp bovis AF2122/97
ggcgcgucggcguuggggcucg

SEQ ID NO: 1175474 - RNA, 20 nt, Mycobacterium bovis subsp bovis AF2122/97
ggcgcugaugcgcugggcca

SEQ ID NO: 1175475 - RNA, 21 nt, Mycobacterium bovis subsp bovis AF2122/97
ggcgcugaucgcgcgcaccgg

SEQ ID NO: 1175476 - RNA, 19 nt, Mycobacterium bovis subsp bovis AF2122/97
ggcgcggugcgcucacugg

SEQ ID NO: 1175477 - RNA, 13 nt, Mycobacterium bovis subsp bovis AF2122/97
ggcgcggugccgg

SEQ ID NO: 1175478 - RNA, 19 nt, Mycobacterium bovis subsp bovis AF2122/97
ggcgcugcgcgcgauccac

SEQ ID NO: 1175479 - RNA, 18 nt, Mycobacterium bovis subsp bovis AF2122/97
ggcgcugaugcuggccau

SEQ ID NO: 1175480 - RNA, 21 nt, Mycobacterium bovis subsp bovis AF2122/97
ggcgcugauggugcugcggcg

SEQ ID NO: 1175481 - RNA, 11 nt, Mycobacterium bovis subsp bovis AF2122/97
ggcgcugcagc

SEQ ID NO: 1175482 - RNA, 12 nt, Mycobacterium bovis subsp bovis AF2122/97
ggcgcugcagca

SEQ ID NO: 1175483 - RNA, 14 nt, Mycobacterium bovis subsp bovis AF2122/97
ggcgcugcccgccg

SEQ ID NO: 1175484 - RNA, 20 nt, Mycobacterium bovis subsp bovis AF2122/97
ggcggacccggugacccgcu

SEQ ID NO: 1175485 - RNA, 16 nt, Mycobacterium bovis subsp bovis AF2122/97
ggcggacagggcggca

SEQ ID NO: 1175486 - RNA, 23 nt, Mycobacterium bovis subsp bovis AF2122/97
ggcggacccggugacccgcuggg

SEQ ID NO: 1175487 - RNA, 14 nt, Mycobacterium bovis subsp bovis AF2122/97
ggcggaccgcagcg

SEQ ID NO: 1175488 - RNA, 20 nt, Mycobacterium bovis subsp bovis AF2122/97
ggcggacccgcucgcggcga

SEQ ID NO: 1175489 - RNA, 22 nt, Mycobacterium bovis subsp bovis AF2122/97
ggcggacaccucgggcgcccgc

SEQ ID NO: 1175490 - RNA, 15 nt, Mycobacterium bovis subsp bovis AF2122/97
ggcggacaccucggg

SEQ ID NO: 1175491 - RNA, 19 nt, Mycobacterium bovis subsp bovis AF2122/97
ggcggccucccgggccgcc

SEQ ID NO: 1175492 - RNA, 11 nt, Mycobacterium bovis subsp bovis AF2122/97
ggcggccuccg

SEQ ID NO: 1175493 - RNA, 15 nt, Mycobacterium bovis subsp bovis AF2122/97
ggcggccgugucggg

SEQ ID NO: 1175494 - RNA, 19 nt, Mycobacterium bovis subsp bovis AF2122/97
ggcggccgugucgggcgcg

SEQ ID NO: 1175495 - RNA, 13 nt, Mycobacterium bovis subsp bovis AF2122/97
ggcggccuccucc

SEQ ID NO: 1175496 - RNA, 16 nt, Mycobacterium bovis subsp bovis AF2122/97
ggcggccucgccggcg

SEQ ID NO: 1175497 - RNA, 15 nt, Mycobacterium bovis subsp bovis AF2122/97
ggcggccucgcugcu

SEQ ID NO: 1175498 - RNA, 16 nt, Mycobacterium bovis subsp bovis AF2122/97
ggcggccucggggccg

SEQ ID NO: 1175499 - RNA, 17 nt, Mycobacterium bovis subsp bovis AF2122/97
ggcggccugggccagcc

SEQ ID NO: 1175500 - RNA, 13 nt, Mycobacterium bovis subsp bovis AF2122/97
ggcggccauggug

SEQ ID NO: 1175501 - RNA, 18 nt, Mycobacterium bovis subsp bovis AF2122/97
ggcggccaugucagcggc

SEQ ID NO: 1175502 - RNA, 20 nt, Mycobacterium bovis subsp bovis AF2122/97
ggcggccaugucagcggccu

SEQ ID NO: 1175503 - RNA, 23 nt, Mycobacterium bovis subsp bovis AF2122/97
ggcggccaugucagcggccugcu

SEQ ID NO: 1175504 - RNA, 14 nt, Mycobacterium bovis subsp bovis AF2122/97
ggcggccagcucgg

SEQ ID NO: 1175505 - RNA, 13 nt, Mycobacterium bovis subsp bovis AF2122/97
ggcggccagcgcg

SEQ ID NO: 1175506 - RNA, 14 nt, Mycobacterium bovis subsp bovis AF2122/97
ggcggccaccaugu

SEQ ID NO: 1175507 - RNA, 19 nt, Mycobacterium bovis subsp bovis AF2122/97
ggcggccaccucuucucgg

SEQ ID NO: 1175508 - RNA, 12 nt, Mycobacterium bovis subsp bovis AF2122/97
ggcggccacguc

SEQ ID NO: 1175509 - RNA, 12 nt, Mycobacterium bovis subsp bovis AF2122/97
ggcggccagcac

SEQ ID NO: 1175510 - RNA, 21 nt, Mycobacterium bovis subsp bovis AF2122/97
ggcggccagcaucgcgguggu

SEQ ID NO: 1175511 - RNA, 21 nt, Mycobacterium bovis subsp bovis AF2122/97
ggcggccagcaucggguggcg

SEQ ID NO: 1175512 - RNA, 23 nt, Mycobacterium bovis subsp bovis AF2122/97
ggcggcauccugcacgacccgcu

SEQ ID NO: 1175513 - RNA, 19 nt, Mycobacterium bovis subsp bovis AF2122/97
ggcggcaucgggguuggug

SEQ ID NO: 1175514 - RNA, 18 nt, Mycobacterium bovis subsp bovis AF2122/97
ggcggcacuacgcagccg

SEQ ID NO: 1175515 - RNA, 14 nt, Mycobacterium bovis subsp bovis AF2122/97
ggcggcaucaccug

SEQ ID NO: 1175516 - RNA, 17 nt, Mycobacterium bovis subsp bovis AF2122/97
ggcggacgugaccagau

SEQ ID NO: 1175517 - RNA, 19 nt, Mycobacterium bovis subsp bovis AF2122/97
ggcggagcgggccagcacc

SEQ ID NO: 1175518 - RNA, 17 nt, Mycobacterium bovis subsp bovis AF2122/97
ggcggagucgcgcaggg

SEQ ID NO: 1175519 - RNA, 15 nt, Mycobacterium bovis subsp bovis AF2122/97
ggcggaucggcggcc

SEQ ID NO: 1175520 - RNA, 15 nt, Mycobacterium bovis subsp bovis AF2122/97
ggcggaucgcgagcg

SEQ ID NO: 1175521 - RNA, 22 nt, Mycobacterium bovis subsp bovis AF2122/97
ggcggaucccgaggcgcccaac

SEQ ID NO: 1175522 - RNA, 16 nt, Mycobacterium bovis subsp bovis AF2122/97
ggcggaucgcgagcgc

SEQ ID NO: 1175523 - RNA, 18 nt, Mycobacterium bovis subsp bovis AF2122/97
ggcggaucgccggggacg

SEQ ID NO: 1175524 - RNA, 17 nt, Mycobacterium bovis subsp bovis AF2122/97
ggcggaucccgaggcgc

SEQ ID NO: 1175525 - RNA, 18 nt, Mycobacterium bovis subsp bovis AF2122/97
ggcggaucccgaggcgcc

SEQ ID NO: 1175526 - RNA, 19 nt, Mycobacterium bovis subsp bovis AF2122/97
ggcggaucugaucggcgcg

SEQ ID NO: 1175527 - RNA, 18 nt, Mycobacterium bovis subsp bovis AF2122/97
ggcggaugaugcaacgcc

SEQ ID NO: 1175528 - RNA, 16 nt, Mycobacterium bovis subsp bovis AF2122/97
ggcggcaagcucgacg

SEQ ID NO: 1175529 - RNA, 19 nt, Mycobacterium bovis subsp bovis AF2122/97
ggcggcaacccugcccggc

SEQ ID NO: 1175530 - RNA, 16 nt, Mycobacterium bovis subsp bovis AF2122/97
ggcggcaacggcggca

SEQ ID NO: 1175531 - RNA, 16 nt, Mycobacterium bovis subsp bovis AF2122/97
ggcggcaacggcggcg

SEQ ID NO: 1175532 - RNA, 17 nt, Mycobacterium bovis subsp bovis AF2122/97
ggcggcaacggcggcga

SEQ ID NO: 1175533 - RNA, 15 nt, Mycobacterium bovis subsp bovis AF2122/97
ggcggcacgcucgcg

SEQ ID NO: 1175534 - RNA, 12 nt, Mycobacterium bovis subsp bovis AF2122/97
ggcggcagcggc

SEQ ID NO: 1175535 - RNA, 14 nt, Mycobacterium bovis subsp bovis AF2122/97
ggcggcagcgaggc

SEQ ID NO: 1175536 - RNA, 16 nt, Mycobacterium bovis subsp bovis AF2122/97
ggcggcaacgggggcg

SEQ ID NO: 1175537 - RNA, 19 nt, Mycobacterium bovis subsp bovis AF2122/97
ggcggcgcgugcgguggcg

SEQ ID NO: 1175538 - RNA, 12 nt, Mycobacterium bovis subsp bovis AF2122/97
ggcggcgcucgu

SEQ ID NO: 1175539 - RNA, 21 nt, Mycobacterium bovis subsp bovis AF2122/97
ggcggccuugcgggcucucgg

SEQ ID NO: 1175540 - RNA, 13 nt, Mycobacterium bovis subsp bovis AF2122/97
ggcggcggcggca

SEQ ID NO: 1175541 - RNA, 22 nt, Mycobacterium bovis subsp bovis AF2122/97
ggcggcggcuguugcggcggcg

SEQ ID NO: 1175542 - RNA, 13 nt, Mycobacterium bovis subsp bovis AF2122/97
ggcggcggcaagu

SEQ ID NO: 1175543 - RNA, 20 nt, Mycobacterium bovis subsp bovis AF2122/97
ggcgggaacggugccgaucg

SEQ ID NO: 1175544 - RNA, 18 nt, Mycobacterium bovis subsp bovis AF2122/97
ggcggcgcugcagcugcu

SEQ ID NO: 1175545 - RNA, 14 nt, Mycobacterium bovis subsp bovis AF2122/97
ggcggcggaggcug

SEQ ID NO: 1175546 - RNA, 15 nt, Mycobacterium bovis subsp bovis AF2122/97
ggcggcggacccgcu

SEQ ID NO: 1175547 - RNA, 22 nt, Mycobacterium bovis subsp bovis AF2122/97
ggcggcggacccgcucgcggcg

SEQ ID NO: 1175548 - RNA, 21 nt, Mycobacterium bovis subsp bovis AF2122/97
ggcgggcccgaugaggacauc

SEQ ID NO: 1175549 - RNA, 13 nt, Mycobacterium bovis subsp bovis AF2122/97
ggcgggccgcgcg

SEQ ID NO: 1175550 - RNA, 18 nt, Mycobacterium bovis subsp bovis AF2122/97
ggcgggcgagugucagca

SEQ ID NO: 1175551 - RNA, 18 nt, Mycobacterium bovis subsp bovis AF2122/97
ggcgggcacucagcaggg

SEQ ID NO: 1175552 - RNA, 21 nt, Mycobacterium bovis subsp bovis AF2122/97
ggcgggcaaucaccgccggcg

SEQ ID NO: 1175553 - RNA, 19 nt, Mycobacterium bovis subsp bovis AF2122/97
ggcgggcacgcacaaguuc

SEQ ID NO: 1175554 - RNA, 16 nt, Mycobacterium bovis subsp bovis AF2122/97
ggcgggaugcgcgccc

SEQ ID NO: 1175555 - RNA, 19 nt, Mycobacterium bovis subsp bovis AF2122/97
ggcgggacaaccgggcggg

SEQ ID NO: 1175556 - RNA, 16 nt, Mycobacterium bovis subsp bovis AF2122/97
ggcggggccggcggcu

SEQ ID NO: 1175557 - RNA, 16 nt, Mycobacterium bovis subsp bovis AF2122/97
ggcggggacggcggca

SEQ ID NO: 1175558 - RNA, 12 nt, Mycobacterium bovis subsp bovis AF2122/97
ggcggggcaacu

SEQ ID NO: 1175559 - RNA, 13 nt, Mycobacterium bovis subsp bovis AF2122/97
ggcggggccggcg

SEQ ID NO: 1175560 - RNA, 16 nt, Mycobacterium bovis subsp bovis AF2122/97
ggcgggggcgucgccg

SEQ ID NO: 1175561 - RNA, 20 nt, Mycobacterium bovis subsp bovis AF2122/97
ggcgggcggugggcagcagc

SEQ ID NO: 1175562 - RNA, 21 nt, Mycobacterium bovis subsp bovis AF2122/97
ggcgggcccgccggccccgcc

SEQ ID NO: 1175563 - RNA, 15 nt, Mycobacterium bovis subsp bovis AF2122/97
ggcgggugcggcgau

SEQ ID NO: 1175564 - RNA, 15 nt, Mycobacterium bovis subsp bovis AF2122/97
ggcgggugccgagcu

SEQ ID NO: 1175565 - RNA, 15 nt, Mycobacterium bovis subsp bovis AF2122/97
ggcgggugcgacauc

SEQ ID NO: 1175566 - RNA, 12 nt, Mycobacterium bovis subsp bovis AF2122/97
ggcgggucccgc

SEQ ID NO: 1175567 - RNA, 16 nt, Mycobacterium bovis subsp bovis AF2122/97
ggcggguggugcggcc

SEQ ID NO: 1175568 - RNA, 24 nt, Mycobacterium bovis subsp bovis AF2122/97
ggcgguaaguacuagccggucggg

SEQ ID NO: 1175569 - RNA, 13 nt, Mycobacterium bovis subsp bovis AF2122/97
ggcgguaauacag

SEQ ID NO: 1175570 - RNA, 17 nt, Mycobacterium bovis subsp bovis AF2122/97
ggcgguguagccgcggu

SEQ ID NO: 1175571 - RNA, 14 nt, Mycobacterium bovis subsp bovis AF2122/97
ggcgguguccagaa

SEQ ID NO: 1175572 - RNA, 22 nt, Mycobacterium bovis subsp bovis AF2122/97
ggcgguguccagaacgguggcg

SEQ ID NO: 1175573 - RNA, 18 nt, Mycobacterium bovis subsp bovis AF2122/97
ggcggugggcagcagcug

SEQ ID NO: 1175574 - RNA, 14 nt, Mycobacterium bovis subsp bovis AF2122/97
ggcggugggcagca

SEQ ID NO: 1175575 - RNA, 17 nt, Mycobacterium bovis subsp bovis AF2122/97
ggcggugggcagcagcu

SEQ ID NO: 1175576 - RNA, 18 nt, Mycobacterium bovis subsp bovis AF2122/97
ggcgguagucggccagcu

SEQ ID NO: 1175577 - RNA, 21 nt, Mycobacterium bovis subsp bovis AF2122/97
ggcgguaugccacaggcugcc

SEQ ID NO: 1175578 - RNA, 21 nt, Mycobacterium bovis subsp bovis AF2122/97
ggcggucaccaccgacccgcu

SEQ ID NO: 1175579 - RNA, 16 nt, Mycobacterium bovis subsp bovis AF2122/97
ggcgguaugcucgcug

SEQ ID NO: 1175580 - RNA, 14 nt, Mycobacterium bovis subsp bovis AF2122/97
ggcggugucggcgc

SEQ ID NO: 1175581 - RNA, 16 nt, Mycobacterium bovis subsp bovis AF2122/97
ggcggugucggcgccg

SEQ ID NO: 1175582 - RNA, 18 nt, Mycobacterium bovis subsp bovis AF2122/97
ggcggugucgucaucggg

SEQ ID NO: 1175583 - RNA, 23 nt, Mycobacterium bovis subsp bovis AF2122/97
ggcggugucgucaucggggccug

SEQ ID NO: 1175584 - RNA, 16 nt, Mycobacterium bovis subsp bovis AF2122/97
ggcgguguugcucccg

SEQ ID NO: 1175585 - RNA, 21 nt, Mycobacterium bovis subsp bovis AF2122/97
ggcgguuccauacagccgccg

SEQ ID NO: 1175586 - RNA, 14 nt, Mycobacterium bovis subsp bovis AF2122/97
ggcgaugcagccgg

SEQ ID NO: 1175587 - RNA, 19 nt, Mycobacterium bovis subsp bovis AF2122/97
ggcgaugaugacggcggcc

SEQ ID NO: 1175588 - RNA, 16 nt, Mycobacterium bovis subsp bovis AF2122/97
ggcgauuacggccagu

SEQ ID NO: 1175589 - RNA, 19 nt, Mycobacterium bovis subsp bovis AF2122/97
ggcgauuucggcgccggcg

SEQ ID NO: 1175590 - RNA, 23 nt, Mycobacterium bovis subsp bovis AF2122/97
ggcgauucugcgucugcucggcg

SEQ ID NO: 1175591 - RNA, 22 nt, Mycobacterium bovis subsp bovis AF2122/97
ggcgauucugugucugcucgcg

SEQ ID NO: 1175592 - RNA, 16 nt, Mycobacterium bovis subsp bovis AF2122/97
ggcgauuggcugugau

SEQ ID NO: 1175593 - RNA, 18 nt, Mycobacterium bovis subsp bovis AF2122/97
ggcgcaccaccgccccgc

SEQ ID NO: 1175594 - RNA, 22 nt, Mycobacterium bovis subsp bovis AF2122/97
ggcgcaccacaccacgguggcc

SEQ ID NO: 1175595 - RNA, 18 nt, Mycobacterium bovis subsp bovis AF2122/97
ggcgauuuugcgucugcu

SEQ ID NO: 1175596 - RNA, 20 nt, Mycobacterium bovis subsp bovis AF2122/97
ggcgcaaaccacccgcaaca

SEQ ID NO: 1175597 - RNA, 22 nt, Mycobacterium bovis subsp bovis AF2122/97
ggcgauuuugcgucugcucgcg

SEQ ID NO: 1175598 - RNA, 19 nt, Mycobacterium bovis subsp bovis AF2122/97
ggcgcacgguccacggugg

SEQ ID NO: 1175599 - RNA, 17 nt, Mycobacterium bovis subsp bovis AF2122/97
ggcgcaccaucgcggcc

SEQ ID NO: 1175600 - RNA, 23 nt, Mycobacterium bovis subsp bovis AF2122/97
ggcgcaccaucgcggccgcuggg

SEQ ID NO: 1175601 - RNA, 15 nt, Mycobacterium bovis subsp bovis AF2122/97
ggcgcacucccggau

SEQ ID NO: 1175602 - RNA, 14 nt, Mycobacterium bovis subsp bovis AF2122/97
ggcgcacgcccgca

SEQ ID NO: 1175603 - RNA, 22 nt, Mycobacterium bovis subsp bovis AF2122/97
aaauacagggugucacgcccau

SEQ ID NO: 1175604 - RNA, 15 nt, Mycobacterium bovis subsp bovis AF2122/97
ggcgccaccgucgcc

SEQ ID NO: 1175605 - RNA, 18 nt, Mycobacterium bovis subsp bovis AF2122/97
ggcgccagaucgacgcca

SEQ ID NO: 1175606 - RNA, 14 nt, Mycobacterium bovis subsp bovis AF2122/97
ggcgccagccgacc

SEQ ID NO: 1175607 - RNA, 19 nt, Mycobacterium bovis subsp bovis AF2122/97
ggcgccaccgccgcugccg

SEQ ID NO: 1175608 - RNA, 16 nt, Mycobacterium bovis subsp bovis AF2122/97
ggcgccaccggcgccg

SEQ ID NO: 1175609 - RNA, 16 nt, Mycobacterium bovis subsp bovis AF2122/97
ggcgaucagcagccgc

SEQ ID NO: 1175610 - RNA, 19 nt, Mycobacterium bovis subsp bovis AF2122/97
ggcgaucaccgcgccggag

SEQ ID NO: 1175611 - RNA, 19 nt, Mycobacterium bovis subsp bovis AF2122/97
ggcgaucagcagccgccga

SEQ ID NO: 1175612 - RNA, 20 nt, Mycobacterium bovis subsp bovis AF2122/97
ggcgaucuggucggcggccu

SEQ ID NO: 1175613 - RNA, 21 nt, Mycobacterium bovis subsp bovis AF2122/97
ggcgaucuggucggcggccuc

SEQ ID NO: 1175614 - RNA, 14 nt, Mycobacterium bovis subsp bovis AF2122/97
ggcgaugagcgugc

SEQ ID NO: 1175615 - RNA, 23 nt, Mycobacterium bovis subsp bovis AF2122/97
ggcgaugagggcuuguggugagc

SEQ ID NO: 1175616 - RNA, 23 nt, Mycobacterium bovis subsp bovis AF2122/97
ggcgaugaucaccagucgcugau

SEQ ID NO: 1175617 - RNA, 18 nt, Mycobacterium bovis subsp bovis AF2122/97
ggcgaucuugcgacgccc

SEQ ID NO: 1175618 - RNA, 19 nt, Mycobacterium bovis subsp bovis AF2122/97
ggcgaugaccacgccgacg

SEQ ID NO: 1175619 - RNA, 20 nt, Mycobacterium bovis subsp bovis AF2122/97
ggcgaucaacucgggcagcg

SEQ ID NO: 1175620 - RNA, 14 nt, Mycobacterium bovis subsp bovis AF2122/97
ggcgaaccagcgcg

SEQ ID NO: 1175621 - RNA, 22 nt, Mycobacterium bovis subsp bovis AF2122/97
ggcgaacccgccgaugcugccg

SEQ ID NO: 1175622 - RNA, 20 nt, Mycobacterium bovis subsp bovis AF2122/97
ggcgaaccgucagcgcgccg

SEQ ID NO: 1175623 - RNA, 13 nt, Mycobacterium bovis subsp bovis AF2122/97
ggcgacagcgcgg

SEQ ID NO: 1175624 - RNA, 18 nt, Mycobacterium bovis subsp bovis AF2122/97
ggcgaaccgucagcgcgc

SEQ ID NO: 1175625 - RNA, 18 nt, Mycobacterium bovis subsp bovis AF2122/97
ggcgacaaucgagaacgc

SEQ ID NO: 1175626 - RNA, 22 nt, Mycobacterium bovis subsp bovis AF2122/97
ggcgacaaucgagaacgcccgc

SEQ ID NO: 1175627 - RNA, 17 nt, Mycobacterium bovis subsp bovis AF2122/97
ggcgacaucgagaucgc

SEQ ID NO: 1175628 - RNA, 21 nt, Mycobacterium bovis subsp bovis AF2122/97
ggcgacaucgagaucgccguu

SEQ ID NO: 1175629 - RNA, 17 nt, Mycobacterium bovis subsp bovis AF2122/97
ggcgacagcgcggcggu

SEQ ID NO: 1175630 - RNA, 18 nt, Mycobacterium bovis subsp bovis AF2122/97
ggcgacagcgcggcgguc

SEQ ID NO: 1175631 - RNA, 22 nt, Mycobacterium bovis subsp bovis AF2122/97
ggcgaccccgaacauccgccgc

SEQ ID NO: 1175632 - RNA, 20 nt, Mycobacterium bovis subsp bovis AF2122/97
ggcgacccggucacucuggc

SEQ ID NO: 1175633 - RNA, 21 nt, Mycobacterium bovis subsp bovis AF2122/97
ggcgacccggucacucuggcg

SEQ ID NO: 1175634 - RNA, 13 nt, Mycobacterium bovis subsp bovis AF2122/97
ggcgaccggccgg

SEQ ID NO: 1175635 - RNA, 18 nt, Mycobacterium bovis subsp bovis AF2122/97
ggcgaccggggaucgggg

SEQ ID NO: 1175636 - RNA, 14 nt, Mycobacterium bovis subsp bovis AF2122/97
ggcgaccugcucgc

SEQ ID NO: 1175637 - RNA, 16 nt, Mycobacterium bovis subsp bovis AF2122/97
ggcgaccugcucgcug

SEQ ID NO: 1175638 - RNA, 20 nt, Mycobacterium bovis subsp bovis AF2122/97
ggcgaccugccggaccgcgg

SEQ ID NO: 1175639 - RNA, 16 nt, Mycobacterium bovis subsp bovis AF2122/97
ggcgaccucggcggcg

SEQ ID NO: 1175640 - RNA, 19 nt, Mycobacterium bovis subsp bovis AF2122/97
ggcgaccacccccggcagg

SEQ ID NO: 1175641 - RNA, 20 nt, Mycobacterium bovis subsp bovis AF2122/97
ggcgaccacccccggcaggc

SEQ ID NO: 1175642 - RNA, 22 nt, Mycobacterium bovis subsp bovis AF2122/97
ggcgaccaacacgucgagcagc

SEQ ID NO: 1175643 - RNA, 19 nt, Mycobacterium bovis subsp bovis AF2122/97
ggcgaccaccgcggcugcu

SEQ ID NO: 1175644 - RNA, 20 nt, Mycobacterium bovis subsp bovis AF2122/97
ggcgaccagcucagcugcgg

SEQ ID NO: 1175645 - RNA, 13 nt, Mycobacterium bovis subsp bovis AF2122/97
ggcgaccaggagc

SEQ ID NO: 1175646 - RNA, 14 nt, Mycobacterium bovis subsp bovis AF2122/97
ggcgaccaggagcc

SEQ ID NO: 1175647 - RNA, 12 nt, Mycobacterium bovis subsp bovis AF2122/97
ggcgaccacggc

SEQ ID NO: 1175648 - RNA, 19 nt, Mycobacterium bovis subsp bovis AF2122/97
ggcgaccagcucagcugcg

SEQ ID NO: 1175649 - RNA, 16 nt, Mycobacterium bovis subsp bovis AF2122/97
ggccgacccggauguc

SEQ ID NO: 1175650 - RNA, 13 nt, Mycobacterium bovis subsp bovis AF2122/97
ggccgaccagagc

SEQ ID NO: 1175651 - RNA, 13 nt, Mycobacterium bovis subsp bovis AF2122/97
ggccgaccagcac

SEQ ID NO: 1175652 - RNA, 18 nt, Mycobacterium bovis subsp bovis AF2122/97
ggccgacgauagcggccc

SEQ ID NO: 1175653 - RNA, 22 nt, Mycobacterium bovis subsp bovis AF2122/97
ggccgaccgggcucuggccagu

SEQ ID NO: 1175654 - RNA, 12 nt, Mycobacterium bovis subsp bovis AF2122/97
ggccgacgcugc

SEQ ID NO: 1175655 - RNA, 16 nt, Mycobacterium bovis subsp bovis AF2122/97
ggccgacgugaccagc

SEQ ID NO: 1175656 - RNA, 17 nt, Mycobacterium bovis subsp bovis AF2122/97
ggccgacgugaccagcu

SEQ ID NO: 1175657 - RNA, 20 nt, Mycobacterium bovis subsp bovis AF2122/97
ggccgagaucacgccgggcg

SEQ ID NO: 1175658 - RNA, 19 nt, Mycobacterium bovis subsp bovis AF2122/97
ggcgaacacgucggccagu

SEQ ID NO: 1175659 - RNA, 17 nt, Mycobacterium bovis subsp bovis AF2122/97
ggccuuugagcgcggcc

SEQ ID NO: 1175660 - RNA, 16 nt, Mycobacterium bovis subsp bovis AF2122/97
ggcgacgucggcggcu

SEQ ID NO: 1175661 - RNA, 18 nt, Mycobacterium bovis subsp bovis AF2122/97
ggcgacugcagcgaagcc

SEQ ID NO: 1175662 - RNA, 16 nt, Mycobacterium bovis subsp bovis AF2122/97
ggcgacucugcggggc

SEQ ID NO: 1175663 - RNA, 22 nt, Mycobacterium bovis subsp bovis AF2122/97
ggcgacuacccagccagccgcg

SEQ ID NO: 1175664 - RNA, 14 nt, Mycobacterium bovis subsp bovis AF2122/97
ggcgacggugccac

SEQ ID NO: 1175665 - RNA, 18 nt, Mycobacterium bovis subsp bovis AF2122/97
ggcgagcacaugcugccg

SEQ ID NO: 1175666 - RNA, 22 nt, Mycobacterium bovis subsp bovis AF2122/97
ggcgagcagacgcauaagcccc

SEQ ID NO: 1175667 - RNA, 12 nt, Mycobacterium bovis subsp bovis AF2122/97
ggcgagcagaga

SEQ ID NO: 1175668 - RNA, 18 nt, Mycobacterium bovis subsp bovis AF2122/97
ggcgagacauugacgagg

SEQ ID NO: 1175669 - RNA, 13 nt, Mycobacterium bovis subsp bovis AF2122/97
ggcgagcagcagg

SEQ ID NO: 1175670 - RNA, 21 nt, Mycobacterium bovis subsp bovis AF2122/97
ggcgagcagagaacuccgcca

SEQ ID NO: 1175671 - RNA, 15 nt, Mycobacterium bovis subsp bovis AF2122/97
ggcgagccggcgcgc

SEQ ID NO: 1175672 - RNA, 11 nt, Mycobacterium bovis subsp bovis AF2122/97
ggcgagcgcgc

SEQ ID NO: 1175673 - RNA, 12 nt, Mycobacterium bovis subsp bovis AF2122/97
ggcgagcgcgcc

SEQ ID NO: 1175674 - RNA, 14 nt, Mycobacterium bovis subsp bovis AF2122/97
ggcgagcggccagu

SEQ ID NO: 1175675 - RNA, 16 nt, Mycobacterium bovis subsp bovis AF2122/97
ggcgagcggccuccag

SEQ ID NO: 1175676 - RNA, 16 nt, Mycobacterium bovis subsp bovis AF2122/97
ggcgagcgcggccugc

SEQ ID NO: 1175677 - RNA, 23 nt, Mycobacterium bovis subsp bovis AF2122/97
ggcgagcuccgaugccgacggcg

SEQ ID NO: 1175678 - RNA, 20 nt, Mycobacterium bovis subsp bovis AF2122/97
ggcgagcuaacacccgagca

SEQ ID NO: 1175679 - RNA, 13 nt, Mycobacterium bovis subsp bovis AF2122/97
ggcgagcucgucg

SEQ ID NO: 1175680 - RNA, 17 nt, Mycobacterium bovis subsp bovis AF2122/97
ggcgagcucgucgagcg

SEQ ID NO: 1175681 - RNA, 19 nt, Mycobacterium bovis subsp bovis AF2122/97
ggcgacgaaguccccguag

SEQ ID NO: 1175682 - RNA, 18 nt, Mycobacterium bovis subsp bovis AF2122/97
ggcgacgaacugaagccc

SEQ ID NO: 1175683 - RNA, 17 nt, Mycobacterium bovis subsp bovis AF2122/97
ggcgacgaugucgagcg

SEQ ID NO: 1175684 - RNA, 21 nt, Mycobacterium bovis subsp bovis AF2122/97
ggcgacgaucucgccgccagc

SEQ ID NO: 1175685 - RNA, 13 nt, Mycobacterium bovis subsp bovis AF2122/97
ggcgacggcggcg

SEQ ID NO: 1175686 - RNA, 17 nt, Mycobacterium bovis subsp bovis AF2122/97
ggcgacggccagcgcgu

SEQ ID NO: 1175687 - RNA, 21 nt, Mycobacterium bovis subsp bovis AF2122/97
ggcgacgcggaguccgucgac

SEQ ID NO: 1175688 - RNA, 14 nt, Mycobacterium bovis subsp bovis AF2122/97
ggcgacggccagcg

SEQ ID NO: 1175689 - RNA, 15 nt, Mycobacterium bovis subsp bovis AF2122/97
ggcugcauccuccuc

SEQ ID NO: 1175690 - RNA, 20 nt, Mycobacterium bovis subsp bovis AF2122/97
ggcugcaguaaaugggccuc

SEQ ID NO: 1175691 - RNA, 20 nt, Mycobacterium bovis subsp bovis AF2122/97
ggcugccgaaguugaagaag

SEQ ID NO: 1175692 - RNA, 21 nt, Mycobacterium bovis subsp bovis AF2122/97
ggcugcgccgaacaccacacc

SEQ ID NO: 1175693 - RNA, 22 nt, Mycobacterium bovis subsp bovis AF2122/97
ggcugcgcucgcccgcggccgu

SEQ ID NO: 1175694 - RNA, 21 nt, Mycobacterium bovis subsp bovis AF2122/97
ggcugcgcuuugcacagcggc

SEQ ID NO: 1175695 - RNA, 24 nt, Mycobacterium bovis subsp bovis AF2122/97
ggcugcgcuuugcacagcggcauc

SEQ ID NO: 1175696 - RNA, 18 nt, Mycobacterium bovis subsp bovis AF2122/97
ggcugcggaugcgcggcg

SEQ ID NO: 1175697 - RNA, 22 nt, Mycobacterium bovis subsp bovis AF2122/97
ggcugccggcaacagcucgccu

SEQ ID NO: 1175698 - RNA, 21 nt, Mycobacterium bovis subsp bovis AF2122/97
ggcugccgcaccaaggccgcc

SEQ ID NO: 1175699 - RNA, 19 nt, Mycobacterium bovis subsp bovis AF2122/97
ggcugccuucggcgagcgg

SEQ ID NO: 1175700 - RNA, 15 nt, Mycobacterium bovis subsp bovis AF2122/97
ggcugcgaccggcuc

SEQ ID NO: 1175701 - RNA, 16 nt, Mycobacterium bovis subsp bovis AF2122/97
ggcugcgaccggcucc

SEQ ID NO: 1175702 - RNA, 17 nt, Mycobacterium bovis subsp bovis AF2122/97
ggcugccgucuccuggu

SEQ ID NO: 1175703 - RNA, 20 nt, Mycobacterium bovis subsp bovis AF2122/97
ggcugccuccaucaacugca

SEQ ID NO: 1175704 - RNA, 22 nt, Mycobacterium bovis subsp bovis AF2122/97
ggcugccguugauucggccgcc

SEQ ID NO: 1175705 - RNA, 20 nt, Mycobacterium bovis subsp bovis AF2122/97
ggcugaccucccacccccgg

SEQ ID NO: 1175706 - RNA, 15 nt, Mycobacterium bovis subsp bovis AF2122/97
ggcugaacggcagcc

SEQ ID NO: 1175707 - RNA, 15 nt, Mycobacterium bovis subsp bovis AF2122/97
ggcugagcccgccgc

SEQ ID NO: 1175708 - RNA, 17 nt, Mycobacterium bovis subsp bovis AF2122/97
ggcugaggaacgccggc

SEQ ID NO: 1175709 - RNA, 23 nt, Mycobacterium bovis subsp bovis AF2122/97
ggcugauggacggugcgcagggc

SEQ ID NO: 1175710 - RNA, 23 nt, Mycobacterium bovis subsp bovis AF2122/97
ggcugagacgguguugcucgccg

SEQ ID NO: 1175711 - RNA, 15 nt, Mycobacterium bovis subsp bovis AF2122/97
ggcugauucgagcca

SEQ ID NO: 1175712 - RNA, 18 nt, Mycobacterium bovis subsp bovis AF2122/97
ggcugcaaccagcggcac

SEQ ID NO: 1175713 - RNA, 16 nt, Mycobacterium bovis subsp bovis AF2122/97
ggcguagugcucgccg

SEQ ID NO: 1175714 - RNA, 14 nt, Mycobacterium bovis subsp bovis AF2122/97
ggcguagucggcgg

SEQ ID NO: 1175715 - RNA, 14 nt, Mycobacterium bovis subsp bovis AF2122/97
ggcguagugcagcu

SEQ ID NO: 1175716 - RNA, 22 nt, Mycobacterium bovis subsp bovis AF2122/97
ggcguauugcaccgccaggucg

SEQ ID NO: 1175717 - RNA, 23 nt, Mycobacterium bovis subsp bovis AF2122/97
ggcucaucgaagcuucggccuuc

SEQ ID NO: 1175718 - RNA, 12 nt, Mycobacterium bovis subsp bovis AF2122/97
ggcucauggcau

SEQ ID NO: 1175719 - RNA, 15 nt, Mycobacterium bovis subsp bovis AF2122/97
ggcucgagcucggcg

SEQ ID NO: 1175720 - RNA, 21 nt, Mycobacterium bovis subsp bovis AF2122/97
ggcuccuggucgccgugggcc

SEQ ID NO: 1175721 - RNA, 17 nt, Mycobacterium bovis subsp bovis AF2122/97
ggcuccagcgcgcgccg

SEQ ID NO: 1175722 - RNA, 21 nt, Mycobacterium bovis subsp bovis AF2122/97
ggcuccucgugcacgcacagc

SEQ ID NO: 1175723 - RNA, 20 nt, Mycobacterium bovis subsp bovis AF2122/97
ggcuccaccgggcccgccgg

SEQ ID NO: 1175724 - RNA, 15 nt, Mycobacterium bovis subsp bovis AF2122/97
ggcuccagcgcgcgc

SEQ ID NO: 1175725 - RNA, 21 nt, Mycobacterium bovis subsp bovis AF2122/97
ggcucgcgcucgauggcggcc

SEQ ID NO: 1175726 - RNA, 19 nt, Mycobacterium bovis subsp bovis AF2122/97
ggcucgccggcggcccgcu

SEQ ID NO: 1175727 - RNA, 21 nt, Mycobacterium bovis subsp bovis AF2122/97
ggcucgcccgcuacggcagcc

SEQ ID NO: 1175728 - RNA, 21 nt, Mycobacterium bovis subsp bovis AF2122/97
ggcucgcauguucuccacgcc

SEQ ID NO: 1175729 - RNA, 14 nt, Mycobacterium bovis subsp bovis AF2122/97
ggcucggcaggccc

SEQ ID NO: 1175730 - RNA, 13 nt, Mycobacterium bovis subsp bovis AF2122/97
ggcucggccggag

SEQ ID NO: 1175731 - RNA, 19 nt, Mycobacterium bovis subsp bovis AF2122/97
ggcucggcgaaacccggga

SEQ ID NO: 1175732 - RNA, 24 nt, Mycobacterium bovis subsp bovis AF2122/97
ggcucggcgaaacccgggaucagc

SEQ ID NO: 1175733 - RNA, 13 nt, Mycobacterium bovis subsp bovis AF2122/97
ggcucgcucgccg

SEQ ID NO: 1175734 - RNA, 17 nt, Mycobacterium bovis subsp bovis AF2122/97
ggcucgcucgccgagcu

SEQ ID NO: 1175735 - RNA, 18 nt, Mycobacterium bovis subsp bovis AF2122/97
ggcucggucggcagcucc

SEQ ID NO: 1175736 - RNA, 13 nt, Mycobacterium bovis subsp bovis AF2122/97
ggcucgggcagcg

SEQ ID NO: 1175737 - RNA, 18 nt, Mycobacterium bovis subsp bovis AF2122/97
ggcucgggugcgcccggc

SEQ ID NO: 1175738 - RNA, 12 nt, Mycobacterium bovis subsp bovis AF2122/97
ggcucggcggcc

SEQ ID NO: 1175739 - RNA, 16 nt, Mycobacterium bovis subsp bovis AF2122/97
ggcucggcgucgccgc

SEQ ID NO: 1175740 - RNA, 20 nt, Mycobacterium bovis subsp bovis AF2122/97
ggcucgguggcgccggggcg

SEQ ID NO: 1175741 - RNA, 17 nt, Mycobacterium bovis subsp bovis AF2122/97
ggcucguggcgacggcg

SEQ ID NO: 1175742 - RNA, 16 nt, Mycobacterium bovis subsp bovis AF2122/97
ggcucgugcgcuuggu

SEQ ID NO: 1175743 - RNA, 19 nt, Mycobacterium bovis subsp bovis AF2122/97
ggcucuagaucgccgagcg

SEQ ID NO: 1175744 - RNA, 20 nt, Mycobacterium bovis subsp bovis AF2122/97
ggcucucuucgcgcgcuggg

SEQ ID NO: 1175745 - RNA, 22 nt, Mycobacterium bovis subsp bovis AF2122/97
ggcuugcaaggucgcugcuugc

SEQ ID NO: 1175746 - RNA, 18 nt, Mycobacterium bovis subsp bovis AF2122/97
ggcuugacccuugggcac

SEQ ID NO: 1175747 - RNA, 20 nt, Mycobacterium bovis subsp bovis AF2122/97
ggcuucggcggccgagcgca

SEQ ID NO: 1175748 - RNA, 15 nt, Mycobacterium bovis subsp bovis AF2122/97
ggcuucggcagccgc

SEQ ID NO: 1175749 - RNA, 15 nt, Mycobacterium bovis subsp bovis AF2122/97
ggcuucggcgagcgc

SEQ ID NO: 1175750 - RNA, 19 nt, Mycobacterium bovis subsp bovis AF2122/97
ggcuucucguucguaggga

SEQ ID NO: 1175751 - RNA, 21 nt, Mycobacterium bovis subsp bovis AF2122/97
ggcuuggugaaccgcgcggcg

SEQ ID NO: 1175752 - RNA, 18 nt, Mycobacterium bovis subsp bovis AF2122/97
ggcuuggggucccgccgg

SEQ ID NO: 1175753 - RNA, 16 nt, Mycobacterium bovis subsp bovis AF2122/97
ggcuuggaccagcgug

SEQ ID NO: 1175754 - RNA, 14 nt, Mycobacterium bovis subsp bovis AF2122/97
ggcuuggccaucac

SEQ ID NO: 1175755 - RNA, 13 nt, Mycobacterium bovis subsp bovis AF2122/97
ggcuugcaccugc

SEQ ID NO: 1175756 - RNA, 21 nt, Mycobacterium bovis subsp bovis AF2122/97
ggcuugccgauggcgguggcg

SEQ ID NO: 1175757 - RNA, 19 nt, Mycobacterium bovis subsp bovis AF2122/97
ggcuugcgcgacgagacgc

SEQ ID NO: 1175758 - RNA, 17 nt, Mycobacterium bovis subsp bovis AF2122/97
ggcuugcgauuggcugg

SEQ ID NO: 1175759 - RNA, 18 nt, Mycobacterium bovis subsp bovis AF2122/97
ggcuugcgauuggcuggg

SEQ ID NO: 1175760 - RNA, 21 nt, Mycobacterium bovis subsp bovis AF2122/97
ggcuuaugcgucugcucgccg

SEQ ID NO: 1175761 - RNA, 16 nt, Mycobacterium bovis subsp bovis AF2122/97
ggcuguugcggcggcg

SEQ ID NO: 1175762 - RNA, 23 nt, Mycobacterium bovis subsp bovis AF2122/97
ggcuuccaacucggcggccagcg

SEQ ID NO: 1175763 - RNA, 21 nt, Mycobacterium bovis subsp bovis AF2122/97
ggcuucacccaaccccgccgg

SEQ ID NO: 1175764 - RNA, 19 nt, Mycobacterium bovis subsp bovis AF2122/97
ggcuucgccgcgggacaga

SEQ ID NO: 1175765 - RNA, 19 nt, Mycobacterium bovis subsp bovis AF2122/97
ggcuucgacgcuuccuggg

SEQ ID NO: 1175766 - RNA, 15 nt, Mycobacterium bovis subsp bovis AF2122/97
ggcuuccuccucggc

SEQ ID NO: 1175767 - RNA, 19 nt, Mycobacterium bovis subsp bovis AF2122/97
ggcuuccggcgcgaccggu

SEQ ID NO: 1175768 - RNA, 15 nt, Mycobacterium bovis subsp bovis AF2122/97
ggcugcguuggcugg

SEQ ID NO: 1175769 - RNA, 14 nt, Mycobacterium bovis subsp bovis AF2122/97
ggcugcguggcggg

SEQ ID NO: 1175770 - RNA, 14 nt, Mycobacterium bovis subsp bovis AF2122/97
ggcugcucgacggc

SEQ ID NO: 1175771 - RNA, 16 nt, Mycobacterium bovis subsp bovis AF2122/97
ggcugcguuggcuggu

SEQ ID NO: 1175772 - RNA, 12 nt, Mycobacterium bovis subsp bovis AF2122/97
ggcugcuccugg

SEQ ID NO: 1175773 - RNA, 18 nt, Mycobacterium bovis subsp bovis AF2122/97
ggcuggaccacucgccgg

SEQ ID NO: 1175774 - RNA, 21 nt, Mycobacterium bovis subsp bovis AF2122/97
ggcugcuuggucgcccagcca

SEQ ID NO: 1175775 - RNA, 20 nt, Mycobacterium bovis subsp bovis AF2122/97
ggcuggaccacucgccggcg

SEQ ID NO: 1175776 - RNA, 21 nt, Mycobacterium bovis subsp bovis AF2122/97
ggcuggaccacucgccggcgg

SEQ ID NO: 1175777 - RNA, 15 nt, Mycobacterium bovis subsp bovis AF2122/97
ggcuggacggcgccg

SEQ ID NO: 1175778 - RNA, 17 nt, Mycobacterium bovis subsp bovis AF2122/97
ggcuggcaucccgggca

SEQ ID NO: 1175779 - RNA, 16 nt, Mycobacterium bovis subsp bovis AF2122/97
ggcuggcgccccaggu

SEQ ID NO: 1175780 - RNA, 14 nt, Mycobacterium bovis subsp bovis AF2122/97
ggcuggcggcgacc

SEQ ID NO: 1175781 - RNA, 24 nt, Mycobacterium bovis subsp bovis AF2122/97
ggcuggcccgcaugccggcgcacc

SEQ ID NO: 1175782 - RNA, 13 nt, Mycobacterium bovis subsp bovis AF2122/97
ggcugggcccgcc

SEQ ID NO: 1175783 - RNA, 14 nt, Mycobacterium bovis subsp bovis AF2122/97
ggcugggcccgccg

SEQ ID NO: 1175784 - RNA, 14 nt, Mycobacterium bovis subsp bovis AF2122/97
ggcuggggccgcuu

SEQ ID NO: 1175785 - RNA, 21 nt, Mycobacterium bovis subsp bovis AF2122/97
ggcuggguaugcacccaggca

SEQ ID NO: 1175786 - RNA, 19 nt, Mycobacterium bovis subsp bovis AF2122/97
ggcuggucuacccgcggcg

SEQ ID NO: 1175787 - RNA, 12 nt, Mycobacterium bovis subsp bovis AF2122/97
ggcugguagcug

SEQ ID NO: 1175788 - RNA, 20 nt, Mycobacterium bovis subsp bovis AF2122/97
ggcuguaacacccggccgcc

SEQ ID NO: 1175789 - RNA, 19 nt, Mycobacterium bovis subsp bovis AF2122/97
ggcuggugccaacugcgcc

SEQ ID NO: 1175790 - RNA, 14 nt, Mycobacterium bovis subsp bovis AF2122/97
ggcugucacaagcc

SEQ ID NO: 1175791 - RNA, 18 nt, Mycobacterium bovis subsp bovis AF2122/97
ggcugucacaagccugcc

SEQ ID NO: 1175792 - RNA, 21 nt, Mycobacterium bovis subsp bovis AF2122/97
ggcugucgagucgguccugcc

SEQ ID NO: 1175793 - RNA, 15 nt, Mycobacterium bovis subsp bovis AF2122/97
ggcuguggccagcau

SEQ ID NO: 1175794 - RNA, 14 nt, Mycobacterium bovis subsp bovis AF2122/97
ggcuguccaccgag

SEQ ID NO: 1175795 - RNA, 19 nt, Mycobacterium bovis subsp bovis AF2122/97
gggcaccacuuggguggcg

SEQ ID NO: 1175796 - RNA, 12 nt, Mycobacterium bovis subsp bovis AF2122/97
gggcacagccag

SEQ ID NO: 1175797 - RNA, 15 nt, Mycobacterium bovis subsp bovis AF2122/97
gggcacagccauggu

SEQ ID NO: 1175798 - RNA, 20 nt, Mycobacterium bovis subsp bovis AF2122/97
gggcacaauaggcuccagcg

SEQ ID NO: 1175799 - RNA, 18 nt, Mycobacterium bovis subsp bovis AF2122/97
gggcacaccgacgccgcc

SEQ ID NO: 1175800 - RNA, 16 nt, Mycobacterium bovis subsp bovis AF2122/97
gggcaaucacaucaaa

SEQ ID NO: 1175801 - RNA, 19 nt, Mycobacterium bovis subsp bovis AF2122/97
gggcaauacguagucgccg

SEQ ID NO: 1175802 - RNA, 17 nt, Mycobacterium bovis subsp bovis AF2122/97
gggcaagcugaccgcca

SEQ ID NO: 1175803 - RNA, 16 nt, Mycobacterium bovis subsp bovis AF2122/97
gggcaagaaaguucca

SEQ ID NO: 1175804 - RNA, 15 nt, Mycobacterium bovis subsp bovis AF2122/97
gggcaaggcggcggc

SEQ ID NO: 1175805 - RNA, 16 nt, Mycobacterium bovis subsp bovis AF2122/97
gggcaaggcggcggcc

SEQ ID NO: 1175806 - RNA, 17 nt, Mycobacterium bovis subsp bovis AF2122/97
gggcaaggcggcggcca

SEQ ID NO: 1175807 - RNA, 22 nt, Mycobacterium bovis subsp bovis AF2122/97
gggcacgaucgucgcggccaag

SEQ ID NO: 1175808 - RNA, 14 nt, Mycobacterium bovis subsp bovis AF2122/97
gggcaccgagcuga

SEQ ID NO: 1175809 - RNA, 22 nt, Mycobacterium bovis subsp bovis AF2122/97
gggcaccgagcugagcggccag

SEQ ID NO: 1175810 - RNA, 13 nt, Mycobacterium bovis subsp bovis AF2122/97
gggcaccggccgg

SEQ ID NO: 1175811 - RNA, 17 nt, Mycobacterium bovis subsp bovis AF2122/97
gggcagaaucggugggc

SEQ ID NO: 1175812 - RNA, 19 nt, Mycobacterium bovis subsp bovis AF2122/97
gggcacuccgggcucggcg

SEQ ID NO: 1175813 - RNA, 14 nt, Mycobacterium bovis subsp bovis AF2122/97
gggcacgggcaacg

SEQ ID NO: 1175814 - RNA, 12 nt, Mycobacterium bovis subsp bovis AF2122/97
gggcacuggggu

SEQ ID NO: 1175815 - RNA, 17 nt, Mycobacterium bovis subsp bovis AF2122/97
gggcaggcggccagcga

SEQ ID NO: 1175816 - RNA, 22 nt, Mycobacterium bovis subsp bovis AF2122/97
gggcaggccccacuggugcagc

SEQ ID NO: 1175817 - RNA, 14 nt, Mycobacterium bovis subsp bovis AF2122/97
gggcaguagcugug

SEQ ID NO: 1175818 - RNA, 14 nt, Mycobacterium bovis subsp bovis AF2122/97
gggcagucaacucc

SEQ ID NO: 1175819 - RNA, 16 nt, Mycobacterium bovis subsp bovis AF2122/97
gggcagucaggccuag

SEQ ID NO: 1175820 - RNA, 14 nt, Mycobacterium bovis subsp bovis AF2122/97
gggcaguccaggca

SEQ ID NO: 1175821 - RNA, 16 nt, Mycobacterium bovis subsp bovis AF2122/97
gggcaguggcagcccg

SEQ ID NO: 1175822 - RNA, 13 nt, Mycobacterium bovis subsp bovis AF2122/97
gggcagugcgcgg

SEQ ID NO: 1175823 - RNA, 18 nt, Mycobacterium bovis subsp bovis AF2122/97
gggcaguuuggcggcagg

SEQ ID NO: 1175824 - RNA, 19 nt, Mycobacterium bovis subsp bovis AF2122/97
gggcagcgaaacgagccgg

SEQ ID NO: 1175825 - RNA, 17 nt, Mycobacterium bovis subsp bovis AF2122/97
gggcagcgcgugcugug

SEQ ID NO: 1175826 - RNA, 21 nt, Mycobacterium bovis subsp bovis AF2122/97
gggcagcgcgugcuguggaug

SEQ ID NO: 1175827 - RNA, 11 nt, Mycobacterium bovis subsp bovis AF2122/97
gggcagcuggc

SEQ ID NO: 1175828 - RNA, 14 nt, Mycobacterium bovis subsp bovis AF2122/97
gggcagcgggccgc

SEQ ID NO: 1175829 - RNA, 16 nt, Mycobacterium bovis subsp bovis AF2122/97
gggcagcgcggccagu

SEQ ID NO: 1175830 - RNA, 14 nt, Mycobacterium bovis subsp bovis AF2122/97
gggcagcgccucca

SEQ ID NO: 1175831 - RNA, 18 nt, Mycobacterium bovis subsp bovis AF2122/97
gggcagcuccaccaggac

SEQ ID NO: 1175832 - RNA, 15 nt, Mycobacterium bovis subsp bovis AF2122/97
gggcagcugguaggu

SEQ ID NO: 1175833 - RNA, 20 nt, Mycobacterium bovis subsp bovis AF2122/97
gggcagcugguaggucaccg

SEQ ID NO: 1175834 - RNA, 14 nt, Mycobacterium bovis subsp bovis AF2122/97
gggcagcuguucgg

SEQ ID NO: 1175835 - RNA, 22 nt, Mycobacterium bovis subsp bovis AF2122/97
gggcagcaucaacaccggcugg

SEQ ID NO: 1175836 - RNA, 16 nt, Mycobacterium bovis subsp bovis AF2122/97
gggcagauucuucacc

SEQ ID NO: 1175837 - RNA, 14 nt, Mycobacterium bovis subsp bovis AF2122/97
gggcagcagcuggu

SEQ ID NO: 1175838 - RNA, 19 nt, Mycobacterium bovis subsp bovis AF2122/97
gggcagcaggcccacccgg

SEQ ID NO: 1175839 - RNA, 17 nt, Mycobacterium bovis subsp bovis AF2122/97
gggaucgguggcggcac

SEQ ID NO: 1175840 - RNA, 16 nt, Mycobacterium bovis subsp bovis AF2122/97
gggaucuagaugcgga

SEQ ID NO: 1175841 - RNA, 16 nt, Mycobacterium bovis subsp bovis AF2122/97
gggaugagaucaucca

SEQ ID NO: 1175842 - RNA, 17 nt, Mycobacterium bovis subsp bovis AF2122/97
gggaugcagcugcccgg

SEQ ID NO: 1175843 - RNA, 23 nt, Mycobacterium bovis subsp bovis AF2122/97
gggaugcucgauccacugccgcg

SEQ ID NO: 1175844 - RNA, 21 nt, Mycobacterium bovis subsp bovis AF2122/97
gggauggacggcagccagcca

SEQ ID NO: 1175845 - RNA, 17 nt, Mycobacterium bovis subsp bovis AF2122/97
gggauuaugccggcaac

SEQ ID NO: 1175846 - RNA, 22 nt, Mycobacterium bovis subsp bovis AF2122/97
gggcaaaucaagcacagcccgg

SEQ ID NO: 1175847 - RNA, 19 nt, Mycobacterium bovis subsp bovis AF2122/97
gggcaaaucaagcacagcc

SEQ ID NO: 1175848 - RNA, 14 nt, Mycobacterium bovis subsp bovis AF2122/97
gggcaaaucaagca

SEQ ID NO: 1175849 - RNA, 18 nt, Mycobacterium bovis subsp bovis AF2122/97
gggcaacgaucagguugg

SEQ ID NO: 1175850 - RNA, 16 nt, Mycobacterium bovis subsp bovis AF2122/97
gggauugcgggccugc

SEQ ID NO: 1175851 - RNA, 14 nt, Mycobacterium bovis subsp bovis AF2122/97
gggauucggccaga

SEQ ID NO: 1175852 - RNA, 13 nt, Mycobacterium bovis subsp bovis AF2122/97
gggauucuggaug

SEQ ID NO: 1175853 - RNA, 17 nt, Mycobacterium bovis subsp bovis AF2122/97
gggcaaacugggcaccg

SEQ ID NO: 1175854 - RNA, 13 nt, Mycobacterium bovis subsp bovis AF2122/97
gggaucaugacca

SEQ ID NO: 1175855 - RNA, 13 nt, Mycobacterium bovis subsp bovis AF2122/97
gggaucccccgcg

SEQ ID NO: 1175856 - RNA, 21 nt, Mycobacterium bovis subsp bovis AF2122/97
gggauccgaagagccagcaac

SEQ ID NO: 1175857 - RNA, 17 nt, Mycobacterium bovis subsp bovis AF2122/97
gggauccgcgcgcugga

SEQ ID NO: 1175858 - RNA, 15 nt, Mycobacterium bovis subsp bovis AF2122/97
gggaucgggcccucc

SEQ ID NO: 1175859 - RNA, 17 nt, Mycobacterium bovis subsp bovis AF2122/97
gggaucgccguccagca

SEQ ID NO: 1175860 - RNA, 13 nt, Mycobacterium bovis subsp bovis AF2122/97
gggaucgcccagg

SEQ ID NO: 1175861 - RNA, 19 nt, Mycobacterium bovis subsp bovis AF2122/97
gggauccacgcaaacgggg

SEQ ID NO: 1175862 - RNA, 17 nt, Mycobacterium bovis subsp bovis AF2122/97
gggauccagcaggccgg

SEQ ID NO: 1175863 - RNA, 14 nt, Mycobacterium bovis subsp bovis AF2122/97
gggaucacgccacc

SEQ ID NO: 1175864 - RNA, 21 nt, Mycobacterium bovis subsp bovis AF2122/97
gggaucacaccccaggcaccc

SEQ ID NO: 1175865 - RNA, 20 nt, Mycobacterium bovis subsp bovis AF2122/97
gggaggccaacccugcggcg

SEQ ID NO: 1175866 - RNA, 17 nt, Mycobacterium bovis subsp bovis AF2122/97
gggaguacgggagccgg

SEQ ID NO: 1175867 - RNA, 22 nt, Mycobacterium bovis subsp bovis AF2122/97
gggagucgucggcaugggccgg

SEQ ID NO: 1175868 - RNA, 15 nt, Mycobacterium bovis subsp bovis AF2122/97
gggauaggccguggu

SEQ ID NO: 1175869 - RNA, 16 nt, Mycobacterium bovis subsp bovis AF2122/97
gggaguugaucuccac

SEQ ID NO: 1175870 - RNA, 17 nt, Mycobacterium bovis subsp bovis AF2122/97
gggagugcgccggcugg

SEQ ID NO: 1175871 - RNA, 21 nt, Mycobacterium bovis subsp bovis AF2122/97
gggauacucgucgucggcagg

SEQ ID NO: 1175872 - RNA, 17 nt, Mycobacterium bovis subsp bovis AF2122/97
gggaacgaugccgccgg

SEQ ID NO: 1175873 - RNA, 20 nt, Mycobacterium bovis subsp bovis AF2122/97
gggaacgcggaagccgccua

SEQ ID NO: 1175874 - RNA, 20 nt, Mycobacterium bovis subsp bovis AF2122/97
gggaacguccgcgccgagcc

SEQ ID NO: 1175875 - RNA, 20 nt, Mycobacterium bovis subsp bovis AF2122/97
gggaaccguccaagccggcu

SEQ ID NO: 1175876 - RNA, 20 nt, Mycobacterium bovis subsp bovis AF2122/97
gggaaccacggucagcacgc

SEQ ID NO: 1175877 - RNA, 17 nt, Mycobacterium bovis subsp bovis AF2122/97
gggaaacccggccagcu

SEQ ID NO: 1175878 - RNA, 22 nt, Mycobacterium bovis subsp bovis AF2122/97
gggaaaaucacaauuccacaaa

SEQ ID NO: 1175879 - RNA, 12 nt, Mycobacterium bovis subsp bovis AF2122/97
gggaaacaccgg

SEQ ID NO: 1175880 - RNA, 18 nt, Mycobacterium bovis subsp bovis AF2122/97
gggaagcgcguccaacca

SEQ ID NO: 1175881 - RNA, 21 nt, Mycobacterium bovis subsp bovis AF2122/97
gggaaggaaccgggcaaauca

SEQ ID NO: 1175882 - RNA, 23 nt, Mycobacterium bovis subsp bovis AF2122/97
gggaaggaaccgggcaaaucaag

SEQ ID NO: 1175883 - RNA, 20 nt, Mycobacterium bovis subsp bovis AF2122/97
gggaagagccgggcucgucg

SEQ ID NO: 1175884 - RNA, 13 nt, Mycobacterium bovis subsp bovis AF2122/97
gggaacccgagcu

SEQ ID NO: 1175885 - RNA, 20 nt, Mycobacterium bovis subsp bovis AF2122/97
gggaagacgaccgugcuggg

SEQ ID NO: 1175886 - RNA, 18 nt, Mycobacterium bovis subsp bovis AF2122/97
ggcuuuuacgucugcucg

SEQ ID NO: 1175887 - RNA, 22 nt, Mycobacterium bovis subsp bovis AF2122/97
gggaaaacgggguggcacgcau

SEQ ID NO: 1175888 - RNA, 16 nt, Mycobacterium bovis subsp bovis AF2122/97
ggcuuugccgcuguga

SEQ ID NO: 1175889 - RNA, 17 nt, Mycobacterium bovis subsp bovis AF2122/97
ggcuuuggacaggucaa

SEQ ID NO: 1175890 - RNA, 16 nt, Mycobacterium bovis subsp bovis AF2122/97
ggcuuguucggacuca

SEQ ID NO: 1175891 - RNA, 17 nt, Mycobacterium bovis subsp bovis AF2122/97
gggaccccgccagccgg

SEQ ID NO: 1175892 - RNA, 14 nt, Mycobacterium bovis subsp bovis AF2122/97
gggacccgagauca

SEQ ID NO: 1175893 - RNA, 22 nt, Mycobacterium bovis subsp bovis AF2122/97
gggaccacccgguccugcucgc

SEQ ID NO: 1175894 - RNA, 21 nt, Mycobacterium bovis subsp bovis AF2122/97
gggaccagugcgguggcaggu

SEQ ID NO: 1175895 - RNA, 19 nt, Mycobacterium bovis subsp bovis AF2122/97
gggaccggcaggccggcgu

SEQ ID NO: 1175896 - RNA, 14 nt, Mycobacterium bovis subsp bovis AF2122/97
gggacccggggccg

SEQ ID NO: 1175897 - RNA, 17 nt, Mycobacterium bovis subsp bovis AF2122/97
gggaccgccccggccag

SEQ ID NO: 1175898 - RNA, 12 nt, Mycobacterium bovis subsp bovis AF2122/97
gggaccgcccga

SEQ ID NO: 1175899 - RNA, 15 nt, Mycobacterium bovis subsp bovis AF2122/97
gggacaccaaaagga

SEQ ID NO: 1175900 - RNA, 12 nt, Mycobacterium bovis subsp bovis AF2122/97
gggacaccaucu

SEQ ID NO: 1175901 - RNA, 18 nt, Mycobacterium bovis subsp bovis AF2122/97
gggacacgucgcgccagg

SEQ ID NO: 1175902 - RNA, 22 nt, Mycobacterium bovis subsp bovis AF2122/97
gggacaaucguccacccgagcu

SEQ ID NO: 1175903 - RNA, 11 nt, Mycobacterium bovis subsp bovis AF2122/97
gggacaacucg

SEQ ID NO: 1175904 - RNA, 24 nt, Mycobacterium bovis subsp bovis AF2122/97
gggacgacgccaccugacgugcgg

SEQ ID NO: 1175905 - RNA, 22 nt, Mycobacterium bovis subsp bovis AF2122/97
gggacgaaucccgcgcccggcc

SEQ ID NO: 1175906 - RNA, 13 nt, Mycobacterium bovis subsp bovis AF2122/97
gggacggcggcga

SEQ ID NO: 1175907 - RNA, 15 nt, Mycobacterium bovis subsp bovis AF2122/97
gggacggcggcgagg

SEQ ID NO: 1175908 - RNA, 18 nt, Mycobacterium bovis subsp bovis AF2122/97
gggacggucgcucggcau

SEQ ID NO: 1175909 - RNA, 17 nt, Mycobacterium bovis subsp bovis AF2122/97
gggacguuguccaccgc

SEQ ID NO: 1175910 - RNA, 12 nt, Mycobacterium bovis subsp bovis AF2122/97
gggacugcagcg

SEQ ID NO: 1175911 - RNA, 16 nt, Mycobacterium bovis subsp bovis AF2122/97
gggacugugggggcgc

SEQ ID NO: 1175912 - RNA, 16 nt, Mycobacterium bovis subsp bovis AF2122/97
gggacuucgugccucg

SEQ ID NO: 1175913 - RNA, 15 nt, Mycobacterium bovis subsp bovis AF2122/97
gggagcccggcggcc

SEQ ID NO: 1175914 - RNA, 22 nt, Mycobacterium bovis subsp bovis AF2122/97
gggagacgcugcgcgccagaca

SEQ ID NO: 1175915 - RNA, 20 nt, Mycobacterium bovis subsp bovis AF2122/97
gggagcaccgaccagggccg

SEQ ID NO: 1175916 - RNA, 17 nt, Mycobacterium bovis subsp bovis AF2122/97
gggagcagagaaaccgc

SEQ ID NO: 1175917 - RNA, 14 nt, Mycobacterium bovis subsp bovis AF2122/97
gggagccacugcgg

SEQ ID NO: 1175918 - RNA, 17 nt, Mycobacterium bovis subsp bovis AF2122/97
gggagccacugcggcau

SEQ ID NO: 1175919 - RNA, 20 nt, Mycobacterium bovis subsp bovis AF2122/97
ggggccccgcgccggccgca

SEQ ID NO: 1175920 - RNA, 19 nt, Mycobacterium bovis subsp bovis AF2122/97
ggggccccgcggcgccgcc

SEQ ID NO: 1175921 - RNA, 16 nt, Mycobacterium bovis subsp bovis AF2122/97
ggggcccgaccugucc

SEQ ID NO: 1175922 - RNA, 22 nt, Mycobacterium bovis subsp bovis AF2122/97
ggggccgagccgacaucgaugu

SEQ ID NO: 1175923 - RNA, 20 nt, Mycobacterium bovis subsp bovis AF2122/97
ggggccgccagcugcgcagc

SEQ ID NO: 1175924 - RNA, 22 nt, Mycobacterium bovis subsp bovis AF2122/97
ggggccgcgucucggugcagca

SEQ ID NO: 1175925 - RNA, 12 nt, Mycobacterium bovis subsp bovis AF2122/97
ggggcagcgcga

SEQ ID NO: 1175926 - RNA, 13 nt, Mycobacterium bovis subsp bovis AF2122/97
ggggcagcgcggc

SEQ ID NO: 1175927 - RNA, 15 nt, Mycobacterium bovis subsp bovis AF2122/97
ggggccacccgcaga

SEQ ID NO: 1175928 - RNA, 19 nt, Mycobacterium bovis subsp bovis AF2122/97
ggggcaucggugcgguucg

SEQ ID NO: 1175929 - RNA, 14 nt, Mycobacterium bovis subsp bovis AF2122/97
ggggcgcagcgcgg

SEQ ID NO: 1175930 - RNA, 15 nt, Mycobacterium bovis subsp bovis AF2122/97
ggggcgccgccguug

SEQ ID NO: 1175931 - RNA, 23 nt, Mycobacterium bovis subsp bovis AF2122/97
ggggcgcacgauggugugcagca

SEQ ID NO: 1175932 - RNA, 15 nt, Mycobacterium bovis subsp bovis AF2122/97
ggggcgcccggccag

SEQ ID NO: 1175933 - RNA, 17 nt, Mycobacterium bovis subsp bovis AF2122/97
ggggcgcgccggcuagg

SEQ ID NO: 1175934 - RNA, 17 nt, Mycobacterium bovis subsp bovis AF2122/97
ggggcgcgugggcgugc

SEQ ID NO: 1175935 - RNA, 20 nt, Mycobacterium bovis subsp bovis AF2122/97
ggggcgcuuccguggcccaa

SEQ ID NO: 1175936 - RNA, 23 nt, Mycobacterium bovis subsp bovis AF2122/97
ggggcgccggauauggcaguguc

SEQ ID NO: 1175937 - RNA, 22 nt, Mycobacterium bovis subsp bovis AF2122/97
ggggcgccuucaccuggugugc

SEQ ID NO: 1175938 - RNA, 21 nt, Mycobacterium bovis subsp bovis AF2122/97
ggggccgcucacaagccgugc

SEQ ID NO: 1175939 - RNA, 18 nt, Mycobacterium bovis subsp bovis AF2122/97
ggggccggcggcucgggu

SEQ ID NO: 1175940 - RNA, 14 nt, Mycobacterium bovis subsp bovis AF2122/97
ggggccggucgggc

SEQ ID NO: 1175941 - RNA, 20 nt, Mycobacterium bovis subsp bovis AF2122/97
ggggccucguugaccagaac

SEQ ID NO: 1175942 - RNA, 16 nt, Mycobacterium bovis subsp bovis AF2122/97
ggggcgaacggcaccg

SEQ ID NO: 1175943 - RNA, 15 nt, Mycobacterium bovis subsp bovis AF2122/97
ggggccggccggcaa

SEQ ID NO: 1175944 - RNA, 21 nt, Mycobacterium bovis subsp bovis AF2122/97
ggggcggccggcggccauggu

SEQ ID NO: 1175945 - RNA, 17 nt, Mycobacterium bovis subsp bovis AF2122/97
ggggcggcggugggcgc

SEQ ID NO: 1175946 - RNA, 13 nt, Mycobacterium bovis subsp bovis AF2122/97
ggggcgucguucg

SEQ ID NO: 1175947 - RNA, 19 nt, Mycobacterium bovis subsp bovis AF2122/97
ggggcgugacagggcggca

SEQ ID NO: 1175948 - RNA, 22 nt, Mycobacterium bovis subsp bovis AF2122/97
ggggcgucgcaacccggccugg

SEQ ID NO: 1175949 - RNA, 21 nt, Mycobacterium bovis subsp bovis AF2122/97
ggggcggucggccggcucguc

SEQ ID NO: 1175950 - RNA, 18 nt, Mycobacterium bovis subsp bovis AF2122/97
ggggcguuguugggcgag

SEQ ID NO: 1175951 - RNA, 20 nt, Mycobacterium bovis subsp bovis AF2122/97
ggggcgugacagggcggcaa

SEQ ID NO: 1175952 - RNA, 20 nt, Mycobacterium bovis subsp bovis AF2122/97
ggggcuacaacugccgagca

SEQ ID NO: 1175953 - RNA, 15 nt, Mycobacterium bovis subsp bovis AF2122/97
ggggcucagcggugg

SEQ ID NO: 1175954 - RNA, 17 nt, Mycobacterium bovis subsp bovis AF2122/97
ggggcucaaccccgucc

SEQ ID NO: 1175955 - RNA, 22 nt, Mycobacterium bovis subsp bovis AF2122/97
ggggcucucgaguccaggcagc

SEQ ID NO: 1175956 - RNA, 17 nt, Mycobacterium bovis subsp bovis AF2122/97
ggggcucguaggugggc

SEQ ID NO: 1175957 - RNA, 24 nt, Mycobacterium bovis subsp bovis AF2122/97
ggggcgucgcaacccggccuggag

SEQ ID NO: 1175958 - RNA, 18 nt, Mycobacterium bovis subsp bovis AF2122/97
ggggcuucaucuggcgcc

SEQ ID NO: 1175959 - RNA, 13 nt, Mycobacterium bovis subsp bovis AF2122/97
ggggcuguacucg

SEQ ID NO: 1175960 - RNA, 14 nt, Mycobacterium bovis subsp bovis AF2122/97
ggggcugugcaggc

SEQ ID NO: 1175961 - RNA, 18 nt, Mycobacterium bovis subsp bovis AF2122/97
ggggcuuuugcgucugcu

SEQ ID NO: 1175962 - RNA, 22 nt, Mycobacterium bovis subsp bovis AF2122/97
ggggcuuuugcgucugcucgcc

SEQ ID NO: 1175963 - RNA, 19 nt, Mycobacterium bovis subsp bovis AF2122/97
gggggccucguugaccaga

SEQ ID NO: 1175964 - RNA, 16 nt, Mycobacterium bovis subsp bovis AF2122/97
gggggauccagcaggc

SEQ ID NO: 1175965 - RNA, 19 nt, Mycobacterium bovis subsp bovis AF2122/97
gggggauccagcaggccgg

SEQ ID NO: 1175966 - RNA, 13 nt, Mycobacterium bovis subsp bovis AF2122/97
gggggagcgaacg

SEQ ID NO: 1175967 - RNA, 15 nt, Mycobacterium bovis subsp bovis AF2122/97
gggggagcggccgcc

SEQ ID NO: 1175968 - RNA, 14 nt, Mycobacterium bovis subsp bovis AF2122/97
ggggaucagcgagu

SEQ ID NO: 1175969 - RNA, 19 nt, Mycobacterium bovis subsp bovis AF2122/97
ggggaucgcuggccgcgag

SEQ ID NO: 1175970 - RNA, 16 nt, Mycobacterium bovis subsp bovis AF2122/97
ggggaguugcuugcag

SEQ ID NO: 1175971 - RNA, 23 nt, Mycobacterium bovis subsp bovis AF2122/97
ggggaguggaaacccgccgaacg

SEQ ID NO: 1175972 - RNA, 18 nt, Mycobacterium bovis subsp bovis AF2122/97
ggggaucgcuggccgcga

SEQ ID NO: 1175973 - RNA, 23 nt, Mycobacterium bovis subsp bovis AF2122/97
ggggauucgucgugcgggcgggc

SEQ ID NO: 1175974 - RNA, 16 nt, Mycobacterium bovis subsp bovis AF2122/97
ggggcacuggggucug

SEQ ID NO: 1175975 - RNA, 18 nt, Mycobacterium bovis subsp bovis AF2122/97
ggggauguuuuuggccgc

SEQ ID NO: 1175976 - RNA, 17 nt, Mycobacterium bovis subsp bovis AF2122/97
ggggcaccacgccagcc

SEQ ID NO: 1175977 - RNA, 20 nt, Mycobacterium bovis subsp bovis AF2122/97
ggggcaccagcgaauccagc

SEQ ID NO: 1175978 - RNA, 23 nt, Mycobacterium bovis subsp bovis AF2122/97
ggggcagcacgucacgcaaccgg

SEQ ID NO: 1175979 - RNA, 18 nt, Mycobacterium bovis subsp bovis AF2122/97
ggggcacuuccagcccgg

SEQ ID NO: 1175980 - RNA, 14 nt, Mycobacterium bovis subsp bovis AF2122/97
ggggaagccugcgg

SEQ ID NO: 1175981 - RNA, 21 nt, Mycobacterium bovis subsp bovis AF2122/97
ggggaaaccggccagccgacg

SEQ ID NO: 1175982 - RNA, 14 nt, Mycobacterium bovis subsp bovis AF2122/97
ggggaaucacccac

SEQ ID NO: 1175983 - RNA, 21 nt, Mycobacterium bovis subsp bovis AF2122/97
ggggaacguccgcgccgagcc

SEQ ID NO: 1175984 - RNA, 21 nt, Mycobacterium bovis subsp bovis AF2122/97
ggggacccgcuccaagcgcgg

SEQ ID NO: 1175985 - RNA, 22 nt, Mycobacterium bovis subsp bovis AF2122/97
ggggaccccgccagccggagcg

SEQ ID NO: 1175986 - RNA, 12 nt, Mycobacterium bovis subsp bovis AF2122/97
ggggaccccgcc

SEQ ID NO: 1175987 - RNA, 14 nt, Mycobacterium bovis subsp bovis AF2122/97
ggggaccccgccag

SEQ ID NO: 1175988 - RNA, 17 nt, Mycobacterium bovis subsp bovis AF2122/97
ggggaguaguggugggc

SEQ ID NO: 1175989 - RNA, 12 nt, Mycobacterium bovis subsp bovis AF2122/97
ggggaggcuagg

SEQ ID NO: 1175990 - RNA, 14 nt, Mycobacterium bovis subsp bovis AF2122/97
ggggacgggucggc

SEQ ID NO: 1175991 - RNA, 14 nt, Mycobacterium bovis subsp bovis AF2122/97
ggggacgggcggcc

SEQ ID NO: 1175992 - RNA, 20 nt, Mycobacterium bovis subsp bovis AF2122/97
ggggacggcggcgaggcggu

SEQ ID NO: 1175993 - RNA, 13 nt, Mycobacterium bovis subsp bovis AF2122/97
ggggacgccgcgg

SEQ ID NO: 1175994 - RNA, 19 nt, Mycobacterium bovis subsp bovis AF2122/97
ggggacgccgcggcgccgg

SEQ ID NO: 1175995 - RNA, 16 nt, Mycobacterium bovis subsp bovis AF2122/97
ggggaccgcggcgcgu

SEQ ID NO: 1175996 - RNA, 21 nt, Mycobacterium bovis subsp bovis AF2122/97
ggggaagaucucggccaggau

SEQ ID NO: 1175997 - RNA, 13 nt, Mycobacterium bovis subsp bovis AF2122/97
ggggaccggcagg

SEQ ID NO: 1175998 - RNA, 18 nt, Mycobacterium bovis subsp bovis AF2122/97
gggcuguccgaccucgcc

SEQ ID NO: 1175999 - RNA, 22 nt, Mycobacterium bovis subsp bovis AF2122/97
gggcuguucggccauggcggcg

SEQ ID NO: 1176000 - RNA, 15 nt, Mycobacterium bovis subsp bovis AF2122/97
gggcuguugacgcca

SEQ ID NO: 1176001 - RNA, 21 nt, Mycobacterium bovis subsp bovis AF2122/97
gggcuggucuacccgcggcgc

SEQ ID NO: 1176002 - RNA, 17 nt, Mycobacterium bovis subsp bovis AF2122/97
gggcuuaggccgcggca

SEQ ID NO: 1176003 - RNA, 19 nt, Mycobacterium bovis subsp bovis AF2122/97
gggcugccggccagacggu

SEQ ID NO: 1176004 - RNA, 13 nt, Mycobacterium bovis subsp bovis AF2122/97
gggcuggccagca

SEQ ID NO: 1176005 - RNA, 14 nt, Mycobacterium bovis subsp bovis AF2122/97
gggcuggccagcac

SEQ ID NO: 1176006 - RNA, 14 nt, Mycobacterium bovis subsp bovis AF2122/97
gggcuugcgcagca

SEQ ID NO: 1176007 - RNA, 14 nt, Mycobacterium bovis subsp bovis AF2122/97
gggcuugagcgccg

SEQ ID NO: 1176008 - RNA, 16 nt, Mycobacterium bovis subsp bovis AF2122/97
gggcuugugggccggu

SEQ ID NO: 1176009 - RNA, 17 nt, Mycobacterium bovis subsp bovis AF2122/97
gggcuucugcgucugcu

SEQ ID NO: 1176010 - RNA, 20 nt, Mycobacterium bovis subsp bovis AF2122/97
gggcuuucgcgugcggcugc

SEQ ID NO: 1176011 - RNA, 23 nt, Mycobacterium bovis subsp bovis AF2122/97
gggcuuucgcgugcggcugccag

SEQ ID NO: 1176012 - RNA, 14 nt, Mycobacterium bovis subsp bovis AF2122/97
ggggaacaccgcgg

SEQ ID NO: 1176013 - RNA, 16 nt, Mycobacterium bovis subsp bovis AF2122/97
ggggaaagccgcagcc

SEQ ID NO: 1176014 - RNA, 16 nt, Mycobacterium bovis subsp bovis AF2122/97
gggucugcgccgccgg

SEQ ID NO: 1176015 - RNA, 16 nt, Mycobacterium bovis subsp bovis AF2122/97
gggucuggcaggccag

SEQ ID NO: 1176016 - RNA, 15 nt, Mycobacterium bovis subsp bovis AF2122/97
gggucugggucaggc

SEQ ID NO: 1176017 - RNA, 18 nt, Mycobacterium bovis subsp bovis AF2122/97
gggucuggcaggccagca

SEQ ID NO: 1176018 - RNA, 20 nt, Mycobacterium bovis subsp bovis AF2122/97
gggucgugccccggcgcggu

SEQ ID NO: 1176019 - RNA, 18 nt, Mycobacterium bovis subsp bovis AF2122/97
gggucguugaggccggug

SEQ ID NO: 1176020 - RNA, 21 nt, Mycobacterium bovis subsp bovis AF2122/97
gggucugacaucggccaaggu

SEQ ID NO: 1176021 - RNA, 17 nt, Mycobacterium bovis subsp bovis AF2122/97
gggugaccaggcggcgc

SEQ ID NO: 1176022 - RNA, 18 nt, Mycobacterium bovis subsp bovis AF2122/97
gggugaccaacacccccc

SEQ ID NO: 1176023 - RNA, 20 nt, Mycobacterium bovis subsp bovis AF2122/97
gggucuugacggcgccaggc

SEQ ID NO: 1176024 - RNA, 21 nt, Mycobacterium bovis subsp bovis AF2122/97
gggucggucgguaacggcggu

SEQ ID NO: 1176025 - RNA, 14 nt, Mycobacterium bovis subsp bovis AF2122/97
gggucgccggcacc

SEQ ID NO: 1176026 - RNA, 18 nt, Mycobacterium bovis subsp bovis AF2122/97
gggucgcgcuggcgccgg

SEQ ID NO: 1176027 - RNA, 23 nt, Mycobacterium bovis subsp bovis AF2122/97
gggucgcgcuggcgccggccagc

SEQ ID NO: 1176028 - RNA, 15 nt, Mycobacterium bovis subsp bovis AF2122/97
gggucggcacgaccc

SEQ ID NO: 1176029 - RNA, 18 nt, Mycobacterium bovis subsp bovis AF2122/97
gggucggcacgacccggg

SEQ ID NO: 1176030 - RNA, 20 nt, Mycobacterium bovis subsp bovis AF2122/97
gggucgucauacagcgcccu

SEQ ID NO: 1176031 - RNA, 22 nt, Mycobacterium bovis subsp bovis AF2122/97
gggucgguuuccuccggcagca

SEQ ID NO: 1176032 - RNA, 17 nt, Mycobacterium bovis subsp bovis AF2122/97
gggucguacaacacggg

SEQ ID NO: 1176033 - RNA, 13 nt, Mycobacterium bovis subsp bovis AF2122/97
gggucgggcaccg

SEQ ID NO: 1176034 - RNA, 15 nt, Mycobacterium bovis subsp bovis AF2122/97
ggguccggauggccc

SEQ ID NO: 1176035 - RNA, 17 nt, Mycobacterium bovis subsp bovis AF2122/97
gggucgaccccggccag

SEQ ID NO: 1176036 - RNA, 19 nt, Mycobacterium bovis subsp bovis AF2122/97
gggucgaccccggccagga

SEQ ID NO: 1176037 - RNA, 18 nt, Mycobacterium bovis subsp bovis AF2122/97
gggucgaucaccgacacc

SEQ ID NO: 1176038 - RNA, 15 nt, Mycobacterium bovis subsp bovis AF2122/97
gggucaggaucgcaa

SEQ ID NO: 1176039 - RNA, 14 nt, Mycobacterium bovis subsp bovis AF2122/97
gggucaggccgacg

SEQ ID NO: 1176040 - RNA, 17 nt, Mycobacterium bovis subsp bovis AF2122/97
gggucaggcgaaccugg

SEQ ID NO: 1176041 - RNA, 18 nt, Mycobacterium bovis subsp bovis AF2122/97
ggguccgcgucggcggcg

SEQ ID NO: 1176042 - RNA, 22 nt, Mycobacterium bovis subsp bovis AF2122/97
ggguccgacgguguagccgccg

SEQ ID NO: 1176043 - RNA, 14 nt, Mycobacterium bovis subsp bovis AF2122/97
ggguccagcgagga

SEQ ID NO: 1176044 - RNA, 13 nt, Mycobacterium bovis subsp bovis AF2122/97
gggucagcccagc

SEQ ID NO: 1176045 - RNA, 19 nt, Mycobacterium bovis subsp bovis AF2122/97
gggucacaaacccagcauc

SEQ ID NO: 1176046 - RNA, 19 nt, Mycobacterium bovis subsp bovis AF2122/97
gggucaccgauucggccag

SEQ ID NO: 1176047 - RNA, 23 nt, Mycobacterium bovis subsp bovis AF2122/97
gggucaccagcgcaucggccagc

SEQ ID NO: 1176048 - RNA, 15 nt, Mycobacterium bovis subsp bovis AF2122/97
gggucacaaaaccug

SEQ ID NO: 1176049 - RNA, 20 nt, Mycobacterium bovis subsp bovis AF2122/97
gggucaaucccacgcccggc

SEQ ID NO: 1176050 - RNA, 21 nt, Mycobacterium bovis subsp bovis AF2122/97
gggucaaugcuggcagcggcc

SEQ ID NO: 1176051 - RNA, 12 nt, Mycobacterium bovis subsp bovis AF2122/97
gggucaaccggu

SEQ ID NO: 1176052 - RNA, 20 nt, Mycobacterium bovis subsp bovis AF2122/97
ggguaucgacccuccagcac

SEQ ID NO: 1176053 - RNA, 17 nt, Mycobacterium bovis subsp bovis AF2122/97
ggguaugcacccaggca

SEQ ID NO: 1176054 - RNA, 19 nt, Mycobacterium bovis subsp bovis AF2122/97
ggguaucgacccuccagca

SEQ ID NO: 1176055 - RNA, 17 nt, Mycobacterium bovis subsp bovis AF2122/97
gggguugaucaccgaca

SEQ ID NO: 1176056 - RNA, 15 nt, Mycobacterium bovis subsp bovis AF2122/97
gggguugcggcagcu

SEQ ID NO: 1176057 - RNA, 17 nt, Mycobacterium bovis subsp bovis AF2122/97
gggguugcggcagcugg

SEQ ID NO: 1176058 - RNA, 12 nt, Mycobacterium bovis subsp bovis AF2122/97
ggguaacguguu

SEQ ID NO: 1176059 - RNA, 14 nt, Mycobacterium bovis subsp bovis AF2122/97
ggguagauccgccg

SEQ ID NO: 1176060 - RNA, 18 nt, Mycobacterium bovis subsp bovis AF2122/97
ggguagaccuucucgccg

SEQ ID NO: 1176061 - RNA, 18 nt, Mycobacterium bovis subsp bovis AF2122/97
ggguacgacaccgcagcg

SEQ ID NO: 1176062 - RNA, 24 nt, Mycobacterium bovis subsp bovis AF2122/97
ggguacgacaccgcagcgggcggu

SEQ ID NO: 1176063 - RNA, 17 nt, Mycobacterium bovis subsp bovis AF2122/97
ggguacccgggaaugga

SEQ ID NO: 1176064 - RNA, 14 nt, Mycobacterium bovis subsp bovis AF2122/97
ggguacgccgggca

SEQ ID NO: 1176065 - RNA, 21 nt, Mycobacterium bovis subsp bovis AF2122/97
ggguagauguucacgccgccg

SEQ ID NO: 1176066 - RNA, 13 nt, Mycobacterium bovis subsp bovis AF2122/97
ggguagcggcgcc

SEQ ID NO: 1176067 - RNA, 18 nt, Mycobacterium bovis subsp bovis AF2122/97
ggguagcguucaaggucu

SEQ ID NO: 1176068 - RNA, 15 nt, Mycobacterium bovis subsp bovis AF2122/97
ggguagccgccggcg

SEQ ID NO: 1176069 - RNA, 16 nt, Mycobacterium bovis subsp bovis AF2122/97
ggguaguugaggccgu

SEQ ID NO: 1176070 - RNA, 21 nt, Mycobacterium bovis subsp bovis AF2122/97
ggggucggccugcggcaccgg

SEQ ID NO: 1176071 - RNA, 20 nt, Mycobacterium bovis subsp bovis AF2122/97
ggggugaacgcggacaccgc

SEQ ID NO: 1176072 - RNA, 20 nt, Mycobacterium bovis subsp bovis AF2122/97
ggggugcccggccgccagcg

SEQ ID NO: 1176073 - RNA, 16 nt, Mycobacterium bovis subsp bovis AF2122/97
ggggugugcgggcggu

SEQ ID NO: 1176074 - RNA, 15 nt, Mycobacterium bovis subsp bovis AF2122/97
gggguggcggcaggu

SEQ ID NO: 1176075 - RNA, 15 nt, Mycobacterium bovis subsp bovis AF2122/97
gggguggcagcgcgg

SEQ ID NO: 1176076 - RNA, 20 nt, Mycobacterium bovis subsp bovis AF2122/97
gggguggccaccagcggcau

SEQ ID NO: 1176077 - RNA, 13 nt, Mycobacterium bovis subsp bovis AF2122/97
gggguggcgcggg

SEQ ID NO: 1176078 - RNA, 14 nt, Mycobacterium bovis subsp bovis AF2122/97
ggggugugcggggu

SEQ ID NO: 1176079 - RNA, 15 nt, Mycobacterium bovis subsp bovis AF2122/97
ggggguccggcggcc

SEQ ID NO: 1176080 - RNA, 17 nt, Mycobacterium bovis subsp bovis AF2122/97
ggggguccggcggccgc

SEQ ID NO: 1176081 - RNA, 18 nt, Mycobacterium bovis subsp bovis AF2122/97
ggggguccggcggccgcc

SEQ ID NO: 1176082 - RNA, 21 nt, Mycobacterium bovis subsp bovis AF2122/97
gggggcuuaugcgucugcucg

SEQ ID NO: 1176083 - RNA, 15 nt, Mycobacterium bovis subsp bovis AF2122/97
ggggguagccgccgg

SEQ ID NO: 1176084 - RNA, 12 nt, Mycobacterium bovis subsp bovis AF2122/97
ggggguggcagc

SEQ ID NO: 1176085 - RNA, 15 nt, Mycobacterium bovis subsp bovis AF2122/97
ggggucaggcaggag

SEQ ID NO: 1176086 - RNA, 16 nt, Mycobacterium bovis subsp bovis AF2122/97
ggggucgcaggccagg

SEQ ID NO: 1176087 - RNA, 16 nt, Mycobacterium bovis subsp bovis AF2122/97
ggggucgccggcaccg

SEQ ID NO: 1176088 - RNA, 23 nt, Mycobacterium bovis subsp bovis AF2122/97
ggggucagugcgggcggcgucug

SEQ ID NO: 1176089 - RNA, 14 nt, Mycobacterium bovis subsp bovis AF2122/97
gggguaggggucga

SEQ ID NO: 1176090 - RNA, 21 nt, Mycobacterium bovis subsp bovis AF2122/97
gggguagaccuucucgccgcc

SEQ ID NO: 1176091 - RNA, 23 nt, Mycobacterium bovis subsp bovis AF2122/97
gggguaauacgcggggccggccg

SEQ ID NO: 1176092 - RNA, 15 nt, Mycobacterium bovis subsp bovis AF2122/97
gggccgucucgccgu

SEQ ID NO: 1176093 - RNA, 21 nt, Mycobacterium bovis subsp bovis AF2122/97
gggccguccucccacagguag

SEQ ID NO: 1176094 - RNA, 21 nt, Mycobacterium bovis subsp bovis AF2122/97
gggccuaucccgaaucucacc

SEQ ID NO: 1176095 - RNA, 21 nt, Mycobacterium bovis subsp bovis AF2122/97
gggccguuuguagaucugggc

SEQ ID NO: 1176096 - RNA, 15 nt, Mycobacterium bovis subsp bovis AF2122/97
gggccucgaccgcca

SEQ ID NO: 1176097 - RNA, 15 nt, Mycobacterium bovis subsp bovis AF2122/97
gggccugcacgccgg

SEQ ID NO: 1176098 - RNA, 17 nt, Mycobacterium bovis subsp bovis AF2122/97
gggccucgaccgccagc

SEQ ID NO: 1176099 - RNA, 17 nt, Mycobacterium bovis subsp bovis AF2122/97
gggccugacgcgucagc

SEQ ID NO: 1176100 - RNA, 19 nt, Mycobacterium bovis subsp bovis AF2122/97
gggccucgaucagcgccgg

SEQ ID NO: 1176101 - RNA, 23 nt, Mycobacterium bovis subsp bovis AF2122/97
gggccucguugaccagaaccugg

SEQ ID NO: 1176102 - RNA, 13 nt, Mycobacterium bovis subsp bovis AF2122/97
gggccguccuccc

SEQ ID NO: 1176103 - RNA, 21 nt, Mycobacterium bovis subsp bovis AF2122/97
gggccguccggcuuggcggcg

SEQ ID NO: 1176104 - RNA, 20 nt, Mycobacterium bovis subsp bovis AF2122/97
gggccgucaguuaaaggugg

SEQ ID NO: 1176105 - RNA, 23 nt, Mycobacterium bovis subsp bovis AF2122/97
gggccgguggaaaagccacggcu

SEQ ID NO: 1176106 - RNA, 18 nt, Mycobacterium bovis subsp bovis AF2122/97
gggccgguggacgugcac

SEQ ID NO: 1176107 - RNA, 17 nt, Mycobacterium bovis subsp bovis AF2122/97
gggccguacggcgcgua

SEQ ID NO: 1176108 - RNA, 21 nt, Mycobacterium bovis subsp bovis AF2122/97
gggccguagaucccgaagcga

SEQ ID NO: 1176109 - RNA, 19 nt, Mycobacterium bovis subsp bovis AF2122/97
gggccgguccggggcaacg

SEQ ID NO: 1176110 - RNA, 19 nt, Mycobacterium bovis subsp bovis AF2122/97
gggccggucgugccggggc

SEQ ID NO: 1176111 - RNA, 22 nt, Mycobacterium bovis subsp bovis AF2122/97
gggccgggcgaucgccugggcu

SEQ ID NO: 1176112 - RNA, 20 nt, Mycobacterium bovis subsp bovis AF2122/97
gggccgggcuccucugguug

SEQ ID NO: 1176113 - RNA, 14 nt, Mycobacterium bovis subsp bovis AF2122/97
gggccgcucgccuc

SEQ ID NO: 1176114 - RNA, 23 nt, Mycobacterium bovis subsp bovis AF2122/97
gggccgcucacaagccgugcagc

SEQ ID NO: 1176115 - RNA, 17 nt, Mycobacterium bovis subsp bovis AF2122/97
gggccgcggcggccagc

SEQ ID NO: 1176116 - RNA, 17 nt, Mycobacterium bovis subsp bovis AF2122/97
gggccggcaccgcagcg

SEQ ID NO: 1176117 - RNA, 16 nt, Mycobacterium bovis subsp bovis AF2122/97
gggccgcgaaacccug

SEQ ID NO: 1176118 - RNA, 17 nt, Mycobacterium bovis subsp bovis AF2122/97
gggccgcgcccuguccu

SEQ ID NO: 1176119 - RNA, 12 nt, Mycobacterium bovis subsp bovis AF2122/97
gggccgcgcuga

SEQ ID NO: 1176120 - RNA, 22 nt, Mycobacterium bovis subsp bovis AF2122/97
gggccgccgcccugguccaggc

SEQ ID NO: 1176121 - RNA, 14 nt, Mycobacterium bovis subsp bovis AF2122/97
gggccgcggccaca

SEQ ID NO: 1176122 - RNA, 20 nt, Mycobacterium bovis subsp bovis AF2122/97
gggccgcggccacaucgcca

SEQ ID NO: 1176123 - RNA, 13 nt, Mycobacterium bovis subsp bovis AF2122/97
gggccgccgagcu

SEQ ID NO: 1176124 - RNA, 12 nt, Mycobacterium bovis subsp bovis AF2122/97
gggccgccaggc

SEQ ID NO: 1176125 - RNA, 13 nt, Mycobacterium bovis subsp bovis AF2122/97
gggccgccaggcg

SEQ ID NO: 1176126 - RNA, 18 nt, Mycobacterium bovis subsp bovis AF2122/97
gggccgccaggcggccgg

SEQ ID NO: 1176127 - RNA, 23 nt, Mycobacterium bovis subsp bovis AF2122/97
gggccgacugggcgcgaccccag

SEQ ID NO: 1176128 - RNA, 12 nt, Mycobacterium bovis subsp bovis AF2122/97
gggccgccagcu

SEQ ID NO: 1176129 - RNA, 22 nt, Mycobacterium bovis subsp bovis AF2122/97
gggccgaacacaccgggcgggc

SEQ ID NO: 1176130 - RNA, 19 nt, Mycobacterium bovis subsp bovis AF2122/97
gggccgacgggacaacccg

SEQ ID NO: 1176131 - RNA, 14 nt, Mycobacterium bovis subsp bovis AF2122/97
gggccgaccagagc

SEQ ID NO: 1176132 - RNA, 17 nt, Mycobacterium bovis subsp bovis AF2122/97
gggccgaguucgucagc

SEQ ID NO: 1176133 - RNA, 22 nt, Mycobacterium bovis subsp bovis AF2122/97
gggcccgcguucucggcacccu

SEQ ID NO: 1176134 - RNA, 22 nt, Mycobacterium bovis subsp bovis AF2122/97
gggcccggccggacgggugcgg

SEQ ID NO: 1176135 - RNA, 14 nt, Mycobacterium bovis subsp bovis AF2122/97
gggcccggcgagcu

SEQ ID NO: 1176136 - RNA, 15 nt, Mycobacterium bovis subsp bovis AF2122/97
gggcccggcgagcua

SEQ ID NO: 1176137 - RNA, 21 nt, Mycobacterium bovis subsp bovis AF2122/97
gggcccucuaugcgggcagcg

SEQ ID NO: 1176138 - RNA, 19 nt, Mycobacterium bovis subsp bovis AF2122/97
gggcccuggcggcccgggu

SEQ ID NO: 1176139 - RNA, 17 nt, Mycobacterium bovis subsp bovis AF2122/97
gggccaggucagccgcg

SEQ ID NO: 1176140 - RNA, 14 nt, Mycobacterium bovis subsp bovis AF2122/97
gggccagcggcagc

SEQ ID NO: 1176141 - RNA, 17 nt, Mycobacterium bovis subsp bovis AF2122/97
gggccagcggcagccug

SEQ ID NO: 1176142 - RNA, 21 nt, Mycobacterium bovis subsp bovis AF2122/97
gggccagccgcucacccgguc

SEQ ID NO: 1176143 - RNA, 14 nt, Mycobacterium bovis subsp bovis AF2122/97
gggcccgcgcggcg

SEQ ID NO: 1176144 - RNA, 18 nt, Mycobacterium bovis subsp bovis AF2122/97
gggcccgccggccccgcc

SEQ ID NO: 1176145 - RNA, 19 nt, Mycobacterium bovis subsp bovis AF2122/97
gggcccgccggccccgccg

SEQ ID NO: 1176146 - RNA, 11 nt, Mycobacterium bovis subsp bovis AF2122/97
gggcccgccgu

SEQ ID NO: 1176147 - RNA, 12 nt, Mycobacterium bovis subsp bovis AF2122/97
gggcccgccagc

SEQ ID NO: 1176148 - RNA, 13 nt, Mycobacterium bovis subsp bovis AF2122/97
gggcccgccagcc

SEQ ID NO: 1176149 - RNA, 17 nt, Mycobacterium bovis subsp bovis AF2122/97
gggcccgccagcccagc

SEQ ID NO: 1176150 - RNA, 23 nt, Mycobacterium bovis subsp bovis AF2122/97
gggcccgacguugccgaagccgg

SEQ ID NO: 1176151 - RNA, 21 nt, Mycobacterium bovis subsp bovis AF2122/97
gggcccccaaucagugcagcg

SEQ ID NO: 1176152 - RNA, 21 nt, Mycobacterium bovis subsp bovis AF2122/97
gggccccacaucgccccccag

SEQ ID NO: 1176153 - RNA, 13 nt, Mycobacterium bovis subsp bovis AF2122/97
gggccccacggcg

SEQ ID NO: 1176154 - RNA, 14 nt, Mycobacterium bovis subsp bovis AF2122/97
gggcccagcggccg

SEQ ID NO: 1176155 - RNA, 13 nt, Mycobacterium bovis subsp bovis AF2122/97
gggcccagcagcg

SEQ ID NO: 1176156 - RNA, 17 nt, Mycobacterium bovis subsp bovis AF2122/97
gggcccacacggugcga

SEQ ID NO: 1176157 - RNA, 20 nt, Mycobacterium bovis subsp bovis AF2122/97
gggccaucgcauccccagca

SEQ ID NO: 1176158 - RNA, 18 nt, Mycobacterium bovis subsp bovis AF2122/97
gggccauggguagccgcc

SEQ ID NO: 1176159 - RNA, 22 nt, Mycobacterium bovis subsp bovis AF2122/97
gggccauggguagccgcccagc

SEQ ID NO: 1176160 - RNA, 19 nt, Mycobacterium bovis subsp bovis AF2122/97
gggccacgaugaucccaag

SEQ ID NO: 1176161 - RNA, 22 nt, Mycobacterium bovis subsp bovis AF2122/97
gggccacgcuucuuccgcgcgc

SEQ ID NO: 1176162 - RNA, 15 nt, Mycobacterium bovis subsp bovis AF2122/97
gggccaacgacgcca

SEQ ID NO: 1176163 - RNA, 20 nt, Mycobacterium bovis subsp bovis AF2122/97
gggccagaucgaagcgcagc

SEQ ID NO: 1176164 - RNA, 15 nt, Mycobacterium bovis subsp bovis AF2122/97
gggccagcacccgcu

SEQ ID NO: 1176165 - RNA, 22 nt, Mycobacterium bovis subsp bovis AF2122/97
gggccaccgccgccugcccggc

SEQ ID NO: 1176166 - RNA, 13 nt, Mycobacterium bovis subsp bovis AF2122/97
gggccaccaccuc

SEQ ID NO: 1176167 - RNA, 17 nt, Mycobacterium bovis subsp bovis AF2122/97
gggccaaagccgucagc

SEQ ID NO: 1176168 - RNA, 16 nt, Mycobacterium bovis subsp bovis AF2122/97
gggcauugcggcgcgg

SEQ ID NO: 1176169 - RNA, 16 nt, Mycobacterium bovis subsp bovis AF2122/97
gggcauggugguggcc

SEQ ID NO: 1176170 - RNA, 13 nt, Mycobacterium bovis subsp bovis AF2122/97
gggcaugucgccg

SEQ ID NO: 1176171 - RNA, 23 nt, Mycobacterium bovis subsp bovis AF2122/97
gggcaugucgccgaacgccacca

SEQ ID NO: 1176172 - RNA, 22 nt, Mycobacterium bovis subsp bovis AF2122/97
gggcaucgucgucgcugccgcc

SEQ ID NO: 1176173 - RNA, 18 nt, Mycobacterium bovis subsp bovis AF2122/97
gggcaguggcagcccguc

SEQ ID NO: 1176174 - RNA, 17 nt, Mycobacterium bovis subsp bovis AF2122/97
gggcaucaagaaacgug

SEQ ID NO: 1176175 - RNA, 13 nt, Mycobacterium bovis subsp bovis AF2122/97
gggcaucaccgcc

SEQ ID NO: 1176176 - RNA, 17 nt, Mycobacterium bovis subsp bovis AF2122/97
gggcaucgggccuagcc

SEQ ID NO: 1176177 - RNA, 18 nt, Mycobacterium bovis subsp bovis AF2122/97
gggcgccacugaccgcga

SEQ ID NO: 1176178 - RNA, 12 nt, Mycobacterium bovis subsp bovis AF2122/97
gggcgccccagg

SEQ ID NO: 1176179 - RNA, 18 nt, Mycobacterium bovis subsp bovis AF2122/97
gggcgcccgccccgcgcc

SEQ ID NO: 1176180 - RNA, 21 nt, Mycobacterium bovis subsp bovis AF2122/97
gggcgccgaauuggcccgggu

SEQ ID NO: 1176181 - RNA, 21 nt, Mycobacterium bovis subsp bovis AF2122/97
gggcgcgcugcccacggaggg

SEQ ID NO: 1176182 - RNA, 21 nt, Mycobacterium bovis subsp bovis AF2122/97
gggcgcgcuggcgggcggcgu

SEQ ID NO: 1176183 - RNA, 18 nt, Mycobacterium bovis subsp bovis AF2122/97
gggcgcgggugaccaggc

SEQ ID NO: 1176184 - RNA, 13 nt, Mycobacterium bovis subsp bovis AF2122/97
gggcgcgucggcg

SEQ ID NO: 1176185 - RNA, 15 nt, Mycobacterium bovis subsp bovis AF2122/97
gggcgcggcccauga

SEQ ID NO: 1176186 - RNA, 22 nt, Mycobacterium bovis subsp bovis AF2122/97
gggcgcuugcaccaggggcgcg

SEQ ID NO: 1176187 - RNA, 16 nt, Mycobacterium bovis subsp bovis AF2122/97
gggcggaacgccggca

SEQ ID NO: 1176188 - RNA, 13 nt, Mycobacterium bovis subsp bovis AF2122/97
gggcggaucgccg

SEQ ID NO: 1176189 - RNA, 18 nt, Mycobacterium bovis subsp bovis AF2122/97
gggcggcauagcucagac

SEQ ID NO: 1176190 - RNA, 23 nt, Mycobacterium bovis subsp bovis AF2122/97
gggcggagccgaugaccugcccg

SEQ ID NO: 1176191 - RNA, 18 nt, Mycobacterium bovis subsp bovis AF2122/97
gggcgaauccggcgggug

SEQ ID NO: 1176192 - RNA, 21 nt, Mycobacterium bovis subsp bovis AF2122/97
gggcgaaacgcccgggcggcg

SEQ ID NO: 1176193 - RNA, 12 nt, Mycobacterium bovis subsp bovis AF2122/97
gggcgacggcga

SEQ ID NO: 1176194 - RNA, 13 nt, Mycobacterium bovis subsp bovis AF2122/97
gggcgacgcggcg

SEQ ID NO: 1176195 - RNA, 16 nt, Mycobacterium bovis subsp bovis AF2122/97
gggcgacuaccggcuc

SEQ ID NO: 1176196 - RNA, 17 nt, Mycobacterium bovis subsp bovis AF2122/97
gggcgagaccgcgagca

SEQ ID NO: 1176197 - RNA, 14 nt, Mycobacterium bovis subsp bovis AF2122/97
gggcgaugcggcgu

SEQ ID NO: 1176198 - RNA, 19 nt, Mycobacterium bovis subsp bovis AF2122/97
gggcgauauuggacgcgca

SEQ ID NO: 1176199 - RNA, 16 nt, Mycobacterium bovis subsp bovis AF2122/97
gggcgaugucggcugg

SEQ ID NO: 1176200 - RNA, 22 nt, Mycobacterium bovis subsp bovis AF2122/97
gggcgauucugugucugcucgc

SEQ ID NO: 1176201 - RNA, 19 nt, Mycobacterium bovis subsp bovis AF2122/97
gggcgcaacgagagcggcu

SEQ ID NO: 1176202 - RNA, 18 nt, Mycobacterium bovis subsp bovis AF2122/97
gggcgcaccaagacgcca

SEQ ID NO: 1176203 - RNA, 15 nt, Mycobacterium bovis subsp bovis AF2122/97
gggcgcaccgagcga

SEQ ID NO: 1176204 - RNA, 22 nt, Mycobacterium bovis subsp bovis AF2122/97
gggcgaucgcuucgcaagucau

SEQ ID NO: 1176205 - RNA, 17 nt, Mycobacterium bovis subsp bovis AF2122/97
gggcgagucgggggccg

SEQ ID NO: 1176206 - RNA, 13 nt, Mycobacterium bovis subsp bovis AF2122/97
gggcggccgggcu

SEQ ID NO: 1176207 - RNA, 15 nt, Mycobacterium bovis subsp bovis AF2122/97
gggcggccgggcucc

SEQ ID NO: 1176208 - RNA, 20 nt, Mycobacterium bovis subsp bovis AF2122/97
gggcggcgaccucggcggcg

SEQ ID NO: 1176209 - RNA, 12 nt, Mycobacterium bovis subsp bovis AF2122/97
gggcggccagga

SEQ ID NO: 1176210 - RNA, 21 nt, Mycobacterium bovis subsp bovis AF2122/97
gggcggccauggcacugccgg

SEQ ID NO: 1176211 - RNA, 18 nt, Mycobacterium bovis subsp bovis AF2122/97
gggcggcccaccggccac

SEQ ID NO: 1176212 - RNA, 14 nt, Mycobacterium bovis subsp bovis AF2122/97
gggcggcaucgccg

SEQ ID NO: 1176213 - RNA, 21 nt, Mycobacterium bovis subsp bovis AF2122/97
gggcggccaccgcacgcuggc

SEQ ID NO: 1176214 - RNA, 18 nt, Mycobacterium bovis subsp bovis AF2122/97
gggcggggacggcggcaa

SEQ ID NO: 1176215 - RNA, 17 nt, Mycobacterium bovis subsp bovis AF2122/97
gggcgggauccacccag

SEQ ID NO: 1176216 - RNA, 19 nt, Mycobacterium bovis subsp bovis AF2122/97
gggcggcgucgcggaucug

SEQ ID NO: 1176217 - RNA, 23 nt, Mycobacterium bovis subsp bovis AF2122/97
gggcggcuucgaugucguaccgg

SEQ ID NO: 1176218 - RNA, 21 nt, Mycobacterium bovis subsp bovis AF2122/97
gggcgucgcaacccggccugg

SEQ ID NO: 1176219 - RNA, 19 nt, Mycobacterium bovis subsp bovis AF2122/97
gggcgugacgggcaggagc

SEQ ID NO: 1176220 - RNA, 14 nt, Mycobacterium bovis subsp bovis AF2122/97
gggcgugccgacca

SEQ ID NO: 1176221 - RNA, 13 nt, Mycobacterium bovis subsp bovis AF2122/97
gggcgugccgccg

SEQ ID NO: 1176222 - RNA, 14 nt, Mycobacterium bovis subsp bovis AF2122/97
gggcgugcugccga

SEQ ID NO: 1176223 - RNA, 20 nt, Mycobacterium bovis subsp bovis AF2122/97
gggcggugggcagcagcugg

SEQ ID NO: 1176224 - RNA, 20 nt, Mycobacterium bovis subsp bovis AF2122/97
gggcgguagccauccgugaa

SEQ ID NO: 1176225 - RNA, 17 nt, Mycobacterium bovis subsp bovis AF2122/97
gggcggugaggcagcga

SEQ ID NO: 1176226 - RNA, 22 nt, Mycobacterium bovis subsp bovis AF2122/97
gggcgguggccacccggccgcg

SEQ ID NO: 1176227 - RNA, 21 nt, Mycobacterium bovis subsp bovis AF2122/97
gggcguaaaccguggccgcga

SEQ ID NO: 1176228 - RNA, 16 nt, Mycobacterium bovis subsp bovis AF2122/97
gggcguacucggcgcg

SEQ ID NO: 1176229 - RNA, 14 nt, Mycobacterium bovis subsp bovis AF2122/97
gggcguuggcgacg

SEQ ID NO: 1176230 - RNA, 15 nt, Mycobacterium bovis subsp bovis AF2122/97
gggcguuggcggcaa

SEQ ID NO: 1176231 - RNA, 19 nt, Mycobacterium bovis subsp bovis AF2122/97
gggcguuggcggcaagggu

SEQ ID NO: 1176232 - RNA, 21 nt, Mycobacterium bovis subsp bovis AF2122/97
gggcguuggcggcaagggugg

SEQ ID NO: 1176233 - RNA, 13 nt, Mycobacterium bovis subsp bovis AF2122/97
gggcugcccgcgg

SEQ ID NO: 1176234 - RNA, 17 nt, Mycobacterium bovis subsp bovis AF2122/97
gggcucuggccaguccg

SEQ ID NO: 1176235 - RNA, 20 nt, Mycobacterium bovis subsp bovis AF2122/97
gggcucuucgcagcgguggu

SEQ ID NO: 1176236 - RNA, 14 nt, Mycobacterium bovis subsp bovis AF2122/97
gggcugaggcggcg

SEQ ID NO: 1176237 - RNA, 14 nt, Mycobacterium bovis subsp bovis AF2122/97
gggcuccaacaggu

SEQ ID NO: 1176238 - RNA, 17 nt, Mycobacterium bovis subsp bovis AF2122/97
gggcucggcggcccggc

SEQ ID NO: 1176239 - RNA, 18 nt, Mycobacterium bovis subsp bovis AF2122/97
gggcucggcggcccggcc

SEQ ID NO: 1176240 - RNA, 19 nt, Mycobacterium bovis subsp bovis AF2122/97
gggcucuacucgcggccgg

SEQ ID NO: 1176241 - RNA, 17 nt, Mycobacterium bovis subsp bovis AF2122/97
gggcucugcugccagcc

SEQ ID NO: 1176242 - RNA, 21 nt, Mycobacterium bovis subsp bovis AF2122/97
ggguuuugauagacgacccgg

SEQ ID NO: 1176243 - RNA, 15 nt, Mycobacterium bovis subsp bovis AF2122/97
gguaacgccaacacc

SEQ ID NO: 1176244 - RNA, 14 nt, Mycobacterium bovis subsp bovis AF2122/97
gguaagcagccagc

SEQ ID NO: 1176245 - RNA, 19 nt, Mycobacterium bovis subsp bovis AF2122/97
gguaagcgaacggguaguc

SEQ ID NO: 1176246 - RNA, 16 nt, Mycobacterium bovis subsp bovis AF2122/97
gguaaugguggcgucc

SEQ ID NO: 1176247 - RNA, 17 nt, Mycobacterium bovis subsp bovis AF2122/97
gguaauccacuccagcg

SEQ ID NO: 1176248 - RNA, 15 nt, Mycobacterium bovis subsp bovis AF2122/97
gguaauacgucccga

SEQ ID NO: 1176249 - RNA, 14 nt, Mycobacterium bovis subsp bovis AF2122/97
gggugugcgggcgg

SEQ ID NO: 1176250 - RNA, 17 nt, Mycobacterium bovis subsp bovis AF2122/97
ggguguuugucgcggug

SEQ ID NO: 1176251 - RNA, 21 nt, Mycobacterium bovis subsp bovis AF2122/97
gggugguucaccucggcgacg

SEQ ID NO: 1176252 - RNA, 13 nt, Mycobacterium bovis subsp bovis AF2122/97
gggugguggugga

SEQ ID NO: 1176253 - RNA, 21 nt, Mycobacterium bovis subsp bovis AF2122/97
ggguggcgucgaucucgauca

SEQ ID NO: 1176254 - RNA, 18 nt, Mycobacterium bovis subsp bovis AF2122/97
gggugguaccggcggcgc

SEQ ID NO: 1176255 - RNA, 11 nt, Mycobacterium bovis subsp bovis AF2122/97
gggugggugca

SEQ ID NO: 1176256 - RNA, 24 nt, Mycobacterium bovis subsp bovis AF2122/97
ggguugaggaucccggccgggucg

SEQ ID NO: 1176257 - RNA, 14 nt, Mycobacterium bovis subsp bovis AF2122/97
ggguugggcggggu

SEQ ID NO: 1176258 - RNA, 20 nt, Mycobacterium bovis subsp bovis AF2122/97
ggguuggcucggcgcagcac

SEQ ID NO: 1176259 - RNA, 16 nt, Mycobacterium bovis subsp bovis AF2122/97
ggguugcggcagcugg

SEQ ID NO: 1176260 - RNA, 15 nt, Mycobacterium bovis subsp bovis AF2122/97
gggugccgucgggua

SEQ ID NO: 1176261 - RNA, 14 nt, Mycobacterium bovis subsp bovis AF2122/97
gggugcgagcgaca

SEQ ID NO: 1176262 - RNA, 17 nt, Mycobacterium bovis subsp bovis AF2122/97
gggugcucucguggaug

SEQ ID NO: 1176263 - RNA, 19 nt, Mycobacterium bovis subsp bovis AF2122/97
gggugcugaugggucaggc

SEQ ID NO: 1176264 - RNA, 20 nt, Mycobacterium bovis subsp bovis AF2122/97
ggguggcccccgccggccac

SEQ ID NO: 1176265 - RNA, 12 nt, Mycobacterium bovis subsp bovis AF2122/97
ggguggccagca

SEQ ID NO: 1176266 - RNA, 18 nt, Mycobacterium bovis subsp bovis AF2122/97
gggugcgugcgcgucggu

SEQ ID NO: 1176267 - RNA, 22 nt, Mycobacterium bovis subsp bovis AF2122/97
ggguggaaguacuucgcggcgg

SEQ ID NO: 1176268 - RNA, 11 nt, Mycobacterium bovis subsp bovis AF2122/97
ggguggcggcg

SEQ ID NO: 1176269 - RNA, 23 nt, Mycobacterium bovis subsp bovis AF2122/97
gggugccagcccguugcaggacg

SEQ ID NO: 1176270 - RNA, 18 nt, Mycobacterium bovis subsp bovis AF2122/97
gggugcccggcggccaac

SEQ ID NO: 1176271 - RNA, 14 nt, Mycobacterium bovis subsp bovis AF2122/97
gggugcccucggcc

SEQ ID NO: 1176272 - RNA, 18 nt, Mycobacterium bovis subsp bovis AF2122/97
gggugcagaucgccccag

SEQ ID NO: 1176273 - RNA, 13 nt, Mycobacterium bovis subsp bovis AF2122/97
gggugcagugacc

SEQ ID NO: 1176274 - RNA, 17 nt, Mycobacterium bovis subsp bovis AF2122/97
gggugcagaucgcccca

SEQ ID NO: 1176275 - RNA, 22 nt, Mycobacterium bovis subsp bovis AF2122/97
gggugaucugggcggugaaggc

SEQ ID NO: 1176276 - RNA, 19 nt, Mycobacterium bovis subsp bovis AF2122/97
gggugagcauggcuagggc

SEQ ID NO: 1176277 - RNA, 15 nt, Mycobacterium bovis subsp bovis AF2122/97
gggugagccgagcca

SEQ ID NO: 1176278 - RNA, 17 nt, Mycobacterium bovis subsp bovis AF2122/97
gggugagcgaccugggu

SEQ ID NO: 1176279 - RNA, 12 nt, Mycobacterium bovis subsp bovis AF2122/97
gguagcggcgcc

SEQ ID NO: 1176280 - RNA, 12 nt, Mycobacterium bovis subsp bovis AF2122/97
gguagcggcggc

SEQ ID NO: 1176281 - RNA, 12 nt, Mycobacterium bovis subsp bovis AF2122/97
gguagcggcggu

SEQ ID NO: 1176282 - RNA, 16 nt, Mycobacterium bovis subsp bovis AF2122/97
gguagcugccgcggcc

SEQ ID NO: 1176283 - RNA, 16 nt, Mycobacterium bovis subsp bovis AF2122/97
gguagcggcgccgccc

SEQ ID NO: 1176284 - RNA, 13 nt, Mycobacterium bovis subsp bovis AF2122/97
gguagccgcggcc

SEQ ID NO: 1176285 - RNA, 16 nt, Mycobacterium bovis subsp bovis AF2122/97
gguagccgcggccaca

SEQ ID NO: 1176286 - RNA, 19 nt, Mycobacterium bovis subsp bovis AF2122/97
gguagccgacgauguucca

SEQ ID NO: 1176287 - RNA, 18 nt, Mycobacterium bovis subsp bovis AF2122/97
gguagccauucggugugg

SEQ ID NO: 1176288 - RNA, 23 nt, Mycobacterium bovis subsp bovis AF2122/97
gguagccccgucgaccuccacca

SEQ ID NO: 1176289 - RNA, 17 nt, Mycobacterium bovis subsp bovis AF2122/97
gguagcacugucgaggu

SEQ ID NO: 1176290 - RNA, 17 nt, Mycobacterium bovis subsp bovis AF2122/97
gguagcauccagcgcgc

SEQ ID NO: 1176291 - RNA, 21 nt, Mycobacterium bovis subsp bovis AF2122/97
gguagccaaccugaagccagc

SEQ ID NO: 1176292 - RNA, 18 nt, Mycobacterium bovis subsp bovis AF2122/97
gguagaccaccugcaugu

SEQ ID NO: 1176293 - RNA, 13 nt, Mycobacterium bovis subsp bovis AF2122/97
gguagaccaugaa

SEQ ID NO: 1176294 - RNA, 16 nt, Mycobacterium bovis subsp bovis AF2122/97
gguagaccaugaagaa

SEQ ID NO: 1176295 - RNA, 16 nt, Mycobacterium bovis subsp bovis AF2122/97
gguacugcggcucgcu

SEQ ID NO: 1176296 - RNA, 19 nt, Mycobacterium bovis subsp bovis AF2122/97
gguaccucaacaccaggcc

SEQ ID NO: 1176297 - RNA, 21 nt, Mycobacterium bovis subsp bovis AF2122/97
gguaccucgucgagcgugcgc

SEQ ID NO: 1176298 - RNA, 17 nt, Mycobacterium bovis subsp bovis AF2122/97
gguaccgaucagcaggg

SEQ ID NO: 1176299 - RNA, 17 nt, Mycobacterium bovis subsp bovis AF2122/97
gguaccgcgugcgccgg

SEQ ID NO: 1176300 - RNA, 17 nt, Mycobacterium bovis subsp bovis AF2122/97
gguaccggaaucggcgg

SEQ ID NO: 1176301 - RNA, 22 nt, Mycobacterium bovis subsp bovis AF2122/97
gguaccggcuucgucggccagc

SEQ ID NO: 1176302 - RNA, 18 nt, Mycobacterium bovis subsp bovis AF2122/97
gguacgggggugggccca

SEQ ID NO: 1176303 - RNA, 19 nt, Mycobacterium bovis subsp bovis AF2122/97
gguacggucucacggcgcg

SEQ ID NO: 1176304 - RNA, 21 nt, Mycobacterium bovis subsp bovis AF2122/97
gguacgugaauuaaggugacc

SEQ ID NO: 1176305 - RNA, 22 nt, Mycobacterium bovis subsp bovis AF2122/97
gguacugcgaugugcgugaaca

SEQ ID NO: 1176306 - RNA, 14 nt, Mycobacterium bovis subsp bovis AF2122/97
gguacugcgcagcg

SEQ ID NO: 1176307 - RNA, 18 nt, Mycobacterium bovis subsp bovis AF2122/97
gguacgccaggugcagca

SEQ ID NO: 1176308 - RNA, 19 nt, Mycobacterium bovis subsp bovis AF2122/97
gguaccacgcuggcgcgua

SEQ ID NO: 1176309 - RNA, 16 nt, Mycobacterium bovis subsp bovis AF2122/97
gguaccaaccugcgcg

SEQ ID NO: 1176310 - RNA, 18 nt, Mycobacterium bovis subsp bovis AF2122/97
gguaauucuugacgccga

SEQ ID NO: 1176311 - RNA, 20 nt, Mycobacterium bovis subsp bovis AF2122/97
gguacacccgcucgcccgcc

SEQ ID NO: 1176312 - RNA, 18 nt, Mycobacterium bovis subsp bovis AF2122/97
gguaucgacccuccagca

SEQ ID NO: 1176313 - RNA, 21 nt, Mycobacterium bovis subsp bovis AF2122/97
gguagucgggcaaggcggcgg

SEQ ID NO: 1176314 - RNA, 14 nt, Mycobacterium bovis subsp bovis AF2122/97
gguaguaggccugg

SEQ ID NO: 1176315 - RNA, 16 nt, Mycobacterium bovis subsp bovis AF2122/97
gguagucgaugcugac

SEQ ID NO: 1176316 - RNA, 12 nt, Mycobacterium bovis subsp bovis AF2122/97
gguaggcggcca

SEQ ID NO: 1176317 - RNA, 13 nt, Mycobacterium bovis subsp bovis AF2122/97
gguaggcgguguc

SEQ ID NO: 1176318 - RNA, 20 nt, Mycobacterium bovis subsp bovis AF2122/97
gguagguucgacggacaccc

SEQ ID NO: 1176319 - RNA, 17 nt, Mycobacterium bovis subsp bovis AF2122/97
gguaggucaccaggcug

SEQ ID NO: 1176320 - RNA, 14 nt, Mycobacterium bovis subsp bovis AF2122/97
gguaggccggugcg

SEQ ID NO: 1176321 - RNA, 20 nt, Mycobacterium bovis subsp bovis AF2122/97
gguaggaacuacccgccagc

SEQ ID NO: 1176322 - RNA, 19 nt, Mycobacterium bovis subsp bovis AF2122/97
gguaggcaauggcgugcgg

SEQ ID NO: 1176323 - RNA, 14 nt, Mycobacterium bovis subsp bovis AF2122/97
gguaggcaggccgg

SEQ ID NO: 1176324 - RNA, 15 nt, Mycobacterium bovis subsp bovis AF2122/97
gguaggcaggccggc

SEQ ID NO: 1176325 - RNA, 15 nt, Mycobacterium bovis subsp bovis AF2122/97
gguaucggcgugcug

SEQ ID NO: 1176326 - RNA, 19 nt, Mycobacterium bovis subsp bovis AF2122/97
gguaugagcuuccgcgcgc

SEQ ID NO: 1176327 - RNA, 20 nt, Mycobacterium bovis subsp bovis AF2122/97
ggucagggacgaacugcuga

SEQ ID NO: 1176328 - RNA, 22 nt, Mycobacterium bovis subsp bovis AF2122/97
ggucaggcggccgucgucggcc

SEQ ID NO: 1176329 - RNA, 16 nt, Mycobacterium bovis subsp bovis AF2122/97
ggucaggcggcuggcc

SEQ ID NO: 1176330 - RNA, 17 nt, Mycobacterium bovis subsp bovis AF2122/97
ggucagguccugggugu

SEQ ID NO: 1176331 - RNA, 17 nt, Mycobacterium bovis subsp bovis AF2122/97
ggucagguugucggcga

SEQ ID NO: 1176332 - RNA, 14 nt, Mycobacterium bovis subsp bovis AF2122/97
ggucagcgugcagg

SEQ ID NO: 1176333 - RNA, 19 nt, Mycobacterium bovis subsp bovis AF2122/97
ggucagcugacgggccgcu

SEQ ID NO: 1176334 - RNA, 21 nt, Mycobacterium bovis subsp bovis AF2122/97
ggucagcugacgggccgcugu

SEQ ID NO: 1176335 - RNA, 16 nt, Mycobacterium bovis subsp bovis AF2122/97
ggucaggccaggguga

SEQ ID NO: 1176336 - RNA, 13 nt, Mycobacterium bovis subsp bovis AF2122/97
ggucaggccgccg

SEQ ID NO: 1176337 - RNA, 13 nt, Mycobacterium bovis subsp bovis AF2122/97
ggucaggcggccg

SEQ ID NO: 1176338 - RNA, 16 nt, Mycobacterium bovis subsp bovis AF2122/97
ggucagccgcggcggc

SEQ ID NO: 1176339 - RNA, 19 nt, Mycobacterium bovis subsp bovis AF2122/97
ggucagcgaccucacugcg

SEQ ID NO: 1176340 - RNA, 12 nt, Mycobacterium bovis subsp bovis AF2122/97
ggucagccgcgg

SEQ ID NO: 1176341 - RNA, 11 nt, Mycobacterium bovis subsp bovis AF2122/97
ggucagcagcg

SEQ ID NO: 1176342 - RNA, 14 nt, Mycobacterium bovis subsp bovis AF2122/97
ggucagcaccacca

SEQ ID NO: 1176343 - RNA, 16 nt, Mycobacterium bovis subsp bovis AF2122/97
ggucagcaccaccagc

SEQ ID NO: 1176344 - RNA, 23 nt, Mycobacterium bovis subsp bovis AF2122/97
ggucagcacccaacccggcggca

SEQ ID NO: 1176345 - RNA, 19 nt, Mycobacterium bovis subsp bovis AF2122/97
ggucagcaauacggcggcg

SEQ ID NO: 1176346 - RNA, 21 nt, Mycobacterium bovis subsp bovis AF2122/97
ggucaccccuucgccagcgcc

SEQ ID NO: 1176347 - RNA, 21 nt, Mycobacterium bovis subsp bovis AF2122/97
ggucaccgauucggccagcgc

SEQ ID NO: 1176348 - RNA, 15 nt, Mycobacterium bovis subsp bovis AF2122/97
ggucaagccggcgcc

SEQ ID NO: 1176349 - RNA, 20 nt, Mycobacterium bovis subsp bovis AF2122/97
ggucaaugcuggcagcggcc

SEQ ID NO: 1176350 - RNA, 14 nt, Mycobacterium bovis subsp bovis AF2122/97
ggucacgcagcacc

SEQ ID NO: 1176351 - RNA, 13 nt, Mycobacterium bovis subsp bovis AF2122/97
ggucaccugcugc

SEQ ID NO: 1176352 - RNA, 20 nt, Mycobacterium bovis subsp bovis AF2122/97
ggucaccggcgaccggugcc

SEQ ID NO: 1176353 - RNA, 20 nt, Mycobacterium bovis subsp bovis AF2122/97
ggucaccggcuucuccucca

SEQ ID NO: 1176354 - RNA, 22 nt, Mycobacterium bovis subsp bovis AF2122/97
ggucaccggcuucuccuccaga

SEQ ID NO: 1176355 - RNA, 17 nt, Mycobacterium bovis subsp bovis AF2122/97
ggucaccucgucgccua

SEQ ID NO: 1176356 - RNA, 22 nt, Mycobacterium bovis subsp bovis AF2122/97
ggucacgguucgcccgucgcca

SEQ ID NO: 1176357 - RNA, 18 nt, Mycobacterium bovis subsp bovis AF2122/97
ggucacgugggccaugcu

SEQ ID NO: 1176358 - RNA, 13 nt, Mycobacterium bovis subsp bovis AF2122/97
ggucacucuggcg

SEQ ID NO: 1176359 - RNA, 15 nt, Mycobacterium bovis subsp bovis AF2122/97
ggucaucgagcugac

SEQ ID NO: 1176360 - RNA, 13 nt, Mycobacterium bovis subsp bovis AF2122/97
ggucaucggcgcc

SEQ ID NO: 1176361 - RNA, 20 nt, Mycobacterium bovis subsp bovis AF2122/97
ggucaggucgagguccucgg

SEQ ID NO: 1176362 - RNA, 20 nt, Mycobacterium bovis subsp bovis AF2122/97
ggucaggucugacagaccgg

SEQ ID NO: 1176363 - RNA, 14 nt, Mycobacterium bovis subsp bovis AF2122/97
ggucaguuccucua

SEQ ID NO: 1176364 - RNA, 18 nt, Mycobacterium bovis subsp bovis AF2122/97
ggucauauugugggugcg

SEQ ID NO: 1176365 - RNA, 18 nt, Mycobacterium bovis subsp bovis AF2122/97
gguccaaccgggccggcu

SEQ ID NO: 1176366 - RNA, 14 nt, Mycobacterium bovis subsp bovis AF2122/97
gguccaacagcgcc

SEQ ID NO: 1176367 - RNA, 18 nt, Mycobacterium bovis subsp bovis AF2122/97
gguccaagugggccggcg

SEQ ID NO: 1176368 - RNA, 14 nt, Mycobacterium bovis subsp bovis AF2122/97
ggucaugggcgcgu

SEQ ID NO: 1176369 - RNA, 19 nt, Mycobacterium bovis subsp bovis AF2122/97
gguccaacagcgccaguag

SEQ ID NO: 1176370 - RNA, 22 nt, Mycobacterium bovis subsp bovis AF2122/97
gguccaaccaccgguccagcgc

SEQ ID NO: 1176371 - RNA, 19 nt, Mycobacterium bovis subsp bovis AF2122/97
gguccaaccacgagcauca

SEQ ID NO: 1176372 - RNA, 15 nt, Mycobacterium bovis subsp bovis AF2122/97
gguccaaccagcacc

SEQ ID NO: 1176373 - RNA, 20 nt, Mycobacterium bovis subsp bovis AF2122/97
gguccgccagcgcgaaccug

SEQ ID NO: 1176374 - RNA, 17 nt, Mycobacterium bovis subsp bovis AF2122/97
gguccgccacggcgggc

SEQ ID NO: 1176375 - RNA, 18 nt, Mycobacterium bovis subsp bovis AF2122/97
gguccgcacgaucugcag

SEQ ID NO: 1176376 - RNA, 14 nt, Mycobacterium bovis subsp bovis AF2122/97
gguccgccacggcg

SEQ ID NO: 1176377 - RNA, 16 nt, Mycobacterium bovis subsp bovis AF2122/97
gguccgaccagcggcc

SEQ ID NO: 1176378 - RNA, 16 nt, Mycobacterium bovis subsp bovis AF2122/97
gguccgcgucggcggc

SEQ ID NO: 1176379 - RNA, 13 nt, Mycobacterium bovis subsp bovis AF2122/97
gguccgcgugcug

SEQ ID NO: 1176380 - RNA, 14 nt, Mycobacterium bovis subsp bovis AF2122/97
gguccgccggugcc

SEQ ID NO: 1176381 - RNA, 14 nt, Mycobacterium bovis subsp bovis AF2122/97
gguccgcugcagca

SEQ ID NO: 1176382 - RNA, 15 nt, Mycobacterium bovis subsp bovis AF2122/97
gguccggcccgggga

SEQ ID NO: 1176383 - RNA, 15 nt, Mycobacterium bovis subsp bovis AF2122/97
gguccucgagcggca

SEQ ID NO: 1176384 - RNA, 22 nt, Mycobacterium bovis subsp bovis AF2122/97
gguccguuuuaccucggccgcc

SEQ ID NO: 1176385 - RNA, 12 nt, Mycobacterium bovis subsp bovis AF2122/97
gguccggcggcc

SEQ ID NO: 1176386 - RNA, 21 nt, Mycobacterium bovis subsp bovis AF2122/97
gguccggcguacgccguaccc

SEQ ID NO: 1176387 - RNA, 15 nt, Mycobacterium bovis subsp bovis AF2122/97
gguccggugaacccg

SEQ ID NO: 1176388 - RNA, 14 nt, Mycobacterium bovis subsp bovis AF2122/97
gguccagcggccgc

SEQ ID NO: 1176389 - RNA, 23 nt, Mycobacterium bovis subsp bovis AF2122/97
gguccagccgguccagacccagc

SEQ ID NO: 1176390 - RNA, 20 nt, Mycobacterium bovis subsp bovis AF2122/97
gguccacgccaggagcgugu

SEQ ID NO: 1176391 - RNA, 17 nt, Mycobacterium bovis subsp bovis AF2122/97
gguccagacccagcucg

SEQ ID NO: 1176392 - RNA, 13 nt, Mycobacterium bovis subsp bovis AF2122/97
gguccagcccagc

SEQ ID NO: 1176393 - RNA, 13 nt, Mycobacterium bovis subsp bovis AF2122/97
gguccaggucggg

SEQ ID NO: 1176394 - RNA, 13 nt, Mycobacterium bovis subsp bovis AF2122/97
gguccaggcccug

SEQ ID NO: 1176395 - RNA, 15 nt, Mycobacterium bovis subsp bovis AF2122/97
gguccaggcccuggc

SEQ ID NO: 1176396 - RNA, 12 nt, Mycobacterium bovis subsp bovis AF2122/97
ggucccgugcgc

SEQ ID NO: 1176397 - RNA, 22 nt, Mycobacterium bovis subsp bovis AF2122/97
ggucccgugcgcgcgcagcuga

SEQ ID NO: 1176398 - RNA, 21 nt, Mycobacterium bovis subsp bovis AF2122/97
ggucccguugccgcccacuag

SEQ ID NO: 1176399 - RNA, 20 nt, Mycobacterium bovis subsp bovis AF2122/97
ggucccgcucuggucgucga

SEQ ID NO: 1176400 - RNA, 17 nt, Mycobacterium bovis subsp bovis AF2122/97
ggucccuuuguggggcc

SEQ ID NO: 1176401 - RNA, 21 nt, Mycobacterium bovis subsp bovis AF2122/97
gguccccucggugccacugcc

SEQ ID NO: 1176402 - RNA, 20 nt, Mycobacterium bovis subsp bovis AF2122/97
ggucgacgggucggcgccga

SEQ ID NO: 1176403 - RNA, 20 nt, Mycobacterium bovis subsp bovis AF2122/97
ggucgacggggcggucggcc

SEQ ID NO: 1176404 - RNA, 20 nt, Mycobacterium bovis subsp bovis AF2122/97
ggucgaaucgcugccgccga

SEQ ID NO: 1176405 - RNA, 21 nt, Mycobacterium bovis subsp bovis AF2122/97
ggucgaagaccaagagcgcgc

SEQ ID NO: 1176406 - RNA, 19 nt, Mycobacterium bovis subsp bovis AF2122/97
ggucgacaggugccagacc

SEQ ID NO: 1176407 - RNA, 19 nt, Mycobacterium bovis subsp bovis AF2122/97
gguccuugucggccccggc

SEQ ID NO: 1176408 - RNA, 22 nt, Mycobacterium bovis subsp bovis AF2122/97
gguccuucuccagauccacgcc

SEQ ID NO: 1176409 - RNA, 17 nt, Mycobacterium bovis subsp bovis AF2122/97
gguccugcggucgcgga

SEQ ID NO: 1176410 - RNA, 18 nt, Mycobacterium bovis subsp bovis AF2122/97
gguccgucgagucgccga

SEQ ID NO: 1176411 - RNA, 14 nt, Mycobacterium bovis subsp bovis AF2122/97
ggucgagggcggcg

SEQ ID NO: 1176412 - RNA, 13 nt, Mycobacterium bovis subsp bovis AF2122/97
ggucgagcgccuu

SEQ ID NO: 1176413 - RNA, 22 nt, Mycobacterium bovis subsp bovis AF2122/97
ggucgagcacgcugcugcgggu

SEQ ID NO: 1176414 - RNA, 15 nt, Mycobacterium bovis subsp bovis AF2122/97
ggucgaggucggcga

SEQ ID NO: 1176415 - RNA, 16 nt, Mycobacterium bovis subsp bovis AF2122/97
ggucgagguggggugg

SEQ ID NO: 1176416 - RNA, 16 nt, Mycobacterium bovis subsp bovis AF2122/97
ggucgaguugaagaau

SEQ ID NO: 1176417 - RNA, 23 nt, Mycobacterium bovis subsp bovis AF2122/97
ggucgaucaugacgagccgagcc

SEQ ID NO: 1176418 - RNA, 17 nt, Mycobacterium bovis subsp bovis AF2122/97
ggucgcauggucgacga

SEQ ID NO: 1176419 - RNA, 16 nt, Mycobacterium bovis subsp bovis AF2122/97
ggucgcaccgccggcc

SEQ ID NO: 1176420 - RNA, 18 nt, Mycobacterium bovis subsp bovis AF2122/97
ggucgcaccccggcggcg

SEQ ID NO: 1176421 - RNA, 22 nt, Mycobacterium bovis subsp bovis AF2122/97
ggucgcaauauccggccgagcc

SEQ ID NO: 1176422 - RNA, 18 nt, Mycobacterium bovis subsp bovis AF2122/97
ggucgcgcagcuccaccg

SEQ ID NO: 1176423 - RNA, 19 nt, Mycobacterium bovis subsp bovis AF2122/97
ggucgccgccaucagcccu

SEQ ID NO: 1176424 - RNA, 14 nt, Mycobacterium bovis subsp bovis AF2122/97
ggucgccggcaccg

SEQ ID NO: 1176425 - RNA, 13 nt, Mycobacterium bovis subsp bovis AF2122/97
ggucgccuccucg

SEQ ID NO: 1176426 - RNA, 21 nt, Mycobacterium bovis subsp bovis AF2122/97
ggucgccucgcuaacucccca

SEQ ID NO: 1176427 - RNA, 15 nt, Mycobacterium bovis subsp bovis AF2122/97
ggucgcgcgacggcc

SEQ ID NO: 1176428 - RNA, 19 nt, Mycobacterium bovis subsp bovis AF2122/97
ggucgcccaacaccgcgcc

SEQ ID NO: 1176429 - RNA, 13 nt, Mycobacterium bovis subsp bovis AF2122/97
ggucgccggggcc

SEQ ID NO: 1176430 - RNA, 18 nt, Mycobacterium bovis subsp bovis AF2122/97
ggucgccggacugcggcc

SEQ ID NO: 1176431 - RNA, 13 nt, Mycobacterium bovis subsp bovis AF2122/97
ggucgccagcucg

SEQ ID NO: 1176432 - RNA, 20 nt, Mycobacterium bovis subsp bovis AF2122/97
ggucgccaugucggccaggu

SEQ ID NO: 1176433 - RNA, 22 nt, Mycobacterium bovis subsp bovis AF2122/97
ggucgccauguugaagcgaagc

SEQ ID NO: 1176434 - RNA, 18 nt, Mycobacterium bovis subsp bovis AF2122/97
ggucgccaacgccagcac

SEQ ID NO: 1176435 - RNA, 19 nt, Mycobacterium bovis subsp bovis AF2122/97
ggucgccaacgccagcacc

SEQ ID NO: 1176436 - RNA, 12 nt, Mycobacterium bovis subsp bovis AF2122/97
ggucgcggggcc

SEQ ID NO: 1176437 - RNA, 18 nt, Mycobacterium bovis subsp bovis AF2122/97
ggucgcgguggcggcggu

SEQ ID NO: 1176438 - RNA, 19 nt, Mycobacterium bovis subsp bovis AF2122/97
ggucgcgcuggcgccggcc

SEQ ID NO: 1176439 - RNA, 18 nt, Mycobacterium bovis subsp bovis AF2122/97
ggucgcggaucucaucgg

SEQ ID NO: 1176440 - RNA, 16 nt, Mycobacterium bovis subsp bovis AF2122/97
ggucgcgucggcugcc

SEQ ID NO: 1176441 - RNA, 20 nt, Mycobacterium bovis subsp bovis AF2122/97
ggucgcugauccgggcgccg

SEQ ID NO: 1176442 - RNA, 21 nt, Mycobacterium bovis subsp bovis AF2122/97
ggucgcugauccgggcgccga

SEQ ID NO: 1176443 - RNA, 19 nt, Mycobacterium bovis subsp bovis AF2122/97
ggucggagacgucuucggg

SEQ ID NO: 1176444 - RNA, 13 nt, Mycobacterium bovis subsp bovis AF2122/97
ggucggccaggcc

SEQ ID NO: 1176445 - RNA, 23 nt, Mycobacterium bovis subsp bovis AF2122/97
ggucggacagcgucucggaggcg

SEQ ID NO: 1176446 - RNA, 16 nt, Mycobacterium bovis subsp bovis AF2122/97
ggucggaacuagccag

SEQ ID NO: 1176447 - RNA, 18 nt, Mycobacterium bovis subsp bovis AF2122/97
ggucgcugccggcugacg

SEQ ID NO: 1176448 - RNA, 15 nt, Mycobacterium bovis subsp bovis AF2122/97
ggucgcuucagcgcc

SEQ ID NO: 1176449 - RNA, 13 nt, Mycobacterium bovis subsp bovis AF2122/97
ggucuacgccacc

SEQ ID NO: 1176450 - RNA, 23 nt, Mycobacterium bovis subsp bovis AF2122/97
ggucuacgccaccgagaucggac

SEQ ID NO: 1176451 - RNA, 18 nt, Mycobacterium bovis subsp bovis AF2122/97
ggucguugucgggguugc

SEQ ID NO: 1176452 - RNA, 16 nt, Mycobacterium bovis subsp bovis AF2122/97
ggucguuggcggcggu

SEQ ID NO: 1176453 - RNA, 14 nt, Mycobacterium bovis subsp bovis AF2122/97
ggucguugucgggg

SEQ ID NO: 1176454 - RNA, 13 nt, Mycobacterium bovis subsp bovis AF2122/97
ggucgugucgcca

SEQ ID NO: 1176455 - RNA, 15 nt, Mycobacterium bovis subsp bovis AF2122/97
ggucgugccagcagc

SEQ ID NO: 1176456 - RNA, 23 nt, Mycobacterium bovis subsp bovis AF2122/97
ggucguggugcaacacgccggcc

SEQ ID NO: 1176457 - RNA, 18 nt, Mycobacterium bovis subsp bovis AF2122/97
ggucgguuuccuccggca

SEQ ID NO: 1176458 - RNA, 14 nt, Mycobacterium bovis subsp bovis AF2122/97
ggucguccggcggc

SEQ ID NO: 1176459 - RNA, 22 nt, Mycobacterium bovis subsp bovis AF2122/97
ggucggcgaucaugggagcggg

SEQ ID NO: 1176460 - RNA, 16 nt, Mycobacterium bovis subsp bovis AF2122/97
ggucggccugcggcac

SEQ ID NO: 1176461 - RNA, 19 nt, Mycobacterium bovis subsp bovis AF2122/97
ggucggcaucggagauacg

SEQ ID NO: 1176462 - RNA, 22 nt, Mycobacterium bovis subsp bovis AF2122/97
ggucggcugucgugccucucgg

SEQ ID NO: 1176463 - RNA, 14 nt, Mycobacterium bovis subsp bovis AF2122/97
ggucgggcagcacu

SEQ ID NO: 1176464 - RNA, 17 nt, Mycobacterium bovis subsp bovis AF2122/97
ggucgggguccgcggca

SEQ ID NO: 1176465 - RNA, 20 nt, Mycobacterium bovis subsp bovis AF2122/97
ggucggggagcugcggcggc

SEQ ID NO: 1176466 - RNA, 21 nt, Mycobacterium bovis subsp bovis AF2122/97
ggucggugauggucagcuggc

SEQ ID NO: 1176467 - RNA, 20 nt, Mycobacterium bovis subsp bovis AF2122/97
ggucgguggucucgacggcg

SEQ ID NO: 1176468 - RNA, 15 nt, Mycobacterium bovis subsp bovis AF2122/97
ggucggugggcggcg

SEQ ID NO: 1176469 - RNA, 12 nt, Mycobacterium bovis subsp bovis AF2122/97
ggucggucaggu

SEQ ID NO: 1176470 - RNA, 13 nt, Mycobacterium bovis subsp bovis AF2122/97
ggucucggugcgg

SEQ ID NO: 1176471 - RNA, 11 nt, Mycobacterium bovis subsp bovis AF2122/97
ggucucggccg

SEQ ID NO: 1176472 - RNA, 20 nt, Mycobacterium bovis subsp bovis AF2122/97
ggucucggaaacggaccucc

SEQ ID NO: 1176473 - RNA, 22 nt, Mycobacterium bovis subsp bovis AF2122/97
ggucucaacgcaucgguggcac

SEQ ID NO: 1176474 - RNA, 17 nt, Mycobacterium bovis subsp bovis AF2122/97
ggucuccggaucgccga

SEQ ID NO: 1176475 - RNA, 16 nt, Mycobacterium bovis subsp bovis AF2122/97
ggucugcgccgccggc

SEQ ID NO: 1176476 - RNA, 20 nt, Mycobacterium bovis subsp bovis AF2122/97
ggucugcgccgccggcggcg

SEQ ID NO: 1176477 - RNA, 22 nt, Mycobacterium bovis subsp bovis AF2122/97
ggucugacagaccgggcaccag

SEQ ID NO: 1176478 - RNA, 23 nt, Mycobacterium bovis subsp bovis AF2122/97
ggucugcuauugguugaggaggu

SEQ ID NO: 1176479 - RNA, 10 nt, Mycobacterium bovis subsp bovis AF2122/97
ggucugcucc

SEQ ID NO: 1176480 - RNA, 18 nt, Mycobacterium bovis subsp bovis AF2122/97
ggucuggcaggccagcau

SEQ ID NO: 1176481 - RNA, 16 nt, Mycobacterium bovis subsp bovis AF2122/97
ggucuuggcgauccag

SEQ ID NO: 1176482 - RNA, 20 nt, Mycobacterium bovis subsp bovis AF2122/97
ggucuugggcgcgggugcgc

SEQ ID NO: 1176483 - RNA, 20 nt, Mycobacterium bovis subsp bovis AF2122/97
ggucuuuaauccagcgccga

SEQ ID NO: 1176484 - RNA, 17 nt, Mycobacterium bovis subsp bovis AF2122/97
gccguccgaccagggau

SEQ ID NO: 1176485 - RNA, 20 nt, Mycobacterium bovis subsp bovis AF2122/97
gccgucccgauacggccggc

SEQ ID NO: 1176486 - RNA, 19 nt, Mycobacterium bovis subsp bovis AF2122/97
gccguccagguucaugcaa

SEQ ID NO: 1176487 - RNA, 19 nt, Mycobacterium bovis subsp bovis AF2122/97
gccgucaccgucauugcca

SEQ ID NO: 1176488 - RNA, 15 nt, Mycobacterium bovis subsp bovis AF2122/97
gccgucagaacaccg

SEQ ID NO: 1176489 - RNA, 23 nt, Mycobacterium bovis subsp bovis AF2122/97
gccgucagaacaccggccaggcc

SEQ ID NO: 1176490 - RNA, 13 nt, Mycobacterium bovis subsp bovis AF2122/97
gccgucacccccg

SEQ ID NO: 1176491 - RNA, 19 nt, Mycobacterium bovis subsp bovis AF2122/97
gccguccggcuuggcggcg

SEQ ID NO: 1176492 - RNA, 15 nt, Mycobacterium bovis subsp bovis AF2122/97
gccguccgggcggcc

SEQ ID NO: 1176493 - RNA, 23 nt, Mycobacterium bovis subsp bovis AF2122/97
gccguccggguagacauggguga

SEQ ID NO: 1176494 - RNA, 15 nt, Mycobacterium bovis subsp bovis AF2122/97
gccgucgccgccggc

SEQ ID NO: 1176495 - RNA, 19 nt, Mycobacterium bovis subsp bovis AF2122/97
gccguccgguguggcgcug

SEQ ID NO: 1176496 - RNA, 21 nt, Mycobacterium bovis subsp bovis AF2122/97
gccgucgcugacgcccuccug

SEQ ID NO: 1176497 - RNA, 23 nt, Mycobacterium bovis subsp bovis AF2122/97
gccgucgcggcacgcccacagcu

SEQ ID NO: 1176498 - RNA, 14 nt, Mycobacterium bovis subsp bovis AF2122/97
gccgucggcgccuc

SEQ ID NO: 1176499 - RNA, 20 nt, Mycobacterium bovis subsp bovis AF2122/97
gccgucggccucggcggucg

SEQ ID NO: 1176500 - RNA, 17 nt, Mycobacterium bovis subsp bovis AF2122/97
gccgucgcugguguaga

SEQ ID NO: 1176501 - RNA, 22 nt, Mycobacterium bovis subsp bovis AF2122/97
gccgucggggaguucgcgcagc

SEQ ID NO: 1176502 - RNA, 23 nt, Mycobacterium bovis subsp bovis AF2122/97
gccgucugaucacucacccgggc

SEQ ID NO: 1176503 - RNA, 16 nt, Mycobacterium bovis subsp bovis AF2122/97
gccgucuuggcccggu

SEQ ID NO: 1176504 - RNA, 21 nt, Mycobacterium bovis subsp bovis AF2122/97
gccgucugcggggugagugac

SEQ ID NO: 1176505 - RNA, 18 nt, Mycobacterium bovis subsp bovis AF2122/97
gccggaacgagcggccgc

SEQ ID NO: 1176506 - RNA, 16 nt, Mycobacterium bovis subsp bovis AF2122/97
gccguaguggccggcu

SEQ ID NO: 1176507 - RNA, 14 nt, Mycobacterium bovis subsp bovis AF2122/97
gccggaaagcccgu

SEQ ID NO: 1176508 - RNA, 16 nt, Mycobacterium bovis subsp bovis AF2122/97
gccguauccaggcgug

SEQ ID NO: 1176509 - RNA, 17 nt, Mycobacterium bovis subsp bovis AF2122/97
gccguaucggggcacca

SEQ ID NO: 1176510 - RNA, 19 nt, Mycobacterium bovis subsp bovis AF2122/97
gccguaugccgccaaccgc

SEQ ID NO: 1176511 - RNA, 18 nt, Mycobacterium bovis subsp bovis AF2122/97
gccgucaagauugaacga

SEQ ID NO: 1176512 - RNA, 18 nt, Mycobacterium bovis subsp bovis AF2122/97
gccgcuugccccgccuug

SEQ ID NO: 1176513 - RNA, 15 nt, Mycobacterium bovis subsp bovis AF2122/97
gccgcuugccccgcc

SEQ ID NO: 1176514 - RNA, 17 nt, Mycobacterium bovis subsp bovis AF2122/97
gccgcuugccccgccuu

SEQ ID NO: 1176515 - RNA, 23 nt, Mycobacterium bovis subsp bovis AF2122/97
gccgcuugagcgaguugcagucg

SEQ ID NO: 1176516 - RNA, 22 nt, Mycobacterium bovis subsp bovis AF2122/97
gccgcuuucuuggcgggcgccu

SEQ ID NO: 1176517 - RNA, 23 nt, Mycobacterium bovis subsp bovis AF2122/97
gccgcuuuugauugaccaacccu

SEQ ID NO: 1176518 - RNA, 20 nt, Mycobacterium bovis subsp bovis AF2122/97
gccguugcgggccaggcccu

SEQ ID NO: 1176519 - RNA, 22 nt, Mycobacterium bovis subsp bovis AF2122/97
gccguuggccggaucgaagacc

SEQ ID NO: 1176520 - RNA, 14 nt, Mycobacterium bovis subsp bovis AF2122/97
gccguuggcggcuu

SEQ ID NO: 1176521 - RNA, 17 nt, Mycobacterium bovis subsp bovis AF2122/97
gccguugggccaccggc

SEQ ID NO: 1176522 - RNA, 19 nt, Mycobacterium bovis subsp bovis AF2122/97
gccguuguagacggcggca

SEQ ID NO: 1176523 - RNA, 23 nt, Mycobacterium bovis subsp bovis AF2122/97
gccguuggugaggccccccgcgc

SEQ ID NO: 1176524 - RNA, 17 nt, Mycobacterium bovis subsp bovis AF2122/97
gccuaggccgaggccgc

SEQ ID NO: 1176525 - RNA, 20 nt, Mycobacterium bovis subsp bovis AF2122/97
gccuagccgcagccccgaca

SEQ ID NO: 1176526 - RNA, 14 nt, Mycobacterium bovis subsp bovis AF2122/97
gccguuccagcauc

SEQ ID NO: 1176527 - RNA, 20 nt, Mycobacterium bovis subsp bovis AF2122/97
gccguuccagcaucgagcag

SEQ ID NO: 1176528 - RNA, 14 nt, Mycobacterium bovis subsp bovis AF2122/97
gccguucgcagcug

SEQ ID NO: 1176529 - RNA, 16 nt, Mycobacterium bovis subsp bovis AF2122/97
gccguucccaccacca

SEQ ID NO: 1176530 - RNA, 19 nt, Mycobacterium bovis subsp bovis AF2122/97
gccguggcagucgcacggu

SEQ ID NO: 1176531 - RNA, 18 nt, Mycobacterium bovis subsp bovis AF2122/97
gccgugcggcggcugccg

SEQ ID NO: 1176532 - RNA, 17 nt, Mycobacterium bovis subsp bovis AF2122/97
gccguuaaucaagguga

SEQ ID NO: 1176533 - RNA, 21 nt, Mycobacterium bovis subsp bovis AF2122/97
gccguuaccgccguugccgcc

SEQ ID NO: 1176534 - RNA, 14 nt, Mycobacterium bovis subsp bovis AF2122/97
gccgugcggcggcu

SEQ ID NO: 1176535 - RNA, 13 nt, Mycobacterium bovis subsp bovis AF2122/97
gccgugcggcggc

SEQ ID NO: 1176536 - RNA, 17 nt, Mycobacterium bovis subsp bovis AF2122/97
gccgugcgggccggucg

SEQ ID NO: 1176537 - RNA, 19 nt, Mycobacterium bovis subsp bovis AF2122/97
gccgugcggucgcgcccuc

SEQ ID NO: 1176538 - RNA, 14 nt, Mycobacterium bovis subsp bovis AF2122/97
gccgugcgugcggg

SEQ ID NO: 1176539 - RNA, 18 nt, Mycobacterium bovis subsp bovis AF2122/97
gccgugcugaacuccgcc

SEQ ID NO: 1176540 - RNA, 18 nt, Mycobacterium bovis subsp bovis AF2122/97
gccgugcgugcgggggcu

SEQ ID NO: 1176541 - RNA, 19 nt, Mycobacterium bovis subsp bovis AF2122/97
gccgugacgauucgagcaa

SEQ ID NO: 1176542 - RNA, 23 nt, Mycobacterium bovis subsp bovis AF2122/97
gccgugaucagcucgcgcacguc

SEQ ID NO: 1176543 - RNA, 18 nt, Mycobacterium bovis subsp bovis AF2122/97
gccgugaccgagccgcga

SEQ ID NO: 1176544 - RNA, 18 nt, Mycobacterium bovis subsp bovis AF2122/97
gccgugaucggcgcccgg

SEQ ID NO: 1176545 - RNA, 21 nt, Mycobacterium bovis subsp bovis AF2122/97
gccucgaggguuuccauggcg

SEQ ID NO: 1176546 - RNA, 22 nt, Mycobacterium bovis subsp bovis AF2122/97
gccucgaucgacucgaaccguu

SEQ ID NO: 1176547 - RNA, 16 nt, Mycobacterium bovis subsp bovis AF2122/97
gccucgauggcggugg

SEQ ID NO: 1176548 - RNA, 23 nt, Mycobacterium bovis subsp bovis AF2122/97
gccucgaugucgcggucgcccgc

SEQ ID NO: 1176549 - RNA, 18 nt, Mycobacterium bovis subsp bovis AF2122/97
gccucgauuguggccagc

SEQ ID NO: 1176550 - RNA, 22 nt, Mycobacterium bovis subsp bovis AF2122/97
gccucgauuguggccagcgcuu

SEQ ID NO: 1176551 - RNA, 15 nt, Mycobacterium bovis subsp bovis AF2122/97
gccucgacacccagc

SEQ ID NO: 1176552 - RNA, 16 nt, Mycobacterium bovis subsp bovis AF2122/97
gccucgacacccagcc

SEQ ID NO: 1176553 - RNA, 14 nt, Mycobacterium bovis subsp bovis AF2122/97
gccucgacagcggc

SEQ ID NO: 1176554 - RNA, 14 nt, Mycobacterium bovis subsp bovis AF2122/97
gccucgaccgccag

SEQ ID NO: 1176555 - RNA, 16 nt, Mycobacterium bovis subsp bovis AF2122/97
gccucgaccgccagcc

SEQ ID NO: 1176556 - RNA, 18 nt, Mycobacterium bovis subsp bovis AF2122/97
gccucgaccgccagccgc

SEQ ID NO: 1176557 - RNA, 22 nt, Mycobacterium bovis subsp bovis AF2122/97
gccucgaccgccagccgcgagc

SEQ ID NO: 1176558 - RNA, 23 nt, Mycobacterium bovis subsp bovis AF2122/97
gccucgagcaacggacgaagcac

SEQ ID NO: 1176559 - RNA, 19 nt, Mycobacterium bovis subsp bovis AF2122/97
gccucgacgcggcaggccg

SEQ ID NO: 1176560 - RNA, 17 nt, Mycobacterium bovis subsp bovis AF2122/97
gccucgccgaagugguc

SEQ ID NO: 1176561 - RNA, 21 nt, Mycobacterium bovis subsp bovis AF2122/97
gccucgccguagagcuggugc

SEQ ID NO: 1176562 - RNA, 23 nt, Mycobacterium bovis subsp bovis AF2122/97
gccucgcgggaagucccgagugg

SEQ ID NO: 1176563 - RNA, 18 nt, Mycobacterium bovis subsp bovis AF2122/97
gccucgcguucgcugguc

SEQ ID NO: 1176564 - RNA, 17 nt, Mycobacterium bovis subsp bovis AF2122/97
gccucgcuaacucccca

SEQ ID NO: 1176565 - RNA, 21 nt, Mycobacterium bovis subsp bovis AF2122/97
gccucgcuaacuccccagaca

SEQ ID NO: 1176566 - RNA, 13 nt, Mycobacterium bovis subsp bovis AF2122/97
gccucgcucucca

SEQ ID NO: 1176567 - RNA, 18 nt, Mycobacterium bovis subsp bovis AF2122/97
gccucgggcucaaacgga

SEQ ID NO: 1176568 - RNA, 23 nt, Mycobacterium bovis subsp bovis AF2122/97
gccucggggccggaggcuugcaa

SEQ ID NO: 1176569 - RNA, 17 nt, Mycobacterium bovis subsp bovis AF2122/97
gccucguagucccacug

SEQ ID NO: 1176570 - RNA, 22 nt, Mycobacterium bovis subsp bovis AF2122/97
gccucgucgucggacucguccu

SEQ ID NO: 1176571 - RNA, 17 nt, Mycobacterium bovis subsp bovis AF2122/97
gccucgucgaugccuag

SEQ ID NO: 1176572 - RNA, 13 nt, Mycobacterium bovis subsp bovis AF2122/97
gccucgucgccgc

SEQ ID NO: 1176573 - RNA, 13 nt, Mycobacterium bovis subsp bovis AF2122/97
gccucggggccua

SEQ ID NO: 1176574 - RNA, 18 nt, Mycobacterium bovis subsp bovis AF2122/97
gccucguugaccagaacc

SEQ ID NO: 1176575 - RNA, 15 nt, Mycobacterium bovis subsp bovis AF2122/97
gccucggcgcugcgc

SEQ ID NO: 1176576 - RNA, 23 nt, Mycobacterium bovis subsp bovis AF2122/97
gccucggcgcugcgcaccgccgc

SEQ ID NO: 1176577 - RNA, 18 nt, Mycobacterium bovis subsp bovis AF2122/97
gccucggcggccguggcc

SEQ ID NO: 1176578 - RNA, 16 nt, Mycobacterium bovis subsp bovis AF2122/97
gccucggcggccucgc

SEQ ID NO: 1176579 - RNA, 16 nt, Mycobacterium bovis subsp bovis AF2122/97
gccucggaccagaccc

SEQ ID NO: 1176580 - RNA, 21 nt, Mycobacterium bovis subsp bovis AF2122/97
gccucggaccagacccacgau

SEQ ID NO: 1176581 - RNA, 16 nt, Mycobacterium bovis subsp bovis AF2122/97
gccucgcugcucagca

SEQ ID NO: 1176582 - RNA, 18 nt, Mycobacterium bovis subsp bovis AF2122/97
gccucggcaucgccgcgg

SEQ ID NO: 1176583 - RNA, 12 nt, Mycobacterium bovis subsp bovis AF2122/97
gccucggcaugc

SEQ ID NO: 1176584 - RNA, 22 nt, Mycobacterium bovis subsp bovis AF2122/97
gccuccuggaaggaggccggga

SEQ ID NO: 1176585 - RNA, 12 nt, Mycobacterium bovis subsp bovis AF2122/97
gccuccugcugg

SEQ ID NO: 1176586 - RNA, 17 nt, Mycobacterium bovis subsp bovis AF2122/97
gccuccugcuggcccug

SEQ ID NO: 1176587 - RNA, 20 nt, Mycobacterium bovis subsp bovis AF2122/97
gccuccugccgccgcuccau

SEQ ID NO: 1176588 - RNA, 18 nt, Mycobacterium bovis subsp bovis AF2122/97
gccuccucgugcaggacc

SEQ ID NO: 1176589 - RNA, 16 nt, Mycobacterium bovis subsp bovis AF2122/97
gccuccucuugggucc

SEQ ID NO: 1176590 - RNA, 21 nt, Mycobacterium bovis subsp bovis AF2122/97
gccuccugcuggcccugcucc

SEQ ID NO: 1176591 - RNA, 21 nt, Mycobacterium bovis subsp bovis AF2122/97
gccuccuccccgaccgccacc

SEQ ID NO: 1176592 - RNA, 15 nt, Mycobacterium bovis subsp bovis AF2122/97
gccuccguugccccc

SEQ ID NO: 1176593 - RNA, 23 nt, Mycobacterium bovis subsp bovis AF2122/97
gccuccggugcauauuggaucgu

SEQ ID NO: 1176594 - RNA, 16 nt, Mycobacterium bovis subsp bovis AF2122/97
gccuccgcugccgccc

SEQ ID NO: 1176595 - RNA, 18 nt, Mycobacterium bovis subsp bovis AF2122/97
gccuccagcuuggcgagc

SEQ ID NO: 1176596 - RNA, 13 nt, Mycobacterium bovis subsp bovis AF2122/97
gccuccaucgcga

SEQ ID NO: 1176597 - RNA, 17 nt, Mycobacterium bovis subsp bovis AF2122/97
gccuccgccgaggccgc

SEQ ID NO: 1176598 - RNA, 13 nt, Mycobacterium bovis subsp bovis AF2122/97
gccuccgccugcc

SEQ ID NO: 1176599 - RNA, 17 nt, Mycobacterium bovis subsp bovis AF2122/97
gccucccgggccgccgc

SEQ ID NO: 1176600 - RNA, 15 nt, Mycobacterium bovis subsp bovis AF2122/97
gccucccgcgccggc

SEQ ID NO: 1176601 - RNA, 18 nt, Mycobacterium bovis subsp bovis AF2122/97
gccucccacucacccagc

SEQ ID NO: 1176602 - RNA, 14 nt, Mycobacterium bovis subsp bovis AF2122/97
gccuccacccgcca

SEQ ID NO: 1176603 - RNA, 16 nt, Mycobacterium bovis subsp bovis AF2122/97
gccuccacccgccacg

SEQ ID NO: 1176604 - RNA, 14 nt, Mycobacterium bovis subsp bovis AF2122/97
gccuccaccgccgc

SEQ ID NO: 1176605 - RNA, 16 nt, Mycobacterium bovis subsp bovis AF2122/97
gccuccaccgcgucca

SEQ ID NO: 1176606 - RNA, 19 nt, Mycobacterium bovis subsp bovis AF2122/97
gccuccagauucgccgccc

SEQ ID NO: 1176607 - RNA, 15 nt, Mycobacterium bovis subsp bovis AF2122/97
gccuccagcaggucc

SEQ ID NO: 1176608 - RNA, 23 nt, Mycobacterium bovis subsp bovis AF2122/97
gccucaucggacagcgccuggcc

SEQ ID NO: 1176609 - RNA, 15 nt, Mycobacterium bovis subsp bovis AF2122/97
gccucauccaccgau

SEQ ID NO: 1176610 - RNA, 22 nt, Mycobacterium bovis subsp bovis AF2122/97
gccucauccaccgauggcgcgc

SEQ ID NO: 1176611 - RNA, 22 nt, Mycobacterium bovis subsp bovis AF2122/97
gccuccaaaaucgcggccacac

SEQ ID NO: 1176612 - RNA, 15 nt, Mycobacterium bovis subsp bovis AF2122/97
gccucaugcuaggcc

SEQ ID NO: 1176613 - RNA, 17 nt, Mycobacterium bovis subsp bovis AF2122/97
gccucaugcuaggccac

SEQ ID NO: 1176614 - RNA, 21 nt, Mycobacterium bovis subsp bovis AF2122/97
gccucaugcuaggccaccggc

SEQ ID NO: 1176615 - RNA, 15 nt, Mycobacterium bovis subsp bovis AF2122/97
gccucaggggcgccu

SEQ ID NO: 1176616 - RNA, 12 nt, Mycobacterium bovis subsp bovis AF2122/97
gccucagccgcu

SEQ ID NO: 1176617 - RNA, 13 nt, Mycobacterium bovis subsp bovis AF2122/97
gccucagcccggc

SEQ ID NO: 1176618 - RNA, 17 nt, Mycobacterium bovis subsp bovis AF2122/97
gccucagcccggccagc

SEQ ID NO: 1176619 - RNA, 23 nt, Mycobacterium bovis subsp bovis AF2122/97
gccucaccgccgcuaccgcccgc

SEQ ID NO: 1176620 - RNA, 20 nt, Mycobacterium bovis subsp bovis AF2122/97
gccucagaccggaaacagca

SEQ ID NO: 1176621 - RNA, 21 nt, Mycobacterium bovis subsp bovis AF2122/97
gccuaucccgaaucucaccca

SEQ ID NO: 1176622 - RNA, 15 nt, Mycobacterium bovis subsp bovis AF2122/97
gccuagggcggcggc

SEQ ID NO: 1176623 - RNA, 18 nt, Mycobacterium bovis subsp bovis AF2122/97
gccuagguucgcccagcc

SEQ ID NO: 1176624 - RNA, 18 nt, Mycobacterium bovis subsp bovis AF2122/97
gcgaaacgcccgggcggc

SEQ ID NO: 1176625 - RNA, 19 nt, Mycobacterium bovis subsp bovis AF2122/97
gcgaaaguccugcagugcg

SEQ ID NO: 1176626 - RNA, 12 nt, Mycobacterium bovis subsp bovis AF2122/97
gcgaacagcggc

SEQ ID NO: 1176627 - RNA, 22 nt, Mycobacterium bovis subsp bovis AF2122/97
gcgaacaucaccgucgcccggg

SEQ ID NO: 1176628 - RNA, 20 nt, Mycobacterium bovis subsp bovis AF2122/97
gcgaacacccgaagccggcg

SEQ ID NO: 1176629 - RNA, 20 nt, Mycobacterium bovis subsp bovis AF2122/97
gcgaaauaacggagcggccu

SEQ ID NO: 1176630 - RNA, 16 nt, Mycobacterium bovis subsp bovis AF2122/97
gcgaaauagcgagcgu

SEQ ID NO: 1176631 - RNA, 16 nt, Mycobacterium bovis subsp bovis AF2122/97
gcgaaaucgacagcag

SEQ ID NO: 1176632 - RNA, 17 nt, Mycobacterium bovis subsp bovis AF2122/97
gcgaaaucgacagcagc

SEQ ID NO: 1176633 - RNA, 19 nt, Mycobacterium bovis subsp bovis AF2122/97
gcgaaccagaguucggcca

SEQ ID NO: 1176634 - RNA, 13 nt, Mycobacterium bovis subsp bovis AF2122/97
gcgaacccgccga

SEQ ID NO: 1176635 - RNA, 15 nt, Mycobacterium bovis subsp bovis AF2122/97
gcgaacccccgccgc

SEQ ID NO: 1176636 - RNA, 12 nt, Mycobacterium bovis subsp bovis AF2122/97
gcgaacccgguc

SEQ ID NO: 1176637 - RNA, 14 nt, Mycobacterium bovis subsp bovis AF2122/97
gcgaacccuccgca

SEQ ID NO: 1176638 - RNA, 15 nt, Mycobacterium bovis subsp bovis AF2122/97
gcgaacgggcuuccg

SEQ ID NO: 1176639 - RNA, 13 nt, Mycobacterium bovis subsp bovis AF2122/97
gcgaacggccagg

SEQ ID NO: 1176640 - RNA, 21 nt, Mycobacterium bovis subsp bovis AF2122/97
gcgaacgcguccagcgcggcc

SEQ ID NO: 1176641 - RNA, 15 nt, Mycobacterium bovis subsp bovis AF2122/97
gcgaacgccacggca

SEQ ID NO: 1176642 - RNA, 13 nt, Mycobacterium bovis subsp bovis AF2122/97
gcgaagcaaguga

SEQ ID NO: 1176643 - RNA, 13 nt, Mycobacterium bovis subsp bovis AF2122/97
gcgaagcacaccg

SEQ ID NO: 1176644 - RNA, 13 nt, Mycobacterium bovis subsp bovis AF2122/97
gcgaagccgagca

SEQ ID NO: 1176645 - RNA, 18 nt, Mycobacterium bovis subsp bovis AF2122/97
gcgaagccgggucucggu

SEQ ID NO: 1176646 - RNA, 17 nt, Mycobacterium bovis subsp bovis AF2122/97
gcgaagccgagcaucag

SEQ ID NO: 1176647 - RNA, 15 nt, Mycobacterium bovis subsp bovis AF2122/97
gcgaacuccagcagc

SEQ ID NO: 1176648 - RNA, 18 nt, Mycobacterium bovis subsp bovis AF2122/97
gcgaacucgcgccgagcc

SEQ ID NO: 1176649 - RNA, 19 nt, Mycobacterium bovis subsp bovis AF2122/97
gccuugacugaacucaaca

SEQ ID NO: 1176650 - RNA, 20 nt, Mycobacterium bovis subsp bovis AF2122/97
gccuugaccgcggucuucuu

SEQ ID NO: 1176651 - RNA, 18 nt, Mycobacterium bovis subsp bovis AF2122/97
gccuugaggcccugcggc

SEQ ID NO: 1176652 - RNA, 19 nt, Mycobacterium bovis subsp bovis AF2122/97
gccuugaucugagcgcggg

SEQ ID NO: 1176653 - RNA, 16 nt, Mycobacterium bovis subsp bovis AF2122/97
gccuugaucgugcugg

SEQ ID NO: 1176654 - RNA, 19 nt, Mycobacterium bovis subsp bovis AF2122/97
gccuugauggucuccacca

SEQ ID NO: 1176655 - RNA, 18 nt, Mycobacterium bovis subsp bovis AF2122/97
gccuugcagcgcccccgc

SEQ ID NO: 1176656 - RNA, 17 nt, Mycobacterium bovis subsp bovis AF2122/97
gccuugacagcuuucuu

SEQ ID NO: 1176657 - RNA, 18 nt, Mycobacterium bovis subsp bovis AF2122/97
gccuucguagaaggaccg

SEQ ID NO: 1176658 - RNA, 18 nt, Mycobacterium bovis subsp bovis AF2122/97
gccuucguagcggccgca

SEQ ID NO: 1176659 - RNA, 20 nt, Mycobacterium bovis subsp bovis AF2122/97
gccuucguagcggccgcagg

SEQ ID NO: 1176660 - RNA, 22 nt, Mycobacterium bovis subsp bovis AF2122/97
gccuucggcuaggucagcgggc

SEQ ID NO: 1176661 - RNA, 15 nt, Mycobacterium bovis subsp bovis AF2122/97
gccuucgccagcggc

SEQ ID NO: 1176662 - RNA, 16 nt, Mycobacterium bovis subsp bovis AF2122/97
gccuucacgcuggccu

SEQ ID NO: 1176663 - RNA, 14 nt, Mycobacterium bovis subsp bovis AF2122/97
gccuucagcucacc

SEQ ID NO: 1176664 - RNA, 14 nt, Mycobacterium bovis subsp bovis AF2122/97
gccuuggucgccgc

SEQ ID NO: 1176665 - RNA, 17 nt, Mycobacterium bovis subsp bovis AF2122/97
gccuugguagccggccg

SEQ ID NO: 1176666 - RNA, 15 nt, Mycobacterium bovis subsp bovis AF2122/97
gccuuggucgccgcc

SEQ ID NO: 1176667 - RNA, 16 nt, Mycobacterium bovis subsp bovis AF2122/97
gccuuggucgccgccu

SEQ ID NO: 1176668 - RNA, 22 nt, Mycobacterium bovis subsp bovis AF2122/97
gccuugggcguacucggcgcgc

SEQ ID NO: 1176669 - RNA, 18 nt, Mycobacterium bovis subsp bovis AF2122/97
gccuuggcggccgcgacc

SEQ ID NO: 1176670 - RNA, 15 nt, Mycobacterium bovis subsp bovis AF2122/97
gccuuggcggcggca

SEQ ID NO: 1176671 - RNA, 18 nt, Mycobacterium bovis subsp bovis AF2122/97
gccuuggucaccuucuug

SEQ ID NO: 1176672 - RNA, 21 nt, Mycobacterium bovis subsp bovis AF2122/97
gccuuggucgccgcuuucuug

SEQ ID NO: 1176673 - RNA, 18 nt, Mycobacterium bovis subsp bovis AF2122/97
gccuuggucgccgccuuc

SEQ ID NO: 1176674 - RNA, 21 nt, Mycobacterium bovis subsp bovis AF2122/97
gccuuggucgccgccuucuug

SEQ ID NO: 1176675 - RNA, 20 nt, Mycobacterium bovis subsp bovis AF2122/97
gccuuggucgccgcuuucuu

SEQ ID NO: 1176676 - RNA, 14 nt, Mycobacterium bovis subsp bovis AF2122/97
gccuuggcccccgg

SEQ ID NO: 1176677 - RNA, 14 nt, Mycobacterium bovis subsp bovis AF2122/97
gccuuggcgcggca

SEQ ID NO: 1176678 - RNA, 16 nt, Mycobacterium bovis subsp bovis AF2122/97
gccuuggcagcccagu

SEQ ID NO: 1176679 - RNA, 22 nt, Mycobacterium bovis subsp bovis AF2122/97
gccuuggacgugcgcgccaagu

SEQ ID NO: 1176680 - RNA, 14 nt, Mycobacterium bovis subsp bovis AF2122/97
gccuuugagcgcgg

SEQ ID NO: 1176681 - RNA, 14 nt, Mycobacterium bovis subsp bovis AF2122/97
gccuuugcccccgg

SEQ ID NO: 1176682 - RNA, 14 nt, Mycobacterium bovis subsp bovis AF2122/97
gccuuugcggcggg

SEQ ID NO: 1176683 - RNA, 14 nt, Mycobacterium bovis subsp bovis AF2122/97
gccuggccaccugg

SEQ ID NO: 1176684 - RNA, 16 nt, Mycobacterium bovis subsp bovis AF2122/97
gccuggcgagccagcu

SEQ ID NO: 1176685 - RNA, 12 nt, Mycobacterium bovis subsp bovis AF2122/97
gccugcuggccg

SEQ ID NO: 1176686 - RNA, 18 nt, Mycobacterium bovis subsp bovis AF2122/97
gccugcgggaacgcggcg

SEQ ID NO: 1176687 - RNA, 13 nt, Mycobacterium bovis subsp bovis AF2122/97
gccugcggcggcg

SEQ ID NO: 1176688 - RNA, 16 nt, Mycobacterium bovis subsp bovis AF2122/97
gccugccguuccagca

SEQ ID NO: 1176689 - RNA, 21 nt, Mycobacterium bovis subsp bovis AF2122/97
gccugccucgccugcacgccc

SEQ ID NO: 1176690 - RNA, 16 nt, Mycobacterium bovis subsp bovis AF2122/97
gccugccgcucgccgg

SEQ ID NO: 1176691 - RNA, 23 nt, Mycobacterium bovis subsp bovis AF2122/97
gccugccgcacguucggcgauga

SEQ ID NO: 1176692 - RNA, 13 nt, Mycobacterium bovis subsp bovis AF2122/97
gccugcccggcgc

SEQ ID NO: 1176693 - RNA, 12 nt, Mycobacterium bovis subsp bovis AF2122/97
gccucugucuuc

SEQ ID NO: 1176694 - RNA, 11 nt, Mycobacterium bovis subsp bovis AF2122/97
gccucugcauc

SEQ ID NO: 1176695 - RNA, 15 nt, Mycobacterium bovis subsp bovis AF2122/97
gccucucuucccaac

SEQ ID NO: 1176696 - RNA, 18 nt, Mycobacterium bovis subsp bovis AF2122/97
gccuggcggcgccgcaga

SEQ ID NO: 1176697 - RNA, 18 nt, Mycobacterium bovis subsp bovis AF2122/97
gccuggcuggccagcugc

SEQ ID NO: 1176698 - RNA, 23 nt, Mycobacterium bovis subsp bovis AF2122/97
gccuggcuguccgcgggccgcgc

SEQ ID NO: 1176699 - RNA, 18 nt, Mycobacterium bovis subsp bovis AF2122/97
gccugggcacggccgucg

SEQ ID NO: 1176700 - RNA, 16 nt, Mycobacterium bovis subsp bovis AF2122/97
gccuguagucccucau

SEQ ID NO: 1176701 - RNA, 23 nt, Mycobacterium bovis subsp bovis AF2122/97
gccuguagucccucaucaccucu

SEQ ID NO: 1176702 - RNA, 14 nt, Mycobacterium bovis subsp bovis AF2122/97
gccugguccucacg

SEQ ID NO: 1176703 - RNA, 16 nt, Mycobacterium bovis subsp bovis AF2122/97
gccugguaccgcggug

SEQ ID NO: 1176704 - RNA, 21 nt, Mycobacterium bovis subsp bovis AF2122/97
gccuggguuggugauugcggc

SEQ ID NO: 1176705 - RNA, 15 nt, Mycobacterium bovis subsp bovis AF2122/97
gccuggccugcccag

SEQ ID NO: 1176706 - RNA, 13 nt, Mycobacterium bovis subsp bovis AF2122/97
gccuguucaacuc

SEQ ID NO: 1176707 - RNA, 13 nt, Mycobacterium bovis subsp bovis AF2122/97
gccugucccgccg

SEQ ID NO: 1176708 - RNA, 18 nt, Mycobacterium bovis subsp bovis AF2122/97
gccugucccgccggcccc

SEQ ID NO: 1176709 - RNA, 21 nt, Mycobacterium bovis subsp bovis AF2122/97
gccugucccgccggccccgcc

SEQ ID NO: 1176710 - RNA, 14 nt, Mycobacterium bovis subsp bovis AF2122/97
gcgacucgccggcg

SEQ ID NO: 1176711 - RNA, 19 nt, Mycobacterium bovis subsp bovis AF2122/97
gcgacuaagggcacuccac

SEQ ID NO: 1176712 - RNA, 14 nt, Mycobacterium bovis subsp bovis AF2122/97
gcgacuacggccuc

SEQ ID NO: 1176713 - RNA, 15 nt, Mycobacterium bovis subsp bovis AF2122/97
gcgagaacccgagcg

SEQ ID NO: 1176714 - RNA, 19 nt, Mycobacterium bovis subsp bovis AF2122/97
gcgagaagcagggauucug

SEQ ID NO: 1176715 - RNA, 17 nt, Mycobacterium bovis subsp bovis AF2122/97
gcgacucggugcgguga

SEQ ID NO: 1176716 - RNA, 15 nt, Mycobacterium bovis subsp bovis AF2122/97
gcgacucggccagga

SEQ ID NO: 1176717 - RNA, 14 nt, Mycobacterium bovis subsp bovis AF2122/97
gcgagcccagcugc

SEQ ID NO: 1176718 - RNA, 22 nt, Mycobacterium bovis subsp bovis AF2122/97
gcgagcccagcugcgccgaacg

SEQ ID NO: 1176719 - RNA, 20 nt, Mycobacterium bovis subsp bovis AF2122/97
gcgagcaucugggguccggu

SEQ ID NO: 1176720 - RNA, 21 nt, Mycobacterium bovis subsp bovis AF2122/97
gcgagcccacguggggccggg

SEQ ID NO: 1176721 - RNA, 13 nt, Mycobacterium bovis subsp bovis AF2122/97
gcgagccagcugc

SEQ ID NO: 1176722 - RNA, 13 nt, Mycobacterium bovis subsp bovis AF2122/97
gcgagccacggca

SEQ ID NO: 1176723 - RNA, 18 nt, Mycobacterium bovis subsp bovis AF2122/97
gcgagauagcaccaguuu

SEQ ID NO: 1176724 - RNA, 14 nt, Mycobacterium bovis subsp bovis AF2122/97
gcgagcaggucgga

SEQ ID NO: 1176725 - RNA, 14 nt, Mycobacterium bovis subsp bovis AF2122/97
gcgagcaggggagu

SEQ ID NO: 1176726 - RNA, 18 nt, Mycobacterium bovis subsp bovis AF2122/97
gcgagacgcaugucgggc

SEQ ID NO: 1176727 - RNA, 22 nt, Mycobacterium bovis subsp bovis AF2122/97
gcgagacgcuccaguggcgcca

SEQ ID NO: 1176728 - RNA, 15 nt, Mycobacterium bovis subsp bovis AF2122/97
gcgaaggccagcaga

SEQ ID NO: 1176729 - RNA, 13 nt, Mycobacterium bovis subsp bovis AF2122/97
gcgaaggccgcgc

SEQ ID NO: 1176730 - RNA, 18 nt, Mycobacterium bovis subsp bovis AF2122/97
gcgaagcugugcccggcg

SEQ ID NO: 1176731 - RNA, 21 nt, Mycobacterium bovis subsp bovis AF2122/97
gcgaagcugugcccggcgccc

SEQ ID NO: 1176732 - RNA, 13 nt, Mycobacterium bovis subsp bovis AF2122/97
gcgaagggcaccg

SEQ ID NO: 1176733 - RNA, 19 nt, Mycobacterium bovis subsp bovis AF2122/97
gcgaagcgucuggucagcc

SEQ ID NO: 1176734 - RNA, 16 nt, Mycobacterium bovis subsp bovis AF2122/97
gcgaagguguccucca

SEQ ID NO: 1176735 - RNA, 20 nt, Mycobacterium bovis subsp bovis AF2122/97
gcgacggcucuaccgguccg

SEQ ID NO: 1176736 - RNA, 19 nt, Mycobacterium bovis subsp bovis AF2122/97
gcgacggcgcucggcgagc

SEQ ID NO: 1176737 - RNA, 19 nt, Mycobacterium bovis subsp bovis AF2122/97
gcgacgggcacccgagccg

SEQ ID NO: 1176738 - RNA, 20 nt, Mycobacterium bovis subsp bovis AF2122/97
gcgacgggcacccgagccgc

SEQ ID NO: 1176739 - RNA, 17 nt, Mycobacterium bovis subsp bovis AF2122/97
gcgacguuggcgggagc

SEQ ID NO: 1176740 - RNA, 20 nt, Mycobacterium bovis subsp bovis AF2122/97
gcgacggcagcucggggcac

SEQ ID NO: 1176741 - RNA, 14 nt, Mycobacterium bovis subsp bovis AF2122/97
gcgacggccagcgc

SEQ ID NO: 1176742 - RNA, 14 nt, Mycobacterium bovis subsp bovis AF2122/97
gcgauaaaucgccg

SEQ ID NO: 1176743 - RNA, 22 nt, Mycobacterium bovis subsp bovis AF2122/97
gcgagugucuuagccagcagca

SEQ ID NO: 1176744 - RNA, 18 nt, Mycobacterium bovis subsp bovis AF2122/97
gcgaguuaggccgccagc

SEQ ID NO: 1176745 - RNA, 21 nt, Mycobacterium bovis subsp bovis AF2122/97
gcgaguuaggccgccagccgg

SEQ ID NO: 1176746 - RNA, 13 nt, Mycobacterium bovis subsp bovis AF2122/97
gcgaguugcaguc

SEQ ID NO: 1176747 - RNA, 19 nt, Mycobacterium bovis subsp bovis AF2122/97
gcgagcguuuggacgggcg

SEQ ID NO: 1176748 - RNA, 22 nt, Mycobacterium bovis subsp bovis AF2122/97
gcgagccugauaaagcccggcg

SEQ ID NO: 1176749 - RNA, 15 nt, Mycobacterium bovis subsp bovis AF2122/97
gcgagccgugccagc

SEQ ID NO: 1176750 - RNA, 19 nt, Mycobacterium bovis subsp bovis AF2122/97
gcgagcuaacacccgagca

SEQ ID NO: 1176751 - RNA, 19 nt, Mycobacterium bovis subsp bovis AF2122/97
gcgagcucggccccgccgc

SEQ ID NO: 1176752 - RNA, 14 nt, Mycobacterium bovis subsp bovis AF2122/97
gcgagcuuggcuug

SEQ ID NO: 1176753 - RNA, 15 nt, Mycobacterium bovis subsp bovis AF2122/97
gcgaggagcagggcu

SEQ ID NO: 1176754 - RNA, 22 nt, Mycobacterium bovis subsp bovis AF2122/97
gcgaggaacuggaccggugcca

SEQ ID NO: 1176755 - RNA, 19 nt, Mycobacterium bovis subsp bovis AF2122/97
gcgaucacccacaugguga

SEQ ID NO: 1176756 - RNA, 22 nt, Mycobacterium bovis subsp bovis AF2122/97
gcgaucaccgcgccggagaucg

SEQ ID NO: 1176757 - RNA, 13 nt, Mycobacterium bovis subsp bovis AF2122/97
gcgaucaccaccg

SEQ ID NO: 1176758 - RNA, 19 nt, Mycobacterium bovis subsp bovis AF2122/97
gcgaucaauugcccggcac

SEQ ID NO: 1176759 - RNA, 14 nt, Mycobacterium bovis subsp bovis AF2122/97
gcgaucgucaagcc

SEQ ID NO: 1176760 - RNA, 20 nt, Mycobacterium bovis subsp bovis AF2122/97
gcgaucaccuccgcgacggc

SEQ ID NO: 1176761 - RNA, 15 nt, Mycobacterium bovis subsp bovis AF2122/97
gcgaucgggccggcg

SEQ ID NO: 1176762 - RNA, 18 nt, Mycobacterium bovis subsp bovis AF2122/97
gcgaucgggcccagcagc

SEQ ID NO: 1176763 - RNA, 20 nt, Mycobacterium bovis subsp bovis AF2122/97
gcgaucgcgcccgcugagcc

SEQ ID NO: 1176764 - RNA, 21 nt, Mycobacterium bovis subsp bovis AF2122/97
gcgaucgcggcgagcaccacc

SEQ ID NO: 1176765 - RNA, 20 nt, Mycobacterium bovis subsp bovis AF2122/97
gcgaucugcgcgaugcccac

SEQ ID NO: 1176766 - RNA, 17 nt, Mycobacterium bovis subsp bovis AF2122/97
gcgaucuugcgacgccc

SEQ ID NO: 1176767 - RNA, 22 nt, Mycobacterium bovis subsp bovis AF2122/97
gcgaucuuggcgacaugcagcg

SEQ ID NO: 1176768 - RNA, 14 nt, Mycobacterium bovis subsp bovis AF2122/97
gcgaugaccgggcg

SEQ ID NO: 1176769 - RNA, 21 nt, Mycobacterium bovis subsp bovis AF2122/97
gcgaugaauucuuuggggcgc

SEQ ID NO: 1176770 - RNA, 20 nt, Mycobacterium bovis subsp bovis AF2122/97
gcgaucgugcggaaaccgcu

SEQ ID NO: 1176771 - RNA, 14 nt, Mycobacterium bovis subsp bovis AF2122/97
gcgaucuccuuggc

SEQ ID NO: 1176772 - RNA, 16 nt, Mycobacterium bovis subsp bovis AF2122/97
gcgaucugcggcgccc

SEQ ID NO: 1176773 - RNA, 22 nt, Mycobacterium bovis subsp bovis AF2122/97
gcgaucucuugguagugacugc

SEQ ID NO: 1176774 - RNA, 16 nt, Mycobacterium bovis subsp bovis AF2122/97
gcgaucucaccuggag

SEQ ID NO: 1176775 - RNA, 19 nt, Mycobacterium bovis subsp bovis AF2122/97
gcgauggugcgcccgccgg

SEQ ID NO: 1176776 - RNA, 17 nt, Mycobacterium bovis subsp bovis AF2122/97
gcgauggugcgccgggc

SEQ ID NO: 1176777 - RNA, 18 nt, Mycobacterium bovis subsp bovis AF2122/97
gcgauggugcgccgggcg

SEQ ID NO: 1176778 - RNA, 18 nt, Mycobacterium bovis subsp bovis AF2122/97
gcgauggcguagcccaug

SEQ ID NO: 1176779 - RNA, 18 nt, Mycobacterium bovis subsp bovis AF2122/97
gcgauggccgacgcugcu

SEQ ID NO: 1176780 - RNA, 12 nt, Mycobacterium bovis subsp bovis AF2122/97
gcgauggccagc

SEQ ID NO: 1176781 - RNA, 18 nt, Mycobacterium bovis subsp bovis AF2122/97
gcgaugcggucggccaca

SEQ ID NO: 1176782 - RNA, 23 nt, Mycobacterium bovis subsp bovis AF2122/97
gcgaugcgguguagggcggcguu

SEQ ID NO: 1176783 - RNA, 20 nt, Mycobacterium bovis subsp bovis AF2122/97
gcgaugcgggccgccaggcg

SEQ ID NO: 1176784 - RNA, 19 nt, Mycobacterium bovis subsp bovis AF2122/97
gcgaugcgcgggugguuca

SEQ ID NO: 1176785 - RNA, 20 nt, Mycobacterium bovis subsp bovis AF2122/97
gcgaugccguccaagauguc

SEQ ID NO: 1176786 - RNA, 18 nt, Mycobacterium bovis subsp bovis AF2122/97
gcgaugccccacggugcg

SEQ ID NO: 1176787 - RNA, 18 nt, Mycobacterium bovis subsp bovis AF2122/97
gcgaugcccacgcacagc

SEQ ID NO: 1176788 - RNA, 20 nt, Mycobacterium bovis subsp bovis AF2122/97
gcgaugauguugagcuggac

SEQ ID NO: 1176789 - RNA, 15 nt, Mycobacterium bovis subsp bovis AF2122/97
gcgaugaucaccagu

SEQ ID NO: 1176790 - RNA, 11 nt, Mycobacterium bovis subsp bovis AF2122/97
gcgaugugggc

SEQ ID NO: 1176791 - RNA, 21 nt, Mycobacterium bovis subsp bovis AF2122/97
gcgaugucggcugguggggga

SEQ ID NO: 1176792 - RNA, 21 nt, Mycobacterium bovis subsp bovis AF2122/97
gcgauguccuuguuggccagu

SEQ ID NO: 1176793 - RNA, 23 nt, Mycobacterium bovis subsp bovis AF2122/97
gcgauucugcgucugcucgccag

SEQ ID NO: 1176794 - RNA, 20 nt, Mycobacterium bovis subsp bovis AF2122/97
gcgauucccaaccgguggcc

SEQ ID NO: 1176795 - RNA, 19 nt, Mycobacterium bovis subsp bovis AF2122/97
gcgauugauccgguggcac

SEQ ID NO: 1176796 - RNA, 19 nt, Mycobacterium bovis subsp bovis AF2122/97
gcgauugucggggccgcag

SEQ ID NO: 1176797 - RNA, 18 nt, Mycobacterium bovis subsp bovis AF2122/97
gcgauuuugcgucugcuc

SEQ ID NO: 1176798 - RNA, 20 nt, Mycobacterium bovis subsp bovis AF2122/97
gcgcaaagacaccgaaagcc

SEQ ID NO: 1176799 - RNA, 18 nt, Mycobacterium bovis subsp bovis AF2122/97
gcgcaauagcgacagcag

SEQ ID NO: 1176800 - RNA, 19 nt, Mycobacterium bovis subsp bovis AF2122/97
gcgcaauagcgacagcagc

SEQ ID NO: 1176801 - RNA, 23 nt, Mycobacterium bovis subsp bovis AF2122/97
gcgcaauccugcgggacuggcug

SEQ ID NO: 1176802 - RNA, 21 nt, Mycobacterium bovis subsp bovis AF2122/97
gcgcaaugcaucgcggcggcg

SEQ ID NO: 1176803 - RNA, 22 nt, Mycobacterium bovis subsp bovis AF2122/97
gcgcaaccgguggaugaacacc

SEQ ID NO: 1176804 - RNA, 22 nt, Mycobacterium bovis subsp bovis AF2122/97
gcgcaaccuaaauugccgggcc

SEQ ID NO: 1176805 - RNA, 12 nt, Mycobacterium bovis subsp bovis AF2122/97
gcgcaacaccuc

SEQ ID NO: 1176806 - RNA, 12 nt, Mycobacterium bovis subsp bovis AF2122/97
gcgcaaccagcc

SEQ ID NO: 1176807 - RNA, 14 nt, Mycobacterium bovis subsp bovis AF2122/97
gcgcaaccagccca

SEQ ID NO: 1176808 - RNA, 20 nt, Mycobacterium bovis subsp bovis AF2122/97
gcgcaacaaccgguuggcga

SEQ ID NO: 1176809 - RNA, 20 nt, Mycobacterium bovis subsp bovis AF2122/97
gcgcaacgccgccagccugg

SEQ ID NO: 1176810 - RNA, 23 nt, Mycobacterium bovis subsp bovis AF2122/97
gcgcaaccuaaauugccgggccc

SEQ ID NO: 1176811 - RNA, 22 nt, Mycobacterium bovis subsp bovis AF2122/97
gcgcaacguagccagcagcggc

SEQ ID NO: 1176812 - RNA, 14 nt, Mycobacterium bovis subsp bovis AF2122/97
gcgcaacggccagc

SEQ ID NO: 1176813 - RNA, 16 nt, Mycobacterium bovis subsp bovis AF2122/97
gcgcaacucccagcac

SEQ ID NO: 1176814 - RNA, 22 nt, Mycobacterium bovis subsp bovis AF2122/97
gcgcaacucgccacggucgccg

SEQ ID NO: 1176815 - RNA, 18 nt, Mycobacterium bovis subsp bovis AF2122/97
gcgcacccguccgccgca

SEQ ID NO: 1176816 - RNA, 22 nt, Mycobacterium bovis subsp bovis AF2122/97
gcgcaccgccgauguggucggc

SEQ ID NO: 1176817 - RNA, 21 nt, Mycobacterium bovis subsp bovis AF2122/97
gcgcaccccgcuugcgcggcu

SEQ ID NO: 1176818 - RNA, 13 nt, Mycobacterium bovis subsp bovis AF2122/97
gcgcacccgcggg

SEQ ID NO: 1176819 - RNA, 15 nt, Mycobacterium bovis subsp bovis AF2122/97
gcgcaccaguccagc

SEQ ID NO: 1176820 - RNA, 19 nt, Mycobacterium bovis subsp bovis AF2122/97
gcgcaccaguccagcgggc

SEQ ID NO: 1176821 - RNA, 19 nt, Mycobacterium bovis subsp bovis AF2122/97
gcgcaccaucgcggccgcu

SEQ ID NO: 1176822 - RNA, 17 nt, Mycobacterium bovis subsp bovis AF2122/97
gcgcacccagcccagcc

SEQ ID NO: 1176823 - RNA, 16 nt, Mycobacterium bovis subsp bovis AF2122/97
gcgcacccagcccagc

SEQ ID NO: 1176824 - RNA, 15 nt, Mycobacterium bovis subsp bovis AF2122/97
gcgcaccacaccacg

SEQ ID NO: 1176825 - RNA, 12 nt, Mycobacterium bovis subsp bovis AF2122/97
gcgcaccagcac

SEQ ID NO: 1176826 - RNA, 17 nt, Mycobacterium bovis subsp bovis AF2122/97
gcgcacagugucucaca

SEQ ID NO: 1176827 - RNA, 21 nt, Mycobacterium bovis subsp bovis AF2122/97
gcgcacaugguuuucaguagg

SEQ ID NO: 1176828 - RNA, 21 nt, Mycobacterium bovis subsp bovis AF2122/97
gcgcaccaccgccccgcgccc

SEQ ID NO: 1176829 - RNA, 13 nt, Mycobacterium bovis subsp bovis AF2122/97
gcgcaccagcggc

SEQ ID NO: 1176830 - RNA, 15 nt, Mycobacterium bovis subsp bovis AF2122/97
gcgcacagcgagcac

SEQ ID NO: 1176831 - RNA, 13 nt, Mycobacterium bovis subsp bovis AF2122/97
gcgcacagcgagc

SEQ ID NO: 1176832 - RNA, 16 nt, Mycobacterium bovis subsp bovis AF2122/97
gcgcacacccugcagc

SEQ ID NO: 1176833 - RNA, 20 nt, Mycobacterium bovis subsp bovis AF2122/97
gcgcacaaacauacgccacc

SEQ ID NO: 1176834 - RNA, 14 nt, Mycobacterium bovis subsp bovis AF2122/97
gcgcaggucgccuu

SEQ ID NO: 1176835 - RNA, 21 nt, Mycobacterium bovis subsp bovis AF2122/97
gcgcagguuggcaagcacggc

SEQ ID NO: 1176836 - RNA, 22 nt, Mycobacterium bovis subsp bovis AF2122/97
gcgcaguacuugaccguccacc

SEQ ID NO: 1176837 - RNA, 16 nt, Mycobacterium bovis subsp bovis AF2122/97
gcgcaggggcggcgug

SEQ ID NO: 1176838 - RNA, 16 nt, Mycobacterium bovis subsp bovis AF2122/97
gcgcagggccuggaag

SEQ ID NO: 1176839 - RNA, 14 nt, Mycobacterium bovis subsp bovis AF2122/97
gcgcagggcgacau

SEQ ID NO: 1176840 - RNA, 12 nt, Mycobacterium bovis subsp bovis AF2122/97
gcgcagcgcggc

SEQ ID NO: 1176841 - RNA, 13 nt, Mycobacterium bovis subsp bovis AF2122/97
gcgcagccaggga

SEQ ID NO: 1176842 - RNA, 14 nt, Mycobacterium bovis subsp bovis AF2122/97
gcgcagccugcagc

SEQ ID NO: 1176843 - RNA, 17 nt, Mycobacterium bovis subsp bovis AF2122/97
gcgcagcgccgccaccc

SEQ ID NO: 1176844 - RNA, 18 nt, Mycobacterium bovis subsp bovis AF2122/97
gcgcagcuacuaccugcc

SEQ ID NO: 1176845 - RNA, 22 nt, Mycobacterium bovis subsp bovis AF2122/97
gcgcagcuagcccucagcuagc

SEQ ID NO: 1176846 - RNA, 20 nt, Mycobacterium bovis subsp bovis AF2122/97
gcgcagcugacgucaccacg

SEQ ID NO: 1176847 - RNA, 18 nt, Mycobacterium bovis subsp bovis AF2122/97
gcgcagcugccgcacccc

SEQ ID NO: 1176848 - RNA, 14 nt, Mycobacterium bovis subsp bovis AF2122/97
gcgcagcugggugc

SEQ ID NO: 1176849 - RNA, 17 nt, Mycobacterium bovis subsp bovis AF2122/97
gcgcagcugggugcgcc

SEQ ID NO: 1176850 - RNA, 17 nt, Mycobacterium bovis subsp bovis AF2122/97
gcgcagcuuggccagcc

SEQ ID NO: 1176851 - RNA, 22 nt, Mycobacterium bovis subsp bovis AF2122/97
gcgcaggauguucaaucccucc

SEQ ID NO: 1176852 - RNA, 19 nt, Mycobacterium bovis subsp bovis AF2122/97
gcgcacggaccaucgccag

SEQ ID NO: 1176853 - RNA, 13 nt, Mycobacterium bovis subsp bovis AF2122/97
gcgcacggcggcc

SEQ ID NO: 1176854 - RNA, 13 nt, Mycobacterium bovis subsp bovis AF2122/97
gcgcacggcuggc

SEQ ID NO: 1176855 - RNA, 22 nt, Mycobacterium bovis subsp bovis AF2122/97
gcgcacucccggcucggccagc

SEQ ID NO: 1176856 - RNA, 16 nt, Mycobacterium bovis subsp bovis AF2122/97
gcgcagaacaccaccg

SEQ ID NO: 1176857 - RNA, 15 nt, Mycobacterium bovis subsp bovis AF2122/97
gcgcaccuggcgcgc

SEQ ID NO: 1176858 - RNA, 17 nt, Mycobacterium bovis subsp bovis AF2122/97
gcgcaccugggcugccg

SEQ ID NO: 1176859 - RNA, 19 nt, Mycobacterium bovis subsp bovis AF2122/97
gcgcaccugggcugccggc

SEQ ID NO: 1176860 - RNA, 16 nt, Mycobacterium bovis subsp bovis AF2122/97
gcgcaccggcgucggc

SEQ ID NO: 1176861 - RNA, 20 nt, Mycobacterium bovis subsp bovis AF2122/97
gcgcaccggcguucaccugc

SEQ ID NO: 1176862 - RNA, 20 nt, Mycobacterium bovis subsp bovis AF2122/97
gcgcaccggcuggcccagcg

SEQ ID NO: 1176863 - RNA, 19 nt, Mycobacterium bovis subsp bovis AF2122/97
gcgcaccuccugcgagugc

SEQ ID NO: 1176864 - RNA, 21 nt, Mycobacterium bovis subsp bovis AF2122/97
gcgcaccggguugagccgccg

SEQ ID NO: 1176865 - RNA, 12 nt, Mycobacterium bovis subsp bovis AF2122/97
gcgcaccggagu

SEQ ID NO: 1176866 - RNA, 23 nt, Mycobacterium bovis subsp bovis AF2122/97
gcgcacgcucaguuuggccuggu

SEQ ID NO: 1176867 - RNA, 14 nt, Mycobacterium bovis subsp bovis AF2122/97
gcgcaccugaaggc

SEQ ID NO: 1176868 - RNA, 13 nt, Mycobacterium bovis subsp bovis AF2122/97
gcgcagcagcggc

SEQ ID NO: 1176869 - RNA, 18 nt, Mycobacterium bovis subsp bovis AF2122/97
gcgcagcaucuccgccgg

SEQ ID NO: 1176870 - RNA, 22 nt, Mycobacterium bovis subsp bovis AF2122/97
gcgcagcaguuggucgcggucc

SEQ ID NO: 1176871 - RNA, 14 nt, Mycobacterium bovis subsp bovis AF2122/97
gcgcagccaggcug

SEQ ID NO: 1176872 - RNA, 20 nt, Mycobacterium bovis subsp bovis AF2122/97
gcgcagcauggugcggcggc

SEQ ID NO: 1176873 - RNA, 21 nt, Mycobacterium bovis subsp bovis AF2122/97
gcgcagcauggugcggcggcg

SEQ ID NO: 1176874 - RNA, 12 nt, Mycobacterium bovis subsp bovis AF2122/97
gcgcagccgccg

SEQ ID NO: 1176875 - RNA, 17 nt, Mycobacterium bovis subsp bovis AF2122/97
gcgcagccgccgcgccc

SEQ ID NO: 1176876 - RNA, 16 nt, Mycobacterium bovis subsp bovis AF2122/97
gcgcagccgcucgacg

SEQ ID NO: 1176877 - RNA, 19 nt, Mycobacterium bovis subsp bovis AF2122/97
gcgcagccgcucgacggcc

SEQ ID NO: 1176878 - RNA, 23 nt, Mycobacterium bovis subsp bovis AF2122/97
gcgcagcacauccugcagcucgg

SEQ ID NO: 1176879 - RNA, 18 nt, Mycobacterium bovis subsp bovis AF2122/97
gcgcagcacugcggcagc

SEQ ID NO: 1176880 - RNA, 19 nt, Mycobacterium bovis subsp bovis AF2122/97
gcgcagcacauccugcagc

SEQ ID NO: 1176881 - RNA, 21 nt, Mycobacterium bovis subsp bovis AF2122/97
gcgcagcaacugggcggccug

SEQ ID NO: 1176882 - RNA, 19 nt, Mycobacterium bovis subsp bovis AF2122/97
gcgcagauuugcuccagcg

SEQ ID NO: 1176883 - RNA, 19 nt, Mycobacterium bovis subsp bovis AF2122/97
gcgcagaucguccaccgcc

SEQ ID NO: 1176884 - RNA, 14 nt, Mycobacterium bovis subsp bovis AF2122/97
gcgcagacucgcca

SEQ ID NO: 1176885 - RNA, 22 nt, Mycobacterium bovis subsp bovis AF2122/97
gcgcagacucgccaccgcggcg

SEQ ID NO: 1176886 - RNA, 13 nt, Mycobacterium bovis subsp bovis AF2122/97
gcgccacggcagc

SEQ ID NO: 1176887 - RNA, 14 nt, Mycobacterium bovis subsp bovis AF2122/97
gcgccacggcguga

SEQ ID NO: 1176888 - RNA, 21 nt, Mycobacterium bovis subsp bovis AF2122/97
gcgccacgucgacggucuggc

SEQ ID NO: 1176889 - RNA, 18 nt, Mycobacterium bovis subsp bovis AF2122/97
gcgccacuagcccugagc

SEQ ID NO: 1176890 - RNA, 12 nt, Mycobacterium bovis subsp bovis AF2122/97
gcgccacucaag

SEQ ID NO: 1176891 - RNA, 20 nt, Mycobacterium bovis subsp bovis AF2122/97
gcgccagaucaccgucgaca

SEQ ID NO: 1176892 - RNA, 19 nt, Mycobacterium bovis subsp bovis AF2122/97
gcgccacauacaccggccg

SEQ ID NO: 1176893 - RNA, 16 nt, Mycobacterium bovis subsp bovis AF2122/97
gcgccacccgcgccgc

SEQ ID NO: 1176894 - RNA, 21 nt, Mycobacterium bovis subsp bovis AF2122/97
gcgccaccagucacgcccacc

SEQ ID NO: 1176895 - RNA, 15 nt, Mycobacterium bovis subsp bovis AF2122/97
gcgccaccggcaccg

SEQ ID NO: 1176896 - RNA, 15 nt, Mycobacterium bovis subsp bovis AF2122/97
gcgccaccggcgccg

SEQ ID NO: 1176897 - RNA, 21 nt, Mycobacterium bovis subsp bovis AF2122/97
gcgccacccgguccggcccgg

SEQ ID NO: 1176898 - RNA, 19 nt, Mycobacterium bovis subsp bovis AF2122/97
gcgccaccguuaccgccgu

SEQ ID NO: 1176899 - RNA, 18 nt, Mycobacterium bovis subsp bovis AF2122/97
gcgccaccggcgccgccc

SEQ ID NO: 1176900 - RNA, 19 nt, Mycobacterium bovis subsp bovis AF2122/97
gcgccaccgugguggacga

SEQ ID NO: 1176901 - RNA, 16 nt, Mycobacterium bovis subsp bovis AF2122/97
gcgccagcagccaccc

SEQ ID NO: 1176902 - RNA, 20 nt, Mycobacterium bovis subsp bovis AF2122/97
gcgccagcgauaucggcggc

SEQ ID NO: 1176903 - RNA, 13 nt, Mycobacterium bovis subsp bovis AF2122/97
gcgccagccgacc

SEQ ID NO: 1176904 - RNA, 15 nt, Mycobacterium bovis subsp bovis AF2122/97
gcgccagcgccgcca

SEQ ID NO: 1176905 - RNA, 13 nt, Mycobacterium bovis subsp bovis AF2122/97
gcgccagcgggcu

SEQ ID NO: 1176906 - RNA, 17 nt, Mycobacterium bovis subsp bovis AF2122/97
gcgccaauucagcggca

SEQ ID NO: 1176907 - RNA, 21 nt, Mycobacterium bovis subsp bovis AF2122/97
gcgccaaacccggcgggcccg

SEQ ID NO: 1176908 - RNA, 13 nt, Mycobacterium bovis subsp bovis AF2122/97
gcgccaacaaccc

SEQ ID NO: 1176909 - RNA, 12 nt, Mycobacterium bovis subsp bovis AF2122/97
gcgccaacaccu

SEQ ID NO: 1176910 - RNA, 14 nt, Mycobacterium bovis subsp bovis AF2122/97
gcgccaaaaaggau

SEQ ID NO: 1176911 - RNA, 22 nt, Mycobacterium bovis subsp bovis AF2122/97
gcgccaaaaaggaucccgccgc

SEQ ID NO: 1176912 - RNA, 18 nt, Mycobacterium bovis subsp bovis AF2122/97
gcgccaaaauccgcccac

SEQ ID NO: 1176913 - RNA, 22 nt, Mycobacterium bovis subsp bovis AF2122/97
gcgccaaacaccccggccuugc

SEQ ID NO: 1176914 - RNA, 18 nt, Mycobacterium bovis subsp bovis AF2122/97
gcgcauuucguggcgcgc

SEQ ID NO: 1176915 - RNA, 20 nt, Mycobacterium bovis subsp bovis AF2122/97
gcgcauugccgacgcgcggc

SEQ ID NO: 1176916 - RNA, 14 nt, Mycobacterium bovis subsp bovis AF2122/97
gcgcaucgcgccuu

SEQ ID NO: 1176917 - RNA, 21 nt, Mycobacterium bovis subsp bovis AF2122/97
gcgcaucgccgcuggccagca

SEQ ID NO: 1176918 - RNA, 22 nt, Mycobacterium bovis subsp bovis AF2122/97
gcgcaucgcacgggccaccagc

SEQ ID NO: 1176919 - RNA, 12 nt, Mycobacterium bovis subsp bovis AF2122/97
gcgcaucgccaa

SEQ ID NO: 1176920 - RNA, 16 nt, Mycobacterium bovis subsp bovis AF2122/97
gcgcauauccgcaggc

SEQ ID NO: 1176921 - RNA, 16 nt, Mycobacterium bovis subsp bovis AF2122/97
gcgcaguuuggcggcg

SEQ ID NO: 1176922 - RNA, 20 nt, Mycobacterium bovis subsp bovis AF2122/97
gcgcaguuggcaccagccgg

SEQ ID NO: 1176923 - RNA, 16 nt, Mycobacterium bovis subsp bovis AF2122/97
gcgcaguuggccaugc

SEQ ID NO: 1176924 - RNA, 14 nt, Mycobacterium bovis subsp bovis AF2122/97
gcgcauauccgcag

SEQ ID NO: 1176925 - RNA, 20 nt, Mycobacterium bovis subsp bovis AF2122/97
gcgcucggccauagcgccgc

SEQ ID NO: 1176926 - RNA, 16 nt, Mycobacterium bovis subsp bovis AF2122/97
gcgcucggccagcauc

SEQ ID NO: 1176927 - RNA, 16 nt, Mycobacterium bovis subsp bovis AF2122/97
gcgcucggcagccggc

SEQ ID NO: 1176928 - RNA, 15 nt, Mycobacterium bovis subsp bovis AF2122/97
gcgcucgggcugccg

SEQ ID NO: 1176929 - RNA, 19 nt, Mycobacterium bovis subsp bovis AF2122/97
gcgcucggugccgcccagg

SEQ ID NO: 1176930 - RNA, 18 nt, Mycobacterium bovis subsp bovis AF2122/97
gcgcucguagaaucggcu

SEQ ID NO: 1176931 - RNA, 18 nt, Mycobacterium bovis subsp bovis AF2122/97
gcgcucucauagcgacgg

SEQ ID NO: 1176932 - RNA, 14 nt, Mycobacterium bovis subsp bovis AF2122/97
gcgcugaucggcag

SEQ ID NO: 1176933 - RNA, 15 nt, Mycobacterium bovis subsp bovis AF2122/97
gcgcucgcccgcggc

SEQ ID NO: 1176934 - RNA, 13 nt, Mycobacterium bovis subsp bovis AF2122/97
gcgcucgcgcgcu

SEQ ID NO: 1176935 - RNA, 19 nt, Mycobacterium bovis subsp bovis AF2122/97
gcgcucgaaagagccgcuu

SEQ ID NO: 1176936 - RNA, 15 nt, Mycobacterium bovis subsp bovis AF2122/97
gcgcucgacgagcac

SEQ ID NO: 1176937 - RNA, 22 nt, Mycobacterium bovis subsp bovis AF2122/97
gcgcucgaaggccgcacucaca

SEQ ID NO: 1176938 - RNA, 21 nt, Mycobacterium bovis subsp bovis AF2122/97
gcgcucgauggcggccaccag

SEQ ID NO: 1176939 - RNA, 19 nt, Mycobacterium bovis subsp bovis AF2122/97
gcgcucgcacccgcucggc

SEQ ID NO: 1176940 - RNA, 21 nt, Mycobacterium bovis subsp bovis AF2122/97
gcgcuggcaggcuuagcuucc

SEQ ID NO: 1176941 - RNA, 23 nt, Mycobacterium bovis subsp bovis AF2122/97
gcgcuggaggcuccuggucgccg

SEQ ID NO: 1176942 - RNA, 17 nt, Mycobacterium bovis subsp bovis AF2122/97
gcgcuggaggccaccac

SEQ ID NO: 1176943 - RNA, 18 nt, Mycobacterium bovis subsp bovis AF2122/97
gcgcugcucugagcuugg

SEQ ID NO: 1176944 - RNA, 21 nt, Mycobacterium bovis subsp bovis AF2122/97
gcgcugcggaucguggcgccc

SEQ ID NO: 1176945 - RNA, 22 nt, Mycobacterium bovis subsp bovis AF2122/97
gcgcugcucccgaaaagcgccu

SEQ ID NO: 1176946 - RNA, 17 nt, Mycobacterium bovis subsp bovis AF2122/97
gcgcugcucacgcagca

SEQ ID NO: 1176947 - RNA, 19 nt, Mycobacterium bovis subsp bovis AF2122/97
gcgcugcucacgcagcagu

SEQ ID NO: 1176948 - RNA, 20 nt, Mycobacterium bovis subsp bovis AF2122/97
gcgcugcggcgugccgggug

SEQ ID NO: 1176949 - RNA, 16 nt, Mycobacterium bovis subsp bovis AF2122/97
gcgcugcggcccacac

SEQ ID NO: 1176950 - RNA, 21 nt, Mycobacterium bovis subsp bovis AF2122/97
gcgcugcggcccacaccagcg

SEQ ID NO: 1176951 - RNA, 13 nt, Mycobacterium bovis subsp bovis AF2122/97
gcgcugccggccg

SEQ ID NO: 1176952 - RNA, 23 nt, Mycobacterium bovis subsp bovis AF2122/97
gcgcugccgacuccucguccugg

SEQ ID NO: 1176953 - RNA, 14 nt, Mycobacterium bovis subsp bovis AF2122/97
gcgcugcccacgga

SEQ ID NO: 1176954 - RNA, 15 nt, Mycobacterium bovis subsp bovis AF2122/97
gcgcugcgcaccgcc

SEQ ID NO: 1176955 - RNA, 15 nt, Mycobacterium bovis subsp bovis AF2122/97
gcgcugcaccggguc

SEQ ID NO: 1176956 - RNA, 19 nt, Mycobacterium bovis subsp bovis AF2122/97
gcgcugccaccgcgguggc

SEQ ID NO: 1176957 - RNA, 14 nt, Mycobacterium bovis subsp bovis AF2122/97
gcgcugggcgcgcu

SEQ ID NO: 1176958 - RNA, 17 nt, Mycobacterium bovis subsp bovis AF2122/97
gcgcugggcgcgcucau

SEQ ID NO: 1176959 - RNA, 21 nt, Mycobacterium bovis subsp bovis AF2122/97
gcgcugggcccaggagaucca

SEQ ID NO: 1176960 - RNA, 22 nt, Mycobacterium bovis subsp bovis AF2122/97
gcgcugggcccgagcgcgcgcu

SEQ ID NO: 1176961 - RNA, 22 nt, Mycobacterium bovis subsp bovis AF2122/97
gcgcugggucgugucgccacac

SEQ ID NO: 1176962 - RNA, 19 nt, Mycobacterium bovis subsp bovis AF2122/97
gcgcuggucagccgugccg

SEQ ID NO: 1176963 - RNA, 21 nt, Mycobacterium bovis subsp bovis AF2122/97
gcgcugggacggucgcucggc

SEQ ID NO: 1176964 - RNA, 14 nt, Mycobacterium bovis subsp bovis AF2122/97
gcgcuggcgggcgg

SEQ ID NO: 1176965 - RNA, 16 nt, Mycobacterium bovis subsp bovis AF2122/97
gcgcuggcggcgcagc

SEQ ID NO: 1176966 - RNA, 16 nt, Mycobacterium bovis subsp bovis AF2122/97
gcgcuggccauggugg

SEQ ID NO: 1176967 - RNA, 21 nt, Mycobacterium bovis subsp bovis AF2122/97
gcggaagcgguugacccacag

SEQ ID NO: 1176968 - RNA, 22 nt, Mycobacterium bovis subsp bovis AF2122/97
gcggaagcgguugacccacagc

SEQ ID NO: 1176969 - RNA, 15 nt, Mycobacterium bovis subsp bovis AF2122/97
gcggaacgccgagca

SEQ ID NO: 1176970 - RNA, 24 nt, Mycobacterium bovis subsp bovis AF2122/97
gcggaacaagguauggccggagcg

SEQ ID NO: 1176971 - RNA, 12 nt, Mycobacterium bovis subsp bovis AF2122/97
gcggaacaccgc

SEQ ID NO: 1176972 - RNA, 19 nt, Mycobacterium bovis subsp bovis AF2122/97
gcggaacacgaugcgcggu

SEQ ID NO: 1176973 - RNA, 23 nt, Mycobacterium bovis subsp bovis AF2122/97
gcgcuucacagccaccagccggg

SEQ ID NO: 1176974 - RNA, 14 nt, Mycobacterium bovis subsp bovis AF2122/97
gcggaaacaacccc

SEQ ID NO: 1176975 - RNA, 15 nt, Mycobacterium bovis subsp bovis AF2122/97
gcggauuggccuugu

SEQ ID NO: 1176976 - RNA, 17 nt, Mycobacterium bovis subsp bovis AF2122/97
gcggauuucucgcccug

SEQ ID NO: 1176977 - RNA, 16 nt, Mycobacterium bovis subsp bovis AF2122/97
gcggcaaagccgggug

SEQ ID NO: 1176978 - RNA, 15 nt, Mycobacterium bovis subsp bovis AF2122/97
gcggcaaccgccgcc

SEQ ID NO: 1176979 - RNA, 14 nt, Mycobacterium bovis subsp bovis AF2122/97
gcggcacccaacca

SEQ ID NO: 1176980 - RNA, 20 nt, Mycobacterium bovis subsp bovis AF2122/97
gcggcaccgcuucaggcgcc

SEQ ID NO: 1176981 - RNA, 19 nt, Mycobacterium bovis subsp bovis AF2122/97
gcggcaccuuguagcgggc

SEQ ID NO: 1176982 - RNA, 22 nt, Mycobacterium bovis subsp bovis AF2122/97
gcggcacccaaccaggccgcga

SEQ ID NO: 1176983 - RNA, 14 nt, Mycobacterium bovis subsp bovis AF2122/97
gcggcagcgcggcc

SEQ ID NO: 1176984 - RNA, 15 nt, Mycobacterium bovis subsp bovis AF2122/97
gcggcagcggugcug

SEQ ID NO: 1176985 - RNA, 22 nt, Mycobacterium bovis subsp bovis AF2122/97
gcggcacgcugaccggaucuga

SEQ ID NO: 1176986 - RNA, 16 nt, Mycobacterium bovis subsp bovis AF2122/97
gcggcacucccugggg

SEQ ID NO: 1176987 - RNA, 20 nt, Mycobacterium bovis subsp bovis AF2122/97
gcggcacgggcggccauggc

SEQ ID NO: 1176988 - RNA, 15 nt, Mycobacterium bovis subsp bovis AF2122/97
gcggcacgcccacag

SEQ ID NO: 1176989 - RNA, 16 nt, Mycobacterium bovis subsp bovis AF2122/97
gcggcacgcccacagc

SEQ ID NO: 1176990 - RNA, 21 nt, Mycobacterium bovis subsp bovis AF2122/97
gcggcagcgguuuuaggcagc

SEQ ID NO: 1176991 - RNA, 22 nt, Mycobacterium bovis subsp bovis AF2122/97
gcggaaguagcgcaaugcggcc

SEQ ID NO: 1176992 - RNA, 13 nt, Mycobacterium bovis subsp bovis AF2122/97
gcggaagggggca

SEQ ID NO: 1176993 - RNA, 23 nt, Mycobacterium bovis subsp bovis AF2122/97
gcggaauaugggugugcuccagc

SEQ ID NO: 1176994 - RNA, 19 nt, Mycobacterium bovis subsp bovis AF2122/97
gcggacccgucggcguggc

SEQ ID NO: 1176995 - RNA, 21 nt, Mycobacterium bovis subsp bovis AF2122/97
gcggaccgaugacgaucggcg

SEQ ID NO: 1176996 - RNA, 15 nt, Mycobacterium bovis subsp bovis AF2122/97
gcggaccggcgcgcu

SEQ ID NO: 1176997 - RNA, 16 nt, Mycobacterium bovis subsp bovis AF2122/97
gcggaccggcgcgcuc

SEQ ID NO: 1176998 - RNA, 21 nt, Mycobacterium bovis subsp bovis AF2122/97
gcggacgaacccguuuugggu

SEQ ID NO: 1176999 - RNA, 16 nt, Mycobacterium bovis subsp bovis AF2122/97
gcggaccuggcggcgg

SEQ ID NO: 1177000 - RNA, 17 nt, Mycobacterium bovis subsp bovis AF2122/97
gcggaccuggcggcggu

SEQ ID NO: 1177001 - RNA, 17 nt, Mycobacterium bovis subsp bovis AF2122/97
gcggaccugcgccggug

SEQ ID NO: 1177002 - RNA, 17 nt, Mycobacterium bovis subsp bovis AF2122/97
gcggaucccgaggcgcc

SEQ ID NO: 1177003 - RNA, 19 nt, Mycobacterium bovis subsp bovis AF2122/97
gcggaucgcgcugaucagc

SEQ ID NO: 1177004 - RNA, 18 nt, Mycobacterium bovis subsp bovis AF2122/97
gcggaucggcggccggca

SEQ ID NO: 1177005 - RNA, 21 nt, Mycobacterium bovis subsp bovis AF2122/97
gcggaucggcggaccgcagcg

SEQ ID NO: 1177006 - RNA, 15 nt, Mycobacterium bovis subsp bovis AF2122/97
gcggaucggcggccg

SEQ ID NO: 1177007 - RNA, 23 nt, Mycobacterium bovis subsp bovis AF2122/97
gcggaucggcggccgcgaccagc

SEQ ID NO: 1177008 - RNA, 22 nt, Mycobacterium bovis subsp bovis AF2122/97
gcggaucucaucgggccacagc

SEQ ID NO: 1177009 - RNA, 23 nt, Mycobacterium bovis subsp bovis AF2122/97
gcggaucucaucgggccacagca

SEQ ID NO: 1177010 - RNA, 12 nt, Mycobacterium bovis subsp bovis AF2122/97
gcggaucugguc

SEQ ID NO: 1177011 - RNA, 11 nt, Mycobacterium bovis subsp bovis AF2122/97
gcggauucggc

SEQ ID NO: 1177012 - RNA, 12 nt, Mycobacterium bovis subsp bovis AF2122/97
gcggaucugggc

SEQ ID NO: 1177013 - RNA, 16 nt, Mycobacterium bovis subsp bovis AF2122/97
gcggaucugggcggcc

SEQ ID NO: 1177014 - RNA, 22 nt, Mycobacterium bovis subsp bovis AF2122/97
gcggcccgauagaucgcgugga

SEQ ID NO: 1177015 - RNA, 18 nt, Mycobacterium bovis subsp bovis AF2122/97
gcggcccgaggcucgggc

SEQ ID NO: 1177016 - RNA, 13 nt, Mycobacterium bovis subsp bovis AF2122/97
gcggccccgccgu

SEQ ID NO: 1177017 - RNA, 16 nt, Mycobacterium bovis subsp bovis AF2122/97
gcggccccgcgccacc

SEQ ID NO: 1177018 - RNA, 21 nt, Mycobacterium bovis subsp bovis AF2122/97
gcggccccgacacagcggcgg

SEQ ID NO: 1177019 - RNA, 18 nt, Mycobacterium bovis subsp bovis AF2122/97
gcggcccgcgaauacgag

SEQ ID NO: 1177020 - RNA, 22 nt, Mycobacterium bovis subsp bovis AF2122/97
gcggcccgcagcccgccgggcu

SEQ ID NO: 1177021 - RNA, 14 nt, Mycobacterium bovis subsp bovis AF2122/97
gcggcccgcagccc

SEQ ID NO: 1177022 - RNA, 22 nt, Mycobacterium bovis subsp bovis AF2122/97
gcggcccgcuccacggucaggc

SEQ ID NO: 1177023 - RNA, 18 nt, Mycobacterium bovis subsp bovis AF2122/97
gcggcccgggaacccgcu

SEQ ID NO: 1177024 - RNA, 17 nt, Mycobacterium bovis subsp bovis AF2122/97
gcggcccgucaccgcgg

SEQ ID NO: 1177025 - RNA, 18 nt, Mycobacterium bovis subsp bovis AF2122/97
gcggcccggguuggccga

SEQ ID NO: 1177026 - RNA, 19 nt, Mycobacterium bovis subsp bovis AF2122/97
gcggcccuaaacaccgcga

SEQ ID NO: 1177027 - RNA, 21 nt, Mycobacterium bovis subsp bovis AF2122/97
gcggccaccgccgccgccacc

SEQ ID NO: 1177028 - RNA, 12 nt, Mycobacterium bovis subsp bovis AF2122/97
gcggccagcagc

SEQ ID NO: 1177029 - RNA, 14 nt, Mycobacterium bovis subsp bovis AF2122/97
gcggccagcaccgg

SEQ ID NO: 1177030 - RNA, 21 nt, Mycobacterium bovis subsp bovis AF2122/97
gcggccacuuggaugcgaccc

SEQ ID NO: 1177031 - RNA, 14 nt, Mycobacterium bovis subsp bovis AF2122/97
gcggccacgguggc

SEQ ID NO: 1177032 - RNA, 14 nt, Mycobacterium bovis subsp bovis AF2122/97
gcggcccacgcgca

SEQ ID NO: 1177033 - RNA, 20 nt, Mycobacterium bovis subsp bovis AF2122/97
gcggccccaggggcaccagc

SEQ ID NO: 1177034 - RNA, 20 nt, Mycobacterium bovis subsp bovis AF2122/97
gcggcccacaccagcgcagc

SEQ ID NO: 1177035 - RNA, 14 nt, Mycobacterium bovis subsp bovis AF2122/97
gcggccagcccacu

SEQ ID NO: 1177036 - RNA, 20 nt, Mycobacterium bovis subsp bovis AF2122/97
gcggccagcaucgcgguggu

SEQ ID NO: 1177037 - RNA, 14 nt, Mycobacterium bovis subsp bovis AF2122/97
gcggcaucgcgggc

SEQ ID NO: 1177038 - RNA, 15 nt, Mycobacterium bovis subsp bovis AF2122/97
gcggcaucgcgggcg

SEQ ID NO: 1177039 - RNA, 16 nt, Mycobacterium bovis subsp bovis AF2122/97
gcggcaucgcgggcgg

SEQ ID NO: 1177040 - RNA, 22 nt, Mycobacterium bovis subsp bovis AF2122/97
gcggcaucgaauuccagccagc

SEQ ID NO: 1177041 - RNA, 18 nt, Mycobacterium bovis subsp bovis AF2122/97
gcggcaugcagaucucac

SEQ ID NO: 1177042 - RNA, 21 nt, Mycobacterium bovis subsp bovis AF2122/97
gcggcaugcaaugcuggcggc

SEQ ID NO: 1177043 - RNA, 22 nt, Mycobacterium bovis subsp bovis AF2122/97
gcggcaucggcggcaagggugg

SEQ ID NO: 1177044 - RNA, 17 nt, Mycobacterium bovis subsp bovis AF2122/97
gcggcaucgcgggcggc

SEQ ID NO: 1177045 - RNA, 12 nt, Mycobacterium bovis subsp bovis AF2122/97
gcggccaccagc

SEQ ID NO: 1177046 - RNA, 15 nt, Mycobacterium bovis subsp bovis AF2122/97
gcggccaccagcgcc

SEQ ID NO: 1177047 - RNA, 21 nt, Mycobacterium bovis subsp bovis AF2122/97
gcggccaccacaacgccagga

SEQ ID NO: 1177048 - RNA, 21 nt, Mycobacterium bovis subsp bovis AF2122/97
gcggccacaucgccagcagca

SEQ ID NO: 1177049 - RNA, 15 nt, Mycobacterium bovis subsp bovis AF2122/97
gcggccaccaccgcc

SEQ ID NO: 1177050 - RNA, 21 nt, Mycobacterium bovis subsp bovis AF2122/97
gcggccaaucagcccgccgga

SEQ ID NO: 1177051 - RNA, 24 nt, Mycobacterium bovis subsp bovis AF2122/97
gcggccaacggcuccgggcgcucg

SEQ ID NO: 1177052 - RNA, 13 nt, Mycobacterium bovis subsp bovis AF2122/97
gcggccaaggucg

SEQ ID NO: 1177053 - RNA, 22 nt, Mycobacterium bovis subsp bovis AF2122/97
gcggccacaaugcggccguucg

SEQ ID NO: 1177054 - RNA, 24 nt, Mycobacterium bovis subsp bovis AF2122/97
gcggccaauggugggcgagcugcu

SEQ ID NO: 1177055 - RNA, 17 nt, Mycobacterium bovis subsp bovis AF2122/97
gcggccaauggccgcgg

SEQ ID NO: 1177056 - RNA, 18 nt, Mycobacterium bovis subsp bovis AF2122/97
gcggccaauggccgcggc

SEQ ID NO: 1177057 - RNA, 20 nt, Mycobacterium bovis subsp bovis AF2122/97
gcggcauuaccaacgcggug

SEQ ID NO: 1177058 - RNA, 17 nt, Mycobacterium bovis subsp bovis AF2122/97
gcggcauucucgagcac

SEQ ID NO: 1177059 - RNA, 15 nt, Mycobacterium bovis subsp bovis AF2122/97
gcggcauugccagcc

SEQ ID NO: 1177060 - RNA, 15 nt, Mycobacterium bovis subsp bovis AF2122/97
gcggcauuggcggug

SEQ ID NO: 1177061 - RNA, 22 nt, Mycobacterium bovis subsp bovis AF2122/97
gcgggacagauggcggccgagg

SEQ ID NO: 1177062 - RNA, 21 nt, Mycobacterium bovis subsp bovis AF2122/97
gcgggacaccaccgcccgcac

SEQ ID NO: 1177063 - RNA, 18 nt, Mycobacterium bovis subsp bovis AF2122/97
gcgggacaaaaucagcag

SEQ ID NO: 1177064 - RNA, 23 nt, Mycobacterium bovis subsp bovis AF2122/97
gcgggaagucccgaguggccggu

SEQ ID NO: 1177065 - RNA, 19 nt, Mycobacterium bovis subsp bovis AF2122/97
gcgggaaggguggaccggg

SEQ ID NO: 1177066 - RNA, 21 nt, Mycobacterium bovis subsp bovis AF2122/97
gcgggagguacccccagcacc

SEQ ID NO: 1177067 - RNA, 15 nt, Mycobacterium bovis subsp bovis AF2122/97
gcgggcaugccggcg

SEQ ID NO: 1177068 - RNA, 21 nt, Mycobacterium bovis subsp bovis AF2122/97
gcgggaccuucgagccgcaca

SEQ ID NO: 1177069 - RNA, 23 nt, Mycobacterium bovis subsp bovis AF2122/97
gcgggacgccgaauacggcugcc

SEQ ID NO: 1177070 - RNA, 12 nt, Mycobacterium bovis subsp bovis AF2122/97
gcgggcccgcgc

SEQ ID NO: 1177071 - RNA, 23 nt, Mycobacterium bovis subsp bovis AF2122/97
gcgggccccaucgccuggaugcc

SEQ ID NO: 1177072 - RNA, 18 nt, Mycobacterium bovis subsp bovis AF2122/97
gcgggcccgcaggucggc

SEQ ID NO: 1177073 - RNA, 13 nt, Mycobacterium bovis subsp bovis AF2122/97
gcgggcccgccgg

SEQ ID NO: 1177074 - RNA, 14 nt, Mycobacterium bovis subsp bovis AF2122/97
gcgggcccgccggc

SEQ ID NO: 1177075 - RNA, 19 nt, Mycobacterium bovis subsp bovis AF2122/97
gcgggcccgccggccccgc

SEQ ID NO: 1177076 - RNA, 19 nt, Mycobacterium bovis subsp bovis AF2122/97
gcgggcgaccaccgcggca

SEQ ID NO: 1177077 - RNA, 22 nt, Mycobacterium bovis subsp bovis AF2122/97
gcgggcgacccguucucgguga

SEQ ID NO: 1177078 - RNA, 16 nt, Mycobacterium bovis subsp bovis AF2122/97
gcgggcgaugcgggcc

SEQ ID NO: 1177079 - RNA, 21 nt, Mycobacterium bovis subsp bovis AF2122/97
gcgggcgagaacccacgcaug

SEQ ID NO: 1177080 - RNA, 15 nt, Mycobacterium bovis subsp bovis AF2122/97
gcgggcgaucggcau

SEQ ID NO: 1177081 - RNA, 21 nt, Mycobacterium bovis subsp bovis AF2122/97
gcgggaacgaugccgccggcg

SEQ ID NO: 1177082 - RNA, 19 nt, Mycobacterium bovis subsp bovis AF2122/97
gcgggaaaacgggguggca

SEQ ID NO: 1177083 - RNA, 18 nt, Mycobacterium bovis subsp bovis AF2122/97
gcgggaaacccaugcaug

SEQ ID NO: 1177084 - RNA, 19 nt, Mycobacterium bovis subsp bovis AF2122/97
gcggcuuggaucucaucca

SEQ ID NO: 1177085 - RNA, 22 nt, Mycobacterium bovis subsp bovis AF2122/97
gcggcugcuuggucgcccagcc

SEQ ID NO: 1177086 - RNA, 20 nt, Mycobacterium bovis subsp bovis AF2122/97
gcggcuggcccgcaugccgg

SEQ ID NO: 1177087 - RNA, 22 nt, Mycobacterium bovis subsp bovis AF2122/97
gcggcuucgucgacaucgccau

SEQ ID NO: 1177088 - RNA, 12 nt, Mycobacterium bovis subsp bovis AF2122/97
gcggcugcagcc

SEQ ID NO: 1177089 - RNA, 23 nt, Mycobacterium bovis subsp bovis AF2122/97
gcggcugccaucccgaucccggc

SEQ ID NO: 1177090 - RNA, 17 nt, Mycobacterium bovis subsp bovis AF2122/97
gcggcugcccgagaucg

SEQ ID NO: 1177091 - RNA, 15 nt, Mycobacterium bovis subsp bovis AF2122/97
gcggcugccagaaug

SEQ ID NO: 1177092 - RNA, 17 nt, Mycobacterium bovis subsp bovis AF2122/97
gcggcucgggugcgccc

SEQ ID NO: 1177093 - RNA, 20 nt, Mycobacterium bovis subsp bovis AF2122/97
gcggcucgggugcgcccggc

SEQ ID NO: 1177094 - RNA, 21 nt, Mycobacterium bovis subsp bovis AF2122/97
gcggcucgggugcgcccggcc

SEQ ID NO: 1177095 - RNA, 13 nt, Mycobacterium bovis subsp bovis AF2122/97
gcggcucgcguag

SEQ ID NO: 1177096 - RNA, 13 nt, Mycobacterium bovis subsp bovis AF2122/97
gcggcucgccggc

SEQ ID NO: 1177097 - RNA, 18 nt, Mycobacterium bovis subsp bovis AF2122/97
gcggcuccgagggcugcg

SEQ ID NO: 1177098 - RNA, 16 nt, Mycobacterium bovis subsp bovis AF2122/97
gcgggcggugggcagc

SEQ ID NO: 1177099 - RNA, 16 nt, Mycobacterium bovis subsp bovis AF2122/97
gcgggcgugugcaguc

SEQ ID NO: 1177100 - RNA, 23 nt, Mycobacterium bovis subsp bovis AF2122/97
gcgggcucaacaccagccggucg

SEQ ID NO: 1177101 - RNA, 20 nt, Mycobacterium bovis subsp bovis AF2122/97
gcgggcguuggccagcaggu

SEQ ID NO: 1177102 - RNA, 16 nt, Mycobacterium bovis subsp bovis AF2122/97
gcgggcuaggcggcgu

SEQ ID NO: 1177103 - RNA, 22 nt, Mycobacterium bovis subsp bovis AF2122/97
gcgggcgccuuccaggcgggcg

SEQ ID NO: 1177104 - RNA, 18 nt, Mycobacterium bovis subsp bovis AF2122/97
gcgggcggugcacaccgu

SEQ ID NO: 1177105 - RNA, 12 nt, Mycobacterium bovis subsp bovis AF2122/97
gcgggcgguggg

SEQ ID NO: 1177106 - RNA, 19 nt, Mycobacterium bovis subsp bovis AF2122/97
gcgggcggugggcagcagc

SEQ ID NO: 1177107 - RNA, 18 nt, Mycobacterium bovis subsp bovis AF2122/97
gcgggcgccuuccaggcg

SEQ ID NO: 1177108 - RNA, 19 nt, Mycobacterium bovis subsp bovis AF2122/97
gcgggcgaugagcgcgauc

SEQ ID NO: 1177109 - RNA, 14 nt, Mycobacterium bovis subsp bovis AF2122/97
gcgggcgccgggaa

SEQ ID NO: 1177110 - RNA, 23 nt, Mycobacterium bovis subsp bovis AF2122/97
gcgggcucgcuucaggcaccgga

SEQ ID NO: 1177111 - RNA, 20 nt, Mycobacterium bovis subsp bovis AF2122/97
gcgggcucuacucgcggccg

SEQ ID NO: 1177112 - RNA, 16 nt, Mycobacterium bovis subsp bovis AF2122/97
gcgggcugaccaacuc

SEQ ID NO: 1177113 - RNA, 23 nt, Mycobacterium bovis subsp bovis AF2122/97
gcgggcugcagugacucgaucac

SEQ ID NO: 1177114 - RNA, 15 nt, Mycobacterium bovis subsp bovis AF2122/97
gcggggaaucaccca

SEQ ID NO: 1177115 - RNA, 17 nt, Mycobacterium bovis subsp bovis AF2122/97
gcgggcuuugagcgccc

SEQ ID NO: 1177116 - RNA, 12 nt, Mycobacterium bovis subsp bovis AF2122/97
gcgggcuugagc

SEQ ID NO: 1177117 - RNA, 21 nt, Mycobacterium bovis subsp bovis AF2122/97
gcgggcuuggggucccgccgg

SEQ ID NO: 1177118 - RNA, 22 nt, Mycobacterium bovis subsp bovis AF2122/97
gcggguagauguucacgccgcc

SEQ ID NO: 1177119 - RNA, 16 nt, Mycobacterium bovis subsp bovis AF2122/97
gcggggaucagcgagu

SEQ ID NO: 1177120 - RNA, 20 nt, Mycobacterium bovis subsp bovis AF2122/97
gcggggaucgcuggccgcga

SEQ ID NO: 1177121 - RNA, 15 nt, Mycobacterium bovis subsp bovis AF2122/97
gcggggacggcggca

SEQ ID NO: 1177122 - RNA, 18 nt, Mycobacterium bovis subsp bovis AF2122/97
gcggggacggcggcaagg

SEQ ID NO: 1177123 - RNA, 16 nt, Mycobacterium bovis subsp bovis AF2122/97
gcgggugaccaggcgg

SEQ ID NO: 1177124 - RNA, 14 nt, Mycobacterium bovis subsp bovis AF2122/97
gcgggucggcggug

SEQ ID NO: 1177125 - RNA, 23 nt, Mycobacterium bovis subsp bovis AF2122/97
gcgggucgugccccggcgcgguc

SEQ ID NO: 1177126 - RNA, 16 nt, Mycobacterium bovis subsp bovis AF2122/97
gcgggucggcgaccgc

SEQ ID NO: 1177127 - RNA, 22 nt, Mycobacterium bovis subsp bovis AF2122/97
gcgggucacaaaaccugggaug

SEQ ID NO: 1177128 - RNA, 21 nt, Mycobacterium bovis subsp bovis AF2122/97
gcggguuugaucuccaccuuc

SEQ ID NO: 1177129 - RNA, 16 nt, Mycobacterium bovis subsp bovis AF2122/97
gcggguuugccgggcg

SEQ ID NO: 1177130 - RNA, 15 nt, Mycobacterium bovis subsp bovis AF2122/97
gcgggugcgccggcg

SEQ ID NO: 1177131 - RNA, 19 nt, Mycobacterium bovis subsp bovis AF2122/97
gcgggugcgcgaggucggc

SEQ ID NO: 1177132 - RNA, 14 nt, Mycobacterium bovis subsp bovis AF2122/97
gcgggugccgggca

SEQ ID NO: 1177133 - RNA, 14 nt, Mycobacterium bovis subsp bovis AF2122/97
gcgggugcgccggc

SEQ ID NO: 1177134 - RNA, 17 nt, Mycobacterium bovis subsp bovis AF2122/97
gcgggucuuggcacaca

SEQ ID NO: 1177135 - RNA, 22 nt, Mycobacterium bovis subsp bovis AF2122/97
gcgggugccagcccguugcagg

SEQ ID NO: 1177136 - RNA, 14 nt, Mycobacterium bovis subsp bovis AF2122/97
gcgggugcggauca

SEQ ID NO: 1177137 - RNA, 23 nt, Mycobacterium bovis subsp bovis AF2122/97
gcgguaaaugccugcccaccuuc

SEQ ID NO: 1177138 - RNA, 22 nt, Mycobacterium bovis subsp bovis AF2122/97
gcggccgaauuccucaaggucg

SEQ ID NO: 1177139 - RNA, 15 nt, Mycobacterium bovis subsp bovis AF2122/97
gcggcccucgagcag

SEQ ID NO: 1177140 - RNA, 18 nt, Mycobacterium bovis subsp bovis AF2122/97
gcggccgcagcggccagc

SEQ ID NO: 1177141 - RNA, 22 nt, Mycobacterium bovis subsp bovis AF2122/97
gcggccgcagcggccagcccag

SEQ ID NO: 1177142 - RNA, 13 nt, Mycobacterium bovis subsp bovis AF2122/97
gcggccgcagcgg

SEQ ID NO: 1177143 - RNA, 18 nt, Mycobacterium bovis subsp bovis AF2122/97
gcggccgcagccagcaag

SEQ ID NO: 1177144 - RNA, 11 nt, Mycobacterium bovis subsp bovis AF2122/97
gcggccgccgc

SEQ ID NO: 1177145 - RNA, 14 nt, Mycobacterium bovis subsp bovis AF2122/97
gcggccgccacucc

SEQ ID NO: 1177146 - RNA, 13 nt, Mycobacterium bovis subsp bovis AF2122/97
gcggccgccccag

SEQ ID NO: 1177147 - RNA, 22 nt, Mycobacterium bovis subsp bovis AF2122/97
gcggccgccccaggcugguccg

SEQ ID NO: 1177148 - RNA, 18 nt, Mycobacterium bovis subsp bovis AF2122/97
gcggccgccguccccgcc

SEQ ID NO: 1177149 - RNA, 20 nt, Mycobacterium bovis subsp bovis AF2122/97
gcggccgccguccccgccgu

SEQ ID NO: 1177150 - RNA, 22 nt, Mycobacterium bovis subsp bovis AF2122/97
gcggccgccguccccgccgucg

SEQ ID NO: 1177151 - RNA, 14 nt, Mycobacterium bovis subsp bovis AF2122/97
gcggcgcccaggaa

SEQ ID NO: 1177152 - RNA, 13 nt, Mycobacterium bovis subsp bovis AF2122/97
gcggcgcccaucg

SEQ ID NO: 1177153 - RNA, 19 nt, Mycobacterium bovis subsp bovis AF2122/97
gcggcgcccaucgcgacgg

SEQ ID NO: 1177154 - RNA, 21 nt, Mycobacterium bovis subsp bovis AF2122/97
gcggcgcgcaacacauccagu

SEQ ID NO: 1177155 - RNA, 13 nt, Mycobacterium bovis subsp bovis AF2122/97
gcggcgcccggcg

SEQ ID NO: 1177156 - RNA, 17 nt, Mycobacterium bovis subsp bovis AF2122/97
gcggcgcgcagcuugga

SEQ ID NO: 1177157 - RNA, 19 nt, Mycobacterium bovis subsp bovis AF2122/97
gcggcgccaguauggccgc

SEQ ID NO: 1177158 - RNA, 23 nt, Mycobacterium bovis subsp bovis AF2122/97
gcggcgccauagccgcgacccgc

SEQ ID NO: 1177159 - RNA, 14 nt, Mycobacterium bovis subsp bovis AF2122/97
gcggcgcaguuucc

SEQ ID NO: 1177160 - RNA, 12 nt, Mycobacterium bovis subsp bovis AF2122/97
gcggcgcugcag

SEQ ID NO: 1177161 - RNA, 13 nt, Mycobacterium bovis subsp bovis AF2122/97
gcggcgcugguug

SEQ ID NO: 1177162 - RNA, 11 nt, Mycobacterium bovis subsp bovis AF2122/97
gcggcgcuggg

SEQ ID NO: 1177163 - RNA, 20 nt, Mycobacterium bovis subsp bovis AF2122/97
gcggcgcuggucgcgguggc

SEQ ID NO: 1177164 - RNA, 13 nt, Mycobacterium bovis subsp bovis AF2122/97
gcggcgcuggcug

SEQ ID NO: 1177165 - RNA, 15 nt, Mycobacterium bovis subsp bovis AF2122/97
gcggcgcgggucggc

SEQ ID NO: 1177166 - RNA, 17 nt, Mycobacterium bovis subsp bovis AF2122/97
gcggcgcgggggugggc

SEQ ID NO: 1177167 - RNA, 24 nt, Mycobacterium bovis subsp bovis AF2122/97
gcggcgcgggggugggcgugacgg

SEQ ID NO: 1177168 - RNA, 17 nt, Mycobacterium bovis subsp bovis AF2122/97
gcggcgcggccgcagcc

SEQ ID NO: 1177169 - RNA, 13 nt, Mycobacterium bovis subsp bovis AF2122/97
gcggcggccgcag

SEQ ID NO: 1177170 - RNA, 20 nt, Mycobacterium bovis subsp bovis AF2122/97
gcggcggcccgcagcccgcc

SEQ ID NO: 1177171 - RNA, 14 nt, Mycobacterium bovis subsp bovis AF2122/97
gcggcggccgcagc

SEQ ID NO: 1177172 - RNA, 13 nt, Mycobacterium bovis subsp bovis AF2122/97
gcggcggccagga

SEQ ID NO: 1177173 - RNA, 15 nt, Mycobacterium bovis subsp bovis AF2122/97
gcggcggcccgcagc

SEQ ID NO: 1177174 - RNA, 15 nt, Mycobacterium bovis subsp bovis AF2122/97
gcggcggccgcagcg

SEQ ID NO: 1177175 - RNA, 13 nt, Mycobacterium bovis subsp bovis AF2122/97
gcggcggccuggg

SEQ ID NO: 1177176 - RNA, 17 nt, Mycobacterium bovis subsp bovis AF2122/97
gcggcggcaaccccgag

SEQ ID NO: 1177177 - RNA, 12 nt, Mycobacterium bovis subsp bovis AF2122/97
gcggcgcgggug

SEQ ID NO: 1177178 - RNA, 13 nt, Mycobacterium bovis subsp bovis AF2122/97
gcggcggccagcg

SEQ ID NO: 1177179 - RNA, 14 nt, Mycobacterium bovis subsp bovis AF2122/97
gcggcggccagcgc

SEQ ID NO: 1177180 - RNA, 15 nt, Mycobacterium bovis subsp bovis AF2122/97
gcggcggagccgggu

SEQ ID NO: 1177181 - RNA, 20 nt, Mycobacterium bovis subsp bovis AF2122/97
gcggcggcacuggugcccga

SEQ ID NO: 1177182 - RNA, 14 nt, Mycobacterium bovis subsp bovis AF2122/97
gcggcggcacgcuc

SEQ ID NO: 1177183 - RNA, 20 nt, Mycobacterium bovis subsp bovis AF2122/97
gcggcggcacuacgcagccg

SEQ ID NO: 1177184 - RNA, 18 nt, Mycobacterium bovis subsp bovis AF2122/97
gcggcgggagucggucug

SEQ ID NO: 1177185 - RNA, 20 nt, Mycobacterium bovis subsp bovis AF2122/97
gcggcggcuuuggccgccgu

SEQ ID NO: 1177186 - RNA, 14 nt, Mycobacterium bovis subsp bovis AF2122/97
gcggcgggcgauga

SEQ ID NO: 1177187 - RNA, 12 nt, Mycobacterium bovis subsp bovis AF2122/97
gcggcgggcccg

SEQ ID NO: 1177188 - RNA, 22 nt, Mycobacterium bovis subsp bovis AF2122/97
gcggcgggggcgucgccgccgg

SEQ ID NO: 1177189 - RNA, 19 nt, Mycobacterium bovis subsp bovis AF2122/97
gcggcgggggcggcggcug

SEQ ID NO: 1177190 - RNA, 14 nt, Mycobacterium bovis subsp bovis AF2122/97
gcggcggcgccggc

SEQ ID NO: 1177191 - RNA, 12 nt, Mycobacterium bovis subsp bovis AF2122/97
gcggcggcgccu

SEQ ID NO: 1177192 - RNA, 15 nt, Mycobacterium bovis subsp bovis AF2122/97
gcggcggcgcucggc

SEQ ID NO: 1177193 - RNA, 12 nt, Mycobacterium bovis subsp bovis AF2122/97
gcggcggcgcug

SEQ ID NO: 1177194 - RNA, 13 nt, Mycobacterium bovis subsp bovis AF2122/97
gcggcggcgcugg

SEQ ID NO: 1177195 - RNA, 13 nt, Mycobacterium bovis subsp bovis AF2122/97
gcggcggcggagg

SEQ ID NO: 1177196 - RNA, 14 nt, Mycobacterium bovis subsp bovis AF2122/97
gcggcggcggcccg

SEQ ID NO: 1177197 - RNA, 15 nt, Mycobacterium bovis subsp bovis AF2122/97
gcggcgguggccagc

SEQ ID NO: 1177198 - RNA, 22 nt, Mycobacterium bovis subsp bovis AF2122/97
gcggcggugcagcagggcgcgc

SEQ ID NO: 1177199 - RNA, 16 nt, Mycobacterium bovis subsp bovis AF2122/97
gcggcguaacugugga

SEQ ID NO: 1177200 - RNA, 15 nt, Mycobacterium bovis subsp bovis AF2122/97
gcggcggucugggug

SEQ ID NO: 1177201 - RNA, 18 nt, Mycobacterium bovis subsp bovis AF2122/97
gcggcggucugggugagc

SEQ ID NO: 1177202 - RNA, 19 nt, Mycobacterium bovis subsp bovis AF2122/97
gcggcggugcagcagggcg

SEQ ID NO: 1177203 - RNA, 16 nt, Mycobacterium bovis subsp bovis AF2122/97
gcggcggucggcuggg

SEQ ID NO: 1177204 - RNA, 22 nt, Mycobacterium bovis subsp bovis AF2122/97
gcggcggucggcugggcgaagc

SEQ ID NO: 1177205 - RNA, 23 nt, Mycobacterium bovis subsp bovis AF2122/97
gcggcgguaugcucgcuggcgcu

SEQ ID NO: 1177206 - RNA, 21 nt, Mycobacterium bovis subsp bovis AF2122/97
gcggcgguaucggcauaccca

SEQ ID NO: 1177207 - RNA, 21 nt, Mycobacterium bovis subsp bovis AF2122/97
gcggcgucgugagaggccaag

SEQ ID NO: 1177208 - RNA, 18 nt, Mycobacterium bovis subsp bovis AF2122/97
gcggcgucguggaucuuc

SEQ ID NO: 1177209 - RNA, 15 nt, Mycobacterium bovis subsp bovis AF2122/97
gcggcgugccgggug

SEQ ID NO: 1177210 - RNA, 14 nt, Mycobacterium bovis subsp bovis AF2122/97
gcggcgugcgcggu

SEQ ID NO: 1177211 - RNA, 22 nt, Mycobacterium bovis subsp bovis AF2122/97
gcggcgugguauccgccguucu

SEQ ID NO: 1177212 - RNA, 16 nt, Mycobacterium bovis subsp bovis AF2122/97
gcggcgugcuccugcc

SEQ ID NO: 1177213 - RNA, 16 nt, Mycobacterium bovis subsp bovis AF2122/97
gcggcguggcgccggc

SEQ ID NO: 1177214 - RNA, 13 nt, Mycobacterium bovis subsp bovis AF2122/97
gcggcguccagca

SEQ ID NO: 1177215 - RNA, 14 nt, Mycobacterium bovis subsp bovis AF2122/97
gcggcguccagcag

SEQ ID NO: 1177216 - RNA, 19 nt, Mycobacterium bovis subsp bovis AF2122/97
gcggcgucgaugucauccg

SEQ ID NO: 1177217 - RNA, 17 nt, Mycobacterium bovis subsp bovis AF2122/97
gcggcguauugcggccu

SEQ ID NO: 1177218 - RNA, 18 nt, Mycobacterium bovis subsp bovis AF2122/97
gcggcguauugcggccug

SEQ ID NO: 1177219 - RNA, 22 nt, Mycobacterium bovis subsp bovis AF2122/97
gcggcgugucguugccagggcg

SEQ ID NO: 1177220 - RNA, 21 nt, Mycobacterium bovis subsp bovis AF2122/97
gcggcguuggugcagucggug

SEQ ID NO: 1177221 - RNA, 18 nt, Mycobacterium bovis subsp bovis AF2122/97
gcggcuccaccgggcccg

SEQ ID NO: 1177222 - RNA, 21 nt, Mycobacterium bovis subsp bovis AF2122/97
gcggcucaaccucuggcggcg

SEQ ID NO: 1177223 - RNA, 16 nt, Mycobacterium bovis subsp bovis AF2122/97
gcggcuaggcaccagc

SEQ ID NO: 1177224 - RNA, 17 nt, Mycobacterium bovis subsp bovis AF2122/97
gcggcuaggccagcacg

SEQ ID NO: 1177225 - RNA, 21 nt, Mycobacterium bovis subsp bovis AF2122/97
gcggcuaggccagcacggcga

SEQ ID NO: 1177226 - RNA, 19 nt, Mycobacterium bovis subsp bovis AF2122/97
gcggcuauggcgccgcggc

SEQ ID NO: 1177227 - RNA, 17 nt, Mycobacterium bovis subsp bovis AF2122/97
gcggcucaaucuccucc

SEQ ID NO: 1177228 - RNA, 20 nt, Mycobacterium bovis subsp bovis AF2122/97
gcgcgcauauccgcaggccc

SEQ ID NO: 1177229 - RNA, 17 nt, Mycobacterium bovis subsp bovis AF2122/97
gcgcgccacccagcacc

SEQ ID NO: 1177230 - RNA, 16 nt, Mycobacterium bovis subsp bovis AF2122/97
gcgcgccagcucggcg

SEQ ID NO: 1177231 - RNA, 21 nt, Mycobacterium bovis subsp bovis AF2122/97
gcgcgaucugcucgccccaug

SEQ ID NO: 1177232 - RNA, 16 nt, Mycobacterium bovis subsp bovis AF2122/97
gcgcgauggcgcgugg

SEQ ID NO: 1177233 - RNA, 19 nt, Mycobacterium bovis subsp bovis AF2122/97
gcgcgcaacccugccgcga

SEQ ID NO: 1177234 - RNA, 15 nt, Mycobacterium bovis subsp bovis AF2122/97
gcgcgcaacccugcc

SEQ ID NO: 1177235 - RNA, 13 nt, Mycobacterium bovis subsp bovis AF2122/97
gcgcgcaaccgcu

SEQ ID NO: 1177236 - RNA, 16 nt, Mycobacterium bovis subsp bovis AF2122/97
gcgcgcaacgcuggag

SEQ ID NO: 1177237 - RNA, 20 nt, Mycobacterium bovis subsp bovis AF2122/97
gcgcgacguaguugccggcu

SEQ ID NO: 1177238 - RNA, 18 nt, Mycobacterium bovis subsp bovis AF2122/97
gcgcgacguccaccagcc

SEQ ID NO: 1177239 - RNA, 17 nt, Mycobacterium bovis subsp bovis AF2122/97
gcgcgaccucgcuggcc

SEQ ID NO: 1177240 - RNA, 18 nt, Mycobacterium bovis subsp bovis AF2122/97
gcgcgaccucgcuggccg

SEQ ID NO: 1177241 - RNA, 17 nt, Mycobacterium bovis subsp bovis AF2122/97
gcgcgaucuccuccacc

SEQ ID NO: 1177242 - RNA, 23 nt, Mycobacterium bovis subsp bovis AF2122/97
gcgcgauggccuggcccuuguug

SEQ ID NO: 1177243 - RNA, 17 nt, Mycobacterium bovis subsp bovis AF2122/97
gcgcgaucugcucgccc

SEQ ID NO: 1177244 - RNA, 16 nt, Mycobacterium bovis subsp bovis AF2122/97
gcgccuugaccacagc

SEQ ID NO: 1177245 - RNA, 17 nt, Mycobacterium bovis subsp bovis AF2122/97
gcgccuucgccagcggc

SEQ ID NO: 1177246 - RNA, 21 nt, Mycobacterium bovis subsp bovis AF2122/97
gcgccuugauggucuccacca

SEQ ID NO: 1177247 - RNA, 22 nt, Mycobacterium bovis subsp bovis AF2122/97
gcgccuuccaggcgggcggcac

SEQ ID NO: 1177248 - RNA, 18 nt, Mycobacterium bovis subsp bovis AF2122/97
gcgccuucaccuggugug

SEQ ID NO: 1177249 - RNA, 15 nt, Mycobacterium bovis subsp bovis AF2122/97
gcgccuuggucgccg

SEQ ID NO: 1177250 - RNA, 18 nt, Mycobacterium bovis subsp bovis AF2122/97
gcgccuuggucgccgccu

SEQ ID NO: 1177251 - RNA, 18 nt, Mycobacterium bovis subsp bovis AF2122/97
gcgccuuggucgccgcuu

SEQ ID NO: 1177252 - RNA, 17 nt, Mycobacterium bovis subsp bovis AF2122/97
gcgccuuggucgccggc

SEQ ID NO: 1177253 - RNA, 21 nt, Mycobacterium bovis subsp bovis AF2122/97
gcgcgccgcauccagccgugc

SEQ ID NO: 1177254 - RNA, 18 nt, Mycobacterium bovis subsp bovis AF2122/97
gcgcgccgaucggcaccg

SEQ ID NO: 1177255 - RNA, 22 nt, Mycobacterium bovis subsp bovis AF2122/97
gcgcgccgcauccagccgugcg

SEQ ID NO: 1177256 - RNA, 11 nt, Mycobacterium bovis subsp bovis AF2122/97
gcgcgccgcga

SEQ ID NO: 1177257 - RNA, 13 nt, Mycobacterium bovis subsp bovis AF2122/97
gcgcgcugagccg

SEQ ID NO: 1177258 - RNA, 13 nt, Mycobacterium bovis subsp bovis AF2122/97
gcgcgcugccgcu

SEQ ID NO: 1177259 - RNA, 13 nt, Mycobacterium bovis subsp bovis AF2122/97
gcgcgcgcgccgg

SEQ ID NO: 1177260 - RNA, 14 nt, Mycobacterium bovis subsp bovis AF2122/97
gcgcgcgcgccggc

SEQ ID NO: 1177261 - RNA, 14 nt, Mycobacterium bovis subsp bovis AF2122/97
gcgcgcugggcccg

SEQ ID NO: 1177262 - RNA, 15 nt, Mycobacterium bovis subsp bovis AF2122/97
gcgcgcugggcgccg

SEQ ID NO: 1177263 - RNA, 17 nt, Mycobacterium bovis subsp bovis AF2122/97
gcgcgcuggcgggcggc

SEQ ID NO: 1177264 - RNA, 18 nt, Mycobacterium bovis subsp bovis AF2122/97
gcgcgcuggcgggcggcg

SEQ ID NO: 1177265 - RNA, 21 nt, Mycobacterium bovis subsp bovis AF2122/97
gcgcgcugggaagcucggucc

SEQ ID NO: 1177266 - RNA, 15 nt, Mycobacterium bovis subsp bovis AF2122/97
gcgcgcugggcgcgc

SEQ ID NO: 1177267 - RNA, 17 nt, Mycobacterium bovis subsp bovis AF2122/97
gcgcgcugggcgcgcuc

SEQ ID NO: 1177268 - RNA, 18 nt, Mycobacterium bovis subsp bovis AF2122/97
gcgcggcaagcucguccg

SEQ ID NO: 1177269 - RNA, 21 nt, Mycobacterium bovis subsp bovis AF2122/97
gcgcggcaaaguuggccgccc

SEQ ID NO: 1177270 - RNA, 23 nt, Mycobacterium bovis subsp bovis AF2122/97
gcgcggcgaucgcuccgcggcgc

SEQ ID NO: 1177271 - RNA, 19 nt, Mycobacterium bovis subsp bovis AF2122/97
gcgcggcgagcacgcgggc

SEQ ID NO: 1177272 - RNA, 17 nt, Mycobacterium bovis subsp bovis AF2122/97
gcgcggccuuggugggc

SEQ ID NO: 1177273 - RNA, 18 nt, Mycobacterium bovis subsp bovis AF2122/97
gcgcggcgaagccgggug

SEQ ID NO: 1177274 - RNA, 20 nt, Mycobacterium bovis subsp bovis AF2122/97
gcgcggcgaagccgggugcu

SEQ ID NO: 1177275 - RNA, 12 nt, Mycobacterium bovis subsp bovis AF2122/97
gcgcggccuugg

SEQ ID NO: 1177276 - RNA, 13 nt, Mycobacterium bovis subsp bovis AF2122/97
gcgcggcaggccu

SEQ ID NO: 1177277 - RNA, 16 nt, Mycobacterium bovis subsp bovis AF2122/97
gcgcggcaggccuggc

SEQ ID NO: 1177278 - RNA, 20 nt, Mycobacterium bovis subsp bovis AF2122/97
gcgcggccaaucagcccgcc

SEQ ID NO: 1177279 - RNA, 22 nt, Mycobacterium bovis subsp bovis AF2122/97
gcgccucgaccugacuggucag

SEQ ID NO: 1177280 - RNA, 17 nt, Mycobacterium bovis subsp bovis AF2122/97
gcgccucgcccagcaag

SEQ ID NO: 1177281 - RNA, 17 nt, Mycobacterium bovis subsp bovis AF2122/97
gcgccucggcggccagc

SEQ ID NO: 1177282 - RNA, 17 nt, Mycobacterium bovis subsp bovis AF2122/97
gcgccucauccuccagu

SEQ ID NO: 1177283 - RNA, 17 nt, Mycobacterium bovis subsp bovis AF2122/97
gcgccucaagcucgccg

SEQ ID NO: 1177284 - RNA, 22 nt, Mycobacterium bovis subsp bovis AF2122/97
gcgccgugaucagcucgcgcac

SEQ ID NO: 1177285 - RNA, 21 nt, Mycobacterium bovis subsp bovis AF2122/97
gcgccguggaucaucccgacc

SEQ ID NO: 1177286 - RNA, 14 nt, Mycobacterium bovis subsp bovis AF2122/97
gcgccuaccagcac

SEQ ID NO: 1177287 - RNA, 20 nt, Mycobacterium bovis subsp bovis AF2122/97
gcgccguugccgccgucgcc

SEQ ID NO: 1177288 - RNA, 15 nt, Mycobacterium bovis subsp bovis AF2122/97
gcgccugcggcagca

SEQ ID NO: 1177289 - RNA, 20 nt, Mycobacterium bovis subsp bovis AF2122/97
gcgccuggcggcgccgcaga

SEQ ID NO: 1177290 - RNA, 20 nt, Mycobacterium bovis subsp bovis AF2122/97
gcgccuggcuggccagcugc

SEQ ID NO: 1177291 - RNA, 14 nt, Mycobacterium bovis subsp bovis AF2122/97
gcgccugcggcagc

SEQ ID NO: 1177292 - RNA, 18 nt, Mycobacterium bovis subsp bovis AF2122/97
gcgccugaugcggccggc

SEQ ID NO: 1177293 - RNA, 20 nt, Mycobacterium bovis subsp bovis AF2122/97
gcgccugaugcggccggcgc

SEQ ID NO: 1177294 - RNA, 19 nt, Mycobacterium bovis subsp bovis AF2122/97
gcgccugaauaggucgguc

SEQ ID NO: 1177295 - RNA, 15 nt, Mycobacterium bovis subsp bovis AF2122/97
gcgccugagcggccu

SEQ ID NO: 1177296 - RNA, 16 nt, Mycobacterium bovis subsp bovis AF2122/97
gcgccugagcggccuc

SEQ ID NO: 1177297 - RNA, 14 nt, Mycobacterium bovis subsp bovis AF2122/97
gcgccggggcgcag

SEQ ID NO: 1177298 - RNA, 16 nt, Mycobacterium bovis subsp bovis AF2122/97
gcgccggggccgccga

SEQ ID NO: 1177299 - RNA, 16 nt, Mycobacterium bovis subsp bovis AF2122/97
gcgccgggggcgccgc

SEQ ID NO: 1177300 - RNA, 19 nt, Mycobacterium bovis subsp bovis AF2122/97
gcgccgguuacccggaccg

SEQ ID NO: 1177301 - RNA, 18 nt, Mycobacterium bovis subsp bovis AF2122/97
gcgccggugccgccuccg

SEQ ID NO: 1177302 - RNA, 18 nt, Mycobacterium bovis subsp bovis AF2122/97
gcgccggugcggcgggcu

SEQ ID NO: 1177303 - RNA, 12 nt, Mycobacterium bovis subsp bovis AF2122/97
gcgccggugcug

SEQ ID NO: 1177304 - RNA, 19 nt, Mycobacterium bovis subsp bovis AF2122/97
gcgccggugccgccgggug

SEQ ID NO: 1177305 - RNA, 19 nt, Mycobacterium bovis subsp bovis AF2122/97
gcgccggucgccggcuggg

SEQ ID NO: 1177306 - RNA, 23 nt, Mycobacterium bovis subsp bovis AF2122/97
gcgccggucagcaauacggcggc

SEQ ID NO: 1177307 - RNA, 21 nt, Mycobacterium bovis subsp bovis AF2122/97
gcgccgucguugugccggucg

SEQ ID NO: 1177308 - RNA, 15 nt, Mycobacterium bovis subsp bovis AF2122/97
gcgccgucgcccagc

SEQ ID NO: 1177309 - RNA, 20 nt, Mycobacterium bovis subsp bovis AF2122/97
gcgccgguuucgaggcgaag

SEQ ID NO: 1177310 - RNA, 20 nt, Mycobacterium bovis subsp bovis AF2122/97
gcgccggugguaacggcggc

SEQ ID NO: 1177311 - RNA, 16 nt, Mycobacterium bovis subsp bovis AF2122/97
gcgccguacagcggcg

SEQ ID NO: 1177312 - RNA, 19 nt, Mycobacterium bovis subsp bovis AF2122/97
gcgccguaacagccggccg

SEQ ID NO: 1177313 - RNA, 22 nt, Mycobacterium bovis subsp bovis AF2122/97
gcgccguaacagccggccggau

SEQ ID NO: 1177314 - RNA, 16 nt, Mycobacterium bovis subsp bovis AF2122/97
gcgccguagccgagga

SEQ ID NO: 1177315 - RNA, 16 nt, Mycobacterium bovis subsp bovis AF2122/97
gcgccgguuggccagu

SEQ ID NO: 1177316 - RNA, 18 nt, Mycobacterium bovis subsp bovis AF2122/97
gcgccguacagcggcggc

SEQ ID NO: 1177317 - RNA, 18 nt, Mycobacterium bovis subsp bovis AF2122/97
gcgccguagaccagcagg

SEQ ID NO: 1177318 - RNA, 15 nt, Mycobacterium bovis subsp bovis AF2122/97
gcgccgucaucgcag

SEQ ID NO: 1177319 - RNA, 16 nt, Mycobacterium bovis subsp bovis AF2122/97
gcgccggccagccagc

SEQ ID NO: 1177320 - RNA, 14 nt, Mycobacterium bovis subsp bovis AF2122/97
gcgccggccaugcc

SEQ ID NO: 1177321 - RNA, 13 nt, Mycobacterium bovis subsp bovis AF2122/97
gcgccggccgcug

SEQ ID NO: 1177322 - RNA, 12 nt, Mycobacterium bovis subsp bovis AF2122/97
gcgccggccggc

SEQ ID NO: 1177323 - RNA, 14 nt, Mycobacterium bovis subsp bovis AF2122/97
gcgccggccggcgc

SEQ ID NO: 1177324 - RNA, 17 nt, Mycobacterium bovis subsp bovis AF2122/97
gcgccggccgcacgccg

SEQ ID NO: 1177325 - RNA, 17 nt, Mycobacterium bovis subsp bovis AF2122/97
gcgccggccgcugccuu

SEQ ID NO: 1177326 - RNA, 11 nt, Mycobacterium bovis subsp bovis AF2122/97
gcgccggccgg

SEQ ID NO: 1177327 - RNA, 14 nt, Mycobacterium bovis subsp bovis AF2122/97
gcgccggcgcugcu

SEQ ID NO: 1177328 - RNA, 15 nt, Mycobacterium bovis subsp bovis AF2122/97
gcgccggcgcugcug

SEQ ID NO: 1177329 - RNA, 17 nt, Mycobacterium bovis subsp bovis AF2122/97
gcgccggcgcugcugcc

SEQ ID NO: 1177330 - RNA, 12 nt, Mycobacterium bovis subsp bovis AF2122/97
gcgccggcggca

SEQ ID NO: 1177331 - RNA, 13 nt, Mycobacterium bovis subsp bovis AF2122/97
gcgccggcggcca

SEQ ID NO: 1177332 - RNA, 16 nt, Mycobacterium bovis subsp bovis AF2122/97
gcgccggcgggcgcgg

SEQ ID NO: 1177333 - RNA, 18 nt, Mycobacterium bovis subsp bovis AF2122/97
gcgccggcuagggcccug

SEQ ID NO: 1177334 - RNA, 21 nt, Mycobacterium bovis subsp bovis AF2122/97
gcgccggcgucggcgcccagc

SEQ ID NO: 1177335 - RNA, 18 nt, Mycobacterium bovis subsp bovis AF2122/97
gcgccggcgugcaugagc

SEQ ID NO: 1177336 - RNA, 14 nt, Mycobacterium bovis subsp bovis AF2122/97
gcgccggcgucggc

SEQ ID NO: 1177337 - RNA, 20 nt, Mycobacterium bovis subsp bovis AF2122/97
gcgccggcuagggcccuggc

SEQ ID NO: 1177338 - RNA, 17 nt, Mycobacterium bovis subsp bovis AF2122/97
gcgccggcugccacaca

SEQ ID NO: 1177339 - RNA, 19 nt, Mycobacterium bovis subsp bovis AF2122/97
gcgccgggcguccgccggc

SEQ ID NO: 1177340 - RNA, 20 nt, Mycobacterium bovis subsp bovis AF2122/97
gcgccggggacacagcgucc

SEQ ID NO: 1177341 - RNA, 12 nt, Mycobacterium bovis subsp bovis AF2122/97
gcgccggcuggc

SEQ ID NO: 1177342 - RNA, 15 nt, Mycobacterium bovis subsp bovis AF2122/97
gcgccggcuggcggc

SEQ ID NO: 1177343 - RNA, 13 nt, Mycobacterium bovis subsp bovis AF2122/97
gcgccgcgcgcgc

SEQ ID NO: 1177344 - RNA, 12 nt, Mycobacterium bovis subsp bovis AF2122/97
gcgccgcggccc

SEQ ID NO: 1177345 - RNA, 22 nt, Mycobacterium bovis subsp bovis AF2122/97
gcgccgcgcuugcgaucggcac

SEQ ID NO: 1177346 - RNA, 13 nt, Mycobacterium bovis subsp bovis AF2122/97
gcgccgcgcggcu

SEQ ID NO: 1177347 - RNA, 14 nt, Mycobacterium bovis subsp bovis AF2122/97
gcgccgcgcgggug

SEQ ID NO: 1177348 - RNA, 16 nt, Mycobacterium bovis subsp bovis AF2122/97
gcgccgcggcccgcuc

SEQ ID NO: 1177349 - RNA, 13 nt, Mycobacterium bovis subsp bovis AF2122/97
gcgccgcggcgac

SEQ ID NO: 1177350 - RNA, 13 nt, Mycobacterium bovis subsp bovis AF2122/97
gcgccgcggcgga

SEQ ID NO: 1177351 - RNA, 14 nt, Mycobacterium bovis subsp bovis AF2122/97
gcgccgcggcuggg

SEQ ID NO: 1177352 - RNA, 19 nt, Mycobacterium bovis subsp bovis AF2122/97
gcgccgcguggcuggcggc

SEQ ID NO: 1177353 - RNA, 22 nt, Mycobacterium bovis subsp bovis AF2122/97
gcgccgcuaggugacgccgcca

SEQ ID NO: 1177354 - RNA, 23 nt, Mycobacterium bovis subsp bovis AF2122/97
gcgccggauggguggccagcaac

SEQ ID NO: 1177355 - RNA, 17 nt, Mycobacterium bovis subsp bovis AF2122/97
gcgccggaguuucccuu

SEQ ID NO: 1177356 - RNA, 20 nt, Mycobacterium bovis subsp bovis AF2122/97
gcgccggaguugaagaagcc

SEQ ID NO: 1177357 - RNA, 18 nt, Mycobacterium bovis subsp bovis AF2122/97
gcgccgcugacuccugcg

SEQ ID NO: 1177358 - RNA, 17 nt, Mycobacterium bovis subsp bovis AF2122/97
gcgccggaacgagcggc

SEQ ID NO: 1177359 - RNA, 20 nt, Mycobacterium bovis subsp bovis AF2122/97
gcgccggaacgagcggccgc

SEQ ID NO: 1177360 - RNA, 16 nt, Mycobacterium bovis subsp bovis AF2122/97
gcgccgcgaggcaccg

SEQ ID NO: 1177361 - RNA, 17 nt, Mycobacterium bovis subsp bovis AF2122/97
gcgccgcgccgcgccgc

SEQ ID NO: 1177362 - RNA, 13 nt, Mycobacterium bovis subsp bovis AF2122/97
gcgccgcgcccac

SEQ ID NO: 1177363 - RNA, 18 nt, Mycobacterium bovis subsp bovis AF2122/97
gcgccgccguccagcgcc

SEQ ID NO: 1177364 - RNA, 14 nt, Mycobacterium bovis subsp bovis AF2122/97
gcgccgccggugcc

SEQ ID NO: 1177365 - RNA, 19 nt, Mycobacterium bovis subsp bovis AF2122/97
gcgccgccggcucgccggc

SEQ ID NO: 1177366 - RNA, 15 nt, Mycobacterium bovis subsp bovis AF2122/97
gcgccgccggcggcg

SEQ ID NO: 1177367 - RNA, 17 nt, Mycobacterium bovis subsp bovis AF2122/97
gcgccgccggcggcggu

SEQ ID NO: 1177368 - RNA, 18 nt, Mycobacterium bovis subsp bovis AF2122/97
gcgccgccucgggcaccu

SEQ ID NO: 1177369 - RNA, 19 nt, Mycobacterium bovis subsp bovis AF2122/97
gcgccgccguuaccgccgg

SEQ ID NO: 1177370 - RNA, 20 nt, Mycobacterium bovis subsp bovis AF2122/97
gcgccgccguuaccgccggc

SEQ ID NO: 1177371 - RNA, 21 nt, Mycobacterium bovis subsp bovis AF2122/97
gcgccgccguuaccgccggcg

SEQ ID NO: 1177372 - RNA, 21 nt, Mycobacterium bovis subsp bovis AF2122/97
gcgccgccguucccgccggcg

SEQ ID NO: 1177373 - RNA, 16 nt, Mycobacterium bovis subsp bovis AF2122/97
gcgccgcccgcgccac

SEQ ID NO: 1177374 - RNA, 15 nt, Mycobacterium bovis subsp bovis AF2122/97
gcgccgcccagcauc

SEQ ID NO: 1177375 - RNA, 19 nt, Mycobacterium bovis subsp bovis AF2122/97
gcgccgcccgcgcccccgg

SEQ ID NO: 1177376 - RNA, 17 nt, Mycobacterium bovis subsp bovis AF2122/97
gcgccgccggcgccggc

SEQ ID NO: 1177377 - RNA, 22 nt, Mycobacterium bovis subsp bovis AF2122/97
gcgccgccgcgagcgccggccg

SEQ ID NO: 1177378 - RNA, 22 nt, Mycobacterium bovis subsp bovis AF2122/97
gcgccgccggaagcgccggccg

SEQ ID NO: 1177379 - RNA, 20 nt, Mycobacterium bovis subsp bovis AF2122/97
gcgccgccggcacccgccgu

SEQ ID NO: 1177380 - RNA, 15 nt, Mycobacterium bovis subsp bovis AF2122/97
gcgccgccggcaccg

SEQ ID NO: 1177381 - RNA, 17 nt, Mycobacterium bovis subsp bovis AF2122/97
gcgccgccggcaccgcc

SEQ ID NO: 1177382 - RNA, 20 nt, Mycobacterium bovis subsp bovis AF2122/97
gcgccgcccuugccgccggc

SEQ ID NO: 1177383 - RNA, 10 nt, Mycobacterium bovis subsp bovis AF2122/97
gcgccgccgc

SEQ ID NO: 1177384 - RNA, 13 nt, Mycobacterium bovis subsp bovis AF2122/97
gcgccgccgaucc

SEQ ID NO: 1177385 - RNA, 16 nt, Mycobacterium bovis subsp bovis AF2122/97
gcgcccugcgccacac

SEQ ID NO: 1177386 - RNA, 14 nt, Mycobacterium bovis subsp bovis AF2122/97
gcgcccuccuuggc

SEQ ID NO: 1177387 - RNA, 15 nt, Mycobacterium bovis subsp bovis AF2122/97
gcgcccuggccgccc

SEQ ID NO: 1177388 - RNA, 16 nt, Mycobacterium bovis subsp bovis AF2122/97
gcgcccuggccgcccu

SEQ ID NO: 1177389 - RNA, 20 nt, Mycobacterium bovis subsp bovis AF2122/97
gcgccgaaaccacuuccggc

SEQ ID NO: 1177390 - RNA, 16 nt, Mycobacterium bovis subsp bovis AF2122/97
gcgccgaacaccacac

SEQ ID NO: 1177391 - RNA, 17 nt, Mycobacterium bovis subsp bovis AF2122/97
gcgccgaaucgcgggcu

SEQ ID NO: 1177392 - RNA, 14 nt, Mycobacterium bovis subsp bovis AF2122/97
gcgccgaaggccgc

SEQ ID NO: 1177393 - RNA, 18 nt, Mycobacterium bovis subsp bovis AF2122/97
gcgccgaaguagccgacc

SEQ ID NO: 1177394 - RNA, 22 nt, Mycobacterium bovis subsp bovis AF2122/97
gcgccgaccagaacgacgccgc

SEQ ID NO: 1177395 - RNA, 15 nt, Mycobacterium bovis subsp bovis AF2122/97
gcgccgaauggcggu

SEQ ID NO: 1177396 - RNA, 12 nt, Mycobacterium bovis subsp bovis AF2122/97
gcgccgaccaca

SEQ ID NO: 1177397 - RNA, 18 nt, Mycobacterium bovis subsp bovis AF2122/97
gcgccgacccgcgcgccg

SEQ ID NO: 1177398 - RNA, 17 nt, Mycobacterium bovis subsp bovis AF2122/97
gcgccgacccgcgcgcc

SEQ ID NO: 1177399 - RNA, 21 nt, Mycobacterium bovis subsp bovis AF2122/97
gcgccgacccgcgcgccggcg

SEQ ID NO: 1177400 - RNA, 20 nt, Mycobacterium bovis subsp bovis AF2122/97
gcgccgacccgcgcgccggc

SEQ ID NO: 1177401 - RNA, 15 nt, Mycobacterium bovis subsp bovis AF2122/97
gcgccgagcucggcg

SEQ ID NO: 1177402 - RNA, 23 nt, Mycobacterium bovis subsp bovis AF2122/97
gcgccgagcccgggccguacggc

SEQ ID NO: 1177403 - RNA, 20 nt, Mycobacterium bovis subsp bovis AF2122/97
gcgccgacggugcaagcccu

SEQ ID NO: 1177404 - RNA, 18 nt, Mycobacterium bovis subsp bovis AF2122/97
gcgccgacggccagcagg

SEQ ID NO: 1177405 - RNA, 17 nt, Mycobacterium bovis subsp bovis AF2122/97
gcgccgcacccgggacg

SEQ ID NO: 1177406 - RNA, 19 nt, Mycobacterium bovis subsp bovis AF2122/97
gcgccgcagagcaccgcga

SEQ ID NO: 1177407 - RNA, 14 nt, Mycobacterium bovis subsp bovis AF2122/97
gcgccgcagggccg

SEQ ID NO: 1177408 - RNA, 19 nt, Mycobacterium bovis subsp bovis AF2122/97
gcgccgcagaucaccgcca

SEQ ID NO: 1177409 - RNA, 21 nt, Mycobacterium bovis subsp bovis AF2122/97
gcgccgccaccgaagccgccg

SEQ ID NO: 1177410 - RNA, 22 nt, Mycobacterium bovis subsp bovis AF2122/97
gcgccgccaccgaagccgccgg

SEQ ID NO: 1177411 - RNA, 23 nt, Mycobacterium bovis subsp bovis AF2122/97
gcgccgccacgguacauccagag

SEQ ID NO: 1177412 - RNA, 17 nt, Mycobacterium bovis subsp bovis AF2122/97
gcgccgccaagggcccc

SEQ ID NO: 1177413 - RNA, 19 nt, Mycobacterium bovis subsp bovis AF2122/97
gcgccgccacagcacccac

SEQ ID NO: 1177414 - RNA, 20 nt, Mycobacterium bovis subsp bovis AF2122/97
gcgccgccagcgccgccggc

SEQ ID NO: 1177415 - RNA, 21 nt, Mycobacterium bovis subsp bovis AF2122/97
gcgccgccagcgccgccggcg

SEQ ID NO: 1177416 - RNA, 17 nt, Mycobacterium bovis subsp bovis AF2122/97
gcgccgccacugccggc

SEQ ID NO: 1177417 - RNA, 20 nt, Mycobacterium bovis subsp bovis AF2122/97
gcgccgccacugccggcagc

SEQ ID NO: 1177418 - RNA, 15 nt, Mycobacterium bovis subsp bovis AF2122/97
gcgccgccagcacca

SEQ ID NO: 1177419 - RNA, 17 nt, Mycobacterium bovis subsp bovis AF2122/97
gcgccgauguggccggc

SEQ ID NO: 1177420 - RNA, 23 nt, Mycobacterium bovis subsp bovis AF2122/97
gcgccgaucacggugggcgccga

SEQ ID NO: 1177421 - RNA, 22 nt, Mycobacterium bovis subsp bovis AF2122/97
gcgccgauuccaccgccgacgc

SEQ ID NO: 1177422 - RNA, 20 nt, Mycobacterium bovis subsp bovis AF2122/97
gcgccgaguugcccgggucg

SEQ ID NO: 1177423 - RNA, 19 nt, Mycobacterium bovis subsp bovis AF2122/97
gcgccgaucacggugggcg

SEQ ID NO: 1177424 - RNA, 17 nt, Mycobacterium bovis subsp bovis AF2122/97
gcgccgauaccggcggc

SEQ ID NO: 1177425 - RNA, 20 nt, Mycobacterium bovis subsp bovis AF2122/97
gcgccgaguuguucgcccac

SEQ ID NO: 1177426 - RNA, 18 nt, Mycobacterium bovis subsp bovis AF2122/97
gcgccgauacccagcggg

SEQ ID NO: 1177427 - RNA, 16 nt, Mycobacterium bovis subsp bovis AF2122/97
gcgccccuggcaccuc

SEQ ID NO: 1177428 - RNA, 17 nt, Mycobacterium bovis subsp bovis AF2122/97
gcgccccaugcaacaca

SEQ ID NO: 1177429 - RNA, 18 nt, Mycobacterium bovis subsp bovis AF2122/97
gcgcccccagcagcugcg

SEQ ID NO: 1177430 - RNA, 15 nt, Mycobacterium bovis subsp bovis AF2122/97
gcgcccagaucgccg

SEQ ID NO: 1177431 - RNA, 23 nt, Mycobacterium bovis subsp bovis AF2122/97
gcgcccagcgcuagccgggcgcg

SEQ ID NO: 1177432 - RNA, 16 nt, Mycobacterium bovis subsp bovis AF2122/97
gcgcccauggccacca

SEQ ID NO: 1177433 - RNA, 15 nt, Mycobacterium bovis subsp bovis AF2122/97
gcgcccauagcugcc

SEQ ID NO: 1177434 - RNA, 18 nt, Mycobacterium bovis subsp bovis AF2122/97
gcgcccauagcugccggc

SEQ ID NO: 1177435 - RNA, 20 nt, Mycobacterium bovis subsp bovis AF2122/97
gcgcccauagcugccggccc

SEQ ID NO: 1177436 - RNA, 18 nt, Mycobacterium bovis subsp bovis AF2122/97
gcgcccgccggcaaccgg

SEQ ID NO: 1177437 - RNA, 12 nt, Mycobacterium bovis subsp bovis AF2122/97
gcgcccgccggc

SEQ ID NO: 1177438 - RNA, 15 nt, Mycobacterium bovis subsp bovis AF2122/97
gcgcccgccgcggca

SEQ ID NO: 1177439 - RNA, 14 nt, Mycobacterium bovis subsp bovis AF2122/97
gcgcccgccgcggc

SEQ ID NO: 1177440 - RNA, 13 nt, Mycobacterium bovis subsp bovis AF2122/97
gcgcccgcgcggc

SEQ ID NO: 1177441 - RNA, 23 nt, Mycobacterium bovis subsp bovis AF2122/97
gcgcccgccgcgaacuccagcag

SEQ ID NO: 1177442 - RNA, 16 nt, Mycobacterium bovis subsp bovis AF2122/97
gcgcccgccaucagcc

SEQ ID NO: 1177443 - RNA, 14 nt, Mycobacterium bovis subsp bovis AF2122/97
gcgcccgcaccacc

SEQ ID NO: 1177444 - RNA, 20 nt, Mycobacterium bovis subsp bovis AF2122/97
gcgcccgaagccgggcccca

SEQ ID NO: 1177445 - RNA, 21 nt, Mycobacterium bovis subsp bovis AF2122/97
gcgcccgggaucggggcaccg

SEQ ID NO: 1177446 - RNA, 21 nt, Mycobacterium bovis subsp bovis AF2122/97
gcgcccgggcauccuucacca

SEQ ID NO: 1177447 - RNA, 19 nt, Mycobacterium bovis subsp bovis AF2122/97
gcgcccgggucccggcagc

SEQ ID NO: 1177448 - RNA, 17 nt, Mycobacterium bovis subsp bovis AF2122/97
gcgcccguccgcgcgcc

SEQ ID NO: 1177449 - RNA, 15 nt, Mycobacterium bovis subsp bovis AF2122/97
gcgcccgugccgccc

SEQ ID NO: 1177450 - RNA, 18 nt, Mycobacterium bovis subsp bovis AF2122/97
gcgcccucagccgcggcc

SEQ ID NO: 1177451 - RNA, 19 nt, Mycobacterium bovis subsp bovis AF2122/97
gcgcccggccaagccggcg

SEQ ID NO: 1177452 - RNA, 17 nt, Mycobacterium bovis subsp bovis AF2122/97
gcgcccggcccgccacc

SEQ ID NO: 1177453 - RNA, 20 nt, Mycobacterium bovis subsp bovis AF2122/97
gcgcccgcucggccgcagcc

SEQ ID NO: 1177454 - RNA, 22 nt, Mycobacterium bovis subsp bovis AF2122/97
gcgcccgcucggccgcagccag

SEQ ID NO: 1177455 - RNA, 12 nt, Mycobacterium bovis subsp bovis AF2122/97
gcgccaggaacc

SEQ ID NO: 1177456 - RNA, 20 nt, Mycobacterium bovis subsp bovis AF2122/97
gcgccagcguuaggucgccg

SEQ ID NO: 1177457 - RNA, 18 nt, Mycobacterium bovis subsp bovis AF2122/97
gcgccaggagcgcggccc

SEQ ID NO: 1177458 - RNA, 23 nt, Mycobacterium bovis subsp bovis AF2122/97
gcgccaggagcgcggcccgccuc

SEQ ID NO: 1177459 - RNA, 13 nt, Mycobacterium bovis subsp bovis AF2122/97
gcgccaggccacg

SEQ ID NO: 1177460 - RNA, 19 nt, Mycobacterium bovis subsp bovis AF2122/97
gcgccaggcgcgaucgcgc

SEQ ID NO: 1177461 - RNA, 15 nt, Mycobacterium bovis subsp bovis AF2122/97
gcgccaggggugugc

SEQ ID NO: 1177462 - RNA, 13 nt, Mycobacterium bovis subsp bovis AF2122/97
gcgccaggucggu

SEQ ID NO: 1177463 - RNA, 17 nt, Mycobacterium bovis subsp bovis AF2122/97
gcgccaggccgcacagc

SEQ ID NO: 1177464 - RNA, 13 nt, Mycobacterium bovis subsp bovis AF2122/97
gcgccaggucagc

SEQ ID NO: 1177465 - RNA, 23 nt, Mycobacterium bovis subsp bovis AF2122/97
gcgccauaauauugccgccuccg

SEQ ID NO: 1177466 - RNA, 20 nt, Mycobacterium bovis subsp bovis AF2122/97
gcgccaguguggugcggcgc

SEQ ID NO: 1177467 - RNA, 20 nt, Mycobacterium bovis subsp bovis AF2122/97
gcgcccaccggcuagcugug

SEQ ID NO: 1177468 - RNA, 16 nt, Mycobacterium bovis subsp bovis AF2122/97
gcgcccagaccgaccc

SEQ ID NO: 1177469 - RNA, 16 nt, Mycobacterium bovis subsp bovis AF2122/97
gcgcccaccgggcggc

SEQ ID NO: 1177470 - RNA, 21 nt, Mycobacterium bovis subsp bovis AF2122/97
gcgccauucccgguggcugug

SEQ ID NO: 1177471 - RNA, 19 nt, Mycobacterium bovis subsp bovis AF2122/97
gcgcccaacgcgggugccg

SEQ ID NO: 1177472 - RNA, 15 nt, Mycobacterium bovis subsp bovis AF2122/97
gcgccaucgccucca

SEQ ID NO: 1177473 - RNA, 16 nt, Mycobacterium bovis subsp bovis AF2122/97
gcgccauccccgccgg

SEQ ID NO: 1177474 - RNA, 22 nt, Mycobacterium bovis subsp bovis AF2122/97
gcgccaucacaucggccucuga

SEQ ID NO: 1177475 - RNA, 21 nt, Mycobacterium bovis subsp bovis AF2122/97
gcccggcauuaggccgggguc

SEQ ID NO: 1177476 - RNA, 14 nt, Mycobacterium bovis subsp bovis AF2122/97
gcccggccagccgc

SEQ ID NO: 1177477 - RNA, 22 nt, Mycobacterium bovis subsp bovis AF2122/97
gcccggccagccgcacgguugc

SEQ ID NO: 1177478 - RNA, 16 nt, Mycobacterium bovis subsp bovis AF2122/97
gcccggccccgcaagc

SEQ ID NO: 1177479 - RNA, 15 nt, Mycobacterium bovis subsp bovis AF2122/97
gcccggccccgcggc

SEQ ID NO: 1177480 - RNA, 13 nt, Mycobacterium bovis subsp bovis AF2122/97
gcccggcccgccc

SEQ ID NO: 1177481 - RNA, 11 nt, Mycobacterium bovis subsp bovis AF2122/97
gcccggccgcg

SEQ ID NO: 1177482 - RNA, 12 nt, Mycobacterium bovis subsp bovis AF2122/97
gcccggccgcgc

SEQ ID NO: 1177483 - RNA, 14 nt, Mycobacterium bovis subsp bovis AF2122/97
gcccggccgcgccc

SEQ ID NO: 1177484 - RNA, 18 nt, Mycobacterium bovis subsp bovis AF2122/97
gcccggccugcuggucac

SEQ ID NO: 1177485 - RNA, 16 nt, Mycobacterium bovis subsp bovis AF2122/97
gcccggccuugccgcc

SEQ ID NO: 1177486 - RNA, 21 nt, Mycobacterium bovis subsp bovis AF2122/97
gcccggccuugccgccggccc

SEQ ID NO: 1177487 - RNA, 22 nt, Mycobacterium bovis subsp bovis AF2122/97
gcccggcgcaccaucgcggccg

SEQ ID NO: 1177488 - RNA, 20 nt, Mycobacterium bovis subsp bovis AF2122/97
gcccggcgagcuaacacccg

SEQ ID NO: 1177489 - RNA, 23 nt, Mycobacterium bovis subsp bovis AF2122/97
gcccggcgagcuaacacccgagc

SEQ ID NO: 1177490 - RNA, 21 nt, Mycobacterium bovis subsp bovis AF2122/97
gcccggcgauaaacccgaggc

SEQ ID NO: 1177491 - RNA, 16 nt, Mycobacterium bovis subsp bovis AF2122/97
gcccggccaagccggc

SEQ ID NO: 1177492 - RNA, 18 nt, Mycobacterium bovis subsp bovis AF2122/97
gcccggccaaaauggcgc

SEQ ID NO: 1177493 - RNA, 22 nt, Mycobacterium bovis subsp bovis AF2122/97
gcccggcuuuugcgcccagcac

SEQ ID NO: 1177494 - RNA, 23 nt, Mycobacterium bovis subsp bovis AF2122/97
gcccgggauaguuuucggccgcc

SEQ ID NO: 1177495 - RNA, 19 nt, Mycobacterium bovis subsp bovis AF2122/97
gcccgggaucggggcaccg

SEQ ID NO: 1177496 - RNA, 13 nt, Mycobacterium bovis subsp bovis AF2122/97
gcccgggccaccg

SEQ ID NO: 1177497 - RNA, 20 nt, Mycobacterium bovis subsp bovis AF2122/97
gcccggcuccuccccggccc

SEQ ID NO: 1177498 - RNA, 16 nt, Mycobacterium bovis subsp bovis AF2122/97
gcccggcucacagcac

SEQ ID NO: 1177499 - RNA, 16 nt, Mycobacterium bovis subsp bovis AF2122/97
gcccggccgccagcgc

SEQ ID NO: 1177500 - RNA, 15 nt, Mycobacterium bovis subsp bovis AF2122/97
gcccggcgcggccgc

SEQ ID NO: 1177501 - RNA, 13 nt, Mycobacterium bovis subsp bovis AF2122/97
gcccggcgcgccg

SEQ ID NO: 1177502 - RNA, 15 nt, Mycobacterium bovis subsp bovis AF2122/97
gcccggcggccgcuu

SEQ ID NO: 1177503 - RNA, 20 nt, Mycobacterium bovis subsp bovis AF2122/97
gcccggcgugucgccgccac

SEQ ID NO: 1177504 - RNA, 23 nt, Mycobacterium bovis subsp bovis AF2122/97
gcccggcguuguugaccagcacg

SEQ ID NO: 1177505 - RNA, 21 nt, Mycobacterium bovis subsp bovis AF2122/97
gcccggcgugucgccgccacc

SEQ ID NO: 1177506 - RNA, 22 nt, Mycobacterium bovis subsp bovis AF2122/97
gcccggcgugucgccgccacca

SEQ ID NO: 1177507 - RNA, 13 nt, Mycobacterium bovis subsp bovis AF2122/97
gcccgcugagcca

SEQ ID NO: 1177508 - RNA, 19 nt, Mycobacterium bovis subsp bovis AF2122/97
gcccgcugaucagauccuc

SEQ ID NO: 1177509 - RNA, 14 nt, Mycobacterium bovis subsp bovis AF2122/97
gcccgcugcagacg

SEQ ID NO: 1177510 - RNA, 20 nt, Mycobacterium bovis subsp bovis AF2122/97
gcccgcucggaugaguagca

SEQ ID NO: 1177511 - RNA, 22 nt, Mycobacterium bovis subsp bovis AF2122/97
gcccgcugaccaucacacccau

SEQ ID NO: 1177512 - RNA, 18 nt, Mycobacterium bovis subsp bovis AF2122/97
gcccgcuggccuccugga

SEQ ID NO: 1177513 - RNA, 19 nt, Mycobacterium bovis subsp bovis AF2122/97
gcccgcugcgccgggucug

SEQ ID NO: 1177514 - RNA, 17 nt, Mycobacterium bovis subsp bovis AF2122/97
gcccgcuccgggaccca

SEQ ID NO: 1177515 - RNA, 14 nt, Mycobacterium bovis subsp bovis AF2122/97
gcccgcuccgcggc

SEQ ID NO: 1177516 - RNA, 17 nt, Mycobacterium bovis subsp bovis AF2122/97
gcccgcucaacgggccg

SEQ ID NO: 1177517 - RNA, 13 nt, Mycobacterium bovis subsp bovis AF2122/97
gcccgcucggccg

SEQ ID NO: 1177518 - RNA, 18 nt, Mycobacterium bovis subsp bovis AF2122/97
gcccgcucggccgcagcc

SEQ ID NO: 1177519 - RNA, 14 nt, Mycobacterium bovis subsp bovis AF2122/97
gcccgcucauaccg

SEQ ID NO: 1177520 - RNA, 20 nt, Mycobacterium bovis subsp bovis AF2122/97
gcccggaccacuguuggugc

SEQ ID NO: 1177521 - RNA, 14 nt, Mycobacterium bovis subsp bovis AF2122/97
gcccggacaugcgg

SEQ ID NO: 1177522 - RNA, 18 nt, Mycobacterium bovis subsp bovis AF2122/97
gcccggacgcaacacccg

SEQ ID NO: 1177523 - RNA, 15 nt, Mycobacterium bovis subsp bovis AF2122/97
gcccggaacccgagc

SEQ ID NO: 1177524 - RNA, 18 nt, Mycobacterium bovis subsp bovis AF2122/97
gcccggaaccggcgugca

SEQ ID NO: 1177525 - RNA, 15 nt, Mycobacterium bovis subsp bovis AF2122/97
gcccgcuucagcacg

SEQ ID NO: 1177526 - RNA, 11 nt, Mycobacterium bovis subsp bovis AF2122/97
gcccgcuggcc

SEQ ID NO: 1177527 - RNA, 18 nt, Mycobacterium bovis subsp bovis AF2122/97
gcccgcugggcucgcugc

SEQ ID NO: 1177528 - RNA, 19 nt, Mycobacterium bovis subsp bovis AF2122/97
gcccgcugggcucgcugca

SEQ ID NO: 1177529 - RNA, 19 nt, Mycobacterium bovis subsp bovis AF2122/97
gcccgcugggcuuggggcc

SEQ ID NO: 1177530 - RNA, 23 nt, Mycobacterium bovis subsp bovis AF2122/97
gcccgcgcggccaaucagcccgc

SEQ ID NO: 1177531 - RNA, 18 nt, Mycobacterium bovis subsp bovis AF2122/97
gcccgcgccgccgcuacc

SEQ ID NO: 1177532 - RNA, 20 nt, Mycobacterium bovis subsp bovis AF2122/97
gcccgcgaucucggagcgca

SEQ ID NO: 1177533 - RNA, 15 nt, Mycobacterium bovis subsp bovis AF2122/97
gcccgcgaggacagc

SEQ ID NO: 1177534 - RNA, 21 nt, Mycobacterium bovis subsp bovis AF2122/97
gcccgcgcagcgguccgccgc

SEQ ID NO: 1177535 - RNA, 18 nt, Mycobacterium bovis subsp bovis AF2122/97
gcccgcgccaccagcacc

SEQ ID NO: 1177536 - RNA, 17 nt, Mycobacterium bovis subsp bovis AF2122/97
gcccgcgccgccgccac

SEQ ID NO: 1177537 - RNA, 15 nt, Mycobacterium bovis subsp bovis AF2122/97
gcccgcgccaccggc

SEQ ID NO: 1177538 - RNA, 23 nt, Mycobacterium bovis subsp bovis AF2122/97
gcccgcgccaccagcaccgccgc

SEQ ID NO: 1177539 - RNA, 21 nt, Mycobacterium bovis subsp bovis AF2122/97
gcccgcguugccaaagcccac

SEQ ID NO: 1177540 - RNA, 21 nt, Mycobacterium bovis subsp bovis AF2122/97
gcccgcguuugcgaagcccac

SEQ ID NO: 1177541 - RNA, 18 nt, Mycobacterium bovis subsp bovis AF2122/97
gcccgcguucagggcacg

SEQ ID NO: 1177542 - RNA, 13 nt, Mycobacterium bovis subsp bovis AF2122/97
gcccgcguucucg

SEQ ID NO: 1177543 - RNA, 18 nt, Mycobacterium bovis subsp bovis AF2122/97
gcccgcguugccaaagcc

SEQ ID NO: 1177544 - RNA, 21 nt, Mycobacterium bovis subsp bovis AF2122/97
gcccgcgggcaguggcagccc

SEQ ID NO: 1177545 - RNA, 13 nt, Mycobacterium bovis subsp bovis AF2122/97
gcccgcguucagg

SEQ ID NO: 1177546 - RNA, 21 nt, Mycobacterium bovis subsp bovis AF2122/97
gcccgcgaacgaucccgccga

SEQ ID NO: 1177547 - RNA, 16 nt, Mycobacterium bovis subsp bovis AF2122/97
gcccgcccagcccggc

SEQ ID NO: 1177548 - RNA, 16 nt, Mycobacterium bovis subsp bovis AF2122/97
gcccgccccgcgccuu

SEQ ID NO: 1177549 - RNA, 19 nt, Mycobacterium bovis subsp bovis AF2122/97
gcccgcccgucuuccagcc

SEQ ID NO: 1177550 - RNA, 14 nt, Mycobacterium bovis subsp bovis AF2122/97
gcccgccgccacca

SEQ ID NO: 1177551 - RNA, 16 nt, Mycobacterium bovis subsp bovis AF2122/97
gcccgacugccguuca

SEQ ID NO: 1177552 - RNA, 15 nt, Mycobacterium bovis subsp bovis AF2122/97
gcccgagauccccaa

SEQ ID NO: 1177553 - RNA, 15 nt, Mycobacterium bovis subsp bovis AF2122/97
gcccgagcccagcgc

SEQ ID NO: 1177554 - RNA, 17 nt, Mycobacterium bovis subsp bovis AF2122/97
gcccgaggcucgggccg

SEQ ID NO: 1177555 - RNA, 13 nt, Mycobacterium bovis subsp bovis AF2122/97
gcccgaggcgaga

SEQ ID NO: 1177556 - RNA, 14 nt, Mycobacterium bovis subsp bovis AF2122/97
gcccgagcucgccg

SEQ ID NO: 1177557 - RNA, 18 nt, Mycobacterium bovis subsp bovis AF2122/97
gcccgagcucgccgcagc

SEQ ID NO: 1177558 - RNA, 16 nt, Mycobacterium bovis subsp bovis AF2122/97
gcccgaucgaagaaac

SEQ ID NO: 1177559 - RNA, 14 nt, Mycobacterium bovis subsp bovis AF2122/97
gcccgaucgcuucc

SEQ ID NO: 1177560 - RNA, 14 nt, Mycobacterium bovis subsp bovis AF2122/97
gcccgcccagcccg

SEQ ID NO: 1177561 - RNA, 24 nt, Mycobacterium bovis subsp bovis AF2122/97
gcccgaugaggacauccggcgccg

SEQ ID NO: 1177562 - RNA, 14 nt, Mycobacterium bovis subsp bovis AF2122/97
gcccgaucaccauc

SEQ ID NO: 1177563 - RNA, 22 nt, Mycobacterium bovis subsp bovis AF2122/97
gcccgaucaccauccagcccau

SEQ ID NO: 1177564 - RNA, 19 nt, Mycobacterium bovis subsp bovis AF2122/97
gcccgaguuaaacgcagcg

SEQ ID NO: 1177565 - RNA, 16 nt, Mycobacterium bovis subsp bovis AF2122/97
gcccgaguugaagaag

SEQ ID NO: 1177566 - RNA, 16 nt, Mycobacterium bovis subsp bovis AF2122/97
gcccgaguuguuggug

SEQ ID NO: 1177567 - RNA, 18 nt, Mycobacterium bovis subsp bovis AF2122/97
gccccgggggaagcgcca

SEQ ID NO: 1177568 - RNA, 12 nt, Mycobacterium bovis subsp bovis AF2122/97
gccccggggugc

SEQ ID NO: 1177569 - RNA, 17 nt, Mycobacterium bovis subsp bovis AF2122/97
gccccgguggcagggaa

SEQ ID NO: 1177570 - RNA, 16 nt, Mycobacterium bovis subsp bovis AF2122/97
gccccggucggcgacg

SEQ ID NO: 1177571 - RNA, 21 nt, Mycobacterium bovis subsp bovis AF2122/97
gccccguugagcagcacccau

SEQ ID NO: 1177572 - RNA, 18 nt, Mycobacterium bovis subsp bovis AF2122/97
gccccuucaaagcggccu

SEQ ID NO: 1177573 - RNA, 23 nt, Mycobacterium bovis subsp bovis AF2122/97
gcccgacgugaagccaagcgacu

SEQ ID NO: 1177574 - RNA, 21 nt, Mycobacterium bovis subsp bovis AF2122/97
gcccgacugccguucagcggc

SEQ ID NO: 1177575 - RNA, 15 nt, Mycobacterium bovis subsp bovis AF2122/97
gcccgacgccagcug

SEQ ID NO: 1177576 - RNA, 16 nt, Mycobacterium bovis subsp bovis AF2122/97
gcccgacgccagcugc

SEQ ID NO: 1177577 - RNA, 17 nt, Mycobacterium bovis subsp bovis AF2122/97
gcccgacgccagcugcc

SEQ ID NO: 1177578 - RNA, 16 nt, Mycobacterium bovis subsp bovis AF2122/97
gcccgacgccggucac

SEQ ID NO: 1177579 - RNA, 21 nt, Mycobacterium bovis subsp bovis AF2122/97
gcccgacgagauugccgggcc

SEQ ID NO: 1177580 - RNA, 15 nt, Mycobacterium bovis subsp bovis AF2122/97
gcccgaaggcggcuc

SEQ ID NO: 1177581 - RNA, 14 nt, Mycobacterium bovis subsp bovis AF2122/97
gcccgacgagauug

SEQ ID NO: 1177582 - RNA, 15 nt, Mycobacterium bovis subsp bovis AF2122/97
gccccuuucugaagc

SEQ ID NO: 1177583 - RNA, 16 nt, Mycobacterium bovis subsp bovis AF2122/97
gccccuuuugccgcag

SEQ ID NO: 1177584 - RNA, 20 nt, Mycobacterium bovis subsp bovis AF2122/97
gcccgaagacgggguggugg

SEQ ID NO: 1177585 - RNA, 16 nt, Mycobacterium bovis subsp bovis AF2122/97
gcccgaagccgggccc

SEQ ID NO: 1177586 - RNA, 14 nt, Mycobacterium bovis subsp bovis AF2122/97
gccccgccgccaua

SEQ ID NO: 1177587 - RNA, 12 nt, Mycobacterium bovis subsp bovis AF2122/97
gccccgccgagc

SEQ ID NO: 1177588 - RNA, 13 nt, Mycobacterium bovis subsp bovis AF2122/97
gccccgccgagca

SEQ ID NO: 1177589 - RNA, 19 nt, Mycobacterium bovis subsp bovis AF2122/97
gccccgccgaugccgccgg

SEQ ID NO: 1177590 - RNA, 22 nt, Mycobacterium bovis subsp bovis AF2122/97
gccccgccgaugccgccggccc

SEQ ID NO: 1177591 - RNA, 14 nt, Mycobacterium bovis subsp bovis AF2122/97
gccccgccgcacgc

SEQ ID NO: 1177592 - RNA, 14 nt, Mycobacterium bovis subsp bovis AF2122/97
gccccgccgcuacc

SEQ ID NO: 1177593 - RNA, 16 nt, Mycobacterium bovis subsp bovis AF2122/97
gccccgccggcgccgc

SEQ ID NO: 1177594 - RNA, 18 nt, Mycobacterium bovis subsp bovis AF2122/97
gccccgccggcgccgccc

SEQ ID NO: 1177595 - RNA, 13 nt, Mycobacterium bovis subsp bovis AF2122/97
gccccgccggccc

SEQ ID NO: 1177596 - RNA, 19 nt, Mycobacterium bovis subsp bovis AF2122/97
gccccgccgucacccccga

SEQ ID NO: 1177597 - RNA, 15 nt, Mycobacterium bovis subsp bovis AF2122/97
gccccgccguuaccg

SEQ ID NO: 1177598 - RNA, 17 nt, Mycobacterium bovis subsp bovis AF2122/97
gccccgccguugccgcc

SEQ ID NO: 1177599 - RNA, 16 nt, Mycobacterium bovis subsp bovis AF2122/97
gcccccuggauggcgc

SEQ ID NO: 1177600 - RNA, 23 nt, Mycobacterium bovis subsp bovis AF2122/97
gcccccuggauggcgcccugcgc

SEQ ID NO: 1177601 - RNA, 20 nt, Mycobacterium bovis subsp bovis AF2122/97
gcccccguucuggaaccccg

SEQ ID NO: 1177602 - RNA, 21 nt, Mycobacterium bovis subsp bovis AF2122/97
gcccccguucuggaaccccga

SEQ ID NO: 1177603 - RNA, 20 nt, Mycobacterium bovis subsp bovis AF2122/97
gcccccguuuacggcccggc

SEQ ID NO: 1177604 - RNA, 13 nt, Mycobacterium bovis subsp bovis AF2122/97
gccccgccagcgc

SEQ ID NO: 1177605 - RNA, 23 nt, Mycobacterium bovis subsp bovis AF2122/97
gccccgaaacgauggccgggucg

SEQ ID NO: 1177606 - RNA, 18 nt, Mycobacterium bovis subsp bovis AF2122/97
gccccgaagccggugccg

SEQ ID NO: 1177607 - RNA, 17 nt, Mycobacterium bovis subsp bovis AF2122/97
gccccggcgcggccagc

SEQ ID NO: 1177608 - RNA, 14 nt, Mycobacterium bovis subsp bovis AF2122/97
gccccggcgcuggu

SEQ ID NO: 1177609 - RNA, 20 nt, Mycobacterium bovis subsp bovis AF2122/97
gccccggcauugcccgagcc

SEQ ID NO: 1177610 - RNA, 16 nt, Mycobacterium bovis subsp bovis AF2122/97
gccccgccgucacccc

SEQ ID NO: 1177611 - RNA, 17 nt, Mycobacterium bovis subsp bovis AF2122/97
gccccgccuuggccacc

SEQ ID NO: 1177612 - RNA, 18 nt, Mycobacterium bovis subsp bovis AF2122/97
gccccgccuuggccacca

SEQ ID NO: 1177613 - RNA, 16 nt, Mycobacterium bovis subsp bovis AF2122/97
gcccccggugccgccc

SEQ ID NO: 1177614 - RNA, 15 nt, Mycobacterium bovis subsp bovis AF2122/97
gcccccggcgcggcg

SEQ ID NO: 1177615 - RNA, 22 nt, Mycobacterium bovis subsp bovis AF2122/97
gcccccgcgggggcggccggcg

SEQ ID NO: 1177616 - RNA, 13 nt, Mycobacterium bovis subsp bovis AF2122/97
gcccccgccggcc

SEQ ID NO: 1177617 - RNA, 14 nt, Mycobacterium bovis subsp bovis AF2122/97
gcccccgccggccg

SEQ ID NO: 1177618 - RNA, 23 nt, Mycobacterium bovis subsp bovis AF2122/97
gcccccgccggccgcgccggccc

SEQ ID NO: 1177619 - RNA, 17 nt, Mycobacterium bovis subsp bovis AF2122/97
gccccaugcaacacacc

SEQ ID NO: 1177620 - RNA, 15 nt, Mycobacterium bovis subsp bovis AF2122/97
gccccaugcgccagc

SEQ ID NO: 1177621 - RNA, 22 nt, Mycobacterium bovis subsp bovis AF2122/97
gccccauucguaucccgcaaac

SEQ ID NO: 1177622 - RNA, 21 nt, Mycobacterium bovis subsp bovis AF2122/97
gcccccaacgcgguaaagccc

SEQ ID NO: 1177623 - RNA, 22 nt, Mycobacterium bovis subsp bovis AF2122/97
gcccccaacgcgguaaagcccc

SEQ ID NO: 1177624 - RNA, 23 nt, Mycobacterium bovis subsp bovis AF2122/97
gcccccaacgcgguaaagccccg

SEQ ID NO: 1177625 - RNA, 11 nt, Mycobacterium bovis subsp bovis AF2122/97
gcccauggcgu

SEQ ID NO: 1177626 - RNA, 19 nt, Mycobacterium bovis subsp bovis AF2122/97
gcccauggcgucgaaccag

SEQ ID NO: 1177627 - RNA, 17 nt, Mycobacterium bovis subsp bovis AF2122/97
gcccauugacguagacc

SEQ ID NO: 1177628 - RNA, 22 nt, Mycobacterium bovis subsp bovis AF2122/97
gcccacgcgcacucgaccagga

SEQ ID NO: 1177629 - RNA, 15 nt, Mycobacterium bovis subsp bovis AF2122/97
gcccaccuggggccg

SEQ ID NO: 1177630 - RNA, 19 nt, Mycobacterium bovis subsp bovis AF2122/97
gcccaccucgaucgcgccg

SEQ ID NO: 1177631 - RNA, 18 nt, Mycobacterium bovis subsp bovis AF2122/97
gcccaccuccucgccgga

SEQ ID NO: 1177632 - RNA, 15 nt, Mycobacterium bovis subsp bovis AF2122/97
gcccaccgucugcug

SEQ ID NO: 1177633 - RNA, 23 nt, Mycobacterium bovis subsp bovis AF2122/97
gcccaccucaccgaucucgacca

SEQ ID NO: 1177634 - RNA, 14 nt, Mycobacterium bovis subsp bovis AF2122/97
gcccaccggccacu

SEQ ID NO: 1177635 - RNA, 18 nt, Mycobacterium bovis subsp bovis AF2122/97
gcccaccgggcggcggcg

SEQ ID NO: 1177636 - RNA, 21 nt, Mycobacterium bovis subsp bovis AF2122/97
gcccaccggugccgcccgcgc

SEQ ID NO: 1177637 - RNA, 16 nt, Mycobacterium bovis subsp bovis AF2122/97
gcccaccggucgccgc

SEQ ID NO: 1177638 - RNA, 17 nt, Mycobacterium bovis subsp bovis AF2122/97
gcccaccggugccgccc

SEQ ID NO: 1177639 - RNA, 20 nt, Mycobacterium bovis subsp bovis AF2122/97
gcccacggagggcaggagaa

SEQ ID NO: 1177640 - RNA, 19 nt, Mycobacterium bovis subsp bovis AF2122/97
gcccacggcgaccaggagc

SEQ ID NO: 1177641 - RNA, 16 nt, Mycobacterium bovis subsp bovis AF2122/97
gcccacguuggccccg

SEQ ID NO: 1177642 - RNA, 16 nt, Mycobacterium bovis subsp bovis AF2122/97
gcccacguggggccgg

SEQ ID NO: 1177643 - RNA, 18 nt, Mycobacterium bovis subsp bovis AF2122/97
gcccacguggggccgggg

SEQ ID NO: 1177644 - RNA, 18 nt, Mycobacterium bovis subsp bovis AF2122/97
gcccacguuuagggugcc

SEQ ID NO: 1177645 - RNA, 20 nt, Mycobacterium bovis subsp bovis AF2122/97
gcccagaaaaccgccgcaac

SEQ ID NO: 1177646 - RNA, 17 nt, Mycobacterium bovis subsp bovis AF2122/97
gcccagaaaaccgccgc

SEQ ID NO: 1177647 - RNA, 16 nt, Mycobacterium bovis subsp bovis AF2122/97
gcccacuccagcagcu

SEQ ID NO: 1177648 - RNA, 21 nt, Mycobacterium bovis subsp bovis AF2122/97
gcccacuccagcagcucgccg

SEQ ID NO: 1177649 - RNA, 17 nt, Mycobacterium bovis subsp bovis AF2122/97
gcccaccaggcccaucu

SEQ ID NO: 1177650 - RNA, 15 nt, Mycobacterium bovis subsp bovis AF2122/97
gcccaccagcgcagc

SEQ ID NO: 1177651 - RNA, 13 nt, Mycobacterium bovis subsp bovis AF2122/97
gcccaccaugauc

SEQ ID NO: 1177652 - RNA, 15 nt, Mycobacterium bovis subsp bovis AF2122/97
gcccacccacuggcg

SEQ ID NO: 1177653 - RNA, 17 nt, Mycobacterium bovis subsp bovis AF2122/97
gcccacccauggccucc

SEQ ID NO: 1177654 - RNA, 18 nt, Mycobacterium bovis subsp bovis AF2122/97
gcccaccggcgccgccgg

SEQ ID NO: 1177655 - RNA, 19 nt, Mycobacterium bovis subsp bovis AF2122/97
gcccaccggcgccgccggc

SEQ ID NO: 1177656 - RNA, 22 nt, Mycobacterium bovis subsp bovis AF2122/97
gcccaccgccguugggccgcgc

SEQ ID NO: 1177657 - RNA, 19 nt, Mycobacterium bovis subsp bovis AF2122/97
gcccaccgccugggcggcc

SEQ ID NO: 1177658 - RNA, 12 nt, Mycobacterium bovis subsp bovis AF2122/97
gcccaccgcaac

SEQ ID NO: 1177659 - RNA, 13 nt, Mycobacterium bovis subsp bovis AF2122/97
gcccaccgaaacc

SEQ ID NO: 1177660 - RNA, 16 nt, Mycobacterium bovis subsp bovis AF2122/97
gcccacaugcgcucgc

SEQ ID NO: 1177661 - RNA, 17 nt, Mycobacterium bovis subsp bovis AF2122/97
gcccaccacacagccgc

SEQ ID NO: 1177662 - RNA, 19 nt, Mycobacterium bovis subsp bovis AF2122/97
gcccaccacacagccgcgc

SEQ ID NO: 1177663 - RNA, 20 nt, Mycobacterium bovis subsp bovis AF2122/97
gcccacaugcucagggcagu

SEQ ID NO: 1177664 - RNA, 19 nt, Mycobacterium bovis subsp bovis AF2122/97
gcccaccacgcgacgcggg

SEQ ID NO: 1177665 - RNA, 12 nt, Mycobacterium bovis subsp bovis AF2122/97
gcccaccacugu

SEQ ID NO: 1177666 - RNA, 23 nt, Mycobacterium bovis subsp bovis AF2122/97
gcccaccacugugacacccgagg

SEQ ID NO: 1177667 - RNA, 15 nt, Mycobacterium bovis subsp bovis AF2122/97
gcccacacggucguc

SEQ ID NO: 1177668 - RNA, 20 nt, Mycobacterium bovis subsp bovis AF2122/97
gcccacacuaggccccacca

SEQ ID NO: 1177669 - RNA, 16 nt, Mycobacterium bovis subsp bovis AF2122/97
gcccacaggcggcgcu

SEQ ID NO: 1177670 - RNA, 17 nt, Mycobacterium bovis subsp bovis AF2122/97
gcccacagcuugcccga

SEQ ID NO: 1177671 - RNA, 18 nt, Mycobacterium bovis subsp bovis AF2122/97
gcccacauacagcggagg

SEQ ID NO: 1177672 - RNA, 23 nt, Mycobacterium bovis subsp bovis AF2122/97
gcccacaucgucggcgggcggca

SEQ ID NO: 1177673 - RNA, 15 nt, Mycobacterium bovis subsp bovis AF2122/97
gcccacaggggcagc

SEQ ID NO: 1177674 - RNA, 19 nt, Mycobacterium bovis subsp bovis AF2122/97
gcccacaggggcagcgcgg

SEQ ID NO: 1177675 - RNA, 20 nt, Mycobacterium bovis subsp bovis AF2122/97
gcccacaggggcagcgcggc

SEQ ID NO: 1177676 - RNA, 14 nt, Mycobacterium bovis subsp bovis AF2122/97
gcccaucacacccg

SEQ ID NO: 1177677 - RNA, 24 nt, Mycobacterium bovis subsp bovis AF2122/97
gcccaucccggccgaguaccagcc

SEQ ID NO: 1177678 - RNA, 14 nt, Mycobacterium bovis subsp bovis AF2122/97
gcccauccggccgu

SEQ ID NO: 1177679 - RNA, 22 nt, Mycobacterium bovis subsp bovis AF2122/97
gcccauccggccgucgggcagc

SEQ ID NO: 1177680 - RNA, 16 nt, Mycobacterium bovis subsp bovis AF2122/97
gcccauggccaccagg

SEQ ID NO: 1177681 - RNA, 15 nt, Mycobacterium bovis subsp bovis AF2122/97
gcccaggucuccauc

SEQ ID NO: 1177682 - RNA, 23 nt, Mycobacterium bovis subsp bovis AF2122/97
gcccaggugggccgagagcagcc

SEQ ID NO: 1177683 - RNA, 18 nt, Mycobacterium bovis subsp bovis AF2122/97
gcccagguguguggcggc

SEQ ID NO: 1177684 - RNA, 22 nt, Mycobacterium bovis subsp bovis AF2122/97
gcccagguguguggcggcgucc

SEQ ID NO: 1177685 - RNA, 22 nt, Mycobacterium bovis subsp bovis AF2122/97
gcccaguugggccucagcuacc

SEQ ID NO: 1177686 - RNA, 22 nt, Mycobacterium bovis subsp bovis AF2122/97
gcccauaccgaugguggugcca

SEQ ID NO: 1177687 - RNA, 14 nt, Mycobacterium bovis subsp bovis AF2122/97
gcccagcagguucc

SEQ ID NO: 1177688 - RNA, 19 nt, Mycobacterium bovis subsp bovis AF2122/97
gcccagcagguuccacggc

SEQ ID NO: 1177689 - RNA, 22 nt, Mycobacterium bovis subsp bovis AF2122/97
gcccagcagguuccacggccag

SEQ ID NO: 1177690 - RNA, 13 nt, Mycobacterium bovis subsp bovis AF2122/97
gcccagcccggcg

SEQ ID NO: 1177691 - RNA, 18 nt, Mycobacterium bovis subsp bovis AF2122/97
gcccagcucgucgagcug

SEQ ID NO: 1177692 - RNA, 16 nt, Mycobacterium bovis subsp bovis AF2122/97
gcccagcguggcuggc

SEQ ID NO: 1177693 - RNA, 23 nt, Mycobacterium bovis subsp bovis AF2122/97
gcccagcguugucggguggcugc

SEQ ID NO: 1177694 - RNA, 15 nt, Mycobacterium bovis subsp bovis AF2122/97
gcccaggacagcagc

SEQ ID NO: 1177695 - RNA, 16 nt, Mycobacterium bovis subsp bovis AF2122/97
gcccaggacagcagcc

SEQ ID NO: 1177696 - RNA, 16 nt, Mycobacterium bovis subsp bovis AF2122/97
gccauguucggagcca

SEQ ID NO: 1177697 - RNA, 18 nt, Mycobacterium bovis subsp bovis AF2122/97
gccaugcucgccaaaccc

SEQ ID NO: 1177698 - RNA, 15 nt, Mycobacterium bovis subsp bovis AF2122/97
gccaugcugcccuug

SEQ ID NO: 1177699 - RNA, 16 nt, Mycobacterium bovis subsp bovis AF2122/97
gccauuagcagcaccc

SEQ ID NO: 1177700 - RNA, 14 nt, Mycobacterium bovis subsp bovis AF2122/97
gccaucugccugcc

SEQ ID NO: 1177701 - RNA, 17 nt, Mycobacterium bovis subsp bovis AF2122/97
gccaucugcuggcuggg

SEQ ID NO: 1177702 - RNA, 19 nt, Mycobacterium bovis subsp bovis AF2122/97
gccaucuucgggccgacgg

SEQ ID NO: 1177703 - RNA, 19 nt, Mycobacterium bovis subsp bovis AF2122/97
gcccacacgcucacgggcu

SEQ ID NO: 1177704 - RNA, 15 nt, Mycobacterium bovis subsp bovis AF2122/97
gcccacaccagcgca

SEQ ID NO: 1177705 - RNA, 22 nt, Mycobacterium bovis subsp bovis AF2122/97
gcccaauuucgugccgaaaugg

SEQ ID NO: 1177706 - RNA, 17 nt, Mycobacterium bovis subsp bovis AF2122/97
gcccaacucggccagcu

SEQ ID NO: 1177707 - RNA, 20 nt, Mycobacterium bovis subsp bovis AF2122/97
gcccaacggaagaccgcggg

SEQ ID NO: 1177708 - RNA, 16 nt, Mycobacterium bovis subsp bovis AF2122/97
gcccaacucggccagc

SEQ ID NO: 1177709 - RNA, 13 nt, Mycobacterium bovis subsp bovis AF2122/97
gcccaacgcgagc

SEQ ID NO: 1177710 - RNA, 23 nt, Mycobacterium bovis subsp bovis AF2122/97
gcccaacaggcgggacaaccggg

SEQ ID NO: 1177711 - RNA, 23 nt, Mycobacterium bovis subsp bovis AF2122/97
gcccaaaggcuguaacacccggc

SEQ ID NO: 1177712 - RNA, 17 nt, Mycobacterium bovis subsp bovis AF2122/97
gcccaaaucccagagca

SEQ ID NO: 1177713 - RNA, 19 nt, Mycobacterium bovis subsp bovis AF2122/97
gccauuguaguacaccuug

SEQ ID NO: 1177714 - RNA, 17 nt, Mycobacterium bovis subsp bovis AF2122/97
gccauuggcgccgccga

SEQ ID NO: 1177715 - RNA, 14 nt, Mycobacterium bovis subsp bovis AF2122/97
gccauugccgccgg

SEQ ID NO: 1177716 - RNA, 20 nt, Mycobacterium bovis subsp bovis AF2122/97
gccauugccucccgcgccgg

SEQ ID NO: 1177717 - RNA, 12 nt, Mycobacterium bovis subsp bovis AF2122/97
gccauugccgcc

SEQ ID NO: 1177718 - RNA, 13 nt, Mycobacterium bovis subsp bovis AF2122/97
gccaggcgcgcua

SEQ ID NO: 1177719 - RNA, 22 nt, Mycobacterium bovis subsp bovis AF2122/97
gccaggcgaagucgacucgcca

SEQ ID NO: 1177720 - RNA, 19 nt, Mycobacterium bovis subsp bovis AF2122/97
gccaggcgauugcccgcgc

SEQ ID NO: 1177721 - RNA, 13 nt, Mycobacterium bovis subsp bovis AF2122/97
gccaggcgcagcu

SEQ ID NO: 1177722 - RNA, 22 nt, Mycobacterium bovis subsp bovis AF2122/97
gccaggcgugcacaggucagcg

SEQ ID NO: 1177723 - RNA, 20 nt, Mycobacterium bovis subsp bovis AF2122/97
gccaggcggcaauucgggca

SEQ ID NO: 1177724 - RNA, 22 nt, Mycobacterium bovis subsp bovis AF2122/97
gccaggcggcaaggacggagcc

SEQ ID NO: 1177725 - RNA, 13 nt, Mycobacterium bovis subsp bovis AF2122/97
gccaggcugcgca

SEQ ID NO: 1177726 - RNA, 16 nt, Mycobacterium bovis subsp bovis AF2122/97
gccaggcugcgcagug

SEQ ID NO: 1177727 - RNA, 20 nt, Mycobacterium bovis subsp bovis AF2122/97
gccauauugauuccgacccc

SEQ ID NO: 1177728 - RNA, 21 nt, Mycobacterium bovis subsp bovis AF2122/97
gccaucagcccggcgcgccga

SEQ ID NO: 1177729 - RNA, 17 nt, Mycobacterium bovis subsp bovis AF2122/97
gccaucagcccuucagc

SEQ ID NO: 1177730 - RNA, 12 nt, Mycobacterium bovis subsp bovis AF2122/97
gccaucaucgcu

SEQ ID NO: 1177731 - RNA, 11 nt, Mycobacterium bovis subsp bovis AF2122/97
gccaucuggcc

SEQ ID NO: 1177732 - RNA, 13 nt, Mycobacterium bovis subsp bovis AF2122/97
gccaucugccugc

SEQ ID NO: 1177733 - RNA, 15 nt, Mycobacterium bovis subsp bovis AF2122/97
gccaucgaguccacc

SEQ ID NO: 1177734 - RNA, 21 nt, Mycobacterium bovis subsp bovis AF2122/97
gccaucgccaugauggacagc

SEQ ID NO: 1177735 - RNA, 15 nt, Mycobacterium bovis subsp bovis AF2122/97
gccgaggaccagagg

SEQ ID NO: 1177736 - RNA, 19 nt, Mycobacterium bovis subsp bovis AF2122/97
gccgaggaccagaggcgcu

SEQ ID NO: 1177737 - RNA, 16 nt, Mycobacterium bovis subsp bovis AF2122/97
gccgaggacgccggcg

SEQ ID NO: 1177738 - RNA, 20 nt, Mycobacterium bovis subsp bovis AF2122/97
gccgaggacgccggcgccgc

SEQ ID NO: 1177739 - RNA, 23 nt, Mycobacterium bovis subsp bovis AF2122/97
gccgaggacuggaaagcagcagc

SEQ ID NO: 1177740 - RNA, 19 nt, Mycobacterium bovis subsp bovis AF2122/97
gccgagcuugucgagcagg

SEQ ID NO: 1177741 - RNA, 13 nt, Mycobacterium bovis subsp bovis AF2122/97
gccgagcuugagc

SEQ ID NO: 1177742 - RNA, 21 nt, Mycobacterium bovis subsp bovis AF2122/97
gccgagcuggcaacgccgcgc

SEQ ID NO: 1177743 - RNA, 19 nt, Mycobacterium bovis subsp bovis AF2122/97
gccgagcugguuggcgccg

SEQ ID NO: 1177744 - RNA, 17 nt, Mycobacterium bovis subsp bovis AF2122/97
gccgagcugugcgcaga

SEQ ID NO: 1177745 - RNA, 13 nt, Mycobacterium bovis subsp bovis AF2122/97
gccgaggcaaccg

SEQ ID NO: 1177746 - RNA, 15 nt, Mycobacterium bovis subsp bovis AF2122/97
gccgaguugcccggg

SEQ ID NO: 1177747 - RNA, 15 nt, Mycobacterium bovis subsp bovis AF2122/97
gccgauagcgcggca

SEQ ID NO: 1177748 - RNA, 17 nt, Mycobacterium bovis subsp bovis AF2122/97
gccgauaccggcggcga

SEQ ID NO: 1177749 - RNA, 18 nt, Mycobacterium bovis subsp bovis AF2122/97
gccgauaccggcggcgag

SEQ ID NO: 1177750 - RNA, 24 nt, Mycobacterium bovis subsp bovis AF2122/97
gccgauaccagccaaaacgagcag

SEQ ID NO: 1177751 - RNA, 15 nt, Mycobacterium bovis subsp bovis AF2122/97
gccgauaccgccggc

SEQ ID NO: 1177752 - RNA, 15 nt, Mycobacterium bovis subsp bovis AF2122/97
gccgauaccggcggc

SEQ ID NO: 1177753 - RNA, 15 nt, Mycobacterium bovis subsp bovis AF2122/97
gccgauccgguggcu

SEQ ID NO: 1177754 - RNA, 19 nt, Mycobacterium bovis subsp bovis AF2122/97
gccgaucgaaccgcugcuc

SEQ ID NO: 1177755 - RNA, 17 nt, Mycobacterium bovis subsp bovis AF2122/97
gccgaucccgugguggc

SEQ ID NO: 1177756 - RNA, 16 nt, Mycobacterium bovis subsp bovis AF2122/97
gccgauaucugccacg

SEQ ID NO: 1177757 - RNA, 13 nt, Mycobacterium bovis subsp bovis AF2122/97
gccgaucgggagu

SEQ ID NO: 1177758 - RNA, 17 nt, Mycobacterium bovis subsp bovis AF2122/97
gccgaucggccugcagc

SEQ ID NO: 1177759 - RNA, 16 nt, Mycobacterium bovis subsp bovis AF2122/97
gccgaucggccacagu

SEQ ID NO: 1177760 - RNA, 20 nt, Mycobacterium bovis subsp bovis AF2122/97
gccgagcucggucaccacgg

SEQ ID NO: 1177761 - RNA, 19 nt, Mycobacterium bovis subsp bovis AF2122/97
gccgagcucguaguguucc

SEQ ID NO: 1177762 - RNA, 17 nt, Mycobacterium bovis subsp bovis AF2122/97
gccgagcucguugcugg

SEQ ID NO: 1177763 - RNA, 18 nt, Mycobacterium bovis subsp bovis AF2122/97
gccgagcuggcgcgcggg

SEQ ID NO: 1177764 - RNA, 14 nt, Mycobacterium bovis subsp bovis AF2122/97
gccgagccgcccgc

SEQ ID NO: 1177765 - RNA, 21 nt, Mycobacterium bovis subsp bovis AF2122/97
gccgagccagcuccggcgcuc

SEQ ID NO: 1177766 - RNA, 22 nt, Mycobacterium bovis subsp bovis AF2122/97
gccgagcagguuccgcacgauc

SEQ ID NO: 1177767 - RNA, 22 nt, Mycobacterium bovis subsp bovis AF2122/97
gccgagccgauauaccagggca

SEQ ID NO: 1177768 - RNA, 21 nt, Mycobacterium bovis subsp bovis AF2122/97
gccgagauccacgccagagcg

SEQ ID NO: 1177769 - RNA, 12 nt, Mycobacterium bovis subsp bovis AF2122/97
gccgagauccgc

SEQ ID NO: 1177770 - RNA, 18 nt, Mycobacterium bovis subsp bovis AF2122/97
gccgagaugaugcugccg

SEQ ID NO: 1177771 - RNA, 15 nt, Mycobacterium bovis subsp bovis AF2122/97
gccgagaugccggcg

SEQ ID NO: 1177772 - RNA, 18 nt, Mycobacterium bovis subsp bovis AF2122/97
gccgagaugccggcgagc

SEQ ID NO: 1177773 - RNA, 23 nt, Mycobacterium bovis subsp bovis AF2122/97
gccgagaugccggcgagcaggcc

SEQ ID NO: 1177774 - RNA, 16 nt, Mycobacterium bovis subsp bovis AF2122/97
gccgagagcagccagc

SEQ ID NO: 1177775 - RNA, 17 nt, Mycobacterium bovis subsp bovis AF2122/97
gccgagaccgccgcugc

SEQ ID NO: 1177776 - RNA, 18 nt, Mycobacterium bovis subsp bovis AF2122/97
gccgagaagugggcggua

SEQ ID NO: 1177777 - RNA, 20 nt, Mycobacterium bovis subsp bovis AF2122/97
gccgagcacgccgagcccgc

SEQ ID NO: 1177778 - RNA, 22 nt, Mycobacterium bovis subsp bovis AF2122/97
gccgagcacgccgagcccgccg

SEQ ID NO: 1177779 - RNA, 23 nt, Mycobacterium bovis subsp bovis AF2122/97
gccgagcaaacauccacccgcgg

SEQ ID NO: 1177780 - RNA, 20 nt, Mycobacterium bovis subsp bovis AF2122/97
gccgagcagcuccuugaggu

SEQ ID NO: 1177781 - RNA, 17 nt, Mycobacterium bovis subsp bovis AF2122/97
gccgagcagcccgcgga

SEQ ID NO: 1177782 - RNA, 18 nt, Mycobacterium bovis subsp bovis AF2122/97
gccgagcacucggccacg

SEQ ID NO: 1177783 - RNA, 17 nt, Mycobacterium bovis subsp bovis AF2122/97
gccgcacgccggccagc

SEQ ID NO: 1177784 - RNA, 21 nt, Mycobacterium bovis subsp bovis AF2122/97
gccgcacggcgacgccagugu

SEQ ID NO: 1177785 - RNA, 20 nt, Mycobacterium bovis subsp bovis AF2122/97
gccgcacgucgaccucggca

SEQ ID NO: 1177786 - RNA, 15 nt, Mycobacterium bovis subsp bovis AF2122/97
gccgcacgccgacca

SEQ ID NO: 1177787 - RNA, 20 nt, Mycobacterium bovis subsp bovis AF2122/97
gccgcacgccgaccagcacc

SEQ ID NO: 1177788 - RNA, 22 nt, Mycobacterium bovis subsp bovis AF2122/97
gccgcacgccggcaugccagcc

SEQ ID NO: 1177789 - RNA, 14 nt, Mycobacterium bovis subsp bovis AF2122/97
gccgcaccggugcu

SEQ ID NO: 1177790 - RNA, 19 nt, Mycobacterium bovis subsp bovis AF2122/97
gccgcaagccucgugguga

SEQ ID NO: 1177791 - RNA, 16 nt, Mycobacterium bovis subsp bovis AF2122/97
gccgaucuucgcgcgc

SEQ ID NO: 1177792 - RNA, 18 nt, Mycobacterium bovis subsp bovis AF2122/97
gccgaucuucgcgcgcuc

SEQ ID NO: 1177793 - RNA, 21 nt, Mycobacterium bovis subsp bovis AF2122/97
gccgaugaccgaagagcgcgc

SEQ ID NO: 1177794 - RNA, 19 nt, Mycobacterium bovis subsp bovis AF2122/97
gccgaucugcucgccgagc

SEQ ID NO: 1177795 - RNA, 20 nt, Mycobacterium bovis subsp bovis AF2122/97
gccgaucucgcccagcgagc

SEQ ID NO: 1177796 - RNA, 23 nt, Mycobacterium bovis subsp bovis AF2122/97
gccgcaaccauguuaacgcgcgu

SEQ ID NO: 1177797 - RNA, 22 nt, Mycobacterium bovis subsp bovis AF2122/97
gccgcaacaccccccguccacc

SEQ ID NO: 1177798 - RNA, 19 nt, Mycobacterium bovis subsp bovis AF2122/97
gccgcaacaugggugaugc

SEQ ID NO: 1177799 - RNA, 13 nt, Mycobacterium bovis subsp bovis AF2122/97
gccgcaaccaugu

SEQ ID NO: 1177800 - RNA, 18 nt, Mycobacterium bovis subsp bovis AF2122/97
gccgcaucgucgccgcgc

SEQ ID NO: 1177801 - RNA, 15 nt, Mycobacterium bovis subsp bovis AF2122/97
gccgcaucgucgccg

SEQ ID NO: 1177802 - RNA, 21 nt, Mycobacterium bovis subsp bovis AF2122/97
gccgcaucggcgggucugggu

SEQ ID NO: 1177803 - RNA, 23 nt, Mycobacterium bovis subsp bovis AF2122/97
gccgccaccgcgacgagcggccg

SEQ ID NO: 1177804 - RNA, 19 nt, Mycobacterium bovis subsp bovis AF2122/97
gccgccaccggcgccgccg

SEQ ID NO: 1177805 - RNA, 20 nt, Mycobacterium bovis subsp bovis AF2122/97
gccgccaccgucaccgccgu

SEQ ID NO: 1177806 - RNA, 19 nt, Mycobacterium bovis subsp bovis AF2122/97
gccgccacggaucgcggcg

SEQ ID NO: 1177807 - RNA, 16 nt, Mycobacterium bovis subsp bovis AF2122/97
gccgccacgggcggcc

SEQ ID NO: 1177808 - RNA, 22 nt, Mycobacterium bovis subsp bovis AF2122/97
gccgccaccuuggcugggcccg

SEQ ID NO: 1177809 - RNA, 22 nt, Mycobacterium bovis subsp bovis AF2122/97
gccgccacggaucgcggcggcg

SEQ ID NO: 1177810 - RNA, 19 nt, Mycobacterium bovis subsp bovis AF2122/97
gccgcagcccgugacuggu

SEQ ID NO: 1177811 - RNA, 21 nt, Mycobacterium bovis subsp bovis AF2122/97
gccgcagcccgugacugguga

SEQ ID NO: 1177812 - RNA, 13 nt, Mycobacterium bovis subsp bovis AF2122/97
gccgcagccagca

SEQ ID NO: 1177813 - RNA, 14 nt, Mycobacterium bovis subsp bovis AF2122/97
gccgcagccagcaa

SEQ ID NO: 1177814 - RNA, 24 nt, Mycobacterium bovis subsp bovis AF2122/97
gccgcagcgaaaacccggucggcg

SEQ ID NO: 1177815 - RNA, 20 nt, Mycobacterium bovis subsp bovis AF2122/97
gccgcagcggccagcccagc

SEQ ID NO: 1177816 - RNA, 13 nt, Mycobacterium bovis subsp bovis AF2122/97
gccgcauaccagu

SEQ ID NO: 1177817 - RNA, 13 nt, Mycobacterium bovis subsp bovis AF2122/97
gcccuugaagaaa

SEQ ID NO: 1177818 - RNA, 14 nt, Mycobacterium bovis subsp bovis AF2122/97
gcccuugccgccag

SEQ ID NO: 1177819 - RNA, 20 nt, Mycobacterium bovis subsp bovis AF2122/97
gcccuugccgccagccccag

SEQ ID NO: 1177820 - RNA, 15 nt, Mycobacterium bovis subsp bovis AF2122/97
gcccuugccgccggc

SEQ ID NO: 1177821 - RNA, 23 nt, Mycobacterium bovis subsp bovis AF2122/97
gcccuugccgccggccccgccgg

SEQ ID NO: 1177822 - RNA, 23 nt, Mycobacterium bovis subsp bovis AF2122/97
gcccugguccaggcccuggccag

SEQ ID NO: 1177823 - RNA, 17 nt, Mycobacterium bovis subsp bovis AF2122/97
gcccugguccaggcccu

SEQ ID NO: 1177824 - RNA, 19 nt, Mycobacterium bovis subsp bovis AF2122/97
gcccugguccaggcccugg

SEQ ID NO: 1177825 - RNA, 19 nt, Mycobacterium bovis subsp bovis AF2122/97
gcccuguccggcgccgagg

SEQ ID NO: 1177826 - RNA, 14 nt, Mycobacterium bovis subsp bovis AF2122/97
gccgaaagccuugc

SEQ ID NO: 1177827 - RNA, 19 nt, Mycobacterium bovis subsp bovis AF2122/97
gccgaaacgccgaccgcgc

SEQ ID NO: 1177828 - RNA, 15 nt, Mycobacterium bovis subsp bovis AF2122/97
gccgaaacagcaccc

SEQ ID NO: 1177829 - RNA, 12 nt, Mycobacterium bovis subsp bovis AF2122/97
gcccuugccuug

SEQ ID NO: 1177830 - RNA, 18 nt, Mycobacterium bovis subsp bovis AF2122/97
gcccuugccgccuuggcc

SEQ ID NO: 1177831 - RNA, 14 nt, Mycobacterium bovis subsp bovis AF2122/97
gcccuugccgccuu

SEQ ID NO: 1177832 - RNA, 15 nt, Mycobacterium bovis subsp bovis AF2122/97
gcccuugccgccuug

SEQ ID NO: 1177833 - RNA, 22 nt, Mycobacterium bovis subsp bovis AF2122/97
gcccuugccggcgagagcguca

SEQ ID NO: 1177834 - RNA, 18 nt, Mycobacterium bovis subsp bovis AF2122/97
gccgaacacgcacacgau

SEQ ID NO: 1177835 - RNA, 17 nt, Mycobacterium bovis subsp bovis AF2122/97
gccgaacaccgccgcgu

SEQ ID NO: 1177836 - RNA, 12 nt, Mycobacterium bovis subsp bovis AF2122/97
gccgaacaccuc

SEQ ID NO: 1177837 - RNA, 18 nt, Mycobacterium bovis subsp bovis AF2122/97
gccgaacagcaggccucc

SEQ ID NO: 1177838 - RNA, 19 nt, Mycobacterium bovis subsp bovis AF2122/97
gccgaacaccacaccgagc

SEQ ID NO: 1177839 - RNA, 17 nt, Mycobacterium bovis subsp bovis AF2122/97
gccgaaaucggccagcu

SEQ ID NO: 1177840 - RNA, 18 nt, Mycobacterium bovis subsp bovis AF2122/97
gccgaaagagccagcggc

SEQ ID NO: 1177841 - RNA, 13 nt, Mycobacterium bovis subsp bovis AF2122/97
gccgaaauccaga

SEQ ID NO: 1177842 - RNA, 14 nt, Mycobacterium bovis subsp bovis AF2122/97
gcccugcuggccca

SEQ ID NO: 1177843 - RNA, 14 nt, Mycobacterium bovis subsp bovis AF2122/97
gcccugggugguuc

SEQ ID NO: 1177844 - RNA, 22 nt, Mycobacterium bovis subsp bovis AF2122/97
gcccugggugguuccgcgcggc

SEQ ID NO: 1177845 - RNA, 18 nt, Mycobacterium bovis subsp bovis AF2122/97
gcccugggugauggccgc

SEQ ID NO: 1177846 - RNA, 22 nt, Mycobacterium bovis subsp bovis AF2122/97
gcccugggugauggccgcgccc

SEQ ID NO: 1177847 - RNA, 20 nt, Mycobacterium bovis subsp bovis AF2122/97
gcccuggcaacgacacgccg

SEQ ID NO: 1177848 - RNA, 18 nt, Mycobacterium bovis subsp bovis AF2122/97
gcccuggaauccaggagc

SEQ ID NO: 1177849 - RNA, 14 nt, Mycobacterium bovis subsp bovis AF2122/97
gcccgggcgggagu

SEQ ID NO: 1177850 - RNA, 21 nt, Mycobacterium bovis subsp bovis AF2122/97
gcccgggcgggauccacccag

SEQ ID NO: 1177851 - RNA, 23 nt, Mycobacterium bovis subsp bovis AF2122/97
gcccgggcgugggcaccccgcgg

SEQ ID NO: 1177852 - RNA, 16 nt, Mycobacterium bovis subsp bovis AF2122/97
gcccgggcugccgccc

SEQ ID NO: 1177853 - RNA, 18 nt, Mycobacterium bovis subsp bovis AF2122/97
gcccugccgacgcuccag

SEQ ID NO: 1177854 - RNA, 17 nt, Mycobacterium bovis subsp bovis AF2122/97
gcccugccggcagcggc

SEQ ID NO: 1177855 - RNA, 21 nt, Mycobacterium bovis subsp bovis AF2122/97
gcccugccgccggccccgccg

SEQ ID NO: 1177856 - RNA, 21 nt, Mycobacterium bovis subsp bovis AF2122/97
gcccugcggccacgguggcgc

SEQ ID NO: 1177857 - RNA, 19 nt, Mycobacterium bovis subsp bovis AF2122/97
gcccugcgccacacccggc

SEQ ID NO: 1177858 - RNA, 15 nt, Mycobacterium bovis subsp bovis AF2122/97
gcccugcgcagccgc

SEQ ID NO: 1177859 - RNA, 19 nt, Mycobacterium bovis subsp bovis AF2122/97
gcccugcgccucggcggcc

SEQ ID NO: 1177860 - RNA, 22 nt, Mycobacterium bovis subsp bovis AF2122/97
gccgaccgguggcaccggcggc

SEQ ID NO: 1177861 - RNA, 22 nt, Mycobacterium bovis subsp bovis AF2122/97
gccgaccguuucuccgccgccc

SEQ ID NO: 1177862 - RNA, 13 nt, Mycobacterium bovis subsp bovis AF2122/97
gccgaccggcggc

SEQ ID NO: 1177863 - RNA, 21 nt, Mycobacterium bovis subsp bovis AF2122/97
gccgaccgggcucuggccagu

SEQ ID NO: 1177864 - RNA, 14 nt, Mycobacterium bovis subsp bovis AF2122/97
gccgaccggcggca

SEQ ID NO: 1177865 - RNA, 23 nt, Mycobacterium bovis subsp bovis AF2122/97
gccgaccgggcucuggccagucc

SEQ ID NO: 1177866 - RNA, 20 nt, Mycobacterium bovis subsp bovis AF2122/97
gccgacgucgaccacugccc

SEQ ID NO: 1177867 - RNA, 15 nt, Mycobacterium bovis subsp bovis AF2122/97
gccgacgucuaggcc

SEQ ID NO: 1177868 - RNA, 21 nt, Mycobacterium bovis subsp bovis AF2122/97
gccgacgucuaggccaaaccc

SEQ ID NO: 1177869 - RNA, 17 nt, Mycobacterium bovis subsp bovis AF2122/97
gccgacgugaccagcuu

SEQ ID NO: 1177870 - RNA, 15 nt, Mycobacterium bovis subsp bovis AF2122/97
gccgacggugauggg

SEQ ID NO: 1177871 - RNA, 14 nt, Mycobacterium bovis subsp bovis AF2122/97
gccgacugggcgcg

SEQ ID NO: 1177872 - RNA, 21 nt, Mycobacterium bovis subsp bovis AF2122/97
gccgacugggcgcgaccccag

SEQ ID NO: 1177873 - RNA, 21 nt, Mycobacterium bovis subsp bovis AF2122/97
gccgacuuccgcgucgccggc

SEQ ID NO: 1177874 - RNA, 20 nt, Mycobacterium bovis subsp bovis AF2122/97
gccgacucggcaccgcggcc

SEQ ID NO: 1177875 - RNA, 18 nt, Mycobacterium bovis subsp bovis AF2122/97
gccgacuccccgccgggc

SEQ ID NO: 1177876 - RNA, 16 nt, Mycobacterium bovis subsp bovis AF2122/97
gccgacucaggucggu

SEQ ID NO: 1177877 - RNA, 23 nt, Mycobacterium bovis subsp bovis AF2122/97
gccgacuagcuggggucaaagca

SEQ ID NO: 1177878 - RNA, 15 nt, Mycobacterium bovis subsp bovis AF2122/97
gccgacuaucggccg

SEQ ID NO: 1177879 - RNA, 17 nt, Mycobacterium bovis subsp bovis AF2122/97
gccgacuaucggccgcc

SEQ ID NO: 1177880 - RNA, 16 nt, Mycobacterium bovis subsp bovis AF2122/97
gccgaccaggaccacc

SEQ ID NO: 1177881 - RNA, 22 nt, Mycobacterium bovis subsp bovis AF2122/97
gccgaccauaaaacucgggggc

SEQ ID NO: 1177882 - RNA, 21 nt, Mycobacterium bovis subsp bovis AF2122/97
gccgacccgcccgaagaugcc

SEQ ID NO: 1177883 - RNA, 15 nt, Mycobacterium bovis subsp bovis AF2122/97
gccgacccgccgcgc

SEQ ID NO: 1177884 - RNA, 22 nt, Mycobacterium bovis subsp bovis AF2122/97
gccgacccgccgcgcccggcgc

SEQ ID NO: 1177885 - RNA, 15 nt, Mycobacterium bovis subsp bovis AF2122/97
gccgacccgccgcgg

SEQ ID NO: 1177886 - RNA, 14 nt, Mycobacterium bovis subsp bovis AF2122/97
gccgaccagcgcgc

SEQ ID NO: 1177887 - RNA, 22 nt, Mycobacterium bovis subsp bovis AF2122/97
gccgaccgcguuuugcaggccc

SEQ ID NO: 1177888 - RNA, 14 nt, Mycobacterium bovis subsp bovis AF2122/97
gccgaccgcggguc

SEQ ID NO: 1177889 - RNA, 18 nt, Mycobacterium bovis subsp bovis AF2122/97
gccgaccgcgggucgugc

SEQ ID NO: 1177890 - RNA, 19 nt, Mycobacterium bovis subsp bovis AF2122/97
gccgaccggcacccgcggc

SEQ ID NO: 1177891 - RNA, 18 nt, Mycobacterium bovis subsp bovis AF2122/97
gccgaccggcagcgaugc

SEQ ID NO: 1177892 - RNA, 15 nt, Mycobacterium bovis subsp bovis AF2122/97
gccgacccgggggcg

SEQ ID NO: 1177893 - RNA, 19 nt, Mycobacterium bovis subsp bovis AF2122/97
gccgaccgauggcucacca

SEQ ID NO: 1177894 - RNA, 14 nt, Mycobacterium bovis subsp bovis AF2122/97
gccgaaccagcgau

SEQ ID NO: 1177895 - RNA, 14 nt, Mycobacterium bovis subsp bovis AF2122/97
gccgaacagcgacg

SEQ ID NO: 1177896 - RNA, 21 nt, Mycobacterium bovis subsp bovis AF2122/97
gccgaacagcgaaccgccggc

SEQ ID NO: 1177897 - RNA, 20 nt, Mycobacterium bovis subsp bovis AF2122/97
gccgaaccggcaccagcggc

SEQ ID NO: 1177898 - RNA, 22 nt, Mycobacterium bovis subsp bovis AF2122/97
gccgaacgccucgccggccacc

SEQ ID NO: 1177899 - RNA, 15 nt, Mycobacterium bovis subsp bovis AF2122/97
gccgaacgguugcuc

SEQ ID NO: 1177900 - RNA, 19 nt, Mycobacterium bovis subsp bovis AF2122/97
gccgaccacucgagcgcuc

SEQ ID NO: 1177901 - RNA, 23 nt, Mycobacterium bovis subsp bovis AF2122/97
gccgaccagagcuucgccgcgca

SEQ ID NO: 1177902 - RNA, 17 nt, Mycobacterium bovis subsp bovis AF2122/97
gccgaccagcacccgcu

SEQ ID NO: 1177903 - RNA, 21 nt, Mycobacterium bovis subsp bovis AF2122/97
gccgacaccaccggcgccgcc

SEQ ID NO: 1177904 - RNA, 18 nt, Mycobacterium bovis subsp bovis AF2122/97
gccgacaaucaccaacgc

SEQ ID NO: 1177905 - RNA, 14 nt, Mycobacterium bovis subsp bovis AF2122/97
gccgaauggcuggg

SEQ ID NO: 1177906 - RNA, 15 nt, Mycobacterium bovis subsp bovis AF2122/97
gccgaauggcugggc

SEQ ID NO: 1177907 - RNA, 23 nt, Mycobacterium bovis subsp bovis AF2122/97
gccgacaacgacgucgccgaccc

SEQ ID NO: 1177908 - RNA, 23 nt, Mycobacterium bovis subsp bovis AF2122/97
gccgcgcuggugauucgcagccg

SEQ ID NO: 1177909 - RNA, 13 nt, Mycobacterium bovis subsp bovis AF2122/97
gccgcggccggcg

SEQ ID NO: 1177910 - RNA, 14 nt, Mycobacterium bovis subsp bovis AF2122/97
gccgcggccgccgu

SEQ ID NO: 1177911 - RNA, 15 nt, Mycobacterium bovis subsp bovis AF2122/97
gccgcggcgcccggc

SEQ ID NO: 1177912 - RNA, 21 nt, Mycobacterium bovis subsp bovis AF2122/97
gccgcggcgccauagccgcga

SEQ ID NO: 1177913 - RNA, 13 nt, Mycobacterium bovis subsp bovis AF2122/97
gccgcggcggccc

SEQ ID NO: 1177914 - RNA, 11 nt, Mycobacterium bovis subsp bovis AF2122/97
gccgcggcggc

SEQ ID NO: 1177915 - RNA, 17 nt, Mycobacterium bovis subsp bovis AF2122/97
gccgcggcggcagcggc

SEQ ID NO: 1177916 - RNA, 15 nt, Mycobacterium bovis subsp bovis AF2122/97
gccgcgggcuccccg

SEQ ID NO: 1177917 - RNA, 14 nt, Mycobacterium bovis subsp bovis AF2122/97
gccgcggggcaucg

SEQ ID NO: 1177918 - RNA, 15 nt, Mycobacterium bovis subsp bovis AF2122/97
gccgcgggucccggc

SEQ ID NO: 1177919 - RNA, 17 nt, Mycobacterium bovis subsp bovis AF2122/97
gccgcgggucccggccg

SEQ ID NO: 1177920 - RNA, 17 nt, Mycobacterium bovis subsp bovis AF2122/97
gccgcgguacccaccuc

SEQ ID NO: 1177921 - RNA, 17 nt, Mycobacterium bovis subsp bovis AF2122/97
gccgcgggugcggcaug

SEQ ID NO: 1177922 - RNA, 17 nt, Mycobacterium bovis subsp bovis AF2122/97
gccgcgggacaccaccg

SEQ ID NO: 1177923 - RNA, 14 nt, Mycobacterium bovis subsp bovis AF2122/97
gccgcggcggucug

SEQ ID NO: 1177924 - RNA, 14 nt, Mycobacterium bovis subsp bovis AF2122/97
gccgcggcuaggcc

SEQ ID NO: 1177925 - RNA, 21 nt, Mycobacterium bovis subsp bovis AF2122/97
gccgcguagugcuccguccga

SEQ ID NO: 1177926 - RNA, 17 nt, Mycobacterium bovis subsp bovis AF2122/97
gccgcguaaaccggcug

SEQ ID NO: 1177927 - RNA, 19 nt, Mycobacterium bovis subsp bovis AF2122/97
gccgcgucgagcaccuugg

SEQ ID NO: 1177928 - RNA, 20 nt, Mycobacterium bovis subsp bovis AF2122/97
gccgcgucgcgaaaggccac

SEQ ID NO: 1177929 - RNA, 21 nt, Mycobacterium bovis subsp bovis AF2122/97
gccgcgucgaacugggcgccc

SEQ ID NO: 1177930 - RNA, 18 nt, Mycobacterium bovis subsp bovis AF2122/97
gccgcggugacggcggcu

SEQ ID NO: 1177931 - RNA, 18 nt, Mycobacterium bovis subsp bovis AF2122/97
gccgcgguugugcugggu

SEQ ID NO: 1177932 - RNA, 21 nt, Mycobacterium bovis subsp bovis AF2122/97
gccgcggucgauguccgcagc

SEQ ID NO: 1177933 - RNA, 16 nt, Mycobacterium bovis subsp bovis AF2122/97
gccgcggucggcgacg

SEQ ID NO: 1177934 - RNA, 15 nt, Mycobacterium bovis subsp bovis AF2122/97
gccgcggucggcgug

SEQ ID NO: 1177935 - RNA, 17 nt, Mycobacterium bovis subsp bovis AF2122/97
gccgcgguaggugcaug

SEQ ID NO: 1177936 - RNA, 17 nt, Mycobacterium bovis subsp bovis AF2122/97
gccgcggucaccccggc

SEQ ID NO: 1177937 - RNA, 20 nt, Mycobacterium bovis subsp bovis AF2122/97
gccgcggucagauccagaga

SEQ ID NO: 1177938 - RNA, 21 nt, Mycobacterium bovis subsp bovis AF2122/97
gccgcgugguuccggcgugca

SEQ ID NO: 1177939 - RNA, 16 nt, Mycobacterium bovis subsp bovis AF2122/97
gccgcgugcugcggcu

SEQ ID NO: 1177940 - RNA, 15 nt, Mycobacterium bovis subsp bovis AF2122/97
gccgcgugcucgccg

SEQ ID NO: 1177941 - RNA, 16 nt, Mycobacterium bovis subsp bovis AF2122/97
gccgcgucgcugagca

SEQ ID NO: 1177942 - RNA, 16 nt, Mycobacterium bovis subsp bovis AF2122/97
gccgcgucucggugca

SEQ ID NO: 1177943 - RNA, 18 nt, Mycobacterium bovis subsp bovis AF2122/97
gccgcgucucggugcagc

SEQ ID NO: 1177944 - RNA, 14 nt, Mycobacterium bovis subsp bovis AF2122/97
gccgcgugccgccc

SEQ ID NO: 1177945 - RNA, 22 nt, Mycobacterium bovis subsp bovis AF2122/97
gccgcguuucggucguuggugc

SEQ ID NO: 1177946 - RNA, 23 nt, Mycobacterium bovis subsp bovis AF2122/97
gccgcguucgcgcaaaugccugc

SEQ ID NO: 1177947 - RNA, 15 nt, Mycobacterium bovis subsp bovis AF2122/97
gccgcguugccgggg

SEQ ID NO: 1177948 - RNA, 13 nt, Mycobacterium bovis subsp bovis AF2122/97
gccgcguuggggu

SEQ ID NO: 1177949 - RNA, 22 nt, Mycobacterium bovis subsp bovis AF2122/97
gccgcuaccccagccggcagca

SEQ ID NO: 1177950 - RNA, 18 nt, Mycobacterium bovis subsp bovis AF2122/97
gccgcuaccgaacaguag

SEQ ID NO: 1177951 - RNA, 18 nt, Mycobacterium bovis subsp bovis AF2122/97
gccgcguucacgcaauug

SEQ ID NO: 1177952 - RNA, 20 nt, Mycobacterium bovis subsp bovis AF2122/97
gccgcguuuauaccucgccg

SEQ ID NO: 1177953 - RNA, 13 nt, Mycobacterium bovis subsp bovis AF2122/97
gccgcuggccagc

SEQ ID NO: 1177954 - RNA, 17 nt, Mycobacterium bovis subsp bovis AF2122/97
gccgcugggugaccagg

SEQ ID NO: 1177955 - RNA, 18 nt, Mycobacterium bovis subsp bovis AF2122/97
gccgcugggugaccagga

SEQ ID NO: 1177956 - RNA, 19 nt, Mycobacterium bovis subsp bovis AF2122/97
gccgcugcgccgucgcagc

SEQ ID NO: 1177957 - RNA, 15 nt, Mycobacterium bovis subsp bovis AF2122/97
gccgcugccgguggc

SEQ ID NO: 1177958 - RNA, 23 nt, Mycobacterium bovis subsp bovis AF2122/97
gccgcugcgacaaaucggcggug

SEQ ID NO: 1177959 - RNA, 13 nt, Mycobacterium bovis subsp bovis AF2122/97
gccgcugccuucu

SEQ ID NO: 1177960 - RNA, 12 nt, Mycobacterium bovis subsp bovis AF2122/97
gccgcuggcaau

SEQ ID NO: 1177961 - RNA, 21 nt, Mycobacterium bovis subsp bovis AF2122/97
gccgcugccgaucaguccggc

SEQ ID NO: 1177962 - RNA, 13 nt, Mycobacterium bovis subsp bovis AF2122/97
gccgcugccgccg

SEQ ID NO: 1177963 - RNA, 17 nt, Mycobacterium bovis subsp bovis AF2122/97
gccgcugccgccgagcu

SEQ ID NO: 1177964 - RNA, 14 nt, Mycobacterium bovis subsp bovis AF2122/97
gccgcugccgccug

SEQ ID NO: 1177965 - RNA, 16 nt, Mycobacterium bovis subsp bovis AF2122/97
gccgcugccgcgcggc

SEQ ID NO: 1177966 - RNA, 17 nt, Mycobacterium bovis subsp bovis AF2122/97
gccgcugccgcgcggcg

SEQ ID NO: 1177967 - RNA, 18 nt, Mycobacterium bovis subsp bovis AF2122/97
gccgcugcauccgcagca

SEQ ID NO: 1177968 - RNA, 13 nt, Mycobacterium bovis subsp bovis AF2122/97
gccgcugccacag

SEQ ID NO: 1177969 - RNA, 12 nt, Mycobacterium bovis subsp bovis AF2122/97
gccgcugccacu

SEQ ID NO: 1177970 - RNA, 14 nt, Mycobacterium bovis subsp bovis AF2122/97
gccgcugccagccg

SEQ ID NO: 1177971 - RNA, 14 nt, Mycobacterium bovis subsp bovis AF2122/97
gccgcugcauccgc

SEQ ID NO: 1177972 - RNA, 20 nt, Mycobacterium bovis subsp bovis AF2122/97
gccgcucacauacagcaggc

SEQ ID NO: 1177973 - RNA, 13 nt, Mycobacterium bovis subsp bovis AF2122/97
gccgcucauccag

SEQ ID NO: 1177974 - RNA, 18 nt, Mycobacterium bovis subsp bovis AF2122/97
gccgcucauccagcgcgu

SEQ ID NO: 1177975 - RNA, 22 nt, Mycobacterium bovis subsp bovis AF2122/97
gccgcuccaaaagccucagccg

SEQ ID NO: 1177976 - RNA, 22 nt, Mycobacterium bovis subsp bovis AF2122/97
gccgcucccgcacaagcccagc

SEQ ID NO: 1177977 - RNA, 20 nt, Mycobacterium bovis subsp bovis AF2122/97
gccgcuaggacggcgcgagc

SEQ ID NO: 1177978 - RNA, 21 nt, Mycobacterium bovis subsp bovis AF2122/97
gccgcuaggacggcgcgagcc

SEQ ID NO: 1177979 - RNA, 19 nt, Mycobacterium bovis subsp bovis AF2122/97
gccgcuaccccagccggca

SEQ ID NO: 1177980 - RNA, 21 nt, Mycobacterium bovis subsp bovis AF2122/97
gccgcuacgccggcccgaggc

SEQ ID NO: 1177981 - RNA, 22 nt, Mycobacterium bovis subsp bovis AF2122/97
gccgcuaggacggcgcgagccg

SEQ ID NO: 1177982 - RNA, 17 nt, Mycobacterium bovis subsp bovis AF2122/97
gccgcugaagccaaaug

SEQ ID NO: 1177983 - RNA, 22 nt, Mycobacterium bovis subsp bovis AF2122/97
gccgcucguuacgccgagcaca

SEQ ID NO: 1177984 - RNA, 12 nt, Mycobacterium bovis subsp bovis AF2122/97
gccgcugagccc

SEQ ID NO: 1177985 - RNA, 22 nt, Mycobacterium bovis subsp bovis AF2122/97
gccgcugacgguucggucgggg

SEQ ID NO: 1177986 - RNA, 22 nt, Mycobacterium bovis subsp bovis AF2122/97
gccgcugacuccugcggcaccg

SEQ ID NO: 1177987 - RNA, 22 nt, Mycobacterium bovis subsp bovis AF2122/97
gccgcugauguacccggcgacg

SEQ ID NO: 1177988 - RNA, 19 nt, Mycobacterium bovis subsp bovis AF2122/97
gccgcucgaaauccuggug

SEQ ID NO: 1177989 - RNA, 16 nt, Mycobacterium bovis subsp bovis AF2122/97
gccgcucggggugguc

SEQ ID NO: 1177990 - RNA, 21 nt, Mycobacterium bovis subsp bovis AF2122/97
gccgcucguuacgccgagcac

SEQ ID NO: 1177991 - RNA, 15 nt, Mycobacterium bovis subsp bovis AF2122/97
gccgccgccaccggc

SEQ ID NO: 1177992 - RNA, 12 nt, Mycobacterium bovis subsp bovis AF2122/97
gccgccgcagcu

SEQ ID NO: 1177993 - RNA, 12 nt, Mycobacterium bovis subsp bovis AF2122/97
gccgccgccauc

SEQ ID NO: 1177994 - RNA, 20 nt, Mycobacterium bovis subsp bovis AF2122/97
gccgccgccccggcgcuggu

SEQ ID NO: 1177995 - RNA, 16 nt, Mycobacterium bovis subsp bovis AF2122/97
gccgccgccgccggcg

SEQ ID NO: 1177996 - RNA, 12 nt, Mycobacterium bovis subsp bovis AF2122/97
gccgccgcccgu

SEQ ID NO: 1177997 - RNA, 14 nt, Mycobacterium bovis subsp bovis AF2122/97
gccgccgccgccau

SEQ ID NO: 1177998 - RNA, 15 nt, Mycobacterium bovis subsp bovis AF2122/97
gccgccgccgccauc

SEQ ID NO: 1177999 - RNA, 16 nt, Mycobacterium bovis subsp bovis AF2122/97
gccgccgcgagcgccg

SEQ ID NO: 1178000 - RNA, 16 nt, Mycobacterium bovis subsp bovis AF2122/97
gccgccgccgucggcg

SEQ ID NO: 1178001 - RNA, 12 nt, Mycobacterium bovis subsp bovis AF2122/97
gccgccgcgccg

SEQ ID NO: 1178002 - RNA, 12 nt, Mycobacterium bovis subsp bovis AF2122/97
gccgccgcggcc

SEQ ID NO: 1178003 - RNA, 13 nt, Mycobacterium bovis subsp bovis AF2122/97
gccgccgcggccg

SEQ ID NO: 1178004 - RNA, 13 nt, Mycobacterium bovis subsp bovis AF2122/97
gccgccgcgagga

SEQ ID NO: 1178005 - RNA, 15 nt, Mycobacterium bovis subsp bovis AF2122/97
gccgccgcggcgccc

SEQ ID NO: 1178006 - RNA, 16 nt, Mycobacterium bovis subsp bovis AF2122/97
gccgccgcgggcgccg

SEQ ID NO: 1178007 - RNA, 15 nt, Mycobacterium bovis subsp bovis AF2122/97
gccgccgcggccggc

SEQ ID NO: 1178008 - RNA, 16 nt, Mycobacterium bovis subsp bovis AF2122/97
gccgccgcggcgaagc

SEQ ID NO: 1178009 - RNA, 13 nt, Mycobacterium bovis subsp bovis AF2122/97
gccgccggcgccg

SEQ ID NO: 1178010 - RNA, 17 nt, Mycobacterium bovis subsp bovis AF2122/97
gccgccggcgccaccgu

SEQ ID NO: 1178011 - RNA, 22 nt, Mycobacterium bovis subsp bovis AF2122/97
gccgccggcgccagcgccgcca

SEQ ID NO: 1178012 - RNA, 17 nt, Mycobacterium bovis subsp bovis AF2122/97
gccgccggcgccacccg

SEQ ID NO: 1178013 - RNA, 15 nt, Mycobacterium bovis subsp bovis AF2122/97
gccgccggcgcuggc

SEQ ID NO: 1178014 - RNA, 12 nt, Mycobacterium bovis subsp bovis AF2122/97
gccgccggcgcu

SEQ ID NO: 1178015 - RNA, 18 nt, Mycobacterium bovis subsp bovis AF2122/97
gccgccggcgcccaggcc

SEQ ID NO: 1178016 - RNA, 16 nt, Mycobacterium bovis subsp bovis AF2122/97
gccgccggcgccgccg

SEQ ID NO: 1178017 - RNA, 17 nt, Mycobacterium bovis subsp bovis AF2122/97
gccgccggcgccgccgg

SEQ ID NO: 1178018 - RNA, 15 nt, Mycobacterium bovis subsp bovis AF2122/97
gccgccggcgccggc

SEQ ID NO: 1178019 - RNA, 13 nt, Mycobacterium bovis subsp bovis AF2122/97
gccgcccgcgccu

SEQ ID NO: 1178020 - RNA, 22 nt, Mycobacterium bovis subsp bovis AF2122/97
gccgcccgcuccuccggcacca

SEQ ID NO: 1178021 - RNA, 19 nt, Mycobacterium bovis subsp bovis AF2122/97
gccgcccgcagggccgccg

SEQ ID NO: 1178022 - RNA, 15 nt, Mycobacterium bovis subsp bovis AF2122/97
gccgcccgcgccacc

SEQ ID NO: 1178023 - RNA, 17 nt, Mycobacterium bovis subsp bovis AF2122/97
gccgcccgcgccgccgc

SEQ ID NO: 1178024 - RNA, 14 nt, Mycobacterium bovis subsp bovis AF2122/97
gccgcccgcccgga

SEQ ID NO: 1178025 - RNA, 17 nt, Mycobacterium bovis subsp bovis AF2122/97
gccgccccugcgcggcc

SEQ ID NO: 1178026 - RNA, 11 nt, Mycobacterium bovis subsp bovis AF2122/97
gccgccccggc

SEQ ID NO: 1178027 - RNA, 15 nt, Mycobacterium bovis subsp bovis AF2122/97
gccgccccggccgcu

SEQ ID NO: 1178028 - RNA, 16 nt, Mycobacterium bovis subsp bovis AF2122/97
gccgccccggccgcug

SEQ ID NO: 1178029 - RNA, 23 nt, Mycobacterium bovis subsp bovis AF2122/97
gccgcccggcgagcagggcgucg

SEQ ID NO: 1178030 - RNA, 12 nt, Mycobacterium bovis subsp bovis AF2122/97
gccgcccggcga

SEQ ID NO: 1178031 - RNA, 13 nt, Mycobacterium bovis subsp bovis AF2122/97
gccgcgccgcaga

SEQ ID NO: 1178032 - RNA, 15 nt, Mycobacterium bovis subsp bovis AF2122/97
gccgcgccgcggccc

SEQ ID NO: 1178033 - RNA, 14 nt, Mycobacterium bovis subsp bovis AF2122/97
gccgcgccggcccc

SEQ ID NO: 1178034 - RNA, 18 nt, Mycobacterium bovis subsp bovis AF2122/97
gccgcgcucaucgcggcg

SEQ ID NO: 1178035 - RNA, 18 nt, Mycobacterium bovis subsp bovis AF2122/97
gccgcgccggcgggcgag

SEQ ID NO: 1178036 - RNA, 18 nt, Mycobacterium bovis subsp bovis AF2122/97
gccgcgcuacgucaagcc

SEQ ID NO: 1178037 - RNA, 17 nt, Mycobacterium bovis subsp bovis AF2122/97
gccgcgcgggccgccgc

SEQ ID NO: 1178038 - RNA, 18 nt, Mycobacterium bovis subsp bovis AF2122/97
gccgcgcgggccgccgca

SEQ ID NO: 1178039 - RNA, 21 nt, Mycobacterium bovis subsp bovis AF2122/97
gccgcgcgggccgccgcaagu

SEQ ID NO: 1178040 - RNA, 16 nt, Mycobacterium bovis subsp bovis AF2122/97
gccgcgcagccgcucg

SEQ ID NO: 1178041 - RNA, 18 nt, Mycobacterium bovis subsp bovis AF2122/97
gccgcgcccggcgcaagc

SEQ ID NO: 1178042 - RNA, 18 nt, Mycobacterium bovis subsp bovis AF2122/97
gccgcgcccggcgcuagc

SEQ ID NO: 1178043 - RNA, 12 nt, Mycobacterium bovis subsp bovis AF2122/97
gccgcgcccggc

SEQ ID NO: 1178044 - RNA, 23 nt, Mycobacterium bovis subsp bovis AF2122/97
gccgcgcacccguccgccgcaga

SEQ ID NO: 1178045 - RNA, 16 nt, Mycobacterium bovis subsp bovis AF2122/97
gccgcgauggccccug

SEQ ID NO: 1178046 - RNA, 15 nt, Mycobacterium bovis subsp bovis AF2122/97
gccgcgaugccaccc

SEQ ID NO: 1178047 - RNA, 17 nt, Mycobacterium bovis subsp bovis AF2122/97
gccgcgaugccacccaa

SEQ ID NO: 1178048 - RNA, 23 nt, Mycobacterium bovis subsp bovis AF2122/97
gccgcgaucggugcgggcgccgc

SEQ ID NO: 1178049 - RNA, 16 nt, Mycobacterium bovis subsp bovis AF2122/97
gccgcgaucgugcagg

SEQ ID NO: 1178050 - RNA, 16 nt, Mycobacterium bovis subsp bovis AF2122/97
gccgcgaacuccagca

SEQ ID NO: 1178051 - RNA, 18 nt, Mycobacterium bovis subsp bovis AF2122/97
gccgcgaacuccagcagc

SEQ ID NO: 1178052 - RNA, 14 nt, Mycobacterium bovis subsp bovis AF2122/97
gccgcgacauccgc

SEQ ID NO: 1178053 - RNA, 19 nt, Mycobacterium bovis subsp bovis AF2122/97
gccgcgaccagcgccgcac

SEQ ID NO: 1178054 - RNA, 22 nt, Mycobacterium bovis subsp bovis AF2122/97
gccgcgaaacccugaaaagggc

SEQ ID NO: 1178055 - RNA, 21 nt, Mycobacterium bovis subsp bovis AF2122/97
gccgccuugaggcccugcggc

SEQ ID NO: 1178056 - RNA, 22 nt, Mycobacterium bovis subsp bovis AF2122/97
gccgccuuccuggcgggcgccu

SEQ ID NO: 1178057 - RNA, 15 nt, Mycobacterium bovis subsp bovis AF2122/97
gccgccugucccgcc

SEQ ID NO: 1178058 - RNA, 18 nt, Mycobacterium bovis subsp bovis AF2122/97
gccgccugucccgccggc

SEQ ID NO: 1178059 - RNA, 19 nt, Mycobacterium bovis subsp bovis AF2122/97
gccgccugucccgccggcc

SEQ ID NO: 1178060 - RNA, 15 nt, Mycobacterium bovis subsp bovis AF2122/97
gccgccguugccgcc

SEQ ID NO: 1178061 - RNA, 20 nt, Mycobacterium bovis subsp bovis AF2122/97
gccgccguugccgccaucac

SEQ ID NO: 1178062 - RNA, 16 nt, Mycobacterium bovis subsp bovis AF2122/97
gccgccguugccgccg

SEQ ID NO: 1178063 - RNA, 18 nt, Mycobacterium bovis subsp bovis AF2122/97
gccgccguugccgccggc

SEQ ID NO: 1178064 - RNA, 17 nt, Mycobacterium bovis subsp bovis AF2122/97
gccgccguugccggcuu

SEQ ID NO: 1178065 - RNA, 20 nt, Mycobacterium bovis subsp bovis AF2122/97
gccgccguugccguuggugc

SEQ ID NO: 1178066 - RNA, 23 nt, Mycobacterium bovis subsp bovis AF2122/97
gccgccguuggcucgagccgccc

SEQ ID NO: 1178067 - RNA, 16 nt, Mycobacterium bovis subsp bovis AF2122/97
gccgccguuuccugcg

SEQ ID NO: 1178068 - RNA, 19 nt, Mycobacterium bovis subsp bovis AF2122/97
gccgccguugccgccggcg

SEQ ID NO: 1178069 - RNA, 22 nt, Mycobacterium bovis subsp bovis AF2122/97
gccgccguugccgccggcgccg

SEQ ID NO: 1178070 - RNA, 23 nt, Mycobacterium bovis subsp bovis AF2122/97
gccgccguugccgccggcgccgc

SEQ ID NO: 1178071 - RNA, 17 nt, Mycobacterium bovis subsp bovis AF2122/97
gccgccguugccgccgu

SEQ ID NO: 1178072 - RNA, 15 nt, Mycobacterium bovis subsp bovis AF2122/97
gccgccguccccgcc

SEQ ID NO: 1178073 - RNA, 18 nt, Mycobacterium bovis subsp bovis AF2122/97
gccgccgggauaacccag

SEQ ID NO: 1178074 - RNA, 20 nt, Mycobacterium bovis subsp bovis AF2122/97
gccgccgggauaacccagca

SEQ ID NO: 1178075 - RNA, 23 nt, Mycobacterium bovis subsp bovis AF2122/97
gccgccgggaaauaucucgguga

SEQ ID NO: 1178076 - RNA, 16 nt, Mycobacterium bovis subsp bovis AF2122/97
gccgccgucggcgagc

SEQ ID NO: 1178077 - RNA, 17 nt, Mycobacterium bovis subsp bovis AF2122/97
gccgccgucgccgccgc

SEQ ID NO: 1178078 - RNA, 17 nt, Mycobacterium bovis subsp bovis AF2122/97
gccgccguuaccgccgc

SEQ ID NO: 1178079 - RNA, 22 nt, Mycobacterium bovis subsp bovis AF2122/97
gccgccguuaccgccgcugccg

SEQ ID NO: 1178080 - RNA, 18 nt, Mycobacterium bovis subsp bovis AF2122/97
gccgccguuaccgccggc

SEQ ID NO: 1178081 - RNA, 22 nt, Mycobacterium bovis subsp bovis AF2122/97
gccgccguuaccgccggcgccg

SEQ ID NO: 1178082 - RNA, 22 nt, Mycobacterium bovis subsp bovis AF2122/97
gcagugaacguaucgccucgag

SEQ ID NO: 1178083 - RNA, 17 nt, Mycobacterium bovis subsp bovis AF2122/97
gcagucggugcggugca

SEQ ID NO: 1178084 - RNA, 20 nt, Mycobacterium bovis subsp bovis AF2122/97
gcagucgggcagcgcucuca

SEQ ID NO: 1178085 - RNA, 15 nt, Mycobacterium bovis subsp bovis AF2122/97
gcagucgcacggugc

SEQ ID NO: 1178086 - RNA, 21 nt, Mycobacterium bovis subsp bovis AF2122/97
gcagucgcacggugccgccgu

SEQ ID NO: 1178087 - RNA, 16 nt, Mycobacterium bovis subsp bovis AF2122/97
gcagucgaugagugac

SEQ ID NO: 1178088 - RNA, 19 nt, Mycobacterium bovis subsp bovis AF2122/97
gcagucgcaaaagccccca

SEQ ID NO: 1178089 - RNA, 14 nt, Mycobacterium bovis subsp bovis AF2122/97
gcaguccgggugua

SEQ ID NO: 1178090 - RNA, 12 nt, Mycobacterium bovis subsp bovis AF2122/97
gcagucccagcg

SEQ ID NO: 1178091 - RNA, 21 nt, Mycobacterium bovis subsp bovis AF2122/97
gcagucccagcacacccccgu

SEQ ID NO: 1178092 - RNA, 15 nt, Mycobacterium bovis subsp bovis AF2122/97
gcagucccggugggc

SEQ ID NO: 1178093 - RNA, 17 nt, Mycobacterium bovis subsp bovis AF2122/97
gcaguccaccgcgcggc

SEQ ID NO: 1178094 - RNA, 21 nt, Mycobacterium bovis subsp bovis AF2122/97
gcaguccaccgcgcggcgcag

SEQ ID NO: 1178095 - RNA, 19 nt, Mycobacterium bovis subsp bovis AF2122/97
gcaguccagccgggugccg

SEQ ID NO: 1178096 - RNA, 12 nt, Mycobacterium bovis subsp bovis AF2122/97
gcaguccaggca

SEQ ID NO: 1178097 - RNA, 14 nt, Mycobacterium bovis subsp bovis AF2122/97
gcaggggacgggcg

SEQ ID NO: 1178098 - RNA, 17 nt, Mycobacterium bovis subsp bovis AF2122/97
gcagucaacucccgaac

SEQ ID NO: 1178099 - RNA, 23 nt, Mycobacterium bovis subsp bovis AF2122/97
gcagugggggugguaccggcggc

SEQ ID NO: 1178100 - RNA, 16 nt, Mycobacterium bovis subsp bovis AF2122/97
gcaguggccgccgggc

SEQ ID NO: 1178101 - RNA, 18 nt, Mycobacterium bovis subsp bovis AF2122/97
gcaguggccgccgggcag

SEQ ID NO: 1178102 - RNA, 13 nt, Mycobacterium bovis subsp bovis AF2122/97
gcaguggcagccc

SEQ ID NO: 1178103 - RNA, 16 nt, Mycobacterium bovis subsp bovis AF2122/97
gcagugccgcacccag

SEQ ID NO: 1178104 - RNA, 17 nt, Mycobacterium bovis subsp bovis AF2122/97
gcagugccgcacccaga

SEQ ID NO: 1178105 - RNA, 23 nt, Mycobacterium bovis subsp bovis AF2122/97
gcagugccguguccagcaugccc

SEQ ID NO: 1178106 - RNA, 15 nt, Mycobacterium bovis subsp bovis AF2122/97
gcagugccgugcuga

SEQ ID NO: 1178107 - RNA, 14 nt, Mycobacterium bovis subsp bovis AF2122/97
gcagugcgggggcg

SEQ ID NO: 1178108 - RNA, 15 nt, Mycobacterium bovis subsp bovis AF2122/97
gcagugcgaacucau

SEQ ID NO: 1178109 - RNA, 14 nt, Mycobacterium bovis subsp bovis AF2122/97
gcaguucgccgcgc

SEQ ID NO: 1178110 - RNA, 15 nt, Mycobacterium bovis subsp bovis AF2122/97
gcaguucgccgcgca

SEQ ID NO: 1178111 - RNA, 20 nt, Mycobacterium bovis subsp bovis AF2122/97
gcaguucucggucccgccgg

SEQ ID NO: 1178112 - RNA, 22 nt, Mycobacterium bovis subsp bovis AF2122/97
gcaguucggcgaugcgcgggug

SEQ ID NO: 1178113 - RNA, 15 nt, Mycobacterium bovis subsp bovis AF2122/97
gcaguucggucagcg

SEQ ID NO: 1178114 - RNA, 16 nt, Mycobacterium bovis subsp bovis AF2122/97
gcaguuccagcucgcg

SEQ ID NO: 1178115 - RNA, 21 nt, Mycobacterium bovis subsp bovis AF2122/97
gcaguucaacgaggccgacga

SEQ ID NO: 1178116 - RNA, 14 nt, Mycobacterium bovis subsp bovis AF2122/97
gcaguuuggcggca

SEQ ID NO: 1178117 - RNA, 15 nt, Mycobacterium bovis subsp bovis AF2122/97
gcaguuggcaccagc

SEQ ID NO: 1178118 - RNA, 14 nt, Mycobacterium bovis subsp bovis AF2122/97
gcaguugacccaug

SEQ ID NO: 1178119 - RNA, 19 nt, Mycobacterium bovis subsp bovis AF2122/97
gcagcuggcgcagccugcc

SEQ ID NO: 1178120 - RNA, 23 nt, Mycobacterium bovis subsp bovis AF2122/97
gcagcugguaggucaccggucac

SEQ ID NO: 1178121 - RNA, 22 nt, Mycobacterium bovis subsp bovis AF2122/97
gcagcuggucgugggccaccac

SEQ ID NO: 1178122 - RNA, 13 nt, Mycobacterium bovis subsp bovis AF2122/97
gcagcuucaacac

SEQ ID NO: 1178123 - RNA, 17 nt, Mycobacterium bovis subsp bovis AF2122/97
gcaggaagucgagcaga

SEQ ID NO: 1178124 - RNA, 19 nt, Mycobacterium bovis subsp bovis AF2122/97
gcaggaagccggcgugcuc

SEQ ID NO: 1178125 - RNA, 14 nt, Mycobacterium bovis subsp bovis AF2122/97
gcaggaacacccau

SEQ ID NO: 1178126 - RNA, 23 nt, Mycobacterium bovis subsp bovis AF2122/97
gcaggaaaucguccuuggacagg

SEQ ID NO: 1178127 - RNA, 17 nt, Mycobacterium bovis subsp bovis AF2122/97
gcagcuugcccgacggc

SEQ ID NO: 1178128 - RNA, 16 nt, Mycobacterium bovis subsp bovis AF2122/97
gcagcuuggacucauc

SEQ ID NO: 1178129 - RNA, 21 nt, Mycobacterium bovis subsp bovis AF2122/97
gcagcuugguggcguggcccu

SEQ ID NO: 1178130 - RNA, 15 nt, Mycobacterium bovis subsp bovis AF2122/97
gcagcuuguccggug

SEQ ID NO: 1178131 - RNA, 18 nt, Mycobacterium bovis subsp bovis AF2122/97
gcagcggguugcggucac

SEQ ID NO: 1178132 - RNA, 16 nt, Mycobacterium bovis subsp bovis AF2122/97
gcagcgguccgccgcc

SEQ ID NO: 1178133 - RNA, 18 nt, Mycobacterium bovis subsp bovis AF2122/97
gcagcgguccgccgccuu

SEQ ID NO: 1178134 - RNA, 14 nt, Mycobacterium bovis subsp bovis AF2122/97
gcagcggugcagcc

SEQ ID NO: 1178135 - RNA, 15 nt, Mycobacterium bovis subsp bovis AF2122/97
gcagcggugcagccc

SEQ ID NO: 1178136 - RNA, 18 nt, Mycobacterium bovis subsp bovis AF2122/97
gcagcggugcagcccgcc

SEQ ID NO: 1178137 - RNA, 20 nt, Mycobacterium bovis subsp bovis AF2122/97
gcagcgguuuuaggcagccc

SEQ ID NO: 1178138 - RNA, 15 nt, Mycobacterium bovis subsp bovis AF2122/97
gcagcgguccagaca

SEQ ID NO: 1178139 - RNA, 22 nt, Mycobacterium bovis subsp bovis AF2122/97
gcagcgguggcuugccccgccg

SEQ ID NO: 1178140 - RNA, 18 nt, Mycobacterium bovis subsp bovis AF2122/97
gcagcgguguagccggcg

SEQ ID NO: 1178141 - RNA, 22 nt, Mycobacterium bovis subsp bovis AF2122/97
gcagcgguguagccggcgccgc

SEQ ID NO: 1178142 - RNA, 15 nt, Mycobacterium bovis subsp bovis AF2122/97
gcagcguccagcgcc

SEQ ID NO: 1178143 - RNA, 12 nt, Mycobacterium bovis subsp bovis AF2122/97
gcagcguccagc

SEQ ID NO: 1178144 - RNA, 13 nt, Mycobacterium bovis subsp bovis AF2122/97
gcagcucaucgcg

SEQ ID NO: 1178145 - RNA, 15 nt, Mycobacterium bovis subsp bovis AF2122/97
gcagcuagcccggca

SEQ ID NO: 1178146 - RNA, 17 nt, Mycobacterium bovis subsp bovis AF2122/97
gcagcuagcccggcagc

SEQ ID NO: 1178147 - RNA, 14 nt, Mycobacterium bovis subsp bovis AF2122/97
gcagcuccguggug

SEQ ID NO: 1178148 - RNA, 22 nt, Mycobacterium bovis subsp bovis AF2122/97
gcagcugcgauauggucaccaa

SEQ ID NO: 1178149 - RNA, 18 nt, Mycobacterium bovis subsp bovis AF2122/97
gcagcuagcccucagcua

SEQ ID NO: 1178150 - RNA, 21 nt, Mycobacterium bovis subsp bovis AF2122/97
gcagcuccagcaaaacccgcu

SEQ ID NO: 1178151 - RNA, 12 nt, Mycobacterium bovis subsp bovis AF2122/97
gcaggcgaguga

SEQ ID NO: 1178152 - RNA, 21 nt, Mycobacterium bovis subsp bovis AF2122/97
gcaggcgaguuaggccgccag

SEQ ID NO: 1178153 - RNA, 16 nt, Mycobacterium bovis subsp bovis AF2122/97
gcaggcgaaggcggcu

SEQ ID NO: 1178154 - RNA, 14 nt, Mycobacterium bovis subsp bovis AF2122/97
gcaggccucggcgc

SEQ ID NO: 1178155 - RNA, 21 nt, Mycobacterium bovis subsp bovis AF2122/97
gcaggccuccucuugggucca

SEQ ID NO: 1178156 - RNA, 15 nt, Mycobacterium bovis subsp bovis AF2122/97
gcaggccgggcacca

SEQ ID NO: 1178157 - RNA, 14 nt, Mycobacterium bovis subsp bovis AF2122/97
gcaggccggcggcg

SEQ ID NO: 1178158 - RNA, 21 nt, Mycobacterium bovis subsp bovis AF2122/97
gcaggccgguuugcacgcacc

SEQ ID NO: 1178159 - RNA, 19 nt, Mycobacterium bovis subsp bovis AF2122/97
gcaggccuccaagcccgcc

SEQ ID NO: 1178160 - RNA, 21 nt, Mycobacterium bovis subsp bovis AF2122/97
gcaggccuccaagcccgccgg

SEQ ID NO: 1178161 - RNA, 14 nt, Mycobacterium bovis subsp bovis AF2122/97
gcaggccgggcgca

SEQ ID NO: 1178162 - RNA, 13 nt, Mycobacterium bovis subsp bovis AF2122/97
gcaggccgccgcc

SEQ ID NO: 1178163 - RNA, 15 nt, Mycobacterium bovis subsp bovis AF2122/97
gcaggccggccaccg

SEQ ID NO: 1178164 - RNA, 13 nt, Mycobacterium bovis subsp bovis AF2122/97
gcaggccgccggc

SEQ ID NO: 1178165 - RNA, 13 nt, Mycobacterium bovis subsp bovis AF2122/97
gcaggccgcuggg

SEQ ID NO: 1178166 - RNA, 19 nt, Mycobacterium bovis subsp bovis AF2122/97
gcaggccgcccagcuguca

SEQ ID NO: 1178167 - RNA, 22 nt, Mycobacterium bovis subsp bovis AF2122/97
gcaggaucgccugagcgccgcg

SEQ ID NO: 1178168 - RNA, 21 nt, Mycobacterium bovis subsp bovis AF2122/97
gcaggaggcguccggcucaug

SEQ ID NO: 1178169 - RNA, 21 nt, Mycobacterium bovis subsp bovis AF2122/97
gcaggaccagcaccgccgcgc

SEQ ID NO: 1178170 - RNA, 18 nt, Mycobacterium bovis subsp bovis AF2122/97
gcaggacgcccacaugcu

SEQ ID NO: 1178171 - RNA, 15 nt, Mycobacterium bovis subsp bovis AF2122/97
gcaggcgcaccaggc

SEQ ID NO: 1178172 - RNA, 19 nt, Mycobacterium bovis subsp bovis AF2122/97
gcaggcucagcugguggcg

SEQ ID NO: 1178173 - RNA, 13 nt, Mycobacterium bovis subsp bovis AF2122/97
gcagggccgcgcg

SEQ ID NO: 1178174 - RNA, 14 nt, Mycobacterium bovis subsp bovis AF2122/97
gcagggccuggcca

SEQ ID NO: 1178175 - RNA, 16 nt, Mycobacterium bovis subsp bovis AF2122/97
gcagggccuggccaca

SEQ ID NO: 1178176 - RNA, 15 nt, Mycobacterium bovis subsp bovis AF2122/97
gcagggccggcaccg

SEQ ID NO: 1178177 - RNA, 20 nt, Mycobacterium bovis subsp bovis AF2122/97
gcagggccggcaccgcagcg

SEQ ID NO: 1178178 - RNA, 14 nt, Mycobacterium bovis subsp bovis AF2122/97
gcagggcagcccgg

SEQ ID NO: 1178179 - RNA, 23 nt, Mycobacterium bovis subsp bovis AF2122/97
gcauucccgcggcaacgcggucu

SEQ ID NO: 1178180 - RNA, 21 nt, Mycobacterium bovis subsp bovis AF2122/97
gcauucgggauucgggcgccg

SEQ ID NO: 1178181 - RNA, 19 nt, Mycobacterium bovis subsp bovis AF2122/97
gcauugcccauagccaggu

SEQ ID NO: 1178182 - RNA, 11 nt, Mycobacterium bovis subsp bovis AF2122/97
gcauugccgcc

SEQ ID NO: 1178183 - RNA, 20 nt, Mycobacterium bovis subsp bovis AF2122/97
gcauugccgccagcccagcc

SEQ ID NO: 1178184 - RNA, 13 nt, Mycobacterium bovis subsp bovis AF2122/97
gcauugaucggug

SEQ ID NO: 1178185 - RNA, 14 nt, Mycobacterium bovis subsp bovis AF2122/97
gcauugaucggugc

SEQ ID NO: 1178186 - RNA, 18 nt, Mycobacterium bovis subsp bovis AF2122/97
gcauugcuccgguuggcg

SEQ ID NO: 1178187 - RNA, 18 nt, Mycobacterium bovis subsp bovis AF2122/97
gcauugcuguguugcacc

SEQ ID NO: 1178188 - RNA, 18 nt, Mycobacterium bovis subsp bovis AF2122/97
gccaaacuacccgcccac

SEQ ID NO: 1178189 - RNA, 21 nt, Mycobacterium bovis subsp bovis AF2122/97
gccaaacuacccgcccacggc

SEQ ID NO: 1178190 - RNA, 22 nt, Mycobacterium bovis subsp bovis AF2122/97
gcauggcaggcgaaggcggcuu

SEQ ID NO: 1178191 - RNA, 17 nt, Mycobacterium bovis subsp bovis AF2122/97
gcaugguggugggugau

SEQ ID NO: 1178192 - RNA, 16 nt, Mycobacterium bovis subsp bovis AF2122/97
gcauggucaggcggcc

SEQ ID NO: 1178193 - RNA, 15 nt, Mycobacterium bovis subsp bovis AF2122/97
gcaugguccacagcc

SEQ ID NO: 1178194 - RNA, 19 nt, Mycobacterium bovis subsp bovis AF2122/97
gcaugguccacagccggcg

SEQ ID NO: 1178195 - RNA, 22 nt, Mycobacterium bovis subsp bovis AF2122/97
gcaugguccacagccggcggcu

SEQ ID NO: 1178196 - RNA, 20 nt, Mycobacterium bovis subsp bovis AF2122/97
gcauggacggauaguucacc

SEQ ID NO: 1178197 - RNA, 20 nt, Mycobacterium bovis subsp bovis AF2122/97
gcaugucgccgaacgccacc

SEQ ID NO: 1178198 - RNA, 20 nt, Mycobacterium bovis subsp bovis AF2122/97
gcaugguuagcggugauggg

SEQ ID NO: 1178199 - RNA, 17 nt, Mycobacterium bovis subsp bovis AF2122/97
gcaugucgggccaggcg

SEQ ID NO: 1178200 - RNA, 21 nt, Mycobacterium bovis subsp bovis AF2122/97
gcaugcccagcgcacggacca

SEQ ID NO: 1178201 - RNA, 18 nt, Mycobacterium bovis subsp bovis AF2122/97
gcaugcaaugcuggcggc

SEQ ID NO: 1178202 - RNA, 20 nt, Mycobacterium bovis subsp bovis AF2122/97
gcaugcaaugcuggcggcgc

SEQ ID NO: 1178203 - RNA, 18 nt, Mycobacterium bovis subsp bovis AF2122/97
gcaugcaugccggcuagc

SEQ ID NO: 1178204 - RNA, 20 nt, Mycobacterium bovis subsp bovis AF2122/97
gcaucuggggguagccgccg

SEQ ID NO: 1178205 - RNA, 14 nt, Mycobacterium bovis subsp bovis AF2122/97
gcaucugcuucugc

SEQ ID NO: 1178206 - RNA, 18 nt, Mycobacterium bovis subsp bovis AF2122/97
gcauagcggcccaucggg

SEQ ID NO: 1178207 - RNA, 19 nt, Mycobacterium bovis subsp bovis AF2122/97
gcauaggccccgccagcgc

SEQ ID NO: 1178208 - RNA, 13 nt, Mycobacterium bovis subsp bovis AF2122/97
gcauaggcgcggu

SEQ ID NO: 1178209 - RNA, 19 nt, Mycobacterium bovis subsp bovis AF2122/97
gcaucauagacagggccgc

SEQ ID NO: 1178210 - RNA, 21 nt, Mycobacterium bovis subsp bovis AF2122/97
gcaucaucagcggcgccgcac

SEQ ID NO: 1178211 - RNA, 22 nt, Mycobacterium bovis subsp bovis AF2122/97
gcaucaaccguccccggcgucc

SEQ ID NO: 1178212 - RNA, 21 nt, Mycobacterium bovis subsp bovis AF2122/97
gcaucaacgcgggcgcuugcc

SEQ ID NO: 1178213 - RNA, 23 nt, Mycobacterium bovis subsp bovis AF2122/97
gcauauugcggcgccgugaucag

SEQ ID NO: 1178214 - RNA, 14 nt, Mycobacterium bovis subsp bovis AF2122/97
gcaucgccacaguc

SEQ ID NO: 1178215 - RNA, 13 nt, Mycobacterium bovis subsp bovis AF2122/97
gcaucgccaccac

SEQ ID NO: 1178216 - RNA, 21 nt, Mycobacterium bovis subsp bovis AF2122/97
gcaucgccaccaucaccgccu

SEQ ID NO: 1178217 - RNA, 21 nt, Mycobacterium bovis subsp bovis AF2122/97
gcaucgugugguuaacacccu

SEQ ID NO: 1178218 - RNA, 23 nt, Mycobacterium bovis subsp bovis AF2122/97
gcaucuccgucggccaggccacg

SEQ ID NO: 1178219 - RNA, 19 nt, Mycobacterium bovis subsp bovis AF2122/97
gcaucuccgucggccaggc

SEQ ID NO: 1178220 - RNA, 17 nt, Mycobacterium bovis subsp bovis AF2122/97
gcaucucgcaccgcgcc

SEQ ID NO: 1178221 - RNA, 20 nt, Mycobacterium bovis subsp bovis AF2122/97
gcauccagccgugcggcggc

SEQ ID NO: 1178222 - RNA, 12 nt, Mycobacterium bovis subsp bovis AF2122/97
gcauccaggcug

SEQ ID NO: 1178223 - RNA, 21 nt, Mycobacterium bovis subsp bovis AF2122/97
gcauccaggcugucgcgggcc

SEQ ID NO: 1178224 - RNA, 16 nt, Mycobacterium bovis subsp bovis AF2122/97
gcauccaacgcggcgc

SEQ ID NO: 1178225 - RNA, 16 nt, Mycobacterium bovis subsp bovis AF2122/97
gcauccacugcggcgc

SEQ ID NO: 1178226 - RNA, 22 nt, Mycobacterium bovis subsp bovis AF2122/97
gcaucaucgcugugcgcugguc

SEQ ID NO: 1178227 - RNA, 17 nt, Mycobacterium bovis subsp bovis AF2122/97
gcaucgagacgcacggc

SEQ ID NO: 1178228 - RNA, 21 nt, Mycobacterium bovis subsp bovis AF2122/97
gcaucgagacgcacggccacc

SEQ ID NO: 1178229 - RNA, 23 nt, Mycobacterium bovis subsp bovis AF2122/97
gcaucgacugccagcgccgcggc

SEQ ID NO: 1178230 - RNA, 17 nt, Mycobacterium bovis subsp bovis AF2122/97
gcaucgacgugcgcggc

SEQ ID NO: 1178231 - RNA, 18 nt, Mycobacterium bovis subsp bovis AF2122/97
gcaucgacgugcgcggca

SEQ ID NO: 1178232 - RNA, 17 nt, Mycobacterium bovis subsp bovis AF2122/97
gcauccucugaaccagc

SEQ ID NO: 1178233 - RNA, 23 nt, Mycobacterium bovis subsp bovis AF2122/97
gcauccugcacgacccgcugguc

SEQ ID NO: 1178234 - RNA, 19 nt, Mycobacterium bovis subsp bovis AF2122/97
gcauccuugccaaucgccg

SEQ ID NO: 1178235 - RNA, 20 nt, Mycobacterium bovis subsp bovis AF2122/97
gcaucgaacgcccugacggu

SEQ ID NO: 1178236 - RNA, 17 nt, Mycobacterium bovis subsp bovis AF2122/97
gccacgcucggugcugc

SEQ ID NO: 1178237 - RNA, 14 nt, Mycobacterium bovis subsp bovis AF2122/97
gccacggaucgcgg

SEQ ID NO: 1178238 - RNA, 18 nt, Mycobacterium bovis subsp bovis AF2122/97
gccacggaucgcggcggc

SEQ ID NO: 1178239 - RNA, 23 nt, Mycobacterium bovis subsp bovis AF2122/97
gccacgcuucuuccgcgcgccgg

SEQ ID NO: 1178240 - RNA, 15 nt, Mycobacterium bovis subsp bovis AF2122/97
gccagaacguggcca

SEQ ID NO: 1178241 - RNA, 22 nt, Mycobacterium bovis subsp bovis AF2122/97
gccagaacggaauucagcgacg

SEQ ID NO: 1178242 - RNA, 17 nt, Mycobacterium bovis subsp bovis AF2122/97
gccagaacgacaccgcu

SEQ ID NO: 1178243 - RNA, 22 nt, Mycobacterium bovis subsp bovis AF2122/97
gccagaaacccggcgaccacgg

SEQ ID NO: 1178244 - RNA, 16 nt, Mycobacterium bovis subsp bovis AF2122/97
gccagaccagggcagc

SEQ ID NO: 1178245 - RNA, 18 nt, Mycobacterium bovis subsp bovis AF2122/97
gccagacccaccaccgca

SEQ ID NO: 1178246 - RNA, 22 nt, Mycobacterium bovis subsp bovis AF2122/97
gccagacccgaauccaccagcu

SEQ ID NO: 1178247 - RNA, 17 nt, Mycobacterium bovis subsp bovis AF2122/97
gccagaaugggcggcau

SEQ ID NO: 1178248 - RNA, 15 nt, Mycobacterium bovis subsp bovis AF2122/97
gccagaaugggcggc

SEQ ID NO: 1178249 - RNA, 16 nt, Mycobacterium bovis subsp bovis AF2122/97
gccagaaugggcggca

SEQ ID NO: 1178250 - RNA, 18 nt, Mycobacterium bovis subsp bovis AF2122/97
gccagauuucugggagcc

SEQ ID NO: 1178251 - RNA, 14 nt, Mycobacterium bovis subsp bovis AF2122/97
gccagcaaaccuuc

SEQ ID NO: 1178252 - RNA, 15 nt, Mycobacterium bovis subsp bovis AF2122/97
gccagauuggcgcug

SEQ ID NO: 1178253 - RNA, 14 nt, Mycobacterium bovis subsp bovis AF2122/97
gccagauuggcgcu

SEQ ID NO: 1178254 - RNA, 15 nt, Mycobacterium bovis subsp bovis AF2122/97
gccagaugguggcau

SEQ ID NO: 1178255 - RNA, 16 nt, Mycobacterium bovis subsp bovis AF2122/97
gccagaucggucggcc

SEQ ID NO: 1178256 - RNA, 21 nt, Mycobacterium bovis subsp bovis AF2122/97
gccagaucuccccgaccgcgc

SEQ ID NO: 1178257 - RNA, 16 nt, Mycobacterium bovis subsp bovis AF2122/97
gccagaucucgcgcgc

SEQ ID NO: 1178258 - RNA, 19 nt, Mycobacterium bovis subsp bovis AF2122/97
gccagaucucgcgcgcggc

SEQ ID NO: 1178259 - RNA, 14 nt, Mycobacterium bovis subsp bovis AF2122/97
gccagaugaugcca

SEQ ID NO: 1178260 - RNA, 16 nt, Mycobacterium bovis subsp bovis AF2122/97
gccagaucgaacgcag

SEQ ID NO: 1178261 - RNA, 15 nt, Mycobacterium bovis subsp bovis AF2122/97
gccagaucgccgggc

SEQ ID NO: 1178262 - RNA, 20 nt, Mycobacterium bovis subsp bovis AF2122/97
gccagauagguuccaccggg

SEQ ID NO: 1178263 - RNA, 17 nt, Mycobacterium bovis subsp bovis AF2122/97
gccagaucagccgccgc

SEQ ID NO: 1178264 - RNA, 18 nt, Mycobacterium bovis subsp bovis AF2122/97
gccagaucagccgccgcc

SEQ ID NO: 1178265 - RNA, 19 nt, Mycobacterium bovis subsp bovis AF2122/97
gccagaucagccgccgccu

SEQ ID NO: 1178266 - RNA, 18 nt, Mycobacterium bovis subsp bovis AF2122/97
gccagaguuaccaggucg

SEQ ID NO: 1178267 - RNA, 20 nt, Mycobacterium bovis subsp bovis AF2122/97
gccagaguuaccaggucgga

SEQ ID NO: 1178268 - RNA, 15 nt, Mycobacterium bovis subsp bovis AF2122/97
gccagagucgcccgc

SEQ ID NO: 1178269 - RNA, 23 nt, Mycobacterium bovis subsp bovis AF2122/97
gccagagucggagacccguccgg

SEQ ID NO: 1178270 - RNA, 21 nt, Mycobacterium bovis subsp bovis AF2122/97
gccagcacgcccgcgcugaca

SEQ ID NO: 1178271 - RNA, 21 nt, Mycobacterium bovis subsp bovis AF2122/97
gccagcacgcccucgacgcgc

SEQ ID NO: 1178272 - RNA, 22 nt, Mycobacterium bovis subsp bovis AF2122/97
gccagcacgcccucgacgcgcu

SEQ ID NO: 1178273 - RNA, 16 nt, Mycobacterium bovis subsp bovis AF2122/97
gccagcacgccgccgg

SEQ ID NO: 1178274 - RNA, 13 nt, Mycobacterium bovis subsp bovis AF2122/97
gccagcacuccac

SEQ ID NO: 1178275 - RNA, 22 nt, Mycobacterium bovis subsp bovis AF2122/97
gccagcaccuagucgcggccgu

SEQ ID NO: 1178276 - RNA, 16 nt, Mycobacterium bovis subsp bovis AF2122/97
gccagcaccucggcca

SEQ ID NO: 1178277 - RNA, 21 nt, Mycobacterium bovis subsp bovis AF2122/97
gccagcaccagcgucgcggcc

SEQ ID NO: 1178278 - RNA, 13 nt, Mycobacterium bovis subsp bovis AF2122/97
gccagcaccagcg

SEQ ID NO: 1178279 - RNA, 14 nt, Mycobacterium bovis subsp bovis AF2122/97
gccagcaacccugc

SEQ ID NO: 1178280 - RNA, 15 nt, Mycobacterium bovis subsp bovis AF2122/97
gccagcaccaccggc

SEQ ID NO: 1178281 - RNA, 20 nt, Mycobacterium bovis subsp bovis AF2122/97
gccagcaccaccggcucccg

SEQ ID NO: 1178282 - RNA, 14 nt, Mycobacterium bovis subsp bovis AF2122/97
gccaccagggcggc

SEQ ID NO: 1178283 - RNA, 17 nt, Mycobacterium bovis subsp bovis AF2122/97
gccaccaucaccucgca

SEQ ID NO: 1178284 - RNA, 17 nt, Mycobacterium bovis subsp bovis AF2122/97
gccaccaucgccgccgu

SEQ ID NO: 1178285 - RNA, 13 nt, Mycobacterium bovis subsp bovis AF2122/97
gccaccagggcca

SEQ ID NO: 1178286 - RNA, 17 nt, Mycobacterium bovis subsp bovis AF2122/97
gccaccagggccgcagu

SEQ ID NO: 1178287 - RNA, 15 nt, Mycobacterium bovis subsp bovis AF2122/97
gccaccagccgggca

SEQ ID NO: 1178288 - RNA, 22 nt, Mycobacterium bovis subsp bovis AF2122/97
gccaccagccgguccagcagcu

SEQ ID NO: 1178289 - RNA, 22 nt, Mycobacterium bovis subsp bovis AF2122/97
gccaccagcgcccggcccgcca

SEQ ID NO: 1178290 - RNA, 17 nt, Mycobacterium bovis subsp bovis AF2122/97
gccaccgccgccgccac

SEQ ID NO: 1178291 - RNA, 21 nt, Mycobacterium bovis subsp bovis AF2122/97
gccaccgccgccgccaccggc

SEQ ID NO: 1178292 - RNA, 14 nt, Mycobacterium bovis subsp bovis AF2122/97
gccaccgccgccgg

SEQ ID NO: 1178293 - RNA, 13 nt, Mycobacterium bovis subsp bovis AF2122/97
gccaccgccgccu

SEQ ID NO: 1178294 - RNA, 15 nt, Mycobacterium bovis subsp bovis AF2122/97
gccaccgccgcugcc

SEQ ID NO: 1178295 - RNA, 23 nt, Mycobacterium bovis subsp bovis AF2122/97
gccaccgccggcagcaucggcac

SEQ ID NO: 1178296 - RNA, 13 nt, Mycobacterium bovis subsp bovis AF2122/97
gccaccgcgguca

SEQ ID NO: 1178297 - RNA, 14 nt, Mycobacterium bovis subsp bovis AF2122/97
gccaccgcggccug

SEQ ID NO: 1178298 - RNA, 20 nt, Mycobacterium bovis subsp bovis AF2122/97
gccaccgcggucagcucggc

SEQ ID NO: 1178299 - RNA, 20 nt, Mycobacterium bovis subsp bovis AF2122/97
gccaccguugccgaaccacg

SEQ ID NO: 1178300 - RNA, 14 nt, Mycobacterium bovis subsp bovis AF2122/97
gccaccgucgccgu

SEQ ID NO: 1178301 - RNA, 19 nt, Mycobacterium bovis subsp bovis AF2122/97
gccaccgucgcggcggcac

SEQ ID NO: 1178302 - RNA, 23 nt, Mycobacterium bovis subsp bovis AF2122/97
gccaccggaauccuggccgccgc

SEQ ID NO: 1178303 - RNA, 16 nt, Mycobacterium bovis subsp bovis AF2122/97
gccaccgucgcugccc

SEQ ID NO: 1178304 - RNA, 20 nt, Mycobacterium bovis subsp bovis AF2122/97
gccaccgucgcugcccgcgc

SEQ ID NO: 1178305 - RNA, 13 nt, Mycobacterium bovis subsp bovis AF2122/97
gccacgcccacag

SEQ ID NO: 1178306 - RNA, 17 nt, Mycobacterium bovis subsp bovis AF2122/97
gccacgccagccaggcg

SEQ ID NO: 1178307 - RNA, 16 nt, Mycobacterium bovis subsp bovis AF2122/97
gccacgcccgacgcca

SEQ ID NO: 1178308 - RNA, 21 nt, Mycobacterium bovis subsp bovis AF2122/97
gccacgcccgacgccagcugc

SEQ ID NO: 1178309 - RNA, 15 nt, Mycobacterium bovis subsp bovis AF2122/97
gccacgccugagcca

SEQ ID NO: 1178310 - RNA, 17 nt, Mycobacterium bovis subsp bovis AF2122/97
gccacgcaugggccagg

SEQ ID NO: 1178311 - RNA, 13 nt, Mycobacterium bovis subsp bovis AF2122/97
gccacgccagcgu

SEQ ID NO: 1178312 - RNA, 15 nt, Mycobacterium bovis subsp bovis AF2122/97
gccaccuguugcccu

SEQ ID NO: 1178313 - RNA, 16 nt, Mycobacterium bovis subsp bovis AF2122/97
gccacgaugaucccaa

SEQ ID NO: 1178314 - RNA, 17 nt, Mycobacterium bovis subsp bovis AF2122/97
gccacgcagaacacgcu

SEQ ID NO: 1178315 - RNA, 21 nt, Mycobacterium bovis subsp bovis AF2122/97
gccaccucuaccggugguagc

SEQ ID NO: 1178316 - RNA, 22 nt, Mycobacterium bovis subsp bovis AF2122/97
gccaccucggguguggucacca

SEQ ID NO: 1178317 - RNA, 19 nt, Mycobacterium bovis subsp bovis AF2122/97
gccaccucccacgccgccg

SEQ ID NO: 1178318 - RNA, 20 nt, Mycobacterium bovis subsp bovis AF2122/97
gccaccucccacgccgccgu

SEQ ID NO: 1178319 - RNA, 16 nt, Mycobacterium bovis subsp bovis AF2122/97
gccaccucccagggcu

SEQ ID NO: 1178320 - RNA, 19 nt, Mycobacterium bovis subsp bovis AF2122/97
gccaccuccgaggccgcca

SEQ ID NO: 1178321 - RNA, 14 nt, Mycobacterium bovis subsp bovis AF2122/97
gccaccugcuggcc

SEQ ID NO: 1178322 - RNA, 22 nt, Mycobacterium bovis subsp bovis AF2122/97
gccaccugacgugcggcgcggc

SEQ ID NO: 1178323 - RNA, 18 nt, Mycobacterium bovis subsp bovis AF2122/97
gccaccagaaccagcgac

SEQ ID NO: 1178324 - RNA, 17 nt, Mycobacterium bovis subsp bovis AF2122/97
gccaccacugcgcccgc

SEQ ID NO: 1178325 - RNA, 20 nt, Mycobacterium bovis subsp bovis AF2122/97
gccaccacugcgcccgccac

SEQ ID NO: 1178326 - RNA, 19 nt, Mycobacterium bovis subsp bovis AF2122/97
gccaccagaaacaccgacg

SEQ ID NO: 1178327 - RNA, 16 nt, Mycobacterium bovis subsp bovis AF2122/97
gccaccagaaccagcg

SEQ ID NO: 1178328 - RNA, 22 nt, Mycobacterium bovis subsp bovis AF2122/97
gccaccacggucaagccggcgc

SEQ ID NO: 1178329 - RNA, 14 nt, Mycobacterium bovis subsp bovis AF2122/97
gccaccaccgccga

SEQ ID NO: 1178330 - RNA, 14 nt, Mycobacterium bovis subsp bovis AF2122/97
gccaccaccgccgc

SEQ ID NO: 1178331 - RNA, 14 nt, Mycobacterium bovis subsp bovis AF2122/97
gccaccaccagguc

SEQ ID NO: 1178332 - RNA, 18 nt, Mycobacterium bovis subsp bovis AF2122/97
gccaccaccaggcugacg

SEQ ID NO: 1178333 - RNA, 20 nt, Mycobacterium bovis subsp bovis AF2122/97
gccaccaccgugaagcccug

SEQ ID NO: 1178334 - RNA, 23 nt, Mycobacterium bovis subsp bovis AF2122/97
gccaccaccgugaagcccuggcc

SEQ ID NO: 1178335 - RNA, 17 nt, Mycobacterium bovis subsp bovis AF2122/97
gccaccacccaggccau

SEQ ID NO: 1178336 - RNA, 19 nt, Mycobacterium bovis subsp bovis AF2122/97
gccaccacccggcgcagcu

SEQ ID NO: 1178337 - RNA, 18 nt, Mycobacterium bovis subsp bovis AF2122/97
gccaccaccgcugccggc

SEQ ID NO: 1178338 - RNA, 23 nt, Mycobacterium bovis subsp bovis AF2122/97
gccacaugaccugauccggccgg

SEQ ID NO: 1178339 - RNA, 23 nt, Mycobacterium bovis subsp bovis AF2122/97
gccacaucguucaugaucggcag

SEQ ID NO: 1178340 - RNA, 12 nt, Mycobacterium bovis subsp bovis AF2122/97
gccaccaaaccc

SEQ ID NO: 1178341 - RNA, 19 nt, Mycobacterium bovis subsp bovis AF2122/97
gccaccaaauccgcaagga

SEQ ID NO: 1178342 - RNA, 15 nt, Mycobacterium bovis subsp bovis AF2122/97
gccaccaacaccgcg

SEQ ID NO: 1178343 - RNA, 10 nt, Mycobacterium bovis subsp bovis AF2122/97
gccaccaacu

SEQ ID NO: 1178344 - RNA, 13 nt, Mycobacterium bovis subsp bovis AF2122/97
gccacaccaacgu

SEQ ID NO: 1178345 - RNA, 19 nt, Mycobacterium bovis subsp bovis AF2122/97
gccacaccaugauugccag

SEQ ID NO: 1178346 - RNA, 12 nt, Mycobacterium bovis subsp bovis AF2122/97
gccacacaggcg

SEQ ID NO: 1178347 - RNA, 21 nt, Mycobacterium bovis subsp bovis AF2122/97
gccaaagccgggauugccgcc

SEQ ID NO: 1178348 - RNA, 19 nt, Mycobacterium bovis subsp bovis AF2122/97
gccaaaugaugacgaucag

SEQ ID NO: 1178349 - RNA, 16 nt, Mycobacterium bovis subsp bovis AF2122/97
gccaaauccggcuugu

SEQ ID NO: 1178350 - RNA, 19 nt, Mycobacterium bovis subsp bovis AF2122/97
gccaaaucggccaaaugcc

SEQ ID NO: 1178351 - RNA, 19 nt, Mycobacterium bovis subsp bovis AF2122/97
gccagcgagaucagcaugc

SEQ ID NO: 1178352 - RNA, 18 nt, Mycobacterium bovis subsp bovis AF2122/97
gccagcgauaucggcggc

SEQ ID NO: 1178353 - RNA, 19 nt, Mycobacterium bovis subsp bovis AF2122/97
gccagcgauaucggcggcu

SEQ ID NO: 1178354 - RNA, 17 nt, Mycobacterium bovis subsp bovis AF2122/97
gccagcgaugugaaccg

SEQ ID NO: 1178355 - RNA, 23 nt, Mycobacterium bovis subsp bovis AF2122/97
gccagcgaaauacagggugucac

SEQ ID NO: 1178356 - RNA, 17 nt, Mycobacterium bovis subsp bovis AF2122/97
gccagcgcagccaggcu

SEQ ID NO: 1178357 - RNA, 14 nt, Mycobacterium bovis subsp bovis AF2122/97
gccagcgccaccgu

SEQ ID NO: 1178358 - RNA, 15 nt, Mycobacterium bovis subsp bovis AF2122/97
gccagcgccccgcgg

SEQ ID NO: 1178359 - RNA, 13 nt, Mycobacterium bovis subsp bovis AF2122/97
gccagcgccucgg

SEQ ID NO: 1178360 - RNA, 13 nt, Mycobacterium bovis subsp bovis AF2122/97
gccagcgccggcc

SEQ ID NO: 1178361 - RNA, 18 nt, Mycobacterium bovis subsp bovis AF2122/97
gccagcgccggccaggcu

SEQ ID NO: 1178362 - RNA, 13 nt, Mycobacterium bovis subsp bovis AF2122/97
gccagcgccgccg

SEQ ID NO: 1178363 - RNA, 18 nt, Mycobacterium bovis subsp bovis AF2122/97
gccagcgccgccgagguc

SEQ ID NO: 1178364 - RNA, 21 nt, Mycobacterium bovis subsp bovis AF2122/97
gccagcgccgccgaggucggu

SEQ ID NO: 1178365 - RNA, 16 nt, Mycobacterium bovis subsp bovis AF2122/97
gccagcgccgccgcga

SEQ ID NO: 1178366 - RNA, 14 nt, Mycobacterium bovis subsp bovis AF2122/97
gccagcgccgccgg

SEQ ID NO: 1178367 - RNA, 18 nt, Mycobacterium bovis subsp bovis AF2122/97
gccagcgccgccgcgagc

SEQ ID NO: 1178368 - RNA, 12 nt, Mycobacterium bovis subsp bovis AF2122/97
gccagcgccgcc

SEQ ID NO: 1178369 - RNA, 13 nt, Mycobacterium bovis subsp bovis AF2122/97
gccagcgccgcca

SEQ ID NO: 1178370 - RNA, 12 nt, Mycobacterium bovis subsp bovis AF2122/97
gccagcgcccgc

SEQ ID NO: 1178371 - RNA, 16 nt, Mycobacterium bovis subsp bovis AF2122/97
gccagcccggcgugca

SEQ ID NO: 1178372 - RNA, 23 nt, Mycobacterium bovis subsp bovis AF2122/97
gccagccccagcguucccgccgg

SEQ ID NO: 1178373 - RNA, 24 nt, Mycobacterium bovis subsp bovis AF2122/97
gccagccccagcguucccgccggc

SEQ ID NO: 1178374 - RNA, 21 nt, Mycobacterium bovis subsp bovis AF2122/97
gccagccgcgcuagcucggcc

SEQ ID NO: 1178375 - RNA, 14 nt, Mycobacterium bovis subsp bovis AF2122/97
gccagccgcggccc

SEQ ID NO: 1178376 - RNA, 19 nt, Mycobacterium bovis subsp bovis AF2122/97
gccagccggcgcacucccg

SEQ ID NO: 1178377 - RNA, 21 nt, Mycobacterium bovis subsp bovis AF2122/97
gccagccgucgucagguggcc

SEQ ID NO: 1178378 - RNA, 14 nt, Mycobacterium bovis subsp bovis AF2122/97
gccagccgugccgg

SEQ ID NO: 1178379 - RNA, 16 nt, Mycobacterium bovis subsp bovis AF2122/97
gccagccugcuggccg

SEQ ID NO: 1178380 - RNA, 21 nt, Mycobacterium bovis subsp bovis AF2122/97
gccagccugcuggccgcggcc

SEQ ID NO: 1178381 - RNA, 14 nt, Mycobacterium bovis subsp bovis AF2122/97
gccagccuccacca

SEQ ID NO: 1178382 - RNA, 14 nt, Mycobacterium bovis subsp bovis AF2122/97
gccagcagccgcga

SEQ ID NO: 1178383 - RNA, 18 nt, Mycobacterium bovis subsp bovis AF2122/97
gccagcagcgacuccagc

SEQ ID NO: 1178384 - RNA, 13 nt, Mycobacterium bovis subsp bovis AF2122/97
gccagcagcgacu

SEQ ID NO: 1178385 - RNA, 15 nt, Mycobacterium bovis subsp bovis AF2122/97
gccagcagccguuca

SEQ ID NO: 1178386 - RNA, 11 nt, Mycobacterium bovis subsp bovis AF2122/97
gccagcagccg

SEQ ID NO: 1178387 - RNA, 16 nt, Mycobacterium bovis subsp bovis AF2122/97
gccagcagcaggccag

SEQ ID NO: 1178388 - RNA, 15 nt, Mycobacterium bovis subsp bovis AF2122/97
gccagcagcagcgcc

SEQ ID NO: 1178389 - RNA, 19 nt, Mycobacterium bovis subsp bovis AF2122/97
gccagcagcagcgccgcgu

SEQ ID NO: 1178390 - RNA, 12 nt, Mycobacterium bovis subsp bovis AF2122/97
gccagcagcagc

SEQ ID NO: 1178391 - RNA, 17 nt, Mycobacterium bovis subsp bovis AF2122/97
gccagcagcagaugcga

SEQ ID NO: 1178392 - RNA, 19 nt, Mycobacterium bovis subsp bovis AF2122/97
gccagcagcagugccaccg

SEQ ID NO: 1178393 - RNA, 15 nt, Mycobacterium bovis subsp bovis AF2122/97
gccagcagagcggca

SEQ ID NO: 1178394 - RNA, 21 nt, Mycobacterium bovis subsp bovis AF2122/97
gccagcagcaaacaucgcagg

SEQ ID NO: 1178395 - RNA, 16 nt, Mycobacterium bovis subsp bovis AF2122/97
gccagcagcggcgagc

SEQ ID NO: 1178396 - RNA, 16 nt, Mycobacterium bovis subsp bovis AF2122/97
gccagcaggccgaaga

SEQ ID NO: 1178397 - RNA, 20 nt, Mycobacterium bovis subsp bovis AF2122/97
gccagcagcuuguuuuccac

SEQ ID NO: 1178398 - RNA, 15 nt, Mycobacterium bovis subsp bovis AF2122/97
gccagcagguauuug

SEQ ID NO: 1178399 - RNA, 15 nt, Mycobacterium bovis subsp bovis AF2122/97
gccagcagggccacc

SEQ ID NO: 1178400 - RNA, 14 nt, Mycobacterium bovis subsp bovis AF2122/97
gccagcccagcacg

SEQ ID NO: 1178401 - RNA, 13 nt, Mycobacterium bovis subsp bovis AF2122/97
gccagcccagccg

SEQ ID NO: 1178402 - RNA, 14 nt, Mycobacterium bovis subsp bovis AF2122/97
gccagccaggcgaa

SEQ ID NO: 1178403 - RNA, 22 nt, Mycobacterium bovis subsp bovis AF2122/97
gccagccaccacaucgcgggcg

SEQ ID NO: 1178404 - RNA, 14 nt, Mycobacterium bovis subsp bovis AF2122/97
gccagccagcgggc

SEQ ID NO: 1178405 - RNA, 22 nt, Mycobacterium bovis subsp bovis AF2122/97
gccagccaaccguccggggccg

SEQ ID NO: 1178406 - RNA, 21 nt, Mycobacterium bovis subsp bovis AF2122/97
gccagccaacgcgucccgccg

SEQ ID NO: 1178407 - RNA, 18 nt, Mycobacterium bovis subsp bovis AF2122/97
gccagcaucggcagcagc

SEQ ID NO: 1178408 - RNA, 16 nt, Mycobacterium bovis subsp bovis AF2122/97
gccagcaugacaccgg

SEQ ID NO: 1178409 - RNA, 18 nt, Mycobacterium bovis subsp bovis AF2122/97
gccagcaugacaccggcc

SEQ ID NO: 1178410 - RNA, 21 nt, Mycobacterium bovis subsp bovis AF2122/97
gccagcaugacaccggccacc

SEQ ID NO: 1178411 - RNA, 18 nt, Mycobacterium bovis subsp bovis AF2122/97
gccagcauuagccaggcc

SEQ ID NO: 1178412 - RNA, 16 nt, Mycobacterium bovis subsp bovis AF2122/97
gccagcauugaagaag

SEQ ID NO: 1178413 - RNA, 18 nt, Mycobacterium bovis subsp bovis AF2122/97
gccagcauugaagaagcc

SEQ ID NO: 1178414 - RNA, 20 nt, Mycobacterium bovis subsp bovis AF2122/97
gccagcaucagcccggcgcu

SEQ ID NO: 1178415 - RNA, 16 nt, Mycobacterium bovis subsp bovis AF2122/97
gccagcaucaucaagc

SEQ ID NO: 1178416 - RNA, 19 nt, Mycobacterium bovis subsp bovis AF2122/97
gccagcggcacugaucugc

SEQ ID NO: 1178417 - RNA, 21 nt, Mycobacterium bovis subsp bovis AF2122/97
gccagcggcaauggccagcac

SEQ ID NO: 1178418 - RNA, 22 nt, Mycobacterium bovis subsp bovis AF2122/97
gccagcggcaauggccagcacc

SEQ ID NO: 1178419 - RNA, 21 nt, Mycobacterium bovis subsp bovis AF2122/97
gccagcggcacacccaucacc

SEQ ID NO: 1178420 - RNA, 17 nt, Mycobacterium bovis subsp bovis AF2122/97
gccagcggcaauggcca

SEQ ID NO: 1178421 - RNA, 19 nt, Mycobacterium bovis subsp bovis AF2122/97
gccagcggcaauggccagc

SEQ ID NO: 1178422 - RNA, 19 nt, Mycobacterium bovis subsp bovis AF2122/97
gccagcgcuucgucggccg

SEQ ID NO: 1178423 - RNA, 12 nt, Mycobacterium bovis subsp bovis AF2122/97
gccagcggagca

SEQ ID NO: 1178424 - RNA, 15 nt, Mycobacterium bovis subsp bovis AF2122/97
gccagcggcgcgacc

SEQ ID NO: 1178425 - RNA, 19 nt, Mycobacterium bovis subsp bovis AF2122/97
gccagcggcaggaagaaac

SEQ ID NO: 1178426 - RNA, 20 nt, Mycobacterium bovis subsp bovis AF2122/97
gccagcgcuccuugugccug

SEQ ID NO: 1178427 - RNA, 17 nt, Mycobacterium bovis subsp bovis AF2122/97
gccagcgcggugucggg

SEQ ID NO: 1178428 - RNA, 20 nt, Mycobacterium bovis subsp bovis AF2122/97
gccagcgcggugucggggcc

SEQ ID NO: 1178429 - RNA, 13 nt, Mycobacterium bovis subsp bovis AF2122/97
gccagcgcggcgc

SEQ ID NO: 1178430 - RNA, 12 nt, Mycobacterium bovis subsp bovis AF2122/97
gccagcgcggcg

SEQ ID NO: 1178431 - RNA, 17 nt, Mycobacterium bovis subsp bovis AF2122/97
gccagcgcgccacgagc

SEQ ID NO: 1178432 - RNA, 18 nt, Mycobacterium bovis subsp bovis AF2122/97
gccagcgcgccacgagca

SEQ ID NO: 1178433 - RNA, 19 nt, Mycobacterium bovis subsp bovis AF2122/97
gccagcgcgcgcgggugca

SEQ ID NO: 1178434 - RNA, 17 nt, Mycobacterium bovis subsp bovis AF2122/97
gccagcgcgcccgcggc

SEQ ID NO: 1178435 - RNA, 13 nt, Mycobacterium bovis subsp bovis AF2122/97
gccagcguggaga

SEQ ID NO: 1178436 - RNA, 19 nt, Mycobacterium bovis subsp bovis AF2122/97
gccagcgucucaaggccuu

SEQ ID NO: 1178437 - RNA, 17 nt, Mycobacterium bovis subsp bovis AF2122/97
gccagcgucaccucacc

SEQ ID NO: 1178438 - RNA, 21 nt, Mycobacterium bovis subsp bovis AF2122/97
gccagcgguagcugcccagcg

SEQ ID NO: 1178439 - RNA, 19 nt, Mycobacterium bovis subsp bovis AF2122/97
gccagcggguccccgguca

SEQ ID NO: 1178440 - RNA, 21 nt, Mycobacterium bovis subsp bovis AF2122/97
gccagcgguaaugccagcggc

SEQ ID NO: 1178441 - RNA, 23 nt, Mycobacterium bovis subsp bovis AF2122/97
gccagcggccgggcggccaggcg

SEQ ID NO: 1178442 - RNA, 16 nt, Mycobacterium bovis subsp bovis AF2122/97
gccagcgucaacagcg

SEQ ID NO: 1178443 - RNA, 22 nt, Mycobacterium bovis subsp bovis AF2122/97
gccagcguaaauagcgcccugc

SEQ ID NO: 1178444 - RNA, 19 nt, Mycobacterium bovis subsp bovis AF2122/97
gccagcucggcacccgccg

SEQ ID NO: 1178445 - RNA, 13 nt, Mycobacterium bovis subsp bovis AF2122/97
gccagcucgccgg

SEQ ID NO: 1178446 - RNA, 14 nt, Mycobacterium bovis subsp bovis AF2122/97
gccagcucgccggc

SEQ ID NO: 1178447 - RNA, 16 nt, Mycobacterium bovis subsp bovis AF2122/97
gccagcucgccggccg

SEQ ID NO: 1178448 - RNA, 18 nt, Mycobacterium bovis subsp bovis AF2122/97
gccagcucgccggccggg

SEQ ID NO: 1178449 - RNA, 16 nt, Mycobacterium bovis subsp bovis AF2122/97
gccagcucgcgggccg

SEQ ID NO: 1178450 - RNA, 18 nt, Mycobacterium bovis subsp bovis AF2122/97
gccagcuccucagccacc

SEQ ID NO: 1178451 - RNA, 15 nt, Mycobacterium bovis subsp bovis AF2122/97
gccagcuccucagcc

SEQ ID NO: 1178452 - RNA, 16 nt, Mycobacterium bovis subsp bovis AF2122/97
gccagcuccucagcca

SEQ ID NO: 1178453 - RNA, 19 nt, Mycobacterium bovis subsp bovis AF2122/97
gccagcuccgccugccgcu

SEQ ID NO: 1178454 - RNA, 21 nt, Mycobacterium bovis subsp bovis AF2122/97
gccagcucacggacgcugggc

SEQ ID NO: 1178455 - RNA, 23 nt, Mycobacterium bovis subsp bovis AF2122/97
gccagcuauugcuauuccgcggc

SEQ ID NO: 1178456 - RNA, 13 nt, Mycobacterium bovis subsp bovis AF2122/97
gccagcucaacca

SEQ ID NO: 1178457 - RNA, 18 nt, Mycobacterium bovis subsp bovis AF2122/97
gccagcgugucccaacgc

SEQ ID NO: 1178458 - RNA, 22 nt, Mycobacterium bovis subsp bovis AF2122/97
gccaggcaaccggucagccugc

SEQ ID NO: 1178459 - RNA, 23 nt, Mycobacterium bovis subsp bovis AF2122/97
gccaggaugaauuuggugaagug

SEQ ID NO: 1178460 - RNA, 20 nt, Mycobacterium bovis subsp bovis AF2122/97
gccaggauccgaccccgcgc

SEQ ID NO: 1178461 - RNA, 22 nt, Mycobacterium bovis subsp bovis AF2122/97
gccaggaucuccccguccugcc

SEQ ID NO: 1178462 - RNA, 18 nt, Mycobacterium bovis subsp bovis AF2122/97
gccaggaucuguuugggc

SEQ ID NO: 1178463 - RNA, 21 nt, Mycobacterium bovis subsp bovis AF2122/97
gccaggacuggcaccgccagc

SEQ ID NO: 1178464 - RNA, 20 nt, Mycobacterium bovis subsp bovis AF2122/97
gccaggagcgcggcccgccu

SEQ ID NO: 1178465 - RNA, 13 nt, Mycobacterium bovis subsp bovis AF2122/97
gccaggccgagcc

SEQ ID NO: 1178466 - RNA, 14 nt, Mycobacterium bovis subsp bovis AF2122/97
gccaggccggcggc

SEQ ID NO: 1178467 - RNA, 13 nt, Mycobacterium bovis subsp bovis AF2122/97
gccaggcccagcu

SEQ ID NO: 1178468 - RNA, 16 nt, Mycobacterium bovis subsp bovis AF2122/97
gccaggcccccucggc

SEQ ID NO: 1178469 - RNA, 14 nt, Mycobacterium bovis subsp bovis AF2122/97
gccaggcccggcuu

SEQ ID NO: 1178470 - RNA, 13 nt, Mycobacterium bovis subsp bovis AF2122/97
gccagcucggcca

SEQ ID NO: 1178471 - RNA, 20 nt, Mycobacterium bovis subsp bovis AF2122/97
gccagcucggcggcagcggc

SEQ ID NO: 1178472 - RNA, 20 nt, Mycobacterium bovis subsp bovis AF2122/97
gccagcucuucggggaugac

SEQ ID NO: 1178473 - RNA, 13 nt, Mycobacterium bovis subsp bovis AF2122/97
gccagcugcgcag

SEQ ID NO: 1178474 - RNA, 14 nt, Mycobacterium bovis subsp bovis AF2122/97
gccagcugcagcag

SEQ ID NO: 1178475 - RNA, 15 nt, Mycobacterium bovis subsp bovis AF2122/97
gccagcugacacccg

SEQ ID NO: 1178476 - RNA, 19 nt, Mycobacterium bovis subsp bovis AF2122/97
gccagcugacacccgcagc

SEQ ID NO: 1178477 - RNA, 16 nt, Mycobacterium bovis subsp bovis AF2122/97
gccagcuucccgcugg

SEQ ID NO: 1178478 - RNA, 22 nt, Mycobacterium bovis subsp bovis AF2122/97
gccagcuucguauggacgagga

SEQ ID NO: 1178479 - RNA, 19 nt, Mycobacterium bovis subsp bovis AF2122/97
gccagcuguugcggggugc

SEQ ID NO: 1178480 - RNA, 21 nt, Mycobacterium bovis subsp bovis AF2122/97
gccagcuuagccgcagcuugg

SEQ ID NO: 1178481 - RNA, 22 nt, Mycobacterium bovis subsp bovis AF2122/97
gccaggacgacgccgacgauga

SEQ ID NO: 1178482 - RNA, 18 nt, Mycobacterium bovis subsp bovis AF2122/97
gccaggaagcgguggccu

SEQ ID NO: 1178483 - RNA, 13 nt, Mycobacterium bovis subsp bovis AF2122/97
gccaggaauugcc

SEQ ID NO: 1178484 - RNA, 22 nt, Mycobacterium bovis subsp bovis AF2122/97
gccagcuugcggagccgccgcu

SEQ ID NO: 1178485 - RNA, 13 nt, Mycobacterium bovis subsp bovis AF2122/97
gcaaaaucgccca

SEQ ID NO: 1178486 - RNA, 17 nt, Mycobacterium bovis subsp bovis AF2122/97
gauuuugugucugcucg

SEQ ID NO: 1178487 - RNA, 19 nt, Mycobacterium bovis subsp bovis AF2122/97
gcaaacauccacccgcggu

SEQ ID NO: 1178488 - RNA, 21 nt, Mycobacterium bovis subsp bovis AF2122/97
gcaaacauccacccgcgguga

SEQ ID NO: 1178489 - RNA, 17 nt, Mycobacterium bovis subsp bovis AF2122/97
gcaaaccaagcgcgcca

SEQ ID NO: 1178490 - RNA, 13 nt, Mycobacterium bovis subsp bovis AF2122/97
gcaaaccacccgc

SEQ ID NO: 1178491 - RNA, 18 nt, Mycobacterium bovis subsp bovis AF2122/97
gcaaacaagaucagaccc

SEQ ID NO: 1178492 - RNA, 20 nt, Mycobacterium bovis subsp bovis AF2122/97
gcaaacaagaucagacccag

SEQ ID NO: 1178493 - RNA, 15 nt, Mycobacterium bovis subsp bovis AF2122/97
gcaaagacagcgcgg

SEQ ID NO: 1178494 - RNA, 21 nt, Mycobacterium bovis subsp bovis AF2122/97
gcaaagccagcgcagccaggc

SEQ ID NO: 1178495 - RNA, 22 nt, Mycobacterium bovis subsp bovis AF2122/97
gcaaagccagcgcagccaggcu

SEQ ID NO: 1178496 - RNA, 23 nt, Mycobacterium bovis subsp bovis AF2122/97
gcaacaggccaacuuggcggcca

SEQ ID NO: 1178497 - RNA, 17 nt, Mycobacterium bovis subsp bovis AF2122/97
gcaacacgggcgccgga

SEQ ID NO: 1178498 - RNA, 21 nt, Mycobacterium bovis subsp bovis AF2122/97
gcaacaccgucggcagcagcg

SEQ ID NO: 1178499 - RNA, 12 nt, Mycobacterium bovis subsp bovis AF2122/97
gcaacacagcug

SEQ ID NO: 1178500 - RNA, 18 nt, Mycobacterium bovis subsp bovis AF2122/97
gcaacaacgucugcagcc

SEQ ID NO: 1178501 - RNA, 21 nt, Mycobacterium bovis subsp bovis AF2122/97
gcaacccugcccggcccgccc

SEQ ID NO: 1178502 - RNA, 16 nt, Mycobacterium bovis subsp bovis AF2122/97
gcaacccagccgcgcc

SEQ ID NO: 1178503 - RNA, 20 nt, Mycobacterium bovis subsp bovis AF2122/97
gcaacccagccgcgccagcu

SEQ ID NO: 1178504 - RNA, 17 nt, Mycobacterium bovis subsp bovis AF2122/97
gcaaccacguccgcaac

SEQ ID NO: 1178505 - RNA, 23 nt, Mycobacterium bovis subsp bovis AF2122/97
gcaaccaggaugguugcgacggc

SEQ ID NO: 1178506 - RNA, 20 nt, Mycobacterium bovis subsp bovis AF2122/97
gcaacaucgaauaugacugc

SEQ ID NO: 1178507 - RNA, 16 nt, Mycobacterium bovis subsp bovis AF2122/97
gcaacaucggaugacc

SEQ ID NO: 1178508 - RNA, 14 nt, Mycobacterium bovis subsp bovis AF2122/97
gcaacaucagcagg

SEQ ID NO: 1178509 - RNA, 12 nt, Mycobacterium bovis subsp bovis AF2122/97
gcaaaucaagca

SEQ ID NO: 1178510 - RNA, 13 nt, Mycobacterium bovis subsp bovis AF2122/97
gcaaaucaagcac

SEQ ID NO: 1178511 - RNA, 16 nt, Mycobacterium bovis subsp bovis AF2122/97
gcaaaucaagcacagc

SEQ ID NO: 1178512 - RNA, 13 nt, Mycobacterium bovis subsp bovis AF2122/97
gcaaaugcggcgc

SEQ ID NO: 1178513 - RNA, 19 nt, Mycobacterium bovis subsp bovis AF2122/97
gcaacaaagguaccgcugg

SEQ ID NO: 1178514 - RNA, 15 nt, Mycobacterium bovis subsp bovis AF2122/97
gauugaccgcggccg

SEQ ID NO: 1178515 - RNA, 20 nt, Mycobacterium bovis subsp bovis AF2122/97
gauugaguucggcggccagg

SEQ ID NO: 1178516 - RNA, 17 nt, Mycobacterium bovis subsp bovis AF2122/97
gauugaagcuggccacc

SEQ ID NO: 1178517 - RNA, 14 nt, Mycobacterium bovis subsp bovis AF2122/97
gauucuggccggau

SEQ ID NO: 1178518 - RNA, 14 nt, Mycobacterium bovis subsp bovis AF2122/97
gauuggccgcugca

SEQ ID NO: 1178519 - RNA, 11 nt, Mycobacterium bovis subsp bovis AF2122/97
gauuggccccg

SEQ ID NO: 1178520 - RNA, 23 nt, Mycobacterium bovis subsp bovis AF2122/97
gauugcugcggcuuucagcgcuu

SEQ ID NO: 1178521 - RNA, 20 nt, Mycobacterium bovis subsp bovis AF2122/97
gauugccugacaacucccga

SEQ ID NO: 1178522 - RNA, 14 nt, Mycobacterium bovis subsp bovis AF2122/97
gauugcggcacgga

SEQ ID NO: 1178523 - RNA, 18 nt, Mycobacterium bovis subsp bovis AF2122/97
gauugcguagcgggucag

SEQ ID NO: 1178524 - RNA, 14 nt, Mycobacterium bovis subsp bovis AF2122/97
gauugcgggccugc

SEQ ID NO: 1178525 - RNA, 15 nt, Mycobacterium bovis subsp bovis AF2122/97
gauucgcggcagccg

SEQ ID NO: 1178526 - RNA, 17 nt, Mycobacterium bovis subsp bovis AF2122/97
gauucgggcuucuccau

SEQ ID NO: 1178527 - RNA, 13 nt, Mycobacterium bovis subsp bovis AF2122/97
gauucggccagac

SEQ ID NO: 1178528 - RNA, 14 nt, Mycobacterium bovis subsp bovis AF2122/97
gauucggccagcgc

SEQ ID NO: 1178529 - RNA, 14 nt, Mycobacterium bovis subsp bovis AF2122/97
gauucggcccaucu

SEQ ID NO: 1178530 - RNA, 18 nt, Mycobacterium bovis subsp bovis AF2122/97
gauucgcggcagccggcg

SEQ ID NO: 1178531 - RNA, 15 nt, Mycobacterium bovis subsp bovis AF2122/97
gauucgguaucaggg

SEQ ID NO: 1178532 - RNA, 19 nt, Mycobacterium bovis subsp bovis AF2122/97
gauucccgcccagcagcac

SEQ ID NO: 1178533 - RNA, 20 nt, Mycobacterium bovis subsp bovis AF2122/97
gauucccgcccagcagcacc

SEQ ID NO: 1178534 - RNA, 20 nt, Mycobacterium bovis subsp bovis AF2122/97
gauuccuugaugccuuccga

SEQ ID NO: 1178535 - RNA, 19 nt, Mycobacterium bovis subsp bovis AF2122/97
gauucacacucgggcggcu

SEQ ID NO: 1178536 - RNA, 12 nt, Mycobacterium bovis subsp bovis AF2122/97
gauucauggcgg

SEQ ID NO: 1178537 - RNA, 17 nt, Mycobacterium bovis subsp bovis AF2122/97
gauuguggccagcgcuu

SEQ ID NO: 1178538 - RNA, 22 nt, Mycobacterium bovis subsp bovis AF2122/97
gauugugucccauggugagcug

SEQ ID NO: 1178539 - RNA, 15 nt, Mycobacterium bovis subsp bovis AF2122/97
gauuugggucagugc

SEQ ID NO: 1178540 - RNA, 22 nt, Mycobacterium bovis subsp bovis AF2122/97
gauuucggugacuccggcugga

SEQ ID NO: 1178541 - RNA, 14 nt, Mycobacterium bovis subsp bovis AF2122/97
gauuuucucggugc

SEQ ID NO: 1178542 - RNA, 18 nt, Mycobacterium bovis subsp bovis AF2122/97
gauggccccgggcgguga

SEQ ID NO: 1178543 - RNA, 12 nt, Mycobacterium bovis subsp bovis AF2122/97
gauggccaggcc

SEQ ID NO: 1178544 - RNA, 10 nt, Mycobacterium bovis subsp bovis AF2122/97
gauggccccg

SEQ ID NO: 1178545 - RNA, 18 nt, Mycobacterium bovis subsp bovis AF2122/97
gauggcgaaccucaccug

SEQ ID NO: 1178546 - RNA, 16 nt, Mycobacterium bovis subsp bovis AF2122/97
gauggccagcgcggcg

SEQ ID NO: 1178547 - RNA, 15 nt, Mycobacterium bovis subsp bovis AF2122/97
gauggcaggggcgau

SEQ ID NO: 1178548 - RNA, 18 nt, Mycobacterium bovis subsp bovis AF2122/97
gauggcgauacgcgcguc

SEQ ID NO: 1178549 - RNA, 21 nt, Mycobacterium bovis subsp bovis AF2122/97
gauggcgaucaugagcagcac

SEQ ID NO: 1178550 - RNA, 14 nt, Mycobacterium bovis subsp bovis AF2122/97
gauggcggccacca

SEQ ID NO: 1178551 - RNA, 12 nt, Mycobacterium bovis subsp bovis AF2122/97
gauggcgguggc

SEQ ID NO: 1178552 - RNA, 16 nt, Mycobacterium bovis subsp bovis AF2122/97
gauggcguccaucucg

SEQ ID NO: 1178553 - RNA, 17 nt, Mycobacterium bovis subsp bovis AF2122/97
gauggcgucggccagga

SEQ ID NO: 1178554 - RNA, 14 nt, Mycobacterium bovis subsp bovis AF2122/97
gaugcugccggcac

SEQ ID NO: 1178555 - RNA, 13 nt, Mycobacterium bovis subsp bovis AF2122/97
gaugcugccagcc

SEQ ID NO: 1178556 - RNA, 19 nt, Mycobacterium bovis subsp bovis AF2122/97
gaugcugccagccauggcc

SEQ ID NO: 1178557 - RNA, 10 nt, Mycobacterium bovis subsp bovis AF2122/97
gaugcugggc

SEQ ID NO: 1178558 - RNA, 13 nt, Mycobacterium bovis subsp bovis AF2122/97
gaugcuucccgga

SEQ ID NO: 1178559 - RNA, 21 nt, Mycobacterium bovis subsp bovis AF2122/97
gauggauuggcgucagcagca

SEQ ID NO: 1178560 - RNA, 14 nt, Mycobacterium bovis subsp bovis AF2122/97
gauggacaccaccu

SEQ ID NO: 1178561 - RNA, 14 nt, Mycobacterium bovis subsp bovis AF2122/97
gauggacaccagcc

SEQ ID NO: 1178562 - RNA, 18 nt, Mycobacterium bovis subsp bovis AF2122/97
gauggaaggcggccaggu

SEQ ID NO: 1178563 - RNA, 14 nt, Mycobacterium bovis subsp bovis AF2122/97
gauggugugcagca

SEQ ID NO: 1178564 - RNA, 16 nt, Mycobacterium bovis subsp bovis AF2122/97
gauggugugcccgcac

SEQ ID NO: 1178565 - RNA, 17 nt, Mycobacterium bovis subsp bovis AF2122/97
gaugguguacugcugcu

SEQ ID NO: 1178566 - RNA, 23 nt, Mycobacterium bovis subsp bovis AF2122/97
gaugguguacugcugcuugagcu

SEQ ID NO: 1178567 - RNA, 20 nt, Mycobacterium bovis subsp bovis AF2122/97
gaugguggugccaaccuggg

SEQ ID NO: 1178568 - RNA, 21 nt, Mycobacterium bovis subsp bovis AF2122/97
gaugguggccgccaccuccca

SEQ ID NO: 1178569 - RNA, 14 nt, Mycobacterium bovis subsp bovis AF2122/97
gauguaccccagcg

SEQ ID NO: 1178570 - RNA, 19 nt, Mycobacterium bovis subsp bovis AF2122/97
gauguccgacgccaccgcc

SEQ ID NO: 1178571 - RNA, 20 nt, Mycobacterium bovis subsp bovis AF2122/97
gauguccgguccgccagcgc

SEQ ID NO: 1178572 - RNA, 17 nt, Mycobacterium bovis subsp bovis AF2122/97
gauguccucgacaccca

SEQ ID NO: 1178573 - RNA, 21 nt, Mycobacterium bovis subsp bovis AF2122/97
gauguccaggagugcgggcau

SEQ ID NO: 1178574 - RNA, 20 nt, Mycobacterium bovis subsp bovis AF2122/97
gaugucagugaucaccaacc

SEQ ID NO: 1178575 - RNA, 13 nt, Mycobacterium bovis subsp bovis AF2122/97
gauguccaggagu

SEQ ID NO: 1178576 - RNA, 23 nt, Mycobacterium bovis subsp bovis AF2122/97
gauggggaacggguagugcacgg

SEQ ID NO: 1178577 - RNA, 15 nt, Mycobacterium bovis subsp bovis AF2122/97
gaugggcaugguggu

SEQ ID NO: 1178578 - RNA, 17 nt, Mycobacterium bovis subsp bovis AF2122/97
gaugggcaugguggugg

SEQ ID NO: 1178579 - RNA, 19 nt, Mycobacterium bovis subsp bovis AF2122/97
gauggcucacccaggcgcc

SEQ ID NO: 1178580 - RNA, 22 nt, Mycobacterium bovis subsp bovis AF2122/97
gaugggaaccgaaucggcaccg

SEQ ID NO: 1178581 - RNA, 23 nt, Mycobacterium bovis subsp bovis AF2122/97
gaugggaccuugaucgagcaggg

SEQ ID NO: 1178582 - RNA, 21 nt, Mycobacterium bovis subsp bovis AF2122/97
gaugggagcccggcggcccga

SEQ ID NO: 1178583 - RNA, 15 nt, Mycobacterium bovis subsp bovis AF2122/97
gauggugaccagcag

SEQ ID NO: 1178584 - RNA, 23 nt, Mycobacterium bovis subsp bovis AF2122/97
gauggucucccggcugaugccug

SEQ ID NO: 1178585 - RNA, 17 nt, Mycobacterium bovis subsp bovis AF2122/97
gaugguaugcccgccgu

SEQ ID NO: 1178586 - RNA, 15 nt, Mycobacterium bovis subsp bovis AF2122/97
gauguggugugccug

SEQ ID NO: 1178587 - RNA, 19 nt, Mycobacterium bovis subsp bovis AF2122/97
gauguuacacuaaccgaau

SEQ ID NO: 1178588 - RNA, 17 nt, Mycobacterium bovis subsp bovis AF2122/97
gauguccgcggccacca

SEQ ID NO: 1178589 - RNA, 14 nt, Mycobacterium bovis subsp bovis AF2122/97
gaugucgacgacaa

SEQ ID NO: 1178590 - RNA, 20 nt, Mycobacterium bovis subsp bovis AF2122/97
gaugucgucaccgugggccu

SEQ ID NO: 1178591 - RNA, 14 nt, Mycobacterium bovis subsp bovis AF2122/97
gaugucggcuggug

SEQ ID NO: 1178592 - RNA, 14 nt, Mycobacterium bovis subsp bovis AF2122/97
gaugucgggaaggu

SEQ ID NO: 1178593 - RNA, 17 nt, Mycobacterium bovis subsp bovis AF2122/97
gaugucggcaccauagc

SEQ ID NO: 1178594 - RNA, 22 nt, Mycobacterium bovis subsp bovis AF2122/97
gaugugagcacaccgacagcac

SEQ ID NO: 1178595 - RNA, 13 nt, Mycobacterium bovis subsp bovis AF2122/97
gaugucuuccugc

SEQ ID NO: 1178596 - RNA, 19 nt, Mycobacterium bovis subsp bovis AF2122/97
gaugucguuggccaccucg

SEQ ID NO: 1178597 - RNA, 24 nt, Mycobacterium bovis subsp bovis AF2122/97
gaugucucggcaccacagugaaau

SEQ ID NO: 1178598 - RNA, 18 nt, Mycobacterium bovis subsp bovis AF2122/97
gaugucgucgaccaggcc

SEQ ID NO: 1178599 - RNA, 20 nt, Mycobacterium bovis subsp bovis AF2122/97
gaugucgucuuuggucagcc

SEQ ID NO: 1178600 - RNA, 19 nt, Mycobacterium bovis subsp bovis AF2122/97
gauguucagcgccacgucc

SEQ ID NO: 1178601 - RNA, 21 nt, Mycobacterium bovis subsp bovis AF2122/97
gauguuuuccccgcccuugcc

SEQ ID NO: 1178602 - RNA, 16 nt, Mycobacterium bovis subsp bovis AF2122/97
gauuaccagcggcacc

SEQ ID NO: 1178603 - RNA, 19 nt, Mycobacterium bovis subsp bovis AF2122/97
gaugagguucaucgccggc

SEQ ID NO: 1178604 - RNA, 16 nt, Mycobacterium bovis subsp bovis AF2122/97
gaugagguggccgcgc

SEQ ID NO: 1178605 - RNA, 17 nt, Mycobacterium bovis subsp bovis AF2122/97
gaugaugcaacgccaaa

SEQ ID NO: 1178606 - RNA, 18 nt, Mycobacterium bovis subsp bovis AF2122/97
gaugaugacggcggcccg

SEQ ID NO: 1178607 - RNA, 22 nt, Mycobacterium bovis subsp bovis AF2122/97
gaugaugccggcguuguaguug

SEQ ID NO: 1178608 - RNA, 16 nt, Mycobacterium bovis subsp bovis AF2122/97
aaagccucgguuagcu

SEQ ID NO: 1178609 - RNA, 20 nt, Mycobacterium bovis subsp bovis AF2122/97
gaugacccggaaucccgagu

SEQ ID NO: 1178610 - RNA, 17 nt, Mycobacterium bovis subsp bovis AF2122/97
gaugacccacugcaggc

SEQ ID NO: 1178611 - RNA, 19 nt, Mycobacterium bovis subsp bovis AF2122/97
gaugaccagcacaccgccc

SEQ ID NO: 1178612 - RNA, 13 nt, Mycobacterium bovis subsp bovis AF2122/97
gaugaccagugau

SEQ ID NO: 1178613 - RNA, 17 nt, Mycobacterium bovis subsp bovis AF2122/97
gaugacguugcagccgg

SEQ ID NO: 1178614 - RNA, 16 nt, Mycobacterium bovis subsp bovis AF2122/97
gaugaccuugcccacc

SEQ ID NO: 1178615 - RNA, 21 nt, Mycobacterium bovis subsp bovis AF2122/97
gaugaccgccaucgccaacac

SEQ ID NO: 1178616 - RNA, 12 nt, Mycobacterium bovis subsp bovis AF2122/97
gaugaccgcgcg

SEQ ID NO: 1178617 - RNA, 13 nt, Mycobacterium bovis subsp bovis AF2122/97
gaugagcgaggcu

SEQ ID NO: 1178618 - RNA, 20 nt, Mycobacterium bovis subsp bovis AF2122/97
gaugagcaugcccagcgcac

SEQ ID NO: 1178619 - RNA, 17 nt, Mycobacterium bovis subsp bovis AF2122/97
gaugagcgcuucgaggu

SEQ ID NO: 1178620 - RNA, 14 nt, Mycobacterium bovis subsp bovis AF2122/97
gaugagcucguuca

SEQ ID NO: 1178621 - RNA, 23 nt, Mycobacterium bovis subsp bovis AF2122/97
gaugagggcuuguggugagcgga

SEQ ID NO: 1178622 - RNA, 18 nt, Mycobacterium bovis subsp bovis AF2122/97
gaugaacggaaucuuguu

SEQ ID NO: 1178623 - RNA, 17 nt, Mycobacterium bovis subsp bovis AF2122/97
gaugaacagacgcccga

SEQ ID NO: 1178624 - RNA, 12 nt, Mycobacterium bovis subsp bovis AF2122/97
gaugaagcuggu

SEQ ID NO: 1178625 - RNA, 20 nt, Mycobacterium bovis subsp bovis AF2122/97
gaugaaggugacgacgaggg

SEQ ID NO: 1178626 - RNA, 15 nt, Mycobacterium bovis subsp bovis AF2122/97
gaucuugguguuggu

SEQ ID NO: 1178627 - RNA, 11 nt, Mycobacterium bovis subsp bovis AF2122/97
gaucuuggcca

SEQ ID NO: 1178628 - RNA, 20 nt, Mycobacterium bovis subsp bovis AF2122/97
gaucuugccgcuggugguga

SEQ ID NO: 1178629 - RNA, 20 nt, Mycobacterium bovis subsp bovis AF2122/97
gaucuucgacaggccaccgc

SEQ ID NO: 1178630 - RNA, 22 nt, Mycobacterium bovis subsp bovis AF2122/97
gaugcgcugcucacgcagcagu

SEQ ID NO: 1178631 - RNA, 18 nt, Mycobacterium bovis subsp bovis AF2122/97
gaugcgggccgccaggcg

SEQ ID NO: 1178632 - RNA, 23 nt, Mycobacterium bovis subsp bovis AF2122/97
gaugcgguaucggucgacuggga

SEQ ID NO: 1178633 - RNA, 20 nt, Mycobacterium bovis subsp bovis AF2122/97
gaugcguccgcccagccgca

SEQ ID NO: 1178634 - RNA, 19 nt, Mycobacterium bovis subsp bovis AF2122/97
gaugcgguguagggcggcg

SEQ ID NO: 1178635 - RNA, 15 nt, Mycobacterium bovis subsp bovis AF2122/97
gaugcgugguuggcc

SEQ ID NO: 1178636 - RNA, 22 nt, Mycobacterium bovis subsp bovis AF2122/97
gaugcugagcgccaggccgcac

SEQ ID NO: 1178637 - RNA, 20 nt, Mycobacterium bovis subsp bovis AF2122/97
gaugcugaacacgcagccga

SEQ ID NO: 1178638 - RNA, 22 nt, Mycobacterium bovis subsp bovis AF2122/97
gaugccggcuagauaacccaac

SEQ ID NO: 1178639 - RNA, 16 nt, Mycobacterium bovis subsp bovis AF2122/97
gaugccggcgagggcc

SEQ ID NO: 1178640 - RNA, 17 nt, Mycobacterium bovis subsp bovis AF2122/97
gaugccggcgagggcca

SEQ ID NO: 1178641 - RNA, 20 nt, Mycobacterium bovis subsp bovis AF2122/97
gaugccgucuuugucacgca

SEQ ID NO: 1178642 - RNA, 18 nt, Mycobacterium bovis subsp bovis AF2122/97
gaugccguaggcggccag

SEQ ID NO: 1178643 - RNA, 12 nt, Mycobacterium bovis subsp bovis AF2122/97
gaugccgcccgu

SEQ ID NO: 1178644 - RNA, 21 nt, Mycobacterium bovis subsp bovis AF2122/97
gaugccgcccgugagauccuc

SEQ ID NO: 1178645 - RNA, 23 nt, Mycobacterium bovis subsp bovis AF2122/97
gaugccgcccgugagauccucca

SEQ ID NO: 1178646 - RNA, 16 nt, Mycobacterium bovis subsp bovis AF2122/97
gaugcgccaggcugaa

SEQ ID NO: 1178647 - RNA, 23 nt, Mycobacterium bovis subsp bovis AF2122/97
gaugcgcaacuucuucagcagcg

SEQ ID NO: 1178648 - RNA, 14 nt, Mycobacterium bovis subsp bovis AF2122/97
gaugccugccaccc

SEQ ID NO: 1178649 - RNA, 19 nt, Mycobacterium bovis subsp bovis AF2122/97
gaugccuucguagcggccg

SEQ ID NO: 1178650 - RNA, 17 nt, Mycobacterium bovis subsp bovis AF2122/97
gaugccgugcccggugc

SEQ ID NO: 1178651 - RNA, 12 nt, Mycobacterium bovis subsp bovis AF2122/97
gaugccguaggc

SEQ ID NO: 1178652 - RNA, 22 nt, Mycobacterium bovis subsp bovis AF2122/97
gaugccuagugguucgaaccgu

SEQ ID NO: 1178653 - RNA, 13 nt, Mycobacterium bovis subsp bovis AF2122/97
gaugcccagcgcc

SEQ ID NO: 1178654 - RNA, 14 nt, Mycobacterium bovis subsp bovis AF2122/97
gaugcccagcagga

SEQ ID NO: 1178655 - RNA, 17 nt, Mycobacterium bovis subsp bovis AF2122/97
gaugccccuucaaagcg

SEQ ID NO: 1178656 - RNA, 19 nt, Mycobacterium bovis subsp bovis AF2122/97
gaugcccaucacgccccag

SEQ ID NO: 1178657 - RNA, 17 nt, Mycobacterium bovis subsp bovis AF2122/97
gaugcccauccggccgu

SEQ ID NO: 1178658 - RNA, 15 nt, Mycobacterium bovis subsp bovis AF2122/97
gaugccgaagccccc

SEQ ID NO: 1178659 - RNA, 16 nt, Mycobacterium bovis subsp bovis AF2122/97
gaugccgacggcgggc

SEQ ID NO: 1178660 - RNA, 20 nt, Mycobacterium bovis subsp bovis AF2122/97
gaugcccuccucgaccgcgg

SEQ ID NO: 1178661 - RNA, 21 nt, Mycobacterium bovis subsp bovis AF2122/97
gaugcccguagacgccgagca

SEQ ID NO: 1178662 - RNA, 21 nt, Mycobacterium bovis subsp bovis AF2122/97
gaugcccgguuucuucuucaa

SEQ ID NO: 1178663 - RNA, 13 nt, Mycobacterium bovis subsp bovis AF2122/97
gaugccacccaac

SEQ ID NO: 1178664 - RNA, 19 nt, Mycobacterium bovis subsp bovis AF2122/97
gaugcaugucuuguggugg

SEQ ID NO: 1178665 - RNA, 21 nt, Mycobacterium bovis subsp bovis AF2122/97
gaugcaucccaacgagaugug

SEQ ID NO: 1178666 - RNA, 18 nt, Mycobacterium bovis subsp bovis AF2122/97
gaugcagggcccgcaaca

SEQ ID NO: 1178667 - RNA, 14 nt, Mycobacterium bovis subsp bovis AF2122/97
aaagcgacagcgcg

SEQ ID NO: 1178668 - RNA, 15 nt, Mycobacterium bovis subsp bovis AF2122/97
aaagcgacgagcagc

SEQ ID NO: 1178669 - RNA, 18 nt, Mycobacterium bovis subsp bovis AF2122/97
gaugcaacgccaaaaugg

SEQ ID NO: 1178670 - RNA, 17 nt, Mycobacterium bovis subsp bovis AF2122/97
gaugcaagcgggcauga

SEQ ID NO: 1178671 - RNA, 22 nt, Mycobacterium bovis subsp bovis AF2122/97
gaugcaacucggcagauugucg

SEQ ID NO: 1178672 - RNA, 21 nt, Mycobacterium bovis subsp bovis AF2122/97
gaugcacaaccgcugcugcug

SEQ ID NO: 1178673 - RNA, 14 nt, Mycobacterium bovis subsp bovis AF2122/97
gaugcaacccggug

SEQ ID NO: 1178674 - RNA, 20 nt, Mycobacterium bovis subsp bovis AF2122/97
gauagacguuguugaaggcu

SEQ ID NO: 1178675 - RNA, 23 nt, Mycobacterium bovis subsp bovis AF2122/97
gauagacuagccgauccagcagg

SEQ ID NO: 1178676 - RNA, 16 nt, Mycobacterium bovis subsp bovis AF2122/97
gauacucggcgacugc

SEQ ID NO: 1178677 - RNA, 24 nt, Mycobacterium bovis subsp bovis AF2122/97
gauaagccugggaaacugggucua

SEQ ID NO: 1178678 - RNA, 20 nt, Mycobacterium bovis subsp bovis AF2122/97
gauaccugggacaggacgac

SEQ ID NO: 1178679 - RNA, 18 nt, Mycobacterium bovis subsp bovis AF2122/97
gauaggucgggcaugacg

SEQ ID NO: 1178680 - RNA, 16 nt, Mycobacterium bovis subsp bovis AF2122/97
gauaggccgcgcggcg

SEQ ID NO: 1178681 - RNA, 20 nt, Mycobacterium bovis subsp bovis AF2122/97
gauagaugcgugcggcagug

SEQ ID NO: 1178682 - RNA, 17 nt, Mycobacterium bovis subsp bovis AF2122/97
gauauagggcuccucgu

SEQ ID NO: 1178683 - RNA, 23 nt, Mycobacterium bovis subsp bovis AF2122/97
gaucaacaccaacgacagcgacg

SEQ ID NO: 1178684 - RNA, 13 nt, Mycobacterium bovis subsp bovis AF2122/97
gaucaacccgguc

SEQ ID NO: 1178685 - RNA, 21 nt, Mycobacterium bovis subsp bovis AF2122/97
gaucaacucgggcagcgcggc

SEQ ID NO: 1178686 - RNA, 19 nt, Mycobacterium bovis subsp bovis AF2122/97
gaucaacucgugcgggcag

SEQ ID NO: 1178687 - RNA, 17 nt, Mycobacterium bovis subsp bovis AF2122/97
gaucaaccgggucagcc

SEQ ID NO: 1178688 - RNA, 20 nt, Mycobacterium bovis subsp bovis AF2122/97
gauaugcgucgauugccgcg

SEQ ID NO: 1178689 - RNA, 17 nt, Mycobacterium bovis subsp bovis AF2122/97
gauauggucaccaagac

SEQ ID NO: 1178690 - RNA, 19 nt, Mycobacterium bovis subsp bovis AF2122/97
gaucaccgacaccgugucg

SEQ ID NO: 1178691 - RNA, 22 nt, Mycobacterium bovis subsp bovis AF2122/97
gaucaccgagucgacggccagu

SEQ ID NO: 1178692 - RNA, 15 nt, Mycobacterium bovis subsp bovis AF2122/97
gaucaccauccagcc

SEQ ID NO: 1178693 - RNA, 21 nt, Mycobacterium bovis subsp bovis AF2122/97
gaucaaggcgcucccggagca

SEQ ID NO: 1178694 - RNA, 22 nt, Mycobacterium bovis subsp bovis AF2122/97
gaucaagcuggcccgcucauac

SEQ ID NO: 1178695 - RNA, 17 nt, Mycobacterium bovis subsp bovis AF2122/97
gaucagcagcggcgacc

SEQ ID NO: 1178696 - RNA, 13 nt, Mycobacterium bovis subsp bovis AF2122/97
gaucagcagcaga

SEQ ID NO: 1178697 - RNA, 16 nt, Mycobacterium bovis subsp bovis AF2122/97
gaucagaaucugccuc

SEQ ID NO: 1178698 - RNA, 19 nt, Mycobacterium bovis subsp bovis AF2122/97
gaucagcaacucggccacg

SEQ ID NO: 1178699 - RNA, 16 nt, Mycobacterium bovis subsp bovis AF2122/97
gaucaccgcggcgguc

SEQ ID NO: 1178700 - RNA, 20 nt, Mycobacterium bovis subsp bovis AF2122/97
gaucacccgcaucggcacgc

SEQ ID NO: 1178701 - RNA, 18 nt, Mycobacterium bovis subsp bovis AF2122/97
gaucaccgccggggcugg

SEQ ID NO: 1178702 - RNA, 18 nt, Mycobacterium bovis subsp bovis AF2122/97
gaucaccgcgcccgccgc

SEQ ID NO: 1178703 - RNA, 15 nt, Mycobacterium bovis subsp bovis AF2122/97
gaucacgccaccauc

SEQ ID NO: 1178704 - RNA, 14 nt, Mycobacterium bovis subsp bovis AF2122/97
gaucacgccgccgg

SEQ ID NO: 1178705 - RNA, 16 nt, Mycobacterium bovis subsp bovis AF2122/97
gaucacgccggccucg

SEQ ID NO: 1178706 - RNA, 15 nt, Mycobacterium bovis subsp bovis AF2122/97
gaucacggagcucuu

SEQ ID NO: 1178707 - RNA, 18 nt, Mycobacterium bovis subsp bovis AF2122/97
gaucacguacgccgccga

SEQ ID NO: 1178708 - RNA, 23 nt, Mycobacterium bovis subsp bovis AF2122/97
gaucacggcgggaugcagcugcc

SEQ ID NO: 1178709 - RNA, 19 nt, Mycobacterium bovis subsp bovis AF2122/97
gaucagcgugaucugcagg

SEQ ID NO: 1178710 - RNA, 20 nt, Mycobacterium bovis subsp bovis AF2122/97
gaucagcgugaucugcaggg

SEQ ID NO: 1178711 - RNA, 17 nt, Mycobacterium bovis subsp bovis AF2122/97
gaucagcgugucgccga

SEQ ID NO: 1178712 - RNA, 15 nt, Mycobacterium bovis subsp bovis AF2122/97
gaucagcgcggcgcc

SEQ ID NO: 1178713 - RNA, 21 nt, Mycobacterium bovis subsp bovis AF2122/97
gaucagcgaaccaccggcgcc

SEQ ID NO: 1178714 - RNA, 17 nt, Mycobacterium bovis subsp bovis AF2122/97
gaucaggguggcgcggu

SEQ ID NO: 1178715 - RNA, 16 nt, Mycobacterium bovis subsp bovis AF2122/97
gaucaggucgccgaga

SEQ ID NO: 1178716 - RNA, 22 nt, Mycobacterium bovis subsp bovis AF2122/97
gaucagggugucgaagagcagg

SEQ ID NO: 1178717 - RNA, 16 nt, Mycobacterium bovis subsp bovis AF2122/97
gaucaggggcccaccc

SEQ ID NO: 1178718 - RNA, 16 nt, Mycobacterium bovis subsp bovis AF2122/97
gaucagguuggcggcu

SEQ ID NO: 1178719 - RNA, 15 nt, Mycobacterium bovis subsp bovis AF2122/97
gaucagugcaagacc

SEQ ID NO: 1178720 - RNA, 17 nt, Mycobacterium bovis subsp bovis AF2122/97
gaucaguucguggcugg

SEQ ID NO: 1178721 - RNA, 17 nt, Mycobacterium bovis subsp bovis AF2122/97
gaucaugagcagcacgu

SEQ ID NO: 1178722 - RNA, 16 nt, Mycobacterium bovis subsp bovis AF2122/97
gaucauggcggcagca

SEQ ID NO: 1178723 - RNA, 18 nt, Mycobacterium bovis subsp bovis AF2122/97
gaucauguucggccacca

SEQ ID NO: 1178724 - RNA, 21 nt, Mycobacterium bovis subsp bovis AF2122/97
gaucaucgacgauuccaggua

SEQ ID NO: 1178725 - RNA, 13 nt, Mycobacterium bovis subsp bovis AF2122/97
gaucaucccggcg

SEQ ID NO: 1178726 - RNA, 17 nt, Mycobacterium bovis subsp bovis AF2122/97
gaucaucauauccgccc

SEQ ID NO: 1178727 - RNA, 17 nt, Mycobacterium bovis subsp bovis AF2122/97
gauccggaucccaccac

SEQ ID NO: 1178728 - RNA, 18 nt, Mycobacterium bovis subsp bovis AF2122/97
gauccggcagcagccggc

SEQ ID NO: 1178729 - RNA, 16 nt, Mycobacterium bovis subsp bovis AF2122/97
gauccggcgccauucg

SEQ ID NO: 1178730 - RNA, 23 nt, Mycobacterium bovis subsp bovis AF2122/97
gauccggccgccaacuucaccac

SEQ ID NO: 1178731 - RNA, 14 nt, Mycobacterium bovis subsp bovis AF2122/97
gauccggccagagu

SEQ ID NO: 1178732 - RNA, 21 nt, Mycobacterium bovis subsp bovis AF2122/97
gaucccuugucgaaguacugg

SEQ ID NO: 1178733 - RNA, 16 nt, Mycobacterium bovis subsp bovis AF2122/97
gauccgaugacauaug

SEQ ID NO: 1178734 - RNA, 16 nt, Mycobacterium bovis subsp bovis AF2122/97
gauccgccugccgacg

SEQ ID NO: 1178735 - RNA, 14 nt, Mycobacterium bovis subsp bovis AF2122/97
gauccgcacagcaa

SEQ ID NO: 1178736 - RNA, 20 nt, Mycobacterium bovis subsp bovis AF2122/97
gauccgcacccggccgcgca

SEQ ID NO: 1178737 - RNA, 18 nt, Mycobacterium bovis subsp bovis AF2122/97
gaucccgguggcagcaca

SEQ ID NO: 1178738 - RNA, 20 nt, Mycobacterium bovis subsp bovis AF2122/97
gaucccguucggggccccgc

SEQ ID NO: 1178739 - RNA, 11 nt, Mycobacterium bovis subsp bovis AF2122/97
gaucccggcgg

SEQ ID NO: 1178740 - RNA, 15 nt, Mycobacterium bovis subsp bovis AF2122/97
gaucccggccaggcc

SEQ ID NO: 1178741 - RNA, 20 nt, Mycobacterium bovis subsp bovis AF2122/97
gaucccggccgggucgagug

SEQ ID NO: 1178742 - RNA, 20 nt, Mycobacterium bovis subsp bovis AF2122/97
gauccccguugacccagacc

SEQ ID NO: 1178743 - RNA, 13 nt, Mycobacterium bovis subsp bovis AF2122/97
gauccccaaaucg

SEQ ID NO: 1178744 - RNA, 19 nt, Mycobacterium bovis subsp bovis AF2122/97
gauccccgcaauucccauc

SEQ ID NO: 1178745 - RNA, 15 nt, Mycobacterium bovis subsp bovis AF2122/97
gaucccgccggggcc

SEQ ID NO: 1178746 - RNA, 13 nt, Mycobacterium bovis subsp bovis AF2122/97
gaucccggccagc

SEQ ID NO: 1178747 - RNA, 13 nt, Mycobacterium bovis subsp bovis AF2122/97
gauccccagcucc

SEQ ID NO: 1178748 - RNA, 14 nt, Mycobacterium bovis subsp bovis AF2122/97
gaucccacccucgg

SEQ ID NO: 1178749 - RNA, 16 nt, Mycobacterium bovis subsp bovis AF2122/97
gaucccacggcgggcg

SEQ ID NO: 1178750 - RNA, 21 nt, Mycobacterium bovis subsp bovis AF2122/97
gauccaggccucgcaccggau

SEQ ID NO: 1178751 - RNA, 18 nt, Mycobacterium bovis subsp bovis AF2122/97
gauccagggagcggcugc

SEQ ID NO: 1178752 - RNA, 13 nt, Mycobacterium bovis subsp bovis AF2122/97
gauccacgccaga

SEQ ID NO: 1178753 - RNA, 16 nt, Mycobacterium bovis subsp bovis AF2122/97
gauccaccaagcucgc

SEQ ID NO: 1178754 - RNA, 13 nt, Mycobacterium bovis subsp bovis AF2122/97
gauccagccaugc

SEQ ID NO: 1178755 - RNA, 17 nt, Mycobacterium bovis subsp bovis AF2122/97
gaucauugcacccaccc

SEQ ID NO: 1178756 - RNA, 21 nt, Mycobacterium bovis subsp bovis AF2122/97
gauccacaacagcccguagca

SEQ ID NO: 1178757 - RNA, 22 nt, Mycobacterium bovis subsp bovis AF2122/97
gauccacauggugaccauggcc

SEQ ID NO: 1178758 - RNA, 18 nt, Mycobacterium bovis subsp bovis AF2122/97
gaucgaccaauucgaccg

SEQ ID NO: 1178759 - RNA, 21 nt, Mycobacterium bovis subsp bovis AF2122/97
gaucgaccaauucgaccgcgc

SEQ ID NO: 1178760 - RNA, 13 nt, Mycobacterium bovis subsp bovis AF2122/97
gaucgacccgguc

SEQ ID NO: 1178761 - RNA, 15 nt, Mycobacterium bovis subsp bovis AF2122/97
gaucgacgccgccac

SEQ ID NO: 1178762 - RNA, 22 nt, Mycobacterium bovis subsp bovis AF2122/97
gaucgacgccgccacccggcgg

SEQ ID NO: 1178763 - RNA, 15 nt, Mycobacterium bovis subsp bovis AF2122/97
gaucgagcaggccgc

SEQ ID NO: 1178764 - RNA, 13 nt, Mycobacterium bovis subsp bovis AF2122/97
gaucgagcagggu

SEQ ID NO: 1178765 - RNA, 19 nt, Mycobacterium bovis subsp bovis AF2122/97
gaucgagcaguuccagcuc

SEQ ID NO: 1178766 - RNA, 16 nt, Mycobacterium bovis subsp bovis AF2122/97
gaucgaggcggcgguc

SEQ ID NO: 1178767 - RNA, 21 nt, Mycobacterium bovis subsp bovis AF2122/97
gaucgagguugacgucaggcu

SEQ ID NO: 1178768 - RNA, 20 nt, Mycobacterium bovis subsp bovis AF2122/97
gaucgaucugcgggcggguc

SEQ ID NO: 1178769 - RNA, 21 nt, Mycobacterium bovis subsp bovis AF2122/97
gaucgauuuggaucggcugcg

SEQ ID NO: 1178770 - RNA, 13 nt, Mycobacterium bovis subsp bovis AF2122/97
gaucgcagcgcca

SEQ ID NO: 1178771 - RNA, 19 nt, Mycobacterium bovis subsp bovis AF2122/97
gaucgcagggaucaccccg

SEQ ID NO: 1178772 - RNA, 16 nt, Mycobacterium bovis subsp bovis AF2122/97
gaucgcacaccaacac

SEQ ID NO: 1178773 - RNA, 22 nt, Mycobacterium bovis subsp bovis AF2122/97
aaagccaccagaauccugcuuu

SEQ ID NO: 1178774 - RNA, 13 nt, Mycobacterium bovis subsp bovis AF2122/97
gauccgggcgccg

SEQ ID NO: 1178775 - RNA, 14 nt, Mycobacterium bovis subsp bovis AF2122/97
aaagcccggcggca

SEQ ID NO: 1178776 - RNA, 13 nt, Mycobacterium bovis subsp bovis AF2122/97
aaagccagcgcag

SEQ ID NO: 1178777 - RNA, 18 nt, Mycobacterium bovis subsp bovis AF2122/97
gaucgccccagccaugcu

SEQ ID NO: 1178778 - RNA, 17 nt, Mycobacterium bovis subsp bovis AF2122/97
gaucgcccugacaccca

SEQ ID NO: 1178779 - RNA, 14 nt, Mycobacterium bovis subsp bovis AF2122/97
gaucgcagugggca

SEQ ID NO: 1178780 - RNA, 12 nt, Mycobacterium bovis subsp bovis AF2122/97
gaucgccaccgg

SEQ ID NO: 1178781 - RNA, 20 nt, Mycobacterium bovis subsp bovis AF2122/97
gaucgccgagcaggucggca

SEQ ID NO: 1178782 - RNA, 16 nt, Mycobacterium bovis subsp bovis AF2122/97
gaucgccgccggcgcc

SEQ ID NO: 1178783 - RNA, 14 nt, Mycobacterium bovis subsp bovis AF2122/97
gaucggcaaaccgu

SEQ ID NO: 1178784 - RNA, 17 nt, Mycobacterium bovis subsp bovis AF2122/97
gaucggaggcccgccac

SEQ ID NO: 1178785 - RNA, 13 nt, Mycobacterium bovis subsp bovis AF2122/97
gaucggcacccca

SEQ ID NO: 1178786 - RNA, 14 nt, Mycobacterium bovis subsp bovis AF2122/97
gaucggaagaaacg

SEQ ID NO: 1178787 - RNA, 16 nt, Mycobacterium bovis subsp bovis AF2122/97
gaucggaccaccaggg

SEQ ID NO: 1178788 - RNA, 18 nt, Mycobacterium bovis subsp bovis AF2122/97
gaucgcggcgcccaggaa

SEQ ID NO: 1178789 - RNA, 19 nt, Mycobacterium bovis subsp bovis AF2122/97
gaucgcggcggccuccacc

SEQ ID NO: 1178790 - RNA, 14 nt, Mycobacterium bovis subsp bovis AF2122/97
gaucgcgcccugcg

SEQ ID NO: 1178791 - RNA, 14 nt, Mycobacterium bovis subsp bovis AF2122/97
gaucgcgcgagcga

SEQ ID NO: 1178792 - RNA, 23 nt, Mycobacterium bovis subsp bovis AF2122/97
gaucgcggucaaauccagcagcc

SEQ ID NO: 1178793 - RNA, 14 nt, Mycobacterium bovis subsp bovis AF2122/97
gaucgcggucagcg

SEQ ID NO: 1178794 - RNA, 18 nt, Mycobacterium bovis subsp bovis AF2122/97
gaucgcgguccaacagcg

SEQ ID NO: 1178795 - RNA, 19 nt, Mycobacterium bovis subsp bovis AF2122/97
gaucgcguuuguggcuggg

SEQ ID NO: 1178796 - RNA, 15 nt, Mycobacterium bovis subsp bovis AF2122/97
gaucgugagacgccg

SEQ ID NO: 1178797 - RNA, 14 nt, Mycobacterium bovis subsp bovis AF2122/97
gaucgucgggagca

SEQ ID NO: 1178798 - RNA, 16 nt, Mycobacterium bovis subsp bovis AF2122/97
gaucguccagcccaga

SEQ ID NO: 1178799 - RNA, 14 nt, Mycobacterium bovis subsp bovis AF2122/97
gaucguucaaugca

SEQ ID NO: 1178800 - RNA, 19 nt, Mycobacterium bovis subsp bovis AF2122/97
gaucggugccagaaugccg

SEQ ID NO: 1178801 - RNA, 17 nt, Mycobacterium bovis subsp bovis AF2122/97
gaucggugccagcacuc

SEQ ID NO: 1178802 - RNA, 22 nt, Mycobacterium bovis subsp bovis AF2122/97
gaucguagguacgcagggucug

SEQ ID NO: 1178803 - RNA, 15 nt, Mycobacterium bovis subsp bovis AF2122/97
gaucgucacucccga

SEQ ID NO: 1178804 - RNA, 19 nt, Mycobacterium bovis subsp bovis AF2122/97
gaucggugcgaucaggcug

SEQ ID NO: 1178805 - RNA, 22 nt, Mycobacterium bovis subsp bovis AF2122/97
gaucgggucguuggcggcgguc

SEQ ID NO: 1178806 - RNA, 20 nt, Mycobacterium bovis subsp bovis AF2122/97
gaucggcuaccuaacccgca

SEQ ID NO: 1178807 - RNA, 16 nt, Mycobacterium bovis subsp bovis AF2122/97
gaucggcugcgcgcuc

SEQ ID NO: 1178808 - RNA, 17 nt, Mycobacterium bovis subsp bovis AF2122/97
gaucggcgcgccgaucg

SEQ ID NO: 1178809 - RNA, 15 nt, Mycobacterium bovis subsp bovis AF2122/97
gaucggcccagcccu

SEQ ID NO: 1178810 - RNA, 20 nt, Mycobacterium bovis subsp bovis AF2122/97
gaucggccauucgggaugcg

SEQ ID NO: 1178811 - RNA, 22 nt, Mycobacterium bovis subsp bovis AF2122/97
gaucggcagucccagcgccgca

SEQ ID NO: 1178812 - RNA, 11 nt, Mycobacterium bovis subsp bovis AF2122/97
gaucggcacuu

SEQ ID NO: 1178813 - RNA, 15 nt, Mycobacterium bovis subsp bovis AF2122/97
gaucugguccagugg

SEQ ID NO: 1178814 - RNA, 16 nt, Mycobacterium bovis subsp bovis AF2122/97
gaucuggucggcggcc

SEQ ID NO: 1178815 - RNA, 18 nt, Mycobacterium bovis subsp bovis AF2122/97
gaucuggucggcggccuc

SEQ ID NO: 1178816 - RNA, 14 nt, Mycobacterium bovis subsp bovis AF2122/97
gaucuggcgcagca

SEQ ID NO: 1178817 - RNA, 21 nt, Mycobacterium bovis subsp bovis AF2122/97
gaucugccgccgcggccacaa

SEQ ID NO: 1178818 - RNA, 24 nt, Mycobacterium bovis subsp bovis AF2122/97
gaucugccgccgcggccacaaccu

SEQ ID NO: 1178819 - RNA, 16 nt, Mycobacterium bovis subsp bovis AF2122/97
gaucugcccccgccgg

SEQ ID NO: 1178820 - RNA, 17 nt, Mycobacterium bovis subsp bovis AF2122/97
gaucugcgccaggggca

SEQ ID NO: 1178821 - RNA, 18 nt, Mycobacterium bovis subsp bovis AF2122/97
gaucugagggcucggugg

SEQ ID NO: 1178822 - RNA, 15 nt, Mycobacterium bovis subsp bovis AF2122/97
gaucugcuccucggu

SEQ ID NO: 1178823 - RNA, 20 nt, Mycobacterium bovis subsp bovis AF2122/97
gaucugcugugucguacccg

SEQ ID NO: 1178824 - RNA, 16 nt, Mycobacterium bovis subsp bovis AF2122/97
gaucucguagccgccg

SEQ ID NO: 1178825 - RNA, 19 nt, Mycobacterium bovis subsp bovis AF2122/97
gaucuccccguccugccag

SEQ ID NO: 1178826 - RNA, 19 nt, Mycobacterium bovis subsp bovis AF2122/97
gaucuccaccuucuggucc

SEQ ID NO: 1178827 - RNA, 19 nt, Mycobacterium bovis subsp bovis AF2122/97
gaucucauccuccugcgcc

SEQ ID NO: 1178828 - RNA, 17 nt, Mycobacterium bovis subsp bovis AF2122/97
gaucucgccgccagcgc

SEQ ID NO: 1178829 - RNA, 15 nt, Mycobacterium bovis subsp bovis AF2122/97
gaucucgccccagug

SEQ ID NO: 1178830 - RNA, 15 nt, Mycobacterium bovis subsp bovis AF2122/97
gaucucgaccagcgc

SEQ ID NO: 1178831 - RNA, 22 nt, Mycobacterium bovis subsp bovis AF2122/97
gaucucgaccggcuugcccucc

SEQ ID NO: 1178832 - RNA, 21 nt, Mycobacterium bovis subsp bovis AF2122/97
gaucucgaccguauugaccag

SEQ ID NO: 1178833 - RNA, 18 nt, Mycobacterium bovis subsp bovis AF2122/97
gaucucgaucgacccggu

SEQ ID NO: 1178834 - RNA, 22 nt, Mycobacterium bovis subsp bovis AF2122/97
gaucucaccacccgucggcccg

SEQ ID NO: 1178835 - RNA, 23 nt, Mycobacterium bovis subsp bovis AF2122/97
gaucguuuccguagacgggguga

SEQ ID NO: 1178836 - RNA, 13 nt, Mycobacterium bovis subsp bovis AF2122/97
gaggcgcggucga

SEQ ID NO: 1178837 - RNA, 19 nt, Mycobacterium bovis subsp bovis AF2122/97
gaggcgaucaccgcgccgg

SEQ ID NO: 1178838 - RNA, 16 nt, Mycobacterium bovis subsp bovis AF2122/97
gaggcgcucacccgcc

SEQ ID NO: 1178839 - RNA, 11 nt, Mycobacterium bovis subsp bovis AF2122/97
gaggcgagcgg

SEQ ID NO: 1178840 - RNA, 15 nt, Mycobacterium bovis subsp bovis AF2122/97
gaggcgaccccggcc

SEQ ID NO: 1178841 - RNA, 15 nt, Mycobacterium bovis subsp bovis AF2122/97
gaggccucggccagc

SEQ ID NO: 1178842 - RNA, 19 nt, Mycobacterium bovis subsp bovis AF2122/97
gaggccucgucccacaacu

SEQ ID NO: 1178843 - RNA, 14 nt, Mycobacterium bovis subsp bovis AF2122/97
gaggccggugaacg

SEQ ID NO: 1178844 - RNA, 16 nt, Mycobacterium bovis subsp bovis AF2122/97
gagggcuaccggcgcc

SEQ ID NO: 1178845 - RNA, 18 nt, Mycobacterium bovis subsp bovis AF2122/97
gagggcuguugacgccac

SEQ ID NO: 1178846 - RNA, 24 nt, Mycobacterium bovis subsp bovis AF2122/97
gaggcggucgaucauggcggcagc

SEQ ID NO: 1178847 - RNA, 22 nt, Mycobacterium bovis subsp bovis AF2122/97
gagggugugagguagucggcgc

SEQ ID NO: 1178848 - RNA, 21 nt, Mycobacterium bovis subsp bovis AF2122/97
gaggguucgccgaagccggac

SEQ ID NO: 1178849 - RNA, 22 nt, Mycobacterium bovis subsp bovis AF2122/97
gaggguuuucgcauagugcggc

SEQ ID NO: 1178850 - RNA, 19 nt, Mycobacterium bovis subsp bovis AF2122/97
gaggguucggacggcuggu

SEQ ID NO: 1178851 - RNA, 19 nt, Mycobacterium bovis subsp bovis AF2122/97
gagguauucguggucggcc

SEQ ID NO: 1178852 - RNA, 17 nt, Mycobacterium bovis subsp bovis AF2122/97
gagguaauccgcggggu

SEQ ID NO: 1178853 - RNA, 21 nt, Mycobacterium bovis subsp bovis AF2122/97
gagguacccaucgucgagccg

SEQ ID NO: 1178854 - RNA, 23 nt, Mycobacterium bovis subsp bovis AF2122/97
gagguacccaucgucgagccgcc

SEQ ID NO: 1178855 - RNA, 19 nt, Mycobacterium bovis subsp bovis AF2122/97
gaguaagcgaacagcggca

SEQ ID NO: 1178856 - RNA, 14 nt, Mycobacterium bovis subsp bovis AF2122/97
gaggaggcggucga

SEQ ID NO: 1178857 - RNA, 18 nt, Mycobacterium bovis subsp bovis AF2122/97
gaggccaaguugcagcgg

SEQ ID NO: 1178858 - RNA, 16 nt, Mycobacterium bovis subsp bovis AF2122/97
gaggccaaccacagcc

SEQ ID NO: 1178859 - RNA, 15 nt, Mycobacterium bovis subsp bovis AF2122/97
gaggcauucucccgg

SEQ ID NO: 1178860 - RNA, 15 nt, Mycobacterium bovis subsp bovis AF2122/97
gaggccgcugccagc

SEQ ID NO: 1178861 - RNA, 13 nt, Mycobacterium bovis subsp bovis AF2122/97
gaggccgccguug

SEQ ID NO: 1178862 - RNA, 17 nt, Mycobacterium bovis subsp bovis AF2122/97
gaggccgccaucgccgc

SEQ ID NO: 1178863 - RNA, 19 nt, Mycobacterium bovis subsp bovis AF2122/97
gaggcccgucacaaugccc

SEQ ID NO: 1178864 - RNA, 15 nt, Mycobacterium bovis subsp bovis AF2122/97
gaggcccgcggugga

SEQ ID NO: 1178865 - RNA, 19 nt, Mycobacterium bovis subsp bovis AF2122/97
gaggccauguugccgugga

SEQ ID NO: 1178866 - RNA, 14 nt, Mycobacterium bovis subsp bovis AF2122/97
gaggccccccgcgc

SEQ ID NO: 1178867 - RNA, 19 nt, Mycobacterium bovis subsp bovis AF2122/97
gaggaacucggacccaccc

SEQ ID NO: 1178868 - RNA, 14 nt, Mycobacterium bovis subsp bovis AF2122/97
gaggaagcggcggc

SEQ ID NO: 1178869 - RNA, 18 nt, Mycobacterium bovis subsp bovis AF2122/97
gaggacggcuugagccgc

SEQ ID NO: 1178870 - RNA, 15 nt, Mycobacterium bovis subsp bovis AF2122/97
gaggacuggaaagca

SEQ ID NO: 1178871 - RNA, 10 nt, Mycobacterium bovis subsp bovis AF2122/97
gaggaagccc

SEQ ID NO: 1178872 - RNA, 22 nt, Mycobacterium bovis subsp bovis AF2122/97
gaggaacuugcauccggcccac

SEQ ID NO: 1178873 - RNA, 17 nt, Mycobacterium bovis subsp bovis AF2122/97
gagcugacgauggccag

SEQ ID NO: 1178874 - RNA, 20 nt, Mycobacterium bovis subsp bovis AF2122/97
gagcugacgauggccaggcc

SEQ ID NO: 1178875 - RNA, 17 nt, Mycobacterium bovis subsp bovis AF2122/97
gagcucuaucgggaagc

SEQ ID NO: 1178876 - RNA, 17 nt, Mycobacterium bovis subsp bovis AF2122/97
gagcucuugcgggcagc

SEQ ID NO: 1178877 - RNA, 22 nt, Mycobacterium bovis subsp bovis AF2122/97
gagcucguugcuggcggccagc

SEQ ID NO: 1178878 - RNA, 15 nt, Mycobacterium bovis subsp bovis AF2122/97
gagcucgaagcccgg

SEQ ID NO: 1178879 - RNA, 22 nt, Mycobacterium bovis subsp bovis AF2122/97
gagcucgaaguuggcuuucggu

SEQ ID NO: 1178880 - RNA, 16 nt, Mycobacterium bovis subsp bovis AF2122/97
gagcucggucaccacg

SEQ ID NO: 1178881 - RNA, 15 nt, Mycobacterium bovis subsp bovis AF2122/97
gagcucgccgcagcg

SEQ ID NO: 1178882 - RNA, 13 nt, Mycobacterium bovis subsp bovis AF2122/97
gagcucgcgcaga

SEQ ID NO: 1178883 - RNA, 19 nt, Mycobacterium bovis subsp bovis AF2122/97
gagcugagcggccagcauc

SEQ ID NO: 1178884 - RNA, 19 nt, Mycobacterium bovis subsp bovis AF2122/97
gagucggcggggcggacuc

SEQ ID NO: 1178885 - RNA, 17 nt, Mycobacterium bovis subsp bovis AF2122/97
gagucgcgaacucaugc

SEQ ID NO: 1178886 - RNA, 14 nt, Mycobacterium bovis subsp bovis AF2122/97
gagucgcacguggg

SEQ ID NO: 1178887 - RNA, 24 nt, Mycobacterium bovis subsp bovis AF2122/97
gagucgaugaccccgguggucugg

SEQ ID NO: 1178888 - RNA, 13 nt, Mycobacterium bovis subsp bovis AF2122/97
gagucgcagcacg

SEQ ID NO: 1178889 - RNA, 15 nt, Mycobacterium bovis subsp bovis AF2122/97
gaguaccggccagcc

SEQ ID NO: 1178890 - RNA, 18 nt, Mycobacterium bovis subsp bovis AF2122/97
gaguaccggccagccgcg

SEQ ID NO: 1178891 - RNA, 16 nt, Mycobacterium bovis subsp bovis AF2122/97
gaguagaagauggcac

SEQ ID NO: 1178892 - RNA, 13 nt, Mycobacterium bovis subsp bovis AF2122/97
gaguacuccagcc

SEQ ID NO: 1178893 - RNA, 17 nt, Mycobacterium bovis subsp bovis AF2122/97
gaguacuccagccgcaa

SEQ ID NO: 1178894 - RNA, 17 nt, Mycobacterium bovis subsp bovis AF2122/97
gaguagaagauggcacc

SEQ ID NO: 1178895 - RNA, 15 nt, Mycobacterium bovis subsp bovis AF2122/97
gaguauuggucggug

SEQ ID NO: 1178896 - RNA, 17 nt, Mycobacterium bovis subsp bovis AF2122/97
gagucggcugguccucc

SEQ ID NO: 1178897 - RNA, 19 nt, Mycobacterium bovis subsp bovis AF2122/97
gagugaccacgcugcuggu

SEQ ID NO: 1178898 - RNA, 19 nt, Mycobacterium bovis subsp bovis AF2122/97
gagugaggcgcuggcccgc

SEQ ID NO: 1178899 - RNA, 20 nt, Mycobacterium bovis subsp bovis AF2122/97
gagugagcucagcaaguucg

SEQ ID NO: 1178900 - RNA, 12 nt, Mycobacterium bovis subsp bovis AF2122/97
gagugcagcacg

SEQ ID NO: 1178901 - RNA, 17 nt, Mycobacterium bovis subsp bovis AF2122/97
gagugcagcacgaucca

SEQ ID NO: 1178902 - RNA, 16 nt, Mycobacterium bovis subsp bovis AF2122/97
gagugugacggcggcc

SEQ ID NO: 1178903 - RNA, 16 nt, Mycobacterium bovis subsp bovis AF2122/97
gaguucgcaaugccug

SEQ ID NO: 1178904 - RNA, 16 nt, Mycobacterium bovis subsp bovis AF2122/97
gaguucgcgcagcacc

SEQ ID NO: 1178905 - RNA, 23 nt, Mycobacterium bovis subsp bovis AF2122/97
gagugucccgaugguggccgcgc

SEQ ID NO: 1178906 - RNA, 22 nt, Mycobacterium bovis subsp bovis AF2122/97
gaguugguguuauugaugcccg

SEQ ID NO: 1178907 - RNA, 20 nt, Mycobacterium bovis subsp bovis AF2122/97
gaguugucgacggccacccc

SEQ ID NO: 1178908 - RNA, 20 nt, Mycobacterium bovis subsp bovis AF2122/97
gaguucucgcugaucagcau

SEQ ID NO: 1178909 - RNA, 18 nt, Mycobacterium bovis subsp bovis AF2122/97
gaguucuggaauccggcc

SEQ ID NO: 1178910 - RNA, 21 nt, Mycobacterium bovis subsp bovis AF2122/97
gaguucuggaauccggccaga

SEQ ID NO: 1178911 - RNA, 22 nt, Mycobacterium bovis subsp bovis AF2122/97
gaguucuggaauccggccagac

SEQ ID NO: 1178912 - RNA, 14 nt, Mycobacterium bovis subsp bovis AF2122/97
gaguucggugcugu

SEQ ID NO: 1178913 - RNA, 22 nt, Mycobacterium bovis subsp bovis AF2122/97
gaguucggcccgcaaacagucg

SEQ ID NO: 1178914 - RNA, 12 nt, Mycobacterium bovis subsp bovis AF2122/97
gaguuucugcuc

SEQ ID NO: 1178915 - RNA, 19 nt, Mycobacterium bovis subsp bovis AF2122/97
gaguuugauuucgcacgga

SEQ ID NO: 1178916 - RNA, 24 nt, Mycobacterium bovis subsp bovis AF2122/97
gagccucgcgcgugugccugaguu

SEQ ID NO: 1178917 - RNA, 22 nt, Mycobacterium bovis subsp bovis AF2122/97
gagccgugccucgaggacggcg

SEQ ID NO: 1178918 - RNA, 17 nt, Mycobacterium bovis subsp bovis AF2122/97
gagccgugccgccagca

SEQ ID NO: 1178919 - RNA, 20 nt, Mycobacterium bovis subsp bovis AF2122/97
gagccgugccgccagcaacc

SEQ ID NO: 1178920 - RNA, 13 nt, Mycobacterium bovis subsp bovis AF2122/97
gagccgugccucg

SEQ ID NO: 1178921 - RNA, 14 nt, Mycobacterium bovis subsp bovis AF2122/97
gagccgugccagca

SEQ ID NO: 1178922 - RNA, 22 nt, Mycobacterium bovis subsp bovis AF2122/97
gagccgccgacucggcaccgcg

SEQ ID NO: 1178923 - RNA, 16 nt, Mycobacterium bovis subsp bovis AF2122/97
gagccgccgcgacggc

SEQ ID NO: 1178924 - RNA, 15 nt, Mycobacterium bovis subsp bovis AF2122/97
gagccgccggccccg

SEQ ID NO: 1178925 - RNA, 22 nt, Mycobacterium bovis subsp bovis AF2122/97
gagccgccggccccgccagcgc

SEQ ID NO: 1178926 - RNA, 19 nt, Mycobacterium bovis subsp bovis AF2122/97
gagccgguggcccgccggc

SEQ ID NO: 1178927 - RNA, 15 nt, Mycobacterium bovis subsp bovis AF2122/97
gagccgaggcgggaa

SEQ ID NO: 1178928 - RNA, 18 nt, Mycobacterium bovis subsp bovis AF2122/97
gagccgauauaccagggc

SEQ ID NO: 1178929 - RNA, 15 nt, Mycobacterium bovis subsp bovis AF2122/97
gagccgaucaccgcc

SEQ ID NO: 1178930 - RNA, 18 nt, Mycobacterium bovis subsp bovis AF2122/97
gagccgacgugcggcggc

SEQ ID NO: 1178931 - RNA, 22 nt, Mycobacterium bovis subsp bovis AF2122/97
gagccgacuuugagucguugga

SEQ ID NO: 1178932 - RNA, 11 nt, Mycobacterium bovis subsp bovis AF2122/97
gagccgcagcc

SEQ ID NO: 1178933 - RNA, 16 nt, Mycobacterium bovis subsp bovis AF2122/97
gagccgaugaccugcc

SEQ ID NO: 1178934 - RNA, 14 nt, Mycobacterium bovis subsp bovis AF2122/97
gagccgcccaagcc

SEQ ID NO: 1178935 - RNA, 13 nt, Mycobacterium bovis subsp bovis AF2122/97
gagccgccccggc

SEQ ID NO: 1178936 - RNA, 18 nt, Mycobacterium bovis subsp bovis AF2122/97
gagccacggcuucgccgc

SEQ ID NO: 1178937 - RNA, 13 nt, Mycobacterium bovis subsp bovis AF2122/97
gagccaccaacac

SEQ ID NO: 1178938 - RNA, 16 nt, Mycobacterium bovis subsp bovis AF2122/97
gagccaccaacaccgc

SEQ ID NO: 1178939 - RNA, 15 nt, Mycobacterium bovis subsp bovis AF2122/97
gagccacucggcccg

SEQ ID NO: 1178940 - RNA, 16 nt, Mycobacterium bovis subsp bovis AF2122/97
gagcgccucgggaggc

SEQ ID NO: 1178941 - RNA, 12 nt, Mycobacterium bovis subsp bovis AF2122/97
gagcgccaggcc

SEQ ID NO: 1178942 - RNA, 15 nt, Mycobacterium bovis subsp bovis AF2122/97
gagcgccgcggcgga

SEQ ID NO: 1178943 - RNA, 17 nt, Mycobacterium bovis subsp bovis AF2122/97
gagcgccaggccgcaca

SEQ ID NO: 1178944 - RNA, 23 nt, Mycobacterium bovis subsp bovis AF2122/97
gagcgcccgucguagguggccgg

SEQ ID NO: 1178945 - RNA, 12 nt, Mycobacterium bovis subsp bovis AF2122/97
gagcgccgagcu

SEQ ID NO: 1178946 - RNA, 13 nt, Mycobacterium bovis subsp bovis AF2122/97
gagcgcaccgcga

SEQ ID NO: 1178947 - RNA, 14 nt, Mycobacterium bovis subsp bovis AF2122/97
gagcgcaucggcca

SEQ ID NO: 1178948 - RNA, 13 nt, Mycobacterium bovis subsp bovis AF2122/97
gagcgcaacuccc

SEQ ID NO: 1178949 - RNA, 14 nt, Mycobacterium bovis subsp bovis AF2122/97
gagcgcaccacggc

SEQ ID NO: 1178950 - RNA, 20 nt, Mycobacterium bovis subsp bovis AF2122/97
gagcgcaccgcugaccgcaa

SEQ ID NO: 1178951 - RNA, 18 nt, Mycobacterium bovis subsp bovis AF2122/97
gagcgaguugcagucgcg

SEQ ID NO: 1178952 - RNA, 21 nt, Mycobacterium bovis subsp bovis AF2122/97
gagcgaguugcagucgcgagg

SEQ ID NO: 1178953 - RNA, 18 nt, Mycobacterium bovis subsp bovis AF2122/97
gagcgauacgucgucagc

SEQ ID NO: 1178954 - RNA, 20 nt, Mycobacterium bovis subsp bovis AF2122/97
gagcgcuuggucaaaaagcu

SEQ ID NO: 1178955 - RNA, 17 nt, Mycobacterium bovis subsp bovis AF2122/97
gagcgcugguuggccug

SEQ ID NO: 1178956 - RNA, 16 nt, Mycobacterium bovis subsp bovis AF2122/97
gagcgcuaucaccgcc

SEQ ID NO: 1178957 - RNA, 19 nt, Mycobacterium bovis subsp bovis AF2122/97
gagcgcgcguagcggggga

SEQ ID NO: 1178958 - RNA, 13 nt, Mycobacterium bovis subsp bovis AF2122/97
gagcgcgccguug

SEQ ID NO: 1178959 - RNA, 18 nt, Mycobacterium bovis subsp bovis AF2122/97
gagcgcgccucgcccagc

SEQ ID NO: 1178960 - RNA, 18 nt, Mycobacterium bovis subsp bovis AF2122/97
gagcgcgcguagcggggg

SEQ ID NO: 1178961 - RNA, 18 nt, Mycobacterium bovis subsp bovis AF2122/97
gagcgcggcggcggaggc

SEQ ID NO: 1178962 - RNA, 12 nt, Mycobacterium bovis subsp bovis AF2122/97
gagcgcggccug

SEQ ID NO: 1178963 - RNA, 19 nt, Mycobacterium bovis subsp bovis AF2122/97
gagcggcccuucaccagcc

SEQ ID NO: 1178964 - RNA, 12 nt, Mycobacterium bovis subsp bovis AF2122/97
gagcggccgcgc

SEQ ID NO: 1178965 - RNA, 12 nt, Mycobacterium bovis subsp bovis AF2122/97
gagcggccggca

SEQ ID NO: 1178966 - RNA, 17 nt, Mycobacterium bovis subsp bovis AF2122/97
gagcggccggcaugcug

SEQ ID NO: 1178967 - RNA, 16 nt, Mycobacterium bovis subsp bovis AF2122/97
gagcggccguggcaug

SEQ ID NO: 1178968 - RNA, 22 nt, Mycobacterium bovis subsp bovis AF2122/97
gagcggccaccguagccagcag

SEQ ID NO: 1178969 - RNA, 14 nt, Mycobacterium bovis subsp bovis AF2122/97
gagcggcggcacug

SEQ ID NO: 1178970 - RNA, 14 nt, Mycobacterium bovis subsp bovis AF2122/97
gagcggcgcggggg

SEQ ID NO: 1178971 - RNA, 15 nt, Mycobacterium bovis subsp bovis AF2122/97
gagcggcgcgggggu

SEQ ID NO: 1178972 - RNA, 16 nt, Mycobacterium bovis subsp bovis AF2122/97
gagcggcgcgggggug

SEQ ID NO: 1178973 - RNA, 19 nt, Mycobacterium bovis subsp bovis AF2122/97
gagcgggaucgggcccucc

SEQ ID NO: 1178974 - RNA, 21 nt, Mycobacterium bovis subsp bovis AF2122/97
gagcgggauucuggcgcagcu

SEQ ID NO: 1178975 - RNA, 16 nt, Mycobacterium bovis subsp bovis AF2122/97
gagcggguggccggga

SEQ ID NO: 1178976 - RNA, 16 nt, Mycobacterium bovis subsp bovis AF2122/97
gagcgggccagcaccc

SEQ ID NO: 1178977 - RNA, 19 nt, Mycobacterium bovis subsp bovis AF2122/97
gagcgguugccauccguca

SEQ ID NO: 1178978 - RNA, 20 nt, Mycobacterium bovis subsp bovis AF2122/97
gagcgguggcgucgucggcg

SEQ ID NO: 1178979 - RNA, 14 nt, Mycobacterium bovis subsp bovis AF2122/97
gagcgguggugagu

SEQ ID NO: 1178980 - RNA, 17 nt, Mycobacterium bovis subsp bovis AF2122/97
gagcgguaccccccagc

SEQ ID NO: 1178981 - RNA, 19 nt, Mycobacterium bovis subsp bovis AF2122/97
gagcguucuucagccaggg

SEQ ID NO: 1178982 - RNA, 20 nt, Mycobacterium bovis subsp bovis AF2122/97
gagcguuuuggugcggaccu

SEQ ID NO: 1178983 - RNA, 23 nt, Mycobacterium bovis subsp bovis AF2122/97
gagcuagccguucggcugccgcg

SEQ ID NO: 1178984 - RNA, 19 nt, Mycobacterium bovis subsp bovis AF2122/97
gagcuaccgcuucccccgg

SEQ ID NO: 1178985 - RNA, 14 nt, Mycobacterium bovis subsp bovis AF2122/97
gagcuaugcuggca

SEQ ID NO: 1178986 - RNA, 22 nt, Mycobacterium bovis subsp bovis AF2122/97
gagcucaccgcacaccugcgcg

SEQ ID NO: 1178987 - RNA, 20 nt, Mycobacterium bovis subsp bovis AF2122/97
gagcgugaaccuggcgacgc

SEQ ID NO: 1178988 - RNA, 14 nt, Mycobacterium bovis subsp bovis AF2122/97
gagcgugagcgccg

SEQ ID NO: 1178989 - RNA, 23 nt, Mycobacterium bovis subsp bovis AF2122/97
gagcguggccaauccggcggcga

SEQ ID NO: 1178990 - RNA, 19 nt, Mycobacterium bovis subsp bovis AF2122/97
gagcguaguucaccaacgc

SEQ ID NO: 1178991 - RNA, 19 nt, Mycobacterium bovis subsp bovis AF2122/97
gagauugggcugggauagc

SEQ ID NO: 1178992 - RNA, 15 nt, Mycobacterium bovis subsp bovis AF2122/97
gagauuggugcagac

SEQ ID NO: 1178993 - RNA, 20 nt, Mycobacterium bovis subsp bovis AF2122/97
gagauccugguaaggccggc

SEQ ID NO: 1178994 - RNA, 15 nt, Mycobacterium bovis subsp bovis AF2122/97
gagaucgaucgacag

SEQ ID NO: 1178995 - RNA, 16 nt, Mycobacterium bovis subsp bovis AF2122/97
gagaucgccgccggcg

SEQ ID NO: 1178996 - RNA, 19 nt, Mycobacterium bovis subsp bovis AF2122/97
gagaucgccguugccggcg

SEQ ID NO: 1178997 - RNA, 17 nt, Mycobacterium bovis subsp bovis AF2122/97
gagaucgucgcgaccuu

SEQ ID NO: 1178998 - RNA, 18 nt, Mycobacterium bovis subsp bovis AF2122/97
gagaucgucgcguaguga

SEQ ID NO: 1178999 - RNA, 16 nt, Mycobacterium bovis subsp bovis AF2122/97
gagaucguagggacgc

SEQ ID NO: 1179000 - RNA, 14 nt, Mycobacterium bovis subsp bovis AF2122/97
gagaucucugagcg

SEQ ID NO: 1179001 - RNA, 21 nt, Mycobacterium bovis subsp bovis AF2122/97
gagaucucugagcgggcgggc

SEQ ID NO: 1179002 - RNA, 13 nt, Mycobacterium bovis subsp bovis AF2122/97
gagagggcggggc

SEQ ID NO: 1179003 - RNA, 15 nt, Mycobacterium bovis subsp bovis AF2122/97
gagaggugcugcacc

SEQ ID NO: 1179004 - RNA, 23 nt, Mycobacterium bovis subsp bovis AF2122/97
gacuccagcaaggccagcacggc

SEQ ID NO: 1179005 - RNA, 21 nt, Mycobacterium bovis subsp bovis AF2122/97
gacuccaccccacccagcgac

SEQ ID NO: 1179006 - RNA, 21 nt, Mycobacterium bovis subsp bovis AF2122/97
gagaggccaagauggcgcgcu

SEQ ID NO: 1179007 - RNA, 15 nt, Mycobacterium bovis subsp bovis AF2122/97
gacucacccacccgc

SEQ ID NO: 1179008 - RNA, 18 nt, Mycobacterium bovis subsp bovis AF2122/97
gagcagcgugggaagagc

SEQ ID NO: 1179009 - RNA, 18 nt, Mycobacterium bovis subsp bovis AF2122/97
gagcagcgcggccagagc

SEQ ID NO: 1179010 - RNA, 22 nt, Mycobacterium bovis subsp bovis AF2122/97
gagcagccggaccguguacugg

SEQ ID NO: 1179011 - RNA, 13 nt, Mycobacterium bovis subsp bovis AF2122/97
gagcagccgaugc

SEQ ID NO: 1179012 - RNA, 13 nt, Mycobacterium bovis subsp bovis AF2122/97
gagcagcgcggcc

SEQ ID NO: 1179013 - RNA, 13 nt, Mycobacterium bovis subsp bovis AF2122/97
gagcaggccgccc

SEQ ID NO: 1179014 - RNA, 17 nt, Mycobacterium bovis subsp bovis AF2122/97
gagcaguuccagcucgc

SEQ ID NO: 1179015 - RNA, 16 nt, Mycobacterium bovis subsp bovis AF2122/97
gagcaggcgcaccagg

SEQ ID NO: 1179016 - RNA, 17 nt, Mycobacterium bovis subsp bovis AF2122/97
gagccaacgcgcagagc

SEQ ID NO: 1179017 - RNA, 16 nt, Mycobacterium bovis subsp bovis AF2122/97
gagcagcagcgggcug

SEQ ID NO: 1179018 - RNA, 22 nt, Mycobacterium bovis subsp bovis AF2122/97
gagcagcaccacccgcaccuca

SEQ ID NO: 1179019 - RNA, 16 nt, Mycobacterium bovis subsp bovis AF2122/97
gagcagccagccaccg

SEQ ID NO: 1179020 - RNA, 12 nt, Mycobacterium bovis subsp bovis AF2122/97
gagcagcaagcc

SEQ ID NO: 1179021 - RNA, 15 nt, Mycobacterium bovis subsp bovis AF2122/97
gagcagcaagccgcc

SEQ ID NO: 1179022 - RNA, 13 nt, Mycobacterium bovis subsp bovis AF2122/97
gagcagcacagca

SEQ ID NO: 1179023 - RNA, 17 nt, Mycobacterium bovis subsp bovis AF2122/97
gagcagcaagccgccgg

SEQ ID NO: 1179024 - RNA, 12 nt, Mycobacterium bovis subsp bovis AF2122/97
gagcagcaaucc

SEQ ID NO: 1179025 - RNA, 20 nt, Mycobacterium bovis subsp bovis AF2122/97
gagcaacaccccuggguuga

SEQ ID NO: 1179026 - RNA, 22 nt, Mycobacterium bovis subsp bovis AF2122/97
gagcaaaccagauugccgagcc

SEQ ID NO: 1179027 - RNA, 14 nt, Mycobacterium bovis subsp bovis AF2122/97
gagcaacggcggca

SEQ ID NO: 1179028 - RNA, 17 nt, Mycobacterium bovis subsp bovis AF2122/97
gagcaacggcggcaggc

SEQ ID NO: 1179029 - RNA, 14 nt, Mycobacterium bovis subsp bovis AF2122/97
cuuucccaccuuca

SEQ ID NO: 1179030 - RNA, 21 nt, Mycobacterium bovis subsp bovis AF2122/97
cuuucauugacacugugcgcc

SEQ ID NO: 1179031 - RNA, 16 nt, Mycobacterium bovis subsp bovis AF2122/97
cuuuccggccgccugc

SEQ ID NO: 1179032 - RNA, 22 nt, Mycobacterium bovis subsp bovis AF2122/97
cuuuccgcgaaucaacaggacc

SEQ ID NO: 1179033 - RNA, 19 nt, Mycobacterium bovis subsp bovis AF2122/97
cuuucccguugcugagcgu

SEQ ID NO: 1179034 - RNA, 17 nt, Mycobacterium bovis subsp bovis AF2122/97
cuuugaauugcgcgccc

SEQ ID NO: 1179035 - RNA, 18 nt, Mycobacterium bovis subsp bovis AF2122/97
cuuugucgccuucuuggc

SEQ ID NO: 1179036 - RNA, 17 nt, Mycobacterium bovis subsp bovis AF2122/97
cuuugucacgcaccgcg

SEQ ID NO: 1179037 - RNA, 19 nt, Mycobacterium bovis subsp bovis AF2122/97
cuuugacaccggucggcag

SEQ ID NO: 1179038 - RNA, 18 nt, Mycobacterium bovis subsp bovis AF2122/97
cuuugacgcccggcaccc

SEQ ID NO: 1179039 - RNA, 19 nt, Mycobacterium bovis subsp bovis AF2122/97
cuuugcucucggucugcau

SEQ ID NO: 1179040 - RNA, 21 nt, Mycobacterium bovis subsp bovis AF2122/97
cuuugcucucggucugcaugc

SEQ ID NO: 1179041 - RNA, 20 nt, Mycobacterium bovis subsp bovis AF2122/97
cuuugcguucccaucccuca

SEQ ID NO: 1179042 - RNA, 17 nt, Mycobacterium bovis subsp bovis AF2122/97
cuuugcggcgggcaccg

SEQ ID NO: 1179043 - RNA, 15 nt, Mycobacterium bovis subsp bovis AF2122/97
cuucggccagcuccc

SEQ ID NO: 1179044 - RNA, 12 nt, Mycobacterium bovis subsp bovis AF2122/97
cuucggccggcg

SEQ ID NO: 1179045 - RNA, 15 nt, Mycobacterium bovis subsp bovis AF2122/97
cuucggccuucuuga

SEQ ID NO: 1179046 - RNA, 23 nt, Mycobacterium bovis subsp bovis AF2122/97
cuucggcggucagcggcugggcg

SEQ ID NO: 1179047 - RNA, 18 nt, Mycobacterium bovis subsp bovis AF2122/97
cuucggcggugccaccag

SEQ ID NO: 1179048 - RNA, 18 nt, Mycobacterium bovis subsp bovis AF2122/97
cuucgcucgggucaucuu

SEQ ID NO: 1179049 - RNA, 21 nt, Mycobacterium bovis subsp bovis AF2122/97
cuucgcuaauacaccuccugc

SEQ ID NO: 1179050 - RNA, 18 nt, Mycobacterium bovis subsp bovis AF2122/97
cuucgcuaccuucuuggc

SEQ ID NO: 1179051 - RNA, 23 nt, Mycobacterium bovis subsp bovis AF2122/97
cuuuaauccagcgccgaccuccu

SEQ ID NO: 1179052 - RNA, 14 nt, Mycobacterium bovis subsp bovis AF2122/97
cuuucagcaggaga

SEQ ID NO: 1179053 - RNA, 19 nt, Mycobacterium bovis subsp bovis AF2122/97
cuuuagcgcgugcugcaga

SEQ ID NO: 1179054 - RNA, 14 nt, Mycobacterium bovis subsp bovis AF2122/97
cuuuugcgucugcu

SEQ ID NO: 1179055 - RNA, 16 nt, Mycobacterium bovis subsp bovis AF2122/97
cuuuugcgcccagcac

SEQ ID NO: 1179056 - RNA, 12 nt, Mycobacterium bovis subsp bovis AF2122/97
aaagacucgacc

SEQ ID NO: 1179057 - RNA, 16 nt, Mycobacterium bovis subsp bovis AF2122/97
aaagacccggcaccca

SEQ ID NO: 1179058 - RNA, 15 nt, Mycobacterium bovis subsp bovis AF2122/97
cuuuuacgucugcuc

SEQ ID NO: 1179059 - RNA, 17 nt, Mycobacterium bovis subsp bovis AF2122/97
gaaaaccccggccacca

SEQ ID NO: 1179060 - RNA, 21 nt, Mycobacterium bovis subsp bovis AF2122/97
gaaaacauguuccacccggug

SEQ ID NO: 1179061 - RNA, 14 nt, Mycobacterium bovis subsp bovis AF2122/97
gaaaacggcggcgc

SEQ ID NO: 1179062 - RNA, 14 nt, Mycobacterium bovis subsp bovis AF2122/97
gaaaacgcccggca

SEQ ID NO: 1179063 - RNA, 20 nt, Mycobacterium bovis subsp bovis AF2122/97
gaaaaccucggacugcagcg

SEQ ID NO: 1179064 - RNA, 14 nt, Mycobacterium bovis subsp bovis AF2122/97
gaaaagacugcgcc

SEQ ID NO: 1179065 - RNA, 15 nt, Mycobacterium bovis subsp bovis AF2122/97
gaaaucaccucacca

SEQ ID NO: 1179066 - RNA, 16 nt, Mycobacterium bovis subsp bovis AF2122/97
gaaaucaccucaccag

SEQ ID NO: 1179067 - RNA, 15 nt, Mycobacterium bovis subsp bovis AF2122/97
gaaauauuggcccgu

SEQ ID NO: 1179068 - RNA, 17 nt, Mycobacterium bovis subsp bovis AF2122/97
gaaauagcugcggaggg

SEQ ID NO: 1179069 - RNA, 21 nt, Mycobacterium bovis subsp bovis AF2122/97
gaaauacccagcgcagcagcg

SEQ ID NO: 1179070 - RNA, 18 nt, Mycobacterium bovis subsp bovis AF2122/97
gaaauacccagcgcagca

SEQ ID NO: 1179071 - RNA, 20 nt, Mycobacterium bovis subsp bovis AF2122/97
gaaauacccagcgcagcagc

SEQ ID NO: 1179072 - RNA, 19 nt, Mycobacterium bovis subsp bovis AF2122/97
gaaauaacggagcggccua

SEQ ID NO: 1179073 - RNA, 22 nt, Mycobacterium bovis subsp bovis AF2122/97
gaaagcgucgaucaccugccag

SEQ ID NO: 1179074 - RNA, 16 nt, Mycobacterium bovis subsp bovis AF2122/97
gaaacucaccagcacc

SEQ ID NO: 1179075 - RNA, 17 nt, Mycobacterium bovis subsp bovis AF2122/97
gaaacucaccagcaccc

SEQ ID NO: 1179076 - RNA, 23 nt, Mycobacterium bovis subsp bovis AF2122/97
gaaaaucugcuagcuuggcggcc

SEQ ID NO: 1179077 - RNA, 21 nt, Mycobacterium bovis subsp bovis AF2122/97
gaaaaucgggucacacuccca

SEQ ID NO: 1179078 - RNA, 15 nt, Mycobacterium bovis subsp bovis AF2122/97
gaaagcagcagcggc

SEQ ID NO: 1179079 - RNA, 21 nt, Mycobacterium bovis subsp bovis AF2122/97
gaaagcgccgaaacagcaccc

SEQ ID NO: 1179080 - RNA, 12 nt, Mycobacterium bovis subsp bovis AF2122/97
gaaacugacccg

SEQ ID NO: 1179081 - RNA, 21 nt, Mycobacterium bovis subsp bovis AF2122/97
gaaauuccggcgcggccggcc

SEQ ID NO: 1179082 - RNA, 16 nt, Mycobacterium bovis subsp bovis AF2122/97
gaaauuccgggccugg

SEQ ID NO: 1179083 - RNA, 15 nt, Mycobacterium bovis subsp bovis AF2122/97
gaaauucgcggcggu

SEQ ID NO: 1179084 - RNA, 18 nt, Mycobacterium bovis subsp bovis AF2122/97
gaaauugcccuagcagca

SEQ ID NO: 1179085 - RNA, 18 nt, Mycobacterium bovis subsp bovis AF2122/97
gaaaucggccagcuuccc

SEQ ID NO: 1179086 - RNA, 19 nt, Mycobacterium bovis subsp bovis AF2122/97
gaaaucgcccugacccgga

SEQ ID NO: 1179087 - RNA, 20 nt, Mycobacterium bovis subsp bovis AF2122/97
gaaaucgcccugacccggag

SEQ ID NO: 1179088 - RNA, 17 nt, Mycobacterium bovis subsp bovis AF2122/97
gaaaucgcccugacccg

SEQ ID NO: 1179089 - RNA, 16 nt, Mycobacterium bovis subsp bovis AF2122/97
gaaaucgcacagcgca

SEQ ID NO: 1179090 - RNA, 19 nt, Mycobacterium bovis subsp bovis AF2122/97
gaaauccugguggcagaca

SEQ ID NO: 1179091 - RNA, 23 nt, Mycobacterium bovis subsp bovis AF2122/97
gaacaggaucagcgacuugcugg

SEQ ID NO: 1179092 - RNA, 17 nt, Mycobacterium bovis subsp bovis AF2122/97
gaacagcugaucccaga

SEQ ID NO: 1179093 - RNA, 15 nt, Mycobacterium bovis subsp bovis AF2122/97
gaacagcaggccucc

SEQ ID NO: 1179094 - RNA, 14 nt, Mycobacterium bovis subsp bovis AF2122/97
gaacagcaccuccg

SEQ ID NO: 1179095 - RNA, 22 nt, Mycobacterium bovis subsp bovis AF2122/97
gaacacguucggguacccggga

SEQ ID NO: 1179096 - RNA, 18 nt, Mycobacterium bovis subsp bovis AF2122/97
gaacacgagcucaccugc

SEQ ID NO: 1179097 - RNA, 16 nt, Mycobacterium bovis subsp bovis AF2122/97
gaacaauucacgcacc

SEQ ID NO: 1179098 - RNA, 16 nt, Mycobacterium bovis subsp bovis AF2122/97
gaacaccggccaggcc

SEQ ID NO: 1179099 - RNA, 23 nt, Mycobacterium bovis subsp bovis AF2122/97
gaacaccggccaacagucgcagc

SEQ ID NO: 1179100 - RNA, 16 nt, Mycobacterium bovis subsp bovis AF2122/97
gaacgcguccagcgcg

SEQ ID NO: 1179101 - RNA, 14 nt, Mycobacterium bovis subsp bovis AF2122/97
gaacgcggaagccg

SEQ ID NO: 1179102 - RNA, 17 nt, Mycobacterium bovis subsp bovis AF2122/97
gaacgcggacaccgcgg

SEQ ID NO: 1179103 - RNA, 23 nt, Mycobacterium bovis subsp bovis AF2122/97
gaacgcuagcgccaaauccggcu

SEQ ID NO: 1179104 - RNA, 17 nt, Mycobacterium bovis subsp bovis AF2122/97
gaacgcgacagccaccu

SEQ ID NO: 1179105 - RNA, 15 nt, Mycobacterium bovis subsp bovis AF2122/97
gaacgcgauccgggu

SEQ ID NO: 1179106 - RNA, 22 nt, Mycobacterium bovis subsp bovis AF2122/97
gaacgcgcgcguggucgccccg

SEQ ID NO: 1179107 - RNA, 18 nt, Mycobacterium bovis subsp bovis AF2122/97
gaacgccggcaucgcgcg

SEQ ID NO: 1179108 - RNA, 16 nt, Mycobacterium bovis subsp bovis AF2122/97
gaacgccagaccgccg

SEQ ID NO: 1179109 - RNA, 18 nt, Mycobacterium bovis subsp bovis AF2122/97
gaacgccgccagcgcggu

SEQ ID NO: 1179110 - RNA, 18 nt, Mycobacterium bovis subsp bovis AF2122/97
gaacgcccgcugcagacg

SEQ ID NO: 1179111 - RNA, 14 nt, Mycobacterium bovis subsp bovis AF2122/97
gaacgcagccagcg

SEQ ID NO: 1179112 - RNA, 16 nt, Mycobacterium bovis subsp bovis AF2122/97
gaacgcagccagcgcc

SEQ ID NO: 1179113 - RNA, 18 nt, Mycobacterium bovis subsp bovis AF2122/97
gaacgcaaccgagggcau

SEQ ID NO: 1179114 - RNA, 17 nt, Mycobacterium bovis subsp bovis AF2122/97
gaacgucgcggccagca

SEQ ID NO: 1179115 - RNA, 19 nt, Mycobacterium bovis subsp bovis AF2122/97
gaacgugcaaccacggcgg

SEQ ID NO: 1179116 - RNA, 23 nt, Mycobacterium bovis subsp bovis AF2122/97
gaacgugacccccagcagggugu

SEQ ID NO: 1179117 - RNA, 18 nt, Mycobacterium bovis subsp bovis AF2122/97
gaacgugcaaccacggcg

SEQ ID NO: 1179118 - RNA, 24 nt, Mycobacterium bovis subsp bovis AF2122/97
gaacguucuuaaacgggcucuucg

SEQ ID NO: 1179119 - RNA, 22 nt, Mycobacterium bovis subsp bovis AF2122/97
gaacgugccuuccucgccggaa

SEQ ID NO: 1179120 - RNA, 23 nt, Mycobacterium bovis subsp bovis AF2122/97
gaacggcuugcgauuggcugggu

SEQ ID NO: 1179121 - RNA, 23 nt, Mycobacterium bovis subsp bovis AF2122/97
gaacggcuuggcgucggccggca

SEQ ID NO: 1179122 - RNA, 15 nt, Mycobacterium bovis subsp bovis AF2122/97
gaacggcgguguggu

SEQ ID NO: 1179123 - RNA, 15 nt, Mycobacterium bovis subsp bovis AF2122/97
gaacucgaccaccgc

SEQ ID NO: 1179124 - RNA, 17 nt, Mycobacterium bovis subsp bovis AF2122/97
gaacuccaucaccacac

SEQ ID NO: 1179125 - RNA, 13 nt, Mycobacterium bovis subsp bovis AF2122/97
gaacuccgccacc

SEQ ID NO: 1179126 - RNA, 17 nt, Mycobacterium bovis subsp bovis AF2122/97
gaacuccagcagcccgg

SEQ ID NO: 1179127 - RNA, 17 nt, Mycobacterium bovis subsp bovis AF2122/97
gaacuacccgccagcaa

SEQ ID NO: 1179128 - RNA, 18 nt, Mycobacterium bovis subsp bovis AF2122/97
gaacucaacaccagcaag

SEQ ID NO: 1179129 - RNA, 22 nt, Mycobacterium bovis subsp bovis AF2122/97
gaacuagaucgucgucaacccg

SEQ ID NO: 1179130 - RNA, 11 nt, Mycobacterium bovis subsp bovis AF2122/97
gaacugcgcaa

SEQ ID NO: 1179131 - RNA, 21 nt, Mycobacterium bovis subsp bovis AF2122/97
gaacugaggauuucauacgcg

SEQ ID NO: 1179132 - RNA, 22 nt, Mycobacterium bovis subsp bovis AF2122/97
gaacuggacggggaagcccggc

SEQ ID NO: 1179133 - RNA, 20 nt, Mycobacterium bovis subsp bovis AF2122/97
gaacuggcggugcagugccu

SEQ ID NO: 1179134 - RNA, 19 nt, Mycobacterium bovis subsp bovis AF2122/97
gaacuggcuguaguccgcu

SEQ ID NO: 1179135 - RNA, 24 nt, Mycobacterium bovis subsp bovis AF2122/97
gaacugggcccccaaucagugcag

SEQ ID NO: 1179136 - RNA, 16 nt, Mycobacterium bovis subsp bovis AF2122/97
gaacucggacccaccc

SEQ ID NO: 1179137 - RNA, 18 nt, Mycobacterium bovis subsp bovis AF2122/97
gaacucgcgccgagccag

SEQ ID NO: 1179138 - RNA, 15 nt, Mycobacterium bovis subsp bovis AF2122/97
gaacucggcccacac

SEQ ID NO: 1179139 - RNA, 19 nt, Mycobacterium bovis subsp bovis AF2122/97
gaacucggcgucguggugg

SEQ ID NO: 1179140 - RNA, 17 nt, Mycobacterium bovis subsp bovis AF2122/97
gaacucgggcaaugucg

SEQ ID NO: 1179141 - RNA, 22 nt, Mycobacterium bovis subsp bovis AF2122/97
gaacugaaacgcuuggcccugg

SEQ ID NO: 1179142 - RNA, 23 nt, Mycobacterium bovis subsp bovis AF2122/97
gaaccaaccucggaucgccaggc

SEQ ID NO: 1179143 - RNA, 21 nt, Mycobacterium bovis subsp bovis AF2122/97
gaaccaccggcgccgccggca

SEQ ID NO: 1179144 - RNA, 14 nt, Mycobacterium bovis subsp bovis AF2122/97
gaaccaccagcacg

SEQ ID NO: 1179145 - RNA, 16 nt, Mycobacterium bovis subsp bovis AF2122/97
gaaccaccaccggcaa

SEQ ID NO: 1179146 - RNA, 23 nt, Mycobacterium bovis subsp bovis AF2122/97
gaaccacgacguugcgaggccgc

SEQ ID NO: 1179147 - RNA, 22 nt, Mycobacterium bovis subsp bovis AF2122/97
gaaccacgcgcccgcaccaccg

SEQ ID NO: 1179148 - RNA, 14 nt, Mycobacterium bovis subsp bovis AF2122/97
gaaccaaaccgcaa

SEQ ID NO: 1179149 - RNA, 17 nt, Mycobacterium bovis subsp bovis AF2122/97
gaacauugcgcccagcg

SEQ ID NO: 1179150 - RNA, 21 nt, Mycobacterium bovis subsp bovis AF2122/97
gaaccagcuugcgccgcagcg

SEQ ID NO: 1179151 - RNA, 22 nt, Mycobacterium bovis subsp bovis AF2122/97
gaaccacuuuccgaggagggcc

SEQ ID NO: 1179152 - RNA, 20 nt, Mycobacterium bovis subsp bovis AF2122/97
gaaccagaggucacgcagca

SEQ ID NO: 1179153 - RNA, 23 nt, Mycobacterium bovis subsp bovis AF2122/97
gaaccagaggucacgcagcaccc

SEQ ID NO: 1179154 - RNA, 14 nt, Mycobacterium bovis subsp bovis AF2122/97
gaaccagcgcgugg

SEQ ID NO: 1179155 - RNA, 21 nt, Mycobacterium bovis subsp bovis AF2122/97
gaaccagcguaucggccggca

SEQ ID NO: 1179156 - RNA, 11 nt, Mycobacterium bovis subsp bovis AF2122/97
gaaccacggcg

SEQ ID NO: 1179157 - RNA, 17 nt, Mycobacterium bovis subsp bovis AF2122/97
gaaccacggucagcacg

SEQ ID NO: 1179158 - RNA, 20 nt, Mycobacterium bovis subsp bovis AF2122/97
gaaccaccgcguuggccaca

SEQ ID NO: 1179159 - RNA, 18 nt, Mycobacterium bovis subsp bovis AF2122/97
gaaccacggcagccaacc

SEQ ID NO: 1179160 - RNA, 17 nt, Mycobacterium bovis subsp bovis AF2122/97
gaaccacggcaggcagg

SEQ ID NO: 1179161 - RNA, 15 nt, Mycobacterium bovis subsp bovis AF2122/97
gaacccagcacuggg

SEQ ID NO: 1179162 - RNA, 19 nt, Mycobacterium bovis subsp bovis AF2122/97
gaacccagcacugggauga

SEQ ID NO: 1179163 - RNA, 24 nt, Mycobacterium bovis subsp bovis AF2122/97
gaacccacugcccgccgacgccag

SEQ ID NO: 1179164 - RNA, 15 nt, Mycobacterium bovis subsp bovis AF2122/97
gaacccccagcugca

SEQ ID NO: 1179165 - RNA, 12 nt, Mycobacterium bovis subsp bovis AF2122/97
gaacccaggcac

SEQ ID NO: 1179166 - RNA, 13 nt, Mycobacterium bovis subsp bovis AF2122/97
gaacccaggcaca

SEQ ID NO: 1179167 - RNA, 15 nt, Mycobacterium bovis subsp bovis AF2122/97
gaaccgggcaaauca

SEQ ID NO: 1179168 - RNA, 14 nt, Mycobacterium bovis subsp bovis AF2122/97
gaaccgggacacca

SEQ ID NO: 1179169 - RNA, 20 nt, Mycobacterium bovis subsp bovis AF2122/97
gaaccgggcaaaucaagcac

SEQ ID NO: 1179170 - RNA, 20 nt, Mycobacterium bovis subsp bovis AF2122/97
gaaccgcggaucgaccgcca

SEQ ID NO: 1179171 - RNA, 14 nt, Mycobacterium bovis subsp bovis AF2122/97
gaaccggaccuggg

SEQ ID NO: 1179172 - RNA, 19 nt, Mycobacterium bovis subsp bovis AF2122/97
gaaccgcguuaugccaggc

SEQ ID NO: 1179173 - RNA, 13 nt, Mycobacterium bovis subsp bovis AF2122/97
gaacccgccggca

SEQ ID NO: 1179174 - RNA, 22 nt, Mycobacterium bovis subsp bovis AF2122/97
gaacccgcgagguugaccacca

SEQ ID NO: 1179175 - RNA, 14 nt, Mycobacterium bovis subsp bovis AF2122/97
gaaccccauaauca

SEQ ID NO: 1179176 - RNA, 16 nt, Mycobacterium bovis subsp bovis AF2122/97
gaaccccgagcugcca

SEQ ID NO: 1179177 - RNA, 14 nt, Mycobacterium bovis subsp bovis AF2122/97
gaacccuccgcagc

SEQ ID NO: 1179178 - RNA, 21 nt, Mycobacterium bovis subsp bovis AF2122/97
gaaccgacgcguccggugcac

SEQ ID NO: 1179179 - RNA, 17 nt, Mycobacterium bovis subsp bovis AF2122/97
gaaccgcagucaacgca

SEQ ID NO: 1179180 - RNA, 19 nt, Mycobacterium bovis subsp bovis AF2122/97
gaaccugcucggccgugca

SEQ ID NO: 1179181 - RNA, 12 nt, Mycobacterium bovis subsp bovis AF2122/97
gaaccucacagc

SEQ ID NO: 1179182 - RNA, 18 nt, Mycobacterium bovis subsp bovis AF2122/97
gaaccgucucgcccccuc

SEQ ID NO: 1179183 - RNA, 16 nt, Mycobacterium bovis subsp bovis AF2122/97
gaaccgucucggcgac

SEQ ID NO: 1179184 - RNA, 21 nt, Mycobacterium bovis subsp bovis AF2122/97
gaaccguucggcgacagcgcg

SEQ ID NO: 1179185 - RNA, 18 nt, Mycobacterium bovis subsp bovis AF2122/97
gaaccguucgacccagcg

SEQ ID NO: 1179186 - RNA, 12 nt, Mycobacterium bovis subsp bovis AF2122/97
gaacgacgccac

SEQ ID NO: 1179187 - RNA, 15 nt, Mycobacterium bovis subsp bovis AF2122/97
gaccgcggcggccga

SEQ ID NO: 1179188 - RNA, 15 nt, Mycobacterium bovis subsp bovis AF2122/97
gaccgcggccuuggc

SEQ ID NO: 1179189 - RNA, 20 nt, Mycobacterium bovis subsp bovis AF2122/97
gaccgcgccggacagcgcau

SEQ ID NO: 1179190 - RNA, 20 nt, Mycobacterium bovis subsp bovis AF2122/97
gaccgcgccgaucaccaccg

SEQ ID NO: 1179191 - RNA, 15 nt, Mycobacterium bovis subsp bovis AF2122/97
gaccgcgccgcauca

SEQ ID NO: 1179192 - RNA, 22 nt, Mycobacterium bovis subsp bovis AF2122/97
gaccgcgaugucacggaugugc

SEQ ID NO: 1179193 - RNA, 12 nt, Mycobacterium bovis subsp bovis AF2122/97
gaccgcuaccag

SEQ ID NO: 1179194 - RNA, 15 nt, Mycobacterium bovis subsp bovis AF2122/97
gaccgcuaccagcug

SEQ ID NO: 1179195 - RNA, 19 nt, Mycobacterium bovis subsp bovis AF2122/97
gaccgcgggucgugccagc

SEQ ID NO: 1179196 - RNA, 20 nt, Mycobacterium bovis subsp bovis AF2122/97
gaccgcggucuucuucaccg

SEQ ID NO: 1179197 - RNA, 21 nt, Mycobacterium bovis subsp bovis AF2122/97
gaccgcggugacucggccucc

SEQ ID NO: 1179198 - RNA, 23 nt, Mycobacterium bovis subsp bovis AF2122/97
gaccgcggugacucggccuccgc

SEQ ID NO: 1179199 - RNA, 22 nt, Mycobacterium bovis subsp bovis AF2122/97
gaccgcugguucucgcuguuga

SEQ ID NO: 1179200 - RNA, 14 nt, Mycobacterium bovis subsp bovis AF2122/97
gaccgcugcccagu

SEQ ID NO: 1179201 - RNA, 15 nt, Mycobacterium bovis subsp bovis AF2122/97
gaccgcugccugccg

SEQ ID NO: 1179202 - RNA, 17 nt, Mycobacterium bovis subsp bovis AF2122/97
gaccgcuaccagcuggg

SEQ ID NO: 1179203 - RNA, 19 nt, Mycobacterium bovis subsp bovis AF2122/97
gaccgcuaccagcugggcg

SEQ ID NO: 1179204 - RNA, 19 nt, Mycobacterium bovis subsp bovis AF2122/97
gaccgcguaaaggccuugg

SEQ ID NO: 1179205 - RNA, 23 nt, Mycobacterium bovis subsp bovis AF2122/97
gaccgcucgucgccgguggcacc

SEQ ID NO: 1179206 - RNA, 20 nt, Mycobacterium bovis subsp bovis AF2122/97
gaccgcccuagcgagcggca

SEQ ID NO: 1179207 - RNA, 14 nt, Mycobacterium bovis subsp bovis AF2122/97
gaccgccgcgagca

SEQ ID NO: 1179208 - RNA, 15 nt, Mycobacterium bovis subsp bovis AF2122/97
gaccgccgcgccggc

SEQ ID NO: 1179209 - RNA, 21 nt, Mycobacterium bovis subsp bovis AF2122/97
gaccgccgcgagcagaaacaa

SEQ ID NO: 1179210 - RNA, 17 nt, Mycobacterium bovis subsp bovis AF2122/97
gaccgccugcgcggcug

SEQ ID NO: 1179211 - RNA, 17 nt, Mycobacterium bovis subsp bovis AF2122/97
gaccgccguggcccgcu

SEQ ID NO: 1179212 - RNA, 14 nt, Mycobacterium bovis subsp bovis AF2122/97
gaccgccuccaccg

SEQ ID NO: 1179213 - RNA, 14 nt, Mycobacterium bovis subsp bovis AF2122/97
gaccgccagcagca

SEQ ID NO: 1179214 - RNA, 17 nt, Mycobacterium bovis subsp bovis AF2122/97
gaccgccgacgccguug

SEQ ID NO: 1179215 - RNA, 22 nt, Mycobacterium bovis subsp bovis AF2122/97
gaccgccauccuucggggugaa

SEQ ID NO: 1179216 - RNA, 16 nt, Mycobacterium bovis subsp bovis AF2122/97
gacccgaauccaccag

SEQ ID NO: 1179217 - RNA, 22 nt, Mycobacterium bovis subsp bovis AF2122/97
gacccgacaugguccgaccagc

SEQ ID NO: 1179218 - RNA, 15 nt, Mycobacterium bovis subsp bovis AF2122/97
gaccccuggccgccg

SEQ ID NO: 1179219 - RNA, 16 nt, Mycobacterium bovis subsp bovis AF2122/97
gaccccucacccagcu

SEQ ID NO: 1179220 - RNA, 16 nt, Mycobacterium bovis subsp bovis AF2122/97
gaccccguaggcgccg

SEQ ID NO: 1179221 - RNA, 19 nt, Mycobacterium bovis subsp bovis AF2122/97
gaccccggcguugccgccg

SEQ ID NO: 1179222 - RNA, 16 nt, Mycobacterium bovis subsp bovis AF2122/97
gaccccggcagcgccc

SEQ ID NO: 1179223 - RNA, 16 nt, Mycobacterium bovis subsp bovis AF2122/97
gaccccgccagccgga

SEQ ID NO: 1179224 - RNA, 14 nt, Mycobacterium bovis subsp bovis AF2122/97
gacccccugccaca

SEQ ID NO: 1179225 - RNA, 17 nt, Mycobacterium bovis subsp bovis AF2122/97
gacccccugccacagcg

SEQ ID NO: 1179226 - RNA, 19 nt, Mycobacterium bovis subsp bovis AF2122/97
gaccccgaacauccgccgc

SEQ ID NO: 1179227 - RNA, 13 nt, Mycobacterium bovis subsp bovis AF2122/97
gacccccagcgcc

SEQ ID NO: 1179228 - RNA, 14 nt, Mycobacterium bovis subsp bovis AF2122/97
gacccccagcaggg

SEQ ID NO: 1179229 - RNA, 17 nt, Mycobacterium bovis subsp bovis AF2122/97
gaccgaccgcauggugg

SEQ ID NO: 1179230 - RNA, 16 nt, Mycobacterium bovis subsp bovis AF2122/97
gaccgccaccccgcuu

SEQ ID NO: 1179231 - RNA, 16 nt, Mycobacterium bovis subsp bovis AF2122/97
gaccgccaccggcuga

SEQ ID NO: 1179232 - RNA, 21 nt, Mycobacterium bovis subsp bovis AF2122/97
gaccgcaugaucgcaccgagg

SEQ ID NO: 1179233 - RNA, 22 nt, Mycobacterium bovis subsp bovis AF2122/97
gaccgccaccgucauggcgggu

SEQ ID NO: 1179234 - RNA, 18 nt, Mycobacterium bovis subsp bovis AF2122/97
gaccgccacacggggccg

SEQ ID NO: 1179235 - RNA, 21 nt, Mycobacterium bovis subsp bovis AF2122/97
gaccgccacacggggccgcca

SEQ ID NO: 1179236 - RNA, 19 nt, Mycobacterium bovis subsp bovis AF2122/97
gaccgacccggaccugggc

SEQ ID NO: 1179237 - RNA, 21 nt, Mycobacterium bovis subsp bovis AF2122/97
gaccgaauggccgccgcagcu

SEQ ID NO: 1179238 - RNA, 21 nt, Mycobacterium bovis subsp bovis AF2122/97
gaccgaaucagcacggugugc

SEQ ID NO: 1179239 - RNA, 21 nt, Mycobacterium bovis subsp bovis AF2122/97
gaccgaaucgggucggccgcu

SEQ ID NO: 1179240 - RNA, 22 nt, Mycobacterium bovis subsp bovis AF2122/97
gaccgaaucgggucggccgcug

SEQ ID NO: 1179241 - RNA, 14 nt, Mycobacterium bovis subsp bovis AF2122/97
gaccgaagaagccc

SEQ ID NO: 1179242 - RNA, 15 nt, Mycobacterium bovis subsp bovis AF2122/97
gaccgaagaagcccg

SEQ ID NO: 1179243 - RNA, 16 nt, Mycobacterium bovis subsp bovis AF2122/97
gaccgaagagcgcgcg

SEQ ID NO: 1179244 - RNA, 18 nt, Mycobacterium bovis subsp bovis AF2122/97
gaccgaaccuggucuuga

SEQ ID NO: 1179245 - RNA, 13 nt, Mycobacterium bovis subsp bovis AF2122/97
gaccgaagaagcc

SEQ ID NO: 1179246 - RNA, 17 nt, Mycobacterium bovis subsp bovis AF2122/97
gaccccgguggucuggu

SEQ ID NO: 1179247 - RNA, 20 nt, Mycobacterium bovis subsp bovis AF2122/97
gaccacgccgccggcgcuga

SEQ ID NO: 1179248 - RNA, 14 nt, Mycobacterium bovis subsp bovis AF2122/97
gaccagcggcggcg

SEQ ID NO: 1179249 - RNA, 15 nt, Mycobacterium bovis subsp bovis AF2122/97
gaccagcgggcggcc

SEQ ID NO: 1179250 - RNA, 22 nt, Mycobacterium bovis subsp bovis AF2122/97
gaccagcguggggccgccacca

SEQ ID NO: 1179251 - RNA, 18 nt, Mycobacterium bovis subsp bovis AF2122/97
gaccagcugccggcgacc

SEQ ID NO: 1179252 - RNA, 19 nt, Mycobacterium bovis subsp bovis AF2122/97
gaccagcuggccguacucg

SEQ ID NO: 1179253 - RNA, 16 nt, Mycobacterium bovis subsp bovis AF2122/97
gaccagcuucggcugg

SEQ ID NO: 1179254 - RNA, 13 nt, Mycobacterium bovis subsp bovis AF2122/97
gaccacccggcgc

SEQ ID NO: 1179255 - RNA, 18 nt, Mycobacterium bovis subsp bovis AF2122/97
gaccaccgcgaaagcacc

SEQ ID NO: 1179256 - RNA, 12 nt, Mycobacterium bovis subsp bovis AF2122/97
gaccaccugguu

SEQ ID NO: 1179257 - RNA, 16 nt, Mycobacterium bovis subsp bovis AF2122/97
gaccaccugcaugugu

SEQ ID NO: 1179258 - RNA, 19 nt, Mycobacterium bovis subsp bovis AF2122/97
gaccaccggguagccggcg

SEQ ID NO: 1179259 - RNA, 20 nt, Mycobacterium bovis subsp bovis AF2122/97
gaccaccucagcugcggacu

SEQ ID NO: 1179260 - RNA, 23 nt, Mycobacterium bovis subsp bovis AF2122/97
gaccacgaacgcgcgcagccggg

SEQ ID NO: 1179261 - RNA, 15 nt, Mycobacterium bovis subsp bovis AF2122/97
gaccacgaccgucuc

SEQ ID NO: 1179262 - RNA, 12 nt, Mycobacterium bovis subsp bovis AF2122/97
gacccauacgaa

SEQ ID NO: 1179263 - RNA, 23 nt, Mycobacterium bovis subsp bovis AF2122/97
gacccaugagcccgugacauucu

SEQ ID NO: 1179264 - RNA, 21 nt, Mycobacterium bovis subsp bovis AF2122/97
gaccauccgaguugucgccgg

SEQ ID NO: 1179265 - RNA, 14 nt, Mycobacterium bovis subsp bovis AF2122/97
gacccagccagcug

SEQ ID NO: 1179266 - RNA, 15 nt, Mycobacterium bovis subsp bovis AF2122/97
gacccagcggcgguc

SEQ ID NO: 1179267 - RNA, 18 nt, Mycobacterium bovis subsp bovis AF2122/97
gacccagcggcggucuuu

SEQ ID NO: 1179268 - RNA, 21 nt, Mycobacterium bovis subsp bovis AF2122/97
gaccaugcuccuaucacugga

SEQ ID NO: 1179269 - RNA, 13 nt, Mycobacterium bovis subsp bovis AF2122/97
gaccaugaagaac

SEQ ID NO: 1179270 - RNA, 16 nt, Mycobacterium bovis subsp bovis AF2122/97
gaccaucacgcccugu

SEQ ID NO: 1179271 - RNA, 16 nt, Mycobacterium bovis subsp bovis AF2122/97
gaccaucacacccauc

SEQ ID NO: 1179272 - RNA, 16 nt, Mycobacterium bovis subsp bovis AF2122/97
gaccaucaccacggcc

SEQ ID NO: 1179273 - RNA, 22 nt, Mycobacterium bovis subsp bovis AF2122/97
gaccaucguguacuggucugga

SEQ ID NO: 1179274 - RNA, 20 nt, Mycobacterium bovis subsp bovis AF2122/97
gaccacagccgcgccgaccu

SEQ ID NO: 1179275 - RNA, 22 nt, Mycobacterium bovis subsp bovis AF2122/97
gaccaccagcgccgacccguac

SEQ ID NO: 1179276 - RNA, 13 nt, Mycobacterium bovis subsp bovis AF2122/97
gaccaccagugag

SEQ ID NO: 1179277 - RNA, 20 nt, Mycobacterium bovis subsp bovis AF2122/97
gaccacaaccgugagcacca

SEQ ID NO: 1179278 - RNA, 21 nt, Mycobacterium bovis subsp bovis AF2122/97
gacagugugaagaccaccgcc

SEQ ID NO: 1179279 - RNA, 19 nt, Mycobacterium bovis subsp bovis AF2122/97
gacauccagaugcccagca

SEQ ID NO: 1179280 - RNA, 17 nt, Mycobacterium bovis subsp bovis AF2122/97
gacagucaacagggcca

SEQ ID NO: 1179281 - RNA, 21 nt, Mycobacterium bovis subsp bovis AF2122/97
gacagucaacagggccaggac

SEQ ID NO: 1179282 - RNA, 14 nt, Mycobacterium bovis subsp bovis AF2122/97
gacagugcugccuu

SEQ ID NO: 1179283 - RNA, 21 nt, Mycobacterium bovis subsp bovis AF2122/97
gacaugcaggugaugagugcg

SEQ ID NO: 1179284 - RNA, 20 nt, Mycobacterium bovis subsp bovis AF2122/97
gacaugccauaugggggaaa

SEQ ID NO: 1179285 - RNA, 23 nt, Mycobacterium bovis subsp bovis AF2122/97
gacaugccauaugggggaaagcu

SEQ ID NO: 1179286 - RNA, 18 nt, Mycobacterium bovis subsp bovis AF2122/97
gacauccgggccgagcgc

SEQ ID NO: 1179287 - RNA, 21 nt, Mycobacterium bovis subsp bovis AF2122/97
gacaugucgaacgccccccac

SEQ ID NO: 1179288 - RNA, 17 nt, Mycobacterium bovis subsp bovis AF2122/97
gacaugucgcugccgcc

SEQ ID NO: 1179289 - RNA, 16 nt, Mycobacterium bovis subsp bovis AF2122/97
gacaugcgggcagcac

SEQ ID NO: 1179290 - RNA, 14 nt, Mycobacterium bovis subsp bovis AF2122/97
gacaggcggcggcc

SEQ ID NO: 1179291 - RNA, 17 nt, Mycobacterium bovis subsp bovis AF2122/97
gacaggcccgguggcgg

SEQ ID NO: 1179292 - RNA, 19 nt, Mycobacterium bovis subsp bovis AF2122/97
gacagccccaucaccaccg

SEQ ID NO: 1179293 - RNA, 19 nt, Mycobacterium bovis subsp bovis AF2122/97
gacagccccgccgcccucc

SEQ ID NO: 1179294 - RNA, 14 nt, Mycobacterium bovis subsp bovis AF2122/97
gacagccccgcggc

SEQ ID NO: 1179295 - RNA, 18 nt, Mycobacterium bovis subsp bovis AF2122/97
gacagccccgcggccagc

SEQ ID NO: 1179296 - RNA, 22 nt, Mycobacterium bovis subsp bovis AF2122/97
gacagcccuaucagccgagaca

SEQ ID NO: 1179297 - RNA, 13 nt, Mycobacterium bovis subsp bovis AF2122/97
gacagggcggcga

SEQ ID NO: 1179298 - RNA, 13 nt, Mycobacterium bovis subsp bovis AF2122/97
gacagggccgcuc

SEQ ID NO: 1179299 - RNA, 22 nt, Mycobacterium bovis subsp bovis AF2122/97
gacaggucgcccaacaccgcgc

SEQ ID NO: 1179300 - RNA, 21 nt, Mycobacterium bovis subsp bovis AF2122/97
gacagggugcgcuugcggccg

SEQ ID NO: 1179301 - RNA, 19 nt, Mycobacterium bovis subsp bovis AF2122/97
gacagccaguguugcagug

SEQ ID NO: 1179302 - RNA, 17 nt, Mycobacterium bovis subsp bovis AF2122/97
gacagcaguuucaccuu

SEQ ID NO: 1179303 - RNA, 13 nt, Mycobacterium bovis subsp bovis AF2122/97
gacagaugcaucc

SEQ ID NO: 1179304 - RNA, 23 nt, Mycobacterium bovis subsp bovis AF2122/97
gacagauagacuagccgauccag

SEQ ID NO: 1179305 - RNA, 14 nt, Mycobacterium bovis subsp bovis AF2122/97
gacaccggccgcga

SEQ ID NO: 1179306 - RNA, 21 nt, Mycobacterium bovis subsp bovis AF2122/97
gacaccgcggcgaucugcgac

SEQ ID NO: 1179307 - RNA, 14 nt, Mycobacterium bovis subsp bovis AF2122/97
gacaccggcugacc

SEQ ID NO: 1179308 - RNA, 17 nt, Mycobacterium bovis subsp bovis AF2122/97
gacaccggucggcagcu

SEQ ID NO: 1179309 - RNA, 13 nt, Mycobacterium bovis subsp bovis AF2122/97
gacagacaggauu

SEQ ID NO: 1179310 - RNA, 22 nt, Mycobacterium bovis subsp bovis AF2122/97
gacaccgagccacgacccagca

SEQ ID NO: 1179311 - RNA, 16 nt, Mycobacterium bovis subsp bovis AF2122/97
gacaccgaaccgccgc

SEQ ID NO: 1179312 - RNA, 12 nt, Mycobacterium bovis subsp bovis AF2122/97
gacacccgggcc

SEQ ID NO: 1179313 - RNA, 23 nt, Mycobacterium bovis subsp bovis AF2122/97
gacacccgcauggcagcggcggu

SEQ ID NO: 1179314 - RNA, 15 nt, Mycobacterium bovis subsp bovis AF2122/97
gacacccgccaggcc

SEQ ID NO: 1179315 - RNA, 18 nt, Mycobacterium bovis subsp bovis AF2122/97
gacgccgaucgcggcggc

SEQ ID NO: 1179316 - RNA, 16 nt, Mycobacterium bovis subsp bovis AF2122/97
gacgccgccgcugccg

SEQ ID NO: 1179317 - RNA, 19 nt, Mycobacterium bovis subsp bovis AF2122/97
gacgccgccggccccgccg

SEQ ID NO: 1179318 - RNA, 21 nt, Mycobacterium bovis subsp bovis AF2122/97
gacgccgccacccggcgggcg

SEQ ID NO: 1179319 - RNA, 17 nt, Mycobacterium bovis subsp bovis AF2122/97
gacgccgcccccguggg

SEQ ID NO: 1179320 - RNA, 20 nt, Mycobacterium bovis subsp bovis AF2122/97
gacgccgaauacggcugccu

SEQ ID NO: 1179321 - RNA, 14 nt, Mycobacterium bovis subsp bovis AF2122/97
gacgcccucggggu

SEQ ID NO: 1179322 - RNA, 23 nt, Mycobacterium bovis subsp bovis AF2122/97
gacgccccauucguaucccgcaa

SEQ ID NO: 1179323 - RNA, 14 nt, Mycobacterium bovis subsp bovis AF2122/97
gacgccagcugccc

SEQ ID NO: 1179324 - RNA, 22 nt, Mycobacterium bovis subsp bovis AF2122/97
gacgcccuccuggcggguggcg

SEQ ID NO: 1179325 - RNA, 14 nt, Mycobacterium bovis subsp bovis AF2122/97
gacgcccucacgcc

SEQ ID NO: 1179326 - RNA, 16 nt, Mycobacterium bovis subsp bovis AF2122/97
gacgcccgcuccgcgg

SEQ ID NO: 1179327 - RNA, 15 nt, Mycobacterium bovis subsp bovis AF2122/97
gacgcccggcgcacc

SEQ ID NO: 1179328 - RNA, 12 nt, Mycobacterium bovis subsp bovis AF2122/97
gacgccagaacg

SEQ ID NO: 1179329 - RNA, 17 nt, Mycobacterium bovis subsp bovis AF2122/97
gacgcauaagcccccga

SEQ ID NO: 1179330 - RNA, 18 nt, Mycobacterium bovis subsp bovis AF2122/97
gacgccaacgccagcggg

SEQ ID NO: 1179331 - RNA, 23 nt, Mycobacterium bovis subsp bovis AF2122/97
gacgccaguugcguuguccacca

SEQ ID NO: 1179332 - RNA, 15 nt, Mycobacterium bovis subsp bovis AF2122/97
gacgccagccuggcc

SEQ ID NO: 1179333 - RNA, 22 nt, Mycobacterium bovis subsp bovis AF2122/97
gacgcccacaugcucagggcag

SEQ ID NO: 1179334 - RNA, 15 nt, Mycobacterium bovis subsp bovis AF2122/97
gacgccaugcccgca

SEQ ID NO: 1179335 - RNA, 14 nt, Mycobacterium bovis subsp bovis AF2122/97
gacgaucaagcugg

SEQ ID NO: 1179336 - RNA, 19 nt, Mycobacterium bovis subsp bovis AF2122/97
gacgauccggucggcgggc

SEQ ID NO: 1179337 - RNA, 14 nt, Mycobacterium bovis subsp bovis AF2122/97
gacgaucagcgagu

SEQ ID NO: 1179338 - RNA, 18 nt, Mycobacterium bovis subsp bovis AF2122/97
gacgaucaccccgccaug

SEQ ID NO: 1179339 - RNA, 16 nt, Mycobacterium bovis subsp bovis AF2122/97
gacgaucaggccgucg

SEQ ID NO: 1179340 - RNA, 16 nt, Mycobacterium bovis subsp bovis AF2122/97
gacgcaggaucacacu

SEQ ID NO: 1179341 - RNA, 21 nt, Mycobacterium bovis subsp bovis AF2122/97
gacgcaggaucacacuggccu

SEQ ID NO: 1179342 - RNA, 24 nt, Mycobacterium bovis subsp bovis AF2122/97
gacgagugguccggcggccgguag

SEQ ID NO: 1179343 - RNA, 13 nt, Mycobacterium bovis subsp bovis AF2122/97
gacgacgccgucg

SEQ ID NO: 1179344 - RNA, 14 nt, Mycobacterium bovis subsp bovis AF2122/97
gacgacgcccucac

SEQ ID NO: 1179345 - RNA, 20 nt, Mycobacterium bovis subsp bovis AF2122/97
gacgacgccgacgaugacgc

SEQ ID NO: 1179346 - RNA, 18 nt, Mycobacterium bovis subsp bovis AF2122/97
gacgacggcgacggcgcc

SEQ ID NO: 1179347 - RNA, 11 nt, Mycobacterium bovis subsp bovis AF2122/97
gacgacgccaa

SEQ ID NO: 1179348 - RNA, 22 nt, Mycobacterium bovis subsp bovis AF2122/97
gacgacguagaugguggucacc

SEQ ID NO: 1179349 - RNA, 16 nt, Mycobacterium bovis subsp bovis AF2122/97
gacgacguggcugcgu

SEQ ID NO: 1179350 - RNA, 19 nt, Mycobacterium bovis subsp bovis AF2122/97
gacgacggguuggcgucgc

SEQ ID NO: 1179351 - RNA, 20 nt, Mycobacterium bovis subsp bovis AF2122/97
gacgacguauucguuggggc

SEQ ID NO: 1179352 - RNA, 15 nt, Mycobacterium bovis subsp bovis AF2122/97
gaccggccggccgcg

SEQ ID NO: 1179353 - RNA, 18 nt, Mycobacterium bovis subsp bovis AF2122/97
gaccggcgaccggcgagc

SEQ ID NO: 1179354 - RNA, 23 nt, Mycobacterium bovis subsp bovis AF2122/97
gaccggaguucagugcgcgugcc

SEQ ID NO: 1179355 - RNA, 13 nt, Mycobacterium bovis subsp bovis AF2122/97
gaccggaaccagc

SEQ ID NO: 1179356 - RNA, 18 nt, Mycobacterium bovis subsp bovis AF2122/97
gaccggcaacgcggccuu

SEQ ID NO: 1179357 - RNA, 20 nt, Mycobacterium bovis subsp bovis AF2122/97
gaccggaaacagcauggcga

SEQ ID NO: 1179358 - RNA, 19 nt, Mycobacterium bovis subsp bovis AF2122/97
gaccggaaaccacagcgcc

SEQ ID NO: 1179359 - RNA, 15 nt, Mycobacterium bovis subsp bovis AF2122/97
gaccugcaagacgcc

SEQ ID NO: 1179360 - RNA, 21 nt, Mycobacterium bovis subsp bovis AF2122/97
gaccugaugagcucaccgggg

SEQ ID NO: 1179361 - RNA, 15 nt, Mycobacterium bovis subsp bovis AF2122/97
gaccugacuggucag

SEQ ID NO: 1179362 - RNA, 13 nt, Mycobacterium bovis subsp bovis AF2122/97
gaccugggacagu

SEQ ID NO: 1179363 - RNA, 17 nt, Mycobacterium bovis subsp bovis AF2122/97
gaccuggccgucgcugg

SEQ ID NO: 1179364 - RNA, 18 nt, Mycobacterium bovis subsp bovis AF2122/97
gaccuggccgucgcuggu

SEQ ID NO: 1179365 - RNA, 11 nt, Mycobacterium bovis subsp bovis AF2122/97
gaccuggccac

SEQ ID NO: 1179366 - RNA, 18 nt, Mycobacterium bovis subsp bovis AF2122/97
gaccuuguugaccaccac

SEQ ID NO: 1179367 - RNA, 16 nt, Mycobacterium bovis subsp bovis AF2122/97
gaccugguugaccucg

SEQ ID NO: 1179368 - RNA, 17 nt, Mycobacterium bovis subsp bovis AF2122/97
gacgaagagcaccgcgc

SEQ ID NO: 1179369 - RNA, 16 nt, Mycobacterium bovis subsp bovis AF2122/97
gacgacgagggcggga

SEQ ID NO: 1179370 - RNA, 14 nt, Mycobacterium bovis subsp bovis AF2122/97
gacgaacugcagcc

SEQ ID NO: 1179371 - RNA, 23 nt, Mycobacterium bovis subsp bovis AF2122/97
gacgaagaucgcgugccacagca

SEQ ID NO: 1179372 - RNA, 11 nt, Mycobacterium bovis subsp bovis AF2122/97
gacgaaacucu

SEQ ID NO: 1179373 - RNA, 12 nt, Mycobacterium bovis subsp bovis AF2122/97
gacgaaaggcuc

SEQ ID NO: 1179374 - RNA, 20 nt, Mycobacterium bovis subsp bovis AF2122/97
gacgaaccgccgacggcgcc

SEQ ID NO: 1179375 - RNA, 19 nt, Mycobacterium bovis subsp bovis AF2122/97
gacgaaccggaucaucgcc

SEQ ID NO: 1179376 - RNA, 14 nt, Mycobacterium bovis subsp bovis AF2122/97
gacgaacaccagcg

SEQ ID NO: 1179377 - RNA, 14 nt, Mycobacterium bovis subsp bovis AF2122/97
gacguggcuugagu

SEQ ID NO: 1179378 - RNA, 16 nt, Mycobacterium bovis subsp bovis AF2122/97
gacguaggcggcggcc

SEQ ID NO: 1179379 - RNA, 11 nt, Mycobacterium bovis subsp bovis AF2122/97
gacguagacgg

SEQ ID NO: 1179380 - RNA, 20 nt, Mycobacterium bovis subsp bovis AF2122/97
gacguaggcgcugaagauca

SEQ ID NO: 1179381 - RNA, 16 nt, Mycobacterium bovis subsp bovis AF2122/97
gacguauagaccaggu

SEQ ID NO: 1179382 - RNA, 17 nt, Mycobacterium bovis subsp bovis AF2122/97
gacguauuggcgcagca

SEQ ID NO: 1179383 - RNA, 23 nt, Mycobacterium bovis subsp bovis AF2122/97
gacgucaaacgcaaagacagcgc

SEQ ID NO: 1179384 - RNA, 20 nt, Mycobacterium bovis subsp bovis AF2122/97
gacguggugggcuuggcugu

SEQ ID NO: 1179385 - RNA, 23 nt, Mycobacterium bovis subsp bovis AF2122/97
gacgugguguaucgacggcggcc

SEQ ID NO: 1179386 - RNA, 18 nt, Mycobacterium bovis subsp bovis AF2122/97
gacguucgacgacagcac

SEQ ID NO: 1179387 - RNA, 15 nt, Mycobacterium bovis subsp bovis AF2122/97
gacuagacgccgccg

SEQ ID NO: 1179388 - RNA, 15 nt, Mycobacterium bovis subsp bovis AF2122/97
gacuacccagccagc

SEQ ID NO: 1179389 - RNA, 16 nt, Mycobacterium bovis subsp bovis AF2122/97
gacuacccagccagcc

SEQ ID NO: 1179390 - RNA, 18 nt, Mycobacterium bovis subsp bovis AF2122/97
gacuaccgccggcggcgg

SEQ ID NO: 1179391 - RNA, 19 nt, Mycobacterium bovis subsp bovis AF2122/97
gacuaccgccggcggcggc

SEQ ID NO: 1179392 - RNA, 17 nt, Mycobacterium bovis subsp bovis AF2122/97
gacuaccaucgccgccc

SEQ ID NO: 1179393 - RNA, 22 nt, Mycobacterium bovis subsp bovis AF2122/97
gacggccugcgagucgcgcuug

SEQ ID NO: 1179394 - RNA, 18 nt, Mycobacterium bovis subsp bovis AF2122/97
gacggccuggggcagccg

SEQ ID NO: 1179395 - RNA, 15 nt, Mycobacterium bovis subsp bovis AF2122/97
gacggccggcaagca

SEQ ID NO: 1179396 - RNA, 11 nt, Mycobacterium bovis subsp bovis AF2122/97
gacggccggcc

SEQ ID NO: 1179397 - RNA, 13 nt, Mycobacterium bovis subsp bovis AF2122/97
gacggcgccaggc

SEQ ID NO: 1179398 - RNA, 20 nt, Mycobacterium bovis subsp bovis AF2122/97
gacggcgaaaucgacagcag

SEQ ID NO: 1179399 - RNA, 21 nt, Mycobacterium bovis subsp bovis AF2122/97
gacggcggguuuucucgccgu

SEQ ID NO: 1179400 - RNA, 16 nt, Mycobacterium bovis subsp bovis AF2122/97
gacggcgcuguggcgg

SEQ ID NO: 1179401 - RNA, 18 nt, Mycobacterium bovis subsp bovis AF2122/97
gacggcgucugcgguggc

SEQ ID NO: 1179402 - RNA, 21 nt, Mycobacterium bovis subsp bovis AF2122/97
gacggcuagcugaugccuggu

SEQ ID NO: 1179403 - RNA, 16 nt, Mycobacterium bovis subsp bovis AF2122/97
gacggucaacgacauu

SEQ ID NO: 1179404 - RNA, 18 nt, Mycobacterium bovis subsp bovis AF2122/97
gacgguccuggcccgcug

SEQ ID NO: 1179405 - RNA, 15 nt, Mycobacterium bovis subsp bovis AF2122/97
gacggugaccgggag

SEQ ID NO: 1179406 - RNA, 17 nt, Mycobacterium bovis subsp bovis AF2122/97
gacggugaagccgagcg

SEQ ID NO: 1179407 - RNA, 17 nt, Mycobacterium bovis subsp bovis AF2122/97
gacggugaagccguuug

SEQ ID NO: 1179408 - RNA, 13 nt, Mycobacterium bovis subsp bovis AF2122/97
gacggugccaccg

SEQ ID NO: 1179409 - RNA, 11 nt, Mycobacterium bovis subsp bovis AF2122/97
gacguagacga

SEQ ID NO: 1179410 - RNA, 14 nt, Mycobacterium bovis subsp bovis AF2122/97
gacguaccacggcg

SEQ ID NO: 1179411 - RNA, 21 nt, Mycobacterium bovis subsp bovis AF2122/97
gacguacggggucgccggcac

SEQ ID NO: 1179412 - RNA, 20 nt, Mycobacterium bovis subsp bovis AF2122/97
gacggugcgcagggccugga

SEQ ID NO: 1179413 - RNA, 15 nt, Mycobacterium bovis subsp bovis AF2122/97
gacggugcgcuggau

SEQ ID NO: 1179414 - RNA, 22 nt, Mycobacterium bovis subsp bovis AF2122/97
gacggugcgggcuaggcggcgu

SEQ ID NO: 1179415 - RNA, 14 nt, Mycobacterium bovis subsp bovis AF2122/97
gacggugcggucag

SEQ ID NO: 1179416 - RNA, 13 nt, Mycobacterium bovis subsp bovis AF2122/97
gacggccagcgcg

SEQ ID NO: 1179417 - RNA, 13 nt, Mycobacterium bovis subsp bovis AF2122/97
gacggccagccca

SEQ ID NO: 1179418 - RNA, 22 nt, Mycobacterium bovis subsp bovis AF2122/97
gacggccaguugguagccgccc

SEQ ID NO: 1179419 - RNA, 23 nt, Mycobacterium bovis subsp bovis AF2122/97
gacggccaucgccagccugugcu

SEQ ID NO: 1179420 - RNA, 14 nt, Mycobacterium bovis subsp bovis AF2122/97
gacggccacaugga

SEQ ID NO: 1179421 - RNA, 19 nt, Mycobacterium bovis subsp bovis AF2122/97
gacggcauuucagcgcgcc

SEQ ID NO: 1179422 - RNA, 23 nt, Mycobacterium bovis subsp bovis AF2122/97
gacggcauuucagcgcgccgcgu

SEQ ID NO: 1179423 - RNA, 20 nt, Mycobacterium bovis subsp bovis AF2122/97
gacggaggucggagcgggcu

SEQ ID NO: 1179424 - RNA, 20 nt, Mycobacterium bovis subsp bovis AF2122/97
gacggagguguggucgagcg

SEQ ID NO: 1179425 - RNA, 17 nt, Mycobacterium bovis subsp bovis AF2122/97
gacggcagugcugcaga

SEQ ID NO: 1179426 - RNA, 23 nt, Mycobacterium bovis subsp bovis AF2122/97
gacgccgguggcagagccgccgu

SEQ ID NO: 1179427 - RNA, 21 nt, Mycobacterium bovis subsp bovis AF2122/97
gacgccgucggcgcgcaccuc

SEQ ID NO: 1179428 - RNA, 19 nt, Mycobacterium bovis subsp bovis AF2122/97
gacgccgcgccggcgggcg

SEQ ID NO: 1179429 - RNA, 24 nt, Mycobacterium bovis subsp bovis AF2122/97
gacgccgccguuguugaggaugac

SEQ ID NO: 1179430 - RNA, 19 nt, Mycobacterium bovis subsp bovis AF2122/97
gacgccggccuggccgcca

SEQ ID NO: 1179431 - RNA, 16 nt, Mycobacterium bovis subsp bovis AF2122/97
gacgccguugccaccg

SEQ ID NO: 1179432 - RNA, 19 nt, Mycobacterium bovis subsp bovis AF2122/97
gacgccguugccgccguug

SEQ ID NO: 1179433 - RNA, 17 nt, Mycobacterium bovis subsp bovis AF2122/97
gacgccguugccgccgu

SEQ ID NO: 1179434 - RNA, 18 nt, Mycobacterium bovis subsp bovis AF2122/97
gacgcuuggccaggucau

SEQ ID NO: 1179435 - RNA, 16 nt, Mycobacterium bovis subsp bovis AF2122/97
gacgcuuuccgccgca

SEQ ID NO: 1179436 - RNA, 12 nt, Mycobacterium bovis subsp bovis AF2122/97
gaacuucuccac

SEQ ID NO: 1179437 - RNA, 18 nt, Mycobacterium bovis subsp bovis AF2122/97
gaacugggucggcacggg

SEQ ID NO: 1179438 - RNA, 21 nt, Mycobacterium bovis subsp bovis AF2122/97
gaacuggucucggcugagacg

SEQ ID NO: 1179439 - RNA, 11 nt, Mycobacterium bovis subsp bovis AF2122/97
gaacuguaggu

SEQ ID NO: 1179440 - RNA, 22 nt, Mycobacterium bovis subsp bovis AF2122/97
gaagaacucggugcccccaccc

SEQ ID NO: 1179441 - RNA, 17 nt, Mycobacterium bovis subsp bovis AF2122/97
gaagacguuggcgcggu

SEQ ID NO: 1179442 - RNA, 22 nt, Mycobacterium bovis subsp bovis AF2122/97
gaagacuuagcgggugccagcc

SEQ ID NO: 1179443 - RNA, 16 nt, Mycobacterium bovis subsp bovis AF2122/97
gaagcccagaucuugc

SEQ ID NO: 1179444 - RNA, 18 nt, Mycobacterium bovis subsp bovis AF2122/97
gaagcccagaucuugcag

SEQ ID NO: 1179445 - RNA, 18 nt, Mycobacterium bovis subsp bovis AF2122/97
gaagagggcgccgcgcgc

SEQ ID NO: 1179446 - RNA, 17 nt, Mycobacterium bovis subsp bovis AF2122/97
gaagaguccuuaaacgu

SEQ ID NO: 1179447 - RNA, 20 nt, Mycobacterium bovis subsp bovis AF2122/97
gaagccccgguggcagggaa

SEQ ID NO: 1179448 - RNA, 15 nt, Mycobacterium bovis subsp bovis AF2122/97
gaagccccucaccuc

SEQ ID NO: 1179449 - RNA, 15 nt, Mycobacterium bovis subsp bovis AF2122/97
gaagcgcuccagcug

SEQ ID NO: 1179450 - RNA, 16 nt, Mycobacterium bovis subsp bovis AF2122/97
gaagcgcucggcagcc

SEQ ID NO: 1179451 - RNA, 14 nt, Mycobacterium bovis subsp bovis AF2122/97
gaagcggaucuggc

SEQ ID NO: 1179452 - RNA, 19 nt, Mycobacterium bovis subsp bovis AF2122/97
gaagcgggaaggcucacca

SEQ ID NO: 1179453 - RNA, 21 nt, Mycobacterium bovis subsp bovis AF2122/97
gaagcgggacugcagcgcggu

SEQ ID NO: 1179454 - RNA, 23 nt, Mycobacterium bovis subsp bovis AF2122/97
gaagcgucuggucagccgcggcg

SEQ ID NO: 1179455 - RNA, 19 nt, Mycobacterium bovis subsp bovis AF2122/97
gaagcgugcgccgacuuug

SEQ ID NO: 1179456 - RNA, 20 nt, Mycobacterium bovis subsp bovis AF2122/97
gaagcgucgcuucggcaccg

SEQ ID NO: 1179457 - RNA, 12 nt, Mycobacterium bovis subsp bovis AF2122/97
gaaggggcucag

SEQ ID NO: 1179458 - RNA, 19 nt, Mycobacterium bovis subsp bovis AF2122/97
gaaggcggcgauacccauc

SEQ ID NO: 1179459 - RNA, 18 nt, Mycobacterium bovis subsp bovis AF2122/97
gaaggcgcgggcgacguc

SEQ ID NO: 1179460 - RNA, 16 nt, Mycobacterium bovis subsp bovis AF2122/97
gaaggcgcgcgcccgg

SEQ ID NO: 1179461 - RNA, 14 nt, Mycobacterium bovis subsp bovis AF2122/97
gaagguuucccgcu

SEQ ID NO: 1179462 - RNA, 17 nt, Mycobacterium bovis subsp bovis AF2122/97
gaaguaauggaacggcu

SEQ ID NO: 1179463 - RNA, 20 nt, Mycobacterium bovis subsp bovis AF2122/97
gaaguacgcgacgggccgcg

SEQ ID NO: 1179464 - RNA, 13 nt, Mycobacterium bovis subsp bovis AF2122/97
gaaguacgugcac

SEQ ID NO: 1179465 - RNA, 23 nt, Mycobacterium bovis subsp bovis AF2122/97
gaaggcgacaucaccaccgaccu

SEQ ID NO: 1179466 - RNA, 20 nt, Mycobacterium bovis subsp bovis AF2122/97
gaaggccgcgcgcagggcgu

SEQ ID NO: 1179467 - RNA, 15 nt, Mycobacterium bovis subsp bovis AF2122/97
gaaggccagcgcgcc

SEQ ID NO: 1179468 - RNA, 22 nt, Mycobacterium bovis subsp bovis AF2122/97
gaaggcaccgaaaaacaccagc

SEQ ID NO: 1179469 - RNA, 21 nt, Mycobacterium bovis subsp bovis AF2122/97
gaaggauuuggagcuuuuugc

SEQ ID NO: 1179470 - RNA, 23 nt, Mycobacterium bovis subsp bovis AF2122/97
gaaggauuuggagcuuuuugcgu

SEQ ID NO: 1179471 - RNA, 23 nt, Mycobacterium bovis subsp bovis AF2122/97
gaaggacaucacgaaggcguucg

SEQ ID NO: 1179472 - RNA, 17 nt, Mycobacterium bovis subsp bovis AF2122/97
gaaggacggcagccacc

SEQ ID NO: 1179473 - RNA, 19 nt, Mycobacterium bovis subsp bovis AF2122/97
gaagcuucgggaaccagau

SEQ ID NO: 1179474 - RNA, 20 nt, Mycobacterium bovis subsp bovis AF2122/97
gaaggaaccgggcaaaucaa

SEQ ID NO: 1179475 - RNA, 22 nt, Mycobacterium bovis subsp bovis AF2122/97
gaaggaaccgggcaaaucaagc

SEQ ID NO: 1179476 - RNA, 16 nt, Mycobacterium bovis subsp bovis AF2122/97
gaaguccuccacgcug

SEQ ID NO: 1179477 - RNA, 23 nt, Mycobacterium bovis subsp bovis AF2122/97
gaagucgacgaacucgcccaggg

SEQ ID NO: 1179478 - RNA, 22 nt, Mycobacterium bovis subsp bovis AF2122/97
gaagucgaugaugcccauccgg

SEQ ID NO: 1179479 - RNA, 17 nt, Mycobacterium bovis subsp bovis AF2122/97
gaagucggucugcgggg

SEQ ID NO: 1179480 - RNA, 21 nt, Mycobacterium bovis subsp bovis AF2122/97
gaagucgcggacgucgccccg

SEQ ID NO: 1179481 - RNA, 16 nt, Mycobacterium bovis subsp bovis AF2122/97
gaagugaaagacagug

SEQ ID NO: 1179482 - RNA, 22 nt, Mycobacterium bovis subsp bovis AF2122/97
aaagaucagcaugguccacagc

SEQ ID NO: 1179483 - RNA, 23 nt, Mycobacterium bovis subsp bovis AF2122/97
aaagaucagcaugguccacagcc

SEQ ID NO: 1179484 - RNA, 18 nt, Mycobacterium bovis subsp bovis AF2122/97
gaauacccgcuggcccgc

SEQ ID NO: 1179485 - RNA, 13 nt, Mycobacterium bovis subsp bovis AF2122/97
gaauccagguggu

SEQ ID NO: 1179486 - RNA, 13 nt, Mycobacterium bovis subsp bovis AF2122/97
gaaucccaacucc

SEQ ID NO: 1179487 - RNA, 17 nt, Mycobacterium bovis subsp bovis AF2122/97
gaaucccaacuccucca

SEQ ID NO: 1179488 - RNA, 19 nt, Mycobacterium bovis subsp bovis AF2122/97
gaaucccacagcaggagaa

SEQ ID NO: 1179489 - RNA, 20 nt, Mycobacterium bovis subsp bovis AF2122/97
gaaucccccggacggcaggc

SEQ ID NO: 1179490 - RNA, 18 nt, Mycobacterium bovis subsp bovis AF2122/97
gaauccagaccaugcgca

SEQ ID NO: 1179491 - RNA, 22 nt, Mycobacterium bovis subsp bovis AF2122/97
gaaucagugaagacaccaggcc

SEQ ID NO: 1179492 - RNA, 19 nt, Mycobacterium bovis subsp bovis AF2122/97
gaaucagcaccccauggcc

SEQ ID NO: 1179493 - RNA, 21 nt, Mycobacterium bovis subsp bovis AF2122/97
gaaucagcaccccauggccac

SEQ ID NO: 1179494 - RNA, 18 nt, Mycobacterium bovis subsp bovis AF2122/97
gaaucgcccaucgcaagc

SEQ ID NO: 1179495 - RNA, 17 nt, Mycobacterium bovis subsp bovis AF2122/97
gaaucuucugagacugc

SEQ ID NO: 1179496 - RNA, 19 nt, Mycobacterium bovis subsp bovis AF2122/97
gaaucgaagcccggcggca

SEQ ID NO: 1179497 - RNA, 22 nt, Mycobacterium bovis subsp bovis AF2122/97
gaaucgcacgcgaaaugccugc

SEQ ID NO: 1179498 - RNA, 19 nt, Mycobacterium bovis subsp bovis AF2122/97
gaaugaccuugcccugcgu

SEQ ID NO: 1179499 - RNA, 13 nt, Mycobacterium bovis subsp bovis AF2122/97
gaaugacgaucca

SEQ ID NO: 1179500 - RNA, 18 nt, Mycobacterium bovis subsp bovis AF2122/97
gaaugacgauccagccca

SEQ ID NO: 1179501 - RNA, 21 nt, Mycobacterium bovis subsp bovis AF2122/97
gaaugcggugaguccgcugag

SEQ ID NO: 1179502 - RNA, 21 nt, Mycobacterium bovis subsp bovis AF2122/97
gaaugucaccccgcccagcgu

SEQ ID NO: 1179503 - RNA, 22 nt, Mycobacterium bovis subsp bovis AF2122/97
gaaugucccgguguccagccac

SEQ ID NO: 1179504 - RNA, 23 nt, Mycobacterium bovis subsp bovis AF2122/97
gaaugucgcgcuguuguggaaca

SEQ ID NO: 1179505 - RNA, 23 nt, Mycobacterium bovis subsp bovis AF2122/97
gaaugugucgaccuucucgaugc

SEQ ID NO: 1179506 - RNA, 17 nt, Mycobacterium bovis subsp bovis AF2122/97
gaaugccgcggggauca

SEQ ID NO: 1179507 - RNA, 14 nt, Mycobacterium bovis subsp bovis AF2122/97
gaaugcgggccucc

SEQ ID NO: 1179508 - RNA, 14 nt, Mycobacterium bovis subsp bovis AF2122/97
gaaugcgccgucgg

SEQ ID NO: 1179509 - RNA, 22 nt, Mycobacterium bovis subsp bovis AF2122/97
gaaugccgucgccggucaggcc

SEQ ID NO: 1179510 - RNA, 15 nt, Mycobacterium bovis subsp bovis AF2122/97
gaaugccuggcccgu

SEQ ID NO: 1179511 - RNA, 15 nt, Mycobacterium bovis subsp bovis AF2122/97
gacaacgaugucacc

SEQ ID NO: 1179512 - RNA, 22 nt, Mycobacterium bovis subsp bovis AF2122/97
gacaacgaugucacccucccgc

SEQ ID NO: 1179513 - RNA, 15 nt, Mycobacterium bovis subsp bovis AF2122/97
gacaaccgagcugac

SEQ ID NO: 1179514 - RNA, 17 nt, Mycobacterium bovis subsp bovis AF2122/97
gacaaccccgccaggau

SEQ ID NO: 1179515 - RNA, 18 nt, Mycobacterium bovis subsp bovis AF2122/97
gacaaccccuugccuucc

SEQ ID NO: 1179516 - RNA, 23 nt, Mycobacterium bovis subsp bovis AF2122/97
gacaacggguugucguugcuggu

SEQ ID NO: 1179517 - RNA, 22 nt, Mycobacterium bovis subsp bovis AF2122/97
gacaacgggccuucagcucacc

SEQ ID NO: 1179518 - RNA, 13 nt, Mycobacterium bovis subsp bovis AF2122/97
gacaacggcgguc

SEQ ID NO: 1179519 - RNA, 16 nt, Mycobacterium bovis subsp bovis AF2122/97
gacaaggccaagcgcc

SEQ ID NO: 1179520 - RNA, 16 nt, Mycobacterium bovis subsp bovis AF2122/97
gacaaggcgauugucg

SEQ ID NO: 1179521 - RNA, 13 nt, Mycobacterium bovis subsp bovis AF2122/97
gacaagucaagau

SEQ ID NO: 1179522 - RNA, 20 nt, Mycobacterium bovis subsp bovis AF2122/97
gacaagugccggcgcggagu

SEQ ID NO: 1179523 - RNA, 16 nt, Mycobacterium bovis subsp bovis AF2122/97
gacaaaaucagcagcc

SEQ ID NO: 1179524 - RNA, 18 nt, Mycobacterium bovis subsp bovis AF2122/97
gacaaaaucagcagcccc

SEQ ID NO: 1179525 - RNA, 13 nt, Mycobacterium bovis subsp bovis AF2122/97
gacaaacagcgcc

SEQ ID NO: 1179526 - RNA, 18 nt, Mycobacterium bovis subsp bovis AF2122/97
gacaaacggcgacccagc

SEQ ID NO: 1179527 - RNA, 19 nt, Mycobacterium bovis subsp bovis AF2122/97
gacaaacggcgacccagcg

SEQ ID NO: 1179528 - RNA, 13 nt, Mycobacterium bovis subsp bovis AF2122/97
gacaaaccacaga

SEQ ID NO: 1179529 - RNA, 18 nt, Mycobacterium bovis subsp bovis AF2122/97
gacaccccggaaucccca

SEQ ID NO: 1179530 - RNA, 15 nt, Mycobacterium bovis subsp bovis AF2122/97
gacaccccgcacgga

SEQ ID NO: 1179531 - RNA, 12 nt, Mycobacterium bovis subsp bovis AF2122/97
gacaccaggccc

SEQ ID NO: 1179532 - RNA, 15 nt, Mycobacterium bovis subsp bovis AF2122/97
gacaccaccgcccgc

SEQ ID NO: 1179533 - RNA, 14 nt, Mycobacterium bovis subsp bovis AF2122/97
gacaauucacgagg

SEQ ID NO: 1179534 - RNA, 16 nt, Mycobacterium bovis subsp bovis AF2122/97
gacaaggugcgcuggg

SEQ ID NO: 1179535 - RNA, 15 nt, Mycobacterium bovis subsp bovis AF2122/97
gacaagugcccggcc

SEQ ID NO: 1179536 - RNA, 17 nt, Mycobacterium bovis subsp bovis AF2122/97
gacaauggacaccaacc

SEQ ID NO: 1179537 - RNA, 15 nt, Mycobacterium bovis subsp bovis AF2122/97
gacaauggacaccaa

SEQ ID NO: 1179538 - RNA, 13 nt, Mycobacterium bovis subsp bovis AF2122/97
gacaauggacacc

SEQ ID NO: 1179539 - RNA, 19 nt, Mycobacterium bovis subsp bovis AF2122/97
gacaaugucggcgaugcgu

SEQ ID NO: 1179540 - RNA, 23 nt, Mycobacterium bovis subsp bovis AF2122/97
gaauuaguuucguccccagaccg

SEQ ID NO: 1179541 - RNA, 17 nt, Mycobacterium bovis subsp bovis AF2122/97
cucuacacccggacugc

SEQ ID NO: 1179542 - RNA, 17 nt, Mycobacterium bovis subsp bovis AF2122/97
cucuaccagccgccccg

SEQ ID NO: 1179543 - RNA, 18 nt, Mycobacterium bovis subsp bovis AF2122/97
cucuagauauggaccgcc

SEQ ID NO: 1179544 - RNA, 21 nt, Mycobacterium bovis subsp bovis AF2122/97
cugacgacgagggccagcagc

SEQ ID NO: 1179545 - RNA, 13 nt, Mycobacterium bovis subsp bovis AF2122/97
cugacgacugggc

SEQ ID NO: 1179546 - RNA, 14 nt, Mycobacterium bovis subsp bovis AF2122/97
cugacgacugggcg

SEQ ID NO: 1179547 - RNA, 16 nt, Mycobacterium bovis subsp bovis AF2122/97
cugacgguacagcucc

SEQ ID NO: 1179548 - RNA, 21 nt, Mycobacterium bovis subsp bovis AF2122/97
cugacggucauuuucuguaac

SEQ ID NO: 1179549 - RNA, 13 nt, Mycobacterium bovis subsp bovis AF2122/97
cugacggugguga

SEQ ID NO: 1179550 - RNA, 18 nt, Mycobacterium bovis subsp bovis AF2122/97
cugacgccccgccacaau

SEQ ID NO: 1179551 - RNA, 20 nt, Mycobacterium bovis subsp bovis AF2122/97
cugacgguggggauggcgcc

SEQ ID NO: 1179552 - RNA, 18 nt, Mycobacterium bovis subsp bovis AF2122/97
cugaccgguucccgggca

SEQ ID NO: 1179553 - RNA, 20 nt, Mycobacterium bovis subsp bovis AF2122/97
cugaccgguucccgggcagc

SEQ ID NO: 1179554 - RNA, 21 nt, Mycobacterium bovis subsp bovis AF2122/97
cugaccgguucccgggcagcc

SEQ ID NO: 1179555 - RNA, 16 nt, Mycobacterium bovis subsp bovis AF2122/97
cugaccgaagaagccc

SEQ ID NO: 1179556 - RNA, 22 nt, Mycobacterium bovis subsp bovis AF2122/97
cugaccgaauggccgccgcagc

SEQ ID NO: 1179557 - RNA, 11 nt, Mycobacterium bovis subsp bovis AF2122/97
cugaccgccac

SEQ ID NO: 1179558 - RNA, 13 nt, Mycobacterium bovis subsp bovis AF2122/97
cugaccgccaccc

SEQ ID NO: 1179559 - RNA, 14 nt, Mycobacterium bovis subsp bovis AF2122/97
cugaccgccacccc

SEQ ID NO: 1179560 - RNA, 21 nt, Mycobacterium bovis subsp bovis AF2122/97
cugacagaccgggcaccagaa

SEQ ID NO: 1179561 - RNA, 20 nt, Mycobacterium bovis subsp bovis AF2122/97
cugacagaccgggcaccaga

SEQ ID NO: 1179562 - RNA, 16 nt, Mycobacterium bovis subsp bovis AF2122/97
cugagcgccaggccgc

SEQ ID NO: 1179563 - RNA, 14 nt, Mycobacterium bovis subsp bovis AF2122/97
cugagcgggcgggc

SEQ ID NO: 1179564 - RNA, 11 nt, Mycobacterium bovis subsp bovis AF2122/97
cugagcuucca

SEQ ID NO: 1179565 - RNA, 18 nt, Mycobacterium bovis subsp bovis AF2122/97
cugagcugcucgccggcc

SEQ ID NO: 1179566 - RNA, 17 nt, Mycobacterium bovis subsp bovis AF2122/97
cugaggaacgccggcau

SEQ ID NO: 1179567 - RNA, 17 nt, Mycobacterium bovis subsp bovis AF2122/97
cugaggaagcggcggca

SEQ ID NO: 1179568 - RNA, 19 nt, Mycobacterium bovis subsp bovis AF2122/97
cugauagacccuggggucc

SEQ ID NO: 1179569 - RNA, 19 nt, Mycobacterium bovis subsp bovis AF2122/97
cugauaaagcccggcggca

SEQ ID NO: 1179570 - RNA, 17 nt, Mycobacterium bovis subsp bovis AF2122/97
cugaugggcgaauugca

SEQ ID NO: 1179571 - RNA, 13 nt, Mycobacterium bovis subsp bovis AF2122/97
cugaugggucagg

SEQ ID NO: 1179572 - RNA, 23 nt, Mycobacterium bovis subsp bovis AF2122/97
cugaugucgggaaggugacgcuc

SEQ ID NO: 1179573 - RNA, 18 nt, Mycobacterium bovis subsp bovis AF2122/97
cugcaggcggccuugccg

SEQ ID NO: 1179574 - RNA, 16 nt, Mycobacterium bovis subsp bovis AF2122/97
cugcagggccuggcca

SEQ ID NO: 1179575 - RNA, 11 nt, Mycobacterium bovis subsp bovis AF2122/97
cugcaggcugu

SEQ ID NO: 1179576 - RNA, 14 nt, Mycobacterium bovis subsp bovis AF2122/97
cugcaucaccacug

SEQ ID NO: 1179577 - RNA, 20 nt, Mycobacterium bovis subsp bovis AF2122/97
cugcauaggcgcggucaccg

SEQ ID NO: 1179578 - RNA, 13 nt, Mycobacterium bovis subsp bovis AF2122/97
cugcagcgcggcc

SEQ ID NO: 1179579 - RNA, 15 nt, Mycobacterium bovis subsp bovis AF2122/97
cugcagcgaugcggc

SEQ ID NO: 1179580 - RNA, 20 nt, Mycobacterium bovis subsp bovis AF2122/97
cugcagcgucaagggcuggg

SEQ ID NO: 1179581 - RNA, 21 nt, Mycobacterium bovis subsp bovis AF2122/97
cugcagcgucaagggcugggu

SEQ ID NO: 1179582 - RNA, 14 nt, Mycobacterium bovis subsp bovis AF2122/97
cugcagcgcggccg

SEQ ID NO: 1179583 - RNA, 19 nt, Mycobacterium bovis subsp bovis AF2122/97
cugcagcgaaacaccggcc

SEQ ID NO: 1179584 - RNA, 16 nt, Mycobacterium bovis subsp bovis AF2122/97
cugcagcccgggcagc

SEQ ID NO: 1179585 - RNA, 17 nt, Mycobacterium bovis subsp bovis AF2122/97
cugcagcccgggcagca

SEQ ID NO: 1179586 - RNA, 18 nt, Mycobacterium bovis subsp bovis AF2122/97
cugcagcccgggcagcac

SEQ ID NO: 1179587 - RNA, 17 nt, Mycobacterium bovis subsp bovis AF2122/97
cugcagcaccgcagcga

SEQ ID NO: 1179588 - RNA, 21 nt, Mycobacterium bovis subsp bovis AF2122/97
cugcagcacucggugucggcc

SEQ ID NO: 1179589 - RNA, 19 nt, Mycobacterium bovis subsp bovis AF2122/97
cugcagcauggcccuggcg

SEQ ID NO: 1179590 - RNA, 15 nt, Mycobacterium bovis subsp bovis AF2122/97
cugcagaaaggccaa

SEQ ID NO: 1179591 - RNA, 19 nt, Mycobacterium bovis subsp bovis AF2122/97
cugcagaaaggccaacugg

SEQ ID NO: 1179592 - RNA, 16 nt, Mycobacterium bovis subsp bovis AF2122/97
cugcagaaacagccgc

SEQ ID NO: 1179593 - RNA, 14 nt, Mycobacterium bovis subsp bovis AF2122/97
cugcacgucggccc

SEQ ID NO: 1179594 - RNA, 19 nt, Mycobacterium bovis subsp bovis AF2122/97
cugcacggugcccagggcg

SEQ ID NO: 1179595 - RNA, 23 nt, Mycobacterium bovis subsp bovis AF2122/97
cugcacccaggcaucggugagcc

SEQ ID NO: 1179596 - RNA, 14 nt, Mycobacterium bovis subsp bovis AF2122/97
cugcacccgccagg

SEQ ID NO: 1179597 - RNA, 19 nt, Mycobacterium bovis subsp bovis AF2122/97
cugcacccgacccgaugcg

SEQ ID NO: 1179598 - RNA, 16 nt, Mycobacterium bovis subsp bovis AF2122/97
cugcaccggcaggcgg

SEQ ID NO: 1179599 - RNA, 18 nt, Mycobacterium bovis subsp bovis AF2122/97
cugcaccuggccgcccgc

SEQ ID NO: 1179600 - RNA, 20 nt, Mycobacterium bovis subsp bovis AF2122/97
cugcaccuggccgcccgcuc

SEQ ID NO: 1179601 - RNA, 15 nt, Mycobacterium bovis subsp bovis AF2122/97
cugcaccgucacguc

SEQ ID NO: 1179602 - RNA, 22 nt, Mycobacterium bovis subsp bovis AF2122/97
cugcaccggcuugggccaggcc

SEQ ID NO: 1179603 - RNA, 23 nt, Mycobacterium bovis subsp bovis AF2122/97
cugcaccagcgaguugagcaugu

SEQ ID NO: 1179604 - RNA, 20 nt, Mycobacterium bovis subsp bovis AF2122/97
cugcaccacggcggccaccu

SEQ ID NO: 1179605 - RNA, 15 nt, Mycobacterium bovis subsp bovis AF2122/97
cugccggccggcggg

SEQ ID NO: 1179606 - RNA, 18 nt, Mycobacterium bovis subsp bovis AF2122/97
cugccggccgcguaaacc

SEQ ID NO: 1179607 - RNA, 15 nt, Mycobacterium bovis subsp bovis AF2122/97
cugccggcacgcaug

SEQ ID NO: 1179608 - RNA, 18 nt, Mycobacterium bovis subsp bovis AF2122/97
cugccggcugacgaccaa

SEQ ID NO: 1179609 - RNA, 19 nt, Mycobacterium bovis subsp bovis AF2122/97
cugccggcaacagcucgcc

SEQ ID NO: 1179610 - RNA, 17 nt, Mycobacterium bovis subsp bovis AF2122/97
cugccggagacacccgc

SEQ ID NO: 1179611 - RNA, 12 nt, Mycobacterium bovis subsp bovis AF2122/97
cugccgcugguc

SEQ ID NO: 1179612 - RNA, 14 nt, Mycobacterium bovis subsp bovis AF2122/97
cugccgcucgccgg

SEQ ID NO: 1179613 - RNA, 16 nt, Mycobacterium bovis subsp bovis AF2122/97
cugccgucgcugcccc

SEQ ID NO: 1179614 - RNA, 21 nt, Mycobacterium bovis subsp bovis AF2122/97
cugccgucggagaccagcucg

SEQ ID NO: 1179615 - RNA, 15 nt, Mycobacterium bovis subsp bovis AF2122/97
cugccgucuccuggu

SEQ ID NO: 1179616 - RNA, 18 nt, Mycobacterium bovis subsp bovis AF2122/97
cugccuuggccggcuugu

SEQ ID NO: 1179617 - RNA, 21 nt, Mycobacterium bovis subsp bovis AF2122/97
cugccuucuuugccggcgccu

SEQ ID NO: 1179618 - RNA, 11 nt, Mycobacterium bovis subsp bovis AF2122/97
cugccuucuuu

SEQ ID NO: 1179619 - RNA, 21 nt, Mycobacterium bovis subsp bovis AF2122/97
cugccgccgcggccacaaccu

SEQ ID NO: 1179620 - RNA, 16 nt, Mycobacterium bovis subsp bovis AF2122/97
cugccgccggugccgc

SEQ ID NO: 1179621 - RNA, 15 nt, Mycobacterium bovis subsp bovis AF2122/97
cugccgcccuugccg

SEQ ID NO: 1179622 - RNA, 21 nt, Mycobacterium bovis subsp bovis AF2122/97
cugccgcccuugccgcccgcu

SEQ ID NO: 1179623 - RNA, 15 nt, Mycobacterium bovis subsp bovis AF2122/97
cugccgccgagcugg

SEQ ID NO: 1179624 - RNA, 16 nt, Mycobacterium bovis subsp bovis AF2122/97
cugccgagaucccagc

SEQ ID NO: 1179625 - RNA, 19 nt, Mycobacterium bovis subsp bovis AF2122/97
cugccgagaucccagcggg

SEQ ID NO: 1179626 - RNA, 17 nt, Mycobacterium bovis subsp bovis AF2122/97
cugccgcgaugagcggc

SEQ ID NO: 1179627 - RNA, 23 nt, Mycobacterium bovis subsp bovis AF2122/97
cugccgcgcaacuaucgcaccuc

SEQ ID NO: 1179628 - RNA, 17 nt, Mycobacterium bovis subsp bovis AF2122/97
cugccgcggcugccauc

SEQ ID NO: 1179629 - RNA, 15 nt, Mycobacterium bovis subsp bovis AF2122/97
cugccgcgcgcccgc

SEQ ID NO: 1179630 - RNA, 14 nt, Mycobacterium bovis subsp bovis AF2122/97
cugccgcgcggcga

SEQ ID NO: 1179631 - RNA, 21 nt, Mycobacterium bovis subsp bovis AF2122/97
cugcccuccgugggcagcgcg

SEQ ID NO: 1179632 - RNA, 14 nt, Mycobacterium bovis subsp bovis AF2122/97
cugcccggcgccgu

SEQ ID NO: 1179633 - RNA, 22 nt, Mycobacterium bovis subsp bovis AF2122/97
cugcccuuguugaaguaaugga

SEQ ID NO: 1179634 - RNA, 21 nt, Mycobacterium bovis subsp bovis AF2122/97
cugccgacuccucguccugga

SEQ ID NO: 1179635 - RNA, 22 nt, Mycobacterium bovis subsp bovis AF2122/97
cugccgacuccucguccuggaa

SEQ ID NO: 1179636 - RNA, 19 nt, Mycobacterium bovis subsp bovis AF2122/97
cugccgacucaucggccgc

SEQ ID NO: 1179637 - RNA, 15 nt, Mycobacterium bovis subsp bovis AF2122/97
cugccgacgcuccag

SEQ ID NO: 1179638 - RNA, 23 nt, Mycobacterium bovis subsp bovis AF2122/97
cugccgacaguuuaccgugccgc

SEQ ID NO: 1179639 - RNA, 16 nt, Mycobacterium bovis subsp bovis AF2122/97
cugccgaccagcgcgc

SEQ ID NO: 1179640 - RNA, 15 nt, Mycobacterium bovis subsp bovis AF2122/97
cugccgaccagcgcg

SEQ ID NO: 1179641 - RNA, 17 nt, Mycobacterium bovis subsp bovis AF2122/97
cugccgaagcggccacc

SEQ ID NO: 1179642 - RNA, 14 nt, Mycobacterium bovis subsp bovis AF2122/97
cugccccgccaccu

SEQ ID NO: 1179643 - RNA, 20 nt, Mycobacterium bovis subsp bovis AF2122/97
cugcccccguucuggaaccc

SEQ ID NO: 1179644 - RNA, 18 nt, Mycobacterium bovis subsp bovis AF2122/97
cugcccccggcgcggcgg

SEQ ID NO: 1179645 - RNA, 16 nt, Mycobacterium bovis subsp bovis AF2122/97
cugccccgcaucgccc

SEQ ID NO: 1179646 - RNA, 18 nt, Mycobacterium bovis subsp bovis AF2122/97
cugcccgucgucggcaac

SEQ ID NO: 1179647 - RNA, 22 nt, Mycobacterium bovis subsp bovis AF2122/97
cugcccuccgugggcagcgcgc

SEQ ID NO: 1179648 - RNA, 17 nt, Mycobacterium bovis subsp bovis AF2122/97
cugcccggcccgcucag

SEQ ID NO: 1179649 - RNA, 15 nt, Mycobacterium bovis subsp bovis AF2122/97
cugcccgacacccgc

SEQ ID NO: 1179650 - RNA, 13 nt, Mycobacterium bovis subsp bovis AF2122/97
cugcccaccaucc

SEQ ID NO: 1179651 - RNA, 13 nt, Mycobacterium bovis subsp bovis AF2122/97
cugcccaccuucg

SEQ ID NO: 1179652 - RNA, 14 nt, Mycobacterium bovis subsp bovis AF2122/97
cugcccccgccggc

SEQ ID NO: 1179653 - RNA, 14 nt, Mycobacterium bovis subsp bovis AF2122/97
cugcccccgcgcgc

SEQ ID NO: 1179654 - RNA, 21 nt, Mycobacterium bovis subsp bovis AF2122/97
cugccauugccugggcgaccg

SEQ ID NO: 1179655 - RNA, 21 nt, Mycobacterium bovis subsp bovis AF2122/97
cugccaggcccgugccuggcc

SEQ ID NO: 1179656 - RNA, 20 nt, Mycobacterium bovis subsp bovis AF2122/97
cugccacgaacgcuuccagc

SEQ ID NO: 1179657 - RNA, 16 nt, Mycobacterium bovis subsp bovis AF2122/97
cugccacccggccagg

SEQ ID NO: 1179658 - RNA, 20 nt, Mycobacterium bovis subsp bovis AF2122/97
cugccacgcguuccuccagc

SEQ ID NO: 1179659 - RNA, 23 nt, Mycobacterium bovis subsp bovis AF2122/97
cugcggguucacuuccgggcagc

SEQ ID NO: 1179660 - RNA, 21 nt, Mycobacterium bovis subsp bovis AF2122/97
cugcggguagauguucacgcc

SEQ ID NO: 1179661 - RNA, 19 nt, Mycobacterium bovis subsp bovis AF2122/97
cugcgggugauugagcuca

SEQ ID NO: 1179662 - RNA, 13 nt, Mycobacterium bovis subsp bovis AF2122/97
cugcggucagggc

SEQ ID NO: 1179663 - RNA, 15 nt, Mycobacterium bovis subsp bovis AF2122/97
cugcggucagggcuu

SEQ ID NO: 1179664 - RNA, 15 nt, Mycobacterium bovis subsp bovis AF2122/97
cugcggucgcggagc

SEQ ID NO: 1179665 - RNA, 15 nt, Mycobacterium bovis subsp bovis AF2122/97
cugcgucggcggcuu

SEQ ID NO: 1179666 - RNA, 16 nt, Mycobacterium bovis subsp bovis AF2122/97
cugcgucugcucacca

SEQ ID NO: 1179667 - RNA, 13 nt, Mycobacterium bovis subsp bovis AF2122/97
cugcgucugcucg

SEQ ID NO: 1179668 - RNA, 17 nt, Mycobacterium bovis subsp bovis AF2122/97
cugcgucggcggcuucc

SEQ ID NO: 1179669 - RNA, 18 nt, Mycobacterium bovis subsp bovis AF2122/97
cugcgucgucugcagacc

SEQ ID NO: 1179670 - RNA, 18 nt, Mycobacterium bovis subsp bovis AF2122/97
cugcgucugcucgcgcag

SEQ ID NO: 1179671 - RNA, 12 nt, Mycobacterium bovis subsp bovis AF2122/97
cugcggcaccuc

SEQ ID NO: 1179672 - RNA, 16 nt, Mycobacterium bovis subsp bovis AF2122/97
cugcggcauggcaggc

SEQ ID NO: 1179673 - RNA, 17 nt, Mycobacterium bovis subsp bovis AF2122/97
cugcggcauggcaggcg

SEQ ID NO: 1179674 - RNA, 23 nt, Mycobacterium bovis subsp bovis AF2122/97
cugcggccaauggugggcgagcu

SEQ ID NO: 1179675 - RNA, 17 nt, Mycobacterium bovis subsp bovis AF2122/97
cugcggcccacaccagc

SEQ ID NO: 1179676 - RNA, 13 nt, Mycobacterium bovis subsp bovis AF2122/97
cugcggccacggu

SEQ ID NO: 1179677 - RNA, 17 nt, Mycobacterium bovis subsp bovis AF2122/97
cugcggccagcgcggcg

SEQ ID NO: 1179678 - RNA, 18 nt, Mycobacterium bovis subsp bovis AF2122/97
cugcggcagcgcggccaa

SEQ ID NO: 1179679 - RNA, 14 nt, Mycobacterium bovis subsp bovis AF2122/97
cugcggccagucag

SEQ ID NO: 1179680 - RNA, 14 nt, Mycobacterium bovis subsp bovis AF2122/97
cugcggggagcugu

SEQ ID NO: 1179681 - RNA, 16 nt, Mycobacterium bovis subsp bovis AF2122/97
cugcggccgauacaga

SEQ ID NO: 1179682 - RNA, 13 nt, Mycobacterium bovis subsp bovis AF2122/97
cugcggcaccacc

SEQ ID NO: 1179683 - RNA, 19 nt, Mycobacterium bovis subsp bovis AF2122/97
cugcggauacuguucugcu

SEQ ID NO: 1179684 - RNA, 18 nt, Mycobacterium bovis subsp bovis AF2122/97
cugcggaugcgcggcggg

SEQ ID NO: 1179685 - RNA, 15 nt, Mycobacterium bovis subsp bovis AF2122/97
cugcggaccggcgcg

SEQ ID NO: 1179686 - RNA, 22 nt, Mycobacterium bovis subsp bovis AF2122/97
cugcggaggcgaccccggcccc

SEQ ID NO: 1179687 - RNA, 13 nt, Mycobacterium bovis subsp bovis AF2122/97
cugcggaggcggg

SEQ ID NO: 1179688 - RNA, 20 nt, Mycobacterium bovis subsp bovis AF2122/97
cugcggacaagucggcaccg

SEQ ID NO: 1179689 - RNA, 22 nt, Mycobacterium bovis subsp bovis AF2122/97
cugcggacaagucggcaccggu

SEQ ID NO: 1179690 - RNA, 14 nt, Mycobacterium bovis subsp bovis AF2122/97
cugcgagcgcagcg

SEQ ID NO: 1179691 - RNA, 17 nt, Mycobacterium bovis subsp bovis AF2122/97
cugcgcuuugcacagcg

SEQ ID NO: 1179692 - RNA, 22 nt, Mycobacterium bovis subsp bovis AF2122/97
cugcgcuuugcacagcggcauc

SEQ ID NO: 1179693 - RNA, 20 nt, Mycobacterium bovis subsp bovis AF2122/97
cugcgaagccgagcaucaga

SEQ ID NO: 1179694 - RNA, 15 nt, Mycobacterium bovis subsp bovis AF2122/97
cugcgaaacgccacc

SEQ ID NO: 1179695 - RNA, 19 nt, Mycobacterium bovis subsp bovis AF2122/97
cugcgaaucuccgcgcggu

SEQ ID NO: 1179696 - RNA, 14 nt, Mycobacterium bovis subsp bovis AF2122/97
cugcgaaugcuggg

SEQ ID NO: 1179697 - RNA, 18 nt, Mycobacterium bovis subsp bovis AF2122/97
cugcgacagcacgugccc

SEQ ID NO: 1179698 - RNA, 16 nt, Mycobacterium bovis subsp bovis AF2122/97
cugcgaccgucccggc

SEQ ID NO: 1179699 - RNA, 18 nt, Mycobacterium bovis subsp bovis AF2122/97
cugcgaccgucccggccu

SEQ ID NO: 1179700 - RNA, 21 nt, Mycobacterium bovis subsp bovis AF2122/97
cugcgaccaagucaugcccac

SEQ ID NO: 1179701 - RNA, 17 nt, Mycobacterium bovis subsp bovis AF2122/97
cugcgacgagcccaccg

SEQ ID NO: 1179702 - RNA, 16 nt, Mycobacterium bovis subsp bovis AF2122/97
cugcgacugugaaucu

SEQ ID NO: 1179703 - RNA, 22 nt, Mycobacterium bovis subsp bovis AF2122/97
cugcgaccgucccggccucgau

SEQ ID NO: 1179704 - RNA, 15 nt, Mycobacterium bovis subsp bovis AF2122/97
cugcgaccucgccgg

SEQ ID NO: 1179705 - RNA, 18 nt, Mycobacterium bovis subsp bovis AF2122/97
cugcucccgaaaagcgcc

SEQ ID NO: 1179706 - RNA, 15 nt, Mycobacterium bovis subsp bovis AF2122/97
cugcucgccaggcaa

SEQ ID NO: 1179707 - RNA, 16 nt, Mycobacterium bovis subsp bovis AF2122/97
cugcucgccaggcaag

SEQ ID NO: 1179708 - RNA, 15 nt, Mycobacterium bovis subsp bovis AF2122/97
cugcucgccaggccu

SEQ ID NO: 1179709 - RNA, 14 nt, Mycobacterium bovis subsp bovis AF2122/97
cugcuccaggcgcg

SEQ ID NO: 1179710 - RNA, 19 nt, Mycobacterium bovis subsp bovis AF2122/97
cugcuccaggcgcgccgca

SEQ ID NO: 1179711 - RNA, 12 nt, Mycobacterium bovis subsp bovis AF2122/97
cugcucauccac

SEQ ID NO: 1179712 - RNA, 16 nt, Mycobacterium bovis subsp bovis AF2122/97
cugcucauccaccucg

SEQ ID NO: 1179713 - RNA, 22 nt, Mycobacterium bovis subsp bovis AF2122/97
cugcgugccgcaccgccugcuc

SEQ ID NO: 1179714 - RNA, 17 nt, Mycobacterium bovis subsp bovis AF2122/97
cugcguggcgggcugca

SEQ ID NO: 1179715 - RNA, 20 nt, Mycobacterium bovis subsp bovis AF2122/97
cugcuacccgagccggcacg

SEQ ID NO: 1179716 - RNA, 18 nt, Mycobacterium bovis subsp bovis AF2122/97
cugcuagccagucggcca

SEQ ID NO: 1179717 - RNA, 21 nt, Mycobacterium bovis subsp bovis AF2122/97
cugcuagccagucggccaccu

SEQ ID NO: 1179718 - RNA, 21 nt, Mycobacterium bovis subsp bovis AF2122/97
cugcuagcuuggcggccagcg

SEQ ID NO: 1179719 - RNA, 14 nt, Mycobacterium bovis subsp bovis AF2122/97
cugcucgcgccgcu

SEQ ID NO: 1179720 - RNA, 17 nt, Mycobacterium bovis subsp bovis AF2122/97
cugcucgccguggugga

SEQ ID NO: 1179721 - RNA, 16 nt, Mycobacterium bovis subsp bovis AF2122/97
cugcucgcuggugaac

SEQ ID NO: 1179722 - RNA, 15 nt, Mycobacterium bovis subsp bovis AF2122/97
cugcucggccuggau

SEQ ID NO: 1179723 - RNA, 15 nt, Mycobacterium bovis subsp bovis AF2122/97
cugcugaacaccggu

SEQ ID NO: 1179724 - RNA, 18 nt, Mycobacterium bovis subsp bovis AF2122/97
cugcugguaccgggcucc

SEQ ID NO: 1179725 - RNA, 14 nt, Mycobacterium bovis subsp bovis AF2122/97
cugcugggcacgau

SEQ ID NO: 1179726 - RNA, 21 nt, Mycobacterium bovis subsp bovis AF2122/97
cugcuggcgcuuugggcugcc

SEQ ID NO: 1179727 - RNA, 19 nt, Mycobacterium bovis subsp bovis AF2122/97
cugcuuccggaacaaaggc

SEQ ID NO: 1179728 - RNA, 13 nt, Mycobacterium bovis subsp bovis AF2122/97
cugcuugacuccg

SEQ ID NO: 1179729 - RNA, 21 nt, Mycobacterium bovis subsp bovis AF2122/97
cugcuugagcucgcugaucag

SEQ ID NO: 1179730 - RNA, 23 nt, Mycobacterium bovis subsp bovis AF2122/97
cugcuugaugguguccucgucga

SEQ ID NO: 1179731 - RNA, 13 nt, Mycobacterium bovis subsp bovis AF2122/97
cugcuugccaccg

SEQ ID NO: 1179732 - RNA, 18 nt, Mycobacterium bovis subsp bovis AF2122/97
cugcuugccaccgccgcc

SEQ ID NO: 1179733 - RNA, 16 nt, Mycobacterium bovis subsp bovis AF2122/97
cugcuugcgcccggcc

SEQ ID NO: 1179734 - RNA, 20 nt, Mycobacterium bovis subsp bovis AF2122/97
cugcuucuucggacagcagc

SEQ ID NO: 1179735 - RNA, 23 nt, Mycobacterium bovis subsp bovis AF2122/97
cugcuugucgaggcgcaggucaa

SEQ ID NO: 1179736 - RNA, 22 nt, Mycobacterium bovis subsp bovis AF2122/97
cuggaagacggugcgggcuagg

SEQ ID NO: 1179737 - RNA, 19 nt, Mycobacterium bovis subsp bovis AF2122/97
cuggaaccaaaccugggcg

SEQ ID NO: 1179738 - RNA, 16 nt, Mycobacterium bovis subsp bovis AF2122/97
cuggagugaggcugug

SEQ ID NO: 1179739 - RNA, 23 nt, Mycobacterium bovis subsp bovis AF2122/97
cuggaggggcaacaggggaaaac

SEQ ID NO: 1179740 - RNA, 23 nt, Mycobacterium bovis subsp bovis AF2122/97
cuggagccgugcggucgcgcccu

SEQ ID NO: 1179741 - RNA, 22 nt, Mycobacterium bovis subsp bovis AF2122/97
cuggaauggcucacgcuccgcc

SEQ ID NO: 1179742 - RNA, 22 nt, Mycobacterium bovis subsp bovis AF2122/97
cuggaagcggcgacuacccagc

SEQ ID NO: 1179743 - RNA, 19 nt, Mycobacterium bovis subsp bovis AF2122/97
cuggaaguacacggcggcc

SEQ ID NO: 1179744 - RNA, 15 nt, Mycobacterium bovis subsp bovis AF2122/97
cuggaaggucagcgc

SEQ ID NO: 1179745 - RNA, 22 nt, Mycobacterium bovis subsp bovis AF2122/97
cuggcacccggggugcccggcc

SEQ ID NO: 1179746 - RNA, 17 nt, Mycobacterium bovis subsp bovis AF2122/97
cuggcaccgccagccac

SEQ ID NO: 1179747 - RNA, 15 nt, Mycobacterium bovis subsp bovis AF2122/97
cuggaugccgaucgg

SEQ ID NO: 1179748 - RNA, 13 nt, Mycobacterium bovis subsp bovis AF2122/97
cuggauacccagc

SEQ ID NO: 1179749 - RNA, 17 nt, Mycobacterium bovis subsp bovis AF2122/97
cuggcuacgggccgcgg

SEQ ID NO: 1179750 - RNA, 15 nt, Mycobacterium bovis subsp bovis AF2122/97
cuggcguugccaccg

SEQ ID NO: 1179751 - RNA, 12 nt, Mycobacterium bovis subsp bovis AF2122/97
cuggcguucagc

SEQ ID NO: 1179752 - RNA, 23 nt, Mycobacterium bovis subsp bovis AF2122/97
cuggcgugcugcuagccagucgg

SEQ ID NO: 1179753 - RNA, 15 nt, Mycobacterium bovis subsp bovis AF2122/97
cuggcgugucgccgc

SEQ ID NO: 1179754 - RNA, 18 nt, Mycobacterium bovis subsp bovis AF2122/97
cuggcgugucgccgccac

SEQ ID NO: 1179755 - RNA, 13 nt, Mycobacterium bovis subsp bovis AF2122/97
cuggcugaccgaa

SEQ ID NO: 1179756 - RNA, 20 nt, Mycobacterium bovis subsp bovis AF2122/97
cuggcugcgguaguugcagu

SEQ ID NO: 1179757 - RNA, 23 nt, Mycobacterium bovis subsp bovis AF2122/97
cuggcgucaccgcggguggaugu

SEQ ID NO: 1179758 - RNA, 23 nt, Mycobacterium bovis subsp bovis AF2122/97
cuggcgucgucuucgguuaaggu

SEQ ID NO: 1179759 - RNA, 23 nt, Mycobacterium bovis subsp bovis AF2122/97
cuggcgguugcccgagcggcuga

SEQ ID NO: 1179760 - RNA, 22 nt, Mycobacterium bovis subsp bovis AF2122/97
cuggcggguuggucccgaugac

SEQ ID NO: 1179761 - RNA, 15 nt, Mycobacterium bovis subsp bovis AF2122/97
cuggcggcugcagcc

SEQ ID NO: 1179762 - RNA, 19 nt, Mycobacterium bovis subsp bovis AF2122/97
cugggccggggaggcuagg

SEQ ID NO: 1179763 - RNA, 18 nt, Mycobacterium bovis subsp bovis AF2122/97
cugggcccgccagcccag

SEQ ID NO: 1179764 - RNA, 14 nt, Mycobacterium bovis subsp bovis AF2122/97
cugggccgccgccc

SEQ ID NO: 1179765 - RNA, 23 nt, Mycobacterium bovis subsp bovis AF2122/97
cugggcgaagcccagaucuugca

SEQ ID NO: 1179766 - RNA, 23 nt, Mycobacterium bovis subsp bovis AF2122/97
cugggcccccaaucagugcagcg

SEQ ID NO: 1179767 - RNA, 13 nt, Mycobacterium bovis subsp bovis AF2122/97
cugggcaucaccg

SEQ ID NO: 1179768 - RNA, 20 nt, Mycobacterium bovis subsp bovis AF2122/97
cugggcacucggcccggccc

SEQ ID NO: 1179769 - RNA, 16 nt, Mycobacterium bovis subsp bovis AF2122/97
cugggauucugggcga

SEQ ID NO: 1179770 - RNA, 18 nt, Mycobacterium bovis subsp bovis AF2122/97
cugggcaaguucugcgcu

SEQ ID NO: 1179771 - RNA, 18 nt, Mycobacterium bovis subsp bovis AF2122/97
cugggaucccgacgaagg

SEQ ID NO: 1179772 - RNA, 14 nt, Mycobacterium bovis subsp bovis AF2122/97
cugggagcggaugu

SEQ ID NO: 1179773 - RNA, 11 nt, Mycobacterium bovis subsp bovis AF2122/97
cugggagaucg

SEQ ID NO: 1179774 - RNA, 15 nt, Mycobacterium bovis subsp bovis AF2122/97
cuggcuggugauggc

SEQ ID NO: 1179775 - RNA, 16 nt, Mycobacterium bovis subsp bovis AF2122/97
cuggcuguccgcgggc

SEQ ID NO: 1179776 - RNA, 13 nt, Mycobacterium bovis subsp bovis AF2122/97
cuggcuggucagg

SEQ ID NO: 1179777 - RNA, 21 nt, Mycobacterium bovis subsp bovis AF2122/97
cuggcuugagguaggucacca

SEQ ID NO: 1179778 - RNA, 23 nt, Mycobacterium bovis subsp bovis AF2122/97
cuggcuugggccagcgcaucuuu

SEQ ID NO: 1179779 - RNA, 16 nt, Mycobacterium bovis subsp bovis AF2122/97
cugggaaacugggucu

SEQ ID NO: 1179780 - RNA, 19 nt, Mycobacterium bovis subsp bovis AF2122/97
cuggcgcccgggucccggc

SEQ ID NO: 1179781 - RNA, 15 nt, Mycobacterium bovis subsp bovis AF2122/97
cuggcgcccccgcca

SEQ ID NO: 1179782 - RNA, 14 nt, Mycobacterium bovis subsp bovis AF2122/97
cuggcgccguuagc

SEQ ID NO: 1179783 - RNA, 14 nt, Mycobacterium bovis subsp bovis AF2122/97
cuggcgcagcgcca

SEQ ID NO: 1179784 - RNA, 12 nt, Mycobacterium bovis subsp bovis AF2122/97
cuggcgcagccu

SEQ ID NO: 1179785 - RNA, 21 nt, Mycobacterium bovis subsp bovis AF2122/97
cuggcgcagccugccgaugac

SEQ ID NO: 1179786 - RNA, 21 nt, Mycobacterium bovis subsp bovis AF2122/97
cuggcgauggccguccgaccg

SEQ ID NO: 1179787 - RNA, 19 nt, Mycobacterium bovis subsp bovis AF2122/97
cuggcgaucuggucggcgg

SEQ ID NO: 1179788 - RNA, 20 nt, Mycobacterium bovis subsp bovis AF2122/97
cuggcgcugaugcuggccau

SEQ ID NO: 1179789 - RNA, 22 nt, Mycobacterium bovis subsp bovis AF2122/97
cuggcgcugaugcuggccaugu

SEQ ID NO: 1179790 - RNA, 19 nt, Mycobacterium bovis subsp bovis AF2122/97
cuggcgcuuugggcugccg

SEQ ID NO: 1179791 - RNA, 20 nt, Mycobacterium bovis subsp bovis AF2122/97
cuggcgcuuugggcugccgu

SEQ ID NO: 1179792 - RNA, 20 nt, Mycobacterium bovis subsp bovis AF2122/97
cuggcggccagcaucgggug

SEQ ID NO: 1179793 - RNA, 21 nt, Mycobacterium bovis subsp bovis AF2122/97
cuggcggcagcgguuuuaggc

SEQ ID NO: 1179794 - RNA, 16 nt, Mycobacterium bovis subsp bovis AF2122/97
cuggcggauggccgcc

SEQ ID NO: 1179795 - RNA, 14 nt, Mycobacterium bovis subsp bovis AF2122/97
cuggcggcgcagcg

SEQ ID NO: 1179796 - RNA, 15 nt, Mycobacterium bovis subsp bovis AF2122/97
cuggcggcgccgcag

SEQ ID NO: 1179797 - RNA, 23 nt, Mycobacterium bovis subsp bovis AF2122/97
cuggcggcgugcuuaacacaugc

SEQ ID NO: 1179798 - RNA, 19 nt, Mycobacterium bovis subsp bovis AF2122/97
cuggcaggcuuagcuuccg

SEQ ID NO: 1179799 - RNA, 19 nt, Mycobacterium bovis subsp bovis AF2122/97
cuggcaggccgggcaccaa

SEQ ID NO: 1179800 - RNA, 16 nt, Mycobacterium bovis subsp bovis AF2122/97
cuggcagcggccuccg

SEQ ID NO: 1179801 - RNA, 18 nt, Mycobacterium bovis subsp bovis AF2122/97
cuggcaccucgcccuccc

SEQ ID NO: 1179802 - RNA, 14 nt, Mycobacterium bovis subsp bovis AF2122/97
cuggccgcgccggg

SEQ ID NO: 1179803 - RNA, 13 nt, Mycobacterium bovis subsp bovis AF2122/97
cuggccgccggcg

SEQ ID NO: 1179804 - RNA, 16 nt, Mycobacterium bovis subsp bovis AF2122/97
cuggccgccggccccg

SEQ ID NO: 1179805 - RNA, 17 nt, Mycobacterium bovis subsp bovis AF2122/97
cuggccgccggccccgc

SEQ ID NO: 1179806 - RNA, 17 nt, Mycobacterium bovis subsp bovis AF2122/97
cuggccgccuccgcggc

SEQ ID NO: 1179807 - RNA, 13 nt, Mycobacterium bovis subsp bovis AF2122/97
cuggccgccgccc

SEQ ID NO: 1179808 - RNA, 14 nt, Mycobacterium bovis subsp bovis AF2122/97
cuggccgccgccgu

SEQ ID NO: 1179809 - RNA, 14 nt, Mycobacterium bovis subsp bovis AF2122/97
cuggccgcccgcuc

SEQ ID NO: 1179810 - RNA, 13 nt, Mycobacterium bovis subsp bovis AF2122/97
cuggccgcccggc

SEQ ID NO: 1179811 - RNA, 20 nt, Mycobacterium bovis subsp bovis AF2122/97
cuggccgaugugggcggagc

SEQ ID NO: 1179812 - RNA, 20 nt, Mycobacterium bovis subsp bovis AF2122/97
cuggccgauggcgucaagca

SEQ ID NO: 1179813 - RNA, 13 nt, Mycobacterium bovis subsp bovis AF2122/97
cuggccgccagau

SEQ ID NO: 1179814 - RNA, 18 nt, Mycobacterium bovis subsp bovis AF2122/97
cuggcauaucccuugccg

SEQ ID NO: 1179815 - RNA, 23 nt, Mycobacterium bovis subsp bovis AF2122/97
cuggccguccuaccgaugaacca

SEQ ID NO: 1179816 - RNA, 16 nt, Mycobacterium bovis subsp bovis AF2122/97
cuggccguuucggcgc

SEQ ID NO: 1179817 - RNA, 22 nt, Mycobacterium bovis subsp bovis AF2122/97
cuggccugauuguugagccacg

SEQ ID NO: 1179818 - RNA, 13 nt, Mycobacterium bovis subsp bovis AF2122/97
cuggccuccagcu

SEQ ID NO: 1179819 - RNA, 15 nt, Mycobacterium bovis subsp bovis AF2122/97
cuggccuccagcuug

SEQ ID NO: 1179820 - RNA, 16 nt, Mycobacterium bovis subsp bovis AF2122/97
cuggccgucccaccag

SEQ ID NO: 1179821 - RNA, 16 nt, Mycobacterium bovis subsp bovis AF2122/97
cuggccgucgcuggug

SEQ ID NO: 1179822 - RNA, 21 nt, Mycobacterium bovis subsp bovis AF2122/97
cuggccgggaccgccccggcc

SEQ ID NO: 1179823 - RNA, 21 nt, Mycobacterium bovis subsp bovis AF2122/97
cuggccggguuccagcggcac

SEQ ID NO: 1179824 - RNA, 14 nt, Mycobacterium bovis subsp bovis AF2122/97
cuggccgggaccgc

SEQ ID NO: 1179825 - RNA, 22 nt, Mycobacterium bovis subsp bovis AF2122/97
cuggccgcgccucggucugcuc

SEQ ID NO: 1179826 - RNA, 17 nt, Mycobacterium bovis subsp bovis AF2122/97
cuggccugcccagcacc

SEQ ID NO: 1179827 - RNA, 15 nt, Mycobacterium bovis subsp bovis AF2122/97
cuggccugcggcagg

SEQ ID NO: 1179828 - RNA, 14 nt, Mycobacterium bovis subsp bovis AF2122/97
cuggcgaacaguga

SEQ ID NO: 1179829 - RNA, 17 nt, Mycobacterium bovis subsp bovis AF2122/97
cuggccuuugagcgcgg

SEQ ID NO: 1179830 - RNA, 18 nt, Mycobacterium bovis subsp bovis AF2122/97
cuggcgagggcuaccggc

SEQ ID NO: 1179831 - RNA, 19 nt, Mycobacterium bovis subsp bovis AF2122/97
cuggcgaaugcgggccucc

SEQ ID NO: 1179832 - RNA, 21 nt, Mycobacterium bovis subsp bovis AF2122/97
cuggcgaaugcgggccuccug

SEQ ID NO: 1179833 - RNA, 18 nt, Mycobacterium bovis subsp bovis AF2122/97
cuggcgaaggacaacagc

SEQ ID NO: 1179834 - RNA, 22 nt, Mycobacterium bovis subsp bovis AF2122/97
cuggcgaaggacaacagccgcu

SEQ ID NO: 1179835 - RNA, 14 nt, Mycobacterium bovis subsp bovis AF2122/97
cuggucggccaggu

SEQ ID NO: 1179836 - RNA, 18 nt, Mycobacterium bovis subsp bovis AF2122/97
cuggucggcuaccgccga

SEQ ID NO: 1179837 - RNA, 14 nt, Mycobacterium bovis subsp bovis AF2122/97
cuggucgugggcca

SEQ ID NO: 1179838 - RNA, 20 nt, Mycobacterium bovis subsp bovis AF2122/97
cuggucgugggccaccaccu

SEQ ID NO: 1179839 - RNA, 22 nt, Mycobacterium bovis subsp bovis AF2122/97
cuggugacgaaagcgcccagga

SEQ ID NO: 1179840 - RNA, 20 nt, Mycobacterium bovis subsp bovis AF2122/97
cugguccucacgggucagca

SEQ ID NO: 1179841 - RNA, 18 nt, Mycobacterium bovis subsp bovis AF2122/97
cuggucccacaccuccuc

SEQ ID NO: 1179842 - RNA, 13 nt, Mycobacterium bovis subsp bovis AF2122/97
cugguccagcacc

SEQ ID NO: 1179843 - RNA, 21 nt, Mycobacterium bovis subsp bovis AF2122/97
cuggucauggccgaacauucc

SEQ ID NO: 1179844 - RNA, 22 nt, Mycobacterium bovis subsp bovis AF2122/97
cuggucgauggcguacagcacc

SEQ ID NO: 1179845 - RNA, 20 nt, Mycobacterium bovis subsp bovis AF2122/97
cuggucgcuggugcacggcu

SEQ ID NO: 1179846 - RNA, 14 nt, Mycobacterium bovis subsp bovis AF2122/97
cuggucgccgucga

SEQ ID NO: 1179847 - RNA, 22 nt, Mycobacterium bovis subsp bovis AF2122/97
cugguaggagaucaccucggug

SEQ ID NO: 1179848 - RNA, 20 nt, Mycobacterium bovis subsp bovis AF2122/97
cugguaccccagcacaaggc

SEQ ID NO: 1179849 - RNA, 14 nt, Mycobacterium bovis subsp bovis AF2122/97
cugguaccgcggug

SEQ ID NO: 1179850 - RNA, 15 nt, Mycobacterium bovis subsp bovis AF2122/97
cugguaagucagcuc

SEQ ID NO: 1179851 - RNA, 14 nt, Mycobacterium bovis subsp bovis AF2122/97
cuggucacugcccu

SEQ ID NO: 1179852 - RNA, 17 nt, Mycobacterium bovis subsp bovis AF2122/97
cuggucagccgcggcgg

SEQ ID NO: 1179853 - RNA, 16 nt, Mycobacterium bovis subsp bovis AF2122/97
cugguauuuguccggc

SEQ ID NO: 1179854 - RNA, 14 nt, Mycobacterium bovis subsp bovis AF2122/97
cugguaggucaccg

SEQ ID NO: 1179855 - RNA, 24 nt, Mycobacterium bovis subsp bovis AF2122/97
cugggcgguagcuuccgcgacgcu

SEQ ID NO: 1179856 - RNA, 22 nt, Mycobacterium bovis subsp bovis AF2122/97
cugggcgcuggaggccaccacc

SEQ ID NO: 1179857 - RNA, 17 nt, Mycobacterium bovis subsp bovis AF2122/97
cugggcggccuuuuccg

SEQ ID NO: 1179858 - RNA, 10 nt, Mycobacterium bovis subsp bovis AF2122/97
cugggcggcc

SEQ ID NO: 1179859 - RNA, 23 nt, Mycobacterium bovis subsp bovis AF2122/97
cugggcgcccgcgguccggcgaa

SEQ ID NO: 1179860 - RNA, 18 nt, Mycobacterium bovis subsp bovis AF2122/97
cugggcgcgcuggcgggc

SEQ ID NO: 1179861 - RNA, 16 nt, Mycobacterium bovis subsp bovis AF2122/97
cuggggcagccgggcg

SEQ ID NO: 1179862 - RNA, 20 nt, Mycobacterium bovis subsp bovis AF2122/97
cuggggccguccggcuuggc

SEQ ID NO: 1179863 - RNA, 16 nt, Mycobacterium bovis subsp bovis AF2122/97
cuggggguaccucccg

SEQ ID NO: 1179864 - RNA, 13 nt, Mycobacterium bovis subsp bovis AF2122/97
cugggggccggca

SEQ ID NO: 1179865 - RNA, 18 nt, Mycobacterium bovis subsp bovis AF2122/97
cugggggccggcacugcc

SEQ ID NO: 1179866 - RNA, 14 nt, Mycobacterium bovis subsp bovis AF2122/97
cugggcugccggcc

SEQ ID NO: 1179867 - RNA, 15 nt, Mycobacterium bovis subsp bovis AF2122/97
cugggcugcggccgc

SEQ ID NO: 1179868 - RNA, 15 nt, Mycobacterium bovis subsp bovis AF2122/97
cuggggaggccaacc

SEQ ID NO: 1179869 - RNA, 18 nt, Mycobacterium bovis subsp bovis AF2122/97
cuggggaacagcagcgca

SEQ ID NO: 1179870 - RNA, 15 nt, Mycobacterium bovis subsp bovis AF2122/97
cugggcuuucagcac

SEQ ID NO: 1179871 - RNA, 17 nt, Mycobacterium bovis subsp bovis AF2122/97
cugggcuuucagcaccg

SEQ ID NO: 1179872 - RNA, 19 nt, Mycobacterium bovis subsp bovis AF2122/97
cugggugccggcagcggcg

SEQ ID NO: 1179873 - RNA, 16 nt, Mycobacterium bovis subsp bovis AF2122/97
cugggugccggcagcg

SEQ ID NO: 1179874 - RNA, 18 nt, Mycobacterium bovis subsp bovis AF2122/97
cuggguggccaaccaacc

SEQ ID NO: 1179875 - RNA, 22 nt, Mycobacterium bovis subsp bovis AF2122/97
cuggguucccgaugugaacgca

SEQ ID NO: 1179876 - RNA, 16 nt, Mycobacterium bovis subsp bovis AF2122/97
cuggguuugcacggcg

SEQ ID NO: 1179877 - RNA, 20 nt, Mycobacterium bovis subsp bovis AF2122/97
cuggguuugcacggcgcgcc

SEQ ID NO: 1179878 - RNA, 21 nt, Mycobacterium bovis subsp bovis AF2122/97
cugggucggaccuuccgggug

SEQ ID NO: 1179879 - RNA, 23 nt, Mycobacterium bovis subsp bovis AF2122/97
cugggugagcaccugggcgcgcu

SEQ ID NO: 1179880 - RNA, 14 nt, Mycobacterium bovis subsp bovis AF2122/97
cugggugaccagga

SEQ ID NO: 1179881 - RNA, 20 nt, Mycobacterium bovis subsp bovis AF2122/97
cuggggguggcagcgcggcc

SEQ ID NO: 1179882 - RNA, 21 nt, Mycobacterium bovis subsp bovis AF2122/97
cugggguccgcgucggcggcg

SEQ ID NO: 1179883 - RNA, 23 nt, Mycobacterium bovis subsp bovis AF2122/97
cuggggugcugcgcgcggcggcc

SEQ ID NO: 1179884 - RNA, 23 nt, Mycobacterium bovis subsp bovis AF2122/97
cuggugcccgacccgccgaugau

SEQ ID NO: 1179885 - RNA, 17 nt, Mycobacterium bovis subsp bovis AF2122/97
cuggugcgccacgccac

SEQ ID NO: 1179886 - RNA, 15 nt, Mycobacterium bovis subsp bovis AF2122/97
cuggugccuuaccac

SEQ ID NO: 1179887 - RNA, 22 nt, Mycobacterium bovis subsp bovis AF2122/97
cuggugccuuaccaccgucucc

SEQ ID NO: 1179888 - RNA, 18 nt, Mycobacterium bovis subsp bovis AF2122/97
cuggugcgcggagagcgc

SEQ ID NO: 1179889 - RNA, 14 nt, Mycobacterium bovis subsp bovis AF2122/97
cuggugcgggacgc

SEQ ID NO: 1179890 - RNA, 15 nt, Mycobacterium bovis subsp bovis AF2122/97
cuggugcgggacgcc

SEQ ID NO: 1179891 - RNA, 14 nt, Mycobacterium bovis subsp bovis AF2122/97
cugguggucggcga

SEQ ID NO: 1179892 - RNA, 20 nt, Mycobacterium bovis subsp bovis AF2122/97
cugguguagaccgaaauggu

SEQ ID NO: 1179893 - RNA, 16 nt, Mycobacterium bovis subsp bovis AF2122/97
cuggugucgggcguca

SEQ ID NO: 1179894 - RNA, 18 nt, Mycobacterium bovis subsp bovis AF2122/97
cugguguccagccaggcg

SEQ ID NO: 1179895 - RNA, 21 nt, Mycobacterium bovis subsp bovis AF2122/97
cugguggcggcacuggccccg

SEQ ID NO: 1179896 - RNA, 20 nt, Mycobacterium bovis subsp bovis AF2122/97
cuggugggggagcggccgcc

SEQ ID NO: 1179897 - RNA, 15 nt, Mycobacterium bovis subsp bovis AF2122/97
cugguggucagcacc

SEQ ID NO: 1179898 - RNA, 17 nt, Mycobacterium bovis subsp bovis AF2122/97
cugguggcagaaaccgg

SEQ ID NO: 1179899 - RNA, 17 nt, Mycobacterium bovis subsp bovis AF2122/97
cugguggacucgggcgc

SEQ ID NO: 1179900 - RNA, 15 nt, Mycobacterium bovis subsp bovis AF2122/97
cugguggcagacaug

SEQ ID NO: 1179901 - RNA, 17 nt, Mycobacterium bovis subsp bovis AF2122/97
cugguugaccucgguga

SEQ ID NO: 1179902 - RNA, 18 nt, Mycobacterium bovis subsp bovis AF2122/97
cugguuugcuucucccgc

SEQ ID NO: 1179903 - RNA, 16 nt, Mycobacterium bovis subsp bovis AF2122/97
cugguucagccauucu

SEQ ID NO: 1179904 - RNA, 17 nt, Mycobacterium bovis subsp bovis AF2122/97
cuguacggaucaggccc

SEQ ID NO: 1179905 - RNA, 21 nt, Mycobacterium bovis subsp bovis AF2122/97
cuguaaaaaugcuucgccaac

SEQ ID NO: 1179906 - RNA, 13 nt, Mycobacterium bovis subsp bovis AF2122/97
cuguccgguggaa

SEQ ID NO: 1179907 - RNA, 14 nt, Mycobacterium bovis subsp bovis AF2122/97
cugucccggcgcgc

SEQ ID NO: 1179908 - RNA, 20 nt, Mycobacterium bovis subsp bovis AF2122/97
cuguccgaccucgccgcgcg

SEQ ID NO: 1179909 - RNA, 20 nt, Mycobacterium bovis subsp bovis AF2122/97
cugucccugcaguccacuga

SEQ ID NO: 1179910 - RNA, 19 nt, Mycobacterium bovis subsp bovis AF2122/97
cuguccccgccgagggcuu

SEQ ID NO: 1179911 - RNA, 13 nt, Mycobacterium bovis subsp bovis AF2122/97
cugucccgccggc

SEQ ID NO: 1179912 - RNA, 17 nt, Mycobacterium bovis subsp bovis AF2122/97
cugucccgccggccccg

SEQ ID NO: 1179913 - RNA, 18 nt, Mycobacterium bovis subsp bovis AF2122/97
cugucccgccggccccgc

SEQ ID NO: 1179914 - RNA, 15 nt, Mycobacterium bovis subsp bovis AF2122/97
cugucccgcgggcca

SEQ ID NO: 1179915 - RNA, 23 nt, Mycobacterium bovis subsp bovis AF2122/97
cuguccaggucugggcuuugcag

SEQ ID NO: 1179916 - RNA, 16 nt, Mycobacterium bovis subsp bovis AF2122/97
cuguccacguccagcc

SEQ ID NO: 1179917 - RNA, 18 nt, Mycobacterium bovis subsp bovis AF2122/97
cuguccacguccagcccg

SEQ ID NO: 1179918 - RNA, 17 nt, Mycobacterium bovis subsp bovis AF2122/97
cugucccaccagguacg

SEQ ID NO: 1179919 - RNA, 15 nt, Mycobacterium bovis subsp bovis AF2122/97
cugucccagcccggc

SEQ ID NO: 1179920 - RNA, 15 nt, Mycobacterium bovis subsp bovis AF2122/97
cugucagcgcggcgc

SEQ ID NO: 1179921 - RNA, 18 nt, Mycobacterium bovis subsp bovis AF2122/97
cuguaguucgaugacuga

SEQ ID NO: 1179922 - RNA, 17 nt, Mycobacterium bovis subsp bovis AF2122/97
cuguacggcggcuaggc

SEQ ID NO: 1179923 - RNA, 22 nt, Mycobacterium bovis subsp bovis AF2122/97
cuguacggaucaggcccgggcg

SEQ ID NO: 1179924 - RNA, 14 nt, Mycobacterium bovis subsp bovis AF2122/97
cuguagaccuggcc

SEQ ID NO: 1179925 - RNA, 17 nt, Mycobacterium bovis subsp bovis AF2122/97
cugucaagcgggcuggc

SEQ ID NO: 1179926 - RNA, 15 nt, Mycobacterium bovis subsp bovis AF2122/97
cugugcguuccugau

SEQ ID NO: 1179927 - RNA, 17 nt, Mycobacterium bovis subsp bovis AF2122/97
cugugcucacggcggcg

SEQ ID NO: 1179928 - RNA, 15 nt, Mycobacterium bovis subsp bovis AF2122/97
cugugcgcagacauc

SEQ ID NO: 1179929 - RNA, 21 nt, Mycobacterium bovis subsp bovis AF2122/97
cugugcgccgcagccugcaac

SEQ ID NO: 1179930 - RNA, 17 nt, Mycobacterium bovis subsp bovis AF2122/97
cuguggaugccgacggc

SEQ ID NO: 1179931 - RNA, 13 nt, Mycobacterium bovis subsp bovis AF2122/97
cuguggaagcccg

SEQ ID NO: 1179932 - RNA, 22 nt, Mycobacterium bovis subsp bovis AF2122/97
cuguggaagcccgucgcggccg

SEQ ID NO: 1179933 - RNA, 14 nt, Mycobacterium bovis subsp bovis AF2122/97
cugugaggucauug

SEQ ID NO: 1179934 - RNA, 17 nt, Mycobacterium bovis subsp bovis AF2122/97
cugugaacagcgcgucg

SEQ ID NO: 1179935 - RNA, 19 nt, Mycobacterium bovis subsp bovis AF2122/97
cugugacacccgagggccu

SEQ ID NO: 1179936 - RNA, 23 nt, Mycobacterium bovis subsp bovis AF2122/97
cugugacacccgagggccugacg

SEQ ID NO: 1179937 - RNA, 15 nt, Mycobacterium bovis subsp bovis AF2122/97
cugugccagcagcag

SEQ ID NO: 1179938 - RNA, 16 nt, Mycobacterium bovis subsp bovis AF2122/97
cugugccagcagcagc

SEQ ID NO: 1179939 - RNA, 16 nt, Mycobacterium bovis subsp bovis AF2122/97
cugugccccagggcag

SEQ ID NO: 1179940 - RNA, 14 nt, Mycobacterium bovis subsp bovis AF2122/97
cugugccgccggcg

SEQ ID NO: 1179941 - RNA, 14 nt, Mycobacterium bovis subsp bovis AF2122/97
cuguccugccagaa

SEQ ID NO: 1179942 - RNA, 15 nt, Mycobacterium bovis subsp bovis AF2122/97
cugucgaagauccag

SEQ ID NO: 1179943 - RNA, 15 nt, Mycobacterium bovis subsp bovis AF2122/97
cuguccucgcgggcu

SEQ ID NO: 1179944 - RNA, 20 nt, Mycobacterium bovis subsp bovis AF2122/97
cugucgauggacaaggugug

SEQ ID NO: 1179945 - RNA, 21 nt, Mycobacterium bovis subsp bovis AF2122/97
cugucgugauacagcucggug

SEQ ID NO: 1179946 - RNA, 14 nt, Mycobacterium bovis subsp bovis AF2122/97
cugucguaccgcuc

SEQ ID NO: 1179947 - RNA, 21 nt, Mycobacterium bovis subsp bovis AF2122/97
cugucgugccucucgggggcc

SEQ ID NO: 1179948 - RNA, 20 nt, Mycobacterium bovis subsp bovis AF2122/97
cuguugaagccgcccgaguu

SEQ ID NO: 1179949 - RNA, 15 nt, Mycobacterium bovis subsp bovis AF2122/97
cuguugaagaagccc

SEQ ID NO: 1179950 - RNA, 17 nt, Mycobacterium bovis subsp bovis AF2122/97
cuguugacuaccaccgc

SEQ ID NO: 1179951 - RNA, 21 nt, Mycobacterium bovis subsp bovis AF2122/97
cuguucuuggugaccaaugcg

SEQ ID NO: 1179952 - RNA, 12 nt, Mycobacterium bovis subsp bovis AF2122/97
cuguucaacucc

SEQ ID NO: 1179953 - RNA, 13 nt, Mycobacterium bovis subsp bovis AF2122/97
cuguucaacuccg

SEQ ID NO: 1179954 - RNA, 21 nt, Mycobacterium bovis subsp bovis AF2122/97
cuguggucggugccagcacca

SEQ ID NO: 1179955 - RNA, 22 nt, Mycobacterium bovis subsp bovis AF2122/97
cuguggucgcugcugccgcacc

SEQ ID NO: 1179956 - RNA, 17 nt, Mycobacterium bovis subsp bovis AF2122/97
cugugucugcucgcgcc

SEQ ID NO: 1179957 - RNA, 15 nt, Mycobacterium bovis subsp bovis AF2122/97
cugugucguggucga

SEQ ID NO: 1179958 - RNA, 15 nt, Mycobacterium bovis subsp bovis AF2122/97
cuguugcguagcgcg

SEQ ID NO: 1179959 - RNA, 16 nt, Mycobacterium bovis subsp bovis AF2122/97
cuguugcggcggcgcu

SEQ ID NO: 1179960 - RNA, 20 nt, Mycobacterium bovis subsp bovis AF2122/97
cuguugcccaauucgacugc

SEQ ID NO: 1179961 - RNA, 22 nt, Mycobacterium bovis subsp bovis AF2122/97
cuguuggcaugccgcccgcucc

SEQ ID NO: 1179962 - RNA, 22 nt, Mycobacterium bovis subsp bovis AF2122/97
cuguuggcguggaucuuggcca

SEQ ID NO: 1179963 - RNA, 21 nt, Mycobacterium bovis subsp bovis AF2122/97
cuguuggugccgccaccaccg

SEQ ID NO: 1179964 - RNA, 13 nt, Mycobacterium bovis subsp bovis AF2122/97
cuguugguuuugu

SEQ ID NO: 1179965 - RNA, 13 nt, Mycobacterium bovis subsp bovis AF2122/97
aaacugggcaccg

SEQ ID NO: 1179966 - RNA, 21 nt, Mycobacterium bovis subsp bovis AF2122/97
aaacuggggguuguucaacuc

SEQ ID NO: 1179967 - RNA, 19 nt, Mycobacterium bovis subsp bovis AF2122/97
cuuaaggcccuggccgcgc

SEQ ID NO: 1179968 - RNA, 13 nt, Mycobacterium bovis subsp bovis AF2122/97
cuucaccuggaag

SEQ ID NO: 1179969 - RNA, 24 nt, Mycobacterium bovis subsp bovis AF2122/97
cuucaccuggaaggucagcgcccu

SEQ ID NO: 1179970 - RNA, 18 nt, Mycobacterium bovis subsp bovis AF2122/97
cuucaaggaagccgcggc

SEQ ID NO: 1179971 - RNA, 13 nt, Mycobacterium bovis subsp bovis AF2122/97
cuuccaaacccgg

SEQ ID NO: 1179972 - RNA, 23 nt, Mycobacterium bovis subsp bovis AF2122/97
cuucaucuucgaggucugguaga

SEQ ID NO: 1179973 - RNA, 20 nt, Mycobacterium bovis subsp bovis AF2122/97
cuucaucgccucgaggacca

SEQ ID NO: 1179974 - RNA, 13 nt, Mycobacterium bovis subsp bovis AF2122/97
cuucagcguccug

SEQ ID NO: 1179975 - RNA, 17 nt, Mycobacterium bovis subsp bovis AF2122/97
cuucagcguccugguga

SEQ ID NO: 1179976 - RNA, 20 nt, Mycobacterium bovis subsp bovis AF2122/97
cuucacuguugcccuuggga

SEQ ID NO: 1179977 - RNA, 14 nt, Mycobacterium bovis subsp bovis AF2122/97
cuucagccagucca

SEQ ID NO: 1179978 - RNA, 19 nt, Mycobacterium bovis subsp bovis AF2122/97
cuucagccaguccagcgcg

SEQ ID NO: 1179979 - RNA, 19 nt, Mycobacterium bovis subsp bovis AF2122/97
cuucccaguaaguccucga

SEQ ID NO: 1179980 - RNA, 12 nt, Mycobacterium bovis subsp bovis AF2122/97
cuucccacccgg

SEQ ID NO: 1179981 - RNA, 13 nt, Mycobacterium bovis subsp bovis AF2122/97
cuuccauaacgac

SEQ ID NO: 1179982 - RNA, 21 nt, Mycobacterium bovis subsp bovis AF2122/97
cuuccaauugauaggccccga

SEQ ID NO: 1179983 - RNA, 23 nt, Mycobacterium bovis subsp bovis AF2122/97
cuuccaauugauaggccccgagg

SEQ ID NO: 1179984 - RNA, 17 nt, Mycobacterium bovis subsp bovis AF2122/97
cuuccagccacagcccg

SEQ ID NO: 1179985 - RNA, 19 nt, Mycobacterium bovis subsp bovis AF2122/97
cuuccagccacagcccggc

SEQ ID NO: 1179986 - RNA, 22 nt, Mycobacterium bovis subsp bovis AF2122/97
cuuccagccacagcccggcggc

SEQ ID NO: 1179987 - RNA, 19 nt, Mycobacterium bovis subsp bovis AF2122/97
cuuccucggauugcagcgc

SEQ ID NO: 1179988 - RNA, 14 nt, Mycobacterium bovis subsp bovis AF2122/97
cuuccucgccggaa

SEQ ID NO: 1179989 - RNA, 23 nt, Mycobacterium bovis subsp bovis AF2122/97
cuuccgcgcgcagaugagcgcgg

SEQ ID NO: 1179990 - RNA, 14 nt, Mycobacterium bovis subsp bovis AF2122/97
cuuccgcagcgcca

SEQ ID NO: 1179991 - RNA, 17 nt, Mycobacterium bovis subsp bovis AF2122/97
cuuccucggccacccgc

SEQ ID NO: 1179992 - RNA, 17 nt, Mycobacterium bovis subsp bovis AF2122/97
cuucgcccuugccgcag

SEQ ID NO: 1179993 - RNA, 22 nt, Mycobacterium bovis subsp bovis AF2122/97
cuucgccgaagcgccgcuuggc

SEQ ID NO: 1179994 - RNA, 18 nt, Mycobacterium bovis subsp bovis AF2122/97
cuucgccagcgccacugg

SEQ ID NO: 1179995 - RNA, 16 nt, Mycobacterium bovis subsp bovis AF2122/97
cuucgcaagucaucca

SEQ ID NO: 1179996 - RNA, 22 nt, Mycobacterium bovis subsp bovis AF2122/97
cuucgcaguugagggugugagg

SEQ ID NO: 1179997 - RNA, 16 nt, Mycobacterium bovis subsp bovis AF2122/97
cuucgaucagcggcag

SEQ ID NO: 1179998 - RNA, 20 nt, Mycobacterium bovis subsp bovis AF2122/97
cuucgaucaucgaccuggcc

SEQ ID NO: 1179999 - RNA, 19 nt, Mycobacterium bovis subsp bovis AF2122/97
cuucgaucuccaggcccgg

SEQ ID NO: 1180000 - RNA, 14 nt, Mycobacterium bovis subsp bovis AF2122/97
cguacagcgccugg

SEQ ID NO: 1180001 - RNA, 19 nt, Mycobacterium bovis subsp bovis AF2122/97
cguaaugcugcugcagcaa

SEQ ID NO: 1180002 - RNA, 18 nt, Mycobacterium bovis subsp bovis AF2122/97
cggcguacucgugcaccg

SEQ ID NO: 1180003 - RNA, 22 nt, Mycobacterium bovis subsp bovis AF2122/97
cggcguacucgugcaccgucgg

SEQ ID NO: 1180004 - RNA, 23 nt, Mycobacterium bovis subsp bovis AF2122/97
cggcguacucgugcaccgucggg

SEQ ID NO: 1180005 - RNA, 19 nt, Mycobacterium bovis subsp bovis AF2122/97
cguacaacacgggcagcuu

SEQ ID NO: 1180006 - RNA, 14 nt, Mycobacterium bovis subsp bovis AF2122/97
cguaccggccuuca

SEQ ID NO: 1180007 - RNA, 16 nt, Mycobacterium bovis subsp bovis AF2122/97
cguacgcacgcagccc

SEQ ID NO: 1180008 - RNA, 14 nt, Mycobacterium bovis subsp bovis AF2122/97
cguacugaucuucg

SEQ ID NO: 1180009 - RNA, 15 nt, Mycobacterium bovis subsp bovis AF2122/97
cguacugcuugaugg

SEQ ID NO: 1180010 - RNA, 15 nt, Mycobacterium bovis subsp bovis AF2122/97
cguacugguagcacu

SEQ ID NO: 1180011 - RNA, 19 nt, Mycobacterium bovis subsp bovis AF2122/97
cguacuucgcuggaaaccu

SEQ ID NO: 1180012 - RNA, 15 nt, Mycobacterium bovis subsp bovis AF2122/97
cguacucgugcaccg

SEQ ID NO: 1180013 - RNA, 17 nt, Mycobacterium bovis subsp bovis AF2122/97
cguacgucggaucuucg

SEQ ID NO: 1180014 - RNA, 16 nt, Mycobacterium bovis subsp bovis AF2122/97
cguacguucaccaccg

SEQ ID NO: 1180015 - RNA, 15 nt, Mycobacterium bovis subsp bovis AF2122/97
cguagaucaucagcg

SEQ ID NO: 1180016 - RNA, 19 nt, Mycobacterium bovis subsp bovis AF2122/97
cguagagcaugccgcccgc

SEQ ID NO: 1180017 - RNA, 13 nt, Mycobacterium bovis subsp bovis AF2122/97
cguagauguugcc

SEQ ID NO: 1180018 - RNA, 23 nt, Mycobacterium bovis subsp bovis AF2122/97
cguagaugguggucaccaccauc

SEQ ID NO: 1180019 - RNA, 22 nt, Mycobacterium bovis subsp bovis AF2122/97
cguagaaccggggugaggcuuc

SEQ ID NO: 1180020 - RNA, 21 nt, Mycobacterium bovis subsp bovis AF2122/97
cguagaaucggcucagcaacg

SEQ ID NO: 1180021 - RNA, 14 nt, Mycobacterium bovis subsp bovis AF2122/97
cguacuugccaccc

SEQ ID NO: 1180022 - RNA, 13 nt, Mycobacterium bovis subsp bovis AF2122/97
cguagagcagcag

SEQ ID NO: 1180023 - RNA, 15 nt, Mycobacterium bovis subsp bovis AF2122/97
cguagaccuucuuga

SEQ ID NO: 1180024 - RNA, 19 nt, Mycobacterium bovis subsp bovis AF2122/97
cguagaccagcaggcccug

SEQ ID NO: 1180025 - RNA, 14 nt, Mycobacterium bovis subsp bovis AF2122/97
cguagacccacagu

SEQ ID NO: 1180026 - RNA, 17 nt, Mycobacterium bovis subsp bovis AF2122/97
cguagcaccacaucggu

SEQ ID NO: 1180027 - RNA, 16 nt, Mycobacterium bovis subsp bovis AF2122/97
cguagcaccggucccu

SEQ ID NO: 1180028 - RNA, 19 nt, Mycobacterium bovis subsp bovis AF2122/97
cguagccgaucaacagggc

SEQ ID NO: 1180029 - RNA, 21 nt, Mycobacterium bovis subsp bovis AF2122/97
cguagcugcgcagcgcaaaca

SEQ ID NO: 1180030 - RNA, 18 nt, Mycobacterium bovis subsp bovis AF2122/97
cguagcuggccagguugc

SEQ ID NO: 1180031 - RNA, 15 nt, Mycobacterium bovis subsp bovis AF2122/97
cguagcuggucccac

SEQ ID NO: 1180032 - RNA, 15 nt, Mycobacterium bovis subsp bovis AF2122/97
cguagccgccgucgc

SEQ ID NO: 1180033 - RNA, 16 nt, Mycobacterium bovis subsp bovis AF2122/97
cguaggcgauggcggc

SEQ ID NO: 1180034 - RNA, 17 nt, Mycobacterium bovis subsp bovis AF2122/97
cguaggcggcgacccgc

SEQ ID NO: 1180035 - RNA, 20 nt, Mycobacterium bovis subsp bovis AF2122/97
cguaggcguacaccagggug

SEQ ID NO: 1180036 - RNA, 12 nt, Mycobacterium bovis subsp bovis AF2122/97
cguaggcacccc

SEQ ID NO: 1180037 - RNA, 22 nt, Mycobacterium bovis subsp bovis AF2122/97
cguaggcgcuaggaacgccacc

SEQ ID NO: 1180038 - RNA, 21 nt, Mycobacterium bovis subsp bovis AF2122/97
cguagggauagcagugcagca

SEQ ID NO: 1180039 - RNA, 16 nt, Mycobacterium bovis subsp bovis AF2122/97
cguagguugcgccccg

SEQ ID NO: 1180040 - RNA, 12 nt, Mycobacterium bovis subsp bovis AF2122/97
cguagggugggu

SEQ ID NO: 1180041 - RNA, 20 nt, Mycobacterium bovis subsp bovis AF2122/97
cguaucacgguugccgcgau

SEQ ID NO: 1180042 - RNA, 14 nt, Mycobacterium bovis subsp bovis AF2122/97
cguauccacggucg

SEQ ID NO: 1180043 - RNA, 13 nt, Mycobacterium bovis subsp bovis AF2122/97
cguaucccagaua

SEQ ID NO: 1180044 - RNA, 19 nt, Mycobacterium bovis subsp bovis AF2122/97
cguagguggccggcuugca

SEQ ID NO: 1180045 - RNA, 23 nt, Mycobacterium bovis subsp bovis AF2122/97
cguagguggccggcuugcaguga

SEQ ID NO: 1180046 - RNA, 16 nt, Mycobacterium bovis subsp bovis AF2122/97
cguaguagcgaugcac

SEQ ID NO: 1180047 - RNA, 14 nt, Mycobacterium bovis subsp bovis AF2122/97
cguaguacagcgcg

SEQ ID NO: 1180048 - RNA, 17 nt, Mycobacterium bovis subsp bovis AF2122/97
cguaguaaugcucgacg

SEQ ID NO: 1180049 - RNA, 16 nt, Mycobacterium bovis subsp bovis AF2122/97
cguccgaucggcgcgc

SEQ ID NO: 1180050 - RNA, 20 nt, Mycobacterium bovis subsp bovis AF2122/97
cguccgaccgauaacacccg

SEQ ID NO: 1180051 - RNA, 15 nt, Mycobacterium bovis subsp bovis AF2122/97
cguccgccugcaccg

SEQ ID NO: 1180052 - RNA, 18 nt, Mycobacterium bovis subsp bovis AF2122/97
cguccgccugcaccgccg

SEQ ID NO: 1180053 - RNA, 15 nt, Mycobacterium bovis subsp bovis AF2122/97
cguccgcccagccgc

SEQ ID NO: 1180054 - RNA, 17 nt, Mycobacterium bovis subsp bovis AF2122/97
cguccgcccagccgcag

SEQ ID NO: 1180055 - RNA, 20 nt, Mycobacterium bovis subsp bovis AF2122/97
cguccgcccagccgcagcac

SEQ ID NO: 1180056 - RNA, 13 nt, Mycobacterium bovis subsp bovis AF2122/97
cgucccgcggcgc

SEQ ID NO: 1180057 - RNA, 18 nt, Mycobacterium bovis subsp bovis AF2122/97
cgucccgauacggccggc

SEQ ID NO: 1180058 - RNA, 19 nt, Mycobacterium bovis subsp bovis AF2122/97
cgucccgauacggccggcc

SEQ ID NO: 1180059 - RNA, 22 nt, Mycobacterium bovis subsp bovis AF2122/97
cgucccgauggcgguggggcug

SEQ ID NO: 1180060 - RNA, 12 nt, Mycobacterium bovis subsp bovis AF2122/97
cgucccgcccgg

SEQ ID NO: 1180061 - RNA, 17 nt, Mycobacterium bovis subsp bovis AF2122/97
cgucccgcccggaugcg

SEQ ID NO: 1180062 - RNA, 21 nt, Mycobacterium bovis subsp bovis AF2122/97
cgucccgguugacgccggucc

SEQ ID NO: 1180063 - RNA, 16 nt, Mycobacterium bovis subsp bovis AF2122/97
cgucccggucgccaaa

SEQ ID NO: 1180064 - RNA, 20 nt, Mycobacterium bovis subsp bovis AF2122/97
cgucccgcgagcagcccggc

SEQ ID NO: 1180065 - RNA, 22 nt, Mycobacterium bovis subsp bovis AF2122/97
cgucccgcgagcagcccggcga

SEQ ID NO: 1180066 - RNA, 22 nt, Mycobacterium bovis subsp bovis AF2122/97
cguccagcaggacggugaagca

SEQ ID NO: 1180067 - RNA, 23 nt, Mycobacterium bovis subsp bovis AF2122/97
cguccaauuggcgucgucggcgg

SEQ ID NO: 1180068 - RNA, 16 nt, Mycobacterium bovis subsp bovis AF2122/97
cguccaauagcugaca

SEQ ID NO: 1180069 - RNA, 23 nt, Mycobacterium bovis subsp bovis AF2122/97
cguccaccacaccugcggcugcu

SEQ ID NO: 1180070 - RNA, 12 nt, Mycobacterium bovis subsp bovis AF2122/97
cguccaccagcc

SEQ ID NO: 1180071 - RNA, 24 nt, Mycobacterium bovis subsp bovis AF2122/97
cguccaccgacguggccagcccgc

SEQ ID NO: 1180072 - RNA, 22 nt, Mycobacterium bovis subsp bovis AF2122/97
cguccacccacgaucagcagcg

SEQ ID NO: 1180073 - RNA, 19 nt, Mycobacterium bovis subsp bovis AF2122/97
cguccacgaccccggcggu

SEQ ID NO: 1180074 - RNA, 13 nt, Mycobacterium bovis subsp bovis AF2122/97
cguccacgcagag

SEQ ID NO: 1180075 - RNA, 18 nt, Mycobacterium bovis subsp bovis AF2122/97
cguccacgcagaggcggc

SEQ ID NO: 1180076 - RNA, 20 nt, Mycobacterium bovis subsp bovis AF2122/97
cguccaccgauacccccggc

SEQ ID NO: 1180077 - RNA, 20 nt, Mycobacterium bovis subsp bovis AF2122/97
cguccaccgccgacauggcg

SEQ ID NO: 1180078 - RNA, 14 nt, Mycobacterium bovis subsp bovis AF2122/97
cguccacgcugacc

SEQ ID NO: 1180079 - RNA, 20 nt, Mycobacterium bovis subsp bovis AF2122/97
cguccaagaacggaugccgg

SEQ ID NO: 1180080 - RNA, 13 nt, Mycobacterium bovis subsp bovis AF2122/97
cguccaagauguc

SEQ ID NO: 1180081 - RNA, 18 nt, Mycobacterium bovis subsp bovis AF2122/97
cguccaagccagcguugg

SEQ ID NO: 1180082 - RNA, 21 nt, Mycobacterium bovis subsp bovis AF2122/97
cguccaagccagcguuggcgg

SEQ ID NO: 1180083 - RNA, 23 nt, Mycobacterium bovis subsp bovis AF2122/97
cguccaaccaaggacgaacgcgc

SEQ ID NO: 1180084 - RNA, 18 nt, Mycobacterium bovis subsp bovis AF2122/97
cguccaacuacgccagcc

SEQ ID NO: 1180085 - RNA, 20 nt, Mycobacterium bovis subsp bovis AF2122/97
cguccaaaccuucaacaacg

SEQ ID NO: 1180086 - RNA, 20 nt, Mycobacterium bovis subsp bovis AF2122/97
cgucauggcccgaucgaccg

SEQ ID NO: 1180087 - RNA, 14 nt, Mycobacterium bovis subsp bovis AF2122/97
cgucaugcccaggu

SEQ ID NO: 1180088 - RNA, 23 nt, Mycobacterium bovis subsp bovis AF2122/97
cgucacuucccggauagacggcg

SEQ ID NO: 1180089 - RNA, 20 nt, Mycobacterium bovis subsp bovis AF2122/97
cgucagaccauccagguuga

SEQ ID NO: 1180090 - RNA, 16 nt, Mycobacterium bovis subsp bovis AF2122/97
cgucagauccggccgu

SEQ ID NO: 1180091 - RNA, 14 nt, Mycobacterium bovis subsp bovis AF2122/97
cgucagcaccaucc

SEQ ID NO: 1180092 - RNA, 15 nt, Mycobacterium bovis subsp bovis AF2122/97
cgucaggaaccaccc

SEQ ID NO: 1180093 - RNA, 20 nt, Mycobacterium bovis subsp bovis AF2122/97
cgucaggcacaacgcgacgc

SEQ ID NO: 1180094 - RNA, 17 nt, Mycobacterium bovis subsp bovis AF2122/97
cgucagcgggcagcagg

SEQ ID NO: 1180095 - RNA, 18 nt, Mycobacterium bovis subsp bovis AF2122/97
cgucagcgucucucgcag

SEQ ID NO: 1180096 - RNA, 15 nt, Mycobacterium bovis subsp bovis AF2122/97
cgucaggugcgcgac

SEQ ID NO: 1180097 - RNA, 19 nt, Mycobacterium bovis subsp bovis AF2122/97
cgucaggugcgcgaccagg

SEQ ID NO: 1180098 - RNA, 19 nt, Mycobacterium bovis subsp bovis AF2122/97
cgucagguggccaaugccu

SEQ ID NO: 1180099 - RNA, 20 nt, Mycobacterium bovis subsp bovis AF2122/97
cgucaucgcguagugauggc

SEQ ID NO: 1180100 - RNA, 23 nt, Mycobacterium bovis subsp bovis AF2122/97
cgucaccggguccggugaacccg

SEQ ID NO: 1180101 - RNA, 22 nt, Mycobacterium bovis subsp bovis AF2122/97
cgucaccgugggccugcccggc

SEQ ID NO: 1180102 - RNA, 19 nt, Mycobacterium bovis subsp bovis AF2122/97
cgucaccguuggccgcgcu

SEQ ID NO: 1180103 - RNA, 13 nt, Mycobacterium bovis subsp bovis AF2122/97
cgucaccgcgggu

SEQ ID NO: 1180104 - RNA, 20 nt, Mycobacterium bovis subsp bovis AF2122/97
cgucaccgaugcgccggacc

SEQ ID NO: 1180105 - RNA, 12 nt, Mycobacterium bovis subsp bovis AF2122/97
cgucacgcaacc

SEQ ID NO: 1180106 - RNA, 14 nt, Mycobacterium bovis subsp bovis AF2122/97
cgucacugccaccu

SEQ ID NO: 1180107 - RNA, 17 nt, Mycobacterium bovis subsp bovis AF2122/97
cgucaccucaccgaacg

SEQ ID NO: 1180108 - RNA, 16 nt, Mycobacterium bovis subsp bovis AF2122/97
cguauucggccgcgag

SEQ ID NO: 1180109 - RNA, 15 nt, Mycobacterium bovis subsp bovis AF2122/97
cguauugccaaagcc

SEQ ID NO: 1180110 - RNA, 15 nt, Mycobacterium bovis subsp bovis AF2122/97
cguauugcggccugu

SEQ ID NO: 1180111 - RNA, 15 nt, Mycobacterium bovis subsp bovis AF2122/97
cgucacccggggcuc

SEQ ID NO: 1180112 - RNA, 18 nt, Mycobacterium bovis subsp bovis AF2122/97
cgugccccgggcccaggu

SEQ ID NO: 1180113 - RNA, 19 nt, Mycobacterium bovis subsp bovis AF2122/97
cgugcccgccaccggcgcg

SEQ ID NO: 1180114 - RNA, 20 nt, Mycobacterium bovis subsp bovis AF2122/97
cgugcccguauaaccggcca

SEQ ID NO: 1180115 - RNA, 23 nt, Mycobacterium bovis subsp bovis AF2122/97
cgugccgagcuucagcgcgcugc

SEQ ID NO: 1180116 - RNA, 13 nt, Mycobacterium bovis subsp bovis AF2122/97
cgugccgaccagc

SEQ ID NO: 1180117 - RNA, 15 nt, Mycobacterium bovis subsp bovis AF2122/97
cgugccgaccagcau

SEQ ID NO: 1180118 - RNA, 14 nt, Mycobacterium bovis subsp bovis AF2122/97
cgugccgguccccc

SEQ ID NO: 1180119 - RNA, 19 nt, Mycobacterium bovis subsp bovis AF2122/97
cgugccgccgacaccaccg

SEQ ID NO: 1180120 - RNA, 13 nt, Mycobacterium bovis subsp bovis AF2122/97
cgugccgccgcag

SEQ ID NO: 1180121 - RNA, 17 nt, Mycobacterium bovis subsp bovis AF2122/97
cgugccgcaccgccugc

SEQ ID NO: 1180122 - RNA, 12 nt, Mycobacterium bovis subsp bovis AF2122/97
cgugccgcagcg

SEQ ID NO: 1180123 - RNA, 17 nt, Mycobacterium bovis subsp bovis AF2122/97
cgugccgcccggucggg

SEQ ID NO: 1180124 - RNA, 16 nt, Mycobacterium bovis subsp bovis AF2122/97
cgugccucucgggggc

SEQ ID NO: 1180125 - RNA, 21 nt, Mycobacterium bovis subsp bovis AF2122/97
cgugccgucggcgugcagcag

SEQ ID NO: 1180126 - RNA, 16 nt, Mycobacterium bovis subsp bovis AF2122/97
cgugcgaugcagcgcg

SEQ ID NO: 1180127 - RNA, 17 nt, Mycobacterium bovis subsp bovis AF2122/97
cgugcgaugcagcgcgc

SEQ ID NO: 1180128 - RNA, 15 nt, Mycobacterium bovis subsp bovis AF2122/97
cgugccuuccucgcc

SEQ ID NO: 1180129 - RNA, 17 nt, Mycobacterium bovis subsp bovis AF2122/97
cgugccuuccucgccgg

SEQ ID NO: 1180130 - RNA, 18 nt, Mycobacterium bovis subsp bovis AF2122/97
cgugccggggcugccgaa

SEQ ID NO: 1180131 - RNA, 17 nt, Mycobacterium bovis subsp bovis AF2122/97
cgugcgagggcacggcg

SEQ ID NO: 1180132 - RNA, 23 nt, Mycobacterium bovis subsp bovis AF2122/97
cgugcucgccguaagcaccagcc

SEQ ID NO: 1180133 - RNA, 13 nt, Mycobacterium bovis subsp bovis AF2122/97
cgugcuccugccc

SEQ ID NO: 1180134 - RNA, 19 nt, Mycobacterium bovis subsp bovis AF2122/97
cgugcaggaccagcaccgc

SEQ ID NO: 1180135 - RNA, 18 nt, Mycobacterium bovis subsp bovis AF2122/97
cgugcaggaccagcaccg

SEQ ID NO: 1180136 - RNA, 19 nt, Mycobacterium bovis subsp bovis AF2122/97
cgugcaucgcgauuccggc

SEQ ID NO: 1180137 - RNA, 23 nt, Mycobacterium bovis subsp bovis AF2122/97
cgugcagcggcgccgccaagggc

SEQ ID NO: 1180138 - RNA, 17 nt, Mycobacterium bovis subsp bovis AF2122/97
cgugaucggcgaaccca

SEQ ID NO: 1180139 - RNA, 15 nt, Mycobacterium bovis subsp bovis AF2122/97
cgugaucuggccgaa

SEQ ID NO: 1180140 - RNA, 23 nt, Mycobacterium bovis subsp bovis AF2122/97
cgugaugucaacgugucccaagc

SEQ ID NO: 1180141 - RNA, 18 nt, Mycobacterium bovis subsp bovis AF2122/97
cgucuugcguccauccgc

SEQ ID NO: 1180142 - RNA, 22 nt, Mycobacterium bovis subsp bovis AF2122/97
cgucuuggugcgcgucagccgc

SEQ ID NO: 1180143 - RNA, 21 nt, Mycobacterium bovis subsp bovis AF2122/97
cgucuugcaucagcggcgcca

SEQ ID NO: 1180144 - RNA, 20 nt, Mycobacterium bovis subsp bovis AF2122/97
cgugaacuguccgggugggc

SEQ ID NO: 1180145 - RNA, 14 nt, Mycobacterium bovis subsp bovis AF2122/97
cgugaaguggucgu

SEQ ID NO: 1180146 - RNA, 13 nt, Mycobacterium bovis subsp bovis AF2122/97
cgugagacgccgu

SEQ ID NO: 1180147 - RNA, 19 nt, Mycobacterium bovis subsp bovis AF2122/97
cgucugguuggcuggcggg

SEQ ID NO: 1180148 - RNA, 22 nt, Mycobacterium bovis subsp bovis AF2122/97
cgucuggucagccgcggcggca

SEQ ID NO: 1180149 - RNA, 15 nt, Mycobacterium bovis subsp bovis AF2122/97
cgucuucgccgccac

SEQ ID NO: 1180150 - RNA, 16 nt, Mycobacterium bovis subsp bovis AF2122/97
cgucucggugcagcag

SEQ ID NO: 1180151 - RNA, 14 nt, Mycobacterium bovis subsp bovis AF2122/97
cgucucggugguga

SEQ ID NO: 1180152 - RNA, 11 nt, Mycobacterium bovis subsp bovis AF2122/97
cgucugcucgg

SEQ ID NO: 1180153 - RNA, 16 nt, Mycobacterium bovis subsp bovis AF2122/97
cgucugcucgccgggc

SEQ ID NO: 1180154 - RNA, 15 nt, Mycobacterium bovis subsp bovis AF2122/97
cgucugcucgcgccg

SEQ ID NO: 1180155 - RNA, 21 nt, Mycobacterium bovis subsp bovis AF2122/97
cgucuggaguucgucaccguu

SEQ ID NO: 1180156 - RNA, 14 nt, Mycobacterium bovis subsp bovis AF2122/97
cgucucgcccccuc

SEQ ID NO: 1180157 - RNA, 18 nt, Mycobacterium bovis subsp bovis AF2122/97
cgucucgcccccucuagc

SEQ ID NO: 1180158 - RNA, 15 nt, Mycobacterium bovis subsp bovis AF2122/97
cgucucgccgcgcac

SEQ ID NO: 1180159 - RNA, 14 nt, Mycobacterium bovis subsp bovis AF2122/97
cgucucgcaccgcg

SEQ ID NO: 1180160 - RNA, 17 nt, Mycobacterium bovis subsp bovis AF2122/97
cgucucgaagcucagcu

SEQ ID NO: 1180161 - RNA, 21 nt, Mycobacterium bovis subsp bovis AF2122/97
cgucuccggcgccaccgccgc

SEQ ID NO: 1180162 - RNA, 20 nt, Mycobacterium bovis subsp bovis AF2122/97
cgucuccggcgccaccgccg

SEQ ID NO: 1180163 - RNA, 21 nt, Mycobacterium bovis subsp bovis AF2122/97
cgucuacgucguccagcacca

SEQ ID NO: 1180164 - RNA, 17 nt, Mycobacterium bovis subsp bovis AF2122/97
cgucuaucuggucgggu

SEQ ID NO: 1180165 - RNA, 14 nt, Mycobacterium bovis subsp bovis AF2122/97
cgucguugucgucg

SEQ ID NO: 1180166 - RNA, 13 nt, Mycobacterium bovis subsp bovis AF2122/97
cgucguugaggaa

SEQ ID NO: 1180167 - RNA, 20 nt, Mycobacterium bovis subsp bovis AF2122/97
cgucguucgagaccccgacg

SEQ ID NO: 1180168 - RNA, 16 nt, Mycobacterium bovis subsp bovis AF2122/97
cgucguucgcgggugc

SEQ ID NO: 1180169 - RNA, 14 nt, Mycobacterium bovis subsp bovis AF2122/97
cgucgugucgccgc

SEQ ID NO: 1180170 - RNA, 19 nt, Mycobacterium bovis subsp bovis AF2122/97
cgucgugcacgacgacauc

SEQ ID NO: 1180171 - RNA, 14 nt, Mycobacterium bovis subsp bovis AF2122/97
cgucgugcacggcg

SEQ ID NO: 1180172 - RNA, 17 nt, Mycobacterium bovis subsp bovis AF2122/97
cgucgugcacggcggcc

SEQ ID NO: 1180173 - RNA, 14 nt, Mycobacterium bovis subsp bovis AF2122/97
cgucgugaccggcg

SEQ ID NO: 1180174 - RNA, 15 nt, Mycobacterium bovis subsp bovis AF2122/97
cgucgucggcaggca

SEQ ID NO: 1180175 - RNA, 14 nt, Mycobacterium bovis subsp bovis AF2122/97
cgucgucgugcacg

SEQ ID NO: 1180176 - RNA, 15 nt, Mycobacterium bovis subsp bovis AF2122/97
cgucguggucggcga

SEQ ID NO: 1180177 - RNA, 19 nt, Mycobacterium bovis subsp bovis AF2122/97
cgucgugcacggcggccag

SEQ ID NO: 1180178 - RNA, 14 nt, Mycobacterium bovis subsp bovis AF2122/97
cgucguacucggcg

SEQ ID NO: 1180179 - RNA, 16 nt, Mycobacterium bovis subsp bovis AF2122/97
cgucguacaugggcag

SEQ ID NO: 1180180 - RNA, 20 nt, Mycobacterium bovis subsp bovis AF2122/97
cgucguaccguucgggccgu

SEQ ID NO: 1180181 - RNA, 14 nt, Mycobacterium bovis subsp bovis AF2122/97
cgucgucagccacc

SEQ ID NO: 1180182 - RNA, 18 nt, Mycobacterium bovis subsp bovis AF2122/97
cgucgucgaauccugccg

SEQ ID NO: 1180183 - RNA, 15 nt, Mycobacterium bovis subsp bovis AF2122/97
cgucgucccagcgcg

SEQ ID NO: 1180184 - RNA, 16 nt, Mycobacterium bovis subsp bovis AF2122/97
cgucgucccagggcug

SEQ ID NO: 1180185 - RNA, 17 nt, Mycobacterium bovis subsp bovis AF2122/97
cgucgucgauccagccc

SEQ ID NO: 1180186 - RNA, 22 nt, Mycobacterium bovis subsp bovis AF2122/97
cgucgucgagcaccacccgggc

SEQ ID NO: 1180187 - RNA, 17 nt, Mycobacterium bovis subsp bovis AF2122/97
cgucgucgccgucggug

SEQ ID NO: 1180188 - RNA, 13 nt, Mycobacterium bovis subsp bovis AF2122/97
cgucgucgguaau

SEQ ID NO: 1180189 - RNA, 14 nt, Mycobacterium bovis subsp bovis AF2122/97
cgucgucgcugaau

SEQ ID NO: 1180190 - RNA, 14 nt, Mycobacterium bovis subsp bovis AF2122/97
cgucgucgcggccg

SEQ ID NO: 1180191 - RNA, 13 nt, Mycobacterium bovis subsp bovis AF2122/97
cgucggcgcggcu

SEQ ID NO: 1180192 - RNA, 15 nt, Mycobacterium bovis subsp bovis AF2122/97
cgucggcgggcggca

SEQ ID NO: 1180193 - RNA, 19 nt, Mycobacterium bovis subsp bovis AF2122/97
cgucggcgcugacgacccu

SEQ ID NO: 1180194 - RNA, 21 nt, Mycobacterium bovis subsp bovis AF2122/97
cgucggcguggucgcgcggca

SEQ ID NO: 1180195 - RNA, 12 nt, Mycobacterium bovis subsp bovis AF2122/97
cgucgggcaccg

SEQ ID NO: 1180196 - RNA, 14 nt, Mycobacterium bovis subsp bovis AF2122/97
cgucgggcacaccg

SEQ ID NO: 1180197 - RNA, 21 nt, Mycobacterium bovis subsp bovis AF2122/97
cgucgggcacaccgacgccgc

SEQ ID NO: 1180198 - RNA, 22 nt, Mycobacterium bovis subsp bovis AF2122/97
cgucgggacggccaacagggcg

SEQ ID NO: 1180199 - RNA, 16 nt, Mycobacterium bovis subsp bovis AF2122/97
cgucgggaugcccgcu

SEQ ID NO: 1180200 - RNA, 14 nt, Mycobacterium bovis subsp bovis AF2122/97
cgucgggacgccgc

SEQ ID NO: 1180201 - RNA, 15 nt, Mycobacterium bovis subsp bovis AF2122/97
cgucggcugccgcgg

SEQ ID NO: 1180202 - RNA, 23 nt, Mycobacterium bovis subsp bovis AF2122/97
cgucggcugccgcaaacgcggcg

SEQ ID NO: 1180203 - RNA, 15 nt, Mycobacterium bovis subsp bovis AF2122/97
cgucggugccaccac

SEQ ID NO: 1180204 - RNA, 16 nt, Mycobacterium bovis subsp bovis AF2122/97
cgucggugccaccacg

SEQ ID NO: 1180205 - RNA, 22 nt, Mycobacterium bovis subsp bovis AF2122/97
cgucggugccgccgccggcgcc

SEQ ID NO: 1180206 - RNA, 18 nt, Mycobacterium bovis subsp bovis AF2122/97
cgucggugcgcgcggcga

SEQ ID NO: 1180207 - RNA, 21 nt, Mycobacterium bovis subsp bovis AF2122/97
cgucguacaccucgagcgcgg

SEQ ID NO: 1180208 - RNA, 23 nt, Mycobacterium bovis subsp bovis AF2122/97
cgucguacacgccaugguaugac

SEQ ID NO: 1180209 - RNA, 22 nt, Mycobacterium bovis subsp bovis AF2122/97
cgucggugggcgugacguagug

SEQ ID NO: 1180210 - RNA, 16 nt, Mycobacterium bovis subsp bovis AF2122/97
cgucgguugccacgcc

SEQ ID NO: 1180211 - RNA, 18 nt, Mycobacterium bovis subsp bovis AF2122/97
cgucgguugccacgccgc

SEQ ID NO: 1180212 - RNA, 21 nt, Mycobacterium bovis subsp bovis AF2122/97
cgucggguuccuccucggcag

SEQ ID NO: 1180213 - RNA, 19 nt, Mycobacterium bovis subsp bovis AF2122/97
cgucggggaguucgcgcag

SEQ ID NO: 1180214 - RNA, 14 nt, Mycobacterium bovis subsp bovis AF2122/97
cgucgggucgcgag

SEQ ID NO: 1180215 - RNA, 15 nt, Mycobacterium bovis subsp bovis AF2122/97
cgucgggucacccag

SEQ ID NO: 1180216 - RNA, 16 nt, Mycobacterium bovis subsp bovis AF2122/97
cgucggagccggccac

SEQ ID NO: 1180217 - RNA, 14 nt, Mycobacterium bovis subsp bovis AF2122/97
cgucggcagcagcg

SEQ ID NO: 1180218 - RNA, 17 nt, Mycobacterium bovis subsp bovis AF2122/97
cgucggcaccagcagcc

SEQ ID NO: 1180219 - RNA, 23 nt, Mycobacterium bovis subsp bovis AF2122/97
cgucggcaugggccggcgccgca

SEQ ID NO: 1180220 - RNA, 13 nt, Mycobacterium bovis subsp bovis AF2122/97
cgucggccaaaga

SEQ ID NO: 1180221 - RNA, 22 nt, Mycobacterium bovis subsp bovis AF2122/97
cgucggccaugguguucggcag

SEQ ID NO: 1180222 - RNA, 17 nt, Mycobacterium bovis subsp bovis AF2122/97
cgucggccagugcgcgc

SEQ ID NO: 1180223 - RNA, 12 nt, Mycobacterium bovis subsp bovis AF2122/97
cgucggccagga

SEQ ID NO: 1180224 - RNA, 15 nt, Mycobacterium bovis subsp bovis AF2122/97
cgucggccggcaccc

SEQ ID NO: 1180225 - RNA, 13 nt, Mycobacterium bovis subsp bovis AF2122/97
cgucggcccggug

SEQ ID NO: 1180226 - RNA, 13 nt, Mycobacterium bovis subsp bovis AF2122/97
cgucggcgagcag

SEQ ID NO: 1180227 - RNA, 17 nt, Mycobacterium bovis subsp bovis AF2122/97
cgucggcgccggcggcc

SEQ ID NO: 1180228 - RNA, 19 nt, Mycobacterium bovis subsp bovis AF2122/97
cgucgcgggauugcgcgcu

SEQ ID NO: 1180229 - RNA, 20 nt, Mycobacterium bovis subsp bovis AF2122/97
cgucgcggauugccgcgcgc

SEQ ID NO: 1180230 - RNA, 16 nt, Mycobacterium bovis subsp bovis AF2122/97
cgucgcggccagcagg

SEQ ID NO: 1180231 - RNA, 17 nt, Mycobacterium bovis subsp bovis AF2122/97
cgucgcggccggcggcc

SEQ ID NO: 1180232 - RNA, 20 nt, Mycobacterium bovis subsp bovis AF2122/97
cgucgcggccggcggccgcc

SEQ ID NO: 1180233 - RNA, 23 nt, Mycobacterium bovis subsp bovis AF2122/97
cgucgcguccgcgaucugcagcg

SEQ ID NO: 1180234 - RNA, 14 nt, Mycobacterium bovis subsp bovis AF2122/97
cgucgcgucgccag

SEQ ID NO: 1180235 - RNA, 21 nt, Mycobacterium bovis subsp bovis AF2122/97
cgucgcgucgccaggcccccu

SEQ ID NO: 1180236 - RNA, 22 nt, Mycobacterium bovis subsp bovis AF2122/97
cgucgcguggaguggugaucca

SEQ ID NO: 1180237 - RNA, 19 nt, Mycobacterium bovis subsp bovis AF2122/97
cgucgcguucuccggcacc

SEQ ID NO: 1180238 - RNA, 20 nt, Mycobacterium bovis subsp bovis AF2122/97
cgucgcguucuccggcaccg

SEQ ID NO: 1180239 - RNA, 18 nt, Mycobacterium bovis subsp bovis AF2122/97
cgucgcguugagcgcagc

SEQ ID NO: 1180240 - RNA, 18 nt, Mycobacterium bovis subsp bovis AF2122/97
cgucgcuagggugagccc

SEQ ID NO: 1180241 - RNA, 20 nt, Mycobacterium bovis subsp bovis AF2122/97
cgucgcuguaggccagcccg

SEQ ID NO: 1180242 - RNA, 22 nt, Mycobacterium bovis subsp bovis AF2122/97
cgucgcuggugggaucgcagcg

SEQ ID NO: 1180243 - RNA, 22 nt, Mycobacterium bovis subsp bovis AF2122/97
cgucgcugccccuugggcucga

SEQ ID NO: 1180244 - RNA, 14 nt, Mycobacterium bovis subsp bovis AF2122/97
cgucgcugacgccc

SEQ ID NO: 1180245 - RNA, 19 nt, Mycobacterium bovis subsp bovis AF2122/97
cgucgcugacgcccuccug

SEQ ID NO: 1180246 - RNA, 15 nt, Mycobacterium bovis subsp bovis AF2122/97
cgucggacagcuuuc

SEQ ID NO: 1180247 - RNA, 14 nt, Mycobacterium bovis subsp bovis AF2122/97
cgucggaccagcug

SEQ ID NO: 1180248 - RNA, 17 nt, Mycobacterium bovis subsp bovis AF2122/97
cgucggaauacaacagc

SEQ ID NO: 1180249 - RNA, 22 nt, Mycobacterium bovis subsp bovis AF2122/97
cgucgcuuggaucgucgcugug

SEQ ID NO: 1180250 - RNA, 12 nt, Mycobacterium bovis subsp bovis AF2122/97
cgucgccggcac

SEQ ID NO: 1180251 - RNA, 18 nt, Mycobacterium bovis subsp bovis AF2122/97
cgucgcgcucgacaaagc

SEQ ID NO: 1180252 - RNA, 19 nt, Mycobacterium bovis subsp bovis AF2122/97
cgucgcgcucgcaccacca

SEQ ID NO: 1180253 - RNA, 16 nt, Mycobacterium bovis subsp bovis AF2122/97
cgucgcggaguagccg

SEQ ID NO: 1180254 - RNA, 13 nt, Mycobacterium bovis subsp bovis AF2122/97
cgucgcggaucug

SEQ ID NO: 1180255 - RNA, 20 nt, Mycobacterium bovis subsp bovis AF2122/97
cgucgcggaguagccgcagc

SEQ ID NO: 1180256 - RNA, 22 nt, Mycobacterium bovis subsp bovis AF2122/97
cgucgcggaucagcccgcgcag

SEQ ID NO: 1180257 - RNA, 16 nt, Mycobacterium bovis subsp bovis AF2122/97
cgucgcgcugccggcc

SEQ ID NO: 1180258 - RNA, 22 nt, Mycobacterium bovis subsp bovis AF2122/97
cgucgcggaaucgcgacacgcg

SEQ ID NO: 1180259 - RNA, 14 nt, Mycobacterium bovis subsp bovis AF2122/97
cgucgccgcggcgg

SEQ ID NO: 1180260 - RNA, 16 nt, Mycobacterium bovis subsp bovis AF2122/97
cgucgccgcggcggca

SEQ ID NO: 1180261 - RNA, 19 nt, Mycobacterium bovis subsp bovis AF2122/97
cgucgccgcggcggcagcg

SEQ ID NO: 1180262 - RNA, 15 nt, Mycobacterium bovis subsp bovis AF2122/97
cgucgccggccccgc

SEQ ID NO: 1180263 - RNA, 19 nt, Mycobacterium bovis subsp bovis AF2122/97
cgucgccggccccgccggc

SEQ ID NO: 1180264 - RNA, 22 nt, Mycobacterium bovis subsp bovis AF2122/97
cgucgccgccguugccgccggc

SEQ ID NO: 1180265 - RNA, 13 nt, Mycobacterium bovis subsp bovis AF2122/97
cgucgccgcccgu

SEQ ID NO: 1180266 - RNA, 18 nt, Mycobacterium bovis subsp bovis AF2122/97
cgucgccgacccgggggc

SEQ ID NO: 1180267 - RNA, 13 nt, Mycobacterium bovis subsp bovis AF2122/97
cgucgccgccgcu

SEQ ID NO: 1180268 - RNA, 16 nt, Mycobacterium bovis subsp bovis AF2122/97
cgucgccgccggcgcc

SEQ ID NO: 1180269 - RNA, 22 nt, Mycobacterium bovis subsp bovis AF2122/97
cgucgccgcccuggccgccggc

SEQ ID NO: 1180270 - RNA, 18 nt, Mycobacterium bovis subsp bovis AF2122/97
cgucgccgccgggcagug

SEQ ID NO: 1180271 - RNA, 21 nt, Mycobacterium bovis subsp bovis AF2122/97
cgucgcccuuagggucgccgc

SEQ ID NO: 1180272 - RNA, 13 nt, Mycobacterium bovis subsp bovis AF2122/97
cgucgccaugcug

SEQ ID NO: 1180273 - RNA, 14 nt, Mycobacterium bovis subsp bovis AF2122/97
cgucgcccagcgug

SEQ ID NO: 1180274 - RNA, 15 nt, Mycobacterium bovis subsp bovis AF2122/97
cgucgcacgcgcgca

SEQ ID NO: 1180275 - RNA, 18 nt, Mycobacterium bovis subsp bovis AF2122/97
cguccgcgaucugcagcg

SEQ ID NO: 1180276 - RNA, 23 nt, Mycobacterium bovis subsp bovis AF2122/97
cgucgcauacgcccacuccagca

SEQ ID NO: 1180277 - RNA, 21 nt, Mycobacterium bovis subsp bovis AF2122/97
cgucgccaccgguaccgauca

SEQ ID NO: 1180278 - RNA, 17 nt, Mycobacterium bovis subsp bovis AF2122/97
cgucgccaagcccaggc

SEQ ID NO: 1180279 - RNA, 13 nt, Mycobacterium bovis subsp bovis AF2122/97
cuaaucagccagg

SEQ ID NO: 1180280 - RNA, 16 nt, Mycobacterium bovis subsp bovis AF2122/97
cuaauucggggccgcg

SEQ ID NO: 1180281 - RNA, 19 nt, Mycobacterium bovis subsp bovis AF2122/97
cuaagcauucagcgcgccg

SEQ ID NO: 1180282 - RNA, 15 nt, Mycobacterium bovis subsp bovis AF2122/97
cuaacuggcccggac

SEQ ID NO: 1180283 - RNA, 16 nt, Mycobacterium bovis subsp bovis AF2122/97
cuaacggcagccaccg

SEQ ID NO: 1180284 - RNA, 19 nt, Mycobacterium bovis subsp bovis AF2122/97
cuaacggcagccaccguca

SEQ ID NO: 1180285 - RNA, 23 nt, Mycobacterium bovis subsp bovis AF2122/97
cuaaccgcuuggugugauacaac

SEQ ID NO: 1180286 - RNA, 20 nt, Mycobacterium bovis subsp bovis AF2122/97
cuaacaacaccaccagcacg

SEQ ID NO: 1180287 - RNA, 17 nt, Mycobacterium bovis subsp bovis AF2122/97
cuaacaccgcaggcaca

SEQ ID NO: 1180288 - RNA, 13 nt, Mycobacterium bovis subsp bovis AF2122/97
cuaacccugcccu

SEQ ID NO: 1180289 - RNA, 23 nt, Mycobacterium bovis subsp bovis AF2122/97
cguucggcgcccgcucggccgca

SEQ ID NO: 1180290 - RNA, 18 nt, Mycobacterium bovis subsp bovis AF2122/97
cguucgagagccccgacc

SEQ ID NO: 1180291 - RNA, 21 nt, Mycobacterium bovis subsp bovis AF2122/97
cguucgagagccccgaccagc

SEQ ID NO: 1180292 - RNA, 20 nt, Mycobacterium bovis subsp bovis AF2122/97
cguucggggccccgcggcgc

SEQ ID NO: 1180293 - RNA, 13 nt, Mycobacterium bovis subsp bovis AF2122/97
cguuccgccgccu

SEQ ID NO: 1180294 - RNA, 15 nt, Mycobacterium bovis subsp bovis AF2122/97
cguuccgccgccucg

SEQ ID NO: 1180295 - RNA, 16 nt, Mycobacterium bovis subsp bovis AF2122/97
cguuccguugugcgcc

SEQ ID NO: 1180296 - RNA, 18 nt, Mycobacterium bovis subsp bovis AF2122/97
cguucgaaggccacccgc

SEQ ID NO: 1180297 - RNA, 17 nt, Mycobacterium bovis subsp bovis AF2122/97
cguugaugaccgccgcc

SEQ ID NO: 1180298 - RNA, 22 nt, Mycobacterium bovis subsp bovis AF2122/97
cguugaucaagaaggccagcgc

SEQ ID NO: 1180299 - RNA, 20 nt, Mycobacterium bovis subsp bovis AF2122/97
cguugaucacauucagcacg

SEQ ID NO: 1180300 - RNA, 11 nt, Mycobacterium bovis subsp bovis AF2122/97
cguugaggccg

SEQ ID NO: 1180301 - RNA, 20 nt, Mycobacterium bovis subsp bovis AF2122/97
cguugagguucuucugcgcc

SEQ ID NO: 1180302 - RNA, 14 nt, Mycobacterium bovis subsp bovis AF2122/97
cguugagugggagc

SEQ ID NO: 1180303 - RNA, 18 nt, Mycobacterium bovis subsp bovis AF2122/97
cguucgucguaguccagg

SEQ ID NO: 1180304 - RNA, 23 nt, Mycobacterium bovis subsp bovis AF2122/97
cguucacgccagucccacugggc

SEQ ID NO: 1180305 - RNA, 18 nt, Mycobacterium bovis subsp bovis AF2122/97
cguucaacgacggcaagc

SEQ ID NO: 1180306 - RNA, 21 nt, Mycobacterium bovis subsp bovis AF2122/97
cguucagguguugacgccaac

SEQ ID NO: 1180307 - RNA, 22 nt, Mycobacterium bovis subsp bovis AF2122/97
cguucccgccauugccgccguc

SEQ ID NO: 1180308 - RNA, 13 nt, Mycobacterium bovis subsp bovis AF2122/97
cguucccgccggc

SEQ ID NO: 1180309 - RNA, 15 nt, Mycobacterium bovis subsp bovis AF2122/97
cguucccgccggcuc

SEQ ID NO: 1180310 - RNA, 16 nt, Mycobacterium bovis subsp bovis AF2122/97
cguucaugcggcggcg

SEQ ID NO: 1180311 - RNA, 13 nt, Mycobacterium bovis subsp bovis AF2122/97
cguggcagugcag

SEQ ID NO: 1180312 - RNA, 15 nt, Mycobacterium bovis subsp bovis AF2122/97
cguggcauccagcag

SEQ ID NO: 1180313 - RNA, 20 nt, Mycobacterium bovis subsp bovis AF2122/97
cguggcacugacgcgcccga

SEQ ID NO: 1180314 - RNA, 19 nt, Mycobacterium bovis subsp bovis AF2122/97
cguggccacggcauucgac

SEQ ID NO: 1180315 - RNA, 19 nt, Mycobacterium bovis subsp bovis AF2122/97
cguggccaauccggcggcg

SEQ ID NO: 1180316 - RNA, 22 nt, Mycobacterium bovis subsp bovis AF2122/97
cguggccaauccggcggcgacg

SEQ ID NO: 1180317 - RNA, 19 nt, Mycobacterium bovis subsp bovis AF2122/97
cgugcugcccgcaacacug

SEQ ID NO: 1180318 - RNA, 17 nt, Mycobacterium bovis subsp bovis AF2122/97
cguggaucuuggccagc

SEQ ID NO: 1180319 - RNA, 21 nt, Mycobacterium bovis subsp bovis AF2122/97
cguuaaucaaggugaucagca

SEQ ID NO: 1180320 - RNA, 20 nt, Mycobacterium bovis subsp bovis AF2122/97
cguuaccaccgucaccgccg

SEQ ID NO: 1180321 - RNA, 21 nt, Mycobacterium bovis subsp bovis AF2122/97
cguuagcauugaguucggcca

SEQ ID NO: 1180322 - RNA, 15 nt, Mycobacterium bovis subsp bovis AF2122/97
cguuagggccgccau

SEQ ID NO: 1180323 - RNA, 14 nt, Mycobacterium bovis subsp bovis AF2122/97
cguuaggucacucc

SEQ ID NO: 1180324 - RNA, 19 nt, Mycobacterium bovis subsp bovis AF2122/97
cguuaccgccggcgccggu

SEQ ID NO: 1180325 - RNA, 21 nt, Mycobacterium bovis subsp bovis AF2122/97
cguugcagaccaccagugagg

SEQ ID NO: 1180326 - RNA, 21 nt, Mycobacterium bovis subsp bovis AF2122/97
cguugcaggacgcccacaugc

SEQ ID NO: 1180327 - RNA, 12 nt, Mycobacterium bovis subsp bovis AF2122/97
cguugccaccgg

SEQ ID NO: 1180328 - RNA, 12 nt, Mycobacterium bovis subsp bovis AF2122/97
cguugccaccgu

SEQ ID NO: 1180329 - RNA, 11 nt, Mycobacterium bovis subsp bovis AF2122/97
cguugcaggug

SEQ ID NO: 1180330 - RNA, 20 nt, Mycobacterium bovis subsp bovis AF2122/97
cguugcaggugaacaacagc

SEQ ID NO: 1180331 - RNA, 16 nt, Mycobacterium bovis subsp bovis AF2122/97
cguugccagggcgggc

SEQ ID NO: 1180332 - RNA, 20 nt, Mycobacterium bovis subsp bovis AF2122/97
cguugccaacaacaucagcg

SEQ ID NO: 1180333 - RNA, 17 nt, Mycobacterium bovis subsp bovis AF2122/97
cguuguagacggcggca

SEQ ID NO: 1180334 - RNA, 16 nt, Mycobacterium bovis subsp bovis AF2122/97
cguugcccccauugcc

SEQ ID NO: 1180335 - RNA, 16 nt, Mycobacterium bovis subsp bovis AF2122/97
cguugucggcuggacg

SEQ ID NO: 1180336 - RNA, 18 nt, Mycobacterium bovis subsp bovis AF2122/97
cguugugcccgccggccc

SEQ ID NO: 1180337 - RNA, 17 nt, Mycobacterium bovis subsp bovis AF2122/97
cguuguggcguguggcu

SEQ ID NO: 1180338 - RNA, 21 nt, Mycobacterium bovis subsp bovis AF2122/97
cguugugcgccuugaccacag

SEQ ID NO: 1180339 - RNA, 13 nt, Mycobacterium bovis subsp bovis AF2122/97
cguuguccaccgc

SEQ ID NO: 1180340 - RNA, 19 nt, Mycobacterium bovis subsp bovis AF2122/97
cguuguaugcugcgcgccg

SEQ ID NO: 1180341 - RNA, 14 nt, Mycobacterium bovis subsp bovis AF2122/97
cguuguaggagaac

SEQ ID NO: 1180342 - RNA, 16 nt, Mycobacterium bovis subsp bovis AF2122/97
cguuguaggcuuccag

SEQ ID NO: 1180343 - RNA, 20 nt, Mycobacterium bovis subsp bovis AF2122/97
cguuguaguugcccacguug

SEQ ID NO: 1180344 - RNA, 18 nt, Mycobacterium bovis subsp bovis AF2122/97
cguugugugccagcgugg

SEQ ID NO: 1180345 - RNA, 17 nt, Mycobacterium bovis subsp bovis AF2122/97
cguuguugaccaccacg

SEQ ID NO: 1180346 - RNA, 13 nt, Mycobacterium bovis subsp bovis AF2122/97
cguuguugaggau

SEQ ID NO: 1180347 - RNA, 19 nt, Mycobacterium bovis subsp bovis AF2122/97
cguuguuggauccggccac

SEQ ID NO: 1180348 - RNA, 18 nt, Mycobacterium bovis subsp bovis AF2122/97
cguuucgcgaugugcgcc

SEQ ID NO: 1180349 - RNA, 14 nt, Mycobacterium bovis subsp bovis AF2122/97
cguuucgcagccgc

SEQ ID NO: 1180350 - RNA, 15 nt, Mycobacterium bovis subsp bovis AF2122/97
cguuucgccagccgg

SEQ ID NO: 1180351 - RNA, 20 nt, Mycobacterium bovis subsp bovis AF2122/97
cguuuccgccgccgccgcca

SEQ ID NO: 1180352 - RNA, 15 nt, Mycobacterium bovis subsp bovis AF2122/97
cguuuggcugccgaa

SEQ ID NO: 1180353 - RNA, 18 nt, Mycobacterium bovis subsp bovis AF2122/97
cguuuggugugauacagc

SEQ ID NO: 1180354 - RNA, 15 nt, Mycobacterium bovis subsp bovis AF2122/97
cuaaacaggccgcca

SEQ ID NO: 1180355 - RNA, 14 nt, Mycobacterium bovis subsp bovis AF2122/97
cguuuuccagccga

SEQ ID NO: 1180356 - RNA, 16 nt, Mycobacterium bovis subsp bovis AF2122/97
cguuuucgccgauccc

SEQ ID NO: 1180357 - RNA, 17 nt, Mycobacterium bovis subsp bovis AF2122/97
cguuuuccugaucgcgc

SEQ ID NO: 1180358 - RNA, 15 nt, Mycobacterium bovis subsp bovis AF2122/97
cguuuugcggcccgg

SEQ ID NO: 1180359 - RNA, 19 nt, Mycobacterium bovis subsp bovis AF2122/97
cuccaccaacucgacgugc

SEQ ID NO: 1180360 - RNA, 14 nt, Mycobacterium bovis subsp bovis AF2122/97
cuccaccaccgacg

SEQ ID NO: 1180361 - RNA, 18 nt, Mycobacterium bovis subsp bovis AF2122/97
cuccaccaccgucgagcc

SEQ ID NO: 1180362 - RNA, 16 nt, Mycobacterium bovis subsp bovis AF2122/97
cuccaagcucgacaac

SEQ ID NO: 1180363 - RNA, 13 nt, Mycobacterium bovis subsp bovis AF2122/97
cuccaaguagcac

SEQ ID NO: 1180364 - RNA, 13 nt, Mycobacterium bovis subsp bovis AF2122/97
cuccaccgcuggc

SEQ ID NO: 1180365 - RNA, 19 nt, Mycobacterium bovis subsp bovis AF2122/97
cuccaccgcguccaggugc

SEQ ID NO: 1180366 - RNA, 13 nt, Mycobacterium bovis subsp bovis AF2122/97
cuccaccgcgccg

SEQ ID NO: 1180367 - RNA, 16 nt, Mycobacterium bovis subsp bovis AF2122/97
cuccaccgggcccgcc

SEQ ID NO: 1180368 - RNA, 22 nt, Mycobacterium bovis subsp bovis AF2122/97
cuccaccagugccccgccgagc

SEQ ID NO: 1180369 - RNA, 15 nt, Mycobacterium bovis subsp bovis AF2122/97
cuccaccccacccag

SEQ ID NO: 1180370 - RNA, 14 nt, Mycobacterium bovis subsp bovis AF2122/97
cuccacccuugccg

SEQ ID NO: 1180371 - RNA, 13 nt, Mycobacterium bovis subsp bovis AF2122/97
cuccaccuucugg

SEQ ID NO: 1180372 - RNA, 20 nt, Mycobacterium bovis subsp bovis AF2122/97
cuccacgaucggcccagccc

SEQ ID NO: 1180373 - RNA, 23 nt, Mycobacterium bovis subsp bovis AF2122/97
cuccagcacccgcugcacgccgu

SEQ ID NO: 1180374 - RNA, 15 nt, Mycobacterium bovis subsp bovis AF2122/97
cuccagcagcucgcc

SEQ ID NO: 1180375 - RNA, 20 nt, Mycobacterium bovis subsp bovis AF2122/97
cuccagcagcucgccggcac

SEQ ID NO: 1180376 - RNA, 14 nt, Mycobacterium bovis subsp bovis AF2122/97
cuccagcaccaccg

SEQ ID NO: 1180377 - RNA, 15 nt, Mycobacterium bovis subsp bovis AF2122/97
cuccagcaccagcac

SEQ ID NO: 1180378 - RNA, 24 nt, Mycobacterium bovis subsp bovis AF2122/97
cuccagcaaaacccgcuccacccc

SEQ ID NO: 1180379 - RNA, 16 nt, Mycobacterium bovis subsp bovis AF2122/97
cuccagauccacgccg

SEQ ID NO: 1180380 - RNA, 23 nt, Mycobacterium bovis subsp bovis AF2122/97
cuccagagacagcgccaugcccu

SEQ ID NO: 1180381 - RNA, 15 nt, Mycobacterium bovis subsp bovis AF2122/97
cuccagauccacgcc

SEQ ID NO: 1180382 - RNA, 14 nt, Mycobacterium bovis subsp bovis AF2122/97
cuccagacguucca

SEQ ID NO: 1180383 - RNA, 16 nt, Mycobacterium bovis subsp bovis AF2122/97
cuccacuuggggcgcc

SEQ ID NO: 1180384 - RNA, 17 nt, Mycobacterium bovis subsp bovis AF2122/97
cuccacuuggggcgcca

SEQ ID NO: 1180385 - RNA, 23 nt, Mycobacterium bovis subsp bovis AF2122/97
cuccacuuggggcgccagggucg

SEQ ID NO: 1180386 - RNA, 20 nt, Mycobacterium bovis subsp bovis AF2122/97
cuccaaaagccucagccgcu

SEQ ID NO: 1180387 - RNA, 22 nt, Mycobacterium bovis subsp bovis AF2122/97
cuccaagccgggugggagcagc

SEQ ID NO: 1180388 - RNA, 13 nt, Mycobacterium bovis subsp bovis AF2122/97
cuccaagcaauuc

SEQ ID NO: 1180389 - RNA, 21 nt, Mycobacterium bovis subsp bovis AF2122/97
cuccagcaggucgccugcccc

SEQ ID NO: 1180390 - RNA, 16 nt, Mycobacterium bovis subsp bovis AF2122/97
cuccauggcauugcuc

SEQ ID NO: 1180391 - RNA, 15 nt, Mycobacterium bovis subsp bovis AF2122/97
cuccagcgcacuacu

SEQ ID NO: 1180392 - RNA, 21 nt, Mycobacterium bovis subsp bovis AF2122/97
cucccaaaugucguaggccgc

SEQ ID NO: 1180393 - RNA, 18 nt, Mycobacterium bovis subsp bovis AF2122/97
cucccagggcucggcggc

SEQ ID NO: 1180394 - RNA, 13 nt, Mycobacterium bovis subsp bovis AF2122/97
cucccagugagca

SEQ ID NO: 1180395 - RNA, 18 nt, Mycobacterium bovis subsp bovis AF2122/97
cuccccggauuccucguc

SEQ ID NO: 1180396 - RNA, 13 nt, Mycobacterium bovis subsp bovis AF2122/97
cuccccgccggaa

SEQ ID NO: 1180397 - RNA, 13 nt, Mycobacterium bovis subsp bovis AF2122/97
cuccccgccgggc

SEQ ID NO: 1180398 - RNA, 19 nt, Mycobacterium bovis subsp bovis AF2122/97
cuccccgaucugcuccucg

SEQ ID NO: 1180399 - RNA, 18 nt, Mycobacterium bovis subsp bovis AF2122/97
cucccccggcuccgcaac

SEQ ID NO: 1180400 - RNA, 17 nt, Mycobacterium bovis subsp bovis AF2122/97
cuccccgaucagcaccg

SEQ ID NO: 1180401 - RNA, 21 nt, Mycobacterium bovis subsp bovis AF2122/97
cuccccgaccgaaccgucagc

SEQ ID NO: 1180402 - RNA, 12 nt, Mycobacterium bovis subsp bovis AF2122/97
cuccccagcccc

SEQ ID NO: 1180403 - RNA, 14 nt, Mycobacterium bovis subsp bovis AF2122/97
cucccggccgcacc

SEQ ID NO: 1180404 - RNA, 15 nt, Mycobacterium bovis subsp bovis AF2122/97
cuccccguccugcca

SEQ ID NO: 1180405 - RNA, 15 nt, Mycobacterium bovis subsp bovis AF2122/97
cucccgucucgacag

SEQ ID NO: 1180406 - RNA, 19 nt, Mycobacterium bovis subsp bovis AF2122/97
cucccgggcggcggccugg

SEQ ID NO: 1180407 - RNA, 14 nt, Mycobacterium bovis subsp bovis AF2122/97
cucccgggccgccg

SEQ ID NO: 1180408 - RNA, 18 nt, Mycobacterium bovis subsp bovis AF2122/97
cucccgggcgagccgugc

SEQ ID NO: 1180409 - RNA, 22 nt, Mycobacterium bovis subsp bovis AF2122/97
cucccggggguuccacucccca

SEQ ID NO: 1180410 - RNA, 13 nt, Mycobacterium bovis subsp bovis AF2122/97
cucccgugcuggc

SEQ ID NO: 1180411 - RNA, 20 nt, Mycobacterium bovis subsp bovis AF2122/97
cuccgagcacaggaucaccc

SEQ ID NO: 1180412 - RNA, 16 nt, Mycobacterium bovis subsp bovis AF2122/97
cuccgaaguccacgca

SEQ ID NO: 1180413 - RNA, 21 nt, Mycobacterium bovis subsp bovis AF2122/97
cuccgaaguccacgcaccacg

SEQ ID NO: 1180414 - RNA, 21 nt, Mycobacterium bovis subsp bovis AF2122/97
cuccgcggcucaaucuccucc

SEQ ID NO: 1180415 - RNA, 22 nt, Mycobacterium bovis subsp bovis AF2122/97
cuccgcgggguugauugacccg

SEQ ID NO: 1180416 - RNA, 21 nt, Mycobacterium bovis subsp bovis AF2122/97
cuccgcguagaguguccccgg

SEQ ID NO: 1180417 - RNA, 20 nt, Mycobacterium bovis subsp bovis AF2122/97
cuccgcguccaaggcgcgcu

SEQ ID NO: 1180418 - RNA, 15 nt, Mycobacterium bovis subsp bovis AF2122/97
cuccgcguugggcac

SEQ ID NO: 1180419 - RNA, 14 nt, Mycobacterium bovis subsp bovis AF2122/97
cuccgggacgguga

SEQ ID NO: 1180420 - RNA, 17 nt, Mycobacterium bovis subsp bovis AF2122/97
cuccggcgucggcggcc

SEQ ID NO: 1180421 - RNA, 16 nt, Mycobacterium bovis subsp bovis AF2122/97
cuccggaaagcucucg

SEQ ID NO: 1180422 - RNA, 22 nt, Mycobacterium bovis subsp bovis AF2122/97
cuccggaaagcucucggcaccc

SEQ ID NO: 1180423 - RNA, 22 nt, Mycobacterium bovis subsp bovis AF2122/97
cuccggaaccacucgcucagga

SEQ ID NO: 1180424 - RNA, 13 nt, Mycobacterium bovis subsp bovis AF2122/97
cuccggacgcacg

SEQ ID NO: 1180425 - RNA, 19 nt, Mycobacterium bovis subsp bovis AF2122/97
cuccgcugaugagccgcag

SEQ ID NO: 1180426 - RNA, 16 nt, Mycobacterium bovis subsp bovis AF2122/97
cuccgcugccgcccgc

SEQ ID NO: 1180427 - RNA, 14 nt, Mycobacterium bovis subsp bovis AF2122/97
cuccggugcgcagc

SEQ ID NO: 1180428 - RNA, 23 nt, Mycobacterium bovis subsp bovis AF2122/97
cuccguaacgccaagcucggccc

SEQ ID NO: 1180429 - RNA, 23 nt, Mycobacterium bovis subsp bovis AF2122/97
cuccggucaacacccgcccgggc

SEQ ID NO: 1180430 - RNA, 14 nt, Mycobacterium bovis subsp bovis AF2122/97
cuccgucguaguug

SEQ ID NO: 1180431 - RNA, 19 nt, Mycobacterium bovis subsp bovis AF2122/97
cucgcgcaggucgccuucu

SEQ ID NO: 1180432 - RNA, 13 nt, Mycobacterium bovis subsp bovis AF2122/97
cucgcgcucgccg

SEQ ID NO: 1180433 - RNA, 18 nt, Mycobacterium bovis subsp bovis AF2122/97
cucgcgcaaggcgccgca

SEQ ID NO: 1180434 - RNA, 19 nt, Mycobacterium bovis subsp bovis AF2122/97
cucgcgcaaggcgccgcag

SEQ ID NO: 1180435 - RNA, 16 nt, Mycobacterium bovis subsp bovis AF2122/97
cucgcgacaucaccga

SEQ ID NO: 1180436 - RNA, 15 nt, Mycobacterium bovis subsp bovis AF2122/97
cucgccggccgucag

SEQ ID NO: 1180437 - RNA, 15 nt, Mycobacterium bovis subsp bovis AF2122/97
cucgccggcgcgcac

SEQ ID NO: 1180438 - RNA, 16 nt, Mycobacterium bovis subsp bovis AF2122/97
cucgccggcgcgcagc

SEQ ID NO: 1180439 - RNA, 22 nt, Mycobacterium bovis subsp bovis AF2122/97
cucgccggcgcgcagccgggcc

SEQ ID NO: 1180440 - RNA, 13 nt, Mycobacterium bovis subsp bovis AF2122/97
cucgccgggcagc

SEQ ID NO: 1180441 - RNA, 15 nt, Mycobacterium bovis subsp bovis AF2122/97
cucgccgggcagcua

SEQ ID NO: 1180442 - RNA, 14 nt, Mycobacterium bovis subsp bovis AF2122/97
cucgccggccacca

SEQ ID NO: 1180443 - RNA, 21 nt, Mycobacterium bovis subsp bovis AF2122/97
cucgccguacaucagcgcgaa

SEQ ID NO: 1180444 - RNA, 21 nt, Mycobacterium bovis subsp bovis AF2122/97
cucgccgucauagcaggccuc

SEQ ID NO: 1180445 - RNA, 16 nt, Mycobacterium bovis subsp bovis AF2122/97
cucgccugcacccggc

SEQ ID NO: 1180446 - RNA, 15 nt, Mycobacterium bovis subsp bovis AF2122/97
cucgccugcacgccc

SEQ ID NO: 1180447 - RNA, 22 nt, Mycobacterium bovis subsp bovis AF2122/97
cucgccggacgggugcagcgca

SEQ ID NO: 1180448 - RNA, 16 nt, Mycobacterium bovis subsp bovis AF2122/97
cucgccggaucuugcc

SEQ ID NO: 1180449 - RNA, 17 nt, Mycobacterium bovis subsp bovis AF2122/97
cucgccggaucuugccg

SEQ ID NO: 1180450 - RNA, 16 nt, Mycobacterium bovis subsp bovis AF2122/97
cucgccggcacgcagc

SEQ ID NO: 1180451 - RNA, 16 nt, Mycobacterium bovis subsp bovis AF2122/97
cucgccgcacgccggc

SEQ ID NO: 1180452 - RNA, 17 nt, Mycobacterium bovis subsp bovis AF2122/97
cucgccgcgcaccgacc

SEQ ID NO: 1180453 - RNA, 19 nt, Mycobacterium bovis subsp bovis AF2122/97
cucgccgaaaucggccagc

SEQ ID NO: 1180454 - RNA, 15 nt, Mycobacterium bovis subsp bovis AF2122/97
cucgcccgccgccac

SEQ ID NO: 1180455 - RNA, 14 nt, Mycobacterium bovis subsp bovis AF2122/97
cucgccgagcugug

SEQ ID NO: 1180456 - RNA, 21 nt, Mycobacterium bovis subsp bovis AF2122/97
cucgccgaggccuaccaggcg

SEQ ID NO: 1180457 - RNA, 19 nt, Mycobacterium bovis subsp bovis AF2122/97
cucgccaggcaagccagca

SEQ ID NO: 1180458 - RNA, 20 nt, Mycobacterium bovis subsp bovis AF2122/97
cucgcccaccuccugguuga

SEQ ID NO: 1180459 - RNA, 15 nt, Mycobacterium bovis subsp bovis AF2122/97
cucgcccacccgcug

SEQ ID NO: 1180460 - RNA, 16 nt, Mycobacterium bovis subsp bovis AF2122/97
cuccuccccggcccgc

SEQ ID NO: 1180461 - RNA, 17 nt, Mycobacterium bovis subsp bovis AF2122/97
cuccuccgacagggccu

SEQ ID NO: 1180462 - RNA, 18 nt, Mycobacterium bovis subsp bovis AF2122/97
cuccuccggaaagcucuc

SEQ ID NO: 1180463 - RNA, 15 nt, Mycobacterium bovis subsp bovis AF2122/97
cuccuccggcaccaa

SEQ ID NO: 1180464 - RNA, 16 nt, Mycobacterium bovis subsp bovis AF2122/97
cuccuccaccagugcc

SEQ ID NO: 1180465 - RNA, 20 nt, Mycobacterium bovis subsp bovis AF2122/97
cuccuccagagacagcgcca

SEQ ID NO: 1180466 - RNA, 15 nt, Mycobacterium bovis subsp bovis AF2122/97
cuccucagccaccgc

SEQ ID NO: 1180467 - RNA, 19 nt, Mycobacterium bovis subsp bovis AF2122/97
cucgaacagguuggccccg

SEQ ID NO: 1180468 - RNA, 16 nt, Mycobacterium bovis subsp bovis AF2122/97
cucgaccgucaccgga

SEQ ID NO: 1180469 - RNA, 22 nt, Mycobacterium bovis subsp bovis AF2122/97
cucgaccgcgagcaugaugucc

SEQ ID NO: 1180470 - RNA, 15 nt, Mycobacterium bovis subsp bovis AF2122/97
cucgaccgccagccg

SEQ ID NO: 1180471 - RNA, 16 nt, Mycobacterium bovis subsp bovis AF2122/97
cucgaccgccagccgc

SEQ ID NO: 1180472 - RNA, 13 nt, Mycobacterium bovis subsp bovis AF2122/97
cucgaagugcagg

SEQ ID NO: 1180473 - RNA, 15 nt, Mycobacterium bovis subsp bovis AF2122/97
cucgaccgauagcug

SEQ ID NO: 1180474 - RNA, 18 nt, Mycobacterium bovis subsp bovis AF2122/97
cucgaccgacugcccgau

SEQ ID NO: 1180475 - RNA, 19 nt, Mycobacterium bovis subsp bovis AF2122/97
cucgaacugggucggcacg

SEQ ID NO: 1180476 - RNA, 14 nt, Mycobacterium bovis subsp bovis AF2122/97
cucgaaggccgcca

SEQ ID NO: 1180477 - RNA, 20 nt, Mycobacterium bovis subsp bovis AF2122/97
cucgcagcuccucgcccaga

SEQ ID NO: 1180478 - RNA, 14 nt, Mycobacterium bovis subsp bovis AF2122/97
cucgcaccaccacg

SEQ ID NO: 1180479 - RNA, 16 nt, Mycobacterium bovis subsp bovis AF2122/97
cucgacgaucagcacg

SEQ ID NO: 1180480 - RNA, 18 nt, Mycobacterium bovis subsp bovis AF2122/97
cucgacgaucugcagcac

SEQ ID NO: 1180481 - RNA, 16 nt, Mycobacterium bovis subsp bovis AF2122/97
cucgacgacgggcgcc

SEQ ID NO: 1180482 - RNA, 20 nt, Mycobacterium bovis subsp bovis AF2122/97
cucgacgaggagccucgacc

SEQ ID NO: 1180483 - RNA, 16 nt, Mycobacterium bovis subsp bovis AF2122/97
cucgacgaggccacgg

SEQ ID NO: 1180484 - RNA, 20 nt, Mycobacterium bovis subsp bovis AF2122/97
cucgauggcguagggcuguc

SEQ ID NO: 1180485 - RNA, 17 nt, Mycobacterium bovis subsp bovis AF2122/97
cucgauuguggccagcg

SEQ ID NO: 1180486 - RNA, 13 nt, Mycobacterium bovis subsp bovis AF2122/97
cucggcgccgccc

SEQ ID NO: 1180487 - RNA, 14 nt, Mycobacterium bovis subsp bovis AF2122/97
cucggcgccgccca

SEQ ID NO: 1180488 - RNA, 22 nt, Mycobacterium bovis subsp bovis AF2122/97
cucggcgccgucggagccggcc

SEQ ID NO: 1180489 - RNA, 16 nt, Mycobacterium bovis subsp bovis AF2122/97
cucggcgcugcgcacc

SEQ ID NO: 1180490 - RNA, 18 nt, Mycobacterium bovis subsp bovis AF2122/97
cucggcgcccagcucguc

SEQ ID NO: 1180491 - RNA, 19 nt, Mycobacterium bovis subsp bovis AF2122/97
cucggcgcugcgcaccgcc

SEQ ID NO: 1180492 - RNA, 13 nt, Mycobacterium bovis subsp bovis AF2122/97
cucggcgcagccg

SEQ ID NO: 1180493 - RNA, 17 nt, Mycobacterium bovis subsp bovis AF2122/97
cucggcgcagccgguga

SEQ ID NO: 1180494 - RNA, 18 nt, Mycobacterium bovis subsp bovis AF2122/97
cucggcgcccuccuuggc

SEQ ID NO: 1180495 - RNA, 20 nt, Mycobacterium bovis subsp bovis AF2122/97
cucgcugggaaaucccgacc

SEQ ID NO: 1180496 - RNA, 15 nt, Mycobacterium bovis subsp bovis AF2122/97
cucgcuggugaacca

SEQ ID NO: 1180497 - RNA, 19 nt, Mycobacterium bovis subsp bovis AF2122/97
cucgcugcaccagcugcuc

SEQ ID NO: 1180498 - RNA, 22 nt, Mycobacterium bovis subsp bovis AF2122/97
cucgcugaucuggggcaccacg

SEQ ID NO: 1180499 - RNA, 15 nt, Mycobacterium bovis subsp bovis AF2122/97
cucgcugcaccagcu

SEQ ID NO: 1180500 - RNA, 13 nt, Mycobacterium bovis subsp bovis AF2122/97
cucgcugcagcag

SEQ ID NO: 1180501 - RNA, 23 nt, Mycobacterium bovis subsp bovis AF2122/97
cucgcggcggcgcuggcgggcag

SEQ ID NO: 1180502 - RNA, 14 nt, Mycobacterium bovis subsp bovis AF2122/97
cucgcggcgcggcc

SEQ ID NO: 1180503 - RNA, 21 nt, Mycobacterium bovis subsp bovis AF2122/97
cucgcgggccaaagccgucag

SEQ ID NO: 1180504 - RNA, 22 nt, Mycobacterium bovis subsp bovis AF2122/97
cucgcgggugcuggucaacagc

SEQ ID NO: 1180505 - RNA, 18 nt, Mycobacterium bovis subsp bovis AF2122/97
cucgcgguaguugucccg

SEQ ID NO: 1180506 - RNA, 14 nt, Mycobacterium bovis subsp bovis AF2122/97
cucggcggcggcuu

SEQ ID NO: 1180507 - RNA, 15 nt, Mycobacterium bovis subsp bovis AF2122/97
cucggcggccucgcu

SEQ ID NO: 1180508 - RNA, 21 nt, Mycobacterium bovis subsp bovis AF2122/97
cucggcggccucgcugcucag

SEQ ID NO: 1180509 - RNA, 21 nt, Mycobacterium bovis subsp bovis AF2122/97
cucggcggccuuaggugacca

SEQ ID NO: 1180510 - RNA, 21 nt, Mycobacterium bovis subsp bovis AF2122/97
cucggcgguaaaugccugccc

SEQ ID NO: 1180511 - RNA, 24 nt, Mycobacterium bovis subsp bovis AF2122/97
cucggcgguaaaugccugcccacc

SEQ ID NO: 1180512 - RNA, 17 nt, Mycobacterium bovis subsp bovis AF2122/97
cucggcggucgggagau

SEQ ID NO: 1180513 - RNA, 20 nt, Mycobacterium bovis subsp bovis AF2122/97
cucggcguccgcccagcacc

SEQ ID NO: 1180514 - RNA, 19 nt, Mycobacterium bovis subsp bovis AF2122/97
cucggcgucgaccaguucg

SEQ ID NO: 1180515 - RNA, 14 nt, Mycobacterium bovis subsp bovis AF2122/97
cucggcgucgccgc

SEQ ID NO: 1180516 - RNA, 16 nt, Mycobacterium bovis subsp bovis AF2122/97
cucggcgugcucggcc

SEQ ID NO: 1180517 - RNA, 17 nt, Mycobacterium bovis subsp bovis AF2122/97
cucggcgucgccgccau

SEQ ID NO: 1180518 - RNA, 21 nt, Mycobacterium bovis subsp bovis AF2122/97
cucggcgucgccgccauugcc

SEQ ID NO: 1180519 - RNA, 22 nt, Mycobacterium bovis subsp bovis AF2122/97
cucggcgucgugguggccacgg

SEQ ID NO: 1180520 - RNA, 15 nt, Mycobacterium bovis subsp bovis AF2122/97
cucggggaacaccgc

SEQ ID NO: 1180521 - RNA, 14 nt, Mycobacterium bovis subsp bovis AF2122/97
cucggugcagcagc

SEQ ID NO: 1180522 - RNA, 13 nt, Mycobacterium bovis subsp bovis AF2122/97
cucggugccccca

SEQ ID NO: 1180523 - RNA, 21 nt, Mycobacterium bovis subsp bovis AF2122/97
cucgguggucuuggcccggcg

SEQ ID NO: 1180524 - RNA, 16 nt, Mycobacterium bovis subsp bovis AF2122/97
cucgggugcgcccggc

SEQ ID NO: 1180525 - RNA, 19 nt, Mycobacterium bovis subsp bovis AF2122/97
cucggucaccacggcggcg

SEQ ID NO: 1180526 - RNA, 15 nt, Mycobacterium bovis subsp bovis AF2122/97
cucgguaggccggca

SEQ ID NO: 1180527 - RNA, 16 nt, Mycobacterium bovis subsp bovis AF2122/97
cucgguaggccggcaa

SEQ ID NO: 1180528 - RNA, 19 nt, Mycobacterium bovis subsp bovis AF2122/97
cucggguccaaccacgagc

SEQ ID NO: 1180529 - RNA, 17 nt, Mycobacterium bovis subsp bovis AF2122/97
cucguuugcgagcaggg

SEQ ID NO: 1180530 - RNA, 16 nt, Mycobacterium bovis subsp bovis AF2122/97
cucguggucgacguga

SEQ ID NO: 1180531 - RNA, 16 nt, Mycobacterium bovis subsp bovis AF2122/97
cucguggaucugccuc

SEQ ID NO: 1180532 - RNA, 14 nt, Mycobacterium bovis subsp bovis AF2122/97
cucgugucugccuc

SEQ ID NO: 1180533 - RNA, 20 nt, Mycobacterium bovis subsp bovis AF2122/97
cucguguuguugaagcccga

SEQ ID NO: 1180534 - RNA, 19 nt, Mycobacterium bovis subsp bovis AF2122/97
cucgguuugcguccuggug

SEQ ID NO: 1180535 - RNA, 17 nt, Mycobacterium bovis subsp bovis AF2122/97
cucggugucggccgcgu

SEQ ID NO: 1180536 - RNA, 13 nt, Mycobacterium bovis subsp bovis AF2122/97
cucgguucgcccc

SEQ ID NO: 1180537 - RNA, 22 nt, Mycobacterium bovis subsp bovis AF2122/97
cucggugugcucgccgaccagc

SEQ ID NO: 1180538 - RNA, 18 nt, Mycobacterium bovis subsp bovis AF2122/97
cucgugagccccagcgac

SEQ ID NO: 1180539 - RNA, 21 nt, Mycobacterium bovis subsp bovis AF2122/97
cucgucgugagucacccggcc

SEQ ID NO: 1180540 - RNA, 18 nt, Mycobacterium bovis subsp bovis AF2122/97
cucgucgucgauccagcc

SEQ ID NO: 1180541 - RNA, 19 nt, Mycobacterium bovis subsp bovis AF2122/97
cucgucgucgauccagccc

SEQ ID NO: 1180542 - RNA, 15 nt, Mycobacterium bovis subsp bovis AF2122/97
cucgucggugcgcgc

SEQ ID NO: 1180543 - RNA, 23 nt, Mycobacterium bovis subsp bovis AF2122/97
cucgucggugugccagugcugca

SEQ ID NO: 1180544 - RNA, 16 nt, Mycobacterium bovis subsp bovis AF2122/97
cucgucguccggccac

SEQ ID NO: 1180545 - RNA, 19 nt, Mycobacterium bovis subsp bovis AF2122/97
cucgucguccggccacggu

SEQ ID NO: 1180546 - RNA, 16 nt, Mycobacterium bovis subsp bovis AF2122/97
cuauuccgcggcacgc

SEQ ID NO: 1180547 - RNA, 15 nt, Mycobacterium bovis subsp bovis AF2122/97
cuauggcccgggccg

SEQ ID NO: 1180548 - RNA, 13 nt, Mycobacterium bovis subsp bovis AF2122/97
cuaugcuggcagc

SEQ ID NO: 1180549 - RNA, 18 nt, Mycobacterium bovis subsp bovis AF2122/97
cuaugcuggcgcagcgcc

SEQ ID NO: 1180550 - RNA, 19 nt, Mycobacterium bovis subsp bovis AF2122/97
cuauggcgccgcggcuggg

SEQ ID NO: 1180551 - RNA, 22 nt, Mycobacterium bovis subsp bovis AF2122/97
cuauggguucgcgguuguccuc

SEQ ID NO: 1180552 - RNA, 12 nt, Mycobacterium bovis subsp bovis AF2122/97
cucaccaggcga

SEQ ID NO: 1180553 - RNA, 14 nt, Mycobacterium bovis subsp bovis AF2122/97
cucaccaccgaccu

SEQ ID NO: 1180554 - RNA, 20 nt, Mycobacterium bovis subsp bovis AF2122/97
cucaccacgaggcuugcggc

SEQ ID NO: 1180555 - RNA, 18 nt, Mycobacterium bovis subsp bovis AF2122/97
cucaccacgucgaccgaa

SEQ ID NO: 1180556 - RNA, 13 nt, Mycobacterium bovis subsp bovis AF2122/97
cucaccagcuccu

SEQ ID NO: 1180557 - RNA, 20 nt, Mycobacterium bovis subsp bovis AF2122/97
cucaccccaacagggcggca

SEQ ID NO: 1180558 - RNA, 20 nt, Mycobacterium bovis subsp bovis AF2122/97
cucagcacgcguucaacgaa

SEQ ID NO: 1180559 - RNA, 15 nt, Mycobacterium bovis subsp bovis AF2122/97
cucagcauucaccaa

SEQ ID NO: 1180560 - RNA, 19 nt, Mycobacterium bovis subsp bovis AF2122/97
cucagcauucaccaaaccg

SEQ ID NO: 1180561 - RNA, 19 nt, Mycobacterium bovis subsp bovis AF2122/97
cucacgggugcuggcagga

SEQ ID NO: 1180562 - RNA, 19 nt, Mycobacterium bovis subsp bovis AF2122/97
cucacgccguccggugugg

SEQ ID NO: 1180563 - RNA, 15 nt, Mycobacterium bovis subsp bovis AF2122/97
cucacgugcccgcgc

SEQ ID NO: 1180564 - RNA, 22 nt, Mycobacterium bovis subsp bovis AF2122/97
cucacugugguaggccggggcg

SEQ ID NO: 1180565 - RNA, 14 nt, Mycobacterium bovis subsp bovis AF2122/97
cucacuucacgccg

SEQ ID NO: 1180566 - RNA, 17 nt, Mycobacterium bovis subsp bovis AF2122/97
cucacuucacgccgccc

SEQ ID NO: 1180567 - RNA, 22 nt, Mycobacterium bovis subsp bovis AF2122/97
cucagccaccgcggucagcucg

SEQ ID NO: 1180568 - RNA, 14 nt, Mycobacterium bovis subsp bovis AF2122/97
cucagcccgacacc

SEQ ID NO: 1180569 - RNA, 13 nt, Mycobacterium bovis subsp bovis AF2122/97
cucagccgcggcc

SEQ ID NO: 1180570 - RNA, 19 nt, Mycobacterium bovis subsp bovis AF2122/97
cucagccguccgggcggcc

SEQ ID NO: 1180571 - RNA, 16 nt, Mycobacterium bovis subsp bovis AF2122/97
cucagccgugcccagg

SEQ ID NO: 1180572 - RNA, 18 nt, Mycobacterium bovis subsp bovis AF2122/97
cucagcgguagagcucug

SEQ ID NO: 1180573 - RNA, 15 nt, Mycobacterium bovis subsp bovis AF2122/97
cucagcggcucgccu

SEQ ID NO: 1180574 - RNA, 22 nt, Mycobacterium bovis subsp bovis AF2122/97
cuaguucgagcugccaggcccg

SEQ ID NO: 1180575 - RNA, 22 nt, Mycobacterium bovis subsp bovis AF2122/97
cuagugcgggccgugacccuca

SEQ ID NO: 1180576 - RNA, 15 nt, Mycobacterium bovis subsp bovis AF2122/97
cuagugugaccguca

SEQ ID NO: 1180577 - RNA, 13 nt, Mycobacterium bovis subsp bovis AF2122/97
cuaggaacgccac

SEQ ID NO: 1180578 - RNA, 15 nt, Mycobacterium bovis subsp bovis AF2122/97
cuaggaccaccagcg

SEQ ID NO: 1180579 - RNA, 23 nt, Mycobacterium bovis subsp bovis AF2122/97
cuaggacgccgcccucucacggc

SEQ ID NO: 1180580 - RNA, 14 nt, Mycobacterium bovis subsp bovis AF2122/97
cuaggaccaccagc

SEQ ID NO: 1180581 - RNA, 21 nt, Mycobacterium bovis subsp bovis AF2122/97
cuaggaccaccagcgcuccag

SEQ ID NO: 1180582 - RNA, 22 nt, Mycobacterium bovis subsp bovis AF2122/97
cuaggaccaccagcgcuccagc

SEQ ID NO: 1180583 - RNA, 17 nt, Mycobacterium bovis subsp bovis AF2122/97
cuaguugccaacacauu

SEQ ID NO: 1180584 - RNA, 20 nt, Mycobacterium bovis subsp bovis AF2122/97
cuaguugggugggugcagca

SEQ ID NO: 1180585 - RNA, 14 nt, Mycobacterium bovis subsp bovis AF2122/97
cuacggccuggcca

SEQ ID NO: 1180586 - RNA, 17 nt, Mycobacterium bovis subsp bovis AF2122/97
cuagccgcggcaccgcc

SEQ ID NO: 1180587 - RNA, 19 nt, Mycobacterium bovis subsp bovis AF2122/97
cuagccgcggcaccgccga

SEQ ID NO: 1180588 - RNA, 17 nt, Mycobacterium bovis subsp bovis AF2122/97
cuagccgauccagcagg

SEQ ID NO: 1180589 - RNA, 19 nt, Mycobacterium bovis subsp bovis AF2122/97
cuagcgccccuggcaccuc

SEQ ID NO: 1180590 - RNA, 17 nt, Mycobacterium bovis subsp bovis AF2122/97
cuagcgccucgccggcc

SEQ ID NO: 1180591 - RNA, 15 nt, Mycobacterium bovis subsp bovis AF2122/97
cuaccggccuuucca

SEQ ID NO: 1180592 - RNA, 17 nt, Mycobacterium bovis subsp bovis AF2122/97
cuaccggccuuuccagc

SEQ ID NO: 1180593 - RNA, 18 nt, Mycobacterium bovis subsp bovis AF2122/97
cuaccggccuuuccagca

SEQ ID NO: 1180594 - RNA, 17 nt, Mycobacterium bovis subsp bovis AF2122/97
cuaccgcaggugccacc

SEQ ID NO: 1180595 - RNA, 14 nt, Mycobacterium bovis subsp bovis AF2122/97
cuaccgacgcaccu

SEQ ID NO: 1180596 - RNA, 18 nt, Mycobacterium bovis subsp bovis AF2122/97
cuaccgagaucaccgcca

SEQ ID NO: 1180597 - RNA, 17 nt, Mycobacterium bovis subsp bovis AF2122/97
cuaccgaugaaccaggc

SEQ ID NO: 1180598 - RNA, 23 nt, Mycobacterium bovis subsp bovis AF2122/97
cuaccgaacaguaggccuccgcu

SEQ ID NO: 1180599 - RNA, 16 nt, Mycobacterium bovis subsp bovis AF2122/97
cuacccgcggcgcgaa

SEQ ID NO: 1180600 - RNA, 12 nt, Mycobacterium bovis subsp bovis AF2122/97
cuacccgggcca

SEQ ID NO: 1180601 - RNA, 13 nt, Mycobacterium bovis subsp bovis AF2122/97
cuacccgggccag

SEQ ID NO: 1180602 - RNA, 20 nt, Mycobacterium bovis subsp bovis AF2122/97
cuaccggugguagcggcggu

SEQ ID NO: 1180603 - RNA, 19 nt, Mycobacterium bovis subsp bovis AF2122/97
cuaccguacgcagcgugug

SEQ ID NO: 1180604 - RNA, 20 nt, Mycobacterium bovis subsp bovis AF2122/97
cuaccggcgccgcgcggcuu

SEQ ID NO: 1180605 - RNA, 17 nt, Mycobacterium bovis subsp bovis AF2122/97
cuaccggcucguagcug

SEQ ID NO: 1180606 - RNA, 12 nt, Mycobacterium bovis subsp bovis AF2122/97
cuaccggcgccg

SEQ ID NO: 1180607 - RNA, 15 nt, Mycobacterium bovis subsp bovis AF2122/97
cuaccuaacccgcgc

SEQ ID NO: 1180608 - RNA, 16 nt, Mycobacterium bovis subsp bovis AF2122/97
cuaccguuguugagga

SEQ ID NO: 1180609 - RNA, 16 nt, Mycobacterium bovis subsp bovis AF2122/97
cuaccuguugacacaa

SEQ ID NO: 1180610 - RNA, 20 nt, Mycobacterium bovis subsp bovis AF2122/97
cuaccaaccgguacuccugg

SEQ ID NO: 1180611 - RNA, 12 nt, Mycobacterium bovis subsp bovis AF2122/97
cuaccacccgca

SEQ ID NO: 1180612 - RNA, 22 nt, Mycobacterium bovis subsp bovis AF2122/97
cuaccacccgcaggucgcuggc

SEQ ID NO: 1180613 - RNA, 12 nt, Mycobacterium bovis subsp bovis AF2122/97
cuaccagcucac

SEQ ID NO: 1180614 - RNA, 18 nt, Mycobacterium bovis subsp bovis AF2122/97
cuacccgagccggcacgc

SEQ ID NO: 1180615 - RNA, 21 nt, Mycobacterium bovis subsp bovis AF2122/97
cuacaccggcaagccacgccg

SEQ ID NO: 1180616 - RNA, 14 nt, Mycobacterium bovis subsp bovis AF2122/97
aaaaccacccccac

SEQ ID NO: 1180617 - RNA, 14 nt, Mycobacterium bovis subsp bovis AF2122/97
aaaacccaacaccc

SEQ ID NO: 1180618 - RNA, 21 nt, Mycobacterium bovis subsp bovis AF2122/97
aaaacccggugaccagcaacc

SEQ ID NO: 1180619 - RNA, 12 nt, Mycobacterium bovis subsp bovis AF2122/97
aaaaccgcaccg

SEQ ID NO: 1180620 - RNA, 19 nt, Mycobacterium bovis subsp bovis AF2122/97
aaaaccgcaccgucccagu

SEQ ID NO: 1180621 - RNA, 14 nt, Mycobacterium bovis subsp bovis AF2122/97
aaaaccgccgcaac

SEQ ID NO: 1180622 - RNA, 12 nt, Mycobacterium bovis subsp bovis AF2122/97
aaaaccgcgaac

SEQ ID NO: 1180623 - RNA, 21 nt, Mycobacterium bovis subsp bovis AF2122/97
aaaaacccggugaccagcaac

SEQ ID NO: 1180624 - RNA, 18 nt, Mycobacterium bovis subsp bovis AF2122/97
aaaaacgaacccaggcac

SEQ ID NO: 1180625 - RNA, 20 nt, Mycobacterium bovis subsp bovis AF2122/97
aaaaaccucgacgcccgccc

SEQ ID NO: 1180626 - RNA, 22 nt, Mycobacterium bovis subsp bovis AF2122/97
aaaaaggcggcguuguccccca

SEQ ID NO: 1180627 - RNA, 14 nt, Mycobacterium bovis subsp bovis AF2122/97
aaaaagcccagcga

SEQ ID NO: 1180628 - RNA, 14 nt, Mycobacterium bovis subsp bovis AF2122/97
aaaaggaagaccuc

SEQ ID NO: 1180629 - RNA, 13 nt, Mycobacterium bovis subsp bovis AF2122/97
aaaacgagcuucc

SEQ ID NO: 1180630 - RNA, 16 nt, Mycobacterium bovis subsp bovis AF2122/97
aaaacgaacccaggca

SEQ ID NO: 1180631 - RNA, 17 nt, Mycobacterium bovis subsp bovis AF2122/97
aaaacgcccggcacacg

SEQ ID NO: 1180632 - RNA, 16 nt, Mycobacterium bovis subsp bovis AF2122/97
aaacaccagcccggcg

SEQ ID NO: 1180633 - RNA, 16 nt, Mycobacterium bovis subsp bovis AF2122/97
aaacacguucucacca

SEQ ID NO: 1180634 - RNA, 15 nt, Mycobacterium bovis subsp bovis AF2122/97
aaaauugcuccacca

SEQ ID NO: 1180635 - RNA, 19 nt, Mycobacterium bovis subsp bovis AF2122/97
aaaauugcuccaccacuga

SEQ ID NO: 1180636 - RNA, 13 nt, Mycobacterium bovis subsp bovis AF2122/97
aaacagguaagca

SEQ ID NO: 1180637 - RNA, 17 nt, Mycobacterium bovis subsp bovis AF2122/97
aaacagcuugcugcgca

SEQ ID NO: 1180638 - RNA, 22 nt, Mycobacterium bovis subsp bovis AF2122/97
aaacagcgccaucgaugcggug

SEQ ID NO: 1180639 - RNA, 23 nt, Mycobacterium bovis subsp bovis AF2122/97
aaacagcauggcgaagaacaaca

SEQ ID NO: 1180640 - RNA, 12 nt, Mycobacterium bovis subsp bovis AF2122/97
aaacccugcugc

SEQ ID NO: 1180641 - RNA, 23 nt, Mycobacterium bovis subsp bovis AF2122/97
aaacccggcccagguugccaacc

SEQ ID NO: 1180642 - RNA, 22 nt, Mycobacterium bovis subsp bovis AF2122/97
aaacccggugaccagcaaccac

SEQ ID NO: 1180643 - RNA, 21 nt, Mycobacterium bovis subsp bovis AF2122/97
aaaccagauugccgagcccag

SEQ ID NO: 1180644 - RNA, 12 nt, Mycobacterium bovis subsp bovis AF2122/97
aaacaugugggu

SEQ ID NO: 1180645 - RNA, 18 nt, Mycobacterium bovis subsp bovis AF2122/97
aaacaucucggcgcagcc

SEQ ID NO: 1180646 - RNA, 18 nt, Mycobacterium bovis subsp bovis AF2122/97
aaacaucgcacccaccac

SEQ ID NO: 1180647 - RNA, 14 nt, Mycobacterium bovis subsp bovis AF2122/97
aaaccacuggaugg

SEQ ID NO: 1180648 - RNA, 22 nt, Mycobacterium bovis subsp bovis AF2122/97
aacaaccccgaggcaacaagca

SEQ ID NO: 1180649 - RNA, 14 nt, Mycobacterium bovis subsp bovis AF2122/97
aacaacaucacugc

SEQ ID NO: 1180650 - RNA, 20 nt, Mycobacterium bovis subsp bovis AF2122/97
aacaacgcuaacugcuuuuc

SEQ ID NO: 1180651 - RNA, 14 nt, Mycobacterium bovis subsp bovis AF2122/97
aacaacuccagcag

SEQ ID NO: 1180652 - RNA, 15 nt, Mycobacterium bovis subsp bovis AF2122/97
aacaacuccagcagg

SEQ ID NO: 1180653 - RNA, 20 nt, Mycobacterium bovis subsp bovis AF2122/97
aacaacuuggccaucccggc

SEQ ID NO: 1180654 - RNA, 20 nt, Mycobacterium bovis subsp bovis AF2122/97
aacaagaucagacccagcgc

SEQ ID NO: 1180655 - RNA, 16 nt, Mycobacterium bovis subsp bovis AF2122/97
aacaaacccaacacca

SEQ ID NO: 1180656 - RNA, 21 nt, Mycobacterium bovis subsp bovis AF2122/97
aacaaacccaacaccagcagc

SEQ ID NO: 1180657 - RNA, 22 nt, Mycobacterium bovis subsp bovis AF2122/97
aaaugacggcugaaccugcugg

SEQ ID NO: 1180658 - RNA, 22 nt, Mycobacterium bovis subsp bovis AF2122/97
aaaucgggaucugcgccgcgcg

SEQ ID NO: 1180659 - RNA, 20 nt, Mycobacterium bovis subsp bovis AF2122/97
aaaucggcggcguccagcag

SEQ ID NO: 1180660 - RNA, 21 nt, Mycobacterium bovis subsp bovis AF2122/97
aaaucggcggcguccagcagc

SEQ ID NO: 1180661 - RNA, 14 nt, Mycobacterium bovis subsp bovis AF2122/97
aaauccgcccaccg

SEQ ID NO: 1180662 - RNA, 13 nt, Mycobacterium bovis subsp bovis AF2122/97
aaauccgcguggu

SEQ ID NO: 1180663 - RNA, 22 nt, Mycobacterium bovis subsp bovis AF2122/97
aaauccggggggauccagcagg

SEQ ID NO: 1180664 - RNA, 19 nt, Mycobacterium bovis subsp bovis AF2122/97
aaauccagcagccaggagc

SEQ ID NO: 1180665 - RNA, 13 nt, Mycobacterium bovis subsp bovis AF2122/97
aaaguuccacgac

SEQ ID NO: 1180666 - RNA, 21 nt, Mycobacterium bovis subsp bovis AF2122/97
aaagcguaaggccggagucga

SEQ ID NO: 1180667 - RNA, 13 nt, Mycobacterium bovis subsp bovis AF2122/97
aaagcucucggca

SEQ ID NO: 1180668 - RNA, 22 nt, Mycobacterium bovis subsp bovis AF2122/97
aaagccuaguccuggcucggca

SEQ ID NO: 1180669 - RNA, 14 nt, Mycobacterium bovis subsp bovis AF2122/97
aaagccgugccagc

SEQ ID NO: 1180670 - RNA, 22 nt, Mycobacterium bovis subsp bovis AF2122/97
aaagcaucaaagcggugccauu

SEQ ID NO: 1180671 - RNA, 19 nt, Mycobacterium bovis subsp bovis AF2122/97
aaagaccgccgcugggucc

SEQ ID NO: 1180672 - RNA, 16 nt, Mycobacterium bovis subsp bovis AF2122/97
caaacccggcgggccc

SEQ ID NO: 1180673 - RNA, 21 nt, Mycobacterium bovis subsp bovis AF2122/97
caaacccguugaagacggcca

SEQ ID NO: 1180674 - RNA, 21 nt, Mycobacterium bovis subsp bovis AF2122/97
caaacuaacggcagccaccgu

SEQ ID NO: 1180675 - RNA, 17 nt, Mycobacterium bovis subsp bovis AF2122/97
caaacgaccgcugauga

SEQ ID NO: 1180676 - RNA, 15 nt, Mycobacterium bovis subsp bovis AF2122/97
caaacaucgcaccca

SEQ ID NO: 1180677 - RNA, 19 nt, Mycobacterium bovis subsp bovis AF2122/97
caaacaucgcacccaccac

SEQ ID NO: 1180678 - RNA, 15 nt, Mycobacterium bovis subsp bovis AF2122/97
caaacaccccacaca

SEQ ID NO: 1180679 - RNA, 20 nt, Mycobacterium bovis subsp bovis AF2122/97
caaacaccccggccuugcca

SEQ ID NO: 1180680 - RNA, 22 nt, Mycobacterium bovis subsp bovis AF2122/97
caaacacgccucgccgaagugg

SEQ ID NO: 1180681 - RNA, 23 nt, Mycobacterium bovis subsp bovis AF2122/97
caaacaccccggccuugccaccg

SEQ ID NO: 1180682 - RNA, 21 nt, Mycobacterium bovis subsp bovis AF2122/97
caaaaugccuuggcagcccag

SEQ ID NO: 1180683 - RNA, 19 nt, Mycobacterium bovis subsp bovis AF2122/97
caaaaugccuuggcagccc

SEQ ID NO: 1180684 - RNA, 14 nt, Mycobacterium bovis subsp bovis AF2122/97
caaaaucagggugc

SEQ ID NO: 1180685 - RNA, 13 nt, Mycobacterium bovis subsp bovis AF2122/97
caaaaucaucugc

SEQ ID NO: 1180686 - RNA, 17 nt, Mycobacterium bovis subsp bovis AF2122/97
caaagccagcgcagcca

SEQ ID NO: 1180687 - RNA, 21 nt, Mycobacterium bovis subsp bovis AF2122/97
caaagccagcgcagccaggcu

SEQ ID NO: 1180688 - RNA, 11 nt, Mycobacterium bovis subsp bovis AF2122/97
caaagcccaca

SEQ ID NO: 1180689 - RNA, 22 nt, Mycobacterium bovis subsp bovis AF2122/97
caaacugggaugugccgcgcac

SEQ ID NO: 1180690 - RNA, 23 nt, Mycobacterium bovis subsp bovis AF2122/97
caaacugggaugugccgcgcacg

SEQ ID NO: 1180691 - RNA, 14 nt, Mycobacterium bovis subsp bovis AF2122/97
caaacugggcaccg

SEQ ID NO: 1180692 - RNA, 15 nt, Mycobacterium bovis subsp bovis AF2122/97
caaacuccugcagga

SEQ ID NO: 1180693 - RNA, 18 nt, Mycobacterium bovis subsp bovis AF2122/97
caaacuccugcaggauca

SEQ ID NO: 1180694 - RNA, 19 nt, Mycobacterium bovis subsp bovis AF2122/97
caacacgggcagcuucaau

SEQ ID NO: 1180695 - RNA, 17 nt, Mycobacterium bovis subsp bovis AF2122/97
caacacgucgagcagcc

SEQ ID NO: 1180696 - RNA, 15 nt, Mycobacterium bovis subsp bovis AF2122/97
caacaccucaccgcg

SEQ ID NO: 1180697 - RNA, 22 nt, Mycobacterium bovis subsp bovis AF2122/97
caacaccgguaacgccaacacc

SEQ ID NO: 1180698 - RNA, 19 nt, Mycobacterium bovis subsp bovis AF2122/97
caacaccgguggcuucaac

SEQ ID NO: 1180699 - RNA, 14 nt, Mycobacterium bovis subsp bovis AF2122/97
caacaccgcggccg

SEQ ID NO: 1180700 - RNA, 14 nt, Mycobacterium bovis subsp bovis AF2122/97
caacaccgcggcgc

SEQ ID NO: 1180701 - RNA, 20 nt, Mycobacterium bovis subsp bovis AF2122/97
caacaccgcgucaacgcugu

SEQ ID NO: 1180702 - RNA, 13 nt, Mycobacterium bovis subsp bovis AF2122/97
caacacagcugau

SEQ ID NO: 1180703 - RNA, 17 nt, Mycobacterium bovis subsp bovis AF2122/97
caacagaccuagcaccg

SEQ ID NO: 1180704 - RNA, 21 nt, Mycobacterium bovis subsp bovis AF2122/97
caacagaugccacccagaugc

SEQ ID NO: 1180705 - RNA, 16 nt, Mycobacterium bovis subsp bovis AF2122/97
caacaacuccagcagg

SEQ ID NO: 1180706 - RNA, 14 nt, Mycobacterium bovis subsp bovis AF2122/97
caacaacuccagca

SEQ ID NO: 1180707 - RNA, 14 nt, Mycobacterium bovis subsp bovis AF2122/97
caaaugggguguuu

SEQ ID NO: 1180708 - RNA, 14 nt, Mycobacterium bovis subsp bovis AF2122/97
caaaugcgcugucg

SEQ ID NO: 1180709 - RNA, 15 nt, Mycobacterium bovis subsp bovis AF2122/97
caaaugccugcuggu

SEQ ID NO: 1180710 - RNA, 18 nt, Mycobacterium bovis subsp bovis AF2122/97
caacaacccaacaaaagg

SEQ ID NO: 1180711 - RNA, 23 nt, Mycobacterium bovis subsp bovis AF2122/97
caacgccacugcgccgugaccca

SEQ ID NO: 1180712 - RNA, 15 nt, Mycobacterium bovis subsp bovis AF2122/97
caacgaugaugauga

SEQ ID NO: 1180713 - RNA, 14 nt, Mycobacterium bovis subsp bovis AF2122/97
caacgcacgccaca

SEQ ID NO: 1180714 - RNA, 14 nt, Mycobacterium bovis subsp bovis AF2122/97
caacgacugcauga

SEQ ID NO: 1180715 - RNA, 18 nt, Mycobacterium bovis subsp bovis AF2122/97
caacgacuucgggaacgc

SEQ ID NO: 1180716 - RNA, 20 nt, Mycobacterium bovis subsp bovis AF2122/97
caacgagcaggauaaacccg

SEQ ID NO: 1180717 - RNA, 12 nt, Mycobacterium bovis subsp bovis AF2122/97
caacgaucaggu

SEQ ID NO: 1180718 - RNA, 15 nt, Mycobacterium bovis subsp bovis AF2122/97
caacgacuccuggcg

SEQ ID NO: 1180719 - RNA, 16 nt, Mycobacterium bovis subsp bovis AF2122/97
caacgacggcugaccu

SEQ ID NO: 1180720 - RNA, 16 nt, Mycobacterium bovis subsp bovis AF2122/97
caacgacccgccgccc

SEQ ID NO: 1180721 - RNA, 19 nt, Mycobacterium bovis subsp bovis AF2122/97
caacgacgacgacaagugc

SEQ ID NO: 1180722 - RNA, 13 nt, Mycobacterium bovis subsp bovis AF2122/97
caacgaccaccac

SEQ ID NO: 1180723 - RNA, 21 nt, Mycobacterium bovis subsp bovis AF2122/97
caacgacaggcgcccacaaau

SEQ ID NO: 1180724 - RNA, 18 nt, Mycobacterium bovis subsp bovis AF2122/97
caacgacaggcgcccaca

SEQ ID NO: 1180725 - RNA, 15 nt, Mycobacterium bovis subsp bovis AF2122/97
caaccgcgcccuagc

SEQ ID NO: 1180726 - RNA, 11 nt, Mycobacterium bovis subsp bovis AF2122/97
caaccgcccgu

SEQ ID NO: 1180727 - RNA, 22 nt, Mycobacterium bovis subsp bovis AF2122/97
caaccgccaucgucgaagaccu

SEQ ID NO: 1180728 - RNA, 19 nt, Mycobacterium bovis subsp bovis AF2122/97
caaccgcgucgaagccggg

SEQ ID NO: 1180729 - RNA, 17 nt, Mycobacterium bovis subsp bovis AF2122/97
caaccgcgcgagccucg

SEQ ID NO: 1180730 - RNA, 22 nt, Mycobacterium bovis subsp bovis AF2122/97
caaccgcgcuuucgagugcagc

SEQ ID NO: 1180731 - RNA, 14 nt, Mycobacterium bovis subsp bovis AF2122/97
caaccugcgcggcg

SEQ ID NO: 1180732 - RNA, 23 nt, Mycobacterium bovis subsp bovis AF2122/97
caaccuguuccagcgugccuggu

SEQ ID NO: 1180733 - RNA, 16 nt, Mycobacterium bovis subsp bovis AF2122/97
caaccuggacugcagc

SEQ ID NO: 1180734 - RNA, 17 nt, Mycobacterium bovis subsp bovis AF2122/97
caacccgcaccccggcc

SEQ ID NO: 1180735 - RNA, 20 nt, Mycobacterium bovis subsp bovis AF2122/97
caaccgagcggucgaucuga

SEQ ID NO: 1180736 - RNA, 14 nt, Mycobacterium bovis subsp bovis AF2122/97
caacccccgccggc

SEQ ID NO: 1180737 - RNA, 13 nt, Mycobacterium bovis subsp bovis AF2122/97
caaccccgccggc

SEQ ID NO: 1180738 - RNA, 20 nt, Mycobacterium bovis subsp bovis AF2122/97
caaccaccgguccagcgccg

SEQ ID NO: 1180739 - RNA, 22 nt, Mycobacterium bovis subsp bovis AF2122/97
caaccaccgguccagcgccgga

SEQ ID NO: 1180740 - RNA, 20 nt, Mycobacterium bovis subsp bovis AF2122/97
caaccaccucgugggccacu

SEQ ID NO: 1180741 - RNA, 22 nt, Mycobacterium bovis subsp bovis AF2122/97
caaccaccgaaggugcgcguga

SEQ ID NO: 1180742 - RNA, 15 nt, Mycobacterium bovis subsp bovis AF2122/97
caaccagcaaugccg

SEQ ID NO: 1180743 - RNA, 23 nt, Mycobacterium bovis subsp bovis AF2122/97
caacagggcggcaggguguuuau

SEQ ID NO: 1180744 - RNA, 19 nt, Mycobacterium bovis subsp bovis AF2122/97
caacaggaacaggcaaagu

SEQ ID NO: 1180745 - RNA, 16 nt, Mycobacterium bovis subsp bovis AF2122/97
caacagcuuggagauc

SEQ ID NO: 1180746 - RNA, 13 nt, Mycobacterium bovis subsp bovis AF2122/97
caacaggccaacu

SEQ ID NO: 1180747 - RNA, 22 nt, Mycobacterium bovis subsp bovis AF2122/97
caacaggccaacuuggcggcca

SEQ ID NO: 1180748 - RNA, 12 nt, Mycobacterium bovis subsp bovis AF2122/97
caacaggguggg

SEQ ID NO: 1180749 - RNA, 18 nt, Mycobacterium bovis subsp bovis AF2122/97
caaccaaccgcgcgagcc

SEQ ID NO: 1180750 - RNA, 19 nt, Mycobacterium bovis subsp bovis AF2122/97
caacucgagaguggccucg

SEQ ID NO: 1180751 - RNA, 15 nt, Mycobacterium bovis subsp bovis AF2122/97
caacucggccacggc

SEQ ID NO: 1180752 - RNA, 20 nt, Mycobacterium bovis subsp bovis AF2122/97
caacugcagcauggcccugg

SEQ ID NO: 1180753 - RNA, 17 nt, Mycobacterium bovis subsp bovis AF2122/97
caacugcagauaggacc

SEQ ID NO: 1180754 - RNA, 20 nt, Mycobacterium bovis subsp bovis AF2122/97
caacugcagauaggacccag

SEQ ID NO: 1180755 - RNA, 14 nt, Mycobacterium bovis subsp bovis AF2122/97
caacgccucugcuc

SEQ ID NO: 1180756 - RNA, 14 nt, Mycobacterium bovis subsp bovis AF2122/97
caacucccagcacg

SEQ ID NO: 1180757 - RNA, 18 nt, Mycobacterium bovis subsp bovis AF2122/97
caacucccgaacuggcug

SEQ ID NO: 1180758 - RNA, 21 nt, Mycobacterium bovis subsp bovis AF2122/97
caacuccggucaacacccgcc

SEQ ID NO: 1180759 - RNA, 22 nt, Mycobacterium bovis subsp bovis AF2122/97
caacuccugcagcccgggcagc

SEQ ID NO: 1180760 - RNA, 19 nt, Mycobacterium bovis subsp bovis AF2122/97
caacucgaauccggcccac

SEQ ID NO: 1180761 - RNA, 13 nt, Mycobacterium bovis subsp bovis AF2122/97
caacuccucagcc

SEQ ID NO: 1180762 - RNA, 20 nt, Mycobacterium bovis subsp bovis AF2122/97
caacuccucagccgccuguc

SEQ ID NO: 1180763 - RNA, 17 nt, Mycobacterium bovis subsp bovis AF2122/97
caacuacgccagccgcg

SEQ ID NO: 1180764 - RNA, 20 nt, Mycobacterium bovis subsp bovis AF2122/97
caacuaccuguugacacaac

SEQ ID NO: 1180765 - RNA, 22 nt, Mycobacterium bovis subsp bovis AF2122/97
caacuaccuguugacacaacga

SEQ ID NO: 1180766 - RNA, 13 nt, Mycobacterium bovis subsp bovis AF2122/97
caagaccggcggg

SEQ ID NO: 1180767 - RNA, 19 nt, Mycobacterium bovis subsp bovis AF2122/97
caacuuggcggccagccgc

SEQ ID NO: 1180768 - RNA, 16 nt, Mycobacterium bovis subsp bovis AF2122/97
caaggggcagcacguc

SEQ ID NO: 1180769 - RNA, 22 nt, Mycobacterium bovis subsp bovis AF2122/97
caagggggaguuggugaacggu

SEQ ID NO: 1180770 - RNA, 14 nt, Mycobacterium bovis subsp bovis AF2122/97
caagggugcccgga

SEQ ID NO: 1180771 - RNA, 23 nt, Mycobacterium bovis subsp bovis AF2122/97
caagggcgcgagcagacgcagaa

SEQ ID NO: 1180772 - RNA, 17 nt, Mycobacterium bovis subsp bovis AF2122/97
caagggcauacagcaug

SEQ ID NO: 1180773 - RNA, 18 nt, Mycobacterium bovis subsp bovis AF2122/97
caagggcaucaaccaacu

SEQ ID NO: 1180774 - RNA, 15 nt, Mycobacterium bovis subsp bovis AF2122/97
caaggugcgccgcca

SEQ ID NO: 1180775 - RNA, 17 nt, Mycobacterium bovis subsp bovis AF2122/97
caaggugagcagcaaga

SEQ ID NO: 1180776 - RNA, 20 nt, Mycobacterium bovis subsp bovis AF2122/97
caagguauggccggagcgca

SEQ ID NO: 1180777 - RNA, 14 nt, Mycobacterium bovis subsp bovis AF2122/97
caaggugucgacgg

SEQ ID NO: 1180778 - RNA, 21 nt, Mycobacterium bovis subsp bovis AF2122/97
caagguguugcggugggugaa

SEQ ID NO: 1180779 - RNA, 18 nt, Mycobacterium bovis subsp bovis AF2122/97
caagguguccagcaccug

SEQ ID NO: 1180780 - RNA, 18 nt, Mycobacterium bovis subsp bovis AF2122/97
caagguuucgacaucacu

SEQ ID NO: 1180781 - RNA, 23 nt, Mycobacterium bovis subsp bovis AF2122/97
caaggcgauagaugcgugcggca

SEQ ID NO: 1180782 - RNA, 12 nt, Mycobacterium bovis subsp bovis AF2122/97
caaggcgcgcug

SEQ ID NO: 1180783 - RNA, 16 nt, Mycobacterium bovis subsp bovis AF2122/97
caaggcggucaccacc

SEQ ID NO: 1180784 - RNA, 14 nt, Mycobacterium bovis subsp bovis AF2122/97
caaggcggcggcca

SEQ ID NO: 1180785 - RNA, 22 nt, Mycobacterium bovis subsp bovis AF2122/97
caaggcucagcagcgccgcgcg

SEQ ID NO: 1180786 - RNA, 14 nt, Mycobacterium bovis subsp bovis AF2122/97
caagcagcccgggu

SEQ ID NO: 1180787 - RNA, 16 nt, Mycobacterium bovis subsp bovis AF2122/97
caagccagcacugcca

SEQ ID NO: 1180788 - RNA, 12 nt, Mycobacterium bovis subsp bovis AF2122/97
caagcccaaaaa

SEQ ID NO: 1180789 - RNA, 21 nt, Mycobacterium bovis subsp bovis AF2122/97
caagcccaaaaagaccgccgc

SEQ ID NO: 1180790 - RNA, 15 nt, Mycobacterium bovis subsp bovis AF2122/97
caagcgucgcaaaca

SEQ ID NO: 1180791 - RNA, 21 nt, Mycobacterium bovis subsp bovis AF2122/97
caagcccgauucagcgcccca

SEQ ID NO: 1180792 - RNA, 22 nt, Mycobacterium bovis subsp bovis AF2122/97
caagcacgguggccgagccgcg

SEQ ID NO: 1180793 - RNA, 16 nt, Mycobacterium bovis subsp bovis AF2122/97
caagcacagcccggcg

SEQ ID NO: 1180794 - RNA, 16 nt, Mycobacterium bovis subsp bovis AF2122/97
caagcacagcccggcu

SEQ ID NO: 1180795 - RNA, 14 nt, Mycobacterium bovis subsp bovis AF2122/97
caagcacagcgaac

SEQ ID NO: 1180796 - RNA, 22 nt, Mycobacterium bovis subsp bovis AF2122/97
caagcacacuggccacaaucgc

SEQ ID NO: 1180797 - RNA, 15 nt, Mycobacterium bovis subsp bovis AF2122/97
caagcacagcccggc

SEQ ID NO: 1180798 - RNA, 22 nt, Mycobacterium bovis subsp bovis AF2122/97
caagagugcucagcgcgcgccg

SEQ ID NO: 1180799 - RNA, 15 nt, Mycobacterium bovis subsp bovis AF2122/97
caagagccgcagcca

SEQ ID NO: 1180800 - RNA, 16 nt, Mycobacterium bovis subsp bovis AF2122/97
caauccggcugcggua

SEQ ID NO: 1180801 - RNA, 18 nt, Mycobacterium bovis subsp bovis AF2122/97
caauccggucagcgcggc

SEQ ID NO: 1180802 - RNA, 13 nt, Mycobacterium bovis subsp bovis AF2122/97
caaucuccuccgc

SEQ ID NO: 1180803 - RNA, 16 nt, Mycobacterium bovis subsp bovis AF2122/97
caaucgggaucgcugc

SEQ ID NO: 1180804 - RNA, 18 nt, Mycobacterium bovis subsp bovis AF2122/97
caauccgcccuaaugaag

SEQ ID NO: 1180805 - RNA, 22 nt, Mycobacterium bovis subsp bovis AF2122/97
caauccgcaaaacgagcuucca

SEQ ID NO: 1180806 - RNA, 22 nt, Mycobacterium bovis subsp bovis AF2122/97
caauccgcacagcgacgagauc

SEQ ID NO: 1180807 - RNA, 15 nt, Mycobacterium bovis subsp bovis AF2122/97
caaucaugugccagu

SEQ ID NO: 1180808 - RNA, 14 nt, Mycobacterium bovis subsp bovis AF2122/97
caaucaugucagcg

SEQ ID NO: 1180809 - RNA, 13 nt, Mycobacterium bovis subsp bovis AF2122/97
caaugcggcccgg

SEQ ID NO: 1180810 - RNA, 17 nt, Mycobacterium bovis subsp bovis AF2122/97
caaugcggugacaaccg

SEQ ID NO: 1180811 - RNA, 14 nt, Mycobacterium bovis subsp bovis AF2122/97
caaugcgcgacggu

SEQ ID NO: 1180812 - RNA, 14 nt, Mycobacterium bovis subsp bovis AF2122/97
caaugcgagcaccc

SEQ ID NO: 1180813 - RNA, 14 nt, Mycobacterium bovis subsp bovis AF2122/97
caaugccggccgcg

SEQ ID NO: 1180814 - RNA, 16 nt, Mycobacterium bovis subsp bovis AF2122/97
caaugcaaauagccuu

SEQ ID NO: 1180815 - RNA, 20 nt, Mycobacterium bovis subsp bovis AF2122/97
caaugcaaauagccuuguuc

SEQ ID NO: 1180816 - RNA, 17 nt, Mycobacterium bovis subsp bovis AF2122/97
caauaccgccagcgcca

SEQ ID NO: 1180817 - RNA, 15 nt, Mycobacterium bovis subsp bovis AF2122/97
caauagaagcacguc

SEQ ID NO: 1180818 - RNA, 22 nt, Mycobacterium bovis subsp bovis AF2122/97
caauaggcuccagcgcgcgccg

SEQ ID NO: 1180819 - RNA, 20 nt, Mycobacterium bovis subsp bovis AF2122/97
caaguugaccuucaccugga

SEQ ID NO: 1180820 - RNA, 20 nt, Mycobacterium bovis subsp bovis AF2122/97
caaguugggcguucaggugu

SEQ ID NO: 1180821 - RNA, 17 nt, Mycobacterium bovis subsp bovis AF2122/97
caaguugguucaccgcg

SEQ ID NO: 1180822 - RNA, 23 nt, Mycobacterium bovis subsp bovis AF2122/97
cacacucggccgggcucuaucag

SEQ ID NO: 1180823 - RNA, 15 nt, Mycobacterium bovis subsp bovis AF2122/97
cacacuccuagccaa

SEQ ID NO: 1180824 - RNA, 14 nt, Mycobacterium bovis subsp bovis AF2122/97
cacacucgccaggg

SEQ ID NO: 1180825 - RNA, 22 nt, Mycobacterium bovis subsp bovis AF2122/97
cacacucucggugaacgccgcc

SEQ ID NO: 1180826 - RNA, 16 nt, Mycobacterium bovis subsp bovis AF2122/97
cacacuggccacaauc

SEQ ID NO: 1180827 - RNA, 16 nt, Mycobacterium bovis subsp bovis AF2122/97
cacacugaccccgccg

SEQ ID NO: 1180828 - RNA, 18 nt, Mycobacterium bovis subsp bovis AF2122/97
cacacugaccccgccgcc

SEQ ID NO: 1180829 - RNA, 15 nt, Mycobacterium bovis subsp bovis AF2122/97
cacaccuccucgacc

SEQ ID NO: 1180830 - RNA, 13 nt, Mycobacterium bovis subsp bovis AF2122/97
cacaccggcacug

SEQ ID NO: 1180831 - RNA, 18 nt, Mycobacterium bovis subsp bovis AF2122/97
cacaccgggaugggagcc

SEQ ID NO: 1180832 - RNA, 14 nt, Mycobacterium bovis subsp bovis AF2122/97
cacaccgggcacca

SEQ ID NO: 1180833 - RNA, 17 nt, Mycobacterium bovis subsp bovis AF2122/97
cacaccgagcacgggua

SEQ ID NO: 1180834 - RNA, 16 nt, Mycobacterium bovis subsp bovis AF2122/97
cacaccgacagcaccc

SEQ ID NO: 1180835 - RNA, 15 nt, Mycobacterium bovis subsp bovis AF2122/97
cacaccgacgccgcc

SEQ ID NO: 1180836 - RNA, 13 nt, Mycobacterium bovis subsp bovis AF2122/97
cacacccagaugc

SEQ ID NO: 1180837 - RNA, 16 nt, Mycobacterium bovis subsp bovis AF2122/97
cacaccccaggcaccc

SEQ ID NO: 1180838 - RNA, 21 nt, Mycobacterium bovis subsp bovis AF2122/97
cacacccgcgaacgcgacagc

SEQ ID NO: 1180839 - RNA, 20 nt, Mycobacterium bovis subsp bovis AF2122/97
cacaccaggccgagccgccc

SEQ ID NO: 1180840 - RNA, 15 nt, Mycobacterium bovis subsp bovis AF2122/97
cacaauuccacaaau

SEQ ID NO: 1180841 - RNA, 17 nt, Mycobacterium bovis subsp bovis AF2122/97
cacaacagcccguagca

SEQ ID NO: 1180842 - RNA, 21 nt, Mycobacterium bovis subsp bovis AF2122/97
cacaggugccaaacgccgccc

SEQ ID NO: 1180843 - RNA, 15 nt, Mycobacterium bovis subsp bovis AF2122/97
cacagucgugagcca

SEQ ID NO: 1180844 - RNA, 14 nt, Mycobacterium bovis subsp bovis AF2122/97
cacagucgccggcc

SEQ ID NO: 1180845 - RNA, 15 nt, Mycobacterium bovis subsp bovis AF2122/97
cacagucgccggccg

SEQ ID NO: 1180846 - RNA, 15 nt, Mycobacterium bovis subsp bovis AF2122/97
cacaggccgccuggg

SEQ ID NO: 1180847 - RNA, 13 nt, Mycobacterium bovis subsp bovis AF2122/97
cacaggcggcgcu

SEQ ID NO: 1180848 - RNA, 16 nt, Mycobacterium bovis subsp bovis AF2122/97
cacaggcggcgcugca

SEQ ID NO: 1180849 - RNA, 19 nt, Mycobacterium bovis subsp bovis AF2122/97
cacagcccgaugccgugcc

SEQ ID NO: 1180850 - RNA, 22 nt, Mycobacterium bovis subsp bovis AF2122/97
cacagcccggcgacgacccggg

SEQ ID NO: 1180851 - RNA, 14 nt, Mycobacterium bovis subsp bovis AF2122/97
cacagccggcggcu

SEQ ID NO: 1180852 - RNA, 13 nt, Mycobacterium bovis subsp bovis AF2122/97
cacagacacggca

SEQ ID NO: 1180853 - RNA, 15 nt, Mycobacterium bovis subsp bovis AF2122/97
cacagaccgaacagc

SEQ ID NO: 1180854 - RNA, 19 nt, Mycobacterium bovis subsp bovis AF2122/97
cacaggacaauggacacca

SEQ ID NO: 1180855 - RNA, 21 nt, Mycobacterium bovis subsp bovis AF2122/97
cacaggacuuguccaucacau

SEQ ID NO: 1180856 - RNA, 21 nt, Mycobacterium bovis subsp bovis AF2122/97
cacaggcauuuucacugugcc

SEQ ID NO: 1180857 - RNA, 13 nt, Mycobacterium bovis subsp bovis AF2122/97
cacagcgcagccu

SEQ ID NO: 1180858 - RNA, 20 nt, Mycobacterium bovis subsp bovis AF2122/97
caaugcgucgaugcgcugcu

SEQ ID NO: 1180859 - RNA, 20 nt, Mycobacterium bovis subsp bovis AF2122/97
caauuaggucgaccacccgc

SEQ ID NO: 1180860 - RNA, 19 nt, Mycobacterium bovis subsp bovis AF2122/97
caauucacgcaccacaaac

SEQ ID NO: 1180861 - RNA, 17 nt, Mycobacterium bovis subsp bovis AF2122/97
cacaaaauacuccgcga

SEQ ID NO: 1180862 - RNA, 13 nt, Mycobacterium bovis subsp bovis AF2122/97
cacaaacccagca

SEQ ID NO: 1180863 - RNA, 14 nt, Mycobacterium bovis subsp bovis AF2122/97
cacaaacccagcau

SEQ ID NO: 1180864 - RNA, 15 nt, Mycobacterium bovis subsp bovis AF2122/97
caauugugcggcccc

SEQ ID NO: 1180865 - RNA, 18 nt, Mycobacterium bovis subsp bovis AF2122/97
caauugugcggccccguc

SEQ ID NO: 1180866 - RNA, 15 nt, Mycobacterium bovis subsp bovis AF2122/97
cacaugccacagcgg

SEQ ID NO: 1180867 - RNA, 14 nt, Mycobacterium bovis subsp bovis AF2122/97
caccaaggccgccu

SEQ ID NO: 1180868 - RNA, 23 nt, Mycobacterium bovis subsp bovis AF2122/97
caccaaggccgugaugccacggc

SEQ ID NO: 1180869 - RNA, 20 nt, Mycobacterium bovis subsp bovis AF2122/97
caccaagcucggccagcacg

SEQ ID NO: 1180870 - RNA, 19 nt, Mycobacterium bovis subsp bovis AF2122/97
caccaaggucuucaggccg

SEQ ID NO: 1180871 - RNA, 23 nt, Mycobacterium bovis subsp bovis AF2122/97
caccaaggucuucaggccgcgca

SEQ ID NO: 1180872 - RNA, 16 nt, Mycobacterium bovis subsp bovis AF2122/97
caccaagcucggccag

SEQ ID NO: 1180873 - RNA, 15 nt, Mycobacterium bovis subsp bovis AF2122/97
caccaagacaccggc

SEQ ID NO: 1180874 - RNA, 13 nt, Mycobacterium bovis subsp bovis AF2122/97
caccaagacgcca

SEQ ID NO: 1180875 - RNA, 15 nt, Mycobacterium bovis subsp bovis AF2122/97
caccaagacgccacc

SEQ ID NO: 1180876 - RNA, 16 nt, Mycobacterium bovis subsp bovis AF2122/97
caccaagacgccaccc

SEQ ID NO: 1180877 - RNA, 19 nt, Mycobacterium bovis subsp bovis AF2122/97
cacauggaacucacccuau

SEQ ID NO: 1180878 - RNA, 15 nt, Mycobacterium bovis subsp bovis AF2122/97
cacauugguguccac

SEQ ID NO: 1180879 - RNA, 17 nt, Mycobacterium bovis subsp bovis AF2122/97
cacauugccggccacca

SEQ ID NO: 1180880 - RNA, 13 nt, Mycobacterium bovis subsp bovis AF2122/97
cacaugcucaggg

SEQ ID NO: 1180881 - RNA, 19 nt, Mycobacterium bovis subsp bovis AF2122/97
cacaugcucgacgcccgcc

SEQ ID NO: 1180882 - RNA, 14 nt, Mycobacterium bovis subsp bovis AF2122/97
caccaccggcgccg

SEQ ID NO: 1180883 - RNA, 14 nt, Mycobacterium bovis subsp bovis AF2122/97
caccaccggcuccc

SEQ ID NO: 1180884 - RNA, 14 nt, Mycobacterium bovis subsp bovis AF2122/97
caccaccggcaccc

SEQ ID NO: 1180885 - RNA, 18 nt, Mycobacterium bovis subsp bovis AF2122/97
caccaccggcacccgcug

SEQ ID NO: 1180886 - RNA, 13 nt, Mycobacterium bovis subsp bovis AF2122/97
caccaccggcccc

SEQ ID NO: 1180887 - RNA, 23 nt, Mycobacterium bovis subsp bovis AF2122/97
caccaccggccccaccgacagcc

SEQ ID NO: 1180888 - RNA, 13 nt, Mycobacterium bovis subsp bovis AF2122/97
caccaccuccgcg

SEQ ID NO: 1180889 - RNA, 20 nt, Mycobacterium bovis subsp bovis AF2122/97
caccaccgucucgccgcgca

SEQ ID NO: 1180890 - RNA, 12 nt, Mycobacterium bovis subsp bovis AF2122/97
caccaccgccgg

SEQ ID NO: 1180891 - RNA, 23 nt, Mycobacterium bovis subsp bovis AF2122/97
caccaccgcgaccucgcggcgcu

SEQ ID NO: 1180892 - RNA, 14 nt, Mycobacterium bovis subsp bovis AF2122/97
caccaccgcgaccu

SEQ ID NO: 1180893 - RNA, 15 nt, Mycobacterium bovis subsp bovis AF2122/97
caccaccgccgccac

SEQ ID NO: 1180894 - RNA, 14 nt, Mycobacterium bovis subsp bovis AF2122/97
caccaccgcgccgu

SEQ ID NO: 1180895 - RNA, 21 nt, Mycobacterium bovis subsp bovis AF2122/97
caccaccggaucgcucccguc

SEQ ID NO: 1180896 - RNA, 14 nt, Mycobacterium bovis subsp bovis AF2122/97
caccaccggaacca

SEQ ID NO: 1180897 - RNA, 15 nt, Mycobacterium bovis subsp bovis AF2122/97
caccaccggaaccac

SEQ ID NO: 1180898 - RNA, 14 nt, Mycobacterium bovis subsp bovis AF2122/97
caccacggcggcca

SEQ ID NO: 1180899 - RNA, 19 nt, Mycobacterium bovis subsp bovis AF2122/97
caccacggcguugccgccg

SEQ ID NO: 1180900 - RNA, 19 nt, Mycobacterium bovis subsp bovis AF2122/97
caccacggcgcgcgcgccg

SEQ ID NO: 1180901 - RNA, 22 nt, Mycobacterium bovis subsp bovis AF2122/97
caccaccuggccggccaucuug

SEQ ID NO: 1180902 - RNA, 20 nt, Mycobacterium bovis subsp bovis AF2122/97
caccacggugccgacgauga

SEQ ID NO: 1180903 - RNA, 21 nt, Mycobacterium bovis subsp bovis AF2122/97
caccacggugacuaccgugca

SEQ ID NO: 1180904 - RNA, 18 nt, Mycobacterium bovis subsp bovis AF2122/97
caccaccgcacaucgucc

SEQ ID NO: 1180905 - RNA, 14 nt, Mycobacterium bovis subsp bovis AF2122/97
caccaccgaccugg

SEQ ID NO: 1180906 - RNA, 22 nt, Mycobacterium bovis subsp bovis AF2122/97
caccaccgaccuggacgcggcc

SEQ ID NO: 1180907 - RNA, 17 nt, Mycobacterium bovis subsp bovis AF2122/97
caccaccgacagcaccc

SEQ ID NO: 1180908 - RNA, 15 nt, Mycobacterium bovis subsp bovis AF2122/97
caccaccccagcggc

SEQ ID NO: 1180909 - RNA, 23 nt, Mycobacterium bovis subsp bovis AF2122/97
caccaccauucccggacccacca

SEQ ID NO: 1180910 - RNA, 17 nt, Mycobacterium bovis subsp bovis AF2122/97
caccacccgauuggcca

SEQ ID NO: 1180911 - RNA, 21 nt, Mycobacterium bovis subsp bovis AF2122/97
caccacccgauuggccaaccc

SEQ ID NO: 1180912 - RNA, 21 nt, Mycobacterium bovis subsp bovis AF2122/97
caccacccgaccgccauccuu

SEQ ID NO: 1180913 - RNA, 22 nt, Mycobacterium bovis subsp bovis AF2122/97
caccacccgaccgccauccuuc

SEQ ID NO: 1180914 - RNA, 16 nt, Mycobacterium bovis subsp bovis AF2122/97
caccaccccagcggcc

SEQ ID NO: 1180915 - RNA, 20 nt, Mycobacterium bovis subsp bovis AF2122/97
caccaccccagcggccaccg

SEQ ID NO: 1180916 - RNA, 22 nt, Mycobacterium bovis subsp bovis AF2122/97
caccacccgggccucggcgccg

SEQ ID NO: 1180917 - RNA, 22 nt, Mycobacterium bovis subsp bovis AF2122/97
caccacccgucggcccgcucau

SEQ ID NO: 1180918 - RNA, 16 nt, Mycobacterium bovis subsp bovis AF2122/97
caccacccugcacugc

SEQ ID NO: 1180919 - RNA, 20 nt, Mycobacterium bovis subsp bovis AF2122/97
caccaauaccgcacccgcuc

SEQ ID NO: 1180920 - RNA, 20 nt, Mycobacterium bovis subsp bovis AF2122/97
caccaugauugccaggaccg

SEQ ID NO: 1180921 - RNA, 17 nt, Mycobacterium bovis subsp bovis AF2122/97
caccaugaucaggcccc

SEQ ID NO: 1180922 - RNA, 22 nt, Mycobacterium bovis subsp bovis AF2122/97
caccaugaucaggccccacacg

SEQ ID NO: 1180923 - RNA, 16 nt, Mycobacterium bovis subsp bovis AF2122/97
caccaucuccgccguc

SEQ ID NO: 1180924 - RNA, 21 nt, Mycobacterium bovis subsp bovis AF2122/97
caccauguauuucucccagcc

SEQ ID NO: 1180925 - RNA, 16 nt, Mycobacterium bovis subsp bovis AF2122/97
caccauggcgccgcgc

SEQ ID NO: 1180926 - RNA, 17 nt, Mycobacterium bovis subsp bovis AF2122/97
caccauggcgccgcgcc

SEQ ID NO: 1180927 - RNA, 23 nt, Mycobacterium bovis subsp bovis AF2122/97
caccaucgccgccguugccgccg

SEQ ID NO: 1180928 - RNA, 18 nt, Mycobacterium bovis subsp bovis AF2122/97
caccaucgccucggcgcu

SEQ ID NO: 1180929 - RNA, 19 nt, Mycobacterium bovis subsp bovis AF2122/97
caccaucggggaaggggcu

SEQ ID NO: 1180930 - RNA, 21 nt, Mycobacterium bovis subsp bovis AF2122/97
caccaucgguaucgagggcag

SEQ ID NO: 1180931 - RNA, 14 nt, Mycobacterium bovis subsp bovis AF2122/97
caccaucaucaccu

SEQ ID NO: 1180932 - RNA, 20 nt, Mycobacterium bovis subsp bovis AF2122/97
caccaucacgguggccgcac

SEQ ID NO: 1180933 - RNA, 19 nt, Mycobacterium bovis subsp bovis AF2122/97
caccaggguuggcaccguc

SEQ ID NO: 1180934 - RNA, 19 nt, Mycobacterium bovis subsp bovis AF2122/97
caccaggggaccgcggcgc

SEQ ID NO: 1180935 - RNA, 22 nt, Mycobacterium bovis subsp bovis AF2122/97
caccaguuugugccgccgcggc

SEQ ID NO: 1180936 - RNA, 14 nt, Mycobacterium bovis subsp bovis AF2122/97
caccaucaccucgc

SEQ ID NO: 1180937 - RNA, 24 nt, Mycobacterium bovis subsp bovis AF2122/97
caccaucaaggacucggacgcgcc

SEQ ID NO: 1180938 - RNA, 16 nt, Mycobacterium bovis subsp bovis AF2122/97
caccagcgaggccagc

SEQ ID NO: 1180939 - RNA, 18 nt, Mycobacterium bovis subsp bovis AF2122/97
caccagcgaggccagcgg

SEQ ID NO: 1180940 - RNA, 14 nt, Mycobacterium bovis subsp bovis AF2122/97
caccagccuggcug

SEQ ID NO: 1180941 - RNA, 15 nt, Mycobacterium bovis subsp bovis AF2122/97
caccagcccggcggc

SEQ ID NO: 1180942 - RNA, 18 nt, Mycobacterium bovis subsp bovis AF2122/97
caccagccgguagccggg

SEQ ID NO: 1180943 - RNA, 17 nt, Mycobacterium bovis subsp bovis AF2122/97
caccagccgguccagca

SEQ ID NO: 1180944 - RNA, 13 nt, Mycobacterium bovis subsp bovis AF2122/97
caccagaaccggu

SEQ ID NO: 1180945 - RNA, 22 nt, Mycobacterium bovis subsp bovis AF2122/97
caccagaaaacauugcggcccu

SEQ ID NO: 1180946 - RNA, 15 nt, Mycobacterium bovis subsp bovis AF2122/97
caccagaauccugcu

SEQ ID NO: 1180947 - RNA, 20 nt, Mycobacterium bovis subsp bovis AF2122/97
caccaggaugccuaccgugc

SEQ ID NO: 1180948 - RNA, 13 nt, Mycobacterium bovis subsp bovis AF2122/97
caccagcgcagcc

SEQ ID NO: 1180949 - RNA, 23 nt, Mycobacterium bovis subsp bovis AF2122/97
caccagcgcaucggccagcagcg

SEQ ID NO: 1180950 - RNA, 22 nt, Mycobacterium bovis subsp bovis AF2122/97
caccaggccgagccgcccgccc

SEQ ID NO: 1180951 - RNA, 21 nt, Mycobacterium bovis subsp bovis AF2122/97
caccaggcgagccggcgcgca

SEQ ID NO: 1180952 - RNA, 22 nt, Mycobacterium bovis subsp bovis AF2122/97
caccagggccuccacccgccac

SEQ ID NO: 1180953 - RNA, 15 nt, Mycobacterium bovis subsp bovis AF2122/97
caccagggccaccgc

SEQ ID NO: 1180954 - RNA, 14 nt, Mycobacterium bovis subsp bovis AF2122/97
caccagggcgcgga

SEQ ID NO: 1180955 - RNA, 23 nt, Mycobacterium bovis subsp bovis AF2122/97
cacccgcgucgagugccgccacc

SEQ ID NO: 1180956 - RNA, 24 nt, Mycobacterium bovis subsp bovis AF2122/97
cacccgcgucgagugccgccaccg

SEQ ID NO: 1180957 - RNA, 14 nt, Mycobacterium bovis subsp bovis AF2122/97
cacccgcggcgccg

SEQ ID NO: 1180958 - RNA, 23 nt, Mycobacterium bovis subsp bovis AF2122/97
cacccgcacggccuccggaccga

SEQ ID NO: 1180959 - RNA, 18 nt, Mycobacterium bovis subsp bovis AF2122/97
cacccgcaccucaccggg

SEQ ID NO: 1180960 - RNA, 13 nt, Mycobacterium bovis subsp bovis AF2122/97
cacccgcaccacc

SEQ ID NO: 1180961 - RNA, 16 nt, Mycobacterium bovis subsp bovis AF2122/97
cacccgcaccaccggc

SEQ ID NO: 1180962 - RNA, 22 nt, Mycobacterium bovis subsp bovis AF2122/97
cacccgcaccaccggccccacc

SEQ ID NO: 1180963 - RNA, 19 nt, Mycobacterium bovis subsp bovis AF2122/97
cacccgauuggccaacccc

SEQ ID NO: 1180964 - RNA, 19 nt, Mycobacterium bovis subsp bovis AF2122/97
cacccggcauugagccggg

SEQ ID NO: 1180965 - RNA, 19 nt, Mycobacterium bovis subsp bovis AF2122/97
cacccggccucaacacccg

SEQ ID NO: 1180966 - RNA, 21 nt, Mycobacterium bovis subsp bovis AF2122/97
cacccggccucaacacccggc

SEQ ID NO: 1180967 - RNA, 22 nt, Mycobacterium bovis subsp bovis AF2122/97
cacccggacugcgaagaguccu

SEQ ID NO: 1180968 - RNA, 14 nt, Mycobacterium bovis subsp bovis AF2122/97
cacccgcugcacgc

SEQ ID NO: 1180969 - RNA, 16 nt, Mycobacterium bovis subsp bovis AF2122/97
cacccgcucggccgcc

SEQ ID NO: 1180970 - RNA, 17 nt, Mycobacterium bovis subsp bovis AF2122/97
cacccgcucggccguca

SEQ ID NO: 1180971 - RNA, 15 nt, Mycobacterium bovis subsp bovis AF2122/97
cacccuccgccgguc

SEQ ID NO: 1180972 - RNA, 15 nt, Mycobacterium bovis subsp bovis AF2122/97
cacccugaccaacau

SEQ ID NO: 1180973 - RNA, 19 nt, Mycobacterium bovis subsp bovis AF2122/97
cacccucggguccaaccac

SEQ ID NO: 1180974 - RNA, 15 nt, Mycobacterium bovis subsp bovis AF2122/97
cacccugacagcgag

SEQ ID NO: 1180975 - RNA, 20 nt, Mycobacterium bovis subsp bovis AF2122/97
cacccguucgugagcggcca

SEQ ID NO: 1180976 - RNA, 14 nt, Mycobacterium bovis subsp bovis AF2122/97
cacccgagggccug

SEQ ID NO: 1180977 - RNA, 17 nt, Mycobacterium bovis subsp bovis AF2122/97
caccccggucggcccgc

SEQ ID NO: 1180978 - RNA, 14 nt, Mycobacterium bovis subsp bovis AF2122/97
cacccaccagugca

SEQ ID NO: 1180979 - RNA, 15 nt, Mycobacterium bovis subsp bovis AF2122/97
cacccacacccagcg

SEQ ID NO: 1180980 - RNA, 18 nt, Mycobacterium bovis subsp bovis AF2122/97
cacccaacucaugggcca

SEQ ID NO: 1180981 - RNA, 15 nt, Mycobacterium bovis subsp bovis AF2122/97
cacccaacuccauca

SEQ ID NO: 1180982 - RNA, 19 nt, Mycobacterium bovis subsp bovis AF2122/97
cacccaauggagccgcgac

SEQ ID NO: 1180983 - RNA, 23 nt, Mycobacterium bovis subsp bovis AF2122/97
cacccaauucacgacgccgagca

SEQ ID NO: 1180984 - RNA, 23 nt, Mycobacterium bovis subsp bovis AF2122/97
cacccaaaccggcccgcagcagc

SEQ ID NO: 1180985 - RNA, 22 nt, Mycobacterium bovis subsp bovis AF2122/97
cacccaacgcggugggcacagc

SEQ ID NO: 1180986 - RNA, 19 nt, Mycobacterium bovis subsp bovis AF2122/97
caccauuggccaagucagc

SEQ ID NO: 1180987 - RNA, 21 nt, Mycobacterium bovis subsp bovis AF2122/97
caccauuggccuaggacaccg

SEQ ID NO: 1180988 - RNA, 22 nt, Mycobacterium bovis subsp bovis AF2122/97
caccauuguuccguccccgacg

SEQ ID NO: 1180989 - RNA, 13 nt, Mycobacterium bovis subsp bovis AF2122/97
caccauuggccaa

SEQ ID NO: 1180990 - RNA, 16 nt, Mycobacterium bovis subsp bovis AF2122/97
caccauucgcaccggc

SEQ ID NO: 1180991 - RNA, 16 nt, Mycobacterium bovis subsp bovis AF2122/97
caccauucgcgggccg

SEQ ID NO: 1180992 - RNA, 19 nt, Mycobacterium bovis subsp bovis AF2122/97
caccaugucggccacccgg

SEQ ID NO: 1180993 - RNA, 19 nt, Mycobacterium bovis subsp bovis AF2122/97
caccgccgcggccgccguc

SEQ ID NO: 1180994 - RNA, 17 nt, Mycobacterium bovis subsp bovis AF2122/97
caccgccggugccgcca

SEQ ID NO: 1180995 - RNA, 19 nt, Mycobacterium bovis subsp bovis AF2122/97
caccgccggugccgccauc

SEQ ID NO: 1180996 - RNA, 17 nt, Mycobacterium bovis subsp bovis AF2122/97
caccgccggugcggcca

SEQ ID NO: 1180997 - RNA, 18 nt, Mycobacterium bovis subsp bovis AF2122/97
caccgccggugcugacga

SEQ ID NO: 1180998 - RNA, 13 nt, Mycobacterium bovis subsp bovis AF2122/97
caccgccggcgcc

SEQ ID NO: 1180999 - RNA, 14 nt, Mycobacterium bovis subsp bovis AF2122/97
caccgccggcgcca

SEQ ID NO: 1181000 - RNA, 16 nt, Mycobacterium bovis subsp bovis AF2122/97
caccgccggcgccacc

SEQ ID NO: 1181001 - RNA, 19 nt, Mycobacterium bovis subsp bovis AF2122/97
caccgccggcgccaccguc

SEQ ID NO: 1181002 - RNA, 18 nt, Mycobacterium bovis subsp bovis AF2122/97
caccgccggcgcccaggc

SEQ ID NO: 1181003 - RNA, 14 nt, Mycobacterium bovis subsp bovis AF2122/97
caccgccgcggccg

SEQ ID NO: 1181004 - RNA, 19 nt, Mycobacterium bovis subsp bovis AF2122/97
caccgccgcgccggcggcc

SEQ ID NO: 1181005 - RNA, 20 nt, Mycobacterium bovis subsp bovis AF2122/97
caccgcgccagccuccacca

SEQ ID NO: 1181006 - RNA, 23 nt, Mycobacterium bovis subsp bovis AF2122/97
caccgccguugccgccggcgccg

SEQ ID NO: 1181007 - RNA, 18 nt, Mycobacterium bovis subsp bovis AF2122/97
caccgccguugccgccgg

SEQ ID NO: 1181008 - RNA, 22 nt, Mycobacterium bovis subsp bovis AF2122/97
caccgccggggcugguguagac

SEQ ID NO: 1181009 - RNA, 16 nt, Mycobacterium bovis subsp bovis AF2122/97
caccgccggggugugc

SEQ ID NO: 1181010 - RNA, 20 nt, Mycobacterium bovis subsp bovis AF2122/97
caccgccgacauggcggugc

SEQ ID NO: 1181011 - RNA, 17 nt, Mycobacterium bovis subsp bovis AF2122/97
caccgccgaccuaguca

SEQ ID NO: 1181012 - RNA, 14 nt, Mycobacterium bovis subsp bovis AF2122/97
caccgccgacgccc

SEQ ID NO: 1181013 - RNA, 22 nt, Mycobacterium bovis subsp bovis AF2122/97
caccgccgacaggccggccacc

SEQ ID NO: 1181014 - RNA, 14 nt, Mycobacterium bovis subsp bovis AF2122/97
caccgcccggcccg

SEQ ID NO: 1181015 - RNA, 15 nt, Mycobacterium bovis subsp bovis AF2122/97
caccgcccggcccgg

SEQ ID NO: 1181016 - RNA, 21 nt, Mycobacterium bovis subsp bovis AF2122/97
caccgcccuugccgccggccc

SEQ ID NO: 1181017 - RNA, 22 nt, Mycobacterium bovis subsp bovis AF2122/97
caccgcccuugccgccggcccc

SEQ ID NO: 1181018 - RNA, 23 nt, Mycobacterium bovis subsp bovis AF2122/97
caccgcccuugccgccggccccg

SEQ ID NO: 1181019 - RNA, 17 nt, Mycobacterium bovis subsp bovis AF2122/97
caccgccgcccccgccg

SEQ ID NO: 1181020 - RNA, 19 nt, Mycobacterium bovis subsp bovis AF2122/97
caccgccgccgccaccggc

SEQ ID NO: 1181021 - RNA, 15 nt, Mycobacterium bovis subsp bovis AF2122/97
caccgccccgcgccc

SEQ ID NO: 1181022 - RNA, 21 nt, Mycobacterium bovis subsp bovis AF2122/97
caccgccagcgucgacacacc

SEQ ID NO: 1181023 - RNA, 22 nt, Mycobacterium bovis subsp bovis AF2122/97
caccgccagcaugacaccggcc

SEQ ID NO: 1181024 - RNA, 15 nt, Mycobacterium bovis subsp bovis AF2122/97
caccgcaagaaucag

SEQ ID NO: 1181025 - RNA, 19 nt, Mycobacterium bovis subsp bovis AF2122/97
caccgcaacgcuucggcag

SEQ ID NO: 1181026 - RNA, 20 nt, Mycobacterium bovis subsp bovis AF2122/97
caccgauucggccagcgccc

SEQ ID NO: 1181027 - RNA, 15 nt, Mycobacterium bovis subsp bovis AF2122/97
caccgaugccacauc

SEQ ID NO: 1181028 - RNA, 17 nt, Mycobacterium bovis subsp bovis AF2122/97
caccgauggcgcgcuca

SEQ ID NO: 1181029 - RNA, 15 nt, Mycobacterium bovis subsp bovis AF2122/97
caccgaucccgcggc

SEQ ID NO: 1181030 - RNA, 15 nt, Mycobacterium bovis subsp bovis AF2122/97
caccgauccggccgc

SEQ ID NO: 1181031 - RNA, 17 nt, Mycobacterium bovis subsp bovis AF2122/97
caccgaucgacugcagc

SEQ ID NO: 1181032 - RNA, 12 nt, Mycobacterium bovis subsp bovis AF2122/97
caccgacaccgu

SEQ ID NO: 1181033 - RNA, 22 nt, Mycobacterium bovis subsp bovis AF2122/97
caccgacaagaauggccgccuu

SEQ ID NO: 1181034 - RNA, 13 nt, Mycobacterium bovis subsp bovis AF2122/97
caccgaacgcggc

SEQ ID NO: 1181035 - RNA, 14 nt, Mycobacterium bovis subsp bovis AF2122/97
caccgaaccgccgc

SEQ ID NO: 1181036 - RNA, 21 nt, Mycobacterium bovis subsp bovis AF2122/97
caccgaaagccucucuuccca

SEQ ID NO: 1181037 - RNA, 16 nt, Mycobacterium bovis subsp bovis AF2122/97
caccuccgucagcgcc

SEQ ID NO: 1181038 - RNA, 16 nt, Mycobacterium bovis subsp bovis AF2122/97
caccucgaugccgccc

SEQ ID NO: 1181039 - RNA, 17 nt, Mycobacterium bovis subsp bovis AF2122/97
caccucgagcgcggcga

SEQ ID NO: 1181040 - RNA, 15 nt, Mycobacterium bovis subsp bovis AF2122/97
caccucgagcguggc

SEQ ID NO: 1181041 - RNA, 18 nt, Mycobacterium bovis subsp bovis AF2122/97
caccucgaucgcgccguc

SEQ ID NO: 1181042 - RNA, 16 nt, Mycobacterium bovis subsp bovis AF2122/97
caccucgcacgacacc

SEQ ID NO: 1181043 - RNA, 20 nt, Mycobacterium bovis subsp bovis AF2122/97
caccucgcacgacaccucga

SEQ ID NO: 1181044 - RNA, 16 nt, Mycobacterium bovis subsp bovis AF2122/97
caccucgcccucccgg

SEQ ID NO: 1181045 - RNA, 14 nt, Mycobacterium bovis subsp bovis AF2122/97
caccucgggcgccc

SEQ ID NO: 1181046 - RNA, 22 nt, Mycobacterium bovis subsp bovis AF2122/97
caccucggccagcuccgccugc

SEQ ID NO: 1181047 - RNA, 14 nt, Mycobacterium bovis subsp bovis AF2122/97
caccgucugcuggc

SEQ ID NO: 1181048 - RNA, 17 nt, Mycobacterium bovis subsp bovis AF2122/97
caccgugccgacgcccc

SEQ ID NO: 1181049 - RNA, 18 nt, Mycobacterium bovis subsp bovis AF2122/97
caccgugaccgccgcgcc

SEQ ID NO: 1181050 - RNA, 15 nt, Mycobacterium bovis subsp bovis AF2122/97
caccgugaccgccgc

SEQ ID NO: 1181051 - RNA, 15 nt, Mycobacterium bovis subsp bovis AF2122/97
caccguagccgaggg

SEQ ID NO: 1181052 - RNA, 13 nt, Mycobacterium bovis subsp bovis AF2122/97
caccguggccucg

SEQ ID NO: 1181053 - RNA, 19 nt, Mycobacterium bovis subsp bovis AF2122/97
caccgugcggaucgcgcug

SEQ ID NO: 1181054 - RNA, 20 nt, Mycobacterium bovis subsp bovis AF2122/97
caccgugggcccuucacugu

SEQ ID NO: 1181055 - RNA, 20 nt, Mycobacterium bovis subsp bovis AF2122/97
caccuccucgagcaggaugc

SEQ ID NO: 1181056 - RNA, 22 nt, Mycobacterium bovis subsp bovis AF2122/97
caccuccgcgacggcggcuccc

SEQ ID NO: 1181057 - RNA, 15 nt, Mycobacterium bovis subsp bovis AF2122/97
caccguuagccaggu

SEQ ID NO: 1181058 - RNA, 15 nt, Mycobacterium bovis subsp bovis AF2122/97
caccugcaugugugu

SEQ ID NO: 1181059 - RNA, 15 nt, Mycobacterium bovis subsp bovis AF2122/97
caccugagccucagu

SEQ ID NO: 1181060 - RNA, 22 nt, Mycobacterium bovis subsp bovis AF2122/97
caccucggcgaagucacgcacc

SEQ ID NO: 1181061 - RNA, 23 nt, Mycobacterium bovis subsp bovis AF2122/97
caccucggguguggucaccaggc

SEQ ID NO: 1181062 - RNA, 18 nt, Mycobacterium bovis subsp bovis AF2122/97
caccucggugaccaggcc

SEQ ID NO: 1181063 - RNA, 15 nt, Mycobacterium bovis subsp bovis AF2122/97
caccugaaagcuacc

SEQ ID NO: 1181064 - RNA, 17 nt, Mycobacterium bovis subsp bovis AF2122/97
caccggccugcgcgacc

SEQ ID NO: 1181065 - RNA, 12 nt, Mycobacterium bovis subsp bovis AF2122/97
caccggcgccca

SEQ ID NO: 1181066 - RNA, 14 nt, Mycobacterium bovis subsp bovis AF2122/97
caccggcgccgccc

SEQ ID NO: 1181067 - RNA, 14 nt, Mycobacterium bovis subsp bovis AF2122/97
caccggccgcgcag

SEQ ID NO: 1181068 - RNA, 23 nt, Mycobacterium bovis subsp bovis AF2122/97
caccggccgugccgccgacacca

SEQ ID NO: 1181069 - RNA, 12 nt, Mycobacterium bovis subsp bovis AF2122/97
caccggccgccg

SEQ ID NO: 1181070 - RNA, 17 nt, Mycobacterium bovis subsp bovis AF2122/97
caccggcgcgaccgcgg

SEQ ID NO: 1181071 - RNA, 16 nt, Mycobacterium bovis subsp bovis AF2122/97
caccggcgccgccguc

SEQ ID NO: 1181072 - RNA, 17 nt, Mycobacterium bovis subsp bovis AF2122/97
caccgggauggcucacc

SEQ ID NO: 1181073 - RNA, 19 nt, Mycobacterium bovis subsp bovis AF2122/97
caccgggaugggagccacu

SEQ ID NO: 1181074 - RNA, 20 nt, Mycobacterium bovis subsp bovis AF2122/97
caccgggcaccagucgcccc

SEQ ID NO: 1181075 - RNA, 19 nt, Mycobacterium bovis subsp bovis AF2122/97
caccgggcccgccggcccc

SEQ ID NO: 1181076 - RNA, 23 nt, Mycobacterium bovis subsp bovis AF2122/97
caccgggcccgccggccccgccg

SEQ ID NO: 1181077 - RNA, 18 nt, Mycobacterium bovis subsp bovis AF2122/97
caccgggguuacucgcag

SEQ ID NO: 1181078 - RNA, 18 nt, Mycobacterium bovis subsp bovis AF2122/97
caccggugccgcccgcgc

SEQ ID NO: 1181079 - RNA, 15 nt, Mycobacterium bovis subsp bovis AF2122/97
caccggugccgccgu

SEQ ID NO: 1181080 - RNA, 19 nt, Mycobacterium bovis subsp bovis AF2122/97
caccggugccggcgacgcu

SEQ ID NO: 1181081 - RNA, 23 nt, Mycobacterium bovis subsp bovis AF2122/97
caccgguucggugagcgggagga

SEQ ID NO: 1181082 - RNA, 21 nt, Mycobacterium bovis subsp bovis AF2122/97
caccgguuuggagcucaucga

SEQ ID NO: 1181083 - RNA, 14 nt, Mycobacterium bovis subsp bovis AF2122/97
caccggugcccacc

SEQ ID NO: 1181084 - RNA, 17 nt, Mycobacterium bovis subsp bovis AF2122/97
caccggucaccgcgcag

SEQ ID NO: 1181085 - RNA, 15 nt, Mycobacterium bovis subsp bovis AF2122/97
caccggugacgcaca

SEQ ID NO: 1181086 - RNA, 22 nt, Mycobacterium bovis subsp bovis AF2122/97
caccggugacgcacagcagcac

SEQ ID NO: 1181087 - RNA, 23 nt, Mycobacterium bovis subsp bovis AF2122/97
caccggugauggugaccagcagg

SEQ ID NO: 1181088 - RNA, 19 nt, Mycobacterium bovis subsp bovis AF2122/97
caccgguaacgccaacacc

SEQ ID NO: 1181089 - RNA, 21 nt, Mycobacterium bovis subsp bovis AF2122/97
caccgguacgcaaccaaccgu

SEQ ID NO: 1181090 - RNA, 16 nt, Mycobacterium bovis subsp bovis AF2122/97
caccgcgcgcuccaga

SEQ ID NO: 1181091 - RNA, 16 nt, Mycobacterium bovis subsp bovis AF2122/97
caccgcgcgcucgccc

SEQ ID NO: 1181092 - RNA, 19 nt, Mycobacterium bovis subsp bovis AF2122/97
caccgcgccgcgccgcgcc

SEQ ID NO: 1181093 - RNA, 15 nt, Mycobacterium bovis subsp bovis AF2122/97
caccgcgccggcgga

SEQ ID NO: 1181094 - RNA, 14 nt, Mycobacterium bovis subsp bovis AF2122/97
caccgcgccgagca

SEQ ID NO: 1181095 - RNA, 16 nt, Mycobacterium bovis subsp bovis AF2122/97
caccgcgccgagcaga

SEQ ID NO: 1181096 - RNA, 19 nt, Mycobacterium bovis subsp bovis AF2122/97
caccggcaacaucagcagg

SEQ ID NO: 1181097 - RNA, 13 nt, Mycobacterium bovis subsp bovis AF2122/97
caccggcaccacg

SEQ ID NO: 1181098 - RNA, 23 nt, Mycobacterium bovis subsp bovis AF2122/97
caccggaucgucgaacagcaccg

SEQ ID NO: 1181099 - RNA, 23 nt, Mycobacterium bovis subsp bovis AF2122/97
caccggaugauguggugugccug

SEQ ID NO: 1181100 - RNA, 20 nt, Mycobacterium bovis subsp bovis AF2122/97
caccggaucgucgaacagca

SEQ ID NO: 1181101 - RNA, 15 nt, Mycobacterium bovis subsp bovis AF2122/97
caccggauagguggu

SEQ ID NO: 1181102 - RNA, 17 nt, Mycobacterium bovis subsp bovis AF2122/97
caccggaucgcucccgu

SEQ ID NO: 1181103 - RNA, 15 nt, Mycobacterium bovis subsp bovis AF2122/97
caccggauccacgga

SEQ ID NO: 1181104 - RNA, 19 nt, Mycobacterium bovis subsp bovis AF2122/97
caccggcaccgcugccgcu

SEQ ID NO: 1181105 - RNA, 16 nt, Mycobacterium bovis subsp bovis AF2122/97
caccggcacccccguc

SEQ ID NO: 1181106 - RNA, 15 nt, Mycobacterium bovis subsp bovis AF2122/97
caccggcacccgcac

SEQ ID NO: 1181107 - RNA, 22 nt, Mycobacterium bovis subsp bovis AF2122/97
caccggaggccgccgcgccggu

SEQ ID NO: 1181108 - RNA, 16 nt, Mycobacterium bovis subsp bovis AF2122/97
caccggcccucgccag

SEQ ID NO: 1181109 - RNA, 17 nt, Mycobacterium bovis subsp bovis AF2122/97
caccggccacucgggac

SEQ ID NO: 1181110 - RNA, 12 nt, Mycobacterium bovis subsp bovis AF2122/97
caccggccagcg

SEQ ID NO: 1181111 - RNA, 11 nt, Mycobacterium bovis subsp bovis AF2122/97
cacgcccggcc

SEQ ID NO: 1181112 - RNA, 21 nt, Mycobacterium bovis subsp bovis AF2122/97
cacgccgccgacgugaggguc

SEQ ID NO: 1181113 - RNA, 15 nt, Mycobacterium bovis subsp bovis AF2122/97
cacgcccgacgccag

SEQ ID NO: 1181114 - RNA, 13 nt, Mycobacterium bovis subsp bovis AF2122/97
cacgcccgcgagc

SEQ ID NO: 1181115 - RNA, 14 nt, Mycobacterium bovis subsp bovis AF2122/97
cacgcccaccacug

SEQ ID NO: 1181116 - RNA, 18 nt, Mycobacterium bovis subsp bovis AF2122/97
cacgccauaccggcuggc

SEQ ID NO: 1181117 - RNA, 17 nt, Mycobacterium bovis subsp bovis AF2122/97
cacgccagcucgccggc

SEQ ID NO: 1181118 - RNA, 23 nt, Mycobacterium bovis subsp bovis AF2122/97
cacgccauaccggcuggccaggu

SEQ ID NO: 1181119 - RNA, 21 nt, Mycobacterium bovis subsp bovis AF2122/97
cacgcccaauguccaggcgcg

SEQ ID NO: 1181120 - RNA, 20 nt, Mycobacterium bovis subsp bovis AF2122/97
cacgccaacguugcgccagc

SEQ ID NO: 1181121 - RNA, 15 nt, Mycobacterium bovis subsp bovis AF2122/97
cacgccagccgugcc

SEQ ID NO: 1181122 - RNA, 20 nt, Mycobacterium bovis subsp bovis AF2122/97
cacgccaccgcggucaccga

SEQ ID NO: 1181123 - RNA, 13 nt, Mycobacterium bovis subsp bovis AF2122/97
cacgcagccgcgc

SEQ ID NO: 1181124 - RNA, 12 nt, Mycobacterium bovis subsp bovis AF2122/97
cacgcagagcca

SEQ ID NO: 1181125 - RNA, 14 nt, Mycobacterium bovis subsp bovis AF2122/97
cacgaucacccgga

SEQ ID NO: 1181126 - RNA, 23 nt, Mycobacterium bovis subsp bovis AF2122/97
cacgaucaucgggguggccacca

SEQ ID NO: 1181127 - RNA, 13 nt, Mycobacterium bovis subsp bovis AF2122/97
cacgcacccggca

SEQ ID NO: 1181128 - RNA, 13 nt, Mycobacterium bovis subsp bovis AF2122/97
cacgcacccggcg

SEQ ID NO: 1181129 - RNA, 22 nt, Mycobacterium bovis subsp bovis AF2122/97
cacgcacccggcgcaacaaccg

SEQ ID NO: 1181130 - RNA, 22 nt, Mycobacterium bovis subsp bovis AF2122/97
cacgcacugaugucacccgccc

SEQ ID NO: 1181131 - RNA, 15 nt, Mycobacterium bovis subsp bovis AF2122/97
cacgcaccacaaaca

SEQ ID NO: 1181132 - RNA, 15 nt, Mycobacterium bovis subsp bovis AF2122/97
cacgcacucacuacc

SEQ ID NO: 1181133 - RNA, 16 nt, Mycobacterium bovis subsp bovis AF2122/97
cacgcacucccgagcc

SEQ ID NO: 1181134 - RNA, 20 nt, Mycobacterium bovis subsp bovis AF2122/97
cacgcacucccgagccacaa

SEQ ID NO: 1181135 - RNA, 14 nt, Mycobacterium bovis subsp bovis AF2122/97
cacgcaccgccccg

SEQ ID NO: 1181136 - RNA, 24 nt, Mycobacterium bovis subsp bovis AF2122/97
caccugcgaugaugugcgaccaca

SEQ ID NO: 1181137 - RNA, 18 nt, Mycobacterium bovis subsp bovis AF2122/97
caccugcgcgcggccgcg

SEQ ID NO: 1181138 - RNA, 22 nt, Mycobacterium bovis subsp bovis AF2122/97
caccugccgacucaucggccgc

SEQ ID NO: 1181139 - RNA, 23 nt, Mycobacterium bovis subsp bovis AF2122/97
caccugccgacucaucggccgcg

SEQ ID NO: 1181140 - RNA, 23 nt, Mycobacterium bovis subsp bovis AF2122/97
caccuucgucgcggccgcggccu

SEQ ID NO: 1181141 - RNA, 18 nt, Mycobacterium bovis subsp bovis AF2122/97
caccuucugacgcggccg

SEQ ID NO: 1181142 - RNA, 17 nt, Mycobacterium bovis subsp bovis AF2122/97
caccugcgucggcccgc

SEQ ID NO: 1181143 - RNA, 13 nt, Mycobacterium bovis subsp bovis AF2122/97
caccugcgggccc

SEQ ID NO: 1181144 - RNA, 21 nt, Mycobacterium bovis subsp bovis AF2122/97
caccuugccgaacacucgcag

SEQ ID NO: 1181145 - RNA, 13 nt, Mycobacterium bovis subsp bovis AF2122/97
caccuugccuagc

SEQ ID NO: 1181146 - RNA, 14 nt, Mycobacterium bovis subsp bovis AF2122/97
caccuugcuccaca

SEQ ID NO: 1181147 - RNA, 16 nt, Mycobacterium bovis subsp bovis AF2122/97
caccuugggcagcuug

SEQ ID NO: 1181148 - RNA, 21 nt, Mycobacterium bovis subsp bovis AF2122/97
caccuuggccaggaagucccg

SEQ ID NO: 1181149 - RNA, 14 nt, Mycobacterium bovis subsp bovis AF2122/97
caccuuggccggcc

SEQ ID NO: 1181150 - RNA, 15 nt, Mycobacterium bovis subsp bovis AF2122/97
caccuuggccggccc

SEQ ID NO: 1181151 - RNA, 18 nt, Mycobacterium bovis subsp bovis AF2122/97
caccuuggccggccccgc

SEQ ID NO: 1181152 - RNA, 22 nt, Mycobacterium bovis subsp bovis AF2122/97
caccuuggcugggcccgccguc

SEQ ID NO: 1181153 - RNA, 20 nt, Mycobacterium bovis subsp bovis AF2122/97
caccuuguggacccgccagg

SEQ ID NO: 1181154 - RNA, 17 nt, Mycobacterium bovis subsp bovis AF2122/97
caccuuguggacccgcc

SEQ ID NO: 1181155 - RNA, 14 nt, Mycobacterium bovis subsp bovis AF2122/97
caccuuggacacca

SEQ ID NO: 1181156 - RNA, 13 nt, Mycobacterium bovis subsp bovis AF2122/97
cacgaagugaccc

SEQ ID NO: 1181157 - RNA, 17 nt, Mycobacterium bovis subsp bovis AF2122/97
cacgaagugacccgaac

SEQ ID NO: 1181158 - RNA, 16 nt, Mycobacterium bovis subsp bovis AF2122/97
cacgaccgacaccccg

SEQ ID NO: 1181159 - RNA, 19 nt, Mycobacterium bovis subsp bovis AF2122/97
cacgaccgcgcaacaccuc

SEQ ID NO: 1181160 - RNA, 21 nt, Mycobacterium bovis subsp bovis AF2122/97
cacgaagcuggcgugcagcag

SEQ ID NO: 1181161 - RNA, 17 nt, Mycobacterium bovis subsp bovis AF2122/97
cacgacgugcaggaaca

SEQ ID NO: 1181162 - RNA, 17 nt, Mycobacterium bovis subsp bovis AF2122/97
cacgagucgccagaccg

SEQ ID NO: 1181163 - RNA, 16 nt, Mycobacterium bovis subsp bovis AF2122/97
cacgagucgccagacc

SEQ ID NO: 1181164 - RNA, 16 nt, Mycobacterium bovis subsp bovis AF2122/97
cacgacgaacaccagc

SEQ ID NO: 1181165 - RNA, 22 nt, Mycobacterium bovis subsp bovis AF2122/97
cacgacgccggccuggccgcca

SEQ ID NO: 1181166 - RNA, 18 nt, Mycobacterium bovis subsp bovis AF2122/97
cacgacgacaaccggcca

SEQ ID NO: 1181167 - RNA, 18 nt, Mycobacterium bovis subsp bovis AF2122/97
cacgacgacaucgagcca

SEQ ID NO: 1181168 - RNA, 20 nt, Mycobacterium bovis subsp bovis AF2122/97
cacggcaggcagggcagccc

SEQ ID NO: 1181169 - RNA, 17 nt, Mycobacterium bovis subsp bovis AF2122/97
cacggcaucggccaccu

SEQ ID NO: 1181170 - RNA, 13 nt, Mycobacterium bovis subsp bovis AF2122/97
cacggaccuggaa

SEQ ID NO: 1181171 - RNA, 15 nt, Mycobacterium bovis subsp bovis AF2122/97
cacggacaguucccc

SEQ ID NO: 1181172 - RNA, 13 nt, Mycobacterium bovis subsp bovis AF2122/97
cacggcagccaac

SEQ ID NO: 1181173 - RNA, 14 nt, Mycobacterium bovis subsp bovis AF2122/97
cacggcagcgccca

SEQ ID NO: 1181174 - RNA, 18 nt, Mycobacterium bovis subsp bovis AF2122/97
cacggccagaaacccggc

SEQ ID NO: 1181175 - RNA, 15 nt, Mycobacterium bovis subsp bovis AF2122/97
cacggccgagcaggu

SEQ ID NO: 1181176 - RNA, 22 nt, Mycobacterium bovis subsp bovis AF2122/97
cacggcggcggcguagcagaag

SEQ ID NO: 1181177 - RNA, 14 nt, Mycobacterium bovis subsp bovis AF2122/97
cacggccggccgcu

SEQ ID NO: 1181178 - RNA, 14 nt, Mycobacterium bovis subsp bovis AF2122/97
cacggcggccacgu

SEQ ID NO: 1181179 - RNA, 16 nt, Mycobacterium bovis subsp bovis AF2122/97
cacggcgggcgagcca

SEQ ID NO: 1181180 - RNA, 14 nt, Mycobacterium bovis subsp bovis AF2122/97
cacggcgguguguu

SEQ ID NO: 1181181 - RNA, 18 nt, Mycobacterium bovis subsp bovis AF2122/97
cacggcgguugccccgac

SEQ ID NO: 1181182 - RNA, 17 nt, Mycobacterium bovis subsp bovis AF2122/97
cacggcgucggccaccc

SEQ ID NO: 1181183 - RNA, 18 nt, Mycobacterium bovis subsp bovis AF2122/97
cacggcgucggccaccgc

SEQ ID NO: 1181184 - RNA, 15 nt, Mycobacterium bovis subsp bovis AF2122/97
cacggcgugaccacu

SEQ ID NO: 1181185 - RNA, 14 nt, Mycobacterium bovis subsp bovis AF2122/97
cacggcuagcgccg

SEQ ID NO: 1181186 - RNA, 12 nt, Mycobacterium bovis subsp bovis AF2122/97
cacgcucgcccu

SEQ ID NO: 1181187 - RNA, 20 nt, Mycobacterium bovis subsp bovis AF2122/97
cacgcucggcguccgcccag

SEQ ID NO: 1181188 - RNA, 14 nt, Mycobacterium bovis subsp bovis AF2122/97
cacgcucggcgccg

SEQ ID NO: 1181189 - RNA, 18 nt, Mycobacterium bovis subsp bovis AF2122/97
cacgcucugcgccacagc

SEQ ID NO: 1181190 - RNA, 19 nt, Mycobacterium bovis subsp bovis AF2122/97
cacgcucugcgccacagca

SEQ ID NO: 1181191 - RNA, 22 nt, Mycobacterium bovis subsp bovis AF2122/97
cacgcugaauuccacugcgcca

SEQ ID NO: 1181192 - RNA, 18 nt, Mycobacterium bovis subsp bovis AF2122/97
cacgcugccccgccgcca

SEQ ID NO: 1181193 - RNA, 20 nt, Mycobacterium bovis subsp bovis AF2122/97
cacgcuggccuccagcuugg

SEQ ID NO: 1181194 - RNA, 22 nt, Mycobacterium bovis subsp bovis AF2122/97
cacgcugcccacgggccggccg

SEQ ID NO: 1181195 - RNA, 13 nt, Mycobacterium bovis subsp bovis AF2122/97
cacgcugccccgc

SEQ ID NO: 1181196 - RNA, 20 nt, Mycobacterium bovis subsp bovis AF2122/97
cacggucagcacgcugacca

SEQ ID NO: 1181197 - RNA, 23 nt, Mycobacterium bovis subsp bovis AF2122/97
cacggucaagccggcgcccgccg

SEQ ID NO: 1181198 - RNA, 12 nt, Mycobacterium bovis subsp bovis AF2122/97
cacggucacacg

SEQ ID NO: 1181199 - RNA, 19 nt, Mycobacterium bovis subsp bovis AF2122/97
cacggucacacgccagccg

SEQ ID NO: 1181200 - RNA, 16 nt, Mycobacterium bovis subsp bovis AF2122/97
cacggucauugggugu

SEQ ID NO: 1181201 - RNA, 23 nt, Mycobacterium bovis subsp bovis AF2122/97
cacgguccggcccaccagcgcag

SEQ ID NO: 1181202 - RNA, 17 nt, Mycobacterium bovis subsp bovis AF2122/97
cacggucaugccgccgc

SEQ ID NO: 1181203 - RNA, 16 nt, Mycobacterium bovis subsp bovis AF2122/97
cacggcuguggccgca

SEQ ID NO: 1181204 - RNA, 17 nt, Mycobacterium bovis subsp bovis AF2122/97
cacgguguauuggggug

SEQ ID NO: 1181205 - RNA, 18 nt, Mycobacterium bovis subsp bovis AF2122/97
cacgguggugucagccac

SEQ ID NO: 1181206 - RNA, 19 nt, Mycobacterium bovis subsp bovis AF2122/97
cacgguggccgagccgcgg

SEQ ID NO: 1181207 - RNA, 17 nt, Mycobacterium bovis subsp bovis AF2122/97
cacgguggagcgcgccu

SEQ ID NO: 1181208 - RNA, 17 nt, Mycobacterium bovis subsp bovis AF2122/97
cacggugaucagcagca

SEQ ID NO: 1181209 - RNA, 17 nt, Mycobacterium bovis subsp bovis AF2122/97
cacggugaccacgccgu

SEQ ID NO: 1181210 - RNA, 16 nt, Mycobacterium bovis subsp bovis AF2122/97
cacggugccgccgucg

SEQ ID NO: 1181211 - RNA, 14 nt, Mycobacterium bovis subsp bovis AF2122/97
cacggucgccgacc

SEQ ID NO: 1181212 - RNA, 21 nt, Mycobacterium bovis subsp bovis AF2122/97
cacguagcagcgccggcaccg

SEQ ID NO: 1181213 - RNA, 13 nt, Mycobacterium bovis subsp bovis AF2122/97
cacguaacccagu

SEQ ID NO: 1181214 - RNA, 13 nt, Mycobacterium bovis subsp bovis AF2122/97
cacgguuggcgcu

SEQ ID NO: 1181215 - RNA, 17 nt, Mycobacterium bovis subsp bovis AF2122/97
cacgguugccggcggcg

SEQ ID NO: 1181216 - RNA, 20 nt, Mycobacterium bovis subsp bovis AF2122/97
cacggugucgcgcgaccugg

SEQ ID NO: 1181217 - RNA, 17 nt, Mycobacterium bovis subsp bovis AF2122/97
cacggugucgcgcgacc

SEQ ID NO: 1181218 - RNA, 19 nt, Mycobacterium bovis subsp bovis AF2122/97
cacgguguugcgcacccgc

SEQ ID NO: 1181219 - RNA, 17 nt, Mycobacterium bovis subsp bovis AF2122/97
cacgucaaacaacgcaa

SEQ ID NO: 1181220 - RNA, 20 nt, Mycobacterium bovis subsp bovis AF2122/97
cacguccggcgaugaccaga

SEQ ID NO: 1181221 - RNA, 19 nt, Mycobacterium bovis subsp bovis AF2122/97
cacguccgcgggggaccgc

SEQ ID NO: 1181222 - RNA, 22 nt, Mycobacterium bovis subsp bovis AF2122/97
cacguccgcgggggaccgcccg

SEQ ID NO: 1181223 - RNA, 22 nt, Mycobacterium bovis subsp bovis AF2122/97
cacgucgaccaauaccaguccg

SEQ ID NO: 1181224 - RNA, 22 nt, Mycobacterium bovis subsp bovis AF2122/97
cacgucccgguaauccacucca

SEQ ID NO: 1181225 - RNA, 22 nt, Mycobacterium bovis subsp bovis AF2122/97
cacguccaucaccggcggcccc

SEQ ID NO: 1181226 - RNA, 20 nt, Mycobacterium bovis subsp bovis AF2122/97
auuuccuacggugcagucga

SEQ ID NO: 1181227 - RNA, 20 nt, Mycobacterium bovis subsp bovis AF2122/97
auuucgacgaccaccuucug

SEQ ID NO: 1181228 - RNA, 20 nt, Mycobacterium bovis subsp bovis AF2122/97
auuugccccguugagcagca

SEQ ID NO: 1181229 - RNA, 21 nt, Mycobacterium bovis subsp bovis AF2122/97
auuugccccguugagcagcac

SEQ ID NO: 1181230 - RNA, 24 nt, Mycobacterium bovis subsp bovis AF2122/97
auuugccccguugagcagcaccca

SEQ ID NO: 1181231 - RNA, 17 nt, Mycobacterium bovis subsp bovis AF2122/97
auuugccuugagccgcc

SEQ ID NO: 1181232 - RNA, 15 nt, Mycobacterium bovis subsp bovis AF2122/97
auuuggugguguuca

SEQ ID NO: 1181233 - RNA, 21 nt, Mycobacterium bovis subsp bovis AF2122/97
auuuggugaagccguagacgu

SEQ ID NO: 1181234 - RNA, 14 nt, Mycobacterium bovis subsp bovis AF2122/97
auuugucggcgccu

SEQ ID NO: 1181235 - RNA, 22 nt, Mycobacterium bovis subsp bovis AF2122/97
caaaaaccagcguccaacccag

SEQ ID NO: 1181236 - RNA, 20 nt, Mycobacterium bovis subsp bovis AF2122/97
caaaaaucgucggaaucauc

SEQ ID NO: 1181237 - RNA, 19 nt, Mycobacterium bovis subsp bovis AF2122/97
auuuucucggggugguggu

SEQ ID NO: 1181238 - RNA, 14 nt, Mycobacterium bovis subsp bovis AF2122/97
auuggacgcugccg

SEQ ID NO: 1181239 - RNA, 20 nt, Mycobacterium bovis subsp bovis AF2122/97
auuggaugccauaggacagg

SEQ ID NO: 1181240 - RNA, 22 nt, Mycobacterium bovis subsp bovis AF2122/97
auuggcccgucacgcccgcgaa

SEQ ID NO: 1181241 - RNA, 11 nt, Mycobacterium bovis subsp bovis AF2122/97
auuggccaggu

SEQ ID NO: 1181242 - RNA, 14 nt, Mycobacterium bovis subsp bovis AF2122/97
auuggcgaucagca

SEQ ID NO: 1181243 - RNA, 16 nt, Mycobacterium bovis subsp bovis AF2122/97
auugucaacgaauggu

SEQ ID NO: 1181244 - RNA, 13 nt, Mycobacterium bovis subsp bovis AF2122/97
auugguugaggag

SEQ ID NO: 1181245 - RNA, 12 nt, Mycobacterium bovis subsp bovis AF2122/97
auugcgcuucca

SEQ ID NO: 1181246 - RNA, 17 nt, Mycobacterium bovis subsp bovis AF2122/97
auugcgcggccauggca

SEQ ID NO: 1181247 - RNA, 19 nt, Mycobacterium bovis subsp bovis AF2122/97
auugcgcgcugagcucgau

SEQ ID NO: 1181248 - RNA, 21 nt, Mycobacterium bovis subsp bovis AF2122/97
auugcgcccagcgacccggcc

SEQ ID NO: 1181249 - RNA, 13 nt, Mycobacterium bovis subsp bovis AF2122/97
auugcgcccggcc

SEQ ID NO: 1181250 - RNA, 17 nt, Mycobacterium bovis subsp bovis AF2122/97
auugauacugcccgcgu

SEQ ID NO: 1181251 - RNA, 21 nt, Mycobacterium bovis subsp bovis AF2122/97
auuccggcggagcgggccagc

SEQ ID NO: 1181252 - RNA, 16 nt, Mycobacterium bovis subsp bovis AF2122/97
auuccggcggccacgc

SEQ ID NO: 1181253 - RNA, 17 nt, Mycobacterium bovis subsp bovis AF2122/97
auuccggcgcggccggc

SEQ ID NO: 1181254 - RNA, 14 nt, Mycobacterium bovis subsp bovis AF2122/97
auuccgggccuggc

SEQ ID NO: 1181255 - RNA, 12 nt, Mycobacterium bovis subsp bovis AF2122/97
auuccgcagaga

SEQ ID NO: 1181256 - RNA, 13 nt, Mycobacterium bovis subsp bovis AF2122/97
auuccgcagagac

SEQ ID NO: 1181257 - RNA, 15 nt, Mycobacterium bovis subsp bovis AF2122/97
auuccccagccgcau

SEQ ID NO: 1181258 - RNA, 17 nt, Mycobacterium bovis subsp bovis AF2122/97
auuccgaguuguucagc

SEQ ID NO: 1181259 - RNA, 14 nt, Mycobacterium bovis subsp bovis AF2122/97
auuccagccccccg

SEQ ID NO: 1181260 - RNA, 14 nt, Mycobacterium bovis subsp bovis AF2122/97
auuccagaucaacg

SEQ ID NO: 1181261 - RNA, 19 nt, Mycobacterium bovis subsp bovis AF2122/97
auuccagcggaagcgguug

SEQ ID NO: 1181262 - RNA, 18 nt, Mycobacterium bovis subsp bovis AF2122/97
auucggccagcgcccgca

SEQ ID NO: 1181263 - RNA, 17 nt, Mycobacterium bovis subsp bovis AF2122/97
auucggcugccaccgca

SEQ ID NO: 1181264 - RNA, 18 nt, Mycobacterium bovis subsp bovis AF2122/97
auucguuuguagucacgg

SEQ ID NO: 1181265 - RNA, 12 nt, Mycobacterium bovis subsp bovis AF2122/97
auucgccgggcg

SEQ ID NO: 1181266 - RNA, 19 nt, Mycobacterium bovis subsp bovis AF2122/97
auucuguugugccgcaagc

SEQ ID NO: 1181267 - RNA, 19 nt, Mycobacterium bovis subsp bovis AF2122/97
auugaccaccgauauggcc

SEQ ID NO: 1181268 - RNA, 12 nt, Mycobacterium bovis subsp bovis AF2122/97
auugacccgacg

SEQ ID NO: 1181269 - RNA, 18 nt, Mycobacterium bovis subsp bovis AF2122/97
auugagcucagguucagc

SEQ ID NO: 1181270 - RNA, 18 nt, Mycobacterium bovis subsp bovis AF2122/97
auugagcagcaagccgcc

SEQ ID NO: 1181271 - RNA, 16 nt, Mycobacterium bovis subsp bovis AF2122/97
augcagguggagugca

SEQ ID NO: 1181272 - RNA, 18 nt, Mycobacterium bovis subsp bovis AF2122/97
augcauccagcugcugcc

SEQ ID NO: 1181273 - RNA, 17 nt, Mycobacterium bovis subsp bovis AF2122/97
augcaccucgcccugca

SEQ ID NO: 1181274 - RNA, 20 nt, Mycobacterium bovis subsp bovis AF2122/97
augcaccucgcccugcagac

SEQ ID NO: 1181275 - RNA, 20 nt, Mycobacterium bovis subsp bovis AF2122/97
augcacgucgagcaggcugg

SEQ ID NO: 1181276 - RNA, 20 nt, Mycobacterium bovis subsp bovis AF2122/97
augccgggaaccaacaccag

SEQ ID NO: 1181277 - RNA, 15 nt, Mycobacterium bovis subsp bovis AF2122/97
augccggcgagggcc

SEQ ID NO: 1181278 - RNA, 15 nt, Mycobacterium bovis subsp bovis AF2122/97
augccggaucgggac

SEQ ID NO: 1181279 - RNA, 21 nt, Mycobacterium bovis subsp bovis AF2122/97
augcccgcugaucagauccuc

SEQ ID NO: 1181280 - RNA, 21 nt, Mycobacterium bovis subsp bovis AF2122/97
augcccugcgcucgggcugcc

SEQ ID NO: 1181281 - RNA, 14 nt, Mycobacterium bovis subsp bovis AF2122/97
augcccuuggccag

SEQ ID NO: 1181282 - RNA, 17 nt, Mycobacterium bovis subsp bovis AF2122/97
augcccuuggccagcag

SEQ ID NO: 1181283 - RNA, 16 nt, Mycobacterium bovis subsp bovis AF2122/97
augcccgccguagacc

SEQ ID NO: 1181284 - RNA, 19 nt, Mycobacterium bovis subsp bovis AF2122/97
augcccgccguagaccagc

SEQ ID NO: 1181285 - RNA, 19 nt, Mycobacterium bovis subsp bovis AF2122/97
augcccacgcugccgcagu

SEQ ID NO: 1181286 - RNA, 22 nt, Mycobacterium bovis subsp bovis AF2122/97
augcccacgcugccgcaguuca

SEQ ID NO: 1181287 - RNA, 20 nt, Mycobacterium bovis subsp bovis AF2122/97
augccaggacuggcaccgcc

SEQ ID NO: 1181288 - RNA, 13 nt, Mycobacterium bovis subsp bovis AF2122/97
augcggucccucc

SEQ ID NO: 1181289 - RNA, 19 nt, Mycobacterium bovis subsp bovis AF2122/97
augcggguaaaccaggugg

SEQ ID NO: 1181290 - RNA, 19 nt, Mycobacterium bovis subsp bovis AF2122/97
augcgggccgccaggcggc

SEQ ID NO: 1181291 - RNA, 16 nt, Mycobacterium bovis subsp bovis AF2122/97
augcgggccgccaggc

SEQ ID NO: 1181292 - RNA, 17 nt, Mycobacterium bovis subsp bovis AF2122/97
augcgggccgccaggcg

SEQ ID NO: 1181293 - RNA, 17 nt, Mycobacterium bovis subsp bovis AF2122/97
augcgggaaacccaugc

SEQ ID NO: 1181294 - RNA, 14 nt, Mycobacterium bovis subsp bovis AF2122/97
augcggccccgaca

SEQ ID NO: 1181295 - RNA, 20 nt, Mycobacterium bovis subsp bovis AF2122/97
augcggcccggguggcccgg

SEQ ID NO: 1181296 - RNA, 13 nt, Mycobacterium bovis subsp bovis AF2122/97
augcggcccucga

SEQ ID NO: 1181297 - RNA, 23 nt, Mycobacterium bovis subsp bovis AF2122/97
augcggcccucgaauucggccgg

SEQ ID NO: 1181298 - RNA, 20 nt, Mycobacterium bovis subsp bovis AF2122/97
augcgguucucgagcucggc

SEQ ID NO: 1181299 - RNA, 22 nt, Mycobacterium bovis subsp bovis AF2122/97
augcggugguaggacgccagca

SEQ ID NO: 1181300 - RNA, 16 nt, Mycobacterium bovis subsp bovis AF2122/97
augcgguuagcagccg

SEQ ID NO: 1181301 - RNA, 14 nt, Mycobacterium bovis subsp bovis AF2122/97
augcgucugcucgc

SEQ ID NO: 1181302 - RNA, 22 nt, Mycobacterium bovis subsp bovis AF2122/97
augcggaugucgucgaccaggc

SEQ ID NO: 1181303 - RNA, 20 nt, Mycobacterium bovis subsp bovis AF2122/97
augcggaucacaucggccau

SEQ ID NO: 1181304 - RNA, 18 nt, Mycobacterium bovis subsp bovis AF2122/97
augcgcuuccaucgccac

SEQ ID NO: 1181305 - RNA, 15 nt, Mycobacterium bovis subsp bovis AF2122/97
augcggaaaucggac

SEQ ID NO: 1181306 - RNA, 18 nt, Mycobacterium bovis subsp bovis AF2122/97
augcgcuggcgccgccgg

SEQ ID NO: 1181307 - RNA, 12 nt, Mycobacterium bovis subsp bovis AF2122/97
augcgcugggcc

SEQ ID NO: 1181308 - RNA, 16 nt, Mycobacterium bovis subsp bovis AF2122/97
augcgcugggccaggg

SEQ ID NO: 1181309 - RNA, 17 nt, Mycobacterium bovis subsp bovis AF2122/97
augcgcaccaguccagc

SEQ ID NO: 1181310 - RNA, 17 nt, Mycobacterium bovis subsp bovis AF2122/97
augcgcagugcaccgcg

SEQ ID NO: 1181311 - RNA, 16 nt, Mycobacterium bovis subsp bovis AF2122/97
augcgcuaggugcgaa

SEQ ID NO: 1181312 - RNA, 22 nt, Mycobacterium bovis subsp bovis AF2122/97
augcgcaacuucuucagcagcg

SEQ ID NO: 1181313 - RNA, 15 nt, Mycobacterium bovis subsp bovis AF2122/97
augccgugccgggcc

SEQ ID NO: 1181314 - RNA, 20 nt, Mycobacterium bovis subsp bovis AF2122/97
augccguugagugggagcua

SEQ ID NO: 1181315 - RNA, 15 nt, Mycobacterium bovis subsp bovis AF2122/97
augcucacgaucacc

SEQ ID NO: 1181316 - RNA, 17 nt, Mycobacterium bovis subsp bovis AF2122/97
augcucaggucaccggc

SEQ ID NO: 1181317 - RNA, 21 nt, Mycobacterium bovis subsp bovis AF2122/97
augcuaggcaugccacacacu

SEQ ID NO: 1181318 - RNA, 14 nt, Mycobacterium bovis subsp bovis AF2122/97
augcguucggccgg

SEQ ID NO: 1181319 - RNA, 21 nt, Mycobacterium bovis subsp bovis AF2122/97
auggccagguuguagacggca

SEQ ID NO: 1181320 - RNA, 22 nt, Mycobacterium bovis subsp bovis AF2122/97
auggccaccgaacgcggccacc

SEQ ID NO: 1181321 - RNA, 12 nt, Mycobacterium bovis subsp bovis AF2122/97
auggccagcauc

SEQ ID NO: 1181322 - RNA, 20 nt, Mycobacterium bovis subsp bovis AF2122/97
auggccacccgguggcguuu

SEQ ID NO: 1181323 - RNA, 16 nt, Mycobacterium bovis subsp bovis AF2122/97
auggcgccgcggcugg

SEQ ID NO: 1181324 - RNA, 22 nt, Mycobacterium bovis subsp bovis AF2122/97
auggcgcgaauggcggacaggg

SEQ ID NO: 1181325 - RNA, 14 nt, Mycobacterium bovis subsp bovis AF2122/97
augcuggcagcucg

SEQ ID NO: 1181326 - RNA, 23 nt, Mycobacterium bovis subsp bovis AF2122/97
augcuggcggcgcgacaggugcu

SEQ ID NO: 1181327 - RNA, 21 nt, Mycobacterium bovis subsp bovis AF2122/97
augcuggggccuggucccacc

SEQ ID NO: 1181328 - RNA, 23 nt, Mycobacterium bovis subsp bovis AF2122/97
augcugggcccgccagcccagca

SEQ ID NO: 1181329 - RNA, 24 nt, Mycobacterium bovis subsp bovis AF2122/97
auggcggccaccgucagcgcgacc

SEQ ID NO: 1181330 - RNA, 12 nt, Mycobacterium bovis subsp bovis AF2122/97
auggcggccacc

SEQ ID NO: 1181331 - RNA, 24 nt, Mycobacterium bovis subsp bovis AF2122/97
auggcggcauagccgaacagcgga

SEQ ID NO: 1181332 - RNA, 20 nt, Mycobacterium bovis subsp bovis AF2122/97
auggcggucggccugcggca

SEQ ID NO: 1181333 - RNA, 13 nt, Mycobacterium bovis subsp bovis AF2122/97
auggcuuggacca

SEQ ID NO: 1181334 - RNA, 22 nt, Mycobacterium bovis subsp bovis AF2122/97
augggaccuugaucgagcaggg

SEQ ID NO: 1181335 - RNA, 18 nt, Mycobacterium bovis subsp bovis AF2122/97
augggcccugcacagcag

SEQ ID NO: 1181336 - RNA, 14 nt, Mycobacterium bovis subsp bovis AF2122/97
augggagucccacc

SEQ ID NO: 1181337 - RNA, 14 nt, Mycobacterium bovis subsp bovis AF2122/97
augggauaccccuc

SEQ ID NO: 1181338 - RNA, 19 nt, Mycobacterium bovis subsp bovis AF2122/97
augggcagaucgauaccgu

SEQ ID NO: 1181339 - RNA, 15 nt, Mycobacterium bovis subsp bovis AF2122/97
augggcagccgcccg

SEQ ID NO: 1181340 - RNA, 22 nt, Mycobacterium bovis subsp bovis AF2122/97
augggcagccgcccgcccaccu

SEQ ID NO: 1181341 - RNA, 15 nt, Mycobacterium bovis subsp bovis AF2122/97
augggucaccucgga

SEQ ID NO: 1181342 - RNA, 22 nt, Mycobacterium bovis subsp bovis AF2122/97
augguaugcccgccguagacca

SEQ ID NO: 1181343 - RNA, 20 nt, Mycobacterium bovis subsp bovis AF2122/97
auggugaaggcaaacaccag

SEQ ID NO: 1181344 - RNA, 21 nt, Mycobacterium bovis subsp bovis AF2122/97
auggugaacgcgaauaccaga

SEQ ID NO: 1181345 - RNA, 16 nt, Mycobacterium bovis subsp bovis AF2122/97
auggucguaggguggg

SEQ ID NO: 1181346 - RNA, 13 nt, Mycobacterium bovis subsp bovis AF2122/97
auggucuccacca

SEQ ID NO: 1181347 - RNA, 21 nt, Mycobacterium bovis subsp bovis AF2122/97
auggucucccggcugaugccu

SEQ ID NO: 1181348 - RNA, 11 nt, Mycobacterium bovis subsp bovis AF2122/97
auggucagcag

SEQ ID NO: 1181349 - RNA, 15 nt, Mycobacterium bovis subsp bovis AF2122/97
auguaggcuucgccg

SEQ ID NO: 1181350 - RNA, 12 nt, Mycobacterium bovis subsp bovis AF2122/97
auguacugugcc

SEQ ID NO: 1181351 - RNA, 23 nt, Mycobacterium bovis subsp bovis AF2122/97
auguaaccguagcccugcucagc

SEQ ID NO: 1181352 - RNA, 14 nt, Mycobacterium bovis subsp bovis AF2122/97
augucacccucccg

SEQ ID NO: 1181353 - RNA, 20 nt, Mycobacterium bovis subsp bovis AF2122/97
augucacggaugugcucagg

SEQ ID NO: 1181354 - RNA, 20 nt, Mycobacterium bovis subsp bovis AF2122/97
augucaacgugucccaagcc

SEQ ID NO: 1181355 - RNA, 14 nt, Mycobacterium bovis subsp bovis AF2122/97
auguccagguggcg

SEQ ID NO: 1181356 - RNA, 18 nt, Mycobacterium bovis subsp bovis AF2122/97
augucagcggccugcucg

SEQ ID NO: 1181357 - RNA, 14 nt, Mycobacterium bovis subsp bovis AF2122/97
auucacgcaccaca

SEQ ID NO: 1181358 - RNA, 17 nt, Mycobacterium bovis subsp bovis AF2122/97
auucacgacgccgagca

SEQ ID NO: 1181359 - RNA, 22 nt, Mycobacterium bovis subsp bovis AF2122/97
auucagcggcaacgaucgacac

SEQ ID NO: 1181360 - RNA, 15 nt, Mycobacterium bovis subsp bovis AF2122/97
auucaccacuccggc

SEQ ID NO: 1181361 - RNA, 16 nt, Mycobacterium bovis subsp bovis AF2122/97
auucaacagcaccgcg

SEQ ID NO: 1181362 - RNA, 23 nt, Mycobacterium bovis subsp bovis AF2122/97
auguccgacgccaccgccaccac

SEQ ID NO: 1181363 - RNA, 22 nt, Mycobacterium bovis subsp bovis AF2122/97
auguccuauuugcagccuucga

SEQ ID NO: 1181364 - RNA, 17 nt, Mycobacterium bovis subsp bovis AF2122/97
auguccugggccgccgc

SEQ ID NO: 1181365 - RNA, 14 nt, Mycobacterium bovis subsp bovis AF2122/97
auguugcagaacuc

SEQ ID NO: 1181366 - RNA, 14 nt, Mycobacterium bovis subsp bovis AF2122/97
auguuguucagcag

SEQ ID NO: 1181367 - RNA, 15 nt, Mycobacterium bovis subsp bovis AF2122/97
auguuggugaucaaa

SEQ ID NO: 1181368 - RNA, 20 nt, Mycobacterium bovis subsp bovis AF2122/97
auguuggcgaaugcggcccc

SEQ ID NO: 1181369 - RNA, 14 nt, Mycobacterium bovis subsp bovis AF2122/97
aaaagcaucaaagc

SEQ ID NO: 1181370 - RNA, 18 nt, Mycobacterium bovis subsp bovis AF2122/97
aucuucggacgccagcuc

SEQ ID NO: 1181371 - RNA, 20 nt, Mycobacterium bovis subsp bovis AF2122/97
aucuuuccggcguauagccc

SEQ ID NO: 1181372 - RNA, 20 nt, Mycobacterium bovis subsp bovis AF2122/97
aucuuuucaccaccucgguu

SEQ ID NO: 1181373 - RNA, 20 nt, Mycobacterium bovis subsp bovis AF2122/97
augaacgcaaccgagggcau

SEQ ID NO: 1181374 - RNA, 15 nt, Mycobacterium bovis subsp bovis AF2122/97
augaaccaggcggcc

SEQ ID NO: 1181375 - RNA, 17 nt, Mycobacterium bovis subsp bovis AF2122/97
augaaccgggcagcaaa

SEQ ID NO: 1181376 - RNA, 22 nt, Mycobacterium bovis subsp bovis AF2122/97
augaaccacggcaggcagggca

SEQ ID NO: 1181377 - RNA, 22 nt, Mycobacterium bovis subsp bovis AF2122/97
augaacagcgacgccaugguca

SEQ ID NO: 1181378 - RNA, 16 nt, Mycobacterium bovis subsp bovis AF2122/97
augacguugcagccgg

SEQ ID NO: 1181379 - RNA, 17 nt, Mycobacterium bovis subsp bovis AF2122/97
augacguugcagccggc

SEQ ID NO: 1181380 - RNA, 19 nt, Mycobacterium bovis subsp bovis AF2122/97
augacugggcaaacccgga

SEQ ID NO: 1181381 - RNA, 16 nt, Mycobacterium bovis subsp bovis AF2122/97
augagcggcgcggcaa

SEQ ID NO: 1181382 - RNA, 21 nt, Mycobacterium bovis subsp bovis AF2122/97
augagcgcucgggcaaccgga

SEQ ID NO: 1181383 - RNA, 23 nt, Mycobacterium bovis subsp bovis AF2122/97
augagguucaucgccggcgcgcc

SEQ ID NO: 1181384 - RNA, 15 nt, Mycobacterium bovis subsp bovis AF2122/97
augaucccgccaccg

SEQ ID NO: 1181385 - RNA, 22 nt, Mycobacterium bovis subsp bovis AF2122/97
aucucgccggcgaagaccgccg

SEQ ID NO: 1181386 - RNA, 18 nt, Mycobacterium bovis subsp bovis AF2122/97
aucucgaccggcuugccc

SEQ ID NO: 1181387 - RNA, 16 nt, Mycobacterium bovis subsp bovis AF2122/97
aucucgacaucggcca

SEQ ID NO: 1181388 - RNA, 18 nt, Mycobacterium bovis subsp bovis AF2122/97
aucucgaccagcgccgau

SEQ ID NO: 1181389 - RNA, 18 nt, Mycobacterium bovis subsp bovis AF2122/97
aucucgacggccucgucg

SEQ ID NO: 1181390 - RNA, 14 nt, Mycobacterium bovis subsp bovis AF2122/97
aucucgagccgcgg

SEQ ID NO: 1181391 - RNA, 20 nt, Mycobacterium bovis subsp bovis AF2122/97
aucucgcccaccuccugguu

SEQ ID NO: 1181392 - RNA, 20 nt, Mycobacterium bovis subsp bovis AF2122/97
aucucgccccagugcucauc

SEQ ID NO: 1181393 - RNA, 13 nt, Mycobacterium bovis subsp bovis AF2122/97
aucucgcaccgcg

SEQ ID NO: 1181394 - RNA, 20 nt, Mycobacterium bovis subsp bovis AF2122/97
aucuccaccgucgccgccgg

SEQ ID NO: 1181395 - RNA, 15 nt, Mycobacterium bovis subsp bovis AF2122/97
aucuccaccuucugg

SEQ ID NO: 1181396 - RNA, 22 nt, Mycobacterium bovis subsp bovis AF2122/97
aucuccuuggccguucggcgcc

SEQ ID NO: 1181397 - RNA, 19 nt, Mycobacterium bovis subsp bovis AF2122/97
aucgucaggaaccacccac

SEQ ID NO: 1181398 - RNA, 13 nt, Mycobacterium bovis subsp bovis AF2122/97
aucgucaggaacc

SEQ ID NO: 1181399 - RNA, 18 nt, Mycobacterium bovis subsp bovis AF2122/97
aucuggcuggugauggcc

SEQ ID NO: 1181400 - RNA, 22 nt, Mycobacterium bovis subsp bovis AF2122/97
aucuggcguagugcucgccggc

SEQ ID NO: 1181401 - RNA, 16 nt, Mycobacterium bovis subsp bovis AF2122/97
aucuggccuuggcagu

SEQ ID NO: 1181402 - RNA, 23 nt, Mycobacterium bovis subsp bovis AF2122/97
aucuggggguagccgccggcgcc

SEQ ID NO: 1181403 - RNA, 15 nt, Mycobacterium bovis subsp bovis AF2122/97
aucuguaaccuccuc

SEQ ID NO: 1181404 - RNA, 16 nt, Mycobacterium bovis subsp bovis AF2122/97
aucuguaaccuccucg

SEQ ID NO: 1181405 - RNA, 13 nt, Mycobacterium bovis subsp bovis AF2122/97
aucugcuccucgg

SEQ ID NO: 1181406 - RNA, 14 nt, Mycobacterium bovis subsp bovis AF2122/97
aucugcgccaucac

SEQ ID NO: 1181407 - RNA, 19 nt, Mycobacterium bovis subsp bovis AF2122/97
aucugcgcgucaggccagc

SEQ ID NO: 1181408 - RNA, 20 nt, Mycobacterium bovis subsp bovis AF2122/97
aucugaaaauugacccccua

SEQ ID NO: 1181409 - RNA, 14 nt, Mycobacterium bovis subsp bovis AF2122/97
aucugacggcgccg

SEQ ID NO: 1181410 - RNA, 23 nt, Mycobacterium bovis subsp bovis AF2122/97
auccacugccgcgcgcccgccuc

SEQ ID NO: 1181411 - RNA, 17 nt, Mycobacterium bovis subsp bovis AF2122/97
auccacuugaaguucuu

SEQ ID NO: 1181412 - RNA, 15 nt, Mycobacterium bovis subsp bovis AF2122/97
auccagaaguaggcg

SEQ ID NO: 1181413 - RNA, 18 nt, Mycobacterium bovis subsp bovis AF2122/97
auccagaaguaggcgacc

SEQ ID NO: 1181414 - RNA, 18 nt, Mycobacterium bovis subsp bovis AF2122/97
auccaaggcucagcagcg

SEQ ID NO: 1181415 - RNA, 20 nt, Mycobacterium bovis subsp bovis AF2122/97
aucauuacucaacaguucac

SEQ ID NO: 1181416 - RNA, 19 nt, Mycobacterium bovis subsp bovis AF2122/97
auccagguugaggugugcc

SEQ ID NO: 1181417 - RNA, 14 nt, Mycobacterium bovis subsp bovis AF2122/97
auccaggcccagcc

SEQ ID NO: 1181418 - RNA, 21 nt, Mycobacterium bovis subsp bovis AF2122/97
auccccgguucugcgcccacc

SEQ ID NO: 1181419 - RNA, 13 nt, Mycobacterium bovis subsp bovis AF2122/97
aucccggccaggc

SEQ ID NO: 1181420 - RNA, 21 nt, Mycobacterium bovis subsp bovis AF2122/97
aucccggccgaguaccagccc

SEQ ID NO: 1181421 - RNA, 22 nt, Mycobacterium bovis subsp bovis AF2122/97
aucccggccgaguaccagccca

SEQ ID NO: 1181422 - RNA, 20 nt, Mycobacterium bovis subsp bovis AF2122/97
auccccgccggcgccaccgu

SEQ ID NO: 1181423 - RNA, 15 nt, Mycobacterium bovis subsp bovis AF2122/97
auccccgcaauuccc

SEQ ID NO: 1181424 - RNA, 19 nt, Mycobacterium bovis subsp bovis AF2122/97
aucccagauaugcaggacu

SEQ ID NO: 1181425 - RNA, 21 nt, Mycobacterium bovis subsp bovis AF2122/97
aucccaggggcaccgagcuga

SEQ ID NO: 1181426 - RNA, 16 nt, Mycobacterium bovis subsp bovis AF2122/97
auccgcacgcaaugcg

SEQ ID NO: 1181427 - RNA, 19 nt, Mycobacterium bovis subsp bovis AF2122/97
auccgcaccgaaaccaugc

SEQ ID NO: 1181428 - RNA, 14 nt, Mycobacterium bovis subsp bovis AF2122/97
auccgagcgguggu

SEQ ID NO: 1181429 - RNA, 13 nt, Mycobacterium bovis subsp bovis AF2122/97
auccgaccugcuc

SEQ ID NO: 1181430 - RNA, 13 nt, Mycobacterium bovis subsp bovis AF2122/97
auccgaccacucc

SEQ ID NO: 1181431 - RNA, 19 nt, Mycobacterium bovis subsp bovis AF2122/97
auccgccgcccccgcccgu

SEQ ID NO: 1181432 - RNA, 13 nt, Mycobacterium bovis subsp bovis AF2122/97
auccgcccuugcc

SEQ ID NO: 1181433 - RNA, 23 nt, Mycobacterium bovis subsp bovis AF2122/97
auccgccgacagcccacgaaugc

SEQ ID NO: 1181434 - RNA, 12 nt, Mycobacterium bovis subsp bovis AF2122/97
auccgccgccgg

SEQ ID NO: 1181435 - RNA, 15 nt, Mycobacterium bovis subsp bovis AF2122/97
auccgccccgcccgc

SEQ ID NO: 1181436 - RNA, 14 nt, Mycobacterium bovis subsp bovis AF2122/97
aucccggccaggcc

SEQ ID NO: 1181437 - RNA, 23 nt, Mycobacterium bovis subsp bovis AF2122/97
aucccggucgguguggacugggc

SEQ ID NO: 1181438 - RNA, 17 nt, Mycobacterium bovis subsp bovis AF2122/97
aucccgguggcagcaca

SEQ ID NO: 1181439 - RNA, 14 nt, Mycobacterium bovis subsp bovis AF2122/97
aucgcggccgcugg

SEQ ID NO: 1181440 - RNA, 19 nt, Mycobacterium bovis subsp bovis AF2122/97
aucgcggacccgucggcgu

SEQ ID NO: 1181441 - RNA, 16 nt, Mycobacterium bovis subsp bovis AF2122/97
aucgcggaagcgggcg

SEQ ID NO: 1181442 - RNA, 17 nt, Mycobacterium bovis subsp bovis AF2122/97
aucgcgcggaccagagu

SEQ ID NO: 1181443 - RNA, 16 nt, Mycobacterium bovis subsp bovis AF2122/97
aucgcgccuauccaaa

SEQ ID NO: 1181444 - RNA, 19 nt, Mycobacterium bovis subsp bovis AF2122/97
aucgcggcggccuccacca

SEQ ID NO: 1181445 - RNA, 17 nt, Mycobacterium bovis subsp bovis AF2122/97
aucgcggcgcccaggaa

SEQ ID NO: 1181446 - RNA, 13 nt, Mycobacterium bovis subsp bovis AF2122/97
aucgcccugggcg

SEQ ID NO: 1181447 - RNA, 16 nt, Mycobacterium bovis subsp bovis AF2122/97
aucgccgacagcgccu

SEQ ID NO: 1181448 - RNA, 16 nt, Mycobacterium bovis subsp bovis AF2122/97
aucgcccggccccgca

SEQ ID NO: 1181449 - RNA, 21 nt, Mycobacterium bovis subsp bovis AF2122/97
aucgccaggcccugaaucuug

SEQ ID NO: 1181450 - RNA, 23 nt, Mycobacterium bovis subsp bovis AF2122/97
aucgcccucgucgcgggccaccg

SEQ ID NO: 1181451 - RNA, 19 nt, Mycobacterium bovis subsp bovis AF2122/97
aucgcccugacacccaucg

SEQ ID NO: 1181452 - RNA, 21 nt, Mycobacterium bovis subsp bovis AF2122/97
aucgccaggccgagcccggug

SEQ ID NO: 1181453 - RNA, 22 nt, Mycobacterium bovis subsp bovis AF2122/97
aucgcuccggcccugccgccgg

SEQ ID NO: 1181454 - RNA, 21 nt, Mycobacterium bovis subsp bovis AF2122/97
aucgcucucggucaguuccuc

SEQ ID NO: 1181455 - RNA, 17 nt, Mycobacterium bovis subsp bovis AF2122/97
aucggcagucccagcgc

SEQ ID NO: 1181456 - RNA, 21 nt, Mycobacterium bovis subsp bovis AF2122/97
aucggcaggguggccagcagg

SEQ ID NO: 1181457 - RNA, 20 nt, Mycobacterium bovis subsp bovis AF2122/97
aucggccccgaaacgauggc

SEQ ID NO: 1181458 - RNA, 12 nt, Mycobacterium bovis subsp bovis AF2122/97
aucggcagcagg

SEQ ID NO: 1181459 - RNA, 19 nt, Mycobacterium bovis subsp bovis AF2122/97
aucggacagcgccuggccg

SEQ ID NO: 1181460 - RNA, 23 nt, Mycobacterium bovis subsp bovis AF2122/97
aucgguggucgauggacaacagc

SEQ ID NO: 1181461 - RNA, 14 nt, Mycobacterium bovis subsp bovis AF2122/97
aucggugguggcgu

SEQ ID NO: 1181462 - RNA, 20 nt, Mycobacterium bovis subsp bovis AF2122/97
aucggugaccguggcgggga

SEQ ID NO: 1181463 - RNA, 15 nt, Mycobacterium bovis subsp bovis AF2122/97
aucgguccaaagcac

SEQ ID NO: 1181464 - RNA, 22 nt, Mycobacterium bovis subsp bovis AF2122/97
aucggugcacaacgcccaccac

SEQ ID NO: 1181465 - RNA, 16 nt, Mycobacterium bovis subsp bovis AF2122/97
aucgggucacccccgg

SEQ ID NO: 1181466 - RNA, 21 nt, Mycobacterium bovis subsp bovis AF2122/97
aucgggucacccccggccagc

SEQ ID NO: 1181467 - RNA, 17 nt, Mycobacterium bovis subsp bovis AF2122/97
aucggguucuucaacuc

SEQ ID NO: 1181468 - RNA, 15 nt, Mycobacterium bovis subsp bovis AF2122/97
aucgguugcacccgc

SEQ ID NO: 1181469 - RNA, 17 nt, Mycobacterium bovis subsp bovis AF2122/97
aucggcgcaaucaacgu

SEQ ID NO: 1181470 - RNA, 23 nt, Mycobacterium bovis subsp bovis AF2122/97
aucggcgaggccucggcggccgu

SEQ ID NO: 1181471 - RNA, 21 nt, Mycobacterium bovis subsp bovis AF2122/97
aucggccggcgucagccccga

SEQ ID NO: 1181472 - RNA, 22 nt, Mycobacterium bovis subsp bovis AF2122/97
aucggccuguccaccgaugcca

SEQ ID NO: 1181473 - RNA, 14 nt, Mycobacterium bovis subsp bovis AF2122/97
aucggcggaccgca

SEQ ID NO: 1181474 - RNA, 19 nt, Mycobacterium bovis subsp bovis AF2122/97
aucggcggcguccagcagc

SEQ ID NO: 1181475 - RNA, 17 nt, Mycobacterium bovis subsp bovis AF2122/97
aucggcggggcccacac

SEQ ID NO: 1181476 - RNA, 13 nt, Mycobacterium bovis subsp bovis AF2122/97
aucggcuaccuaa

SEQ ID NO: 1181477 - RNA, 23 nt, Mycobacterium bovis subsp bovis AF2122/97
aucggcuaccuaacccgcaccgg

SEQ ID NO: 1181478 - RNA, 15 nt, Mycobacterium bovis subsp bovis AF2122/97
aucggcuaggccggc

SEQ ID NO: 1181479 - RNA, 15 nt, Mycobacterium bovis subsp bovis AF2122/97
aucggcguccaucac

SEQ ID NO: 1181480 - RNA, 19 nt, Mycobacterium bovis subsp bovis AF2122/97
aucggcguuagucgaucac

SEQ ID NO: 1181481 - RNA, 20 nt, Mycobacterium bovis subsp bovis AF2122/97
aucggcguuaucgaaggcga

SEQ ID NO: 1181482 - RNA, 16 nt, Mycobacterium bovis subsp bovis AF2122/97
aucgggaucugggcuc

SEQ ID NO: 1181483 - RNA, 15 nt, Mycobacterium bovis subsp bovis AF2122/97
aucggggccacugag

SEQ ID NO: 1181484 - RNA, 16 nt, Mycobacterium bovis subsp bovis AF2122/97
aucgggcggcaccgcu

SEQ ID NO: 1181485 - RNA, 23 nt, Mycobacterium bovis subsp bovis AF2122/97
aucgggcguggugagcaguguga

SEQ ID NO: 1181486 - RNA, 21 nt, Mycobacterium bovis subsp bovis AF2122/97
aucgggcccaccgcugcggca

SEQ ID NO: 1181487 - RNA, 20 nt, Mycobacterium bovis subsp bovis AF2122/97
aucgggaagccgccgggcau

SEQ ID NO: 1181488 - RNA, 21 nt, Mycobacterium bovis subsp bovis AF2122/97
aucgggaauuucgucggccau

SEQ ID NO: 1181489 - RNA, 19 nt, Mycobacterium bovis subsp bovis AF2122/97
auccugguggcagacaugg

SEQ ID NO: 1181490 - RNA, 19 nt, Mycobacterium bovis subsp bovis AF2122/97
auccuggcggcugcagccg

SEQ ID NO: 1181491 - RNA, 16 nt, Mycobacterium bovis subsp bovis AF2122/97
auccuugacgcggcca

SEQ ID NO: 1181492 - RNA, 20 nt, Mycobacterium bovis subsp bovis AF2122/97
aucgaacugggggccggcac

SEQ ID NO: 1181493 - RNA, 13 nt, Mycobacterium bovis subsp bovis AF2122/97
auccuugccaauc

SEQ ID NO: 1181494 - RNA, 18 nt, Mycobacterium bovis subsp bovis AF2122/97
auccuugccaaucgccgu

SEQ ID NO: 1181495 - RNA, 18 nt, Mycobacterium bovis subsp bovis AF2122/97
auccuugcgacguucuug

SEQ ID NO: 1181496 - RNA, 13 nt, Mycobacterium bovis subsp bovis AF2122/97
auccgcggcaugc

SEQ ID NO: 1181497 - RNA, 16 nt, Mycobacterium bovis subsp bovis AF2122/97
auccgcugcgccgagg

SEQ ID NO: 1181498 - RNA, 18 nt, Mycobacterium bovis subsp bovis AF2122/97
auccgcgguuggcagugg

SEQ ID NO: 1181499 - RNA, 17 nt, Mycobacterium bovis subsp bovis AF2122/97
auccgcucacccgcccg

SEQ ID NO: 1181500 - RNA, 20 nt, Mycobacterium bovis subsp bovis AF2122/97
auccggaauagcaacgcugc

SEQ ID NO: 1181501 - RNA, 14 nt, Mycobacterium bovis subsp bovis AF2122/97
auccgcuguuccuc

SEQ ID NO: 1181502 - RNA, 21 nt, Mycobacterium bovis subsp bovis AF2122/97
auccggaucccaccaccgcuc

SEQ ID NO: 1181503 - RNA, 13 nt, Mycobacterium bovis subsp bovis AF2122/97
auccggaucggcc

SEQ ID NO: 1181504 - RNA, 16 nt, Mycobacterium bovis subsp bovis AF2122/97
auccggaucccaccac

SEQ ID NO: 1181505 - RNA, 24 nt, Mycobacterium bovis subsp bovis AF2122/97
auccugcgguugaguugcagaccg

SEQ ID NO: 1181506 - RNA, 22 nt, Mycobacterium bovis subsp bovis AF2122/97
aucgccacuguugaagaagccc

SEQ ID NO: 1181507 - RNA, 11 nt, Mycobacterium bovis subsp bovis AF2122/97
aucgccagcau

SEQ ID NO: 1181508 - RNA, 19 nt, Mycobacterium bovis subsp bovis AF2122/97
aucgccacgacaggucgcc

SEQ ID NO: 1181509 - RNA, 13 nt, Mycobacterium bovis subsp bovis AF2122/97
aucgccaccaccg

SEQ ID NO: 1181510 - RNA, 17 nt, Mycobacterium bovis subsp bovis AF2122/97
aucgcauugggcgggcu

SEQ ID NO: 1181511 - RNA, 23 nt, Mycobacterium bovis subsp bovis AF2122/97
aucgaucagcaacucggccacgg

SEQ ID NO: 1181512 - RNA, 16 nt, Mycobacterium bovis subsp bovis AF2122/97
aucgacccgaugaccc

SEQ ID NO: 1181513 - RNA, 14 nt, Mycobacterium bovis subsp bovis AF2122/97
aucgaaccgcugcu

SEQ ID NO: 1181514 - RNA, 15 nt, Mycobacterium bovis subsp bovis AF2122/97
aucgaagcggcugcu

SEQ ID NO: 1181515 - RNA, 17 nt, Mycobacterium bovis subsp bovis AF2122/97
aucgacccuccagcacg

SEQ ID NO: 1181516 - RNA, 16 nt, Mycobacterium bovis subsp bovis AF2122/97
aucgacggcggccuuc

SEQ ID NO: 1181517 - RNA, 15 nt, Mycobacterium bovis subsp bovis AF2122/97
aucgacucacacacc

SEQ ID NO: 1181518 - RNA, 16 nt, Mycobacterium bovis subsp bovis AF2122/97
aucgacucacacaccg

SEQ ID NO: 1181519 - RNA, 14 nt, Mycobacterium bovis subsp bovis AF2122/97
aucgaguccaccac

SEQ ID NO: 1181520 - RNA, 22 nt, Mycobacterium bovis subsp bovis AF2122/97
aucgagggggacgcugaucgaa

SEQ ID NO: 1181521 - RNA, 19 nt, Mycobacterium bovis subsp bovis AF2122/97
auacgcccacuccagcagc

SEQ ID NO: 1181522 - RNA, 19 nt, Mycobacterium bovis subsp bovis AF2122/97
auacgccggccgcgcuggu

SEQ ID NO: 1181523 - RNA, 17 nt, Mycobacterium bovis subsp bovis AF2122/97
auacgagcagugaccgc

SEQ ID NO: 1181524 - RNA, 18 nt, Mycobacterium bovis subsp bovis AF2122/97
auaccuuccagaucgcgg

SEQ ID NO: 1181525 - RNA, 17 nt, Mycobacterium bovis subsp bovis AF2122/97
auaccucgccgcccugu

SEQ ID NO: 1181526 - RNA, 18 nt, Mycobacterium bovis subsp bovis AF2122/97
auaccggcaucgaagugc

SEQ ID NO: 1181527 - RNA, 17 nt, Mycobacterium bovis subsp bovis AF2122/97
auaccggcgugcaguac

SEQ ID NO: 1181528 - RNA, 17 nt, Mycobacterium bovis subsp bovis AF2122/97
auaccggcuggccaggu

SEQ ID NO: 1181529 - RNA, 21 nt, Mycobacterium bovis subsp bovis AF2122/97
auaccggcuggccagguggcc

SEQ ID NO: 1181530 - RNA, 14 nt, Mycobacterium bovis subsp bovis AF2122/97
auaccgccagcgcc

SEQ ID NO: 1181531 - RNA, 13 nt, Mycobacterium bovis subsp bovis AF2122/97
auaccgcaccaaa

SEQ ID NO: 1181532 - RNA, 22 nt, Mycobacterium bovis subsp bovis AF2122/97
auacagcggaggauagggcuuu

SEQ ID NO: 1181533 - RNA, 21 nt, Mycobacterium bovis subsp bovis AF2122/97
auacucgaguggcgaacgggu

SEQ ID NO: 1181534 - RNA, 15 nt, Mycobacterium bovis subsp bovis AF2122/97
auagacguuguugaa

SEQ ID NO: 1181535 - RNA, 21 nt, Mycobacterium bovis subsp bovis AF2122/97
auagacuagccgauccagcag

SEQ ID NO: 1181536 - RNA, 17 nt, Mycobacterium bovis subsp bovis AF2122/97
auagcgggcgguagcca

SEQ ID NO: 1181537 - RNA, 11 nt, Mycobacterium bovis subsp bovis AF2122/97
auagcagugca

SEQ ID NO: 1181538 - RNA, 16 nt, Mycobacterium bovis subsp bovis AF2122/97
auagcaacggugcucu

SEQ ID NO: 1181539 - RNA, 17 nt, Mycobacterium bovis subsp bovis AF2122/97
auagcaccaguuugugc

SEQ ID NO: 1181540 - RNA, 20 nt, Mycobacterium bovis subsp bovis AF2122/97
auagcugcguccggaaccaa

SEQ ID NO: 1181541 - RNA, 18 nt, Mycobacterium bovis subsp bovis AF2122/97
auagcugccggcccacca

SEQ ID NO: 1181542 - RNA, 19 nt, Mycobacterium bovis subsp bovis AF2122/97
auagcugcgcgaagccacc

SEQ ID NO: 1181543 - RNA, 23 nt, Mycobacterium bovis subsp bovis AF2122/97
auaucgccgagaaccagcgaaau

SEQ ID NO: 1181544 - RNA, 16 nt, Mycobacterium bovis subsp bovis AF2122/97
auaucggcacggucac

SEQ ID NO: 1181545 - RNA, 22 nt, Mycobacterium bovis subsp bovis AF2122/97
auaucggcacggucacacgcca

SEQ ID NO: 1181546 - RNA, 23 nt, Mycobacterium bovis subsp bovis AF2122/97
auaucggcacggucacacgccag

SEQ ID NO: 1181547 - RNA, 22 nt, Mycobacterium bovis subsp bovis AF2122/97
auaucgucgggcgucccggcgg

SEQ ID NO: 1181548 - RNA, 11 nt, Mycobacterium bovis subsp bovis AF2122/97
auaucugccac

SEQ ID NO: 1181549 - RNA, 16 nt, Mycobacterium bovis subsp bovis AF2122/97
auaugacggcagacca

SEQ ID NO: 1181550 - RNA, 14 nt, Mycobacterium bovis subsp bovis AF2122/97
aucaacaggcgucc

SEQ ID NO: 1181551 - RNA, 23 nt, Mycobacterium bovis subsp bovis AF2122/97
aucaacgaacggauaccugggac

SEQ ID NO: 1181552 - RNA, 14 nt, Mycobacterium bovis subsp bovis AF2122/97
aucaacgacaccag

SEQ ID NO: 1181553 - RNA, 14 nt, Mycobacterium bovis subsp bovis AF2122/97
aucaagcacagccc

SEQ ID NO: 1181554 - RNA, 17 nt, Mycobacterium bovis subsp bovis AF2122/97
aucaagaaacgugguga

SEQ ID NO: 1181555 - RNA, 18 nt, Mycobacterium bovis subsp bovis AF2122/97
aucaacgcgucgcccgca

SEQ ID NO: 1181556 - RNA, 14 nt, Mycobacterium bovis subsp bovis AF2122/97
aucaagggggucga

SEQ ID NO: 1181557 - RNA, 17 nt, Mycobacterium bovis subsp bovis AF2122/97
aucaaugcggucccucc

SEQ ID NO: 1181558 - RNA, 11 nt, Mycobacterium bovis subsp bovis AF2122/97
auauugccauc

SEQ ID NO: 1181559 - RNA, 15 nt, Mycobacterium bovis subsp bovis AF2122/97
auauugcgcccggcc

SEQ ID NO: 1181560 - RNA, 15 nt, Mycobacterium bovis subsp bovis AF2122/97
aucagugcaagaccg

SEQ ID NO: 1181561 - RNA, 15 nt, Mycobacterium bovis subsp bovis AF2122/97
aucagugcagcgugg

SEQ ID NO: 1181562 - RNA, 15 nt, Mycobacterium bovis subsp bovis AF2122/97
aucagugaagacacc

SEQ ID NO: 1181563 - RNA, 22 nt, Mycobacterium bovis subsp bovis AF2122/97
aucaggccuugggauaggccgu

SEQ ID NO: 1181564 - RNA, 21 nt, Mycobacterium bovis subsp bovis AF2122/97
aaaacgccaugccgggaacca

SEQ ID NO: 1181565 - RNA, 23 nt, Mycobacterium bovis subsp bovis AF2122/97
aucaucauauccgccccagcugc

SEQ ID NO: 1181566 - RNA, 20 nt, Mycobacterium bovis subsp bovis AF2122/97
aucauauccgccccagcugc

SEQ ID NO: 1181567 - RNA, 21 nt, Mycobacterium bovis subsp bovis AF2122/97
aucauauccgccccagcugcg

SEQ ID NO: 1181568 - RNA, 17 nt, Mycobacterium bovis subsp bovis AF2122/97
aucaucaugucggcgca

SEQ ID NO: 1181569 - RNA, 23 nt, Mycobacterium bovis subsp bovis AF2122/97
aucaucgccgcggccagguugau

SEQ ID NO: 1181570 - RNA, 16 nt, Mycobacterium bovis subsp bovis AF2122/97
aucagcgccagcgagc

SEQ ID NO: 1181571 - RNA, 19 nt, Mycobacterium bovis subsp bovis AF2122/97
aucagcugcgcaucgccac

SEQ ID NO: 1181572 - RNA, 18 nt, Mycobacterium bovis subsp bovis AF2122/97
aucagcuugggcagcagc

SEQ ID NO: 1181573 - RNA, 15 nt, Mycobacterium bovis subsp bovis AF2122/97
aucagccaccgggug

SEQ ID NO: 1181574 - RNA, 19 nt, Mycobacterium bovis subsp bovis AF2122/97
aucagccagaccaacauga

SEQ ID NO: 1181575 - RNA, 18 nt, Mycobacterium bovis subsp bovis AF2122/97
aucagcaugguccacagc

SEQ ID NO: 1181576 - RNA, 22 nt, Mycobacterium bovis subsp bovis AF2122/97
aucagagcguucuucagccagg

SEQ ID NO: 1181577 - RNA, 20 nt, Mycobacterium bovis subsp bovis AF2122/97
aucagacgcucgaccugccu

SEQ ID NO: 1181578 - RNA, 16 nt, Mycobacterium bovis subsp bovis AF2122/97
aucagauucgcgcugg

SEQ ID NO: 1181579 - RNA, 19 nt, Mycobacterium bovis subsp bovis AF2122/97
aucagcaagagccgcagcc

SEQ ID NO: 1181580 - RNA, 21 nt, Mycobacterium bovis subsp bovis AF2122/97
aucagcaagagccgcagccac

SEQ ID NO: 1181581 - RNA, 12 nt, Mycobacterium bovis subsp bovis AF2122/97
aucagcaacagc

SEQ ID NO: 1181582 - RNA, 17 nt, Mycobacterium bovis subsp bovis AF2122/97
aucagcaacagcaggug

SEQ ID NO: 1181583 - RNA, 18 nt, Mycobacterium bovis subsp bovis AF2122/97
aucacggcaccgaagugc

SEQ ID NO: 1181584 - RNA, 17 nt, Mycobacterium bovis subsp bovis AF2122/97
aucacgucgucagccac

SEQ ID NO: 1181585 - RNA, 17 nt, Mycobacterium bovis subsp bovis AF2122/97
aucacguacgccgccga

SEQ ID NO: 1181586 - RNA, 23 nt, Mycobacterium bovis subsp bovis AF2122/97
aucacgggcuaccggcagcugcu

SEQ ID NO: 1181587 - RNA, 11 nt, Mycobacterium bovis subsp bovis AF2122/97
aucacgugccg

SEQ ID NO: 1181588 - RNA, 17 nt, Mycobacterium bovis subsp bovis AF2122/97
aucacguggaccacggc

SEQ ID NO: 1181589 - RNA, 18 nt, Mycobacterium bovis subsp bovis AF2122/97
aucaccucaccagucagg

SEQ ID NO: 1181590 - RNA, 16 nt, Mycobacterium bovis subsp bovis AF2122/97
aucaccggugcgcugg

SEQ ID NO: 1181591 - RNA, 22 nt, Mycobacterium bovis subsp bovis AF2122/97
aucaccgucguacucggcggcc

SEQ ID NO: 1181592 - RNA, 22 nt, Mycobacterium bovis subsp bovis AF2122/97
aucaccgcgccagccuccacca

SEQ ID NO: 1181593 - RNA, 15 nt, Mycobacterium bovis subsp bovis AF2122/97
auacacgagguagcc

SEQ ID NO: 1181594 - RNA, 20 nt, Mycobacterium bovis subsp bovis AF2122/97
auacacccaacucaugggcc

SEQ ID NO: 1181595 - RNA, 14 nt, Mycobacterium bovis subsp bovis AF2122/97
auacaccuccugcc

SEQ ID NO: 1181596 - RNA, 15 nt, Mycobacterium bovis subsp bovis AF2122/97
auacaccugcuggaa

SEQ ID NO: 1181597 - RNA, 16 nt, Mycobacterium bovis subsp bovis AF2122/97
auacagcaauccgcaa

SEQ ID NO: 1181598 - RNA, 13 nt, Mycobacterium bovis subsp bovis AF2122/97
auacagccgccga

SEQ ID NO: 1181599 - RNA, 10 nt, Mycobacterium bovis subsp bovis AF2122/97
auaacccagc

SEQ ID NO: 1181600 - RNA, 16 nt, Mycobacterium bovis subsp bovis AF2122/97
auaacccaaccgcgcc

SEQ ID NO: 1181601 - RNA, 14 nt, Mycobacterium bovis subsp bovis AF2122/97
auaacgcggaguuc

SEQ ID NO: 1181602 - RNA, 16 nt, Mycobacterium bovis subsp bovis AF2122/97
auaacagcaggcauuc

SEQ ID NO: 1181603 - RNA, 17 nt, Mycobacterium bovis subsp bovis AF2122/97
auaaaccgcacaucgcu

SEQ ID NO: 1181604 - RNA, 12 nt, Mycobacterium bovis subsp bovis AF2122/97
agugucagcaga

SEQ ID NO: 1181605 - RNA, 13 nt, Mycobacterium bovis subsp bovis AF2122/97
agugucagcagau

SEQ ID NO: 1181606 - RNA, 13 nt, Mycobacterium bovis subsp bovis AF2122/97
aguucaccgcgcu

SEQ ID NO: 1181607 - RNA, 14 nt, Mycobacterium bovis subsp bovis AF2122/97
aguucacccaucau

SEQ ID NO: 1181608 - RNA, 16 nt, Mycobacterium bovis subsp bovis AF2122/97
aguucagcacgugggc

SEQ ID NO: 1181609 - RNA, 14 nt, Mycobacterium bovis subsp bovis AF2122/97
aguuaucagccgcg

SEQ ID NO: 1181610 - RNA, 20 nt, Mycobacterium bovis subsp bovis AF2122/97
aguucuugauuagccauuaa

SEQ ID NO: 1181611 - RNA, 19 nt, Mycobacterium bovis subsp bovis AF2122/97
aguucuccucgugcagcac

SEQ ID NO: 1181612 - RNA, 16 nt, Mycobacterium bovis subsp bovis AF2122/97
aguucuucgcgaagaa

SEQ ID NO: 1181613 - RNA, 19 nt, Mycobacterium bovis subsp bovis AF2122/97
aguucgucgguugccacgc

SEQ ID NO: 1181614 - RNA, 21 nt, Mycobacterium bovis subsp bovis AF2122/97
aguucggccgucauggcccga

SEQ ID NO: 1181615 - RNA, 18 nt, Mycobacterium bovis subsp bovis AF2122/97
aguucggugagccgggcg

SEQ ID NO: 1181616 - RNA, 16 nt, Mycobacterium bovis subsp bovis AF2122/97
aguucggccaccaacc

SEQ ID NO: 1181617 - RNA, 21 nt, Mycobacterium bovis subsp bovis AF2122/97
aguugugcgcacucuuuccuu

SEQ ID NO: 1181618 - RNA, 23 nt, Mycobacterium bovis subsp bovis AF2122/97
aguugucuggucauggccgaaca

SEQ ID NO: 1181619 - RNA, 15 nt, Mycobacterium bovis subsp bovis AF2122/97
aguugcgaaccauga

SEQ ID NO: 1181620 - RNA, 15 nt, Mycobacterium bovis subsp bovis AF2122/97
aguugccggucaggc

SEQ ID NO: 1181621 - RNA, 13 nt, Mycobacterium bovis subsp bovis AF2122/97
aguuuaccgugcc

SEQ ID NO: 1181622 - RNA, 13 nt, Mycobacterium bovis subsp bovis AF2122/97
aguuguugcagga

SEQ ID NO: 1181623 - RNA, 15 nt, Mycobacterium bovis subsp bovis AF2122/97
aguuugaccaccugg

SEQ ID NO: 1181624 - RNA, 23 nt, Mycobacterium bovis subsp bovis AF2122/97
agugcgcgcuggaucgugcuggu

SEQ ID NO: 1181625 - RNA, 16 nt, Mycobacterium bovis subsp bovis AF2122/97
agugcgcggaucaaca

SEQ ID NO: 1181626 - RNA, 21 nt, Mycobacterium bovis subsp bovis AF2122/97
agugccucgauuguggccagc

SEQ ID NO: 1181627 - RNA, 13 nt, Mycobacterium bovis subsp bovis AF2122/97
agugccgcgucga

SEQ ID NO: 1181628 - RNA, 13 nt, Mycobacterium bovis subsp bovis AF2122/97
agugccuccgaca

SEQ ID NO: 1181629 - RNA, 12 nt, Mycobacterium bovis subsp bovis AF2122/97
agugcugcaccg

SEQ ID NO: 1181630 - RNA, 20 nt, Mycobacterium bovis subsp bovis AF2122/97
agugcuggccgaagaacuca

SEQ ID NO: 1181631 - RNA, 22 nt, Mycobacterium bovis subsp bovis AF2122/97
agugcggacaucguugacccgg

SEQ ID NO: 1181632 - RNA, 18 nt, Mycobacterium bovis subsp bovis AF2122/97
agugcggaacggccagga

SEQ ID NO: 1181633 - RNA, 20 nt, Mycobacterium bovis subsp bovis AF2122/97
agugcgcgugcccgugguga

SEQ ID NO: 1181634 - RNA, 14 nt, Mycobacterium bovis subsp bovis AF2122/97
agugcgggcggcgu

SEQ ID NO: 1181635 - RNA, 23 nt, Mycobacterium bovis subsp bovis AF2122/97
agugcgggccgugacccucagca

SEQ ID NO: 1181636 - RNA, 15 nt, Mycobacterium bovis subsp bovis AF2122/97
agugcggcagcggug

SEQ ID NO: 1181637 - RNA, 15 nt, Mycobacterium bovis subsp bovis AF2122/97
aguggccaccaucac

SEQ ID NO: 1181638 - RNA, 15 nt, Mycobacterium bovis subsp bovis AF2122/97
aguggccgccgggca

SEQ ID NO: 1181639 - RNA, 13 nt, Mycobacterium bovis subsp bovis AF2122/97
aguggccguggau

SEQ ID NO: 1181640 - RNA, 19 nt, Mycobacterium bovis subsp bovis AF2122/97
aguggccgcauuagccugc

SEQ ID NO: 1181641 - RNA, 13 nt, Mycobacterium bovis subsp bovis AF2122/97
aguggccgccacc

SEQ ID NO: 1181642 - RNA, 17 nt, Mycobacterium bovis subsp bovis AF2122/97
aguggugauccagccgu

SEQ ID NO: 1181643 - RNA, 14 nt, Mycobacterium bovis subsp bovis AF2122/97
agugguccagccag

SEQ ID NO: 1181644 - RNA, 23 nt, Mycobacterium bovis subsp bovis AF2122/97
aguggucccguucgcccgcccgu

SEQ ID NO: 1181645 - RNA, 15 nt, Mycobacterium bovis subsp bovis AF2122/97
aguggugggcguggc

SEQ ID NO: 1181646 - RNA, 18 nt, Mycobacterium bovis subsp bovis AF2122/97
aguggugggcguggcugg

SEQ ID NO: 1181647 - RNA, 15 nt, Mycobacterium bovis subsp bovis AF2122/97
agugaucaccaaccc

SEQ ID NO: 1181648 - RNA, 21 nt, Mycobacterium bovis subsp bovis AF2122/97
agugcagacaggcggcggccu

SEQ ID NO: 1181649 - RNA, 17 nt, Mycobacterium bovis subsp bovis AF2122/97
agugcacccggaucugg

SEQ ID NO: 1181650 - RNA, 14 nt, Mycobacterium bovis subsp bovis AF2122/97
agugcaccgccugc

SEQ ID NO: 1181651 - RNA, 20 nt, Mycobacterium bovis subsp bovis AF2122/97
agugcaccgcgucguagcca

SEQ ID NO: 1181652 - RNA, 19 nt, Mycobacterium bovis subsp bovis AF2122/97
agugcacagccgggcucuc

SEQ ID NO: 1181653 - RNA, 17 nt, Mycobacterium bovis subsp bovis AF2122/97
agugcacugcgaacccu

SEQ ID NO: 1181654 - RNA, 23 nt, Mycobacterium bovis subsp bovis AF2122/97
agugcagcacgauccagcuguac

SEQ ID NO: 1181655 - RNA, 22 nt, Mycobacterium bovis subsp bovis AF2122/97
agugcagaagacaagugguggu

SEQ ID NO: 1181656 - RNA, 19 nt, Mycobacterium bovis subsp bovis AF2122/97
agugcagcgaucccggcaa

SEQ ID NO: 1181657 - RNA, 14 nt, Mycobacterium bovis subsp bovis AF2122/97
agugcaggcggccg

SEQ ID NO: 1181658 - RNA, 12 nt, Mycobacterium bovis subsp bovis AF2122/97
agugcagggcug

SEQ ID NO: 1181659 - RNA, 16 nt, Mycobacterium bovis subsp bovis AF2122/97
agugcaggugcccggc

SEQ ID NO: 1181660 - RNA, 21 nt, Mycobacterium bovis subsp bovis AF2122/97
agugccacgccugagccacca

SEQ ID NO: 1181661 - RNA, 22 nt, Mycobacterium bovis subsp bovis AF2122/97
agugccaauuccagccccccgg

SEQ ID NO: 1181662 - RNA, 15 nt, Mycobacterium bovis subsp bovis AF2122/97
agugccgcacccaga

SEQ ID NO: 1181663 - RNA, 16 nt, Mycobacterium bovis subsp bovis AF2122/97
agugcccggccaacca

SEQ ID NO: 1181664 - RNA, 21 nt, Mycobacterium bovis subsp bovis AF2122/97
agugccagugcgcagcccgca

SEQ ID NO: 1181665 - RNA, 13 nt, Mycobacterium bovis subsp bovis AF2122/97
agucgggcaaggc

SEQ ID NO: 1181666 - RNA, 21 nt, Mycobacterium bovis subsp bovis AF2122/97
agucggcaaacaacgacuccu

SEQ ID NO: 1181667 - RNA, 13 nt, Mycobacterium bovis subsp bovis AF2122/97
agucggcaaacaa

SEQ ID NO: 1181668 - RNA, 15 nt, Mycobacterium bovis subsp bovis AF2122/97
agucggugaaaugac

SEQ ID NO: 1181669 - RNA, 22 nt, Mycobacterium bovis subsp bovis AF2122/97
agucggugaaaugacggcugaa

SEQ ID NO: 1181670 - RNA, 22 nt, Mycobacterium bovis subsp bovis AF2122/97
agucgguagcugaccgugcuga

SEQ ID NO: 1181671 - RNA, 13 nt, Mycobacterium bovis subsp bovis AF2122/97
agucgguccugcc

SEQ ID NO: 1181672 - RNA, 13 nt, Mycobacterium bovis subsp bovis AF2122/97
agucggugaaaug

SEQ ID NO: 1181673 - RNA, 20 nt, Mycobacterium bovis subsp bovis AF2122/97
agucuccggaaccacucgcu

SEQ ID NO: 1181674 - RNA, 15 nt, Mycobacterium bovis subsp bovis AF2122/97
agucuccggaaccac

SEQ ID NO: 1181675 - RNA, 20 nt, Mycobacterium bovis subsp bovis AF2122/97
agucuccggcgucggcggcc

SEQ ID NO: 1181676 - RNA, 17 nt, Mycobacterium bovis subsp bovis AF2122/97
agucugauggccucgcg

SEQ ID NO: 1181677 - RNA, 15 nt, Mycobacterium bovis subsp bovis AF2122/97
agugaagacaccagg

SEQ ID NO: 1181678 - RNA, 17 nt, Mycobacterium bovis subsp bovis AF2122/97
agucuuucgcuucgccc

SEQ ID NO: 1181679 - RNA, 14 nt, Mycobacterium bovis subsp bovis AF2122/97
agucgaagaagacc

SEQ ID NO: 1181680 - RNA, 17 nt, Mycobacterium bovis subsp bovis AF2122/97
aguccugcagugcggcg

SEQ ID NO: 1181681 - RNA, 22 nt, Mycobacterium bovis subsp bovis AF2122/97
aguccucgggcaggcggccagc

SEQ ID NO: 1181682 - RNA, 21 nt, Mycobacterium bovis subsp bovis AF2122/97
agucgauuucggcggcgaggc

SEQ ID NO: 1181683 - RNA, 21 nt, Mycobacterium bovis subsp bovis AF2122/97
agucgaccaugagccggcgcc

SEQ ID NO: 1181684 - RNA, 20 nt, Mycobacterium bovis subsp bovis AF2122/97
agucgaaggucagcaccgcu

SEQ ID NO: 1181685 - RNA, 12 nt, Mycobacterium bovis subsp bovis AF2122/97
agucgaugcuga

SEQ ID NO: 1181686 - RNA, 16 nt, Mycobacterium bovis subsp bovis AF2122/97
agucgaugaccccggu

SEQ ID NO: 1181687 - RNA, 17 nt, Mycobacterium bovis subsp bovis AF2122/97
agucgaugaugcccauc

SEQ ID NO: 1181688 - RNA, 19 nt, Mycobacterium bovis subsp bovis AF2122/97
aguccgguagcuguggugg

SEQ ID NO: 1181689 - RNA, 19 nt, Mycobacterium bovis subsp bovis AF2122/97
aguccguacuugccaccca

SEQ ID NO: 1181690 - RNA, 21 nt, Mycobacterium bovis subsp bovis AF2122/97
aguccgucgacaccgcggacc

SEQ ID NO: 1181691 - RNA, 21 nt, Mycobacterium bovis subsp bovis AF2122/97
aguccggcucauccgacggga

SEQ ID NO: 1181692 - RNA, 19 nt, Mycobacterium bovis subsp bovis AF2122/97
aguccgcgccgacggccag

SEQ ID NO: 1181693 - RNA, 23 nt, Mycobacterium bovis subsp bovis AF2122/97
aguccgauuuugugagccaggcg

SEQ ID NO: 1181694 - RNA, 14 nt, Mycobacterium bovis subsp bovis AF2122/97
aguccgccgccugc

SEQ ID NO: 1181695 - RNA, 17 nt, Mycobacterium bovis subsp bovis AF2122/97
aguccgccgccugcgca

SEQ ID NO: 1181696 - RNA, 20 nt, Mycobacterium bovis subsp bovis AF2122/97
aguccgcgccggcgggcgcg

SEQ ID NO: 1181697 - RNA, 21 nt, Mycobacterium bovis subsp bovis AF2122/97
agguggccgcgcaggggcggc

SEQ ID NO: 1181698 - RNA, 12 nt, Mycobacterium bovis subsp bovis AF2122/97
agguggcccgcg

SEQ ID NO: 1181699 - RNA, 15 nt, Mycobacterium bovis subsp bovis AF2122/97
agguggcgcacaucg

SEQ ID NO: 1181700 - RNA, 22 nt, Mycobacterium bovis subsp bovis AF2122/97
agguugcgccauaacaccgggu

SEQ ID NO: 1181701 - RNA, 19 nt, Mycobacterium bovis subsp bovis AF2122/97
agguugccgcaccagucgc

SEQ ID NO: 1181702 - RNA, 18 nt, Mycobacterium bovis subsp bovis AF2122/97
agguuguagucagaaccg

SEQ ID NO: 1181703 - RNA, 16 nt, Mycobacterium bovis subsp bovis AF2122/97
agguugcguugcagga

SEQ ID NO: 1181704 - RNA, 17 nt, Mycobacterium bovis subsp bovis AF2122/97
agguugcguugcaggaa

SEQ ID NO: 1181705 - RNA, 12 nt, Mycobacterium bovis subsp bovis AF2122/97
aguaaguccucg

SEQ ID NO: 1181706 - RNA, 11 nt, Mycobacterium bovis subsp bovis AF2122/97
aguagcugacc

SEQ ID NO: 1181707 - RNA, 15 nt, Mycobacterium bovis subsp bovis AF2122/97
aguagucgcuggcca

SEQ ID NO: 1181708 - RNA, 16 nt, Mycobacterium bovis subsp bovis AF2122/97
aguagucgcuggccag

SEQ ID NO: 1181709 - RNA, 15 nt, Mycobacterium bovis subsp bovis AF2122/97
aguaguggccgccac

SEQ ID NO: 1181710 - RNA, 20 nt, Mycobacterium bovis subsp bovis AF2122/97
aguagucggccgaugaaggc

SEQ ID NO: 1181711 - RNA, 16 nt, Mycobacterium bovis subsp bovis AF2122/97
aguaccccuuggacug

SEQ ID NO: 1181712 - RNA, 13 nt, Mycobacterium bovis subsp bovis AF2122/97
aguaccagcccac

SEQ ID NO: 1181713 - RNA, 14 nt, Mycobacterium bovis subsp bovis AF2122/97
aguagccgcuagga

SEQ ID NO: 1181714 - RNA, 23 nt, Mycobacterium bovis subsp bovis AF2122/97
aguagccgaccaggaccaccgca

SEQ ID NO: 1181715 - RNA, 17 nt, Mycobacterium bovis subsp bovis AF2122/97
aguagcacguugacguc

SEQ ID NO: 1181716 - RNA, 15 nt, Mycobacterium bovis subsp bovis AF2122/97
aguauggccgccacc

SEQ ID NO: 1181717 - RNA, 13 nt, Mycobacterium bovis subsp bovis AF2122/97
aggcggcaaggac

SEQ ID NO: 1181718 - RNA, 22 nt, Mycobacterium bovis subsp bovis AF2122/97
aggcuuucgauauagccgccgg

SEQ ID NO: 1181719 - RNA, 14 nt, Mycobacterium bovis subsp bovis AF2122/97
aggcuugcggcacc

SEQ ID NO: 1181720 - RNA, 20 nt, Mycobacterium bovis subsp bovis AF2122/97
agggacccggcgccgucgau

SEQ ID NO: 1181721 - RNA, 16 nt, Mycobacterium bovis subsp bovis AF2122/97
agggagugccgcacga

SEQ ID NO: 1181722 - RNA, 22 nt, Mycobacterium bovis subsp bovis AF2122/97
agggaggccccccggggccgca

SEQ ID NO: 1181723 - RNA, 15 nt, Mycobacterium bovis subsp bovis AF2122/97
agggcaccggcgauc

SEQ ID NO: 1181724 - RNA, 22 nt, Mycobacterium bovis subsp bovis AF2122/97
agggcacggcgguguguuccaa

SEQ ID NO: 1181725 - RNA, 21 nt, Mycobacterium bovis subsp bovis AF2122/97
agggccaccgccgccugcccg

SEQ ID NO: 1181726 - RNA, 18 nt, Mycobacterium bovis subsp bovis AF2122/97
agggccgagcagcuccuu

SEQ ID NO: 1181727 - RNA, 22 nt, Mycobacterium bovis subsp bovis AF2122/97
agggccagcggcagccuggccu

SEQ ID NO: 1181728 - RNA, 16 nt, Mycobacterium bovis subsp bovis AF2122/97
agggccaggacaacca

SEQ ID NO: 1181729 - RNA, 18 nt, Mycobacterium bovis subsp bovis AF2122/97
agggcgucgaacucaucu

SEQ ID NO: 1181730 - RNA, 15 nt, Mycobacterium bovis subsp bovis AF2122/97
agggcguuggcggcu

SEQ ID NO: 1181731 - RNA, 15 nt, Mycobacterium bovis subsp bovis AF2122/97
agggcggcagcgagg

SEQ ID NO: 1181732 - RNA, 20 nt, Mycobacterium bovis subsp bovis AF2122/97
agggcggcagcgaggcucgc

SEQ ID NO: 1181733 - RNA, 20 nt, Mycobacterium bovis subsp bovis AF2122/97
agggccgcgaucgacggugu

SEQ ID NO: 1181734 - RNA, 23 nt, Mycobacterium bovis subsp bovis AF2122/97
agggccgccgcgaacgggucggg

SEQ ID NO: 1181735 - RNA, 12 nt, Mycobacterium bovis subsp bovis AF2122/97
agggccgccauc

SEQ ID NO: 1181736 - RNA, 14 nt, Mycobacterium bovis subsp bovis AF2122/97
agggccgcgaucga

SEQ ID NO: 1181737 - RNA, 22 nt, Mycobacterium bovis subsp bovis AF2122/97
agggcggccuccccgaccugca

SEQ ID NO: 1181738 - RNA, 13 nt, Mycobacterium bovis subsp bovis AF2122/97
agggcggcgaggu

SEQ ID NO: 1181739 - RNA, 19 nt, Mycobacterium bovis subsp bovis AF2122/97
agggcggugccaucgggcg

SEQ ID NO: 1181740 - RNA, 19 nt, Mycobacterium bovis subsp bovis AF2122/97
agggcggcguugagcuggc

SEQ ID NO: 1181741 - RNA, 16 nt, Mycobacterium bovis subsp bovis AF2122/97
aggggcgcggguggaa

SEQ ID NO: 1181742 - RNA, 19 nt, Mycobacterium bovis subsp bovis AF2122/97
aggggcaauugccugcgcu

SEQ ID NO: 1181743 - RNA, 16 nt, Mycobacterium bovis subsp bovis AF2122/97
agggcuccucgugcac

SEQ ID NO: 1181744 - RNA, 15 nt, Mycobacterium bovis subsp bovis AF2122/97
agggcucggcggccc

SEQ ID NO: 1181745 - RNA, 20 nt, Mycobacterium bovis subsp bovis AF2122/97
agggcuaccggcgccgcgcg

SEQ ID NO: 1181746 - RNA, 13 nt, Mycobacterium bovis subsp bovis AF2122/97
agggcugcuccug

SEQ ID NO: 1181747 - RNA, 17 nt, Mycobacterium bovis subsp bovis AF2122/97
agggcucggcggcccgg

SEQ ID NO: 1181748 - RNA, 19 nt, Mycobacterium bovis subsp bovis AF2122/97
agggcucggcggcccggcc

SEQ ID NO: 1181749 - RNA, 15 nt, Mycobacterium bovis subsp bovis AF2122/97
aggugcaucgccaca

SEQ ID NO: 1181750 - RNA, 16 nt, Mycobacterium bovis subsp bovis AF2122/97
aggugcguuugcacug

SEQ ID NO: 1181751 - RNA, 12 nt, Mycobacterium bovis subsp bovis AF2122/97
aggucggccacc

SEQ ID NO: 1181752 - RNA, 13 nt, Mycobacterium bovis subsp bovis AF2122/97
aggucggccaccg

SEQ ID NO: 1181753 - RNA, 13 nt, Mycobacterium bovis subsp bovis AF2122/97
aggucggcgauga

SEQ ID NO: 1181754 - RNA, 17 nt, Mycobacterium bovis subsp bovis AF2122/97
aggugaugagugcggac

SEQ ID NO: 1181755 - RNA, 13 nt, Mycobacterium bovis subsp bovis AF2122/97
aggugaucagcag

SEQ ID NO: 1181756 - RNA, 18 nt, Mycobacterium bovis subsp bovis AF2122/97
aggucauauugugggugc

SEQ ID NO: 1181757 - RNA, 17 nt, Mycobacterium bovis subsp bovis AF2122/97
aggucgcggucgagcag

SEQ ID NO: 1181758 - RNA, 23 nt, Mycobacterium bovis subsp bovis AF2122/97
agguccgcacgaucugcaggccc

SEQ ID NO: 1181759 - RNA, 19 nt, Mycobacterium bovis subsp bovis AF2122/97
aggucgccagcucggcacc

SEQ ID NO: 1181760 - RNA, 19 nt, Mycobacterium bovis subsp bovis AF2122/97
agguccccacauggcccgg

SEQ ID NO: 1181761 - RNA, 13 nt, Mycobacterium bovis subsp bovis AF2122/97
agguacgccucga

SEQ ID NO: 1181762 - RNA, 15 nt, Mycobacterium bovis subsp bovis AF2122/97
agguacaucaccacg

SEQ ID NO: 1181763 - RNA, 21 nt, Mycobacterium bovis subsp bovis AF2122/97
agguagcggguugggaccgaa

SEQ ID NO: 1181764 - RNA, 17 nt, Mycobacterium bovis subsp bovis AF2122/97
agguaggucgccgccgc

SEQ ID NO: 1181765 - RNA, 17 nt, Mycobacterium bovis subsp bovis AF2122/97
agguauaaacgcggcgc

SEQ ID NO: 1181766 - RNA, 13 nt, Mycobacterium bovis subsp bovis AF2122/97
aggguggccagca

SEQ ID NO: 1181767 - RNA, 15 nt, Mycobacterium bovis subsp bovis AF2122/97
aggguggccagcagg

SEQ ID NO: 1181768 - RNA, 15 nt, Mycobacterium bovis subsp bovis AF2122/97
agggugccgucgggu

SEQ ID NO: 1181769 - RNA, 16 nt, Mycobacterium bovis subsp bovis AF2122/97
aggguggcgcgguacc

SEQ ID NO: 1181770 - RNA, 23 nt, Mycobacterium bovis subsp bovis AF2122/97
agguaagcgaacggguagucggg

SEQ ID NO: 1181771 - RNA, 13 nt, Mycobacterium bovis subsp bovis AF2122/97
agggugcccgcgu

SEQ ID NO: 1181772 - RNA, 12 nt, Mycobacterium bovis subsp bovis AF2122/97
agggugccggcg

SEQ ID NO: 1181773 - RNA, 14 nt, Mycobacterium bovis subsp bovis AF2122/97
agggugagcggcau

SEQ ID NO: 1181774 - RNA, 22 nt, Mycobacterium bovis subsp bovis AF2122/97
aggguaucgaaaaguagaccga

SEQ ID NO: 1181775 - RNA, 23 nt, Mycobacterium bovis subsp bovis AF2122/97
aggccggugcgucacagccgggu

SEQ ID NO: 1181776 - RNA, 23 nt, Mycobacterium bovis subsp bovis AF2122/97
aggccgguucccuuguucccgaa

SEQ ID NO: 1181777 - RNA, 22 nt, Mycobacterium bovis subsp bovis AF2122/97
aggccggcggucagcagcgccg

SEQ ID NO: 1181778 - RNA, 21 nt, Mycobacterium bovis subsp bovis AF2122/97
aggccgccaucgccgccaacc

SEQ ID NO: 1181779 - RNA, 17 nt, Mycobacterium bovis subsp bovis AF2122/97
aggccgggccggccacg

SEQ ID NO: 1181780 - RNA, 21 nt, Mycobacterium bovis subsp bovis AF2122/97
aggccggguggccacgcccag

SEQ ID NO: 1181781 - RNA, 13 nt, Mycobacterium bovis subsp bovis AF2122/97
aggcccgccagca

SEQ ID NO: 1181782 - RNA, 18 nt, Mycobacterium bovis subsp bovis AF2122/97
aggccgacgucgaccacu

SEQ ID NO: 1181783 - RNA, 13 nt, Mycobacterium bovis subsp bovis AF2122/97
aggccgaccagca

SEQ ID NO: 1181784 - RNA, 14 nt, Mycobacterium bovis subsp bovis AF2122/97
aggccgaccgcgca

SEQ ID NO: 1181785 - RNA, 13 nt, Mycobacterium bovis subsp bovis AF2122/97
aggccgaccugua

SEQ ID NO: 1181786 - RNA, 19 nt, Mycobacterium bovis subsp bovis AF2122/97
aggccgagcagauacuugu

SEQ ID NO: 1181787 - RNA, 13 nt, Mycobacterium bovis subsp bovis AF2122/97
aggccgcaaugcg

SEQ ID NO: 1181788 - RNA, 19 nt, Mycobacterium bovis subsp bovis AF2122/97
aggccgauguacugugccg

SEQ ID NO: 1181789 - RNA, 13 nt, Mycobacterium bovis subsp bovis AF2122/97
aggccgcaccgcc

SEQ ID NO: 1181790 - RNA, 22 nt, Mycobacterium bovis subsp bovis AF2122/97
aggccucgcaccggauccacgg

SEQ ID NO: 1181791 - RNA, 13 nt, Mycobacterium bovis subsp bovis AF2122/97
aggccuccaaaau

SEQ ID NO: 1181792 - RNA, 17 nt, Mycobacterium bovis subsp bovis AF2122/97
aggccuaguccggcacu

SEQ ID NO: 1181793 - RNA, 22 nt, Mycobacterium bovis subsp bovis AF2122/97
aggccuaguccggcacugcggc

SEQ ID NO: 1181794 - RNA, 20 nt, Mycobacterium bovis subsp bovis AF2122/97
aggcgaaaauugcuccacca

SEQ ID NO: 1181795 - RNA, 13 nt, Mycobacterium bovis subsp bovis AF2122/97
aggcgaaccuggu

SEQ ID NO: 1181796 - RNA, 15 nt, Mycobacterium bovis subsp bovis AF2122/97
aggcgacgguuccca

SEQ ID NO: 1181797 - RNA, 13 nt, Mycobacterium bovis subsp bovis AF2122/97
aggcgacggcccu

SEQ ID NO: 1181798 - RNA, 16 nt, Mycobacterium bovis subsp bovis AF2122/97
aggcgcagcgccagcg

SEQ ID NO: 1181799 - RNA, 19 nt, Mycobacterium bovis subsp bovis AF2122/97
aggcgcauagggccaccgc

SEQ ID NO: 1181800 - RNA, 14 nt, Mycobacterium bovis subsp bovis AF2122/97
aggcgcaccaggcg

SEQ ID NO: 1181801 - RNA, 14 nt, Mycobacterium bovis subsp bovis AF2122/97
aggcgaucgcaucc

SEQ ID NO: 1181802 - RNA, 21 nt, Mycobacterium bovis subsp bovis AF2122/97
aggcgaucgcccggccccgca

SEQ ID NO: 1181803 - RNA, 17 nt, Mycobacterium bovis subsp bovis AF2122/97
aggcgaucugcuaccag

SEQ ID NO: 1181804 - RNA, 15 nt, Mycobacterium bovis subsp bovis AF2122/97
aggcgccgcagggcc

SEQ ID NO: 1181805 - RNA, 17 nt, Mycobacterium bovis subsp bovis AF2122/97
aggcgcccaacaggcgg

SEQ ID NO: 1181806 - RNA, 12 nt, Mycobacterium bovis subsp bovis AF2122/97
aggcgcccacaa

SEQ ID NO: 1181807 - RNA, 22 nt, Mycobacterium bovis subsp bovis AF2122/97
aggcgccacugcuuccggaaca

SEQ ID NO: 1181808 - RNA, 13 nt, Mycobacterium bovis subsp bovis AF2122/97
aggcgcgcaccac

SEQ ID NO: 1181809 - RNA, 13 nt, Mycobacterium bovis subsp bovis AF2122/97
aggcgcgccgcac

SEQ ID NO: 1181810 - RNA, 16 nt, Mycobacterium bovis subsp bovis AF2122/97
aggcgcucaucaccca

SEQ ID NO: 1181811 - RNA, 17 nt, Mycobacterium bovis subsp bovis AF2122/97
aggcgcucaucacccag

SEQ ID NO: 1181812 - RNA, 21 nt, Mycobacterium bovis subsp bovis AF2122/97
aggcgcucccggagcacaauc

SEQ ID NO: 1181813 - RNA, 12 nt, Mycobacterium bovis subsp bovis AF2122/97
aggcccacggca

SEQ ID NO: 1181814 - RNA, 19 nt, Mycobacterium bovis subsp bovis AF2122/97
aggcccacggcgaccagga

SEQ ID NO: 1181815 - RNA, 12 nt, Mycobacterium bovis subsp bovis AF2122/97
aggcccagcacg

SEQ ID NO: 1181816 - RNA, 15 nt, Mycobacterium bovis subsp bovis AF2122/97
aggccacagcccggc

SEQ ID NO: 1181817 - RNA, 18 nt, Mycobacterium bovis subsp bovis AF2122/97
aggccaacuuggcggcca

SEQ ID NO: 1181818 - RNA, 21 nt, Mycobacterium bovis subsp bovis AF2122/97
aggccacgcaccgggugcagg

SEQ ID NO: 1181819 - RNA, 18 nt, Mycobacterium bovis subsp bovis AF2122/97
aggccacguagcagcgcc

SEQ ID NO: 1181820 - RNA, 13 nt, Mycobacterium bovis subsp bovis AF2122/97
aggccaacugggc

SEQ ID NO: 1181821 - RNA, 14 nt, Mycobacterium bovis subsp bovis AF2122/97
aggccaagccgcgg

SEQ ID NO: 1181822 - RNA, 16 nt, Mycobacterium bovis subsp bovis AF2122/97
aggcauucgagcacgu

SEQ ID NO: 1181823 - RNA, 14 nt, Mycobacterium bovis subsp bovis AF2122/97
aggcaucguccacg

SEQ ID NO: 1181824 - RNA, 20 nt, Mycobacterium bovis subsp bovis AF2122/97
aggcauucccgcggcaacgc

SEQ ID NO: 1181825 - RNA, 14 nt, Mycobacterium bovis subsp bovis AF2122/97
aggcaugccacaca

SEQ ID NO: 1181826 - RNA, 13 nt, Mycobacterium bovis subsp bovis AF2122/97
aggcaccgacauc

SEQ ID NO: 1181827 - RNA, 21 nt, Mycobacterium bovis subsp bovis AF2122/97
aggcaccggaugauguggugu

SEQ ID NO: 1181828 - RNA, 19 nt, Mycobacterium bovis subsp bovis AF2122/97
aggcaccgaaaaacaccag

SEQ ID NO: 1181829 - RNA, 21 nt, Mycobacterium bovis subsp bovis AF2122/97
aggcaccgaaaaacaccagcg

SEQ ID NO: 1181830 - RNA, 16 nt, Mycobacterium bovis subsp bovis AF2122/97
aggagcgggugcauuc

SEQ ID NO: 1181831 - RNA, 12 nt, Mycobacterium bovis subsp bovis AF2122/97
aggagccgggcc

SEQ ID NO: 1181832 - RNA, 14 nt, Mycobacterium bovis subsp bovis AF2122/97
aggagccgucacgc

SEQ ID NO: 1181833 - RNA, 19 nt, Mycobacterium bovis subsp bovis AF2122/97
aggagcccguccaggcccg

SEQ ID NO: 1181834 - RNA, 16 nt, Mycobacterium bovis subsp bovis AF2122/97
aggauucggcggucgc

SEQ ID NO: 1181835 - RNA, 22 nt, Mycobacterium bovis subsp bovis AF2122/97
aggauuuucucggggugguggu

SEQ ID NO: 1181836 - RNA, 17 nt, Mycobacterium bovis subsp bovis AF2122/97
agcugccguuggggugg

SEQ ID NO: 1181837 - RNA, 17 nt, Mycobacterium bovis subsp bovis AF2122/97
agcugccggcccaccag

SEQ ID NO: 1181838 - RNA, 20 nt, Mycobacterium bovis subsp bovis AF2122/97
agcugccccgccaccucgcc

SEQ ID NO: 1181839 - RNA, 15 nt, Mycobacterium bovis subsp bovis AF2122/97
agcugccgcaccccc

SEQ ID NO: 1181840 - RNA, 15 nt, Mycobacterium bovis subsp bovis AF2122/97
agcugcucgagcaga

SEQ ID NO: 1181841 - RNA, 16 nt, Mycobacterium bovis subsp bovis AF2122/97
agcugcucgccggcca

SEQ ID NO: 1181842 - RNA, 19 nt, Mycobacterium bovis subsp bovis AF2122/97
agcuccaaccaugcgguua

SEQ ID NO: 1181843 - RNA, 20 nt, Mycobacterium bovis subsp bovis AF2122/97
agcugucggcuuccuccucg

SEQ ID NO: 1181844 - RNA, 17 nt, Mycobacterium bovis subsp bovis AF2122/97
agcugucgccuuugagg

SEQ ID NO: 1181845 - RNA, 20 nt, Mycobacterium bovis subsp bovis AF2122/97
agcugugaacaggccgaggc

SEQ ID NO: 1181846 - RNA, 15 nt, Mycobacterium bovis subsp bovis AF2122/97
agcuggacggccucc

SEQ ID NO: 1181847 - RNA, 22 nt, Mycobacterium bovis subsp bovis AF2122/97
agcugguaggucaccggucacc

SEQ ID NO: 1181848 - RNA, 20 nt, Mycobacterium bovis subsp bovis AF2122/97
agcuggucggcuucggggua

SEQ ID NO: 1181849 - RNA, 12 nt, Mycobacterium bovis subsp bovis AF2122/97
agcuggucccac

SEQ ID NO: 1181850 - RNA, 22 nt, Mycobacterium bovis subsp bovis AF2122/97
agcuggucccacaccuccucga

SEQ ID NO: 1181851 - RNA, 19 nt, Mycobacterium bovis subsp bovis AF2122/97
agcugguccuccaaggcgg

SEQ ID NO: 1181852 - RNA, 15 nt, Mycobacterium bovis subsp bovis AF2122/97
agcugguugugcugg

SEQ ID NO: 1181853 - RNA, 15 nt, Mycobacterium bovis subsp bovis AF2122/97
agcuggugagccaga

SEQ ID NO: 1181854 - RNA, 15 nt, Mycobacterium bovis subsp bovis AF2122/97
agcuucgcgcagccg

SEQ ID NO: 1181855 - RNA, 12 nt, Mycobacterium bovis subsp bovis AF2122/97
agcuucgccagg

SEQ ID NO: 1181856 - RNA, 14 nt, Mycobacterium bovis subsp bovis AF2122/97
agcuugucgagcag

SEQ ID NO: 1181857 - RNA, 15 nt, Mycobacterium bovis subsp bovis AF2122/97
agcuugucgggcacc

SEQ ID NO: 1181858 - RNA, 17 nt, Mycobacterium bovis subsp bovis AF2122/97
agcuuggucgccgggca

SEQ ID NO: 1181859 - RNA, 23 nt, Mycobacterium bovis subsp bovis AF2122/97
agcuuggucgccaugucggccag

SEQ ID NO: 1181860 - RNA, 15 nt, Mycobacterium bovis subsp bovis AF2122/97
agcuuggucgccggg

SEQ ID NO: 1181861 - RNA, 18 nt, Mycobacterium bovis subsp bovis AF2122/97
agcuugaucccauccaga

SEQ ID NO: 1181862 - RNA, 16 nt, Mycobacterium bovis subsp bovis AF2122/97
agcuugaucgccgagg

SEQ ID NO: 1181863 - RNA, 21 nt, Mycobacterium bovis subsp bovis AF2122/97
agcuugagcgugagcgccgcg

SEQ ID NO: 1181864 - RNA, 19 nt, Mycobacterium bovis subsp bovis AF2122/97
agcuugacguugccgggcu

SEQ ID NO: 1181865 - RNA, 18 nt, Mycobacterium bovis subsp bovis AF2122/97
aggaagucccgggcaccg

SEQ ID NO: 1181866 - RNA, 21 nt, Mycobacterium bovis subsp bovis AF2122/97
aggaaguccagcuggccgggu

SEQ ID NO: 1181867 - RNA, 20 nt, Mycobacterium bovis subsp bovis AF2122/97
aggaaguagaugagcagacc

SEQ ID NO: 1181868 - RNA, 22 nt, Mycobacterium bovis subsp bovis AF2122/97
aggacagcagccgccggccggc

SEQ ID NO: 1181869 - RNA, 16 nt, Mycobacterium bovis subsp bovis AF2122/97
aggacaauggacacca

SEQ ID NO: 1181870 - RNA, 20 nt, Mycobacterium bovis subsp bovis AF2122/97
aggacaccaccguggccucg

SEQ ID NO: 1181871 - RNA, 20 nt, Mycobacterium bovis subsp bovis AF2122/97
aggacuugcacgucggcugc

SEQ ID NO: 1181872 - RNA, 21 nt, Mycobacterium bovis subsp bovis AF2122/97
aggacuucggugagcagggcg

SEQ ID NO: 1181873 - RNA, 14 nt, Mycobacterium bovis subsp bovis AF2122/97
aggacuucugcugc

SEQ ID NO: 1181874 - RNA, 15 nt, Mycobacterium bovis subsp bovis AF2122/97
aggacuggcaccgcc

SEQ ID NO: 1181875 - RNA, 21 nt, Mycobacterium bovis subsp bovis AF2122/97
aggagaucaacauccugggca

SEQ ID NO: 1181876 - RNA, 13 nt, Mycobacterium bovis subsp bovis AF2122/97
aggagaucagcac

SEQ ID NO: 1181877 - RNA, 16 nt, Mycobacterium bovis subsp bovis AF2122/97
aggagaaccaaaccgc

SEQ ID NO: 1181878 - RNA, 21 nt, Mycobacterium bovis subsp bovis AF2122/97
agcuuucuuggcgggcgccuu

SEQ ID NO: 1181879 - RNA, 17 nt, Mycobacterium bovis subsp bovis AF2122/97
aggaagaucaccucccg

SEQ ID NO: 1181880 - RNA, 20 nt, Mycobacterium bovis subsp bovis AF2122/97
aggaacucggcccacacggu

SEQ ID NO: 1181881 - RNA, 18 nt, Mycobacterium bovis subsp bovis AF2122/97
aggaacucggacccaccc

SEQ ID NO: 1181882 - RNA, 16 nt, Mycobacterium bovis subsp bovis AF2122/97
agaaaacccucgcugc

SEQ ID NO: 1181883 - RNA, 17 nt, Mycobacterium bovis subsp bovis AF2122/97
agaaacccggcgaccac

SEQ ID NO: 1181884 - RNA, 21 nt, Mycobacterium bovis subsp bovis AF2122/97
agaaaccaggacccaucgcca

SEQ ID NO: 1181885 - RNA, 15 nt, Mycobacterium bovis subsp bovis AF2122/97
agaaacccugcugcg

SEQ ID NO: 1181886 - RNA, 17 nt, Mycobacterium bovis subsp bovis AF2122/97
agaaggccagcgcgccc

SEQ ID NO: 1181887 - RNA, 14 nt, Mycobacterium bovis subsp bovis AF2122/97
agaaggaccgcucg

SEQ ID NO: 1181888 - RNA, 14 nt, Mycobacterium bovis subsp bovis AF2122/97
agaagcgcuccagc

SEQ ID NO: 1181889 - RNA, 17 nt, Mycobacterium bovis subsp bovis AF2122/97
agaagauggcaccgccc

SEQ ID NO: 1181890 - RNA, 12 nt, Mycobacterium bovis subsp bovis AF2122/97
agaacuggcugc

SEQ ID NO: 1181891 - RNA, 18 nt, Mycobacterium bovis subsp bovis AF2122/97
agaaccggguaaugcgac

SEQ ID NO: 1181892 - RNA, 18 nt, Mycobacterium bovis subsp bovis AF2122/97
agaaccggucgcagugca

SEQ ID NO: 1181893 - RNA, 15 nt, Mycobacterium bovis subsp bovis AF2122/97
agaacuccgccacca

SEQ ID NO: 1181894 - RNA, 16 nt, Mycobacterium bovis subsp bovis AF2122/97
agaacuccgccaccau

SEQ ID NO: 1181895 - RNA, 16 nt, Mycobacterium bovis subsp bovis AF2122/97
agaacaccaccgccag

SEQ ID NO: 1181896 - RNA, 17 nt, Mycobacterium bovis subsp bovis AF2122/97
agaaccgacggccagca

SEQ ID NO: 1181897 - RNA, 17 nt, Mycobacterium bovis subsp bovis AF2122/97
agacagcgccaugcccu

SEQ ID NO: 1181898 - RNA, 12 nt, Mycobacterium bovis subsp bovis AF2122/97
agacacuggucg

SEQ ID NO: 1181899 - RNA, 20 nt, Mycobacterium bovis subsp bovis AF2122/97
agacaccggcuauaucccgc

SEQ ID NO: 1181900 - RNA, 13 nt, Mycobacterium bovis subsp bovis AF2122/97
agacaacaacacg

SEQ ID NO: 1181901 - RNA, 19 nt, Mycobacterium bovis subsp bovis AF2122/97
agaaucgaagcggcugcug

SEQ ID NO: 1181902 - RNA, 20 nt, Mycobacterium bovis subsp bovis AF2122/97
agaaucgcacgaaaucagcc

SEQ ID NO: 1181903 - RNA, 16 nt, Mycobacterium bovis subsp bovis AF2122/97
agaauccggcaaccac

SEQ ID NO: 1181904 - RNA, 15 nt, Mycobacterium bovis subsp bovis AF2122/97
agaauccggcccacc

SEQ ID NO: 1181905 - RNA, 11 nt, Mycobacterium bovis subsp bovis AF2122/97
agaauuggccc

SEQ ID NO: 1181906 - RNA, 18 nt, Mycobacterium bovis subsp bovis AF2122/97
agaccuggccugcggcag

SEQ ID NO: 1181907 - RNA, 14 nt, Mycobacterium bovis subsp bovis AF2122/97
agaccgcggcggcc

SEQ ID NO: 1181908 - RNA, 16 nt, Mycobacterium bovis subsp bovis AF2122/97
agaccgccuccaccgc

SEQ ID NO: 1181909 - RNA, 18 nt, Mycobacterium bovis subsp bovis AF2122/97
agaccgccuccaccgccg

SEQ ID NO: 1181910 - RNA, 15 nt, Mycobacterium bovis subsp bovis AF2122/97
agaccgcgaacagcg

SEQ ID NO: 1181911 - RNA, 16 nt, Mycobacterium bovis subsp bovis AF2122/97
agaccgaucggcaggc

SEQ ID NO: 1181912 - RNA, 23 nt, Mycobacterium bovis subsp bovis AF2122/97
agaccaugaagaacuggcugcug

SEQ ID NO: 1181913 - RNA, 18 nt, Mycobacterium bovis subsp bovis AF2122/97
agacggugcgggcuaggc

SEQ ID NO: 1181914 - RNA, 20 nt, Mycobacterium bovis subsp bovis AF2122/97
agacgcaugucgggccaggc

SEQ ID NO: 1181915 - RNA, 18 nt, Mycobacterium bovis subsp bovis AF2122/97
agacgccacugccagccg

SEQ ID NO: 1181916 - RNA, 21 nt, Mycobacterium bovis subsp bovis AF2122/97
agacgccacugccagccgugc

SEQ ID NO: 1181917 - RNA, 12 nt, Mycobacterium bovis subsp bovis AF2122/97
agacgccgccgu

SEQ ID NO: 1181918 - RNA, 16 nt, Mycobacterium bovis subsp bovis AF2122/97
agacgauucggcggcc

SEQ ID NO: 1181919 - RNA, 15 nt, Mycobacterium bovis subsp bovis AF2122/97
agacgauggccaggu

SEQ ID NO: 1181920 - RNA, 17 nt, Mycobacterium bovis subsp bovis AF2122/97
agacgaugcuggcggcc

SEQ ID NO: 1181921 - RNA, 15 nt, Mycobacterium bovis subsp bovis AF2122/97
agacgcacggccacc

SEQ ID NO: 1181922 - RNA, 20 nt, Mycobacterium bovis subsp bovis AF2122/97
agacgcacggccaccgcgca

SEQ ID NO: 1181923 - RNA, 19 nt, Mycobacterium bovis subsp bovis AF2122/97
agacgcagaaucgcaugau

SEQ ID NO: 1181924 - RNA, 14 nt, Mycobacterium bovis subsp bovis AF2122/97
agaccagcaggccc

SEQ ID NO: 1181925 - RNA, 16 nt, Mycobacterium bovis subsp bovis AF2122/97
agaccagcaggcccug

SEQ ID NO: 1181926 - RNA, 17 nt, Mycobacterium bovis subsp bovis AF2122/97
agaccagcaggcccugg

SEQ ID NO: 1181927 - RNA, 17 nt, Mycobacterium bovis subsp bovis AF2122/97
agaccagacugcagugc

SEQ ID NO: 1181928 - RNA, 17 nt, Mycobacterium bovis subsp bovis AF2122/97
agaccagggcagcggcc

SEQ ID NO: 1181929 - RNA, 11 nt, Mycobacterium bovis subsp bovis AF2122/97
agaccaagucc

SEQ ID NO: 1181930 - RNA, 19 nt, Mycobacterium bovis subsp bovis AF2122/97
agaccaacauacagcaauc

SEQ ID NO: 1181931 - RNA, 21 nt, Mycobacterium bovis subsp bovis AF2122/97
agaccaagagcgcgcagcagu

SEQ ID NO: 1181932 - RNA, 19 nt, Mycobacterium bovis subsp bovis AF2122/97
agacguccgcggucgcagc

SEQ ID NO: 1181933 - RNA, 20 nt, Mycobacterium bovis subsp bovis AF2122/97
agagccgggcucgucgagug

SEQ ID NO: 1181934 - RNA, 22 nt, Mycobacterium bovis subsp bovis AF2122/97
agagcacugggcuggccagcac

SEQ ID NO: 1181935 - RNA, 22 nt, Mycobacterium bovis subsp bovis AF2122/97
agagcagaucuuccgagcacuc

SEQ ID NO: 1181936 - RNA, 13 nt, Mycobacterium bovis subsp bovis AF2122/97
agagcagccagcc

SEQ ID NO: 1181937 - RNA, 17 nt, Mycobacterium bovis subsp bovis AF2122/97
agaggugcugcaccugg

SEQ ID NO: 1181938 - RNA, 14 nt, Mycobacterium bovis subsp bovis AF2122/97
agagguuggcggcc

SEQ ID NO: 1181939 - RNA, 20 nt, Mycobacterium bovis subsp bovis AF2122/97
agaggcgauccaaugcgagg

SEQ ID NO: 1181940 - RNA, 18 nt, Mycobacterium bovis subsp bovis AF2122/97
agaggcgcaccuccugcg

SEQ ID NO: 1181941 - RNA, 18 nt, Mycobacterium bovis subsp bovis AF2122/97
agaggauggucagcagcu

SEQ ID NO: 1181942 - RNA, 18 nt, Mycobacterium bovis subsp bovis AF2122/97
agaucaccucccgcggca

SEQ ID NO: 1181943 - RNA, 16 nt, Mycobacterium bovis subsp bovis AF2122/97
agaucagcacccaaga

SEQ ID NO: 1181944 - RNA, 14 nt, Mycobacterium bovis subsp bovis AF2122/97
agaucacgcgucgu

SEQ ID NO: 1181945 - RNA, 18 nt, Mycobacterium bovis subsp bovis AF2122/97
agaucagccucgcgggca

SEQ ID NO: 1181946 - RNA, 21 nt, Mycobacterium bovis subsp bovis AF2122/97
agaucagccucgcgggcaggg

SEQ ID NO: 1181947 - RNA, 20 nt, Mycobacterium bovis subsp bovis AF2122/97
agaucagcaugguccacagc

SEQ ID NO: 1181948 - RNA, 13 nt, Mycobacterium bovis subsp bovis AF2122/97
agauacggccacc

SEQ ID NO: 1181949 - RNA, 20 nt, Mycobacterium bovis subsp bovis AF2122/97
agauagacguuguugaaggc

SEQ ID NO: 1181950 - RNA, 19 nt, Mycobacterium bovis subsp bovis AF2122/97
agaguuggggcacaaccgg

SEQ ID NO: 1181951 - RNA, 15 nt, Mycobacterium bovis subsp bovis AF2122/97
agaguucgcgcgccg

SEQ ID NO: 1181952 - RNA, 14 nt, Mycobacterium bovis subsp bovis AF2122/97
agauggcccgucgu

SEQ ID NO: 1181953 - RNA, 21 nt, Mycobacterium bovis subsp bovis AF2122/97
agauggcgaucaugagcagca

SEQ ID NO: 1181954 - RNA, 22 nt, Mycobacterium bovis subsp bovis AF2122/97
agauggcgaucaugagcagcac

SEQ ID NO: 1181955 - RNA, 22 nt, Mycobacterium bovis subsp bovis AF2122/97
agauggcucucggugguccagc

SEQ ID NO: 1181956 - RNA, 22 nt, Mycobacterium bovis subsp bovis AF2122/97
agauguccucccauucccaaca

SEQ ID NO: 1181957 - RNA, 15 nt, Mycobacterium bovis subsp bovis AF2122/97
agaugccggcgagca

SEQ ID NO: 1181958 - RNA, 16 nt, Mycobacterium bovis subsp bovis AF2122/97
agaugcauccagcugc

SEQ ID NO: 1181959 - RNA, 12 nt, Mycobacterium bovis subsp bovis AF2122/97
agauggaauggc

SEQ ID NO: 1181960 - RNA, 23 nt, Mycobacterium bovis subsp bovis AF2122/97
agaugccguaguaaggagccggg

SEQ ID NO: 1181961 - RNA, 20 nt, Mycobacterium bovis subsp bovis AF2122/97
agaugcgcccggcgugguga

SEQ ID NO: 1181962 - RNA, 19 nt, Mycobacterium bovis subsp bovis AF2122/97
agauucggugccagcaggc

SEQ ID NO: 1181963 - RNA, 21 nt, Mycobacterium bovis subsp bovis AF2122/97
agauuccugguuccaagggaa

SEQ ID NO: 1181964 - RNA, 19 nt, Mycobacterium bovis subsp bovis AF2122/97
agauuccucuucaggcccu

SEQ ID NO: 1181965 - RNA, 14 nt, Mycobacterium bovis subsp bovis AF2122/97
agauucauuggccu

SEQ ID NO: 1181966 - RNA, 20 nt, Mycobacterium bovis subsp bovis AF2122/97
agauugguggcccgggccac

SEQ ID NO: 1181967 - RNA, 17 nt, Mycobacterium bovis subsp bovis AF2122/97
agauugugagcaauggc

SEQ ID NO: 1181968 - RNA, 22 nt, Mycobacterium bovis subsp bovis AF2122/97
agauuguuuuccuugcgguagg

SEQ ID NO: 1181969 - RNA, 16 nt, Mycobacterium bovis subsp bovis AF2122/97
agcaacagcaggugcc

SEQ ID NO: 1181970 - RNA, 16 nt, Mycobacterium bovis subsp bovis AF2122/97
agcaaacgaggauuca

SEQ ID NO: 1181971 - RNA, 14 nt, Mycobacterium bovis subsp bovis AF2122/97
agcaaaauggccac

SEQ ID NO: 1181972 - RNA, 20 nt, Mycobacterium bovis subsp bovis AF2122/97
agcaaaggggugugugcugc

SEQ ID NO: 1181973 - RNA, 13 nt, Mycobacterium bovis subsp bovis AF2122/97
agcaaagccagcg

SEQ ID NO: 1181974 - RNA, 14 nt, Mycobacterium bovis subsp bovis AF2122/97
agccuggccucgcc

SEQ ID NO: 1181975 - RNA, 12 nt, Mycobacterium bovis subsp bovis AF2122/97
agccugugcugc

SEQ ID NO: 1181976 - RNA, 15 nt, Mycobacterium bovis subsp bovis AF2122/97
agccugugcugccaa

SEQ ID NO: 1181977 - RNA, 14 nt, Mycobacterium bovis subsp bovis AF2122/97
agcgaaagugugga

SEQ ID NO: 1181978 - RNA, 12 nt, Mycobacterium bovis subsp bovis AF2122/97
agcgaauccagc

SEQ ID NO: 1181979 - RNA, 16 nt, Mycobacterium bovis subsp bovis AF2122/97
agccuuucgugcaccg

SEQ ID NO: 1181980 - RNA, 22 nt, Mycobacterium bovis subsp bovis AF2122/97
agccgccaccguacgacagucg

SEQ ID NO: 1181981 - RNA, 16 nt, Mycobacterium bovis subsp bovis AF2122/97
agccgcagcuuggccu

SEQ ID NO: 1181982 - RNA, 20 nt, Mycobacterium bovis subsp bovis AF2122/97
agccgcaucuugucgagcac

SEQ ID NO: 1181983 - RNA, 18 nt, Mycobacterium bovis subsp bovis AF2122/97
agccgcauaggccccgcc

SEQ ID NO: 1181984 - RNA, 20 nt, Mycobacterium bovis subsp bovis AF2122/97
agccugauaaagcccggcgg

SEQ ID NO: 1181985 - RNA, 23 nt, Mycobacterium bovis subsp bovis AF2122/97
agccugaccgaagucugcagacg

SEQ ID NO: 1181986 - RNA, 20 nt, Mycobacterium bovis subsp bovis AF2122/97
agccugccgaugacgauggc

SEQ ID NO: 1181987 - RNA, 23 nt, Mycobacterium bovis subsp bovis AF2122/97
agccugccgaugacgauggccgc

SEQ ID NO: 1181988 - RNA, 13 nt, Mycobacterium bovis subsp bovis AF2122/97
agccugccgaacc

SEQ ID NO: 1181989 - RNA, 21 nt, Mycobacterium bovis subsp bovis AF2122/97
agccugccagguacucagugu

SEQ ID NO: 1181990 - RNA, 19 nt, Mycobacterium bovis subsp bovis AF2122/97
agccugcgcuguucggcac

SEQ ID NO: 1181991 - RNA, 18 nt, Mycobacterium bovis subsp bovis AF2122/97
agccugcgccgacccgcg

SEQ ID NO: 1181992 - RNA, 22 nt, Mycobacterium bovis subsp bovis AF2122/97
agcgagucgggguacaggcugc

SEQ ID NO: 1181993 - RNA, 17 nt, Mycobacterium bovis subsp bovis AF2122/97
agcgaguuucugcucga

SEQ ID NO: 1181994 - RNA, 15 nt, Mycobacterium bovis subsp bovis AF2122/97
agcgaucgugcugcc

SEQ ID NO: 1181995 - RNA, 17 nt, Mycobacterium bovis subsp bovis AF2122/97
agcgaucuugguggccu

SEQ ID NO: 1181996 - RNA, 20 nt, Mycobacterium bovis subsp bovis AF2122/97
agcgacaagugcacgaaguc

SEQ ID NO: 1181997 - RNA, 17 nt, Mycobacterium bovis subsp bovis AF2122/97
agcgacuccaccccacc

SEQ ID NO: 1181998 - RNA, 22 nt, Mycobacterium bovis subsp bovis AF2122/97
agcgaaugucugcgcagguggu

SEQ ID NO: 1181999 - RNA, 12 nt, Mycobacterium bovis subsp bovis AF2122/97
agcgagcagcuc

SEQ ID NO: 1182000 - RNA, 14 nt, Mycobacterium bovis subsp bovis AF2122/97
agcgagcccagcug

SEQ ID NO: 1182001 - RNA, 15 nt, Mycobacterium bovis subsp bovis AF2122/97
agcgagcggcaccaa

SEQ ID NO: 1182002 - RNA, 18 nt, Mycobacterium bovis subsp bovis AF2122/97
agcgacuccagcgcccgg

SEQ ID NO: 1182003 - RNA, 22 nt, Mycobacterium bovis subsp bovis AF2122/97
agcgcggcgcgcaggaccugcg

SEQ ID NO: 1182004 - RNA, 16 nt, Mycobacterium bovis subsp bovis AF2122/97
agcgcggcgcgacaga

SEQ ID NO: 1182005 - RNA, 20 nt, Mycobacterium bovis subsp bovis AF2122/97
agcgcggcgcccuggccgcc

SEQ ID NO: 1182006 - RNA, 19 nt, Mycobacterium bovis subsp bovis AF2122/97
agcgcgucggagccgggca

SEQ ID NO: 1182007 - RNA, 13 nt, Mycobacterium bovis subsp bovis AF2122/97
agcgcggcgacga

SEQ ID NO: 1182008 - RNA, 19 nt, Mycobacterium bovis subsp bovis AF2122/97
agcgcggccagcagcagau

SEQ ID NO: 1182009 - RNA, 13 nt, Mycobacterium bovis subsp bovis AF2122/97
agcgcggccagca

SEQ ID NO: 1182010 - RNA, 22 nt, Mycobacterium bovis subsp bovis AF2122/97
agcgcggccacgccgaucaaca

SEQ ID NO: 1182011 - RNA, 20 nt, Mycobacterium bovis subsp bovis AF2122/97
agcgcgcgcgggugcaaccg

SEQ ID NO: 1182012 - RNA, 14 nt, Mycobacterium bovis subsp bovis AF2122/97
agcgcgccggccau

SEQ ID NO: 1182013 - RNA, 18 nt, Mycobacterium bovis subsp bovis AF2122/97
agcgcgccucgcccagca

SEQ ID NO: 1182014 - RNA, 22 nt, Mycobacterium bovis subsp bovis AF2122/97
agcgcgcccgacacccguaagc

SEQ ID NO: 1182015 - RNA, 13 nt, Mycobacterium bovis subsp bovis AF2122/97
agcgccgcagggu

SEQ ID NO: 1182016 - RNA, 20 nt, Mycobacterium bovis subsp bovis AF2122/97
agcgccucaagcucgccgga

SEQ ID NO: 1182017 - RNA, 15 nt, Mycobacterium bovis subsp bovis AF2122/97
agcgccuccagcacc

SEQ ID NO: 1182018 - RNA, 18 nt, Mycobacterium bovis subsp bovis AF2122/97
agcgccucgccggccacc

SEQ ID NO: 1182019 - RNA, 19 nt, Mycobacterium bovis subsp bovis AF2122/97
agcgccucgccggccaccc

SEQ ID NO: 1182020 - RNA, 17 nt, Mycobacterium bovis subsp bovis AF2122/97
agcgccgauaccagcca

SEQ ID NO: 1182021 - RNA, 15 nt, Mycobacterium bovis subsp bovis AF2122/97
agcgccgauggccgc

SEQ ID NO: 1182022 - RNA, 18 nt, Mycobacterium bovis subsp bovis AF2122/97
agcgccgcacagaaaacg

SEQ ID NO: 1182023 - RNA, 16 nt, Mycobacterium bovis subsp bovis AF2122/97
agcgcccguuggccaa

SEQ ID NO: 1182024 - RNA, 16 nt, Mycobacterium bovis subsp bovis AF2122/97
agcgccgaaacagcac

SEQ ID NO: 1182025 - RNA, 18 nt, Mycobacterium bovis subsp bovis AF2122/97
agcgccuugaccagcagc

SEQ ID NO: 1182026 - RNA, 22 nt, Mycobacterium bovis subsp bovis AF2122/97
agcgccuugcgggccuggugga

SEQ ID NO: 1182027 - RNA, 19 nt, Mycobacterium bovis subsp bovis AF2122/97
agcgccuugucgaucucgu

SEQ ID NO: 1182028 - RNA, 19 nt, Mycobacterium bovis subsp bovis AF2122/97
agcgccucgguggucuugg

SEQ ID NO: 1182029 - RNA, 17 nt, Mycobacterium bovis subsp bovis AF2122/97
agcgccugagcggccuc

SEQ ID NO: 1182030 - RNA, 21 nt, Mycobacterium bovis subsp bovis AF2122/97
agcgauuuggcgucgccgagg

SEQ ID NO: 1182031 - RNA, 17 nt, Mycobacterium bovis subsp bovis AF2122/97
agcgcaaagcccuccuc

SEQ ID NO: 1182032 - RNA, 18 nt, Mycobacterium bovis subsp bovis AF2122/97
agcgcaacggccagcgcu

SEQ ID NO: 1182033 - RNA, 12 nt, Mycobacterium bovis subsp bovis AF2122/97
agcgcaaugcgc

SEQ ID NO: 1182034 - RNA, 17 nt, Mycobacterium bovis subsp bovis AF2122/97
agcgcaacucccagcac

SEQ ID NO: 1182035 - RNA, 19 nt, Mycobacterium bovis subsp bovis AF2122/97
agcgccaggccgcacagca

SEQ ID NO: 1182036 - RNA, 20 nt, Mycobacterium bovis subsp bovis AF2122/97
agcgcccgucguagguggcc

SEQ ID NO: 1182037 - RNA, 20 nt, Mycobacterium bovis subsp bovis AF2122/97
agcgcccguuggccaagaau

SEQ ID NO: 1182038 - RNA, 13 nt, Mycobacterium bovis subsp bovis AF2122/97
agcgccagcagcu

SEQ ID NO: 1182039 - RNA, 21 nt, Mycobacterium bovis subsp bovis AF2122/97
agcgccagccgcugccacagg

SEQ ID NO: 1182040 - RNA, 13 nt, Mycobacterium bovis subsp bovis AF2122/97
agcgcaucggcca

SEQ ID NO: 1182041 - RNA, 18 nt, Mycobacterium bovis subsp bovis AF2122/97
agcgcaucggccagcagc

SEQ ID NO: 1182042 - RNA, 12 nt, Mycobacterium bovis subsp bovis AF2122/97
agcgcaucgcca

SEQ ID NO: 1182043 - RNA, 16 nt, Mycobacterium bovis subsp bovis AF2122/97
agcgugcugccgccuu

SEQ ID NO: 1182044 - RNA, 19 nt, Mycobacterium bovis subsp bovis AF2122/97
agcgugccgaacagggagg

SEQ ID NO: 1182045 - RNA, 15 nt, Mycobacterium bovis subsp bovis AF2122/97
agcgugccugcaguu

SEQ ID NO: 1182046 - RNA, 22 nt, Mycobacterium bovis subsp bovis AF2122/97
agcguggugauccggucuccgc

SEQ ID NO: 1182047 - RNA, 13 nt, Mycobacterium bovis subsp bovis AF2122/97
agcguucccacac

SEQ ID NO: 1182048 - RNA, 18 nt, Mycobacterium bovis subsp bovis AF2122/97
agcguucccgccggcucc

SEQ ID NO: 1182049 - RNA, 17 nt, Mycobacterium bovis subsp bovis AF2122/97
agcguuccgcucgaauc

SEQ ID NO: 1182050 - RNA, 17 nt, Mycobacterium bovis subsp bovis AF2122/97
agcguuaggucgccggc

SEQ ID NO: 1182051 - RNA, 16 nt, Mycobacterium bovis subsp bovis AF2122/97
agcguccgguggucag

SEQ ID NO: 1182052 - RNA, 23 nt, Mycobacterium bovis subsp bovis AF2122/97
agcguccuggcguagugcagcug

SEQ ID NO: 1182053 - RNA, 22 nt, Mycobacterium bovis subsp bovis AF2122/97
agcguccauggucgcgccaccc

SEQ ID NO: 1182054 - RNA, 17 nt, Mycobacterium bovis subsp bovis AF2122/97
agcguccccaugcagcg

SEQ ID NO: 1182055 - RNA, 22 nt, Mycobacterium bovis subsp bovis AF2122/97
agcgguugccuucuuggcggga

SEQ ID NO: 1182056 - RNA, 13 nt, Mycobacterium bovis subsp bovis AF2122/97
agcguccaaccca

SEQ ID NO: 1182057 - RNA, 20 nt, Mycobacterium bovis subsp bovis AF2122/97
agcguaaugcugcugcagca

SEQ ID NO: 1182058 - RNA, 18 nt, Mycobacterium bovis subsp bovis AF2122/97
agcgcguucggcaccugg

SEQ ID NO: 1182059 - RNA, 18 nt, Mycobacterium bovis subsp bovis AF2122/97
agcgcgugcuguggaugc

SEQ ID NO: 1182060 - RNA, 22 nt, Mycobacterium bovis subsp bovis AF2122/97
agcgcgucguccagggcgacga

SEQ ID NO: 1182061 - RNA, 19 nt, Mycobacterium bovis subsp bovis AF2122/97
agcggcccgaucaccagcc

SEQ ID NO: 1182062 - RNA, 21 nt, Mycobacterium bovis subsp bovis AF2122/97
agcggcccgaucaccagcccc

SEQ ID NO: 1182063 - RNA, 22 nt, Mycobacterium bovis subsp bovis AF2122/97
agcggccauccggcggcggcca

SEQ ID NO: 1182064 - RNA, 12 nt, Mycobacterium bovis subsp bovis AF2122/97
agcggccagcag

SEQ ID NO: 1182065 - RNA, 12 nt, Mycobacterium bovis subsp bovis AF2122/97
agcggccgggac

SEQ ID NO: 1182066 - RNA, 17 nt, Mycobacterium bovis subsp bovis AF2122/97
agcggccgcuccaccuc

SEQ ID NO: 1182067 - RNA, 20 nt, Mycobacterium bovis subsp bovis AF2122/97
agcggccgggcggccaggcg

SEQ ID NO: 1182068 - RNA, 22 nt, Mycobacterium bovis subsp bovis AF2122/97
agcggccgguacacguccagug

SEQ ID NO: 1182069 - RNA, 21 nt, Mycobacterium bovis subsp bovis AF2122/97
agcggccuaggacgccgcccu

SEQ ID NO: 1182070 - RNA, 17 nt, Mycobacterium bovis subsp bovis AF2122/97
agcggcggucucggcgu

SEQ ID NO: 1182071 - RNA, 23 nt, Mycobacterium bovis subsp bovis AF2122/97
agcggcgggggcgucgccgccgg

SEQ ID NO: 1182072 - RNA, 19 nt, Mycobacterium bovis subsp bovis AF2122/97
agcggcgggucccgccacc

SEQ ID NO: 1182073 - RNA, 16 nt, Mycobacterium bovis subsp bovis AF2122/97
agcggcuugcccaggc

SEQ ID NO: 1182074 - RNA, 19 nt, Mycobacterium bovis subsp bovis AF2122/97
agcggcuugcccaggcgca

SEQ ID NO: 1182075 - RNA, 21 nt, Mycobacterium bovis subsp bovis AF2122/97
agcggcugcggcaacgagguc

SEQ ID NO: 1182076 - RNA, 13 nt, Mycobacterium bovis subsp bovis AF2122/97
agcggcugagccg

SEQ ID NO: 1182077 - RNA, 22 nt, Mycobacterium bovis subsp bovis AF2122/97
agcggcucggcgggggaccccg

SEQ ID NO: 1182078 - RNA, 22 nt, Mycobacterium bovis subsp bovis AF2122/97
agcggggauguccgcggccacc

SEQ ID NO: 1182079 - RNA, 22 nt, Mycobacterium bovis subsp bovis AF2122/97
agcggggcuagucgggguggga

SEQ ID NO: 1182080 - RNA, 16 nt, Mycobacterium bovis subsp bovis AF2122/97
agcgggcuccggcucg

SEQ ID NO: 1182081 - RNA, 16 nt, Mycobacterium bovis subsp bovis AF2122/97
agcgguugacccacag

SEQ ID NO: 1182082 - RNA, 19 nt, Mycobacterium bovis subsp bovis AF2122/97
agcgguugacccacagcau

SEQ ID NO: 1182083 - RNA, 16 nt, Mycobacterium bovis subsp bovis AF2122/97
agcgggcaacugcagc

SEQ ID NO: 1182084 - RNA, 21 nt, Mycobacterium bovis subsp bovis AF2122/97
agcuaccccggcggucaggcu

SEQ ID NO: 1182085 - RNA, 22 nt, Mycobacterium bovis subsp bovis AF2122/97
agcuagcgguggaaaaagcccg

SEQ ID NO: 1182086 - RNA, 19 nt, Mycobacterium bovis subsp bovis AF2122/97
agcuagcgcccgcgagaga

SEQ ID NO: 1182087 - RNA, 14 nt, Mycobacterium bovis subsp bovis AF2122/97
agcuagcccggcag

SEQ ID NO: 1182088 - RNA, 15 nt, Mycobacterium bovis subsp bovis AF2122/97
agcuagcccggcagc

SEQ ID NO: 1182089 - RNA, 16 nt, Mycobacterium bovis subsp bovis AF2122/97
agcuagaccgaucacc

SEQ ID NO: 1182090 - RNA, 18 nt, Mycobacterium bovis subsp bovis AF2122/97
agcguugccaggugcugu

SEQ ID NO: 1182091 - RNA, 13 nt, Mycobacterium bovis subsp bovis AF2122/97
agcuaacacccga

SEQ ID NO: 1182092 - RNA, 16 nt, Mycobacterium bovis subsp bovis AF2122/97
agcucacgugcugccg

SEQ ID NO: 1182093 - RNA, 23 nt, Mycobacterium bovis subsp bovis AF2122/97
agcucacuucacgccgccccugc

SEQ ID NO: 1182094 - RNA, 17 nt, Mycobacterium bovis subsp bovis AF2122/97
agcucagaccggcgccg

SEQ ID NO: 1182095 - RNA, 22 nt, Mycobacterium bovis subsp bovis AF2122/97
agcucaccacccgcacuccaag

SEQ ID NO: 1182096 - RNA, 13 nt, Mycobacterium bovis subsp bovis AF2122/97
agcucaucgccgc

SEQ ID NO: 1182097 - RNA, 14 nt, Mycobacterium bovis subsp bovis AF2122/97
agcucaucgccgcu

SEQ ID NO: 1182098 - RNA, 15 nt, Mycobacterium bovis subsp bovis AF2122/97
agcucaaccaccucg

SEQ ID NO: 1182099 - RNA, 17 nt, Mycobacterium bovis subsp bovis AF2122/97
agcccgccggccucugg

SEQ ID NO: 1182100 - RNA, 17 nt, Mycobacterium bovis subsp bovis AF2122/97
agcccggcguuguugac

SEQ ID NO: 1182101 - RNA, 19 nt, Mycobacterium bovis subsp bovis AF2122/97
agcccggggagacgagcac

SEQ ID NO: 1182102 - RNA, 22 nt, Mycobacterium bovis subsp bovis AF2122/97
agcccggucccuuuguggggcc

SEQ ID NO: 1182103 - RNA, 22 nt, Mycobacterium bovis subsp bovis AF2122/97
agcccggucgcugauccgggcg

SEQ ID NO: 1182104 - RNA, 20 nt, Mycobacterium bovis subsp bovis AF2122/97
agcccgcccgguguguucgg

SEQ ID NO: 1182105 - RNA, 16 nt, Mycobacterium bovis subsp bovis AF2122/97
agcccgauucagcgcc

SEQ ID NO: 1182106 - RNA, 19 nt, Mycobacterium bovis subsp bovis AF2122/97
agcccgccacccuuggccc

SEQ ID NO: 1182107 - RNA, 13 nt, Mycobacterium bovis subsp bovis AF2122/97
agcccgccacccu

SEQ ID NO: 1182108 - RNA, 15 nt, Mycobacterium bovis subsp bovis AF2122/97
agcccgagcgcuuga

SEQ ID NO: 1182109 - RNA, 21 nt, Mycobacterium bovis subsp bovis AF2122/97
agcccgacuggucacugcccu

SEQ ID NO: 1182110 - RNA, 22 nt, Mycobacterium bovis subsp bovis AF2122/97
agcccgaucgcggcccggcccu

SEQ ID NO: 1182111 - RNA, 19 nt, Mycobacterium bovis subsp bovis AF2122/97
agcccgagcucaccgcaca

SEQ ID NO: 1182112 - RNA, 14 nt, Mycobacterium bovis subsp bovis AF2122/97
agcccgagcucgcc

SEQ ID NO: 1182113 - RNA, 20 nt, Mycobacterium bovis subsp bovis AF2122/97
agcccgaugaucccgccacc

SEQ ID NO: 1182114 - RNA, 20 nt, Mycobacterium bovis subsp bovis AF2122/97
agcccgaugccgugcccggu

SEQ ID NO: 1182115 - RNA, 22 nt, Mycobacterium bovis subsp bovis AF2122/97
agcccgaugaucccgccaccga

SEQ ID NO: 1182116 - RNA, 14 nt, Mycobacterium bovis subsp bovis AF2122/97
agcccuguuugacu

SEQ ID NO: 1182117 - RNA, 16 nt, Mycobacterium bovis subsp bovis AF2122/97
agccgcagcugagccg

SEQ ID NO: 1182118 - RNA, 17 nt, Mycobacterium bovis subsp bovis AF2122/97
agccgauauaccagggc

SEQ ID NO: 1182119 - RNA, 22 nt, Mycobacterium bovis subsp bovis AF2122/97
agccgagguucaaagcagcgca

SEQ ID NO: 1182120 - RNA, 20 nt, Mycobacterium bovis subsp bovis AF2122/97
agccgagguucaaagcagcg

SEQ ID NO: 1182121 - RNA, 14 nt, Mycobacterium bovis subsp bovis AF2122/97
agccgagccucgcu

SEQ ID NO: 1182122 - RNA, 22 nt, Mycobacterium bovis subsp bovis AF2122/97
agccgaggacuggaaagcagca

SEQ ID NO: 1182123 - RNA, 16 nt, Mycobacterium bovis subsp bovis AF2122/97
agccgagccagcagcu

SEQ ID NO: 1182124 - RNA, 15 nt, Mycobacterium bovis subsp bovis AF2122/97
agccgagccaguccu

SEQ ID NO: 1182125 - RNA, 10 nt, Mycobacterium bovis subsp bovis AF2122/97
agccgagcac

SEQ ID NO: 1182126 - RNA, 16 nt, Mycobacterium bovis subsp bovis AF2122/97
agccgacgauccacgg

SEQ ID NO: 1182127 - RNA, 16 nt, Mycobacterium bovis subsp bovis AF2122/97
agccgaccucgagugc

SEQ ID NO: 1182128 - RNA, 16 nt, Mycobacterium bovis subsp bovis AF2122/97
agccgacgccuuccag

SEQ ID NO: 1182129 - RNA, 16 nt, Mycobacterium bovis subsp bovis AF2122/97
agcccaugucgagcac

SEQ ID NO: 1182130 - RNA, 17 nt, Mycobacterium bovis subsp bovis AF2122/97
agcccaugccgaugccc

SEQ ID NO: 1182131 - RNA, 18 nt, Mycobacterium bovis subsp bovis AF2122/97
agcccaucuaccagcuca

SEQ ID NO: 1182132 - RNA, 22 nt, Mycobacterium bovis subsp bovis AF2122/97
agcccagcagguuccacggcca

SEQ ID NO: 1182133 - RNA, 14 nt, Mycobacterium bovis subsp bovis AF2122/97
agcccagcgccucc

SEQ ID NO: 1182134 - RNA, 16 nt, Mycobacterium bovis subsp bovis AF2122/97
agcccagcgccuccag

SEQ ID NO: 1182135 - RNA, 13 nt, Mycobacterium bovis subsp bovis AF2122/97
agcccagcugcgc

SEQ ID NO: 1182136 - RNA, 15 nt, Mycobacterium bovis subsp bovis AF2122/97
agcccaggacggcua

SEQ ID NO: 1182137 - RNA, 20 nt, Mycobacterium bovis subsp bovis AF2122/97
agcccacccauggccuccca

SEQ ID NO: 1182138 - RNA, 18 nt, Mycobacterium bovis subsp bovis AF2122/97
agcccacucgucgaacac

SEQ ID NO: 1182139 - RNA, 17 nt, Mycobacterium bovis subsp bovis AF2122/97
agcccagauagagcugg

SEQ ID NO: 1182140 - RNA, 18 nt, Mycobacterium bovis subsp bovis AF2122/97
agcccagauccagcaacg

SEQ ID NO: 1182141 - RNA, 21 nt, Mycobacterium bovis subsp bovis AF2122/97
agccccuggaggggcaacagg

SEQ ID NO: 1182142 - RNA, 21 nt, Mycobacterium bovis subsp bovis AF2122/97
agccccugaaggccagccaac

SEQ ID NO: 1182143 - RNA, 13 nt, Mycobacterium bovis subsp bovis AF2122/97
agccccgcgccca

SEQ ID NO: 1182144 - RNA, 14 nt, Mycobacterium bovis subsp bovis AF2122/97
agccccgcgcccac

SEQ ID NO: 1182145 - RNA, 19 nt, Mycobacterium bovis subsp bovis AF2122/97
agccccgcgcccaccccgg

SEQ ID NO: 1182146 - RNA, 14 nt, Mycobacterium bovis subsp bovis AF2122/97
agccccgcaggggg

SEQ ID NO: 1182147 - RNA, 17 nt, Mycobacterium bovis subsp bovis AF2122/97
agccccuccgcgccgau

SEQ ID NO: 1182148 - RNA, 16 nt, Mycobacterium bovis subsp bovis AF2122/97
agccccgaccagcaga

SEQ ID NO: 1182149 - RNA, 19 nt, Mycobacterium bovis subsp bovis AF2122/97
agcccccgcgggggcggcc

SEQ ID NO: 1182150 - RNA, 18 nt, Mycobacterium bovis subsp bovis AF2122/97
agccagaccaacaugaac

SEQ ID NO: 1182151 - RNA, 17 nt, Mycobacterium bovis subsp bovis AF2122/97
agccacgccacguccaa

SEQ ID NO: 1182152 - RNA, 22 nt, Mycobacterium bovis subsp bovis AF2122/97
agccacgcaugggccaggucag

SEQ ID NO: 1182153 - RNA, 18 nt, Mycobacterium bovis subsp bovis AF2122/97
agccacgcugucccgcgg

SEQ ID NO: 1182154 - RNA, 14 nt, Mycobacterium bovis subsp bovis AF2122/97
agccaccgggugga

SEQ ID NO: 1182155 - RNA, 20 nt, Mycobacterium bovis subsp bovis AF2122/97
agccaccggguggaacaugu

SEQ ID NO: 1182156 - RNA, 14 nt, Mycobacterium bovis subsp bovis AF2122/97
agccagaucagccg

SEQ ID NO: 1182157 - RNA, 16 nt, Mycobacterium bovis subsp bovis AF2122/97
agccagagguggauca

SEQ ID NO: 1182158 - RNA, 16 nt, Mycobacterium bovis subsp bovis AF2122/97
agccagcgggcgauga

SEQ ID NO: 1182159 - RNA, 18 nt, Mycobacterium bovis subsp bovis AF2122/97
agccagcggcugcccauc

SEQ ID NO: 1182160 - RNA, 20 nt, Mycobacterium bovis subsp bovis AF2122/97
agccagcgguagcugcccag

SEQ ID NO: 1182161 - RNA, 17 nt, Mycobacterium bovis subsp bovis AF2122/97
agccagcguccaugguc

SEQ ID NO: 1182162 - RNA, 18 nt, Mycobacterium bovis subsp bovis AF2122/97
agcauggcccuggcgacc

SEQ ID NO: 1182163 - RNA, 21 nt, Mycobacterium bovis subsp bovis AF2122/97
agccaacccgucuuaucggcg

SEQ ID NO: 1182164 - RNA, 18 nt, Mycobacterium bovis subsp bovis AF2122/97
agccaaccguccggggcc

SEQ ID NO: 1182165 - RNA, 19 nt, Mycobacterium bovis subsp bovis AF2122/97
agccaacgucaccaaguuc

SEQ ID NO: 1182166 - RNA, 14 nt, Mycobacterium bovis subsp bovis AF2122/97
agccaagaaucacg

SEQ ID NO: 1182167 - RNA, 18 nt, Mycobacterium bovis subsp bovis AF2122/97
agccaaggcuuccuccga

SEQ ID NO: 1182168 - RNA, 23 nt, Mycobacterium bovis subsp bovis AF2122/97
agcaugccuucggccaaccaugc

SEQ ID NO: 1182169 - RNA, 22 nt, Mycobacterium bovis subsp bovis AF2122/97
agcaugauccgcucguggucgg

SEQ ID NO: 1182170 - RNA, 14 nt, Mycobacterium bovis subsp bovis AF2122/97
agccagcugaacac

SEQ ID NO: 1182171 - RNA, 22 nt, Mycobacterium bovis subsp bovis AF2122/97
agccagcugaacacgaauccgg

SEQ ID NO: 1182172 - RNA, 16 nt, Mycobacterium bovis subsp bovis AF2122/97
agccagucggccaccu

SEQ ID NO: 1182173 - RNA, 15 nt, Mycobacterium bovis subsp bovis AF2122/97
agccaggcccggcuu

SEQ ID NO: 1182174 - RNA, 23 nt, Mycobacterium bovis subsp bovis AF2122/97
agccauggccgccaggugaauuc

SEQ ID NO: 1182175 - RNA, 18 nt, Mycobacterium bovis subsp bovis AF2122/97
agcccaacucggccagcu

SEQ ID NO: 1182176 - RNA, 15 nt, Mycobacterium bovis subsp bovis AF2122/97
agcccaacagcaacc

SEQ ID NO: 1182177 - RNA, 16 nt, Mycobacterium bovis subsp bovis AF2122/97
agcccaaaucccagag

SEQ ID NO: 1182178 - RNA, 17 nt, Mycobacterium bovis subsp bovis AF2122/97
agccauuuccuuggcgc

SEQ ID NO: 1182179 - RNA, 19 nt, Mycobacterium bovis subsp bovis AF2122/97
agccauucgguguggccgu

SEQ ID NO: 1182180 - RNA, 17 nt, Mycobacterium bovis subsp bovis AF2122/97
agcaccguucgcagcac

SEQ ID NO: 1182181 - RNA, 15 nt, Mycobacterium bovis subsp bovis AF2122/97
agcaccucgaagugc

SEQ ID NO: 1182182 - RNA, 16 nt, Mycobacterium bovis subsp bovis AF2122/97
agcaccgugacccuga

SEQ ID NO: 1182183 - RNA, 20 nt, Mycobacterium bovis subsp bovis AF2122/97
agcaccgucggcaccagcag

SEQ ID NO: 1182184 - RNA, 19 nt, Mycobacterium bovis subsp bovis AF2122/97
agcaccgucgggcccagcc

SEQ ID NO: 1182185 - RNA, 14 nt, Mycobacterium bovis subsp bovis AF2122/97
agcaccgugacagc

SEQ ID NO: 1182186 - RNA, 17 nt, Mycobacterium bovis subsp bovis AF2122/97
agcacucggugucggcc

SEQ ID NO: 1182187 - RNA, 24 nt, Mycobacterium bovis subsp bovis AF2122/97
agcacucgcccaagcgcagccugg

SEQ ID NO: 1182188 - RNA, 13 nt, Mycobacterium bovis subsp bovis AF2122/97
agcacucggccac

SEQ ID NO: 1182189 - RNA, 22 nt, Mycobacterium bovis subsp bovis AF2122/97
agcacgucgcggccguggaugu

SEQ ID NO: 1182190 - RNA, 18 nt, Mycobacterium bovis subsp bovis AF2122/97
agcacgucgucgcgggaa

SEQ ID NO: 1182191 - RNA, 15 nt, Mycobacterium bovis subsp bovis AF2122/97
agcacgugggccaac

SEQ ID NO: 1182192 - RNA, 19 nt, Mycobacterium bovis subsp bovis AF2122/97
agcacguucaccgcgcgcu

SEQ ID NO: 1182193 - RNA, 16 nt, Mycobacterium bovis subsp bovis AF2122/97
agcacguugcacagcu

SEQ ID NO: 1182194 - RNA, 19 nt, Mycobacterium bovis subsp bovis AF2122/97
agcacggugaucagcagca

SEQ ID NO: 1182195 - RNA, 14 nt, Mycobacterium bovis subsp bovis AF2122/97
agcacguacauggu

SEQ ID NO: 1182196 - RNA, 21 nt, Mycobacterium bovis subsp bovis AF2122/97
agcacggugggcgcugggucg

SEQ ID NO: 1182197 - RNA, 14 nt, Mycobacterium bovis subsp bovis AF2122/97
agcagcaccaacug

SEQ ID NO: 1182198 - RNA, 21 nt, Mycobacterium bovis subsp bovis AF2122/97
agcagcaacgcggugccggga

SEQ ID NO: 1182199 - RNA, 12 nt, Mycobacterium bovis subsp bovis AF2122/97
agcagcacccgg

SEQ ID NO: 1182200 - RNA, 13 nt, Mycobacterium bovis subsp bovis AF2122/97
agcagccagccac

SEQ ID NO: 1182201 - RNA, 14 nt, Mycobacterium bovis subsp bovis AF2122/97
agcagccagccacc

SEQ ID NO: 1182202 - RNA, 15 nt, Mycobacterium bovis subsp bovis AF2122/97
agcagccagcccagc

SEQ ID NO: 1182203 - RNA, 22 nt, Mycobacterium bovis subsp bovis AF2122/97
agcagccacgauccuuggcgua

SEQ ID NO: 1182204 - RNA, 12 nt, Mycobacterium bovis subsp bovis AF2122/97
agcagccagcaa

SEQ ID NO: 1182205 - RNA, 17 nt, Mycobacterium bovis subsp bovis AF2122/97
agcagccagcaacacca

SEQ ID NO: 1182206 - RNA, 12 nt, Mycobacterium bovis subsp bovis AF2122/97
agcagcagugcc

SEQ ID NO: 1182207 - RNA, 21 nt, Mycobacterium bovis subsp bovis AF2122/97
agcacucuucgaugaagcugg

SEQ ID NO: 1182208 - RNA, 16 nt, Mycobacterium bovis subsp bovis AF2122/97
agcagaaacggcgacu

SEQ ID NO: 1182209 - RNA, 19 nt, Mycobacterium bovis subsp bovis AF2122/97
agcagcaaacaucgcaggc

SEQ ID NO: 1182210 - RNA, 13 nt, Mycobacterium bovis subsp bovis AF2122/97
agcagagccccgg

SEQ ID NO: 1182211 - RNA, 19 nt, Mycobacterium bovis subsp bovis AF2122/97
agcagagcggcacgcacgc

SEQ ID NO: 1182212 - RNA, 12 nt, Mycobacterium bovis subsp bovis AF2122/97
agcagcccgcgg

SEQ ID NO: 1182213 - RNA, 18 nt, Mycobacterium bovis subsp bovis AF2122/97
agcagcgccucauccucc

SEQ ID NO: 1182214 - RNA, 20 nt, Mycobacterium bovis subsp bovis AF2122/97
agcagcgggcugcgcuaccc

SEQ ID NO: 1182215 - RNA, 20 nt, Mycobacterium bovis subsp bovis AF2122/97
agcagcucgccggcacgcag

SEQ ID NO: 1182216 - RNA, 23 nt, Mycobacterium bovis subsp bovis AF2122/97
agcagcuccuugaggucacccau

SEQ ID NO: 1182217 - RNA, 15 nt, Mycobacterium bovis subsp bovis AF2122/97
agcagcgugggaaga

SEQ ID NO: 1182218 - RNA, 14 nt, Mycobacterium bovis subsp bovis AF2122/97
agcagcgucaucag

SEQ ID NO: 1182219 - RNA, 15 nt, Mycobacterium bovis subsp bovis AF2122/97
agcagcggugcagcc

SEQ ID NO: 1182220 - RNA, 11 nt, Mycobacterium bovis subsp bovis AF2122/97
agcaggaugau

SEQ ID NO: 1182221 - RNA, 21 nt, Mycobacterium bovis subsp bovis AF2122/97
agcaggaugcgaucgucacgc

SEQ ID NO: 1182222 - RNA, 13 nt, Mycobacterium bovis subsp bovis AF2122/97
agcaggcccagcg

SEQ ID NO: 1182223 - RNA, 13 nt, Mycobacterium bovis subsp bovis AF2122/97
agcaggcauuccc

SEQ ID NO: 1182224 - RNA, 20 nt, Mycobacterium bovis subsp bovis AF2122/97
agcaggcucgaaccgacgcg

SEQ ID NO: 1182225 - RNA, 20 nt, Mycobacterium bovis subsp bovis AF2122/97
agcaggcggcugaacggcag

SEQ ID NO: 1182226 - RNA, 17 nt, Mycobacterium bovis subsp bovis AF2122/97
agcaucuuuggcggccg

SEQ ID NO: 1182227 - RNA, 18 nt, Mycobacterium bovis subsp bovis AF2122/97
agcaugacaccggccacc

SEQ ID NO: 1182228 - RNA, 19 nt, Mycobacterium bovis subsp bovis AF2122/97
agcaugacaccggccacca

SEQ ID NO: 1182229 - RNA, 18 nt, Mycobacterium bovis subsp bovis AF2122/97
agcaucagcucgaugccg

SEQ ID NO: 1182230 - RNA, 14 nt, Mycobacterium bovis subsp bovis AF2122/97
agcaguccacgagc

SEQ ID NO: 1182231 - RNA, 17 nt, Mycobacterium bovis subsp bovis AF2122/97
agcaguacaccgcccgg

SEQ ID NO: 1182232 - RNA, 20 nt, Mycobacterium bovis subsp bovis AF2122/97
accauccccggcaacaaagg

SEQ ID NO: 1182233 - RNA, 13 nt, Mycobacterium bovis subsp bovis AF2122/97
accaucaucucgg

SEQ ID NO: 1182234 - RNA, 18 nt, Mycobacterium bovis subsp bovis AF2122/97
accaugcgcagaguauuc

SEQ ID NO: 1182235 - RNA, 17 nt, Mycobacterium bovis subsp bovis AF2122/97
accaugguugaugacgg

SEQ ID NO: 1182236 - RNA, 20 nt, Mycobacterium bovis subsp bovis AF2122/97
accaugauguagcggcguuc

SEQ ID NO: 1182237 - RNA, 22 nt, Mycobacterium bovis subsp bovis AF2122/97
accaucccugaaauaccagucc

SEQ ID NO: 1182238 - RNA, 16 nt, Mycobacterium bovis subsp bovis AF2122/97
accagaaccagcgacc

SEQ ID NO: 1182239 - RNA, 12 nt, Mycobacterium bovis subsp bovis AF2122/97
accagaaccagc

SEQ ID NO: 1182240 - RNA, 15 nt, Mycobacterium bovis subsp bovis AF2122/97
accaucaccgcgcca

SEQ ID NO: 1182241 - RNA, 20 nt, Mycobacterium bovis subsp bovis AF2122/97
accaucaccgcgccagccuc

SEQ ID NO: 1182242 - RNA, 16 nt, Mycobacterium bovis subsp bovis AF2122/97
accaucacacccauca

SEQ ID NO: 1182243 - RNA, 15 nt, Mycobacterium bovis subsp bovis AF2122/97
accaucaccacggcc

SEQ ID NO: 1182244 - RNA, 21 nt, Mycobacterium bovis subsp bovis AF2122/97
accauacuaauggcgccaccg

SEQ ID NO: 1182245 - RNA, 22 nt, Mycobacterium bovis subsp bovis AF2122/97
accauguauuucucccagccca

SEQ ID NO: 1182246 - RNA, 20 nt, Mycobacterium bovis subsp bovis AF2122/97
accaugucggccacccggac

SEQ ID NO: 1182247 - RNA, 22 nt, Mycobacterium bovis subsp bovis AF2122/97
acccacacgcccucgacgccgc

SEQ ID NO: 1182248 - RNA, 18 nt, Mycobacterium bovis subsp bovis AF2122/97
acccacaucagccgcacc

SEQ ID NO: 1182249 - RNA, 16 nt, Mycobacterium bovis subsp bovis AF2122/97
acccaagucgccgagg

SEQ ID NO: 1182250 - RNA, 22 nt, Mycobacterium bovis subsp bovis AF2122/97
acccaacucaugggccaacuca

SEQ ID NO: 1182251 - RNA, 24 nt, Mycobacterium bovis subsp bovis AF2122/97
acccaacaaaaggccauccgauca

SEQ ID NO: 1182252 - RNA, 15 nt, Mycobacterium bovis subsp bovis AF2122/97
acccaaccgcgccac

SEQ ID NO: 1182253 - RNA, 16 nt, Mycobacterium bovis subsp bovis AF2122/97
acccaacaccagcagc

SEQ ID NO: 1182254 - RNA, 14 nt, Mycobacterium bovis subsp bovis AF2122/97
acccaacacccaga

SEQ ID NO: 1182255 - RNA, 17 nt, Mycobacterium bovis subsp bovis AF2122/97
accccaggcgcucauca

SEQ ID NO: 1182256 - RNA, 23 nt, Mycobacterium bovis subsp bovis AF2122/97
accccaucagaaugccuggcccg

SEQ ID NO: 1182257 - RNA, 17 nt, Mycobacterium bovis subsp bovis AF2122/97
acccccagcaaaggggu

SEQ ID NO: 1182258 - RNA, 16 nt, Mycobacterium bovis subsp bovis AF2122/97
accccauggccaccga

SEQ ID NO: 1182259 - RNA, 17 nt, Mycobacterium bovis subsp bovis AF2122/97
accccgcagcucaccuc

SEQ ID NO: 1182260 - RNA, 16 nt, Mycobacterium bovis subsp bovis AF2122/97
accccccgggcccgcc

SEQ ID NO: 1182261 - RNA, 13 nt, Mycobacterium bovis subsp bovis AF2122/97
accccccagcgcc

SEQ ID NO: 1182262 - RNA, 23 nt, Mycobacterium bovis subsp bovis AF2122/97
accccgccgagcgguugccuucu

SEQ ID NO: 1182263 - RNA, 18 nt, Mycobacterium bovis subsp bovis AF2122/97
accccgcgcggugcccug

SEQ ID NO: 1182264 - RNA, 21 nt, Mycobacterium bovis subsp bovis AF2122/97
accccgcgcggugcccugccg

SEQ ID NO: 1182265 - RNA, 19 nt, Mycobacterium bovis subsp bovis AF2122/97
accccgcguaugccaggac

SEQ ID NO: 1182266 - RNA, 22 nt, Mycobacterium bovis subsp bovis AF2122/97
accccggaauccccaagcccga

SEQ ID NO: 1182267 - RNA, 18 nt, Mycobacterium bovis subsp bovis AF2122/97
accccggccaccagcaug

SEQ ID NO: 1182268 - RNA, 12 nt, Mycobacterium bovis subsp bovis AF2122/97
accccggccacu

SEQ ID NO: 1182269 - RNA, 11 nt, Mycobacterium bovis subsp bovis AF2122/97
accccggcccg

SEQ ID NO: 1182270 - RNA, 20 nt, Mycobacterium bovis subsp bovis AF2122/97
acccaccagugcaucgauca

SEQ ID NO: 1182271 - RNA, 13 nt, Mycobacterium bovis subsp bovis AF2122/97
acccaccccccag

SEQ ID NO: 1182272 - RNA, 16 nt, Mycobacterium bovis subsp bovis AF2122/97
acccacccgcaccgcc

SEQ ID NO: 1182273 - RNA, 14 nt, Mycobacterium bovis subsp bovis AF2122/97
acccaccacaggac

SEQ ID NO: 1182274 - RNA, 14 nt, Mycobacterium bovis subsp bovis AF2122/97
acccaccaauccac

SEQ ID NO: 1182275 - RNA, 15 nt, Mycobacterium bovis subsp bovis AF2122/97
acccaucaccagcgg

SEQ ID NO: 1182276 - RNA, 13 nt, Mycobacterium bovis subsp bovis AF2122/97
acccaucaacauc

SEQ ID NO: 1182277 - RNA, 16 nt, Mycobacterium bovis subsp bovis AF2122/97
acccaccucccgcagc

SEQ ID NO: 1182278 - RNA, 18 nt, Mycobacterium bovis subsp bovis AF2122/97
accccagccggcagcagc

SEQ ID NO: 1182279 - RNA, 19 nt, Mycobacterium bovis subsp bovis AF2122/97
accccagccggcagcagcg

SEQ ID NO: 1182280 - RNA, 14 nt, Mycobacterium bovis subsp bovis AF2122/97
accccacggccagu

SEQ ID NO: 1182281 - RNA, 20 nt, Mycobacterium bovis subsp bovis AF2122/97
acccauggccucccacucac

SEQ ID NO: 1182282 - RNA, 16 nt, Mycobacterium bovis subsp bovis AF2122/97
acccaugaugugcagc

SEQ ID NO: 1182283 - RNA, 13 nt, Mycobacterium bovis subsp bovis AF2122/97
acccaugcaugcg

SEQ ID NO: 1182284 - RNA, 15 nt, Mycobacterium bovis subsp bovis AF2122/97
acccaugcaugcguu

SEQ ID NO: 1182285 - RNA, 20 nt, Mycobacterium bovis subsp bovis AF2122/97
acccggccgggccugcacca

SEQ ID NO: 1182286 - RNA, 12 nt, Mycobacterium bovis subsp bovis AF2122/97
acccggccguug

SEQ ID NO: 1182287 - RNA, 23 nt, Mycobacterium bovis subsp bovis AF2122/97
acccggcgagggcaacgagauuc

SEQ ID NO: 1182288 - RNA, 17 nt, Mycobacterium bovis subsp bovis AF2122/97
acccggcgaugcagccg

SEQ ID NO: 1182289 - RNA, 16 nt, Mycobacterium bovis subsp bovis AF2122/97
acccggcgggcccgcc

SEQ ID NO: 1182290 - RNA, 17 nt, Mycobacterium bovis subsp bovis AF2122/97
acccggcgggcgguggg

SEQ ID NO: 1182291 - RNA, 16 nt, Mycobacterium bovis subsp bovis AF2122/97
acccggcuccagcacc

SEQ ID NO: 1182292 - RNA, 14 nt, Mycobacterium bovis subsp bovis AF2122/97
acccgggaaggaac

SEQ ID NO: 1182293 - RNA, 15 nt, Mycobacterium bovis subsp bovis AF2122/97
acccgggaaggaacc

SEQ ID NO: 1182294 - RNA, 16 nt, Mycobacterium bovis subsp bovis AF2122/97
acccgggaaggaaccg

SEQ ID NO: 1182295 - RNA, 19 nt, Mycobacterium bovis subsp bovis AF2122/97
acccgggaucagcuccucc

SEQ ID NO: 1182296 - RNA, 13 nt, Mycobacterium bovis subsp bovis AF2122/97
acccgggcagccu

SEQ ID NO: 1182297 - RNA, 16 nt, Mycobacterium bovis subsp bovis AF2122/97
acccgggcgugggugu

SEQ ID NO: 1182298 - RNA, 21 nt, Mycobacterium bovis subsp bovis AF2122/97
acccgggccugggacggcggc

SEQ ID NO: 1182299 - RNA, 15 nt, Mycobacterium bovis subsp bovis AF2122/97
acccgucaugcccac

SEQ ID NO: 1182300 - RNA, 13 nt, Mycobacterium bovis subsp bovis AF2122/97
acccggaaccagc

SEQ ID NO: 1182301 - RNA, 22 nt, Mycobacterium bovis subsp bovis AF2122/97
acccggaucuggugggugcggc

SEQ ID NO: 1182302 - RNA, 14 nt, Mycobacterium bovis subsp bovis AF2122/97
acccggaccugggc

SEQ ID NO: 1182303 - RNA, 22 nt, Mycobacterium bovis subsp bovis AF2122/97
acccggccaggaguuugaccac

SEQ ID NO: 1182304 - RNA, 15 nt, Mycobacterium bovis subsp bovis AF2122/97
acccggcacccaguu

SEQ ID NO: 1182305 - RNA, 19 nt, Mycobacterium bovis subsp bovis AF2122/97
acccgcuggucgagcagug

SEQ ID NO: 1182306 - RNA, 15 nt, Mycobacterium bovis subsp bovis AF2122/97
acccgcucggcgcgc

SEQ ID NO: 1182307 - RNA, 17 nt, Mycobacterium bovis subsp bovis AF2122/97
acccgcuccagcucggc

SEQ ID NO: 1182308 - RNA, 17 nt, Mycobacterium bovis subsp bovis AF2122/97
acccgcuggcccgccag

SEQ ID NO: 1182309 - RNA, 22 nt, Mycobacterium bovis subsp bovis AF2122/97
accccuggccgccggcgccgcc

SEQ ID NO: 1182310 - RNA, 15 nt, Mycobacterium bovis subsp bovis AF2122/97
accccuggccgccgg

SEQ ID NO: 1182311 - RNA, 14 nt, Mycobacterium bovis subsp bovis AF2122/97
accccggccacuug

SEQ ID NO: 1182312 - RNA, 17 nt, Mycobacterium bovis subsp bovis AF2122/97
accccugguagcaccca

SEQ ID NO: 1182313 - RNA, 20 nt, Mycobacterium bovis subsp bovis AF2122/97
acccgaaaacugacccccug

SEQ ID NO: 1182314 - RNA, 23 nt, Mycobacterium bovis subsp bovis AF2122/97
accccuuggacugucccaccagg

SEQ ID NO: 1182315 - RNA, 22 nt, Mycobacterium bovis subsp bovis AF2122/97
accccuuggacugucccaccag

SEQ ID NO: 1182316 - RNA, 15 nt, Mycobacterium bovis subsp bovis AF2122/97
acccgcgcgcaccag

SEQ ID NO: 1182317 - RNA, 12 nt, Mycobacterium bovis subsp bovis AF2122/97
acccgcgcgccg

SEQ ID NO: 1182318 - RNA, 15 nt, Mycobacterium bovis subsp bovis AF2122/97
acccgcgccgcccgc

SEQ ID NO: 1182319 - RNA, 16 nt, Mycobacterium bovis subsp bovis AF2122/97
acccgcgccggccgcu

SEQ ID NO: 1182320 - RNA, 14 nt, Mycobacterium bovis subsp bovis AF2122/97
acccgcuccacccc

SEQ ID NO: 1182321 - RNA, 20 nt, Mycobacterium bovis subsp bovis AF2122/97
acccgcggggaaucacccac

SEQ ID NO: 1182322 - RNA, 17 nt, Mycobacterium bovis subsp bovis AF2122/97
acccgcgucgagugccg

SEQ ID NO: 1182323 - RNA, 19 nt, Mycobacterium bovis subsp bovis AF2122/97
accgccagcggccgcucca

SEQ ID NO: 1182324 - RNA, 22 nt, Mycobacterium bovis subsp bovis AF2122/97
accgccaggucgaggcaggccu

SEQ ID NO: 1182325 - RNA, 21 nt, Mycobacterium bovis subsp bovis AF2122/97
accgccaucgucgaagaccuc

SEQ ID NO: 1182326 - RNA, 13 nt, Mycobacterium bovis subsp bovis AF2122/97
accgccagccacc

SEQ ID NO: 1182327 - RNA, 13 nt, Mycobacterium bovis subsp bovis AF2122/97
accgccaccuugg

SEQ ID NO: 1182328 - RNA, 16 nt, Mycobacterium bovis subsp bovis AF2122/97
accgccaccgcggccu

SEQ ID NO: 1182329 - RNA, 17 nt, Mycobacterium bovis subsp bovis AF2122/97
accgccaccgcggccug

SEQ ID NO: 1182330 - RNA, 16 nt, Mycobacterium bovis subsp bovis AF2122/97
accgcccgcgccaccg

SEQ ID NO: 1182331 - RNA, 20 nt, Mycobacterium bovis subsp bovis AF2122/97
accgcccgcgccaccggcac

SEQ ID NO: 1182332 - RNA, 11 nt, Mycobacterium bovis subsp bovis AF2122/97
accgccgccga

SEQ ID NO: 1182333 - RNA, 22 nt, Mycobacterium bovis subsp bovis AF2122/97
accgccgccgacaaucaccaac

SEQ ID NO: 1182334 - RNA, 16 nt, Mycobacterium bovis subsp bovis AF2122/97
accgccgccgccaccg

SEQ ID NO: 1182335 - RNA, 11 nt, Mycobacterium bovis subsp bovis AF2122/97
accgccgccgg

SEQ ID NO: 1182336 - RNA, 22 nt, Mycobacterium bovis subsp bovis AF2122/97
accgccgauacuucaucggcac

SEQ ID NO: 1182337 - RNA, 19 nt, Mycobacterium bovis subsp bovis AF2122/97
accgccgaucggccacagu

SEQ ID NO: 1182338 - RNA, 16 nt, Mycobacterium bovis subsp bovis AF2122/97
accgcccuugccgccg

SEQ ID NO: 1182339 - RNA, 20 nt, Mycobacterium bovis subsp bovis AF2122/97
accgcccuugccgccggccc

SEQ ID NO: 1182340 - RNA, 13 nt, Mycobacterium bovis subsp bovis AF2122/97
accgcagcgggcg

SEQ ID NO: 1182341 - RNA, 24 nt, Mycobacterium bovis subsp bovis AF2122/97
accgcaggugccguggcuaccgca

SEQ ID NO: 1182342 - RNA, 17 nt, Mycobacterium bovis subsp bovis AF2122/97
accgcagucccagcaca

SEQ ID NO: 1182343 - RNA, 12 nt, Mycobacterium bovis subsp bovis AF2122/97
accgcagggacc

SEQ ID NO: 1182344 - RNA, 18 nt, Mycobacterium bovis subsp bovis AF2122/97
accgcagcggaacugggc

SEQ ID NO: 1182345 - RNA, 19 nt, Mycobacterium bovis subsp bovis AF2122/97
accgcagcggaacugggcc

SEQ ID NO: 1182346 - RNA, 17 nt, Mycobacterium bovis subsp bovis AF2122/97
accgccaccacccaggc

SEQ ID NO: 1182347 - RNA, 23 nt, Mycobacterium bovis subsp bovis AF2122/97
accgccaacauuggugagguggu

SEQ ID NO: 1182348 - RNA, 19 nt, Mycobacterium bovis subsp bovis AF2122/97
accgcaucgggcuugcgca

SEQ ID NO: 1182349 - RNA, 13 nt, Mycobacterium bovis subsp bovis AF2122/97
accgcauguggga

SEQ ID NO: 1182350 - RNA, 22 nt, Mycobacterium bovis subsp bovis AF2122/97
accgauaucgcugcggaaauga

SEQ ID NO: 1182351 - RNA, 16 nt, Mycobacterium bovis subsp bovis AF2122/97
accgaucgacugcagc

SEQ ID NO: 1182352 - RNA, 23 nt, Mycobacterium bovis subsp bovis AF2122/97
accgaucggcaaaccgucggagg

SEQ ID NO: 1182353 - RNA, 11 nt, Mycobacterium bovis subsp bovis AF2122/97
accgagcagca

SEQ ID NO: 1182354 - RNA, 18 nt, Mycobacterium bovis subsp bovis AF2122/97
accgagccacgacccagc

SEQ ID NO: 1182355 - RNA, 13 nt, Mycobacterium bovis subsp bovis AF2122/97
accgauacccccg

SEQ ID NO: 1182356 - RNA, 16 nt, Mycobacterium bovis subsp bovis AF2122/97
accgcaauggcggccu

SEQ ID NO: 1182357 - RNA, 15 nt, Mycobacterium bovis subsp bovis AF2122/97
accgcacaccugcgc

SEQ ID NO: 1182358 - RNA, 13 nt, Mycobacterium bovis subsp bovis AF2122/97
accgcacccgcuc

SEQ ID NO: 1182359 - RNA, 13 nt, Mycobacterium bovis subsp bovis AF2122/97
accgcaccguccc

SEQ ID NO: 1182360 - RNA, 20 nt, Mycobacterium bovis subsp bovis AF2122/97
accgaucuuggccaccgccg

SEQ ID NO: 1182361 - RNA, 15 nt, Mycobacterium bovis subsp bovis AF2122/97
accgaugccacaucg

SEQ ID NO: 1182362 - RNA, 16 nt, Mycobacterium bovis subsp bovis AF2122/97
accgaugccuugaccg

SEQ ID NO: 1182363 - RNA, 14 nt, Mycobacterium bovis subsp bovis AF2122/97
accgcaagaaucag

SEQ ID NO: 1182364 - RNA, 18 nt, Mycobacterium bovis subsp bovis AF2122/97
accgcaagaaucagcagc

SEQ ID NO: 1182365 - RNA, 18 nt, Mycobacterium bovis subsp bovis AF2122/97
accgagaucaccgccacc

SEQ ID NO: 1182366 - RNA, 15 nt, Mycobacterium bovis subsp bovis AF2122/97
accgagacuugcugg

SEQ ID NO: 1182367 - RNA, 16 nt, Mycobacterium bovis subsp bovis AF2122/97
accgagaagcccaccg

SEQ ID NO: 1182368 - RNA, 13 nt, Mycobacterium bovis subsp bovis AF2122/97
acccuccgcagcu

SEQ ID NO: 1182369 - RNA, 13 nt, Mycobacterium bovis subsp bovis AF2122/97
acccuccgccggu

SEQ ID NO: 1182370 - RNA, 22 nt, Mycobacterium bovis subsp bovis AF2122/97
acccucgcguagggccagcgcc

SEQ ID NO: 1182371 - RNA, 23 nt, Mycobacterium bovis subsp bovis AF2122/97
acccgugccuuacuuccauccac

SEQ ID NO: 1182372 - RNA, 20 nt, Mycobacterium bovis subsp bovis AF2122/97
acccguucgaacuggcuggu

SEQ ID NO: 1182373 - RNA, 22 nt, Mycobacterium bovis subsp bovis AF2122/97
acccguucuucgcgauguccuc

SEQ ID NO: 1182374 - RNA, 22 nt, Mycobacterium bovis subsp bovis AF2122/97
acccuaaaccagccaccaccag

SEQ ID NO: 1182375 - RNA, 13 nt, Mycobacterium bovis subsp bovis AF2122/97
acccuccacagcg

SEQ ID NO: 1182376 - RNA, 11 nt, Mycobacterium bovis subsp bovis AF2122/97
acccuccagca

SEQ ID NO: 1182377 - RNA, 13 nt, Mycobacterium bovis subsp bovis AF2122/97
acccuccagcacg

SEQ ID NO: 1182378 - RNA, 23 nt, Mycobacterium bovis subsp bovis AF2122/97
accggaucgaccaauucgaccgc

SEQ ID NO: 1182379 - RNA, 16 nt, Mycobacterium bovis subsp bovis AF2122/97
accggagaucccgguc

SEQ ID NO: 1182380 - RNA, 21 nt, Mycobacterium bovis subsp bovis AF2122/97
accgcugggggcggucgccuc

SEQ ID NO: 1182381 - RNA, 13 nt, Mycobacterium bovis subsp bovis AF2122/97
accgcugucaccg

SEQ ID NO: 1182382 - RNA, 16 nt, Mycobacterium bovis subsp bovis AF2122/97
accgcugucagccgac

SEQ ID NO: 1182383 - RNA, 16 nt, Mycobacterium bovis subsp bovis AF2122/97
accgcugcugcugccc

SEQ ID NO: 1182384 - RNA, 17 nt, Mycobacterium bovis subsp bovis AF2122/97
accgcugcugcugcccc

SEQ ID NO: 1182385 - RNA, 14 nt, Mycobacterium bovis subsp bovis AF2122/97
accgcugccgcauc

SEQ ID NO: 1182386 - RNA, 14 nt, Mycobacterium bovis subsp bovis AF2122/97
accgcugccggcac

SEQ ID NO: 1182387 - RNA, 15 nt, Mycobacterium bovis subsp bovis AF2122/97
accgcugccggcagc

SEQ ID NO: 1182388 - RNA, 13 nt, Mycobacterium bovis subsp bovis AF2122/97
accgcugccggcg

SEQ ID NO: 1182389 - RNA, 13 nt, Mycobacterium bovis subsp bovis AF2122/97
accgcugccugcc

SEQ ID NO: 1182390 - RNA, 18 nt, Mycobacterium bovis subsp bovis AF2122/97
accggcccgcagcagcau

SEQ ID NO: 1182391 - RNA, 17 nt, Mycobacterium bovis subsp bovis AF2122/97
accggcccgcauccgca

SEQ ID NO: 1182392 - RNA, 16 nt, Mycobacterium bovis subsp bovis AF2122/97
accggcccagugggac

SEQ ID NO: 1182393 - RNA, 14 nt, Mycobacterium bovis subsp bovis AF2122/97
accggccgaaggcg

SEQ ID NO: 1182394 - RNA, 23 nt, Mycobacterium bovis subsp bovis AF2122/97
accggccaucgaccguccggguc

SEQ ID NO: 1182395 - RNA, 17 nt, Mycobacterium bovis subsp bovis AF2122/97
accggccaguccgggga

SEQ ID NO: 1182396 - RNA, 22 nt, Mycobacterium bovis subsp bovis AF2122/97
accggcaaucggcggcacccgg

SEQ ID NO: 1182397 - RNA, 11 nt, Mycobacterium bovis subsp bovis AF2122/97
accggccagcc

SEQ ID NO: 1182398 - RNA, 12 nt, Mycobacterium bovis subsp bovis AF2122/97
accggccagccg

SEQ ID NO: 1182399 - RNA, 18 nt, Mycobacterium bovis subsp bovis AF2122/97
accggcaagccacgccgg

SEQ ID NO: 1182400 - RNA, 12 nt, Mycobacterium bovis subsp bovis AF2122/97
accggcgcgccc

SEQ ID NO: 1182401 - RNA, 15 nt, Mycobacterium bovis subsp bovis AF2122/97
accggcgcgccccgc

SEQ ID NO: 1182402 - RNA, 16 nt, Mycobacterium bovis subsp bovis AF2122/97
accggcgccgccguug

SEQ ID NO: 1182403 - RNA, 21 nt, Mycobacterium bovis subsp bovis AF2122/97
accggcgccggaguugaagaa

SEQ ID NO: 1182404 - RNA, 13 nt, Mycobacterium bovis subsp bovis AF2122/97
accggcgccuccg

SEQ ID NO: 1182405 - RNA, 17 nt, Mycobacterium bovis subsp bovis AF2122/97
accggcgccuccggcac

SEQ ID NO: 1182406 - RNA, 13 nt, Mycobacterium bovis subsp bovis AF2122/97
accggcggcgccg

SEQ ID NO: 1182407 - RNA, 19 nt, Mycobacterium bovis subsp bovis AF2122/97
accggcggcuacggcugcc

SEQ ID NO: 1182408 - RNA, 17 nt, Mycobacterium bovis subsp bovis AF2122/97
accggcguaaccggcag

SEQ ID NO: 1182409 - RNA, 15 nt, Mycobacterium bovis subsp bovis AF2122/97
accggcgagcccgca

SEQ ID NO: 1182410 - RNA, 17 nt, Mycobacterium bovis subsp bovis AF2122/97
accggcgcccagcgccu

SEQ ID NO: 1182411 - RNA, 17 nt, Mycobacterium bovis subsp bovis AF2122/97
accggcgccgccggcac

SEQ ID NO: 1182412 - RNA, 14 nt, Mycobacterium bovis subsp bovis AF2122/97
accggcgccgccgu

SEQ ID NO: 1182413 - RNA, 17 nt, Mycobacterium bovis subsp bovis AF2122/97
accggccgggugaacca

SEQ ID NO: 1182414 - RNA, 23 nt, Mycobacterium bovis subsp bovis AF2122/97
accggccgucgacgcauggguca

SEQ ID NO: 1182415 - RNA, 16 nt, Mycobacterium bovis subsp bovis AF2122/97
accggccgugccgccg

SEQ ID NO: 1182416 - RNA, 12 nt, Mycobacterium bovis subsp bovis AF2122/97
accggccuucaa

SEQ ID NO: 1182417 - RNA, 21 nt, Mycobacterium bovis subsp bovis AF2122/97
accggccuuuccagcaccccg

SEQ ID NO: 1182418 - RNA, 20 nt, Mycobacterium bovis subsp bovis AF2122/97
accggcugaccggggcgccc

SEQ ID NO: 1182419 - RNA, 15 nt, Mycobacterium bovis subsp bovis AF2122/97
accggcucgucgggc

SEQ ID NO: 1182420 - RNA, 15 nt, Mycobacterium bovis subsp bovis AF2122/97
accggcgucgcugcc

SEQ ID NO: 1182421 - RNA, 17 nt, Mycobacterium bovis subsp bovis AF2122/97
accggcgucugcccgcc

SEQ ID NO: 1182422 - RNA, 16 nt, Mycobacterium bovis subsp bovis AF2122/97
accggcugcaaccagc

SEQ ID NO: 1182423 - RNA, 17 nt, Mycobacterium bovis subsp bovis AF2122/97
accggcuuccccagcag

SEQ ID NO: 1182424 - RNA, 18 nt, Mycobacterium bovis subsp bovis AF2122/97
accggcuuccccagcagu

SEQ ID NO: 1182425 - RNA, 19 nt, Mycobacterium bovis subsp bovis AF2122/97
accggcuuccccagcaguu

SEQ ID NO: 1182426 - RNA, 15 nt, Mycobacterium bovis subsp bovis AF2122/97
accgggcggacagga

SEQ ID NO: 1182427 - RNA, 17 nt, Mycobacterium bovis subsp bovis AF2122/97
accgccugugccgccgg

SEQ ID NO: 1182428 - RNA, 22 nt, Mycobacterium bovis subsp bovis AF2122/97
accgccugugccgccggcgcca

SEQ ID NO: 1182429 - RNA, 16 nt, Mycobacterium bovis subsp bovis AF2122/97
accgcgaaagcaccga

SEQ ID NO: 1182430 - RNA, 21 nt, Mycobacterium bovis subsp bovis AF2122/97
accgcgaaagcaccgagcauc

SEQ ID NO: 1182431 - RNA, 11 nt, Mycobacterium bovis subsp bovis AF2122/97
accgccuuggu

SEQ ID NO: 1182432 - RNA, 16 nt, Mycobacterium bovis subsp bovis AF2122/97
accgccugggcggcca

SEQ ID NO: 1182433 - RNA, 21 nt, Mycobacterium bovis subsp bovis AF2122/97
accgccugggcggccagcacg

SEQ ID NO: 1182434 - RNA, 15 nt, Mycobacterium bovis subsp bovis AF2122/97
accgcgacggcgccg

SEQ ID NO: 1182435 - RNA, 18 nt, Mycobacterium bovis subsp bovis AF2122/97
accgcgagcagcacagca

SEQ ID NO: 1182436 - RNA, 14 nt, Mycobacterium bovis subsp bovis AF2122/97
accgcgagcaugau

SEQ ID NO: 1182437 - RNA, 14 nt, Mycobacterium bovis subsp bovis AF2122/97
accgcgaccccugg

SEQ ID NO: 1182438 - RNA, 15 nt, Mycobacterium bovis subsp bovis AF2122/97
accgcgacaccccgg

SEQ ID NO: 1182439 - RNA, 16 nt, Mycobacterium bovis subsp bovis AF2122/97
accgccguugccgccg

SEQ ID NO: 1182440 - RNA, 20 nt, Mycobacterium bovis subsp bovis AF2122/97
accgccguggccgcacugcu

SEQ ID NO: 1182441 - RNA, 22 nt, Mycobacterium bovis subsp bovis AF2122/97
accgccgucccggcucgagcuc

SEQ ID NO: 1182442 - RNA, 15 nt, Mycobacterium bovis subsp bovis AF2122/97
accgccggcgccacc

SEQ ID NO: 1182443 - RNA, 15 nt, Mycobacterium bovis subsp bovis AF2122/97
accgccgugugccac

SEQ ID NO: 1182444 - RNA, 16 nt, Mycobacterium bovis subsp bovis AF2122/97
accgccggccccaccg

SEQ ID NO: 1182445 - RNA, 16 nt, Mycobacterium bovis subsp bovis AF2122/97
accgccggcaccgccg

SEQ ID NO: 1182446 - RNA, 21 nt, Mycobacterium bovis subsp bovis AF2122/97
accgccggcaccgccgccccc

SEQ ID NO: 1182447 - RNA, 19 nt, Mycobacterium bovis subsp bovis AF2122/97
accgccggggugugcagcg

SEQ ID NO: 1182448 - RNA, 17 nt, Mycobacterium bovis subsp bovis AF2122/97
accgccgcuaccgcccg

SEQ ID NO: 1182449 - RNA, 17 nt, Mycobacterium bovis subsp bovis AF2122/97
accgccggaccgccgca

SEQ ID NO: 1182450 - RNA, 21 nt, Mycobacterium bovis subsp bovis AF2122/97
accgccggcaauaccgccagc

SEQ ID NO: 1182451 - RNA, 15 nt, Mycobacterium bovis subsp bovis AF2122/97
accgccggcaccgcc

SEQ ID NO: 1182452 - RNA, 15 nt, Mycobacterium bovis subsp bovis AF2122/97
accgccgcgcagccg

SEQ ID NO: 1182453 - RNA, 18 nt, Mycobacterium bovis subsp bovis AF2122/97
accgccgcgcagccgcuc

SEQ ID NO: 1182454 - RNA, 14 nt, Mycobacterium bovis subsp bovis AF2122/97
accgccgccugccc

SEQ ID NO: 1182455 - RNA, 20 nt, Mycobacterium bovis subsp bovis AF2122/97
accgccgcgaccgccucgcc

SEQ ID NO: 1182456 - RNA, 14 nt, Mycobacterium bovis subsp bovis AF2122/97
accgccgccggcac

SEQ ID NO: 1182457 - RNA, 18 nt, Mycobacterium bovis subsp bovis AF2122/97
accgccgccggcaccgcc

SEQ ID NO: 1182458 - RNA, 18 nt, Mycobacterium bovis subsp bovis AF2122/97
accgcggcugucacgccu

SEQ ID NO: 1182459 - RNA, 21 nt, Mycobacterium bovis subsp bovis AF2122/97
accgcggcugucacgccugcc

SEQ ID NO: 1182460 - RNA, 22 nt, Mycobacterium bovis subsp bovis AF2122/97
accgcggcugucacgccugcca

SEQ ID NO: 1182461 - RNA, 20 nt, Mycobacterium bovis subsp bovis AF2122/97
accgcgggccgccaucucgu

SEQ ID NO: 1182462 - RNA, 15 nt, Mycobacterium bovis subsp bovis AF2122/97
accgcggguggaugu

SEQ ID NO: 1182463 - RNA, 23 nt, Mycobacterium bovis subsp bovis AF2122/97
accgcggugacucggccuccgcc

SEQ ID NO: 1182464 - RNA, 20 nt, Mycobacterium bovis subsp bovis AF2122/97
accgcggcgcguccgggcuc

SEQ ID NO: 1182465 - RNA, 22 nt, Mycobacterium bovis subsp bovis AF2122/97
accgcggcgcguccgggcucgc

SEQ ID NO: 1182466 - RNA, 16 nt, Mycobacterium bovis subsp bovis AF2122/97
accgcggccagcggga

SEQ ID NO: 1182467 - RNA, 13 nt, Mycobacterium bovis subsp bovis AF2122/97
accgcggccccgc

SEQ ID NO: 1182468 - RNA, 21 nt, Mycobacterium bovis subsp bovis AF2122/97
accgcggccggguggcccggc

SEQ ID NO: 1182469 - RNA, 14 nt, Mycobacterium bovis subsp bovis AF2122/97
accgcggccccgcc

SEQ ID NO: 1182470 - RNA, 15 nt, Mycobacterium bovis subsp bovis AF2122/97
accgcggccccgccg

SEQ ID NO: 1182471 - RNA, 10 nt, Mycobacterium bovis subsp bovis AF2122/97
accgcggaca

SEQ ID NO: 1182472 - RNA, 20 nt, Mycobacterium bovis subsp bovis AF2122/97
accgcggacccgcagcugcg

SEQ ID NO: 1182473 - RNA, 20 nt, Mycobacterium bovis subsp bovis AF2122/97
accgcgaucaccaccggauc

SEQ ID NO: 1182474 - RNA, 16 nt, Mycobacterium bovis subsp bovis AF2122/97
accgcgcaacccggac

SEQ ID NO: 1182475 - RNA, 21 nt, Mycobacterium bovis subsp bovis AF2122/97
accgcgcaucaucgcccaccg

SEQ ID NO: 1182476 - RNA, 18 nt, Mycobacterium bovis subsp bovis AF2122/97
accgcgccaacagaugcc

SEQ ID NO: 1182477 - RNA, 16 nt, Mycobacterium bovis subsp bovis AF2122/97
accgcgcccuucagca

SEQ ID NO: 1182478 - RNA, 22 nt, Mycobacterium bovis subsp bovis AF2122/97
accgcgccaacuccgauccaca

SEQ ID NO: 1182479 - RNA, 21 nt, Mycobacterium bovis subsp bovis AF2122/97
accgcgcccuagcuggugcgc

SEQ ID NO: 1182480 - RNA, 17 nt, Mycobacterium bovis subsp bovis AF2122/97
accgcgcggcgcagcac

SEQ ID NO: 1182481 - RNA, 14 nt, Mycobacterium bovis subsp bovis AF2122/97
accgcgcgcucgcc

SEQ ID NO: 1182482 - RNA, 22 nt, Mycobacterium bovis subsp bovis AF2122/97
accucgccgcccuguccgggua

SEQ ID NO: 1182483 - RNA, 22 nt, Mycobacterium bovis subsp bovis AF2122/97
accucgccggacgggugcagcg

SEQ ID NO: 1182484 - RNA, 11 nt, Mycobacterium bovis subsp bovis AF2122/97
accucgccggc

SEQ ID NO: 1182485 - RNA, 21 nt, Mycobacterium bovis subsp bovis AF2122/97
accucgccggccgucagcaca

SEQ ID NO: 1182486 - RNA, 12 nt, Mycobacterium bovis subsp bovis AF2122/97
accucgcccucc

SEQ ID NO: 1182487 - RNA, 21 nt, Mycobacterium bovis subsp bovis AF2122/97
accucgccaacaucccaacac

SEQ ID NO: 1182488 - RNA, 22 nt, Mycobacterium bovis subsp bovis AF2122/97
accucgccaacaucccaacaca

SEQ ID NO: 1182489 - RNA, 14 nt, Mycobacterium bovis subsp bovis AF2122/97
accucggccgccag

SEQ ID NO: 1182490 - RNA, 22 nt, Mycobacterium bovis subsp bovis AF2122/97
accucggcgacgaugaucucgc

SEQ ID NO: 1182491 - RNA, 16 nt, Mycobacterium bovis subsp bovis AF2122/97
accucggcguuggaaa

SEQ ID NO: 1182492 - RNA, 15 nt, Mycobacterium bovis subsp bovis AF2122/97
accucggacugcagc

SEQ ID NO: 1182493 - RNA, 21 nt, Mycobacterium bovis subsp bovis AF2122/97
accucggaucgccaggccguc

SEQ ID NO: 1182494 - RNA, 18 nt, Mycobacterium bovis subsp bovis AF2122/97
accucggcaaccaccucg

SEQ ID NO: 1182495 - RNA, 15 nt, Mycobacterium bovis subsp bovis AF2122/97
accucggaucgccag

SEQ ID NO: 1182496 - RNA, 19 nt, Mycobacterium bovis subsp bovis AF2122/97
accucgucaaucaccaccg

SEQ ID NO: 1182497 - RNA, 13 nt, Mycobacterium bovis subsp bovis AF2122/97
accucgugggcca

SEQ ID NO: 1182498 - RNA, 15 nt, Mycobacterium bovis subsp bovis AF2122/97
accucguugcugccg

SEQ ID NO: 1182499 - RNA, 17 nt, Mycobacterium bovis subsp bovis AF2122/97
accucguugcugccggc

SEQ ID NO: 1182500 - RNA, 23 nt, Mycobacterium bovis subsp bovis AF2122/97
accucuaccggugguagcggcgg

SEQ ID NO: 1182501 - RNA, 18 nt, Mycobacterium bovis subsp bovis AF2122/97
accucggccgccagcccc

SEQ ID NO: 1182502 - RNA, 16 nt, Mycobacterium bovis subsp bovis AF2122/97
accucgucgcgucgcc

SEQ ID NO: 1182503 - RNA, 23 nt, Mycobacterium bovis subsp bovis AF2122/97
accucgucggccgacaccgccac

SEQ ID NO: 1182504 - RNA, 21 nt, Mycobacterium bovis subsp bovis AF2122/97
accucgucggcuuuggacagg

SEQ ID NO: 1182505 - RNA, 14 nt, Mycobacterium bovis subsp bovis AF2122/97
accucgucacccgg

SEQ ID NO: 1182506 - RNA, 17 nt, Mycobacterium bovis subsp bovis AF2122/97
accugacacgcccgcga

SEQ ID NO: 1182507 - RNA, 21 nt, Mycobacterium bovis subsp bovis AF2122/97
accugacacgcccgcgagcug

SEQ ID NO: 1182508 - RNA, 22 nt, Mycobacterium bovis subsp bovis AF2122/97
accucucgcuugccgaaauccu

SEQ ID NO: 1182509 - RNA, 18 nt, Mycobacterium bovis subsp bovis AF2122/97
accucucugcgccaggcg

SEQ ID NO: 1182510 - RNA, 16 nt, Mycobacterium bovis subsp bovis AF2122/97
accucugcugagcugc

SEQ ID NO: 1182511 - RNA, 17 nt, Mycobacterium bovis subsp bovis AF2122/97
accucugcugagcugcu

SEQ ID NO: 1182512 - RNA, 13 nt, Mycobacterium bovis subsp bovis AF2122/97
accucuggcggcg

SEQ ID NO: 1182513 - RNA, 17 nt, Mycobacterium bovis subsp bovis AF2122/97
accucagaaaguccccg

SEQ ID NO: 1182514 - RNA, 12 nt, Mycobacterium bovis subsp bovis AF2122/97
accucagcgcgg

SEQ ID NO: 1182515 - RNA, 12 nt, Mycobacterium bovis subsp bovis AF2122/97
accucagcugcg

SEQ ID NO: 1182516 - RNA, 19 nt, Mycobacterium bovis subsp bovis AF2122/97
accucgaagugcaggugcg

SEQ ID NO: 1182517 - RNA, 14 nt, Mycobacterium bovis subsp bovis AF2122/97
accucgaaggcccg

SEQ ID NO: 1182518 - RNA, 17 nt, Mycobacterium bovis subsp bovis AF2122/97
accucgaagcccagcac

SEQ ID NO: 1182519 - RNA, 17 nt, Mycobacterium bovis subsp bovis AF2122/97
accuccggguccaggaa

SEQ ID NO: 1182520 - RNA, 20 nt, Mycobacterium bovis subsp bovis AF2122/97
accuccucgaaggcuucgcu

SEQ ID NO: 1182521 - RNA, 14 nt, Mycobacterium bovis subsp bovis AF2122/97
accuccgaggccgc

SEQ ID NO: 1182522 - RNA, 18 nt, Mycobacterium bovis subsp bovis AF2122/97
accggugucggccagcaa

SEQ ID NO: 1182523 - RNA, 19 nt, Mycobacterium bovis subsp bovis AF2122/97
accggugucggccagcaac

SEQ ID NO: 1182524 - RNA, 19 nt, Mycobacterium bovis subsp bovis AF2122/97
accgguguuccgcccagcg

SEQ ID NO: 1182525 - RNA, 17 nt, Mycobacterium bovis subsp bovis AF2122/97
accgguggcagccugcu

SEQ ID NO: 1182526 - RNA, 19 nt, Mycobacterium bovis subsp bovis AF2122/97
accgguggcgcccuugggc

SEQ ID NO: 1182527 - RNA, 20 nt, Mycobacterium bovis subsp bovis AF2122/97
accgguggggacccgcucca

SEQ ID NO: 1182528 - RNA, 15 nt, Mycobacterium bovis subsp bovis AF2122/97
accggucgcagugca

SEQ ID NO: 1182529 - RNA, 18 nt, Mycobacterium bovis subsp bovis AF2122/97
accggucgcagugcaccc

SEQ ID NO: 1182530 - RNA, 18 nt, Mycobacterium bovis subsp bovis AF2122/97
accggguccggugaaccc

SEQ ID NO: 1182531 - RNA, 16 nt, Mycobacterium bovis subsp bovis AF2122/97
accggguagcucccug

SEQ ID NO: 1182532 - RNA, 15 nt, Mycobacterium bovis subsp bovis AF2122/97
accgggucacuccgg

SEQ ID NO: 1182533 - RNA, 16 nt, Mycobacterium bovis subsp bovis AF2122/97
accggggcgcccggcc

SEQ ID NO: 1182534 - RNA, 20 nt, Mycobacterium bovis subsp bovis AF2122/97
accggggcgcccggccaggu

SEQ ID NO: 1182535 - RNA, 13 nt, Mycobacterium bovis subsp bovis AF2122/97
accgggcgugcca

SEQ ID NO: 1182536 - RNA, 17 nt, Mycobacterium bovis subsp bovis AF2122/97
accgggcguuucccugc

SEQ ID NO: 1182537 - RNA, 14 nt, Mycobacterium bovis subsp bovis AF2122/97
accggugccagcag

SEQ ID NO: 1182538 - RNA, 16 nt, Mycobacterium bovis subsp bovis AF2122/97
accggugccagcagug

SEQ ID NO: 1182539 - RNA, 19 nt, Mycobacterium bovis subsp bovis AF2122/97
accggugaucguggguacc

SEQ ID NO: 1182540 - RNA, 17 nt, Mycobacterium bovis subsp bovis AF2122/97
accggugauggugacca

SEQ ID NO: 1182541 - RNA, 21 nt, Mycobacterium bovis subsp bovis AF2122/97
accggugauggugaccagcag

SEQ ID NO: 1182542 - RNA, 18 nt, Mycobacterium bovis subsp bovis AF2122/97
accgggucgggcaccgcg

SEQ ID NO: 1182543 - RNA, 17 nt, Mycobacterium bovis subsp bovis AF2122/97
accggugcccaccaccg

SEQ ID NO: 1182544 - RNA, 14 nt, Mycobacterium bovis subsp bovis AF2122/97
accggugccgccgu

SEQ ID NO: 1182545 - RNA, 18 nt, Mycobacterium bovis subsp bovis AF2122/97
accuucgcuauggcggcu

SEQ ID NO: 1182546 - RNA, 19 nt, Mycobacterium bovis subsp bovis AF2122/97
accuucggcccaugcagcg

SEQ ID NO: 1182547 - RNA, 12 nt, Mycobacterium bovis subsp bovis AF2122/97
accuucggccga

SEQ ID NO: 1182548 - RNA, 18 nt, Mycobacterium bovis subsp bovis AF2122/97
acgaacaguugcggcugg

SEQ ID NO: 1182549 - RNA, 14 nt, Mycobacterium bovis subsp bovis AF2122/97
acgaacaugccaug

SEQ ID NO: 1182550 - RNA, 15 nt, Mycobacterium bovis subsp bovis AF2122/97
acgaaccgcucagcg

SEQ ID NO: 1182551 - RNA, 16 nt, Mycobacterium bovis subsp bovis AF2122/97
acgaaccggaucaucg

SEQ ID NO: 1182552 - RNA, 16 nt, Mycobacterium bovis subsp bovis AF2122/97
acgaaaucgucgggua

SEQ ID NO: 1182553 - RNA, 12 nt, Mycobacterium bovis subsp bovis AF2122/97
acgaaaaccggu

SEQ ID NO: 1182554 - RNA, 14 nt, Mycobacterium bovis subsp bovis AF2122/97
accuggugcaaccg

SEQ ID NO: 1182555 - RNA, 13 nt, Mycobacterium bovis subsp bovis AF2122/97
accuggucgcguc

SEQ ID NO: 1182556 - RNA, 19 nt, Mycobacterium bovis subsp bovis AF2122/97
accugguuccagaggcccg

SEQ ID NO: 1182557 - RNA, 16 nt, Mycobacterium bovis subsp bovis AF2122/97
accuguuuggggcugu

SEQ ID NO: 1182558 - RNA, 17 nt, Mycobacterium bovis subsp bovis AF2122/97
accuguugcccuugcgc

SEQ ID NO: 1182559 - RNA, 20 nt, Mycobacterium bovis subsp bovis AF2122/97
accugggcgacuaccggcuc

SEQ ID NO: 1182560 - RNA, 22 nt, Mycobacterium bovis subsp bovis AF2122/97
accugggguguagccagcggcu

SEQ ID NO: 1182561 - RNA, 13 nt, Mycobacterium bovis subsp bovis AF2122/97
accuggggccacc

SEQ ID NO: 1182562 - RNA, 21 nt, Mycobacterium bovis subsp bovis AF2122/97
accuggguuugcacggcgcgc

SEQ ID NO: 1182563 - RNA, 15 nt, Mycobacterium bovis subsp bovis AF2122/97
accugaguccggcac

SEQ ID NO: 1182564 - RNA, 18 nt, Mycobacterium bovis subsp bovis AF2122/97
accugagcaccaagaccg

SEQ ID NO: 1182565 - RNA, 21 nt, Mycobacterium bovis subsp bovis AF2122/97
accugagcaucuccucgccug

SEQ ID NO: 1182566 - RNA, 20 nt, Mycobacterium bovis subsp bovis AF2122/97
acgaucguagguacgcaggg

SEQ ID NO: 1182567 - RNA, 16 nt, Mycobacterium bovis subsp bovis AF2122/97
acgaucucgccgccag

SEQ ID NO: 1182568 - RNA, 22 nt, Mycobacterium bovis subsp bovis AF2122/97
acgaucugcaggcccaggcugu

SEQ ID NO: 1182569 - RNA, 17 nt, Mycobacterium bovis subsp bovis AF2122/97
acgaucggcggcgcgcc

SEQ ID NO: 1182570 - RNA, 23 nt, Mycobacterium bovis subsp bovis AF2122/97
acgauccagcccaacucggccag

SEQ ID NO: 1182571 - RNA, 13 nt, Mycobacterium bovis subsp bovis AF2122/97
acgauccagcugu

SEQ ID NO: 1182572 - RNA, 21 nt, Mycobacterium bovis subsp bovis AF2122/97
acgaucgaugaccuuugaguc

SEQ ID NO: 1182573 - RNA, 20 nt, Mycobacterium bovis subsp bovis AF2122/97
acgaugguguacugcugcuu

SEQ ID NO: 1182574 - RNA, 16 nt, Mycobacterium bovis subsp bovis AF2122/97
acgauguccuggaagc

SEQ ID NO: 1182575 - RNA, 16 nt, Mycobacterium bovis subsp bovis AF2122/97
acgauggcgaugaggu

SEQ ID NO: 1182576 - RNA, 14 nt, Mycobacterium bovis subsp bovis AF2122/97
acgauggccggguc

SEQ ID NO: 1182577 - RNA, 13 nt, Mycobacterium bovis subsp bovis AF2122/97
acgauggcggcca

SEQ ID NO: 1182578 - RNA, 15 nt, Mycobacterium bovis subsp bovis AF2122/97
acgauggcggccacc

SEQ ID NO: 1182579 - RNA, 18 nt, Mycobacterium bovis subsp bovis AF2122/97
acgaugccucggcggccu

SEQ ID NO: 1182580 - RNA, 20 nt, Mycobacterium bovis subsp bovis AF2122/97
acgauugcugcggcuuucag

SEQ ID NO: 1182581 - RNA, 16 nt, Mycobacterium bovis subsp bovis AF2122/97
acgauuuuagcggcug

SEQ ID NO: 1182582 - RNA, 18 nt, Mycobacterium bovis subsp bovis AF2122/97
acgaagaucuucaccggc

SEQ ID NO: 1182583 - RNA, 17 nt, Mycobacterium bovis subsp bovis AF2122/97
acgaagcagacgaagua

SEQ ID NO: 1182584 - RNA, 19 nt, Mycobacterium bovis subsp bovis AF2122/97
acgaagacuugcaucaaaa

SEQ ID NO: 1182585 - RNA, 18 nt, Mycobacterium bovis subsp bovis AF2122/97
acgacugugcgccgcagc

SEQ ID NO: 1182586 - RNA, 18 nt, Mycobacterium bovis subsp bovis AF2122/97
acgaggacgucaccguca

SEQ ID NO: 1182587 - RNA, 19 nt, Mycobacterium bovis subsp bovis AF2122/97
acgagauacggccaccagg

SEQ ID NO: 1182588 - RNA, 20 nt, Mycobacterium bovis subsp bovis AF2122/97
acgagggccacguagcagca

SEQ ID NO: 1182589 - RNA, 17 nt, Mycobacterium bovis subsp bovis AF2122/97
acgaggcguucaccacg

SEQ ID NO: 1182590 - RNA, 14 nt, Mycobacterium bovis subsp bovis AF2122/97
acgagguagcgcgc

SEQ ID NO: 1182591 - RNA, 15 nt, Mycobacterium bovis subsp bovis AF2122/97
acgagguagcgcgca

SEQ ID NO: 1182592 - RNA, 18 nt, Mycobacterium bovis subsp bovis AF2122/97
acgaguacgggcaggccg

SEQ ID NO: 1182593 - RNA, 23 nt, Mycobacterium bovis subsp bovis AF2122/97
acgauagaacguagcgcccaccg

SEQ ID NO: 1182594 - RNA, 14 nt, Mycobacterium bovis subsp bovis AF2122/97
acgaucaguccaug

SEQ ID NO: 1182595 - RNA, 23 nt, Mycobacterium bovis subsp bovis AF2122/97
acgcagccguagcugggcacccc

SEQ ID NO: 1182596 - RNA, 19 nt, Mycobacterium bovis subsp bovis AF2122/97
acgcagccguagcugggca

SEQ ID NO: 1182597 - RNA, 12 nt, Mycobacterium bovis subsp bovis AF2122/97
acgcagcccguc

SEQ ID NO: 1182598 - RNA, 14 nt, Mycobacterium bovis subsp bovis AF2122/97
acgcagccacgucu

SEQ ID NO: 1182599 - RNA, 14 nt, Mycobacterium bovis subsp bovis AF2122/97
acgcagcgcggcug

SEQ ID NO: 1182600 - RNA, 16 nt, Mycobacterium bovis subsp bovis AF2122/97
acgcagagucaacaga

SEQ ID NO: 1182601 - RNA, 22 nt, Mycobacterium bovis subsp bovis AF2122/97
acgcagagccaacaaaucaggg

SEQ ID NO: 1182602 - RNA, 17 nt, Mycobacterium bovis subsp bovis AF2122/97
acgcagaccguccagca

SEQ ID NO: 1182603 - RNA, 18 nt, Mycobacterium bovis subsp bovis AF2122/97
acgcagaccguccagcaa

SEQ ID NO: 1182604 - RNA, 19 nt, Mycobacterium bovis subsp bovis AF2122/97
acgcagaccguccagcaac

SEQ ID NO: 1182605 - RNA, 17 nt, Mycobacterium bovis subsp bovis AF2122/97
acgcacucccgagccac

SEQ ID NO: 1182606 - RNA, 12 nt, Mycobacterium bovis subsp bovis AF2122/97
acgcaagcagcg

SEQ ID NO: 1182607 - RNA, 11 nt, Mycobacterium bovis subsp bovis AF2122/97
acgcaacaucg

SEQ ID NO: 1182608 - RNA, 13 nt, Mycobacterium bovis subsp bovis AF2122/97
acgcaacaucgga

SEQ ID NO: 1182609 - RNA, 12 nt, Mycobacterium bovis subsp bovis AF2122/97
acgcaccgcccc

SEQ ID NO: 1182610 - RNA, 13 nt, Mycobacterium bovis subsp bovis AF2122/97
acgcacggccacc

SEQ ID NO: 1182611 - RNA, 16 nt, Mycobacterium bovis subsp bovis AF2122/97
acgcaccacgagcagc

SEQ ID NO: 1182612 - RNA, 14 nt, Mycobacterium bovis subsp bovis AF2122/97
acgcacagcagcac

SEQ ID NO: 1182613 - RNA, 12 nt, Mycobacterium bovis subsp bovis AF2122/97
acgccagccgcg

SEQ ID NO: 1182614 - RNA, 16 nt, Mycobacterium bovis subsp bovis AF2122/97
acgccaggugcagcac

SEQ ID NO: 1182615 - RNA, 15 nt, Mycobacterium bovis subsp bovis AF2122/97
acgccagucgagcac

SEQ ID NO: 1182616 - RNA, 15 nt, Mycobacterium bovis subsp bovis AF2122/97
acgccagcaccagcg

SEQ ID NO: 1182617 - RNA, 16 nt, Mycobacterium bovis subsp bovis AF2122/97
acgccagaacguggcc

SEQ ID NO: 1182618 - RNA, 12 nt, Mycobacterium bovis subsp bovis AF2122/97
acgccaccaccu

SEQ ID NO: 1182619 - RNA, 20 nt, Mycobacterium bovis subsp bovis AF2122/97
acgccaagcucggcccagcg

SEQ ID NO: 1182620 - RNA, 17 nt, Mycobacterium bovis subsp bovis AF2122/97
acgcauguuggugauca

SEQ ID NO: 1182621 - RNA, 21 nt, Mycobacterium bovis subsp bovis AF2122/97
acgcauaucgcuugaacgcau

SEQ ID NO: 1182622 - RNA, 23 nt, Mycobacterium bovis subsp bovis AF2122/97
acgcauaagcccccgcacgcacg

SEQ ID NO: 1182623 - RNA, 20 nt, Mycobacterium bovis subsp bovis AF2122/97
acguagacgacgucggccgc

SEQ ID NO: 1182624 - RNA, 17 nt, Mycobacterium bovis subsp bovis AF2122/97
acguagacgguccgguc

SEQ ID NO: 1182625 - RNA, 20 nt, Mycobacterium bovis subsp bovis AF2122/97
acguaaccguuggagucagg

SEQ ID NO: 1182626 - RNA, 23 nt, Mycobacterium bovis subsp bovis AF2122/97
acgguggccgcugccagccguuc

SEQ ID NO: 1182627 - RNA, 12 nt, Mycobacterium bovis subsp bovis AF2122/97
acggugcugccg

SEQ ID NO: 1182628 - RNA, 16 nt, Mycobacterium bovis subsp bovis AF2122/97
acggugcgcuggaugu

SEQ ID NO: 1182629 - RNA, 21 nt, Mycobacterium bovis subsp bovis AF2122/97
acggugcucuucgaugacuag

SEQ ID NO: 1182630 - RNA, 15 nt, Mycobacterium bovis subsp bovis AF2122/97
acggugggugguugu

SEQ ID NO: 1182631 - RNA, 17 nt, Mycobacterium bovis subsp bovis AF2122/97
acggugcaggaccagaa

SEQ ID NO: 1182632 - RNA, 15 nt, Mycobacterium bovis subsp bovis AF2122/97
acggugcgcagggcc

SEQ ID NO: 1182633 - RNA, 19 nt, Mycobacterium bovis subsp bovis AF2122/97
acgggcuaccggcagcugc

SEQ ID NO: 1182634 - RNA, 13 nt, Mycobacterium bovis subsp bovis AF2122/97
acgggcggccacc

SEQ ID NO: 1182635 - RNA, 22 nt, Mycobacterium bovis subsp bovis AF2122/97
acgggcggccauggcacugccg

SEQ ID NO: 1182636 - RNA, 12 nt, Mycobacterium bovis subsp bovis AF2122/97
acgggucggguc

SEQ ID NO: 1182637 - RNA, 20 nt, Mycobacterium bovis subsp bovis AF2122/97
acgggcucgcugcaccagcu

SEQ ID NO: 1182638 - RNA, 18 nt, Mycobacterium bovis subsp bovis AF2122/97
acggguugucguugcugg

SEQ ID NO: 1182639 - RNA, 17 nt, Mycobacterium bovis subsp bovis AF2122/97
acggguggcccgaccgg

SEQ ID NO: 1182640 - RNA, 14 nt, Mycobacterium bovis subsp bovis AF2122/97
acggcgcgccgacc

SEQ ID NO: 1182641 - RNA, 21 nt, Mycobacterium bovis subsp bovis AF2122/97
acggcgcaugcguaugcccac

SEQ ID NO: 1182642 - RNA, 15 nt, Mycobacterium bovis subsp bovis AF2122/97
acggcgcccagcgcu

SEQ ID NO: 1182643 - RNA, 20 nt, Mycobacterium bovis subsp bovis AF2122/97
acggcaagaaacagguaagc

SEQ ID NO: 1182644 - RNA, 21 nt, Mycobacterium bovis subsp bovis AF2122/97
acggcaagccaaccagcccgg

SEQ ID NO: 1182645 - RNA, 17 nt, Mycobacterium bovis subsp bovis AF2122/97
acggcgcugccgggauc

SEQ ID NO: 1182646 - RNA, 22 nt, Mycobacterium bovis subsp bovis AF2122/97
acggcgucgggccguugugcgg

SEQ ID NO: 1182647 - RNA, 15 nt, Mycobacterium bovis subsp bovis AF2122/97
acggcggagucgcgc

SEQ ID NO: 1182648 - RNA, 15 nt, Mycobacterium bovis subsp bovis AF2122/97
acggcgucggccacc

SEQ ID NO: 1182649 - RNA, 21 nt, Mycobacterium bovis subsp bovis AF2122/97
acggcgugaaguggucguaga

SEQ ID NO: 1182650 - RNA, 17 nt, Mycobacterium bovis subsp bovis AF2122/97
acggcguugagcaggug

SEQ ID NO: 1182651 - RNA, 16 nt, Mycobacterium bovis subsp bovis AF2122/97
acggcguugccgccgg

SEQ ID NO: 1182652 - RNA, 19 nt, Mycobacterium bovis subsp bovis AF2122/97
acggcguugccgccggcuc

SEQ ID NO: 1182653 - RNA, 17 nt, Mycobacterium bovis subsp bovis AF2122/97
acggcguugucgacgaa

SEQ ID NO: 1182654 - RNA, 16 nt, Mycobacterium bovis subsp bovis AF2122/97
acggcguggucggcaa

SEQ ID NO: 1182655 - RNA, 18 nt, Mycobacterium bovis subsp bovis AF2122/97
acggcguuacguggugga

SEQ ID NO: 1182656 - RNA, 13 nt, Mycobacterium bovis subsp bovis AF2122/97
acggcuaccaccg

SEQ ID NO: 1182657 - RNA, 22 nt, Mycobacterium bovis subsp bovis AF2122/97
acggcucgggcagcgucacccu

SEQ ID NO: 1182658 - RNA, 14 nt, Mycobacterium bovis subsp bovis AF2122/97
acggcugccacgcg

SEQ ID NO: 1182659 - RNA, 18 nt, Mycobacterium bovis subsp bovis AF2122/97
acggcugccgucagccgu

SEQ ID NO: 1182660 - RNA, 20 nt, Mycobacterium bovis subsp bovis AF2122/97
acggcugccgucagccguuc

SEQ ID NO: 1182661 - RNA, 18 nt, Mycobacterium bovis subsp bovis AF2122/97
acgggccucccccaaacu

SEQ ID NO: 1182662 - RNA, 21 nt, Mycobacterium bovis subsp bovis AF2122/97
acgggccuucagcucaccacc

SEQ ID NO: 1182663 - RNA, 17 nt, Mycobacterium bovis subsp bovis AF2122/97
acgggcccaggacagca

SEQ ID NO: 1182664 - RNA, 19 nt, Mycobacterium bovis subsp bovis AF2122/97
acggcuuugcggcgcgacc

SEQ ID NO: 1182665 - RNA, 18 nt, Mycobacterium bovis subsp bovis AF2122/97
acgcucggugcugcgccg

SEQ ID NO: 1182666 - RNA, 20 nt, Mycobacterium bovis subsp bovis AF2122/97
acgcucggugcugcgccgau

SEQ ID NO: 1182667 - RNA, 19 nt, Mycobacterium bovis subsp bovis AF2122/97
acgcucguagaaccggggu

SEQ ID NO: 1182668 - RNA, 19 nt, Mycobacterium bovis subsp bovis AF2122/97
acgcucguuugcgagcagg

SEQ ID NO: 1182669 - RNA, 20 nt, Mycobacterium bovis subsp bovis AF2122/97
acgcucguuugcgagcaggg

SEQ ID NO: 1182670 - RNA, 21 nt, Mycobacterium bovis subsp bovis AF2122/97
acgcucguuugcgagcagggg

SEQ ID NO: 1182671 - RNA, 22 nt, Mycobacterium bovis subsp bovis AF2122/97
acgcucguuugcgagcagggga

SEQ ID NO: 1182672 - RNA, 18 nt, Mycobacterium bovis subsp bovis AF2122/97
acgcuucggcacgcuuga

SEQ ID NO: 1182673 - RNA, 15 nt, Mycobacterium bovis subsp bovis AF2122/97
acgcuucaccucguc

SEQ ID NO: 1182674 - RNA, 16 nt, Mycobacterium bovis subsp bovis AF2122/97
acgcuguccaggucug

SEQ ID NO: 1182675 - RNA, 20 nt, Mycobacterium bovis subsp bovis AF2122/97
acgcugaguccccagguggg

SEQ ID NO: 1182676 - RNA, 15 nt, Mycobacterium bovis subsp bovis AF2122/97
acgcugcaggcggcc

SEQ ID NO: 1182677 - RNA, 12 nt, Mycobacterium bovis subsp bovis AF2122/97
acgcugcaggcg

SEQ ID NO: 1182678 - RNA, 23 nt, Mycobacterium bovis subsp bovis AF2122/97
acgcugaucuuccccucggccgc

SEQ ID NO: 1182679 - RNA, 21 nt, Mycobacterium bovis subsp bovis AF2122/97
acggagccgccggcggugaug

SEQ ID NO: 1182680 - RNA, 14 nt, Mycobacterium bovis subsp bovis AF2122/97
acggaccuccucgc

SEQ ID NO: 1182681 - RNA, 15 nt, Mycobacterium bovis subsp bovis AF2122/97
acggacgaagcaccu

SEQ ID NO: 1182682 - RNA, 18 nt, Mycobacterium bovis subsp bovis AF2122/97
acggauaguucaccacau

SEQ ID NO: 1182683 - RNA, 23 nt, Mycobacterium bovis subsp bovis AF2122/97
acggauaauucaacagcaccgcg

SEQ ID NO: 1182684 - RNA, 17 nt, Mycobacterium bovis subsp bovis AF2122/97
acggaucgcggcggcgu

SEQ ID NO: 1182685 - RNA, 17 nt, Mycobacterium bovis subsp bovis AF2122/97
acggaucaggcccgggc

SEQ ID NO: 1182686 - RNA, 14 nt, Mycobacterium bovis subsp bovis AF2122/97
acggaugaugccgg

SEQ ID NO: 1182687 - RNA, 14 nt, Mycobacterium bovis subsp bovis AF2122/97
acuaccgacgcacc

SEQ ID NO: 1182688 - RNA, 15 nt, Mycobacterium bovis subsp bovis AF2122/97
acuaccgaucacaua

SEQ ID NO: 1182689 - RNA, 17 nt, Mycobacterium bovis subsp bovis AF2122/97
acuagcgccccuggcac

SEQ ID NO: 1182690 - RNA, 15 nt, Mycobacterium bovis subsp bovis AF2122/97
acuagacgccgccgc

SEQ ID NO: 1182691 - RNA, 15 nt, Mycobacterium bovis subsp bovis AF2122/97
acuagcagcgggcug

SEQ ID NO: 1182692 - RNA, 16 nt, Mycobacterium bovis subsp bovis AF2122/97
acuagccaguuacguu

SEQ ID NO: 1182693 - RNA, 19 nt, Mycobacterium bovis subsp bovis AF2122/97
acuaaccuggcguagauca

SEQ ID NO: 1182694 - RNA, 15 nt, Mycobacterium bovis subsp bovis AF2122/97
acguagcgcccaccg

SEQ ID NO: 1182695 - RNA, 23 nt, Mycobacterium bovis subsp bovis AF2122/97
acgucuucgggcucguccagcaa

SEQ ID NO: 1182696 - RNA, 22 nt, Mycobacterium bovis subsp bovis AF2122/97
acgucuucgaccucacccaccc

SEQ ID NO: 1182697 - RNA, 16 nt, Mycobacterium bovis subsp bovis AF2122/97
acgugcgagcccaccu

SEQ ID NO: 1182698 - RNA, 18 nt, Mycobacterium bovis subsp bovis AF2122/97
acguugacguccaacagc

SEQ ID NO: 1182699 - RNA, 14 nt, Mycobacterium bovis subsp bovis AF2122/97
acguuggccaggcc

SEQ ID NO: 1182700 - RNA, 18 nt, Mycobacterium bovis subsp bovis AF2122/97
acguuggggauggucccg

SEQ ID NO: 1182701 - RNA, 17 nt, Mycobacterium bovis subsp bovis AF2122/97
acguuguccaccgccac

SEQ ID NO: 1182702 - RNA, 17 nt, Mycobacterium bovis subsp bovis AF2122/97
acguugugccuuagcug

SEQ ID NO: 1182703 - RNA, 17 nt, Mycobacterium bovis subsp bovis AF2122/97
acguugcagccggcaua

SEQ ID NO: 1182704 - RNA, 18 nt, Mycobacterium bovis subsp bovis AF2122/97
acguugcaccgagaaagu

SEQ ID NO: 1182705 - RNA, 22 nt, Mycobacterium bovis subsp bovis AF2122/97
acguugauccgcgcaacuucca

SEQ ID NO: 1182706 - RNA, 14 nt, Mycobacterium bovis subsp bovis AF2122/97
acguuggcagcccu

SEQ ID NO: 1182707 - RNA, 16 nt, Mycobacterium bovis subsp bovis AF2122/97
acugucuggucggcua

SEQ ID NO: 1182708 - RNA, 14 nt, Mycobacterium bovis subsp bovis AF2122/97
acuguugaagaagc

SEQ ID NO: 1182709 - RNA, 22 nt, Mycobacterium bovis subsp bovis AF2122/97
acuggcacacggucaccggcac

SEQ ID NO: 1182710 - RNA, 14 nt, Mycobacterium bovis subsp bovis AF2122/97
acuggcaccgccag

SEQ ID NO: 1182711 - RNA, 22 nt, Mycobacterium bovis subsp bovis AF2122/97
acuucuucgcgcaaccagccca

SEQ ID NO: 1182712 - RNA, 15 nt, Mycobacterium bovis subsp bovis AF2122/97
acuucuucacuggcg

SEQ ID NO: 1182713 - RNA, 17 nt, Mycobacterium bovis subsp bovis AF2122/97
acuucggugagcagggc

SEQ ID NO: 1182714 - RNA, 21 nt, Mycobacterium bovis subsp bovis AF2122/97
acuuccgggcagcugggcagg

SEQ ID NO: 1182715 - RNA, 12 nt, Mycobacterium bovis subsp bovis AF2122/97
acuucggccaca

SEQ ID NO: 1182716 - RNA, 15 nt, Mycobacterium bovis subsp bovis AF2122/97
acuucggccacaacc

SEQ ID NO: 1182717 - RNA, 12 nt, Mycobacterium bovis subsp bovis AF2122/97
acuucccccggg

SEQ ID NO: 1182718 - RNA, 20 nt, Mycobacterium bovis subsp bovis AF2122/97
acuucccgcgcgagccgcuc

SEQ ID NO: 1182719 - RNA, 16 nt, Mycobacterium bovis subsp bovis AF2122/97
acuuccagcccggcaa

SEQ ID NO: 1182720 - RNA, 17 nt, Mycobacterium bovis subsp bovis AF2122/97
acuuccagcccggcaau

SEQ ID NO: 1182721 - RNA, 15 nt, Mycobacterium bovis subsp bovis AF2122/97
acuucaugaugacaa

SEQ ID NO: 1182722 - RNA, 22 nt, Mycobacterium bovis subsp bovis AF2122/97
acuuccaagccgaccugcugga

SEQ ID NO: 1182723 - RNA, 19 nt, Mycobacterium bovis subsp bovis AF2122/97
acugaucgcgauccacccg

SEQ ID NO: 1182724 - RNA, 19 nt, Mycobacterium bovis subsp bovis AF2122/97
acugaucuuggcccgggcc

SEQ ID NO: 1182725 - RNA, 15 nt, Mycobacterium bovis subsp bovis AF2122/97
acugauagacccugg

SEQ ID NO: 1182726 - RNA, 14 nt, Mycobacterium bovis subsp bovis AF2122/97
acugcaucaccacu

SEQ ID NO: 1182727 - RNA, 17 nt, Mycobacterium bovis subsp bovis AF2122/97
acugcaacucuucccau

SEQ ID NO: 1182728 - RNA, 23 nt, Mycobacterium bovis subsp bovis AF2122/97
acugcgcccauagcugccggccc

SEQ ID NO: 1182729 - RNA, 22 nt, Mycobacterium bovis subsp bovis AF2122/97
acugcgccguucgcucccccgc

SEQ ID NO: 1182730 - RNA, 15 nt, Mycobacterium bovis subsp bovis AF2122/97
acugcgaacccugcg

SEQ ID NO: 1182731 - RNA, 21 nt, Mycobacterium bovis subsp bovis AF2122/97
acugcgaagaguccuuaaacg

SEQ ID NO: 1182732 - RNA, 15 nt, Mycobacterium bovis subsp bovis AF2122/97
acugcugggcuucga

SEQ ID NO: 1182733 - RNA, 21 nt, Mycobacterium bovis subsp bovis AF2122/97
acugcugggggucaaucgggu

SEQ ID NO: 1182734 - RNA, 15 nt, Mycobacterium bovis subsp bovis AF2122/97
acugcggccugcucg

SEQ ID NO: 1182735 - RNA, 11 nt, Mycobacterium bovis subsp bovis AF2122/97
acuggacucuu

SEQ ID NO: 1182736 - RNA, 12 nt, Mycobacterium bovis subsp bovis AF2122/97
acuggaaggcgg

SEQ ID NO: 1182737 - RNA, 18 nt, Mycobacterium bovis subsp bovis AF2122/97
acuggacaagcuccucgc

SEQ ID NO: 1182738 - RNA, 20 nt, Mycobacterium bovis subsp bovis AF2122/97
acuggaauggcucacgcucc

SEQ ID NO: 1182739 - RNA, 13 nt, Mycobacterium bovis subsp bovis AF2122/97
acuggaagccaag

SEQ ID NO: 1182740 - RNA, 19 nt, Mycobacterium bovis subsp bovis AF2122/97
acuccggcgacgaucucgc

SEQ ID NO: 1182741 - RNA, 13 nt, Mycobacterium bovis subsp bovis AF2122/97
acuccggccgcac

SEQ ID NO: 1182742 - RNA, 17 nt, Mycobacterium bovis subsp bovis AF2122/97
acuccggucaacacccg

SEQ ID NO: 1182743 - RNA, 16 nt, Mycobacterium bovis subsp bovis AF2122/97
acuccggucagcgcgg

SEQ ID NO: 1182744 - RNA, 19 nt, Mycobacterium bovis subsp bovis AF2122/97
acuccguugccaccuuggu

SEQ ID NO: 1182745 - RNA, 17 nt, Mycobacterium bovis subsp bovis AF2122/97
acuccgugcuuccauuc

SEQ ID NO: 1182746 - RNA, 19 nt, Mycobacterium bovis subsp bovis AF2122/97
acucccggauauugccauc

SEQ ID NO: 1182747 - RNA, 22 nt, Mycobacterium bovis subsp bovis AF2122/97
acucccggauauugccaucccu

SEQ ID NO: 1182748 - RNA, 20 nt, Mycobacterium bovis subsp bovis AF2122/97
acucccggcucggccagcca

SEQ ID NO: 1182749 - RNA, 15 nt, Mycobacterium bovis subsp bovis AF2122/97
acucccccacacacc

SEQ ID NO: 1182750 - RNA, 16 nt, Mycobacterium bovis subsp bovis AF2122/97
acuccccagccccacc

SEQ ID NO: 1182751 - RNA, 15 nt, Mycobacterium bovis subsp bovis AF2122/97
acuccccgccgggca

SEQ ID NO: 1182752 - RNA, 12 nt, Mycobacterium bovis subsp bovis AF2122/97
acucggcggcuu

SEQ ID NO: 1182753 - RNA, 13 nt, Mycobacterium bovis subsp bovis AF2122/97
acucggcaccgcg

SEQ ID NO: 1182754 - RNA, 20 nt, Mycobacterium bovis subsp bovis AF2122/97
acucggcgucgugguggcca

SEQ ID NO: 1182755 - RNA, 15 nt, Mycobacterium bovis subsp bovis AF2122/97
acucgggcacgggug

SEQ ID NO: 1182756 - RNA, 19 nt, Mycobacterium bovis subsp bovis AF2122/97
acucguugagcagcuggac

SEQ ID NO: 1182757 - RNA, 12 nt, Mycobacterium bovis subsp bovis AF2122/97
acucgcucagga

SEQ ID NO: 1182758 - RNA, 22 nt, Mycobacterium bovis subsp bovis AF2122/97
acucgaguggcgaacgggugag

SEQ ID NO: 1182759 - RNA, 19 nt, Mycobacterium bovis subsp bovis AF2122/97
acucgauauaacccggcuc

SEQ ID NO: 1182760 - RNA, 22 nt, Mycobacterium bovis subsp bovis AF2122/97
acucgauauaacccggcuccag

SEQ ID NO: 1182761 - RNA, 17 nt, Mycobacterium bovis subsp bovis AF2122/97
acucgauaugcagcucg

SEQ ID NO: 1182762 - RNA, 18 nt, Mycobacterium bovis subsp bovis AF2122/97
acucggacccacccuggu

SEQ ID NO: 1182763 - RNA, 13 nt, Mycobacterium bovis subsp bovis AF2122/97
acuccucagccgc

SEQ ID NO: 1182764 - RNA, 15 nt, Mycobacterium bovis subsp bovis AF2122/97
acucgaccaggaccg

SEQ ID NO: 1182765 - RNA, 19 nt, Mycobacterium bovis subsp bovis AF2122/97
acucuucccauuucggcaa

SEQ ID NO: 1182766 - RNA, 16 nt, Mycobacterium bovis subsp bovis AF2122/97
acucugaugucgggaa

SEQ ID NO: 1182767 - RNA, 16 nt, Mycobacterium bovis subsp bovis AF2122/97
acucugcguccaccac

SEQ ID NO: 1182768 - RNA, 22 nt, Mycobacterium bovis subsp bovis AF2122/97
acucugcguccaccacgcaaaa

SEQ ID NO: 1182769 - RNA, 16 nt, Mycobacterium bovis subsp bovis AF2122/97
aaucgggauagcccag

SEQ ID NO: 1182770 - RNA, 20 nt, Mycobacterium bovis subsp bovis AF2122/97
aaucgcugaccgcguagacc

SEQ ID NO: 1182771 - RNA, 18 nt, Mycobacterium bovis subsp bovis AF2122/97
aaucggcaggauucccuc

SEQ ID NO: 1182772 - RNA, 20 nt, Mycobacterium bovis subsp bovis AF2122/97
aaucggcaggauucccucga

SEQ ID NO: 1182773 - RNA, 16 nt, Mycobacterium bovis subsp bovis AF2122/97
aaucggauagccgugc

SEQ ID NO: 1182774 - RNA, 16 nt, Mycobacterium bovis subsp bovis AF2122/97
aaucguuggccaugcc

SEQ ID NO: 1182775 - RNA, 21 nt, Mycobacterium bovis subsp bovis AF2122/97
aaucuccggcuggcccaccuc

SEQ ID NO: 1182776 - RNA, 20 nt, Mycobacterium bovis subsp bovis AF2122/97
aaucucgguggugcgcucgc

SEQ ID NO: 1182777 - RNA, 14 nt, Mycobacterium bovis subsp bovis AF2122/97
aaucucgaucuugg

SEQ ID NO: 1182778 - RNA, 15 nt, Mycobacterium bovis subsp bovis AF2122/97
aaucgacaccgcccg

SEQ ID NO: 1182779 - RNA, 18 nt, Mycobacterium bovis subsp bovis AF2122/97
aaucgcggagccaggacg

SEQ ID NO: 1182780 - RNA, 18 nt, Mycobacterium bovis subsp bovis AF2122/97
aauccugguaggagaagc

SEQ ID NO: 1182781 - RNA, 20 nt, Mycobacterium bovis subsp bovis AF2122/97
aauccacagauugauuuaac

SEQ ID NO: 1182782 - RNA, 19 nt, Mycobacterium bovis subsp bovis AF2122/97
aauccaaggcucagcagcg

SEQ ID NO: 1182783 - RNA, 18 nt, Mycobacterium bovis subsp bovis AF2122/97
aauccaaggcucagcagc

SEQ ID NO: 1182784 - RNA, 12 nt, Mycobacterium bovis subsp bovis AF2122/97
aaucaucucccg

SEQ ID NO: 1182785 - RNA, 21 nt, Mycobacterium bovis subsp bovis AF2122/97
aaucagcccgcgcagcggucc

SEQ ID NO: 1182786 - RNA, 22 nt, Mycobacterium bovis subsp bovis AF2122/97
aaucucguuccacugugcgagc

SEQ ID NO: 1182787 - RNA, 17 nt, Mycobacterium bovis subsp bovis AF2122/97
aaucuuugguagucugc

SEQ ID NO: 1182788 - RNA, 14 nt, Mycobacterium bovis subsp bovis AF2122/97
aaugaccugcagcg

SEQ ID NO: 1182789 - RNA, 16 nt, Mycobacterium bovis subsp bovis AF2122/97
aaugaccugcagcgca

SEQ ID NO: 1182790 - RNA, 17 nt, Mycobacterium bovis subsp bovis AF2122/97
aaugacgauccagccca

SEQ ID NO: 1182791 - RNA, 21 nt, Mycobacterium bovis subsp bovis AF2122/97
aaugcugacggugcaggacca

SEQ ID NO: 1182792 - RNA, 15 nt, Mycobacterium bovis subsp bovis AF2122/97
aauggcaacacaccg

SEQ ID NO: 1182793 - RNA, 18 nt, Mycobacterium bovis subsp bovis AF2122/97
aauggauugcggcacgga

SEQ ID NO: 1182794 - RNA, 12 nt, Mycobacterium bovis subsp bovis AF2122/97
aaugcugcugca

SEQ ID NO: 1182795 - RNA, 16 nt, Mycobacterium bovis subsp bovis AF2122/97
aaugggcgccacagcc

SEQ ID NO: 1182796 - RNA, 22 nt, Mycobacterium bovis subsp bovis AF2122/97
aaugggaccgggcguuucccug

SEQ ID NO: 1182797 - RNA, 18 nt, Mycobacterium bovis subsp bovis AF2122/97
aaugcaucgcggcggcgc

SEQ ID NO: 1182798 - RNA, 19 nt, Mycobacterium bovis subsp bovis AF2122/97
aaugcccuuggccagcagg

SEQ ID NO: 1182799 - RNA, 15 nt, Mycobacterium bovis subsp bovis AF2122/97
aauugcggccgcgcg

SEQ ID NO: 1182800 - RNA, 22 nt, Mycobacterium bovis subsp bovis AF2122/97
aauugcguucgccgcccggcgu

SEQ ID NO: 1182801 - RNA, 14 nt, Mycobacterium bovis subsp bovis AF2122/97
aauuuggugaagug

SEQ ID NO: 1182802 - RNA, 11 nt, Mycobacterium bovis subsp bovis AF2122/97
aauuugacgac

SEQ ID NO: 1182803 - RNA, 21 nt, Mycobacterium bovis subsp bovis AF2122/97
aauugagccggcccugcucgc

SEQ ID NO: 1182804 - RNA, 16 nt, Mycobacterium bovis subsp bovis AF2122/97
aauuccguuaggcucc

SEQ ID NO: 1182805 - RNA, 14 nt, Mycobacterium bovis subsp bovis AF2122/97
aauuccggcucacc

SEQ ID NO: 1182806 - RNA, 18 nt, Mycobacterium bovis subsp bovis AF2122/97
aauuccggcucaccgauc

SEQ ID NO: 1182807 - RNA, 18 nt, Mycobacterium bovis subsp bovis AF2122/97
aauuccgcagagaccaag

SEQ ID NO: 1182808 - RNA, 18 nt, Mycobacterium bovis subsp bovis AF2122/97
aauucaacagcaccgcga

SEQ ID NO: 1182809 - RNA, 20 nt, Mycobacterium bovis subsp bovis AF2122/97
aauucggcacgaaauugggc

SEQ ID NO: 1182810 - RNA, 15 nt, Mycobacterium bovis subsp bovis AF2122/97
aauucguagggaugc

SEQ ID NO: 1182811 - RNA, 22 nt, Mycobacterium bovis subsp bovis AF2122/97
acaacucuucggcggacaggcc

SEQ ID NO: 1182812 - RNA, 17 nt, Mycobacterium bovis subsp bovis AF2122/97
acaacuggugggccauc

SEQ ID NO: 1182813 - RNA, 17 nt, Mycobacterium bovis subsp bovis AF2122/97
acaacugcgccggugcc

SEQ ID NO: 1182814 - RNA, 22 nt, Mycobacterium bovis subsp bovis AF2122/97
acaacuggugggccaucgucag

SEQ ID NO: 1182815 - RNA, 16 nt, Mycobacterium bovis subsp bovis AF2122/97
acaacuguccugccag

SEQ ID NO: 1182816 - RNA, 21 nt, Mycobacterium bovis subsp bovis AF2122/97
acaacgggccuucagcucacc

SEQ ID NO: 1182817 - RNA, 17 nt, Mycobacterium bovis subsp bovis AF2122/97
acaacgcgacgccgcuc

SEQ ID NO: 1182818 - RNA, 22 nt, Mycobacterium bovis subsp bovis AF2122/97
acaagucaagauugaccgcggc

SEQ ID NO: 1182819 - RNA, 20 nt, Mycobacterium bovis subsp bovis AF2122/97
acaagugcccggccaaccac

SEQ ID NO: 1182820 - RNA, 21 nt, Mycobacterium bovis subsp bovis AF2122/97
acaagccgagcccgucgauca

SEQ ID NO: 1182821 - RNA, 22 nt, Mycobacterium bovis subsp bovis AF2122/97
acaagaucagacccagcgcggc

SEQ ID NO: 1182822 - RNA, 16 nt, Mycobacterium bovis subsp bovis AF2122/97
acaaucucggccgcau

SEQ ID NO: 1182823 - RNA, 18 nt, Mycobacterium bovis subsp bovis AF2122/97
acacagccgucgcaccag

SEQ ID NO: 1182824 - RNA, 21 nt, Mycobacterium bovis subsp bovis AF2122/97
acacaggcguccaucgccacc

SEQ ID NO: 1182825 - RNA, 14 nt, Mycobacterium bovis subsp bovis AF2122/97
acacagucggugca

SEQ ID NO: 1182826 - RNA, 16 nt, Mycobacterium bovis subsp bovis AF2122/97
acacagucggugcagc

SEQ ID NO: 1182827 - RNA, 12 nt, Mycobacterium bovis subsp bovis AF2122/97
acacacccaccg

SEQ ID NO: 1182828 - RNA, 12 nt, Mycobacterium bovis subsp bovis AF2122/97
acaccagcagca

SEQ ID NO: 1182829 - RNA, 22 nt, Mycobacterium bovis subsp bovis AF2122/97
acaccagccggucgucgcgcag

SEQ ID NO: 1182830 - RNA, 22 nt, Mycobacterium bovis subsp bovis AF2122/97
acaccauaggccgacggguugg

SEQ ID NO: 1182831 - RNA, 19 nt, Mycobacterium bovis subsp bovis AF2122/97
acaccaugaucaggcccca

SEQ ID NO: 1182832 - RNA, 17 nt, Mycobacterium bovis subsp bovis AF2122/97
acaccacggaccagcgc

SEQ ID NO: 1182833 - RNA, 19 nt, Mycobacterium bovis subsp bovis AF2122/97
acaccacgguuggccacca

SEQ ID NO: 1182834 - RNA, 20 nt, Mycobacterium bovis subsp bovis AF2122/97
acacaucgucacugccaccu

SEQ ID NO: 1182835 - RNA, 14 nt, Mycobacterium bovis subsp bovis AF2122/97
acaccagaugcacc

SEQ ID NO: 1182836 - RNA, 14 nt, Mycobacterium bovis subsp bovis AF2122/97
acaccagauggcuc

SEQ ID NO: 1182837 - RNA, 15 nt, Mycobacterium bovis subsp bovis AF2122/97
acaccagacacuggc

SEQ ID NO: 1182838 - RNA, 16 nt, Mycobacterium bovis subsp bovis AF2122/97
acagcgcggcggucga

SEQ ID NO: 1182839 - RNA, 18 nt, Mycobacterium bovis subsp bovis AF2122/97
acagcgcuccagccgcgc

SEQ ID NO: 1182840 - RNA, 20 nt, Mycobacterium bovis subsp bovis AF2122/97
acagcggcgauuggcuguga

SEQ ID NO: 1182841 - RNA, 22 nt, Mycobacterium bovis subsp bovis AF2122/97
acagcggcggcgucgacggcuc

SEQ ID NO: 1182842 - RNA, 14 nt, Mycobacterium bovis subsp bovis AF2122/97
acagcccgaugccg

SEQ ID NO: 1182843 - RNA, 16 nt, Mycobacterium bovis subsp bovis AF2122/97
acagcccgaacgaggc

SEQ ID NO: 1182844 - RNA, 23 nt, Mycobacterium bovis subsp bovis AF2122/97
acagcccacgaaugcaagaccgu

SEQ ID NO: 1182845 - RNA, 15 nt, Mycobacterium bovis subsp bovis AF2122/97
acagccccgcggcca

SEQ ID NO: 1182846 - RNA, 18 nt, Mycobacterium bovis subsp bovis AF2122/97
acagccccgcggccagca

SEQ ID NO: 1182847 - RNA, 18 nt, Mycobacterium bovis subsp bovis AF2122/97
acagcccacaggcggcgc

SEQ ID NO: 1182848 - RNA, 18 nt, Mycobacterium bovis subsp bovis AF2122/97
acagcaugguuagcggug

SEQ ID NO: 1182849 - RNA, 22 nt, Mycobacterium bovis subsp bovis AF2122/97
acagcauggcgaagaacaacau

SEQ ID NO: 1182850 - RNA, 23 nt, Mycobacterium bovis subsp bovis AF2122/97
acagcaugucucgggcgcgggug

SEQ ID NO: 1182851 - RNA, 15 nt, Mycobacterium bovis subsp bovis AF2122/97
acagcuguugauuga

SEQ ID NO: 1182852 - RNA, 13 nt, Mycobacterium bovis subsp bovis AF2122/97
acagcuggcggca

SEQ ID NO: 1182853 - RNA, 20 nt, Mycobacterium bovis subsp bovis AF2122/97
acaggaccggugggucugcu

SEQ ID NO: 1182854 - RNA, 18 nt, Mycobacterium bovis subsp bovis AF2122/97
acagcgucauccucgucg

SEQ ID NO: 1182855 - RNA, 18 nt, Mycobacterium bovis subsp bovis AF2122/97
acagcgggauauggauga

SEQ ID NO: 1182856 - RNA, 18 nt, Mycobacterium bovis subsp bovis AF2122/97
acagcggguccuucugcc

SEQ ID NO: 1182857 - RNA, 21 nt, Mycobacterium bovis subsp bovis AF2122/97
acagcgucucggaggcgacca

SEQ ID NO: 1182858 - RNA, 22 nt, Mycobacterium bovis subsp bovis AF2122/97
acagcucggccaggcuggccaa

SEQ ID NO: 1182859 - RNA, 16 nt, Mycobacterium bovis subsp bovis AF2122/97
acagcugcacacagag

SEQ ID NO: 1182860 - RNA, 14 nt, Mycobacterium bovis subsp bovis AF2122/97
acagaugcauccag

SEQ ID NO: 1182861 - RNA, 20 nt, Mycobacterium bovis subsp bovis AF2122/97
acagaugcauccagcugcug

SEQ ID NO: 1182862 - RNA, 18 nt, Mycobacterium bovis subsp bovis AF2122/97
acagaucuugugccaggc

SEQ ID NO: 1182863 - RNA, 15 nt, Mycobacterium bovis subsp bovis AF2122/97
acagcacccacgccg

SEQ ID NO: 1182864 - RNA, 13 nt, Mycobacterium bovis subsp bovis AF2122/97
acagauggcggcc

SEQ ID NO: 1182865 - RNA, 19 nt, Mycobacterium bovis subsp bovis AF2122/97
acacugaguucggugcugu

SEQ ID NO: 1182866 - RNA, 17 nt, Mycobacterium bovis subsp bovis AF2122/97
acacuccugcacacagg

SEQ ID NO: 1182867 - RNA, 22 nt, Mycobacterium bovis subsp bovis AF2122/97
acacucgaagucgcccaguccc

SEQ ID NO: 1182868 - RNA, 19 nt, Mycobacterium bovis subsp bovis AF2122/97
acacuccugagaugcggcc

SEQ ID NO: 1182869 - RNA, 15 nt, Mycobacterium bovis subsp bovis AF2122/97
acacucccauccgcc

SEQ ID NO: 1182870 - RNA, 16 nt, Mycobacterium bovis subsp bovis AF2122/97
acacuguucccacagg

SEQ ID NO: 1182871 - RNA, 23 nt, Mycobacterium bovis subsp bovis AF2122/97
acacuggucgcggcgcuggcugc

SEQ ID NO: 1182872 - RNA, 18 nt, Mycobacterium bovis subsp bovis AF2122/97
acacugguggugcccgga

SEQ ID NO: 1182873 - RNA, 13 nt, Mycobacterium bovis subsp bovis AF2122/97
acacccggcacac

SEQ ID NO: 1182874 - RNA, 21 nt, Mycobacterium bovis subsp bovis AF2122/97
acacccgcuuugcacugugga

SEQ ID NO: 1182875 - RNA, 17 nt, Mycobacterium bovis subsp bovis AF2122/97
acacccggccgaccucg

SEQ ID NO: 1182876 - RNA, 13 nt, Mycobacterium bovis subsp bovis AF2122/97
acacccgcucgcc

SEQ ID NO: 1182877 - RNA, 21 nt, Mycobacterium bovis subsp bovis AF2122/97
acaccgacgcggucggcggcc

SEQ ID NO: 1182878 - RNA, 15 nt, Mycobacterium bovis subsp bovis AF2122/97
acaccgaaagccucu

SEQ ID NO: 1182879 - RNA, 20 nt, Mycobacterium bovis subsp bovis AF2122/97
acacguucucaccaccagag

SEQ ID NO: 1182880 - RNA, 19 nt, Mycobacterium bovis subsp bovis AF2122/97
acaccgagaagcugugccu

SEQ ID NO: 1182881 - RNA, 17 nt, Mycobacterium bovis subsp bovis AF2122/97
acagaccgggcaccaga

SEQ ID NO: 1182882 - RNA, 16 nt, Mycobacterium bovis subsp bovis AF2122/97
acagacgcaauagcca

SEQ ID NO: 1182883 - RNA, 14 nt, Mycobacterium bovis subsp bovis AF2122/97
acauaggccaccuc

SEQ ID NO: 1182884 - RNA, 17 nt, Mycobacterium bovis subsp bovis AF2122/97
acaggcccgccagcagg

SEQ ID NO: 1182885 - RNA, 20 nt, Mycobacterium bovis subsp bovis AF2122/97
acaggccgaagcucacacug

SEQ ID NO: 1182886 - RNA, 20 nt, Mycobacterium bovis subsp bovis AF2122/97
acaggcauuuucacugugcc

SEQ ID NO: 1182887 - RNA, 21 nt, Mycobacterium bovis subsp bovis AF2122/97
acaggccgagcagauacuugu

SEQ ID NO: 1182888 - RNA, 15 nt, Mycobacterium bovis subsp bovis AF2122/97
acaucagcaggacca

SEQ ID NO: 1182889 - RNA, 13 nt, Mycobacterium bovis subsp bovis AF2122/97
acauccacaccgc

SEQ ID NO: 1182890 - RNA, 16 nt, Mycobacterium bovis subsp bovis AF2122/97
acauccaucuccaugu

SEQ ID NO: 1182891 - RNA, 23 nt, Mycobacterium bovis subsp bovis AF2122/97
acauccagggccgagcagcuccu

SEQ ID NO: 1182892 - RNA, 19 nt, Mycobacterium bovis subsp bovis AF2122/97
acauucugcagcgucuccu

SEQ ID NO: 1182893 - RNA, 23 nt, Mycobacterium bovis subsp bovis AF2122/97
acauucccgaguugcccucuggc

SEQ ID NO: 1182894 - RNA, 23 nt, Mycobacterium bovis subsp bovis AF2122/97
acauugguguccaccaccggcac

SEQ ID NO: 1182895 - RNA, 16 nt, Mycobacterium bovis subsp bovis AF2122/97
acauuggcuccgaaca

SEQ ID NO: 1182896 - RNA, 20 nt, Mycobacterium bovis subsp bovis AF2122/97
acaugguccgaccagcggcc

SEQ ID NO: 1182897 - RNA, 15 nt, Mycobacterium bovis subsp bovis AF2122/97
acaugggugaugcaa

SEQ ID NO: 1182898 - RNA, 18 nt, Mycobacterium bovis subsp bovis AF2122/97
acaugcugccgcugcgaa

SEQ ID NO: 1182899 - RNA, 16 nt, Mycobacterium bovis subsp bovis AF2122/97
acaugcuggagaaacc

SEQ ID NO: 1182900 - RNA, 18 nt, Mycobacterium bovis subsp bovis AF2122/97
acaucccagcgaaugcug

SEQ ID NO: 1182901 - RNA, 22 nt, Mycobacterium bovis subsp bovis AF2122/97
acauccuucaucccccaaauca

SEQ ID NO: 1182902 - RNA, 16 nt, Mycobacterium bovis subsp bovis AF2122/97
acaucgaugucggcuc

SEQ ID NO: 1182903 - RNA, 16 nt, Mycobacterium bovis subsp bovis AF2122/97
acaucgaggccacgcc

SEQ ID NO: 1182904 - RNA, 13 nt, Mycobacterium bovis subsp bovis AF2122/97
accacacuggcag

SEQ ID NO: 1182905 - RNA, 22 nt, Mycobacterium bovis subsp bovis AF2122/97
accacagugccaauuccagccc

SEQ ID NO: 1182906 - RNA, 22 nt, Mycobacterium bovis subsp bovis AF2122/97
accacauuggcgaucagcagcc

SEQ ID NO: 1182907 - RNA, 22 nt, Mycobacterium bovis subsp bovis AF2122/97
accaccacuucggcgccgcgcc

SEQ ID NO: 1182908 - RNA, 22 nt, Mycobacterium bovis subsp bovis AF2122/97
accaccaccgccggugccgcca

SEQ ID NO: 1182909 - RNA, 21 nt, Mycobacterium bovis subsp bovis AF2122/97
accaccaagcucggccagcac

SEQ ID NO: 1182910 - RNA, 17 nt, Mycobacterium bovis subsp bovis AF2122/97
accaauugcccuuuccc

SEQ ID NO: 1182911 - RNA, 23 nt, Mycobacterium bovis subsp bovis AF2122/97
accaaugcuccugguggcagaaa

SEQ ID NO: 1182912 - RNA, 19 nt, Mycobacterium bovis subsp bovis AF2122/97
accaaugucagugccccgc

SEQ ID NO: 1182913 - RNA, 16 nt, Mycobacterium bovis subsp bovis AF2122/97
accacaaccgugagca

SEQ ID NO: 1182914 - RNA, 15 nt, Mycobacterium bovis subsp bovis AF2122/97
accacaauccacgca

SEQ ID NO: 1182915 - RNA, 21 nt, Mycobacterium bovis subsp bovis AF2122/97
accacaauccacgcacucguc

SEQ ID NO: 1182916 - RNA, 16 nt, Mycobacterium bovis subsp bovis AF2122/97
accaacgcuucugccu

SEQ ID NO: 1182917 - RNA, 22 nt, Mycobacterium bovis subsp bovis AF2122/97
accaacgcgggaacgaugccgc

SEQ ID NO: 1182918 - RNA, 19 nt, Mycobacterium bovis subsp bovis AF2122/97
accaaccgggacaaccccu

SEQ ID NO: 1182919 - RNA, 22 nt, Mycobacterium bovis subsp bovis AF2122/97
accaaggccgccugcaacaucc

SEQ ID NO: 1182920 - RNA, 17 nt, Mycobacterium bovis subsp bovis AF2122/97
accaagcucggccagca

SEQ ID NO: 1182921 - RNA, 21 nt, Mycobacterium bovis subsp bovis AF2122/97
accaaguugaccuucaccugg

SEQ ID NO: 1182922 - RNA, 15 nt, Mycobacterium bovis subsp bovis AF2122/97
accaagcgugccugc

SEQ ID NO: 1182923 - RNA, 21 nt, Mycobacterium bovis subsp bovis AF2122/97
accaaggugagcagcaagacc

SEQ ID NO: 1182924 - RNA, 22 nt, Mycobacterium bovis subsp bovis AF2122/97
accaaggugagcagcaagaccg

SEQ ID NO: 1182925 - RNA, 22 nt, Mycobacterium bovis subsp bovis AF2122/97
accaaugcuccugguggcagaa

SEQ ID NO: 1182926 - RNA, 15 nt, Mycobacterium bovis subsp bovis AF2122/97
accaaugcagugcga

SEQ ID NO: 1182927 - RNA, 15 nt, Mycobacterium bovis subsp bovis AF2122/97
accaaugaccgccag

SEQ ID NO: 1182928 - RNA, 12 nt, Mycobacterium bovis subsp bovis AF2122/97
accaauccacug

SEQ ID NO: 1182929 - RNA, 14 nt, Mycobacterium bovis subsp bovis AF2122/97
accaauccaggcca

SEQ ID NO: 1182930 - RNA, 22 nt, Mycobacterium bovis subsp bovis AF2122/97
accacgccguggcccgcucccu

SEQ ID NO: 1182931 - RNA, 13 nt, Mycobacterium bovis subsp bovis AF2122/97
accacgcugugcu

SEQ ID NO: 1182932 - RNA, 17 nt, Mycobacterium bovis subsp bovis AF2122/97
accacgcuggccucguc

SEQ ID NO: 1182933 - RNA, 14 nt, Mycobacterium bovis subsp bovis AF2122/97
accacggaccagcg

SEQ ID NO: 1182934 - RNA, 17 nt, Mycobacterium bovis subsp bovis AF2122/97
accacgaucgcgagccc

SEQ ID NO: 1182935 - RNA, 23 nt, Mycobacterium bovis subsp bovis AF2122/97
accacgaucgcgagcccauggac

SEQ ID NO: 1182936 - RNA, 23 nt, Mycobacterium bovis subsp bovis AF2122/97
accacgcccgacgaggaugucga

SEQ ID NO: 1182937 - RNA, 22 nt, Mycobacterium bovis subsp bovis AF2122/97
accacggucagcacgcugacca

SEQ ID NO: 1182938 - RNA, 14 nt, Mycobacterium bovis subsp bovis AF2122/97
accacggccagcgg

SEQ ID NO: 1182939 - RNA, 20 nt, Mycobacterium bovis subsp bovis AF2122/97
accacggcggcaucaccugg

SEQ ID NO: 1182940 - RNA, 18 nt, Mycobacterium bovis subsp bovis AF2122/97
accacgucgagguccacc

SEQ ID NO: 1182941 - RNA, 21 nt, Mycobacterium bovis subsp bovis AF2122/97
accacggucugccacgaggca

SEQ ID NO: 1182942 - RNA, 13 nt, Mycobacterium bovis subsp bovis AF2122/97
accacguggcccu

SEQ ID NO: 1182943 - RNA, 19 nt, Mycobacterium bovis subsp bovis AF2122/97
accacuucccgcuugagca

SEQ ID NO: 1182944 - RNA, 17 nt, Mycobacterium bovis subsp bovis AF2122/97
accacuuggguggcgcc

SEQ ID NO: 1182945 - RNA, 18 nt, Mycobacterium bovis subsp bovis AF2122/97
accacuguuacggccaca

SEQ ID NO: 1182946 - RNA, 19 nt, Mycobacterium bovis subsp bovis AF2122/97
accacuguuggugccgcca

SEQ ID NO: 1182947 - RNA, 22 nt, Mycobacterium bovis subsp bovis AF2122/97
accacuguuggugccgccacca

SEQ ID NO: 1182948 - RNA, 22 nt, Mycobacterium bovis subsp bovis AF2122/97
accacugaucggcauuccuuga

SEQ ID NO: 1182949 - RNA, 22 nt, Mycobacterium bovis subsp bovis AF2122/97
accacugcaugaacugcucgcc

SEQ ID NO: 1182950 - RNA, 16 nt, Mycobacterium bovis subsp bovis AF2122/97
accaccgucaccgccg

SEQ ID NO: 1182951 - RNA, 21 nt, Mycobacterium bovis subsp bovis AF2122/97
accaccggccgucccgcgagc

SEQ ID NO: 1182952 - RNA, 16 nt, Mycobacterium bovis subsp bovis AF2122/97
accaccgggcgcugcu

SEQ ID NO: 1182953 - RNA, 15 nt, Mycobacterium bovis subsp bovis AF2122/97
accaccggcaccgcu

SEQ ID NO: 1182954 - RNA, 17 nt, Mycobacterium bovis subsp bovis AF2122/97
accaccgccgacccuag

SEQ ID NO: 1182955 - RNA, 13 nt, Mycobacterium bovis subsp bovis AF2122/97
accaccgcucgcc

SEQ ID NO: 1182956 - RNA, 19 nt, Mycobacterium bovis subsp bovis AF2122/97
accaccgcucgucguccgg

SEQ ID NO: 1182957 - RNA, 24 nt, Mycobacterium bovis subsp bovis AF2122/97
accaccgccggugccgccaucgcc

SEQ ID NO: 1182958 - RNA, 11 nt, Mycobacterium bovis subsp bovis AF2122/97
accaccgccug

SEQ ID NO: 1182959 - RNA, 18 nt, Mycobacterium bovis subsp bovis AF2122/97
accaccgcggcggcggcc

SEQ ID NO: 1182960 - RNA, 15 nt, Mycobacterium bovis subsp bovis AF2122/97
accaccgcggcugcu

SEQ ID NO: 1182961 - RNA, 22 nt, Mycobacterium bovis subsp bovis AF2122/97
accaccgccgaagcugcggguc

SEQ ID NO: 1182962 - RNA, 23 nt, Mycobacterium bovis subsp bovis AF2122/97
accacgagcguagcgaccucgcc

SEQ ID NO: 1182963 - RNA, 13 nt, Mycobacterium bovis subsp bovis AF2122/97
accacgagcagcc

SEQ ID NO: 1182964 - RNA, 16 nt, Mycobacterium bovis subsp bovis AF2122/97
accacgacgucgguga

SEQ ID NO: 1182965 - RNA, 13 nt, Mycobacterium bovis subsp bovis AF2122/97
accacgacgugga

SEQ ID NO: 1182966 - RNA, 21 nt, Mycobacterium bovis subsp bovis AF2122/97
accacgacguucgacgacagc

SEQ ID NO: 1182967 - RNA, 21 nt, Mycobacterium bovis subsp bovis AF2122/97
accaccuuggaugcccugccc

SEQ ID NO: 1182968 - RNA, 20 nt, Mycobacterium bovis subsp bovis AF2122/97
accaccucggugaccaggcc

SEQ ID NO: 1182969 - RNA, 17 nt, Mycobacterium bovis subsp bovis AF2122/97
accaccucgugggccac

SEQ ID NO: 1182970 - RNA, 17 nt, Mycobacterium bovis subsp bovis AF2122/97
accacccgguccugcuc

SEQ ID NO: 1182971 - RNA, 19 nt, Mycobacterium bovis subsp bovis AF2122/97
accacccgguccugcucgc

SEQ ID NO: 1182972 - RNA, 18 nt, Mycobacterium bovis subsp bovis AF2122/97
accaccgcauaacgccag

SEQ ID NO: 1182973 - RNA, 19 nt, Mycobacterium bovis subsp bovis AF2122/97
accaccgcauaacgccagu

SEQ ID NO: 1182974 - RNA, 15 nt, Mycobacterium bovis subsp bovis AF2122/97
accacccgcaccuca

SEQ ID NO: 1182975 - RNA, 22 nt, Mycobacterium bovis subsp bovis AF2122/97
accacccgcacuccaagucaca

SEQ ID NO: 1182976 - RNA, 21 nt, Mycobacterium bovis subsp bovis AF2122/97
accacccggcgaacccagcgg

SEQ ID NO: 1182977 - RNA, 18 nt, Mycobacterium bovis subsp bovis AF2122/97
accacccgcaccucaccg

SEQ ID NO: 1182978 - RNA, 13 nt, Mycobacterium bovis subsp bovis AF2122/97
accacccgccgca

SEQ ID NO: 1182979 - RNA, 13 nt, Mycobacterium bovis subsp bovis AF2122/97
accacccccaccg

SEQ ID NO: 1182980 - RNA, 12 nt, Mycobacterium bovis subsp bovis AF2122/97
accaccccagcg

SEQ ID NO: 1182981 - RNA, 12 nt, Mycobacterium bovis subsp bovis AF2122/97
accaccagcacg

SEQ ID NO: 1182982 - RNA, 20 nt, Mycobacterium bovis subsp bovis AF2122/97
accaccagcgugcugccgga

SEQ ID NO: 1182983 - RNA, 13 nt, Mycobacterium bovis subsp bovis AF2122/97
accaccaggcuga

SEQ ID NO: 1182984 - RNA, 19 nt, Mycobacterium bovis subsp bovis AF2122/97
accacccaccggccaccag

SEQ ID NO: 1182985 - RNA, 23 nt, Mycobacterium bovis subsp bovis AF2122/97
accaccauucccggacccaccaa

SEQ ID NO: 1182986 - RNA, 21 nt, Mycobacterium bovis subsp bovis AF2122/97
accaccaguggcgcgugcagc

SEQ ID NO: 1182987 - RNA, 21 nt, Mycobacterium bovis subsp bovis AF2122/97
aaaaaguuaccgguauagcca

SEQ ID NO: 1182988 - RNA, 19 nt, Mycobacterium bovis subsp bovis AF2122/97
aauacccagcgcagcagcg

SEQ ID NO: 1182989 - RNA, 14 nt, Mycobacterium bovis subsp bovis AF2122/97
aauacaccugcugg

SEQ ID NO: 1182990 - RNA, 12 nt, Mycobacterium bovis subsp bovis AF2122/97
aauacaccuugu

SEQ ID NO: 1182991 - RNA, 15 nt, Mycobacterium bovis subsp bovis AF2122/97
aauacacauuuccaa

SEQ ID NO: 1182992 - RNA, 19 nt, Mycobacterium bovis subsp bovis AF2122/97
aauauccugcgguugaguu

SEQ ID NO: 1182993 - RNA, 18 nt, Mycobacterium bovis subsp bovis AF2122/97
aauauaugcgcacucuag

SEQ ID NO: 1182994 - RNA, 14 nt, Mycobacterium bovis subsp bovis AF2122/97
aauagcucgccggc

SEQ ID NO: 1182995 - RNA, 20 nt, Mycobacterium bovis subsp bovis AF2122/97
aauaguuguugcaggagccg

SEQ ID NO: 1182996 - RNA, 22 nt, Mycobacterium bovis subsp bovis AF2122/97
aauaggucugagucuuucccgc

SEQ ID NO: 1182997 - RNA, 22 nt, Mycobacterium bovis subsp bovis AF2122/97
aauaggucgguccgcacugugc

SEQ ID NO: 1182998 - RNA, 17 nt, Mycobacterium bovis subsp bovis AF2122/97
aauaggccgggcagugc

SEQ ID NO: 1182999 - RNA, 17 nt, Mycobacterium bovis subsp bovis AF2122/97
aagggcuugucgccggc

SEQ ID NO: 1183000 - RNA, 23 nt, Mycobacterium bovis subsp bovis AF2122/97
aagucaaacgccgucacggcagu

SEQ ID NO: 1183001 - RNA, 17 nt, Mycobacterium bovis subsp bovis AF2122/97
aagucaacaccgcggcc

SEQ ID NO: 1183002 - RNA, 11 nt, Mycobacterium bovis subsp bovis AF2122/97
aaguccagcag

SEQ ID NO: 1183003 - RNA, 15 nt, Mycobacterium bovis subsp bovis AF2122/97
aagucccgggcaccg

SEQ ID NO: 1183004 - RNA, 24 nt, Mycobacterium bovis subsp bovis AF2122/97
aagucauucguagcuucccuccag

SEQ ID NO: 1183005 - RNA, 14 nt, Mycobacterium bovis subsp bovis AF2122/97
aagucgggcacugu

SEQ ID NO: 1183006 - RNA, 18 nt, Mycobacterium bovis subsp bovis AF2122/97
aagucgcagcgaggagcc

SEQ ID NO: 1183007 - RNA, 20 nt, Mycobacterium bovis subsp bovis AF2122/97
aagucgucggccaucgaguc

SEQ ID NO: 1183008 - RNA, 17 nt, Mycobacterium bovis subsp bovis AF2122/97
aagugccuuccucggca

SEQ ID NO: 1183009 - RNA, 20 nt, Mycobacterium bovis subsp bovis AF2122/97
aaguuccagccgacggcagu

SEQ ID NO: 1183010 - RNA, 15 nt, Mycobacterium bovis subsp bovis AF2122/97
aaguugaagaagcca

SEQ ID NO: 1183011 - RNA, 11 nt, Mycobacterium bovis subsp bovis AF2122/97
aaguugaagaa

SEQ ID NO: 1183012 - RNA, 12 nt, Mycobacterium bovis subsp bovis AF2122/97
aaguugaagaag

SEQ ID NO: 1183013 - RNA, 14 nt, Mycobacterium bovis subsp bovis AF2122/97
aaguugaagaagcc

SEQ ID NO: 1183014 - RNA, 18 nt, Mycobacterium bovis subsp bovis AF2122/97
aaggcauugcccacaaag

SEQ ID NO: 1183015 - RNA, 16 nt, Mycobacterium bovis subsp bovis AF2122/97
aaggccaagcgccaac

SEQ ID NO: 1183016 - RNA, 22 nt, Mycobacterium bovis subsp bovis AF2122/97
aaggccagcgaaucgcugguga

SEQ ID NO: 1183017 - RNA, 22 nt, Mycobacterium bovis subsp bovis AF2122/97
aaggaugucggggcgaagcuug

SEQ ID NO: 1183018 - RNA, 22 nt, Mycobacterium bovis subsp bovis AF2122/97
aaggcaggacugaacaguugca

SEQ ID NO: 1183019 - RNA, 22 nt, Mycobacterium bovis subsp bovis AF2122/97
aaggcucagcagcgccgcgcgg

SEQ ID NO: 1183020 - RNA, 18 nt, Mycobacterium bovis subsp bovis AF2122/97
aaggaaccgggcaaauca

SEQ ID NO: 1183021 - RNA, 20 nt, Mycobacterium bovis subsp bovis AF2122/97
aaggaaccgggcaaaucaag

SEQ ID NO: 1183022 - RNA, 16 nt, Mycobacterium bovis subsp bovis AF2122/97
aaggaccgcgcccaga

SEQ ID NO: 1183023 - RNA, 13 nt, Mycobacterium bovis subsp bovis AF2122/97
aaggaccugugcg

SEQ ID NO: 1183024 - RNA, 19 nt, Mycobacterium bovis subsp bovis AF2122/97
aagcugggcguaaaccgug

SEQ ID NO: 1183025 - RNA, 22 nt, Mycobacterium bovis subsp bovis AF2122/97
aagccuggaaaacccaggucuu

SEQ ID NO: 1183026 - RNA, 20 nt, Mycobacterium bovis subsp bovis AF2122/97
aagccuuaccccgcagcuca

SEQ ID NO: 1183027 - RNA, 14 nt, Mycobacterium bovis subsp bovis AF2122/97
aagccuggaaaacc

SEQ ID NO: 1183028 - RNA, 18 nt, Mycobacterium bovis subsp bovis AF2122/97
aagccucggcaugcagcc

SEQ ID NO: 1183029 - RNA, 22 nt, Mycobacterium bovis subsp bovis AF2122/97
aagcgacgagcagcaauccaag

SEQ ID NO: 1183030 - RNA, 23 nt, Mycobacterium bovis subsp bovis AF2122/97
aagcgagcggucgacguguugga

SEQ ID NO: 1183031 - RNA, 15 nt, Mycobacterium bovis subsp bovis AF2122/97
aagcgaggaucucgg

SEQ ID NO: 1183032 - RNA, 13 nt, Mycobacterium bovis subsp bovis AF2122/97
aagcgaagccaga

SEQ ID NO: 1183033 - RNA, 16 nt, Mycobacterium bovis subsp bovis AF2122/97
aagccgggucuguugg

SEQ ID NO: 1183034 - RNA, 19 nt, Mycobacterium bovis subsp bovis AF2122/97
aagccgggugggagcagcc

SEQ ID NO: 1183035 - RNA, 21 nt, Mycobacterium bovis subsp bovis AF2122/97
aagccguaguaguggccgcca

SEQ ID NO: 1183036 - RNA, 14 nt, Mycobacterium bovis subsp bovis AF2122/97
aagccgucagcuca

SEQ ID NO: 1183037 - RNA, 22 nt, Mycobacterium bovis subsp bovis AF2122/97
aagaucgcugcgaagccgagca

SEQ ID NO: 1183038 - RNA, 14 nt, Mycobacterium bovis subsp bovis AF2122/97
aagaucgagccgac

SEQ ID NO: 1183039 - RNA, 13 nt, Mycobacterium bovis subsp bovis AF2122/97
aagauccagcgca

SEQ ID NO: 1183040 - RNA, 23 nt, Mycobacterium bovis subsp bovis AF2122/97
aagcgauuuggcgucgccgaggu

SEQ ID NO: 1183041 - RNA, 17 nt, Mycobacterium bovis subsp bovis AF2122/97
aagcgggauugccgaga

SEQ ID NO: 1183042 - RNA, 17 nt, Mycobacterium bovis subsp bovis AF2122/97
aagcgguugacccacag

SEQ ID NO: 1183043 - RNA, 18 nt, Mycobacterium bovis subsp bovis AF2122/97
aagcgguugacccacagc

SEQ ID NO: 1183044 - RNA, 21 nt, Mycobacterium bovis subsp bovis AF2122/97
aagcuaccgaucgccaaggcg

SEQ ID NO: 1183045 - RNA, 15 nt, Mycobacterium bovis subsp bovis AF2122/97
aagcucaagggacac

SEQ ID NO: 1183046 - RNA, 11 nt, Mycobacterium bovis subsp bovis AF2122/97
aacaggauggu

SEQ ID NO: 1183047 - RNA, 16 nt, Mycobacterium bovis subsp bovis AF2122/97
aacagcgcgccggcgu

SEQ ID NO: 1183048 - RNA, 18 nt, Mycobacterium bovis subsp bovis AF2122/97
aacagcggguccuucugc

SEQ ID NO: 1183049 - RNA, 23 nt, Mycobacterium bovis subsp bovis AF2122/97
aacagcgguggguaggcucccac

SEQ ID NO: 1183050 - RNA, 19 nt, Mycobacterium bovis subsp bovis AF2122/97
aacagcugcccgccagcgc

SEQ ID NO: 1183051 - RNA, 17 nt, Mycobacterium bovis subsp bovis AF2122/97
aacaucaccucgaugcc

SEQ ID NO: 1183052 - RNA, 20 nt, Mycobacterium bovis subsp bovis AF2122/97
aacagucgcagccaggcacg

SEQ ID NO: 1183053 - RNA, 19 nt, Mycobacterium bovis subsp bovis AF2122/97
aacaucggguucuucaacu

SEQ ID NO: 1183054 - RNA, 20 nt, Mycobacterium bovis subsp bovis AF2122/97
aacaucuccucggcgaugcc

SEQ ID NO: 1183055 - RNA, 23 nt, Mycobacterium bovis subsp bovis AF2122/97
aacaugcucacgaucacccgcac

SEQ ID NO: 1183056 - RNA, 15 nt, Mycobacterium bovis subsp bovis AF2122/97
aacauggccagcauc

SEQ ID NO: 1183057 - RNA, 15 nt, Mycobacterium bovis subsp bovis AF2122/97
aaccacuguuucuga

SEQ ID NO: 1183058 - RNA, 16 nt, Mycobacterium bovis subsp bovis AF2122/97
aaccaccggccgcgca

SEQ ID NO: 1183059 - RNA, 20 nt, Mycobacterium bovis subsp bovis AF2122/97
aacccgaaucccacagcagg

SEQ ID NO: 1183060 - RNA, 22 nt, Mycobacterium bovis subsp bovis AF2122/97
aaccccacgcagaaguugaugg

SEQ ID NO: 1183061 - RNA, 18 nt, Mycobacterium bovis subsp bovis AF2122/97
aacccgaucucugcggcg

SEQ ID NO: 1183062 - RNA, 21 nt, Mycobacterium bovis subsp bovis AF2122/97
aacccgauguggcgcuguugu

SEQ ID NO: 1183063 - RNA, 21 nt, Mycobacterium bovis subsp bovis AF2122/97
aaccccggccaccagcaugcc

SEQ ID NO: 1183064 - RNA, 17 nt, Mycobacterium bovis subsp bovis AF2122/97
aaccccgccaggaucug

SEQ ID NO: 1183065 - RNA, 14 nt, Mycobacterium bovis subsp bovis AF2122/97
aaccccgagcugcc

SEQ ID NO: 1183066 - RNA, 17 nt, Mycobacterium bovis subsp bovis AF2122/97
aaccccaggcgcugccg

SEQ ID NO: 1183067 - RNA, 22 nt, Mycobacterium bovis subsp bovis AF2122/97
aaccaguugacgaagaacaccu

SEQ ID NO: 1183068 - RNA, 18 nt, Mycobacterium bovis subsp bovis AF2122/97
aaccaggcgagccgccac

SEQ ID NO: 1183069 - RNA, 16 nt, Mycobacterium bovis subsp bovis AF2122/97
aaccagguggccaggc

SEQ ID NO: 1183070 - RNA, 22 nt, Mycobacterium bovis subsp bovis AF2122/97
aaccagcggucggcgaccacca

SEQ ID NO: 1183071 - RNA, 22 nt, Mycobacterium bovis subsp bovis AF2122/97
aaccagcgaaaugcccaucacc

SEQ ID NO: 1183072 - RNA, 21 nt, Mycobacterium bovis subsp bovis AF2122/97
aaccagccaccaccaggucgg

SEQ ID NO: 1183073 - RNA, 18 nt, Mycobacterium bovis subsp bovis AF2122/97
aaccagcgaccuagcagc

SEQ ID NO: 1183074 - RNA, 22 nt, Mycobacterium bovis subsp bovis AF2122/97
aaccagcgauggguguugcugg

SEQ ID NO: 1183075 - RNA, 14 nt, Mycobacterium bovis subsp bovis AF2122/97
aaccucggacugca

SEQ ID NO: 1183076 - RNA, 13 nt, Mycobacterium bovis subsp bovis AF2122/97
aaccgggccggcu

SEQ ID NO: 1183077 - RNA, 12 nt, Mycobacterium bovis subsp bovis AF2122/97
aaccguagcgcc

SEQ ID NO: 1183078 - RNA, 15 nt, Mycobacterium bovis subsp bovis AF2122/97
aaccgguguagcagc

SEQ ID NO: 1183079 - RNA, 16 nt, Mycobacterium bovis subsp bovis AF2122/97
aaccgguagccaggcg

SEQ ID NO: 1183080 - RNA, 21 nt, Mycobacterium bovis subsp bovis AF2122/97
aaccgguccugggauccggcg

SEQ ID NO: 1183081 - RNA, 17 nt, Mycobacterium bovis subsp bovis AF2122/97
aaccgucccaaugcaac

SEQ ID NO: 1183082 - RNA, 15 nt, Mycobacterium bovis subsp bovis AF2122/97
aaccgugagcaccag

SEQ ID NO: 1183083 - RNA, 17 nt, Mycobacterium bovis subsp bovis AF2122/97
aaccguggucccucggg

SEQ ID NO: 1183084 - RNA, 22 nt, Mycobacterium bovis subsp bovis AF2122/97
aaccgugguguacccgccucgg

SEQ ID NO: 1183085 - RNA, 19 nt, Mycobacterium bovis subsp bovis AF2122/97
aaccgucucggcgaccgac

SEQ ID NO: 1183086 - RNA, 15 nt, Mycobacterium bovis subsp bovis AF2122/97
aaccguuguacccca

SEQ ID NO: 1183087 - RNA, 16 nt, Mycobacterium bovis subsp bovis AF2122/97
aacgaguaggcggcuc

SEQ ID NO: 1183088 - RNA, 18 nt, Mycobacterium bovis subsp bovis AF2122/97
aacgagucagugccaucu

SEQ ID NO: 1183089 - RNA, 12 nt, Mycobacterium bovis subsp bovis AF2122/97
aacgccaaaaug

SEQ ID NO: 1183090 - RNA, 18 nt, Mycobacterium bovis subsp bovis AF2122/97
aacgcauacagcgcccgg

SEQ ID NO: 1183091 - RNA, 13 nt, Mycobacterium bovis subsp bovis AF2122/97
aacgcagccagcg

SEQ ID NO: 1183092 - RNA, 21 nt, Mycobacterium bovis subsp bovis AF2122/97
aacgacaucaccaccgcacgg

SEQ ID NO: 1183093 - RNA, 23 nt, Mycobacterium bovis subsp bovis AF2122/97
aacgagauucggagucaccagca

SEQ ID NO: 1183094 - RNA, 15 nt, Mycobacterium bovis subsp bovis AF2122/97
aacgacuccuggcga

SEQ ID NO: 1183095 - RNA, 22 nt, Mycobacterium bovis subsp bovis AF2122/97
aacgacugaucaagugccagcg

SEQ ID NO: 1183096 - RNA, 21 nt, Mycobacterium bovis subsp bovis AF2122/97
aacgaaugucaccccgcccag

SEQ ID NO: 1183097 - RNA, 13 nt, Mycobacterium bovis subsp bovis AF2122/97
aacgacaccagau

SEQ ID NO: 1183098 - RNA, 21 nt, Mycobacterium bovis subsp bovis AF2122/97
aacgcgguaaagccccgcucc

SEQ ID NO: 1183099 - RNA, 16 nt, Mycobacterium bovis subsp bovis AF2122/97
aacgcggugggcacag

SEQ ID NO: 1183100 - RNA, 17 nt, Mycobacterium bovis subsp bovis AF2122/97
aacgcggugggcacagc

SEQ ID NO: 1183101 - RNA, 14 nt, Mycobacterium bovis subsp bovis AF2122/97
aacgcggccaccac

SEQ ID NO: 1183102 - RNA, 13 nt, Mycobacterium bovis subsp bovis AF2122/97
aacgccugcucgu

SEQ ID NO: 1183103 - RNA, 17 nt, Mycobacterium bovis subsp bovis AF2122/97
aacgcgagcgcuaucac

SEQ ID NO: 1183104 - RNA, 22 nt, Mycobacterium bovis subsp bovis AF2122/97
aacgccugcucgucggccaccg

SEQ ID NO: 1183105 - RNA, 23 nt, Mycobacterium bovis subsp bovis AF2122/97
aacgccuugacugaacucaacac

SEQ ID NO: 1183106 - RNA, 23 nt, Mycobacterium bovis subsp bovis AF2122/97
aacggauuggugggccagcagca

SEQ ID NO: 1183107 - RNA, 20 nt, Mycobacterium bovis subsp bovis AF2122/97
aacggauaacccguggcggu

SEQ ID NO: 1183108 - RNA, 17 nt, Mycobacterium bovis subsp bovis AF2122/97
aacggauucccgcccag

SEQ ID NO: 1183109 - RNA, 21 nt, Mycobacterium bovis subsp bovis AF2122/97
aacgcgugcugagucgguuca

SEQ ID NO: 1183110 - RNA, 19 nt, Mycobacterium bovis subsp bovis AF2122/97
aacugaucgaccgccuccu

SEQ ID NO: 1183111 - RNA, 15 nt, Mycobacterium bovis subsp bovis AF2122/97
aacugcgccggugcc

SEQ ID NO: 1183112 - RNA, 15 nt, Mycobacterium bovis subsp bovis AF2122/97
aacuguccggguggg

SEQ ID NO: 1183113 - RNA, 18 nt, Mycobacterium bovis subsp bovis AF2122/97
aacuguggaaggugauca

SEQ ID NO: 1183114 - RNA, 16 nt, Mycobacterium bovis subsp bovis AF2122/97
aacuucgacaacgcau

SEQ ID NO: 1183115 - RNA, 18 nt, Mycobacterium bovis subsp bovis AF2122/97
aagaaacagguaagcagc

SEQ ID NO: 1183116 - RNA, 12 nt, Mycobacterium bovis subsp bovis AF2122/97
aagaaacaccac

SEQ ID NO: 1183117 - RNA, 23 nt, Mycobacterium bovis subsp bovis AF2122/97
aacgggcuuccgacaugaaccgg

SEQ ID NO: 1183118 - RNA, 21 nt, Mycobacterium bovis subsp bovis AF2122/97
aacggcggaucggcggccggc

SEQ ID NO: 1183119 - RNA, 18 nt, Mycobacterium bovis subsp bovis AF2122/97
aacggcggcaggccggcc

SEQ ID NO: 1183120 - RNA, 18 nt, Mycobacterium bovis subsp bovis AF2122/97
aacggcgcgccgaccacc

SEQ ID NO: 1183121 - RNA, 22 nt, Mycobacterium bovis subsp bovis AF2122/97
aacgggccuucagcucaccacc

SEQ ID NO: 1183122 - RNA, 23 nt, Mycobacterium bovis subsp bovis AF2122/97
aacgggcgaacuuguugaccucc

SEQ ID NO: 1183123 - RNA, 23 nt, Mycobacterium bovis subsp bovis AF2122/97
aacggcuuggcugccuccaucaa

SEQ ID NO: 1183124 - RNA, 15 nt, Mycobacterium bovis subsp bovis AF2122/97
aacucuucagcaagc

SEQ ID NO: 1183125 - RNA, 22 nt, Mycobacterium bovis subsp bovis AF2122/97
aacucgccgcuggcaaucccgc

SEQ ID NO: 1183126 - RNA, 17 nt, Mycobacterium bovis subsp bovis AF2122/97
aacucguccagcagugc

SEQ ID NO: 1183127 - RNA, 15 nt, Mycobacterium bovis subsp bovis AF2122/97
aacucgucgauucgg

SEQ ID NO: 1183128 - RNA, 13 nt, Mycobacterium bovis subsp bovis AF2122/97
aacucggcauuca

SEQ ID NO: 1183129 - RNA, 15 nt, Mycobacterium bovis subsp bovis AF2122/97
aacucggccacggcg

SEQ ID NO: 1183130 - RNA, 22 nt, Mycobacterium bovis subsp bovis AF2122/97
aacucggugccugucagaagga

SEQ ID NO: 1183131 - RNA, 19 nt, Mycobacterium bovis subsp bovis AF2122/97
aacucggcgaccugccgga

SEQ ID NO: 1183132 - RNA, 19 nt, Mycobacterium bovis subsp bovis AF2122/97
aacuccgcguugggcaccu

SEQ ID NO: 1183133 - RNA, 18 nt, Mycobacterium bovis subsp bovis AF2122/97
aagaccggaucgccuugg

SEQ ID NO: 1183134 - RNA, 14 nt, Mycobacterium bovis subsp bovis AF2122/97
aagaccgcgccaac

SEQ ID NO: 1183135 - RNA, 16 nt, Mycobacterium bovis subsp bovis AF2122/97
aagaccgacagcggca

SEQ ID NO: 1183136 - RNA, 15 nt, Mycobacterium bovis subsp bovis AF2122/97
aagacccggcaccca

SEQ ID NO: 1183137 - RNA, 16 nt, Mycobacterium bovis subsp bovis AF2122/97
aagacgccgauccggu

SEQ ID NO: 1183138 - RNA, 15 nt, Mycobacterium bovis subsp bovis AF2122/97
aagaccuggccugcg

SEQ ID NO: 1183139 - RNA, 20 nt, Mycobacterium bovis subsp bovis AF2122/97
aagaccuggcggugccggcg

SEQ ID NO: 1183140 - RNA, 18 nt, Mycobacterium bovis subsp bovis AF2122/97
aagacugcgccgccggcg

SEQ ID NO: 1183141 - RNA, 22 nt, Mycobacterium bovis subsp bovis AF2122/97
aagacgugccggcucaggugug

SEQ ID NO: 1183142 - RNA, 20 nt, Mycobacterium bovis subsp bovis AF2122/97
aagacgugguagaggaacag

SEQ ID NO: 1183143 - RNA, 18 nt, Mycobacterium bovis subsp bovis AF2122/97
aagaccaccgcccacagc

SEQ ID NO: 1183144 - RNA, 23 nt, Mycobacterium bovis subsp bovis AF2122/97
aagaccaccgcccacagcaacga

SEQ ID NO: 1183145 - RNA, 11 nt, Mycobacterium bovis subsp bovis AF2122/97
aagagaagucu

SEQ ID NO: 1183146 - RNA, 14 nt, Mycobacterium bovis subsp bovis AF2122/97
aagaggagaacgag

SEQ ID NO: 1183147 - RNA, 19 nt, Mycobacterium bovis subsp bovis AF2122/97
aagagcggagccggcgcau

SEQ ID NO: 1183148 - RNA, 11 nt, Mycobacterium bovis subsp bovis AF2122/97
aagagccgucc

SEQ ID NO: 1183149 - RNA, 21 nt, Mycobacterium bovis subsp bovis AF2122/97
aagauagacguuguugaaggc

SEQ ID NO: 1183150 - RNA, 22 nt, Mycobacterium bovis subsp bovis AF2122/97
aagaucaccucccgcggcaccu

SEQ ID NO: 1183151 - RNA, 20 nt, Mycobacterium bovis subsp bovis AF2122/97
cggcggaucccgaggcgccc

SEQ ID NO: 1183152 - RNA, 19 nt, Mycobacterium bovis subsp bovis AF2122/97
cggcggaucccgaggcgcc

SEQ ID NO: 1183153 - RNA, 23 nt, Mycobacterium bovis subsp bovis AF2122/97
cggcggagucgcgcagggcgaca

SEQ ID NO: 1183154 - RNA, 16 nt, Mycobacterium bovis subsp bovis AF2122/97
cggcggcaaccccgag

SEQ ID NO: 1183155 - RNA, 16 nt, Mycobacterium bovis subsp bovis AF2122/97
cggcggcacgcugacc

SEQ ID NO: 1183156 - RNA, 16 nt, Mycobacterium bovis subsp bovis AF2122/97
cggcggcaaccgccgc

SEQ ID NO: 1183157 - RNA, 19 nt, Mycobacterium bovis subsp bovis AF2122/97
cggcggcaaccgccgccac

SEQ ID NO: 1183158 - RNA, 17 nt, Mycobacterium bovis subsp bovis AF2122/97
cggcggcaacggcggca

SEQ ID NO: 1183159 - RNA, 19 nt, Mycobacterium bovis subsp bovis AF2122/97
cggcggcaagggcggcaac

SEQ ID NO: 1183160 - RNA, 20 nt, Mycobacterium bovis subsp bovis AF2122/97
cggcggcaagggcggcaacg

SEQ ID NO: 1183161 - RNA, 12 nt, Mycobacterium bovis subsp bovis AF2122/97
cggcggccaacg

SEQ ID NO: 1183162 - RNA, 17 nt, Mycobacterium bovis subsp bovis AF2122/97
cggcggcaucggcggca

SEQ ID NO: 1183163 - RNA, 18 nt, Mycobacterium bovis subsp bovis AF2122/97
cggcggcaucggcggcaa

SEQ ID NO: 1183164 - RNA, 19 nt, Mycobacterium bovis subsp bovis AF2122/97
cggcggcaucggcggcaac

SEQ ID NO: 1183165 - RNA, 18 nt, Mycobacterium bovis subsp bovis AF2122/97
cggcggccaacagcaccc

SEQ ID NO: 1183166 - RNA, 18 nt, Mycobacterium bovis subsp bovis AF2122/97
cggcggcagcggcgccgc

SEQ ID NO: 1183167 - RNA, 17 nt, Mycobacterium bovis subsp bovis AF2122/97
cggcggcaggccggcca

SEQ ID NO: 1183168 - RNA, 20 nt, Mycobacterium bovis subsp bovis AF2122/97
cggcggcacuacgcagccgu

SEQ ID NO: 1183169 - RNA, 20 nt, Mycobacterium bovis subsp bovis AF2122/97
cggcggacccggugacccgc

SEQ ID NO: 1183170 - RNA, 15 nt, Mycobacterium bovis subsp bovis AF2122/97
cggcggagcgggcca

SEQ ID NO: 1183171 - RNA, 20 nt, Mycobacterium bovis subsp bovis AF2122/97
cggcggagcgggccagcacc

SEQ ID NO: 1183172 - RNA, 24 nt, Mycobacterium bovis subsp bovis AF2122/97
cggcggacugagagauggucgggc

SEQ ID NO: 1183173 - RNA, 19 nt, Mycobacterium bovis subsp bovis AF2122/97
cggcggaaggacggcagcc

SEQ ID NO: 1183174 - RNA, 19 nt, Mycobacterium bovis subsp bovis AF2122/97
cggcggacaccucgggcgc

SEQ ID NO: 1183175 - RNA, 20 nt, Mycobacterium bovis subsp bovis AF2122/97
cggcggacaccucgggcgcc

SEQ ID NO: 1183176 - RNA, 17 nt, Mycobacterium bovis subsp bovis AF2122/97
cggcggaccccucgacc

SEQ ID NO: 1183177 - RNA, 19 nt, Mycobacterium bovis subsp bovis AF2122/97
cggcggacccggugacccg

SEQ ID NO: 1183178 - RNA, 21 nt, Mycobacterium bovis subsp bovis AF2122/97
cggcgcgguuuccagacgacc

SEQ ID NO: 1183179 - RNA, 20 nt, Mycobacterium bovis subsp bovis AF2122/97
cggcgcgguggggcgcgccg

SEQ ID NO: 1183180 - RNA, 21 nt, Mycobacterium bovis subsp bovis AF2122/97
cggcgcgucggcaccgauccu

SEQ ID NO: 1183181 - RNA, 21 nt, Mycobacterium bovis subsp bovis AF2122/97
cggcgcguccgggcucgcgcu

SEQ ID NO: 1183182 - RNA, 16 nt, Mycobacterium bovis subsp bovis AF2122/97
cggcgcggccggccgc

SEQ ID NO: 1183183 - RNA, 14 nt, Mycobacterium bovis subsp bovis AF2122/97
cggcgcggagugcc

SEQ ID NO: 1183184 - RNA, 23 nt, Mycobacterium bovis subsp bovis AF2122/97
cggcgcgugcgguggcgcgcagc

SEQ ID NO: 1183185 - RNA, 16 nt, Mycobacterium bovis subsp bovis AF2122/97
cggcgcucgcggcggc

SEQ ID NO: 1183186 - RNA, 20 nt, Mycobacterium bovis subsp bovis AF2122/97
cggcgcucgucgaucuccuc

SEQ ID NO: 1183187 - RNA, 17 nt, Mycobacterium bovis subsp bovis AF2122/97
cggcgcuccacugacca

SEQ ID NO: 1183188 - RNA, 20 nt, Mycobacterium bovis subsp bovis AF2122/97
cggcgcugcgcaccgccgcg

SEQ ID NO: 1183189 - RNA, 13 nt, Mycobacterium bovis subsp bovis AF2122/97
cggcgcugaucgc

SEQ ID NO: 1183190 - RNA, 19 nt, Mycobacterium bovis subsp bovis AF2122/97
cggcgcugaucgcgcgcac

SEQ ID NO: 1183191 - RNA, 21 nt, Mycobacterium bovis subsp bovis AF2122/97
cggcgcugacuagggucaccg

SEQ ID NO: 1183192 - RNA, 19 nt, Mycobacterium bovis subsp bovis AF2122/97
cggcgcuggucgcgguggc

SEQ ID NO: 1183193 - RNA, 22 nt, Mycobacterium bovis subsp bovis AF2122/97
cggcggggguggaaucaggguc

SEQ ID NO: 1183194 - RNA, 12 nt, Mycobacterium bovis subsp bovis AF2122/97
cggcgggccacc

SEQ ID NO: 1183195 - RNA, 18 nt, Mycobacterium bovis subsp bovis AF2122/97
cggcgggggcgucgccgc

SEQ ID NO: 1183196 - RNA, 16 nt, Mycobacterium bovis subsp bovis AF2122/97
cggcgggggaccccgc

SEQ ID NO: 1183197 - RNA, 20 nt, Mycobacterium bovis subsp bovis AF2122/97
cggcgggggaccccgccagc

SEQ ID NO: 1183198 - RNA, 14 nt, Mycobacterium bovis subsp bovis AF2122/97
cggcgggcggcagc

SEQ ID NO: 1183199 - RNA, 14 nt, Mycobacterium bovis subsp bovis AF2122/97
cggcgggcucgccc

SEQ ID NO: 1183200 - RNA, 13 nt, Mycobacterium bovis subsp bovis AF2122/97
cggcgggccugcc

SEQ ID NO: 1183201 - RNA, 20 nt, Mycobacterium bovis subsp bovis AF2122/97
cggcgggccgcgcggcgaca

SEQ ID NO: 1183202 - RNA, 14 nt, Mycobacterium bovis subsp bovis AF2122/97
cggcgggccugccc

SEQ ID NO: 1183203 - RNA, 19 nt, Mycobacterium bovis subsp bovis AF2122/97
cggcgggcccgccggcccc

SEQ ID NO: 1183204 - RNA, 12 nt, Mycobacterium bovis subsp bovis AF2122/97
cggcgggcaccu

SEQ ID NO: 1183205 - RNA, 16 nt, Mycobacterium bovis subsp bovis AF2122/97
cggcggcggccgcagc

SEQ ID NO: 1183206 - RNA, 14 nt, Mycobacterium bovis subsp bovis AF2122/97
cggcggcggcaacg

SEQ ID NO: 1183207 - RNA, 16 nt, Mycobacterium bovis subsp bovis AF2122/97
cggcggcggccaggau

SEQ ID NO: 1183208 - RNA, 19 nt, Mycobacterium bovis subsp bovis AF2122/97
cggcggcguccaucgcgcg

SEQ ID NO: 1183209 - RNA, 19 nt, Mycobacterium bovis subsp bovis AF2122/97
cggcggcggugcgccccgc

SEQ ID NO: 1183210 - RNA, 22 nt, Mycobacterium bovis subsp bovis AF2122/97
cggcggcggugcgccccgcguu

SEQ ID NO: 1183211 - RNA, 16 nt, Mycobacterium bovis subsp bovis AF2122/97
cggcggcggucugaga

SEQ ID NO: 1183212 - RNA, 18 nt, Mycobacterium bovis subsp bovis AF2122/97
cggcggcuuggccgcccc

SEQ ID NO: 1183213 - RNA, 20 nt, Mycobacterium bovis subsp bovis AF2122/97
cggcggcuucguggcggcgc

SEQ ID NO: 1183214 - RNA, 22 nt, Mycobacterium bovis subsp bovis AF2122/97
cggcggcuucguggcggcgcgc

SEQ ID NO: 1183215 - RNA, 23 nt, Mycobacterium bovis subsp bovis AF2122/97
cggcggcuucguggcggcgcgcg

SEQ ID NO: 1183216 - RNA, 12 nt, Mycobacterium bovis subsp bovis AF2122/97
cggcggcugccg

SEQ ID NO: 1183217 - RNA, 14 nt, Mycobacterium bovis subsp bovis AF2122/97
cggcggcugccggu

SEQ ID NO: 1183218 - RNA, 22 nt, Mycobacterium bovis subsp bovis AF2122/97
cggcggccgagcgcaccgcuga

SEQ ID NO: 1183219 - RNA, 14 nt, Mycobacterium bovis subsp bovis AF2122/97
cggcggccgcagcg

SEQ ID NO: 1183220 - RNA, 18 nt, Mycobacterium bovis subsp bovis AF2122/97
cggcggccgcagcggcca

SEQ ID NO: 1183221 - RNA, 12 nt, Mycobacterium bovis subsp bovis AF2122/97
cggcggccgccc

SEQ ID NO: 1183222 - RNA, 16 nt, Mycobacterium bovis subsp bovis AF2122/97
cggcggcccuguucac

SEQ ID NO: 1183223 - RNA, 14 nt, Mycobacterium bovis subsp bovis AF2122/97
cggcggcccgcagc

SEQ ID NO: 1183224 - RNA, 16 nt, Mycobacterium bovis subsp bovis AF2122/97
cggcggccccgcgcca

SEQ ID NO: 1183225 - RNA, 13 nt, Mycobacterium bovis subsp bovis AF2122/97
cggcggccccggc

SEQ ID NO: 1183226 - RNA, 19 nt, Mycobacterium bovis subsp bovis AF2122/97
cggcggccgccaucagccg

SEQ ID NO: 1183227 - RNA, 15 nt, Mycobacterium bovis subsp bovis AF2122/97
cggcggccgcgugcu

SEQ ID NO: 1183228 - RNA, 16 nt, Mycobacterium bovis subsp bovis AF2122/97
cggcggccgucaccgg

SEQ ID NO: 1183229 - RNA, 19 nt, Mycobacterium bovis subsp bovis AF2122/97
cggcggccguggcuggacc

SEQ ID NO: 1183230 - RNA, 17 nt, Mycobacterium bovis subsp bovis AF2122/97
cggcggccgugucgggc

SEQ ID NO: 1183231 - RNA, 15 nt, Mycobacterium bovis subsp bovis AF2122/97
cggcggccugggcca

SEQ ID NO: 1183232 - RNA, 14 nt, Mycobacterium bovis subsp bovis AF2122/97
cggcggcgccgccc

SEQ ID NO: 1183233 - RNA, 15 nt, Mycobacterium bovis subsp bovis AF2122/97
cggcggcgccggccu

SEQ ID NO: 1183234 - RNA, 16 nt, Mycobacterium bovis subsp bovis AF2122/97
cggcggcgcuggcggg

SEQ ID NO: 1183235 - RNA, 17 nt, Mycobacterium bovis subsp bovis AF2122/97
cggcggcgcuggcgggc

SEQ ID NO: 1183236 - RNA, 22 nt, Mycobacterium bovis subsp bovis AF2122/97
cggcggccuucggccggcgugu

SEQ ID NO: 1183237 - RNA, 22 nt, Mycobacterium bovis subsp bovis AF2122/97
cggcggcgaggcgagucaccgg

SEQ ID NO: 1183238 - RNA, 18 nt, Mycobacterium bovis subsp bovis AF2122/97
cggcguacaaaccgucgg

SEQ ID NO: 1183239 - RNA, 19 nt, Mycobacterium bovis subsp bovis AF2122/97
cggcguacaaaccgucggg

SEQ ID NO: 1183240 - RNA, 20 nt, Mycobacterium bovis subsp bovis AF2122/97
cggcguacaaaccgucgggg

SEQ ID NO: 1183241 - RNA, 22 nt, Mycobacterium bovis subsp bovis AF2122/97
cggcgguggugucgcucgcgag

SEQ ID NO: 1183242 - RNA, 19 nt, Mycobacterium bovis subsp bovis AF2122/97
cggcgguggccguuuaggc

SEQ ID NO: 1183243 - RNA, 18 nt, Mycobacterium bovis subsp bovis AF2122/97
cggcggugccgucgccgc

SEQ ID NO: 1183244 - RNA, 15 nt, Mycobacterium bovis subsp bovis AF2122/97
cggcggugccgugcu

SEQ ID NO: 1183245 - RNA, 21 nt, Mycobacterium bovis subsp bovis AF2122/97
cggcggugccgcggcuaggcc

SEQ ID NO: 1183246 - RNA, 22 nt, Mycobacterium bovis subsp bovis AF2122/97
cggcggugcagaucggcucacc

SEQ ID NO: 1183247 - RNA, 19 nt, Mycobacterium bovis subsp bovis AF2122/97
cggcggugcagcagggcgc

SEQ ID NO: 1183248 - RNA, 17 nt, Mycobacterium bovis subsp bovis AF2122/97
cggcggugacggcggca

SEQ ID NO: 1183249 - RNA, 18 nt, Mycobacterium bovis subsp bovis AF2122/97
cggcggugacggcggcaa

SEQ ID NO: 1183250 - RNA, 15 nt, Mycobacterium bovis subsp bovis AF2122/97
cggcggugacggugc

SEQ ID NO: 1183251 - RNA, 23 nt, Mycobacterium bovis subsp bovis AF2122/97
cggcgguuggugcagcgugcagc

SEQ ID NO: 1183252 - RNA, 14 nt, Mycobacterium bovis subsp bovis AF2122/97
cggcggugugcgca

SEQ ID NO: 1183253 - RNA, 19 nt, Mycobacterium bovis subsp bovis AF2122/97
cggcggucuuggcgcgccc

SEQ ID NO: 1183254 - RNA, 14 nt, Mycobacterium bovis subsp bovis AF2122/97
cggcggucgggccc

SEQ ID NO: 1183255 - RNA, 20 nt, Mycobacterium bovis subsp bovis AF2122/97
cggcggugaaaucgcacagc

SEQ ID NO: 1183256 - RNA, 14 nt, Mycobacterium bovis subsp bovis AF2122/97
cggcggucugggug

SEQ ID NO: 1183257 - RNA, 16 nt, Mycobacterium bovis subsp bovis AF2122/97
cggcggucaccaccga

SEQ ID NO: 1183258 - RNA, 20 nt, Mycobacterium bovis subsp bovis AF2122/97
cggcgguagccgaccagcgc

SEQ ID NO: 1183259 - RNA, 18 nt, Mycobacterium bovis subsp bovis AF2122/97
cggcgguaagggcgggcu

SEQ ID NO: 1183260 - RNA, 19 nt, Mycobacterium bovis subsp bovis AF2122/97
cggcggguccucgcggagc

SEQ ID NO: 1183261 - RNA, 23 nt, Mycobacterium bovis subsp bovis AF2122/97
cggcgguaaaugccugcccaccu

SEQ ID NO: 1183262 - RNA, 20 nt, Mycobacterium bovis subsp bovis AF2122/97
cggcgaucgcuccgcggcgc

SEQ ID NO: 1183263 - RNA, 21 nt, Mycobacterium bovis subsp bovis AF2122/97
cggcgauccggucggccaggc

SEQ ID NO: 1183264 - RNA, 19 nt, Mycobacterium bovis subsp bovis AF2122/97
cggcgauccggucgggggc

SEQ ID NO: 1183265 - RNA, 17 nt, Mycobacterium bovis subsp bovis AF2122/97
cggcgaucuccggcgga

SEQ ID NO: 1183266 - RNA, 21 nt, Mycobacterium bovis subsp bovis AF2122/97
cggcgaucgcuccgcggcgca

SEQ ID NO: 1183267 - RNA, 18 nt, Mycobacterium bovis subsp bovis AF2122/97
cggcgaucggaggcccgc

SEQ ID NO: 1183268 - RNA, 21 nt, Mycobacterium bovis subsp bovis AF2122/97
cggcgaugauguugagcugga

SEQ ID NO: 1183269 - RNA, 20 nt, Mycobacterium bovis subsp bovis AF2122/97
cggcgaucaacucgggcagc

SEQ ID NO: 1183270 - RNA, 19 nt, Mycobacterium bovis subsp bovis AF2122/97
cggcgauauaggacgccgc

SEQ ID NO: 1183271 - RNA, 20 nt, Mycobacterium bovis subsp bovis AF2122/97
cggcgaguuggccguggcga

SEQ ID NO: 1183272 - RNA, 14 nt, Mycobacterium bovis subsp bovis AF2122/97
cggcgagcaggccg

SEQ ID NO: 1183273 - RNA, 15 nt, Mycobacterium bovis subsp bovis AF2122/97
cggcgagcccgcauc

SEQ ID NO: 1183274 - RNA, 23 nt, Mycobacterium bovis subsp bovis AF2122/97
cggcgagcgcaucggccaacacc

SEQ ID NO: 1183275 - RNA, 15 nt, Mycobacterium bovis subsp bovis AF2122/97
cggcgagcgucgggc

SEQ ID NO: 1183276 - RNA, 14 nt, Mycobacterium bovis subsp bovis AF2122/97
cggcgagggccacg

SEQ ID NO: 1183277 - RNA, 15 nt, Mycobacterium bovis subsp bovis AF2122/97
cggcgagggcgcgcc

SEQ ID NO: 1183278 - RNA, 16 nt, Mycobacterium bovis subsp bovis AF2122/97
cggcgagggcgcgccg

SEQ ID NO: 1183279 - RNA, 22 nt, Mycobacterium bovis subsp bovis AF2122/97
cggcgagggcggucagcggcca

SEQ ID NO: 1183280 - RNA, 17 nt, Mycobacterium bovis subsp bovis AF2122/97
cggcgagcucggccccg

SEQ ID NO: 1183281 - RNA, 19 nt, Mycobacterium bovis subsp bovis AF2122/97
cggcgaggccucggcggcc

SEQ ID NO: 1183282 - RNA, 20 nt, Mycobacterium bovis subsp bovis AF2122/97
cggcgaggcggucgccgaau

SEQ ID NO: 1183283 - RNA, 23 nt, Mycobacterium bovis subsp bovis AF2122/97
cggcgaggugcccaaggccagga

SEQ ID NO: 1183284 - RNA, 22 nt, Mycobacterium bovis subsp bovis AF2122/97
cggcgagguauaaacgcggcgc

SEQ ID NO: 1183285 - RNA, 19 nt, Mycobacterium bovis subsp bovis AF2122/97
cggcgagugguccagccag

SEQ ID NO: 1183286 - RNA, 21 nt, Mycobacterium bovis subsp bovis AF2122/97
cggcgcaccaucgcggccgcu

SEQ ID NO: 1183287 - RNA, 19 nt, Mycobacterium bovis subsp bovis AF2122/97
cggcgcaagcgccgcgcuu

SEQ ID NO: 1183288 - RNA, 21 nt, Mycobacterium bovis subsp bovis AF2122/97
cggcgcagcacauccugcagc

SEQ ID NO: 1183289 - RNA, 12 nt, Mycobacterium bovis subsp bovis AF2122/97
cggcgcagcacc

SEQ ID NO: 1183290 - RNA, 21 nt, Mycobacterium bovis subsp bovis AF2122/97
cggcgccaauucagcggcaac

SEQ ID NO: 1183291 - RNA, 18 nt, Mycobacterium bovis subsp bovis AF2122/97
cggcgccacccgcgccgc

SEQ ID NO: 1183292 - RNA, 17 nt, Mycobacterium bovis subsp bovis AF2122/97
cggcgcaggucgcgcag

SEQ ID NO: 1183293 - RNA, 14 nt, Mycobacterium bovis subsp bovis AF2122/97
cggcgcagugcagg

SEQ ID NO: 1183294 - RNA, 12 nt, Mycobacterium bovis subsp bovis AF2122/97
cggcgcccagga

SEQ ID NO: 1183295 - RNA, 15 nt, Mycobacterium bovis subsp bovis AF2122/97
cggcgcccaggaacu

SEQ ID NO: 1183296 - RNA, 12 nt, Mycobacterium bovis subsp bovis AF2122/97
cggcgcccaggc

SEQ ID NO: 1183297 - RNA, 14 nt, Mycobacterium bovis subsp bovis AF2122/97
cggcgcccgcccga

SEQ ID NO: 1183298 - RNA, 17 nt, Mycobacterium bovis subsp bovis AF2122/97
cggcgcccgccgcgaac

SEQ ID NO: 1183299 - RNA, 21 nt, Mycobacterium bovis subsp bovis AF2122/97
cggcgcccgcucggccgcagc

SEQ ID NO: 1183300 - RNA, 19 nt, Mycobacterium bovis subsp bovis AF2122/97
cggcgccgcgccgucccga

SEQ ID NO: 1183301 - RNA, 15 nt, Mycobacterium bovis subsp bovis AF2122/97
cggcgccgcgcggcu

SEQ ID NO: 1183302 - RNA, 16 nt, Mycobacterium bovis subsp bovis AF2122/97
cggcgccggagccgcc

SEQ ID NO: 1183303 - RNA, 12 nt, Mycobacterium bovis subsp bovis AF2122/97
cggcgccgcggg

SEQ ID NO: 1183304 - RNA, 14 nt, Mycobacterium bovis subsp bovis AF2122/97
cggcgccgcgggug

SEQ ID NO: 1183305 - RNA, 18 nt, Mycobacterium bovis subsp bovis AF2122/97
cggcgccggaggcggcgc

SEQ ID NO: 1183306 - RNA, 23 nt, Mycobacterium bovis subsp bovis AF2122/97
cggcgccggaguugaagaagccc

SEQ ID NO: 1183307 - RNA, 13 nt, Mycobacterium bovis subsp bovis AF2122/97
cggcgccggcauc

SEQ ID NO: 1183308 - RNA, 23 nt, Mycobacterium bovis subsp bovis AF2122/97
cggcgccggcgucggcgcccagc

SEQ ID NO: 1183309 - RNA, 15 nt, Mycobacterium bovis subsp bovis AF2122/97
cggcgccggcgccuc

SEQ ID NO: 1183310 - RNA, 18 nt, Mycobacterium bovis subsp bovis AF2122/97
cggcgccggugccgccuc

SEQ ID NO: 1183311 - RNA, 12 nt, Mycobacterium bovis subsp bovis AF2122/97
cggcgccgucga

SEQ ID NO: 1183312 - RNA, 17 nt, Mycobacterium bovis subsp bovis AF2122/97
cggcgccgucgcccagc

SEQ ID NO: 1183313 - RNA, 19 nt, Mycobacterium bovis subsp bovis AF2122/97
cggcgccgucggagccggc

SEQ ID NO: 1183314 - RNA, 13 nt, Mycobacterium bovis subsp bovis AF2122/97
cggcgccgguggg

SEQ ID NO: 1183315 - RNA, 17 nt, Mycobacterium bovis subsp bovis AF2122/97
cggcgccggugguaacg

SEQ ID NO: 1183316 - RNA, 12 nt, Mycobacterium bovis subsp bovis AF2122/97
cggcgccgucgu

SEQ ID NO: 1183317 - RNA, 17 nt, Mycobacterium bovis subsp bovis AF2122/97
cggcgccgugucaccgg

SEQ ID NO: 1183318 - RNA, 13 nt, Mycobacterium bovis subsp bovis AF2122/97
cggcgccuccgcu

SEQ ID NO: 1183319 - RNA, 16 nt, Mycobacterium bovis subsp bovis AF2122/97
cggcgccuccgcucgg

SEQ ID NO: 1183320 - RNA, 17 nt, Mycobacterium bovis subsp bovis AF2122/97
cggcgccucggaccaga

SEQ ID NO: 1183321 - RNA, 18 nt, Mycobacterium bovis subsp bovis AF2122/97
cggcgccucggaccagac

SEQ ID NO: 1183322 - RNA, 20 nt, Mycobacterium bovis subsp bovis AF2122/97
cggcgccucggaccagaccc

SEQ ID NO: 1183323 - RNA, 21 nt, Mycobacterium bovis subsp bovis AF2122/97
cggcgccucggaccagaccca

SEQ ID NO: 1183324 - RNA, 21 nt, Mycobacterium bovis subsp bovis AF2122/97
cggcgccuuggucgccgccuu

SEQ ID NO: 1183325 - RNA, 19 nt, Mycobacterium bovis subsp bovis AF2122/97
cggcgccuguucgggagcu

SEQ ID NO: 1183326 - RNA, 16 nt, Mycobacterium bovis subsp bovis AF2122/97
cggcgccuggcggcgc

SEQ ID NO: 1183327 - RNA, 21 nt, Mycobacterium bovis subsp bovis AF2122/97
cggcgcgccgaucggcaccgu

SEQ ID NO: 1183328 - RNA, 14 nt, Mycobacterium bovis subsp bovis AF2122/97
cggcgcgcgcgccg

SEQ ID NO: 1183329 - RNA, 16 nt, Mycobacterium bovis subsp bovis AF2122/97
cggcgcgcgcgccggc

SEQ ID NO: 1183330 - RNA, 14 nt, Mycobacterium bovis subsp bovis AF2122/97
cggcgcggaacgcg

SEQ ID NO: 1183331 - RNA, 13 nt, Mycobacterium bovis subsp bovis AF2122/97
cggcgcggaacgc

SEQ ID NO: 1183332 - RNA, 13 nt, Mycobacterium bovis subsp bovis AF2122/97
cggcgcgcagccg

SEQ ID NO: 1183333 - RNA, 16 nt, Mycobacterium bovis subsp bovis AF2122/97
cggcgcgcaccccggc

SEQ ID NO: 1183334 - RNA, 12 nt, Mycobacterium bovis subsp bovis AF2122/97
cggcgcgcaccc

SEQ ID NO: 1183335 - RNA, 16 nt, Mycobacterium bovis subsp bovis AF2122/97
cggcgcgccccaccgc

SEQ ID NO: 1183336 - RNA, 15 nt, Mycobacterium bovis subsp bovis AF2122/97
cggcgcgacgcccga

SEQ ID NO: 1183337 - RNA, 15 nt, Mycobacterium bovis subsp bovis AF2122/97
cggcgcgaggaacgc

SEQ ID NO: 1183338 - RNA, 21 nt, Mycobacterium bovis subsp bovis AF2122/97
cggcgcgaggaacgccggggc

SEQ ID NO: 1183339 - RNA, 19 nt, Mycobacterium bovis subsp bovis AF2122/97
cggcgcgagccugcucuuc

SEQ ID NO: 1183340 - RNA, 22 nt, Mycobacterium bovis subsp bovis AF2122/97
cggccggagccgccggccccgc

SEQ ID NO: 1183341 - RNA, 16 nt, Mycobacterium bovis subsp bovis AF2122/97
cggccggauacggcga

SEQ ID NO: 1183342 - RNA, 13 nt, Mycobacterium bovis subsp bovis AF2122/97
cggccggcacccc

SEQ ID NO: 1183343 - RNA, 14 nt, Mycobacterium bovis subsp bovis AF2122/97
cggccggcaugcug

SEQ ID NO: 1183344 - RNA, 20 nt, Mycobacterium bovis subsp bovis AF2122/97
cggccgguggaaaccgggcg

SEQ ID NO: 1183345 - RNA, 16 nt, Mycobacterium bovis subsp bovis AF2122/97
cggccgguucagguug

SEQ ID NO: 1183346 - RNA, 22 nt, Mycobacterium bovis subsp bovis AF2122/97
cggccguccuuuccaggagaga

SEQ ID NO: 1183347 - RNA, 23 nt, Mycobacterium bovis subsp bovis AF2122/97
cggccguagugcacgucggcggg

SEQ ID NO: 1183348 - RNA, 15 nt, Mycobacterium bovis subsp bovis AF2122/97
cggccgucgcgggac

SEQ ID NO: 1183349 - RNA, 20 nt, Mycobacterium bovis subsp bovis AF2122/97
cggccgugaacggcgcgggc

SEQ ID NO: 1183350 - RNA, 15 nt, Mycobacterium bovis subsp bovis AF2122/97
cggccgucgucggcc

SEQ ID NO: 1183351 - RNA, 19 nt, Mycobacterium bovis subsp bovis AF2122/97
cggccgucgggacggccaa

SEQ ID NO: 1183352 - RNA, 15 nt, Mycobacterium bovis subsp bovis AF2122/97
cggccgucgggcagc

SEQ ID NO: 1183353 - RNA, 17 nt, Mycobacterium bovis subsp bovis AF2122/97
cggccgcgaccgcgacc

SEQ ID NO: 1183354 - RNA, 15 nt, Mycobacterium bovis subsp bovis AF2122/97
cggccgccguccccg

SEQ ID NO: 1183355 - RNA, 9 nt, Mycobacterium bovis subsp bovis AF2122/97
cggccgccg

SEQ ID NO: 1183356 - RNA, 18 nt, Mycobacterium bovis subsp bovis AF2122/97
cggccgccgcgucgacua

SEQ ID NO: 1183357 - RNA, 16 nt, Mycobacterium bovis subsp bovis AF2122/97
cggccgcgccggcccc

SEQ ID NO: 1183358 - RNA, 14 nt, Mycobacterium bovis subsp bovis AF2122/97
cggccgcucgggcc

SEQ ID NO: 1183359 - RNA, 14 nt, Mycobacterium bovis subsp bovis AF2122/97
cggccgcugacgcc

SEQ ID NO: 1183360 - RNA, 12 nt, Mycobacterium bovis subsp bovis AF2122/97
cggccgcgcgca

SEQ ID NO: 1183361 - RNA, 16 nt, Mycobacterium bovis subsp bovis AF2122/97
cggccgcugggcccau

SEQ ID NO: 1183362 - RNA, 14 nt, Mycobacterium bovis subsp bovis AF2122/97
cggccgcuuggccg

SEQ ID NO: 1183363 - RNA, 19 nt, Mycobacterium bovis subsp bovis AF2122/97
cggccgcugggcccaucgc

SEQ ID NO: 1183364 - RNA, 19 nt, Mycobacterium bovis subsp bovis AF2122/97
cggccggaauacccggccc

SEQ ID NO: 1183365 - RNA, 13 nt, Mycobacterium bovis subsp bovis AF2122/97
cggccgccagccc

SEQ ID NO: 1183366 - RNA, 15 nt, Mycobacterium bovis subsp bovis AF2122/97
cggccgccagcagcu

SEQ ID NO: 1183367 - RNA, 23 nt, Mycobacterium bovis subsp bovis AF2122/97
cggccgccaacuccagcacccgc

SEQ ID NO: 1183368 - RNA, 21 nt, Mycobacterium bovis subsp bovis AF2122/97
cggccgccaacuucaccaccc

SEQ ID NO: 1183369 - RNA, 16 nt, Mycobacterium bovis subsp bovis AF2122/97
cggccgccagcgcgcc

SEQ ID NO: 1183370 - RNA, 16 nt, Mycobacterium bovis subsp bovis AF2122/97
cggccgccagccccac

SEQ ID NO: 1183371 - RNA, 19 nt, Mycobacterium bovis subsp bovis AF2122/97
cggccgccagccccacccg

SEQ ID NO: 1183372 - RNA, 19 nt, Mycobacterium bovis subsp bovis AF2122/97
cggccgccagcgcgccgau

SEQ ID NO: 1183373 - RNA, 15 nt, Mycobacterium bovis subsp bovis AF2122/97
cggccgccaggaauc

SEQ ID NO: 1183374 - RNA, 17 nt, Mycobacterium bovis subsp bovis AF2122/97
cggccgccccaggcugg

SEQ ID NO: 1183375 - RNA, 13 nt, Mycobacterium bovis subsp bovis AF2122/97
cggccgccgcggg

SEQ ID NO: 1183376 - RNA, 19 nt, Mycobacterium bovis subsp bovis AF2122/97
cggccccaccggcaccccc

SEQ ID NO: 1183377 - RNA, 20 nt, Mycobacterium bovis subsp bovis AF2122/97
cggcccauugucgaucaccu

SEQ ID NO: 1183378 - RNA, 23 nt, Mycobacterium bovis subsp bovis AF2122/97
cggcccaucuucggacgccagcu

SEQ ID NO: 1183379 - RNA, 17 nt, Mycobacterium bovis subsp bovis AF2122/97
cggccccaugcgccagc

SEQ ID NO: 1183380 - RNA, 12 nt, Mycobacterium bovis subsp bovis AF2122/97
cggccccagggg

SEQ ID NO: 1183381 - RNA, 20 nt, Mycobacterium bovis subsp bovis AF2122/97
cggcccagguugccuuggcg

SEQ ID NO: 1183382 - RNA, 21 nt, Mycobacterium bovis subsp bovis AF2122/97
cggcccagguugccuuggcgg

SEQ ID NO: 1183383 - RNA, 21 nt, Mycobacterium bovis subsp bovis AF2122/97
cggccaugguguucggcagcg

SEQ ID NO: 1183384 - RNA, 21 nt, Mycobacterium bovis subsp bovis AF2122/97
cggccauuagcagcacccggg

SEQ ID NO: 1183385 - RNA, 22 nt, Mycobacterium bovis subsp bovis AF2122/97
cggccauuagcagcacccgggc

SEQ ID NO: 1183386 - RNA, 23 nt, Mycobacterium bovis subsp bovis AF2122/97
cggccauuagcagcacccgggcc

SEQ ID NO: 1183387 - RNA, 20 nt, Mycobacterium bovis subsp bovis AF2122/97
cggccugaccggcucgccgg

SEQ ID NO: 1183388 - RNA, 16 nt, Mycobacterium bovis subsp bovis AF2122/97
cggccucugaccagcc

SEQ ID NO: 1183389 - RNA, 17 nt, Mycobacterium bovis subsp bovis AF2122/97
cggccugagcggccauc

SEQ ID NO: 1183390 - RNA, 14 nt, Mycobacterium bovis subsp bovis AF2122/97
cggccucgcugggc

SEQ ID NO: 1183391 - RNA, 16 nt, Mycobacterium bovis subsp bovis AF2122/97
cggccguggcuggacc

SEQ ID NO: 1183392 - RNA, 16 nt, Mycobacterium bovis subsp bovis AF2122/97
cggccucgccggcgcg

SEQ ID NO: 1183393 - RNA, 22 nt, Mycobacterium bovis subsp bovis AF2122/97
cggccugaccggucacccgugc

SEQ ID NO: 1183394 - RNA, 17 nt, Mycobacterium bovis subsp bovis AF2122/97
cggccugcacggcgcug

SEQ ID NO: 1183395 - RNA, 15 nt, Mycobacterium bovis subsp bovis AF2122/97
cggccugccgcucgc

SEQ ID NO: 1183396 - RNA, 17 nt, Mycobacterium bovis subsp bovis AF2122/97
cggccugcgagucgcgc

SEQ ID NO: 1183397 - RNA, 14 nt, Mycobacterium bovis subsp bovis AF2122/97
cggccugcggcaac

SEQ ID NO: 1183398 - RNA, 14 nt, Mycobacterium bovis subsp bovis AF2122/97
cggccugcgcgacc

SEQ ID NO: 1183399 - RNA, 16 nt, Mycobacterium bovis subsp bovis AF2122/97
cggccugcgccggcgc

SEQ ID NO: 1183400 - RNA, 19 nt, Mycobacterium bovis subsp bovis AF2122/97
cggccugcgacgagcccac

SEQ ID NO: 1183401 - RNA, 22 nt, Mycobacterium bovis subsp bovis AF2122/97
cggccugcgacgagcccaccgu

SEQ ID NO: 1183402 - RNA, 16 nt, Mycobacterium bovis subsp bovis AF2122/97
cggccugcucgggggc

SEQ ID NO: 1183403 - RNA, 15 nt, Mycobacterium bovis subsp bovis AF2122/97
cggccugcucggcga

SEQ ID NO: 1183404 - RNA, 14 nt, Mycobacterium bovis subsp bovis AF2122/97
cggcgaaccacggc

SEQ ID NO: 1183405 - RNA, 14 nt, Mycobacterium bovis subsp bovis AF2122/97
cggcgaacccagcg

SEQ ID NO: 1183406 - RNA, 23 nt, Mycobacterium bovis subsp bovis AF2122/97
cggcgaacccagcggagccacuc

SEQ ID NO: 1183407 - RNA, 15 nt, Mycobacterium bovis subsp bovis AF2122/97
cggcgaacccgcagu

SEQ ID NO: 1183408 - RNA, 15 nt, Mycobacterium bovis subsp bovis AF2122/97
cggcgaacccgccga

SEQ ID NO: 1183409 - RNA, 18 nt, Mycobacterium bovis subsp bovis AF2122/97
cggcgaaccacggcagcc

SEQ ID NO: 1183410 - RNA, 18 nt, Mycobacterium bovis subsp bovis AF2122/97
cggcgaaccggcccaccg

SEQ ID NO: 1183411 - RNA, 23 nt, Mycobacterium bovis subsp bovis AF2122/97
cggcgaacgcguccagcgcggcc

SEQ ID NO: 1183412 - RNA, 20 nt, Mycobacterium bovis subsp bovis AF2122/97
cggcgaccagcucagcugcg

SEQ ID NO: 1183413 - RNA, 21 nt, Mycobacterium bovis subsp bovis AF2122/97
cggcgaccagaaucucgccgg

SEQ ID NO: 1183414 - RNA, 20 nt, Mycobacterium bovis subsp bovis AF2122/97
cggcgacccggguagacacc

SEQ ID NO: 1183415 - RNA, 14 nt, Mycobacterium bovis subsp bovis AF2122/97
cggcgaccaccccg

SEQ ID NO: 1183416 - RNA, 20 nt, Mycobacterium bovis subsp bovis AF2122/97
cggcgaccaccgcggcugcu

SEQ ID NO: 1183417 - RNA, 13 nt, Mycobacterium bovis subsp bovis AF2122/97
cggcgaccacggc

SEQ ID NO: 1183418 - RNA, 14 nt, Mycobacterium bovis subsp bovis AF2122/97
cggcgacguggcgc

SEQ ID NO: 1183419 - RNA, 17 nt, Mycobacterium bovis subsp bovis AF2122/97
cggcgacggugccaccg

SEQ ID NO: 1183420 - RNA, 13 nt, Mycobacterium bovis subsp bovis AF2122/97
cggcgacuccucu

SEQ ID NO: 1183421 - RNA, 17 nt, Mycobacterium bovis subsp bovis AF2122/97
cggcgacucgaggaccu

SEQ ID NO: 1183422 - RNA, 19 nt, Mycobacterium bovis subsp bovis AF2122/97
cggcgacguuccgcucgag

SEQ ID NO: 1183423 - RNA, 17 nt, Mycobacterium bovis subsp bovis AF2122/97
cggcgacuacccagcca

SEQ ID NO: 1183424 - RNA, 22 nt, Mycobacterium bovis subsp bovis AF2122/97
cggcgacuacccagccagccgc

SEQ ID NO: 1183425 - RNA, 18 nt, Mycobacterium bovis subsp bovis AF2122/97
cggcgacgucgcgcaggu

SEQ ID NO: 1183426 - RNA, 14 nt, Mycobacterium bovis subsp bovis AF2122/97
cggcgaccgggauc

SEQ ID NO: 1183427 - RNA, 14 nt, Mycobacterium bovis subsp bovis AF2122/97
cggcgaccgccagc

SEQ ID NO: 1183428 - RNA, 19 nt, Mycobacterium bovis subsp bovis AF2122/97
cggcgacagcuuggccggu

SEQ ID NO: 1183429 - RNA, 23 nt, Mycobacterium bovis subsp bovis AF2122/97
cggcgaccgacgccggugucggc

SEQ ID NO: 1183430 - RNA, 20 nt, Mycobacterium bovis subsp bovis AF2122/97
cggcgagcagacgcaaaagc

SEQ ID NO: 1183431 - RNA, 15 nt, Mycobacterium bovis subsp bovis AF2122/97
cggcgagcagcaggu

SEQ ID NO: 1183432 - RNA, 16 nt, Mycobacterium bovis subsp bovis AF2122/97
cggcgagcacgcgggc

SEQ ID NO: 1183433 - RNA, 17 nt, Mycobacterium bovis subsp bovis AF2122/97
cggcgagagccucggcc

SEQ ID NO: 1183434 - RNA, 18 nt, Mycobacterium bovis subsp bovis AF2122/97
cggcgagagccucggcca

SEQ ID NO: 1183435 - RNA, 15 nt, Mycobacterium bovis subsp bovis AF2122/97
cggcgagcaccaccc

SEQ ID NO: 1183436 - RNA, 16 nt, Mycobacterium bovis subsp bovis AF2122/97
cggcgacugcgcaccu

SEQ ID NO: 1183437 - RNA, 17 nt, Mycobacterium bovis subsp bovis AF2122/97
cggcaggccuggcgagc

SEQ ID NO: 1183438 - RNA, 14 nt, Mycobacterium bovis subsp bovis AF2122/97
cggcaggcggccgc

SEQ ID NO: 1183439 - RNA, 14 nt, Mycobacterium bovis subsp bovis AF2122/97
cggcaggccggcca

SEQ ID NO: 1183440 - RNA, 17 nt, Mycobacterium bovis subsp bovis AF2122/97
cggcaggaaugccgcgg

SEQ ID NO: 1183441 - RNA, 20 nt, Mycobacterium bovis subsp bovis AF2122/97
cggcaggaaugccgcgggga

SEQ ID NO: 1183442 - RNA, 20 nt, Mycobacterium bovis subsp bovis AF2122/97
cggcagcuggcgcagccugc

SEQ ID NO: 1183443 - RNA, 13 nt, Mycobacterium bovis subsp bovis AF2122/97
cggcagcuccagc

SEQ ID NO: 1183444 - RNA, 14 nt, Mycobacterium bovis subsp bovis AF2122/97
cggcagcuccagca

SEQ ID NO: 1183445 - RNA, 24 nt, Mycobacterium bovis subsp bovis AF2122/97
cggcagcuacuaugccaacgacag

SEQ ID NO: 1183446 - RNA, 21 nt, Mycobacterium bovis subsp bovis AF2122/97
cggcagcgugcggggcgccug

SEQ ID NO: 1183447 - RNA, 22 nt, Mycobacterium bovis subsp bovis AF2122/97
cggcagcggcuaacgaagccag

SEQ ID NO: 1183448 - RNA, 22 nt, Mycobacterium bovis subsp bovis AF2122/97
cggcagcgguuuuaggcagccc

SEQ ID NO: 1183449 - RNA, 22 nt, Mycobacterium bovis subsp bovis AF2122/97
cggcagcgguggcuugccccgc

SEQ ID NO: 1183450 - RNA, 15 nt, Mycobacterium bovis subsp bovis AF2122/97
cggcagcggcgcgcu

SEQ ID NO: 1183451 - RNA, 19 nt, Mycobacterium bovis subsp bovis AF2122/97
cggcagcgcccuuggacgc

SEQ ID NO: 1183452 - RNA, 16 nt, Mycobacterium bovis subsp bovis AF2122/97
cggcagcgccggucgg

SEQ ID NO: 1183453 - RNA, 18 nt, Mycobacterium bovis subsp bovis AF2122/97
cggcagcggaccgcugcc

SEQ ID NO: 1183454 - RNA, 13 nt, Mycobacterium bovis subsp bovis AF2122/97
cggcagcggcgcc

SEQ ID NO: 1183455 - RNA, 15 nt, Mycobacterium bovis subsp bovis AF2122/97
cggcagggcggugcc

SEQ ID NO: 1183456 - RNA, 20 nt, Mycobacterium bovis subsp bovis AF2122/97
cggcagguacggguaacgca

SEQ ID NO: 1183457 - RNA, 18 nt, Mycobacterium bovis subsp bovis AF2122/97
cggcaggcggccgccggg

SEQ ID NO: 1183458 - RNA, 23 nt, Mycobacterium bovis subsp bovis AF2122/97
cggcaggcuggcgagggcugacg

SEQ ID NO: 1183459 - RNA, 22 nt, Mycobacterium bovis subsp bovis AF2122/97
cggcagguccaucuggcgcgcc

SEQ ID NO: 1183460 - RNA, 16 nt, Mycobacterium bovis subsp bovis AF2122/97
cggcagugagucggug

SEQ ID NO: 1183461 - RNA, 16 nt, Mycobacterium bovis subsp bovis AF2122/97
cggcagugcugcagac

SEQ ID NO: 1183462 - RNA, 16 nt, Mycobacterium bovis subsp bovis AF2122/97
cggcaguuccugacgc

SEQ ID NO: 1183463 - RNA, 18 nt, Mycobacterium bovis subsp bovis AF2122/97
cggcaguucgcggccauc

SEQ ID NO: 1183464 - RNA, 15 nt, Mycobacterium bovis subsp bovis AF2122/97
cggcaguuguggcgc

SEQ ID NO: 1183465 - RNA, 19 nt, Mycobacterium bovis subsp bovis AF2122/97
cggcaguuguggcgcugcg

SEQ ID NO: 1183466 - RNA, 17 nt, Mycobacterium bovis subsp bovis AF2122/97
cggcauaacccuggccg

SEQ ID NO: 1183467 - RNA, 19 nt, Mycobacterium bovis subsp bovis AF2122/97
cggcauacccaucaacauc

SEQ ID NO: 1183468 - RNA, 20 nt, Mycobacterium bovis subsp bovis AF2122/97
cggcauaccgaacagcaccu

SEQ ID NO: 1183469 - RNA, 13 nt, Mycobacterium bovis subsp bovis AF2122/97
cggcacgcgcgcu

SEQ ID NO: 1183470 - RNA, 21 nt, Mycobacterium bovis subsp bovis AF2122/97
cggcacgggcggccauggcac

SEQ ID NO: 1183471 - RNA, 21 nt, Mycobacterium bovis subsp bovis AF2122/97
cggcacuuuguagcccgcgau

SEQ ID NO: 1183472 - RNA, 22 nt, Mycobacterium bovis subsp bovis AF2122/97
cggcagaccggugcugucgacg

SEQ ID NO: 1183473 - RNA, 15 nt, Mycobacterium bovis subsp bovis AF2122/97
cggcagaccaugguc

SEQ ID NO: 1183474 - RNA, 15 nt, Mycobacterium bovis subsp bovis AF2122/97
cggcagacaucuggg

SEQ ID NO: 1183475 - RNA, 18 nt, Mycobacterium bovis subsp bovis AF2122/97
cggcagacaucuggguga

SEQ ID NO: 1183476 - RNA, 17 nt, Mycobacterium bovis subsp bovis AF2122/97
cggcagaccgaccucgg

SEQ ID NO: 1183477 - RNA, 22 nt, Mycobacterium bovis subsp bovis AF2122/97
cggcagcgaugcggugucgggc

SEQ ID NO: 1183478 - RNA, 19 nt, Mycobacterium bovis subsp bovis AF2122/97
cggcagcgacgccggcccg

SEQ ID NO: 1183479 - RNA, 18 nt, Mycobacterium bovis subsp bovis AF2122/97
cggcagccgggcggcagc

SEQ ID NO: 1183480 - RNA, 14 nt, Mycobacterium bovis subsp bovis AF2122/97
cggcagccuggccu

SEQ ID NO: 1183481 - RNA, 16 nt, Mycobacterium bovis subsp bovis AF2122/97
cggcagccccugccga

SEQ ID NO: 1183482 - RNA, 14 nt, Mycobacterium bovis subsp bovis AF2122/97
cggcagcccggcgg

SEQ ID NO: 1183483 - RNA, 20 nt, Mycobacterium bovis subsp bovis AF2122/97
cggcagcccaaagcgccagc

SEQ ID NO: 1183484 - RNA, 13 nt, Mycobacterium bovis subsp bovis AF2122/97
cggcagccggcgg

SEQ ID NO: 1183485 - RNA, 14 nt, Mycobacterium bovis subsp bovis AF2122/97
cggcagccagggcg

SEQ ID NO: 1183486 - RNA, 18 nt, Mycobacterium bovis subsp bovis AF2122/97
cggcacgaccgcucccgg

SEQ ID NO: 1183487 - RNA, 16 nt, Mycobacterium bovis subsp bovis AF2122/97
cggcacgccggcggcg

SEQ ID NO: 1183488 - RNA, 13 nt, Mycobacterium bovis subsp bovis AF2122/97
cggcacgcgcagu

SEQ ID NO: 1183489 - RNA, 15 nt, Mycobacterium bovis subsp bovis AF2122/97
cgcuuggcgcggccc

SEQ ID NO: 1183490 - RNA, 20 nt, Mycobacterium bovis subsp bovis AF2122/97
cgcuuggccgcugccuucuu

SEQ ID NO: 1183491 - RNA, 19 nt, Mycobacterium bovis subsp bovis AF2122/97
cgcuuggccggauccucga

SEQ ID NO: 1183492 - RNA, 16 nt, Mycobacterium bovis subsp bovis AF2122/97
cgcuuggcgugaccua

SEQ ID NO: 1183493 - RNA, 18 nt, Mycobacterium bovis subsp bovis AF2122/97
cggcacgaaauugggcga

SEQ ID NO: 1183494 - RNA, 23 nt, Mycobacterium bovis subsp bovis AF2122/97
cgcuuggagcggguccccaccgg

SEQ ID NO: 1183495 - RNA, 15 nt, Mycobacterium bovis subsp bovis AF2122/97
cgcuugcucucgcag

SEQ ID NO: 1183496 - RNA, 18 nt, Mycobacterium bovis subsp bovis AF2122/97
cgcuuggcaaucaucucc

SEQ ID NO: 1183497 - RNA, 21 nt, Mycobacterium bovis subsp bovis AF2122/97
cgcuuggcaaucaucucccga

SEQ ID NO: 1183498 - RNA, 12 nt, Mycobacterium bovis subsp bovis AF2122/97
cgcuugccccgc

SEQ ID NO: 1183499 - RNA, 14 nt, Mycobacterium bovis subsp bovis AF2122/97
cgcuugccgcugag

SEQ ID NO: 1183500 - RNA, 14 nt, Mycobacterium bovis subsp bovis AF2122/97
cgcuugacccgcgg

SEQ ID NO: 1183501 - RNA, 20 nt, Mycobacterium bovis subsp bovis AF2122/97
cgcuugccccgccuuggcca

SEQ ID NO: 1183502 - RNA, 19 nt, Mycobacterium bovis subsp bovis AF2122/97
cgcuugcggggccgggcga

SEQ ID NO: 1183503 - RNA, 14 nt, Mycobacterium bovis subsp bovis AF2122/97
cgcuugcggccgcg

SEQ ID NO: 1183504 - RNA, 23 nt, Mycobacterium bovis subsp bovis AF2122/97
cggccauauugggaguccggccg

SEQ ID NO: 1183505 - RNA, 19 nt, Mycobacterium bovis subsp bovis AF2122/97
cggccaucagaaccuccuc

SEQ ID NO: 1183506 - RNA, 22 nt, Mycobacterium bovis subsp bovis AF2122/97
cggccauagcgccgcgcccacc

SEQ ID NO: 1183507 - RNA, 14 nt, Mycobacterium bovis subsp bovis AF2122/97
cggccaucgccagc

SEQ ID NO: 1183508 - RNA, 22 nt, Mycobacterium bovis subsp bovis AF2122/97
cggccaucgccagccugugcug

SEQ ID NO: 1183509 - RNA, 18 nt, Mycobacterium bovis subsp bovis AF2122/97
cggccauccggcggcggc

SEQ ID NO: 1183510 - RNA, 21 nt, Mycobacterium bovis subsp bovis AF2122/97
cggccaucgaguccaccaccu

SEQ ID NO: 1183511 - RNA, 20 nt, Mycobacterium bovis subsp bovis AF2122/97
cggccaugguguucggcagc

SEQ ID NO: 1183512 - RNA, 15 nt, Mycobacterium bovis subsp bovis AF2122/97
cggccauggcggcgc

SEQ ID NO: 1183513 - RNA, 21 nt, Mycobacterium bovis subsp bovis AF2122/97
cggccauggcggcgccggugg

SEQ ID NO: 1183514 - RNA, 17 nt, Mycobacterium bovis subsp bovis AF2122/97
cggccauggcacugccg

SEQ ID NO: 1183515 - RNA, 17 nt, Mycobacterium bovis subsp bovis AF2122/97
cggccauggcagcgcgc

SEQ ID NO: 1183516 - RNA, 20 nt, Mycobacterium bovis subsp bovis AF2122/97
cggccauggcagcgcgcuga

SEQ ID NO: 1183517 - RNA, 21 nt, Mycobacterium bovis subsp bovis AF2122/97
cggccauggcagcgcgcugag

SEQ ID NO: 1183518 - RNA, 17 nt, Mycobacterium bovis subsp bovis AF2122/97
cggccaugaugaugaca

SEQ ID NO: 1183519 - RNA, 23 nt, Mycobacterium bovis subsp bovis AF2122/97
cggccaggaugaagacgcggguc

SEQ ID NO: 1183520 - RNA, 22 nt, Mycobacterium bovis subsp bovis AF2122/97
cggccaggaugccugccacccg

SEQ ID NO: 1183521 - RNA, 12 nt, Mycobacterium bovis subsp bovis AF2122/97
cggccaggacaa

SEQ ID NO: 1183522 - RNA, 19 nt, Mycobacterium bovis subsp bovis AF2122/97
cggccaggaucuguuuggg

SEQ ID NO: 1183523 - RNA, 21 nt, Mycobacterium bovis subsp bovis AF2122/97
cggccaggaguuugaccaccu

SEQ ID NO: 1183524 - RNA, 20 nt, Mycobacterium bovis subsp bovis AF2122/97
cggccaggaucaaccggccc

SEQ ID NO: 1183525 - RNA, 19 nt, Mycobacterium bovis subsp bovis AF2122/97
cggccaggaucgcuacguc

SEQ ID NO: 1183526 - RNA, 16 nt, Mycobacterium bovis subsp bovis AF2122/97
cggccaggcgcgacgu

SEQ ID NO: 1183527 - RNA, 18 nt, Mycobacterium bovis subsp bovis AF2122/97
cggccaggccgucggcgu

SEQ ID NO: 1183528 - RNA, 15 nt, Mycobacterium bovis subsp bovis AF2122/97
cggccaggccggcgg

SEQ ID NO: 1183529 - RNA, 14 nt, Mycobacterium bovis subsp bovis AF2122/97
cggccaggccgaca

SEQ ID NO: 1183530 - RNA, 19 nt, Mycobacterium bovis subsp bovis AF2122/97
cggccaguucggcggccgc

SEQ ID NO: 1183531 - RNA, 18 nt, Mycobacterium bovis subsp bovis AF2122/97
cggccagcagcagugcca

SEQ ID NO: 1183532 - RNA, 13 nt, Mycobacterium bovis subsp bovis AF2122/97
cggccagcccagc

SEQ ID NO: 1183533 - RNA, 18 nt, Mycobacterium bovis subsp bovis AF2122/97
cggccagccauggcagcg

SEQ ID NO: 1183534 - RNA, 15 nt, Mycobacterium bovis subsp bovis AF2122/97
cggccaccgccgccg

SEQ ID NO: 1183535 - RNA, 16 nt, Mycobacterium bovis subsp bovis AF2122/97
cggccaccgccgccgc

SEQ ID NO: 1183536 - RNA, 15 nt, Mycobacterium bovis subsp bovis AF2122/97
cggccaccgaggcgu

SEQ ID NO: 1183537 - RNA, 23 nt, Mycobacterium bovis subsp bovis AF2122/97
cggccaccgccgccgccaccggc

SEQ ID NO: 1183538 - RNA, 21 nt, Mycobacterium bovis subsp bovis AF2122/97
cggccaccgcacgcuggcggg

SEQ ID NO: 1183539 - RNA, 17 nt, Mycobacterium bovis subsp bovis AF2122/97
cggccaccaucgccccg

SEQ ID NO: 1183540 - RNA, 13 nt, Mycobacterium bovis subsp bovis AF2122/97
cggccaccaggug

SEQ ID NO: 1183541 - RNA, 16 nt, Mycobacterium bovis subsp bovis AF2122/97
cggccaccaggugccg

SEQ ID NO: 1183542 - RNA, 13 nt, Mycobacterium bovis subsp bovis AF2122/97
cggccacccgcga

SEQ ID NO: 1183543 - RNA, 17 nt, Mycobacterium bovis subsp bovis AF2122/97
cggccagcucgcgggcc

SEQ ID NO: 1183544 - RNA, 16 nt, Mycobacterium bovis subsp bovis AF2122/97
cggccagcuccgccug

SEQ ID NO: 1183545 - RNA, 18 nt, Mycobacterium bovis subsp bovis AF2122/97
cggccagcgugucccaac

SEQ ID NO: 1183546 - RNA, 20 nt, Mycobacterium bovis subsp bovis AF2122/97
cggccagcgugucccaacgc

SEQ ID NO: 1183547 - RNA, 13 nt, Mycobacterium bovis subsp bovis AF2122/97
cggccagcucccg

SEQ ID NO: 1183548 - RNA, 20 nt, Mycobacterium bovis subsp bovis AF2122/97
cggccagcugcguggcgaac

SEQ ID NO: 1183549 - RNA, 15 nt, Mycobacterium bovis subsp bovis AF2122/97
cggccagcucggcca

SEQ ID NO: 1183550 - RNA, 21 nt, Mycobacterium bovis subsp bovis AF2122/97
cggccagcuugcggagccgcc

SEQ ID NO: 1183551 - RNA, 13 nt, Mycobacterium bovis subsp bovis AF2122/97
cggccagcuuccc

SEQ ID NO: 1183552 - RNA, 14 nt, Mycobacterium bovis subsp bovis AF2122/97
cggccagccgcggc

SEQ ID NO: 1183553 - RNA, 20 nt, Mycobacterium bovis subsp bovis AF2122/97
cggccagccucaucugaggc

SEQ ID NO: 1183554 - RNA, 21 nt, Mycobacterium bovis subsp bovis AF2122/97
cggccagcggccauccggcgg

SEQ ID NO: 1183555 - RNA, 13 nt, Mycobacterium bovis subsp bovis AF2122/97
cggccagcggccc

SEQ ID NO: 1183556 - RNA, 17 nt, Mycobacterium bovis subsp bovis AF2122/97
cggccagcgggaacaca

SEQ ID NO: 1183557 - RNA, 15 nt, Mycobacterium bovis subsp bovis AF2122/97
cggcaucggccaccu

SEQ ID NO: 1183558 - RNA, 23 nt, Mycobacterium bovis subsp bovis AF2122/97
cggcaucugaaaauugacccccu

SEQ ID NO: 1183559 - RNA, 13 nt, Mycobacterium bovis subsp bovis AF2122/97
cggcaucgcgggc

SEQ ID NO: 1183560 - RNA, 22 nt, Mycobacterium bovis subsp bovis AF2122/97
cggcaucgcgggcggcgcuggc

SEQ ID NO: 1183561 - RNA, 14 nt, Mycobacterium bovis subsp bovis AF2122/97
cggcaucgccgcgg

SEQ ID NO: 1183562 - RNA, 17 nt, Mycobacterium bovis subsp bovis AF2122/97
cggcaucgccgcgggug

SEQ ID NO: 1183563 - RNA, 23 nt, Mycobacterium bovis subsp bovis AF2122/97
cggcauccucugaaccagcugag

SEQ ID NO: 1183564 - RNA, 20 nt, Mycobacterium bovis subsp bovis AF2122/97
cggcaucgaguucggcccgc

SEQ ID NO: 1183565 - RNA, 15 nt, Mycobacterium bovis subsp bovis AF2122/97
cggcauccgcgggga

SEQ ID NO: 1183566 - RNA, 16 nt, Mycobacterium bovis subsp bovis AF2122/97
cggcauagcucagacc

SEQ ID NO: 1183567 - RNA, 23 nt, Mycobacterium bovis subsp bovis AF2122/97
cggcaucaacgcgggcgcuugcc

SEQ ID NO: 1183568 - RNA, 22 nt, Mycobacterium bovis subsp bovis AF2122/97
cggccaacccgggccgccaggg

SEQ ID NO: 1183569 - RNA, 22 nt, Mycobacterium bovis subsp bovis AF2122/97
cggccaacgaacgugccccggc

SEQ ID NO: 1183570 - RNA, 15 nt, Mycobacterium bovis subsp bovis AF2122/97
cggccaacaccacua

SEQ ID NO: 1183571 - RNA, 19 nt, Mycobacterium bovis subsp bovis AF2122/97
cggccaacagucgcagcac

SEQ ID NO: 1183572 - RNA, 14 nt, Mycobacterium bovis subsp bovis AF2122/97
cggccaaccaccaa

SEQ ID NO: 1183573 - RNA, 17 nt, Mycobacterium bovis subsp bovis AF2122/97
cggccaacccaucccga

SEQ ID NO: 1183574 - RNA, 16 nt, Mycobacterium bovis subsp bovis AF2122/97
cggccaaucagcccgc

SEQ ID NO: 1183575 - RNA, 20 nt, Mycobacterium bovis subsp bovis AF2122/97
cggccaaucagcccgccgga

SEQ ID NO: 1183576 - RNA, 21 nt, Mycobacterium bovis subsp bovis AF2122/97
cggccaacggcuccgggcgcu

SEQ ID NO: 1183577 - RNA, 22 nt, Mycobacterium bovis subsp bovis AF2122/97
cggccaagaucggcgccccugc

SEQ ID NO: 1183578 - RNA, 18 nt, Mycobacterium bovis subsp bovis AF2122/97
cggccaacggcuccgggc

SEQ ID NO: 1183579 - RNA, 14 nt, Mycobacterium bovis subsp bovis AF2122/97
cggccaacugggcc

SEQ ID NO: 1183580 - RNA, 18 nt, Mycobacterium bovis subsp bovis AF2122/97
cggccaauccggggcccg

SEQ ID NO: 1183581 - RNA, 14 nt, Mycobacterium bovis subsp bovis AF2122/97
cggccaccagccgg

SEQ ID NO: 1183582 - RNA, 16 nt, Mycobacterium bovis subsp bovis AF2122/97
cggccaccagggccac

SEQ ID NO: 1183583 - RNA, 18 nt, Mycobacterium bovis subsp bovis AF2122/97
cggccaccagggccaccg

SEQ ID NO: 1183584 - RNA, 20 nt, Mycobacterium bovis subsp bovis AF2122/97
cggccaccagggccaccgcg

SEQ ID NO: 1183585 - RNA, 23 nt, Mycobacterium bovis subsp bovis AF2122/97
cggccaccagggccaccgcgccg

SEQ ID NO: 1183586 - RNA, 15 nt, Mycobacterium bovis subsp bovis AF2122/97
cggccaccagcgccu

SEQ ID NO: 1183587 - RNA, 16 nt, Mycobacterium bovis subsp bovis AF2122/97
cggccaccagcgccuu

SEQ ID NO: 1183588 - RNA, 20 nt, Mycobacterium bovis subsp bovis AF2122/97
cggcaugcgugccggcagcg

SEQ ID NO: 1183589 - RNA, 16 nt, Mycobacterium bovis subsp bovis AF2122/97
cggcaugggccggcgc

SEQ ID NO: 1183590 - RNA, 18 nt, Mycobacterium bovis subsp bovis AF2122/97
cggcaugcaaugcuggcg

SEQ ID NO: 1183591 - RNA, 15 nt, Mycobacterium bovis subsp bovis AF2122/97
cggcaugcagaucuc

SEQ ID NO: 1183592 - RNA, 23 nt, Mycobacterium bovis subsp bovis AF2122/97
cggccaaaauuuugucggccgcc

SEQ ID NO: 1183593 - RNA, 17 nt, Mycobacterium bovis subsp bovis AF2122/97
cggccaaagacccggca

SEQ ID NO: 1183594 - RNA, 19 nt, Mycobacterium bovis subsp bovis AF2122/97
cgcucggccugcugcugca

SEQ ID NO: 1183595 - RNA, 19 nt, Mycobacterium bovis subsp bovis AF2122/97
cgcucgggcaacgccucga

SEQ ID NO: 1183596 - RNA, 17 nt, Mycobacterium bovis subsp bovis AF2122/97
cgcucggcguccgccca

SEQ ID NO: 1183597 - RNA, 15 nt, Mycobacterium bovis subsp bovis AF2122/97
cgcucgguccagccg

SEQ ID NO: 1183598 - RNA, 17 nt, Mycobacterium bovis subsp bovis AF2122/97
cgcucgguaccggucga

SEQ ID NO: 1183599 - RNA, 13 nt, Mycobacterium bovis subsp bovis AF2122/97
cgcucguugcguu

SEQ ID NO: 1183600 - RNA, 22 nt, Mycobacterium bovis subsp bovis AF2122/97
cgcucggugcugcgccgauacg

SEQ ID NO: 1183601 - RNA, 17 nt, Mycobacterium bovis subsp bovis AF2122/97
cgcucggucgccaccgc

SEQ ID NO: 1183602 - RNA, 21 nt, Mycobacterium bovis subsp bovis AF2122/97
cgcucggucgccaccgccggc

SEQ ID NO: 1183603 - RNA, 23 nt, Mycobacterium bovis subsp bovis AF2122/97
cgcucggucgccaccgccggcag

SEQ ID NO: 1183604 - RNA, 21 nt, Mycobacterium bovis subsp bovis AF2122/97
cgcucgguuugcguccuggug

SEQ ID NO: 1183605 - RNA, 16 nt, Mycobacterium bovis subsp bovis AF2122/97
cgcucgcgcacccugc

SEQ ID NO: 1183606 - RNA, 12 nt, Mycobacterium bovis subsp bovis AF2122/97
cgcucgcggcgg

SEQ ID NO: 1183607 - RNA, 16 nt, Mycobacterium bovis subsp bovis AF2122/97
cgcucgcggcggcgcu

SEQ ID NO: 1183608 - RNA, 14 nt, Mycobacterium bovis subsp bovis AF2122/97
cgcucgcccgccgc

SEQ ID NO: 1183609 - RNA, 20 nt, Mycobacterium bovis subsp bovis AF2122/97
cgcucggagaucgccacuac

SEQ ID NO: 1183610 - RNA, 23 nt, Mycobacterium bovis subsp bovis AF2122/97
cgcucgcggcuucaguccggccc

SEQ ID NO: 1183611 - RNA, 22 nt, Mycobacterium bovis subsp bovis AF2122/97
cgcugaacgcuguaagcaugcc

SEQ ID NO: 1183612 - RNA, 17 nt, Mycobacterium bovis subsp bovis AF2122/97
cgcugaaguggcacaag

SEQ ID NO: 1183613 - RNA, 23 nt, Mycobacterium bovis subsp bovis AF2122/97
cgcugaagguggcgaacccgguc

SEQ ID NO: 1183614 - RNA, 17 nt, Mycobacterium bovis subsp bovis AF2122/97
cgcugaccccggcagcg

SEQ ID NO: 1183615 - RNA, 19 nt, Mycobacterium bovis subsp bovis AF2122/97
cgcucugcgccacagcagc

SEQ ID NO: 1183616 - RNA, 15 nt, Mycobacterium bovis subsp bovis AF2122/97
cgcucugcggccacg

SEQ ID NO: 1183617 - RNA, 17 nt, Mycobacterium bovis subsp bovis AF2122/97
cgcucucggucaguucc

SEQ ID NO: 1183618 - RNA, 23 nt, Mycobacterium bovis subsp bovis AF2122/97
cgcuccgcggcucaaucuccucc

SEQ ID NO: 1183619 - RNA, 21 nt, Mycobacterium bovis subsp bovis AF2122/97
cgcuccggcccugccgccggc

SEQ ID NO: 1183620 - RNA, 21 nt, Mycobacterium bovis subsp bovis AF2122/97
cgcuccgccgucgccgccggc

SEQ ID NO: 1183621 - RNA, 23 nt, Mycobacterium bovis subsp bovis AF2122/97
cgcuccgccgucgccgccggcgc

SEQ ID NO: 1183622 - RNA, 13 nt, Mycobacterium bovis subsp bovis AF2122/97
cgcuccgcggcgc

SEQ ID NO: 1183623 - RNA, 17 nt, Mycobacterium bovis subsp bovis AF2122/97
cgcuccgcggcgcagca

SEQ ID NO: 1183624 - RNA, 15 nt, Mycobacterium bovis subsp bovis AF2122/97
cgcucccccgccaac

SEQ ID NO: 1183625 - RNA, 22 nt, Mycobacterium bovis subsp bovis AF2122/97
cgcuccccagcgaaucacccgc

SEQ ID NO: 1183626 - RNA, 17 nt, Mycobacterium bovis subsp bovis AF2122/97
cgcucgaaagagccgcu

SEQ ID NO: 1183627 - RNA, 22 nt, Mycobacterium bovis subsp bovis AF2122/97
cgcucgaaagcgucgaucaccu

SEQ ID NO: 1183628 - RNA, 13 nt, Mycobacterium bovis subsp bovis AF2122/97
cgcucgaccccgc

SEQ ID NO: 1183629 - RNA, 15 nt, Mycobacterium bovis subsp bovis AF2122/97
cgcucgacggcccgc

SEQ ID NO: 1183630 - RNA, 18 nt, Mycobacterium bovis subsp bovis AF2122/97
cgcucgacgacgggcgcc

SEQ ID NO: 1183631 - RNA, 21 nt, Mycobacterium bovis subsp bovis AF2122/97
cgcucgacgacgggcgccaac

SEQ ID NO: 1183632 - RNA, 23 nt, Mycobacterium bovis subsp bovis AF2122/97
cgcucgauggcggccaccagcgc

SEQ ID NO: 1183633 - RNA, 21 nt, Mycobacterium bovis subsp bovis AF2122/97
cgcucgaucacuagcgccccu

SEQ ID NO: 1183634 - RNA, 19 nt, Mycobacterium bovis subsp bovis AF2122/97
cgcucgauggcggccacca

SEQ ID NO: 1183635 - RNA, 15 nt, Mycobacterium bovis subsp bovis AF2122/97
cgcuccacugaccag

SEQ ID NO: 1183636 - RNA, 13 nt, Mycobacterium bovis subsp bovis AF2122/97
cgcuccagauggg

SEQ ID NO: 1183637 - RNA, 16 nt, Mycobacterium bovis subsp bovis AF2122/97
cgcuccaccucggcgu

SEQ ID NO: 1183638 - RNA, 18 nt, Mycobacterium bovis subsp bovis AF2122/97
cgcuccaguggcgccagg

SEQ ID NO: 1183639 - RNA, 20 nt, Mycobacterium bovis subsp bovis AF2122/97
cgcuccaguggcgccagggc

SEQ ID NO: 1183640 - RNA, 18 nt, Mycobacterium bovis subsp bovis AF2122/97
cgcucagggugcgccgca

SEQ ID NO: 1183641 - RNA, 20 nt, Mycobacterium bovis subsp bovis AF2122/97
cgcucagggugcgccgcagc

SEQ ID NO: 1183642 - RNA, 18 nt, Mycobacterium bovis subsp bovis AF2122/97
cgcucaguuuggccuggu

SEQ ID NO: 1183643 - RNA, 22 nt, Mycobacterium bovis subsp bovis AF2122/97
cgcucauccauucggcggcggc

SEQ ID NO: 1183644 - RNA, 15 nt, Mycobacterium bovis subsp bovis AF2122/97
cgcucaucgcggcga

SEQ ID NO: 1183645 - RNA, 18 nt, Mycobacterium bovis subsp bovis AF2122/97
cgcucauucgugcccggg

SEQ ID NO: 1183646 - RNA, 18 nt, Mycobacterium bovis subsp bovis AF2122/97
cgcucauguucucgaccg

SEQ ID NO: 1183647 - RNA, 19 nt, Mycobacterium bovis subsp bovis AF2122/97
cgcuccaaaagccucagcc

SEQ ID NO: 1183648 - RNA, 15 nt, Mycobacterium bovis subsp bovis AF2122/97
cgcuccaacaacucc

SEQ ID NO: 1183649 - RNA, 18 nt, Mycobacterium bovis subsp bovis AF2122/97
cgcuccaacacccgccgg

SEQ ID NO: 1183650 - RNA, 15 nt, Mycobacterium bovis subsp bovis AF2122/97
cgcucagggugcgcc

SEQ ID NO: 1183651 - RNA, 13 nt, Mycobacterium bovis subsp bovis AF2122/97
cgcucaccggcgu

SEQ ID NO: 1183652 - RNA, 21 nt, Mycobacterium bovis subsp bovis AF2122/97
cgcucaccuuuggccgcgacc

SEQ ID NO: 1183653 - RNA, 18 nt, Mycobacterium bovis subsp bovis AF2122/97
cgcucaccgacgcugacc

SEQ ID NO: 1183654 - RNA, 14 nt, Mycobacterium bovis subsp bovis AF2122/97
cgcucacgaagacc

SEQ ID NO: 1183655 - RNA, 15 nt, Mycobacterium bovis subsp bovis AF2122/97
cgcucacccgcccgg

SEQ ID NO: 1183656 - RNA, 19 nt, Mycobacterium bovis subsp bovis AF2122/97
cgcucaaugaucgcggcgg

SEQ ID NO: 1183657 - RNA, 13 nt, Mycobacterium bovis subsp bovis AF2122/97
cgcuauggcauua

SEQ ID NO: 1183658 - RNA, 14 nt, Mycobacterium bovis subsp bovis AF2122/97
cgcuauggcccggg

SEQ ID NO: 1183659 - RNA, 23 nt, Mycobacterium bovis subsp bovis AF2122/97
cgcuaggugacgccgccagcacc

SEQ ID NO: 1183660 - RNA, 23 nt, Mycobacterium bovis subsp bovis AF2122/97
cgcuaggugcaacaggcgcgucg

SEQ ID NO: 1183661 - RNA, 18 nt, Mycobacterium bovis subsp bovis AF2122/97
cgcuaccuucuuggcugc

SEQ ID NO: 1183662 - RNA, 19 nt, Mycobacterium bovis subsp bovis AF2122/97
cgcuacgucaagccgugcu

SEQ ID NO: 1183663 - RNA, 17 nt, Mycobacterium bovis subsp bovis AF2122/97
cgcuacgucgaccgacg

SEQ ID NO: 1183664 - RNA, 17 nt, Mycobacterium bovis subsp bovis AF2122/97
cgcuacgcgcgcucgcu

SEQ ID NO: 1183665 - RNA, 20 nt, Mycobacterium bovis subsp bovis AF2122/97
cgcuaggugacgccgccagc

SEQ ID NO: 1183666 - RNA, 15 nt, Mycobacterium bovis subsp bovis AF2122/97
cgcuagggugagccc

SEQ ID NO: 1183667 - RNA, 14 nt, Mycobacterium bovis subsp bovis AF2122/97
cgcuaggucaggug

SEQ ID NO: 1183668 - RNA, 23 nt, Mycobacterium bovis subsp bovis AF2122/97
cgcuagcggauucagcgucgcca

SEQ ID NO: 1183669 - RNA, 14 nt, Mycobacterium bovis subsp bovis AF2122/97
cgcuagccgacagc

SEQ ID NO: 1183670 - RNA, 21 nt, Mycobacterium bovis subsp bovis AF2122/97
cgcuagccgacagcucaucga

SEQ ID NO: 1183671 - RNA, 17 nt, Mycobacterium bovis subsp bovis AF2122/97
cgcuagccgggcgcgcc

SEQ ID NO: 1183672 - RNA, 18 nt, Mycobacterium bovis subsp bovis AF2122/97
cgcuagccgggcgcgccg

SEQ ID NO: 1183673 - RNA, 16 nt, Mycobacterium bovis subsp bovis AF2122/97
cgcguccagcgcggcc

SEQ ID NO: 1183674 - RNA, 16 nt, Mycobacterium bovis subsp bovis AF2122/97
cgcguccaggugcgcc

SEQ ID NO: 1183675 - RNA, 17 nt, Mycobacterium bovis subsp bovis AF2122/97
cgcguccagcgcggccu

SEQ ID NO: 1183676 - RNA, 15 nt, Mycobacterium bovis subsp bovis AF2122/97
cgcgucgagcagcac

SEQ ID NO: 1183677 - RNA, 22 nt, Mycobacterium bovis subsp bovis AF2122/97
cgcgucgagcagcaccacccgc

SEQ ID NO: 1183678 - RNA, 14 nt, Mycobacterium bovis subsp bovis AF2122/97
cgcgucccgccgca

SEQ ID NO: 1183679 - RNA, 20 nt, Mycobacterium bovis subsp bovis AF2122/97
cgcgucgagugccgccaccg

SEQ ID NO: 1183680 - RNA, 20 nt, Mycobacterium bovis subsp bovis AF2122/97
cgcgucgaucguuccgcugg

SEQ ID NO: 1183681 - RNA, 14 nt, Mycobacterium bovis subsp bovis AF2122/97
cgcgucgagcgccg

SEQ ID NO: 1183682 - RNA, 17 nt, Mycobacterium bovis subsp bovis AF2122/97
cgcgucgagcgccggcc

SEQ ID NO: 1183683 - RNA, 14 nt, Mycobacterium bovis subsp bovis AF2122/97
cgcgucgagcagca

SEQ ID NO: 1183684 - RNA, 14 nt, Mycobacterium bovis subsp bovis AF2122/97
cgcgucgccagaua

SEQ ID NO: 1183685 - RNA, 14 nt, Mycobacterium bovis subsp bovis AF2122/97
cgcgucgccggccu

SEQ ID NO: 1183686 - RNA, 15 nt, Mycobacterium bovis subsp bovis AF2122/97
cgcgucgcgcgcggc

SEQ ID NO: 1183687 - RNA, 15 nt, Mycobacterium bovis subsp bovis AF2122/97
cgcgucggagccggg

SEQ ID NO: 1183688 - RNA, 12 nt, Mycobacterium bovis subsp bovis AF2122/97
cgcgucggaccg

SEQ ID NO: 1183689 - RNA, 19 nt, Mycobacterium bovis subsp bovis AF2122/97
cgcgucagccgcaccccgc

SEQ ID NO: 1183690 - RNA, 21 nt, Mycobacterium bovis subsp bovis AF2122/97
cgcguccacgggaucugcgga

SEQ ID NO: 1183691 - RNA, 13 nt, Mycobacterium bovis subsp bovis AF2122/97
cgcgucaucaccg

SEQ ID NO: 1183692 - RNA, 21 nt, Mycobacterium bovis subsp bovis AF2122/97
cgcgggccccaucgccuggau

SEQ ID NO: 1183693 - RNA, 17 nt, Mycobacterium bovis subsp bovis AF2122/97
cgcgggccaccaccgag

SEQ ID NO: 1183694 - RNA, 18 nt, Mycobacterium bovis subsp bovis AF2122/97
cgcgugccgcccgccucu

SEQ ID NO: 1183695 - RNA, 13 nt, Mycobacterium bovis subsp bovis AF2122/97
cgcgugccacagc

SEQ ID NO: 1183696 - RNA, 14 nt, Mycobacterium bovis subsp bovis AF2122/97
cgcgugccagcgcc

SEQ ID NO: 1183697 - RNA, 20 nt, Mycobacterium bovis subsp bovis AF2122/97
cgcguggaacuugcgcaggu

SEQ ID NO: 1183698 - RNA, 12 nt, Mycobacterium bovis subsp bovis AF2122/97
cgcguggcaccg

SEQ ID NO: 1183699 - RNA, 18 nt, Mycobacterium bovis subsp bovis AF2122/97
cgcguggcaccgacagca

SEQ ID NO: 1183700 - RNA, 17 nt, Mycobacterium bovis subsp bovis AF2122/97
cgcguggcauccagcag

SEQ ID NO: 1183701 - RNA, 17 nt, Mycobacterium bovis subsp bovis AF2122/97
cgcguucuccggcaccg

SEQ ID NO: 1183702 - RNA, 22 nt, Mycobacterium bovis subsp bovis AF2122/97
cgcguucgcgcaaaugccugcu

SEQ ID NO: 1183703 - RNA, 13 nt, Mycobacterium bovis subsp bovis AF2122/97
cgcgugcucgacg

SEQ ID NO: 1183704 - RNA, 21 nt, Mycobacterium bovis subsp bovis AF2122/97
cgcgugcugcagaucggccgg

SEQ ID NO: 1183705 - RNA, 22 nt, Mycobacterium bovis subsp bovis AF2122/97
cgcgugcugccguauccaggcg

SEQ ID NO: 1183706 - RNA, 16 nt, Mycobacterium bovis subsp bovis AF2122/97
cgcguuguaggcuucc

SEQ ID NO: 1183707 - RNA, 14 nt, Mycobacterium bovis subsp bovis AF2122/97
cgcguugggcaccu

SEQ ID NO: 1183708 - RNA, 20 nt, Mycobacterium bovis subsp bovis AF2122/97
cgcguugaugaccgccgccg

SEQ ID NO: 1183709 - RNA, 19 nt, Mycobacterium bovis subsp bovis AF2122/97
cgcguugcagaccaccagu

SEQ ID NO: 1183710 - RNA, 18 nt, Mycobacterium bovis subsp bovis AF2122/97
cgcguggccgccggcgcu

SEQ ID NO: 1183711 - RNA, 19 nt, Mycobacterium bovis subsp bovis AF2122/97
cgcguugaccaucacgccc

SEQ ID NO: 1183712 - RNA, 22 nt, Mycobacterium bovis subsp bovis AF2122/97
cgcguuucacgaaacccagucg

SEQ ID NO: 1183713 - RNA, 21 nt, Mycobacterium bovis subsp bovis AF2122/97
cgcguuuauaccucgccgccc

SEQ ID NO: 1183714 - RNA, 16 nt, Mycobacterium bovis subsp bovis AF2122/97
cgcuaccgcccgcgcc

SEQ ID NO: 1183715 - RNA, 20 nt, Mycobacterium bovis subsp bovis AF2122/97
cgcuaccgcccgcgccaccg

SEQ ID NO: 1183716 - RNA, 13 nt, Mycobacterium bovis subsp bovis AF2122/97
cgcuaccgcccgc

SEQ ID NO: 1183717 - RNA, 13 nt, Mycobacterium bovis subsp bovis AF2122/97
cgcuaccgccgga

SEQ ID NO: 1183718 - RNA, 20 nt, Mycobacterium bovis subsp bovis AF2122/97
cgcugccgccgucgccgccg

SEQ ID NO: 1183719 - RNA, 15 nt, Mycobacterium bovis subsp bovis AF2122/97
cgcugccgccgccgg

SEQ ID NO: 1183720 - RNA, 14 nt, Mycobacterium bovis subsp bovis AF2122/97
cgcugccgccgccg

SEQ ID NO: 1183721 - RNA, 16 nt, Mycobacterium bovis subsp bovis AF2122/97
cgcugccgcccuugcc

SEQ ID NO: 1183722 - RNA, 21 nt, Mycobacterium bovis subsp bovis AF2122/97
cgcugccgaucaguccggcgu

SEQ ID NO: 1183723 - RNA, 20 nt, Mycobacterium bovis subsp bovis AF2122/97
cgcugccgagaucccagcgg

SEQ ID NO: 1183724 - RNA, 22 nt, Mycobacterium bovis subsp bovis AF2122/97
cgcugccgaagcggccaccgcc

SEQ ID NO: 1183725 - RNA, 12 nt, Mycobacterium bovis subsp bovis AF2122/97
cgcugcccgcgg

SEQ ID NO: 1183726 - RNA, 15 nt, Mycobacterium bovis subsp bovis AF2122/97
cgcugcccgggcugc

SEQ ID NO: 1183727 - RNA, 13 nt, Mycobacterium bovis subsp bovis AF2122/97
cgcugccggccgc

SEQ ID NO: 1183728 - RNA, 14 nt, Mycobacterium bovis subsp bovis AF2122/97
cgcugccggccgcg

SEQ ID NO: 1183729 - RNA, 14 nt, Mycobacterium bovis subsp bovis AF2122/97
cgcugccggcagcg

SEQ ID NO: 1183730 - RNA, 18 nt, Mycobacterium bovis subsp bovis AF2122/97
cgcugccgcagcucagca

SEQ ID NO: 1183731 - RNA, 14 nt, Mycobacterium bovis subsp bovis AF2122/97
cgcugccgcgcggc

SEQ ID NO: 1183732 - RNA, 15 nt, Mycobacterium bovis subsp bovis AF2122/97
cgcugccggcgccgc

SEQ ID NO: 1183733 - RNA, 13 nt, Mycobacterium bovis subsp bovis AF2122/97
cgcugccggcgcc

SEQ ID NO: 1183734 - RNA, 18 nt, Mycobacterium bovis subsp bovis AF2122/97
cgcugccggcgccgccac

SEQ ID NO: 1183735 - RNA, 17 nt, Mycobacterium bovis subsp bovis AF2122/97
cgcugcgaucacccccu

SEQ ID NO: 1183736 - RNA, 16 nt, Mycobacterium bovis subsp bovis AF2122/97
cgcugccuuggcgcgg

SEQ ID NO: 1183737 - RNA, 18 nt, Mycobacterium bovis subsp bovis AF2122/97
cgcugccuggccgggacc

SEQ ID NO: 1183738 - RNA, 18 nt, Mycobacterium bovis subsp bovis AF2122/97
cgcugcgcgacugauccu

SEQ ID NO: 1183739 - RNA, 17 nt, Mycobacterium bovis subsp bovis AF2122/97
cgcugcggcaccacccg

SEQ ID NO: 1183740 - RNA, 13 nt, Mycobacterium bovis subsp bovis AF2122/97
cgcugcucacgca

SEQ ID NO: 1183741 - RNA, 15 nt, Mycobacterium bovis subsp bovis AF2122/97
cgcugcucuggacgg

SEQ ID NO: 1183742 - RNA, 13 nt, Mycobacterium bovis subsp bovis AF2122/97
cgcugcggcggcu

SEQ ID NO: 1183743 - RNA, 18 nt, Mycobacterium bovis subsp bovis AF2122/97
cgcugcggugccggcccu

SEQ ID NO: 1183744 - RNA, 14 nt, Mycobacterium bovis subsp bovis AF2122/97
cgcugcgguggaac

SEQ ID NO: 1183745 - RNA, 14 nt, Mycobacterium bovis subsp bovis AF2122/97
cgcugcuugcgggc

SEQ ID NO: 1183746 - RNA, 22 nt, Mycobacterium bovis subsp bovis AF2122/97
cgcuggaaaccucuucgggugc

SEQ ID NO: 1183747 - RNA, 18 nt, Mycobacterium bovis subsp bovis AF2122/97
cgcuggacggcgggccgc

SEQ ID NO: 1183748 - RNA, 20 nt, Mycobacterium bovis subsp bovis AF2122/97
cgcuggcaggccgggcacca

SEQ ID NO: 1183749 - RNA, 16 nt, Mycobacterium bovis subsp bovis AF2122/97
cgcuggcaaucccgcg

SEQ ID NO: 1183750 - RNA, 22 nt, Mycobacterium bovis subsp bovis AF2122/97
cgcuggaucuucgacaggccac

SEQ ID NO: 1183751 - RNA, 17 nt, Mycobacterium bovis subsp bovis AF2122/97
cgcuggaggcuccuggu

SEQ ID NO: 1183752 - RNA, 14 nt, Mycobacterium bovis subsp bovis AF2122/97
cgcuggaggccacc

SEQ ID NO: 1183753 - RNA, 16 nt, Mycobacterium bovis subsp bovis AF2122/97
cgcuggaggccaccac

SEQ ID NO: 1183754 - RNA, 19 nt, Mycobacterium bovis subsp bovis AF2122/97
cgcugccagggugcgccgg

SEQ ID NO: 1183755 - RNA, 14 nt, Mycobacterium bovis subsp bovis AF2122/97
cgcugccaguucuu

SEQ ID NO: 1183756 - RNA, 13 nt, Mycobacterium bovis subsp bovis AF2122/97
cgcugccccgccg

SEQ ID NO: 1183757 - RNA, 14 nt, Mycobacterium bovis subsp bovis AF2122/97
cgcugccccgccgc

SEQ ID NO: 1183758 - RNA, 13 nt, Mycobacterium bovis subsp bovis AF2122/97
cgcugcccgccgc

SEQ ID NO: 1183759 - RNA, 14 nt, Mycobacterium bovis subsp bovis AF2122/97
cgcugcccgcgcgg

SEQ ID NO: 1183760 - RNA, 15 nt, Mycobacterium bovis subsp bovis AF2122/97
cgcugcccgcgcggc

SEQ ID NO: 1183761 - RNA, 13 nt, Mycobacterium bovis subsp bovis AF2122/97
cgcugccacccau

SEQ ID NO: 1183762 - RNA, 13 nt, Mycobacterium bovis subsp bovis AF2122/97
cgcugccagccgu

SEQ ID NO: 1183763 - RNA, 18 nt, Mycobacterium bovis subsp bovis AF2122/97
cgcugccagccguucccc

SEQ ID NO: 1183764 - RNA, 16 nt, Mycobacterium bovis subsp bovis AF2122/97
cgcugccagcggccgg

SEQ ID NO: 1183765 - RNA, 14 nt, Mycobacterium bovis subsp bovis AF2122/97
cgcugcaccagcug

SEQ ID NO: 1183766 - RNA, 18 nt, Mycobacterium bovis subsp bovis AF2122/97
cgcugcagacgccccuuc

SEQ ID NO: 1183767 - RNA, 15 nt, Mycobacterium bovis subsp bovis AF2122/97
cgcugcaaccgccgg

SEQ ID NO: 1183768 - RNA, 14 nt, Mycobacterium bovis subsp bovis AF2122/97
cgcugaugcuggcc

SEQ ID NO: 1183769 - RNA, 22 nt, Mycobacterium bovis subsp bovis AF2122/97
cgcugaccuuguugaccaccac

SEQ ID NO: 1183770 - RNA, 17 nt, Mycobacterium bovis subsp bovis AF2122/97
cgcugacgcccuccugg

SEQ ID NO: 1183771 - RNA, 19 nt, Mycobacterium bovis subsp bovis AF2122/97
cgcugaccuuuucccgcag

SEQ ID NO: 1183772 - RNA, 20 nt, Mycobacterium bovis subsp bovis AF2122/97
cgcugagcacggcgcggcgg

SEQ ID NO: 1183773 - RNA, 15 nt, Mycobacterium bovis subsp bovis AF2122/97
cgcugacggccaugg

SEQ ID NO: 1183774 - RNA, 18 nt, Mycobacterium bovis subsp bovis AF2122/97
cgcugaggaagcggcggc

SEQ ID NO: 1183775 - RNA, 17 nt, Mycobacterium bovis subsp bovis AF2122/97
cgcugagcagcgccgcg

SEQ ID NO: 1183776 - RNA, 18 nt, Mycobacterium bovis subsp bovis AF2122/97
cgcugaggaacccuccgg

SEQ ID NO: 1183777 - RNA, 22 nt, Mycobacterium bovis subsp bovis AF2122/97
cgcugagguauugggcgcggca

SEQ ID NO: 1183778 - RNA, 22 nt, Mycobacterium bovis subsp bovis AF2122/97
cgcugauaguggcgcgcggcgc

SEQ ID NO: 1183779 - RNA, 18 nt, Mycobacterium bovis subsp bovis AF2122/97
cgcugaucagauccucga

SEQ ID NO: 1183780 - RNA, 20 nt, Mycobacterium bovis subsp bovis AF2122/97
cgcugauagcggucggucac

SEQ ID NO: 1183781 - RNA, 17 nt, Mycobacterium bovis subsp bovis AF2122/97
cgcuggguccccuccca

SEQ ID NO: 1183782 - RNA, 21 nt, Mycobacterium bovis subsp bovis AF2122/97
cgcuggguccccucccaccag

SEQ ID NO: 1183783 - RNA, 19 nt, Mycobacterium bovis subsp bovis AF2122/97
cgcugggcgcgcucaucga

SEQ ID NO: 1183784 - RNA, 19 nt, Mycobacterium bovis subsp bovis AF2122/97
cgcugggacgggcgcgucg

SEQ ID NO: 1183785 - RNA, 19 nt, Mycobacterium bovis subsp bovis AF2122/97
cgcugggcccgagcgcgcg

SEQ ID NO: 1183786 - RNA, 16 nt, Mycobacterium bovis subsp bovis AF2122/97
cgcugggcacucggcc

SEQ ID NO: 1183787 - RNA, 16 nt, Mycobacterium bovis subsp bovis AF2122/97
cgcuggcggcgcagcg

SEQ ID NO: 1183788 - RNA, 19 nt, Mycobacterium bovis subsp bovis AF2122/97
cgcuggcuacccaccggcc

SEQ ID NO: 1183789 - RNA, 14 nt, Mycobacterium bovis subsp bovis AF2122/97
cgcuggcucaucga

SEQ ID NO: 1183790 - RNA, 21 nt, Mycobacterium bovis subsp bovis AF2122/97
cgcuggcuacccaccggccgg

SEQ ID NO: 1183791 - RNA, 14 nt, Mycobacterium bovis subsp bovis AF2122/97
cgcuggcgggcagc

SEQ ID NO: 1183792 - RNA, 22 nt, Mycobacterium bovis subsp bovis AF2122/97
cgcuggcgggcgaucgcggcga

SEQ ID NO: 1183793 - RNA, 15 nt, Mycobacterium bovis subsp bovis AF2122/97
cgcuggcgccggcca

SEQ ID NO: 1183794 - RNA, 18 nt, Mycobacterium bovis subsp bovis AF2122/97
cgcuggccuccagcuugg

SEQ ID NO: 1183795 - RNA, 23 nt, Mycobacterium bovis subsp bovis AF2122/97
cgcuggcgcccccgacgacggca

SEQ ID NO: 1183796 - RNA, 22 nt, Mycobacterium bovis subsp bovis AF2122/97
cgcuggcgcccuugccggcgag

SEQ ID NO: 1183797 - RNA, 14 nt, Mycobacterium bovis subsp bovis AF2122/97
cgcuggccggcacc

SEQ ID NO: 1183798 - RNA, 17 nt, Mycobacterium bovis subsp bovis AF2122/97
cgcuggccuccuggaag

SEQ ID NO: 1183799 - RNA, 14 nt, Mycobacterium bovis subsp bovis AF2122/97
cgcuggccuccagc

SEQ ID NO: 1183800 - RNA, 15 nt, Mycobacterium bovis subsp bovis AF2122/97
cgcuggcccgccaga

SEQ ID NO: 1183801 - RNA, 15 nt, Mycobacterium bovis subsp bovis AF2122/97
cgcuggccagcccgg

SEQ ID NO: 1183802 - RNA, 19 nt, Mycobacterium bovis subsp bovis AF2122/97
cgcuggccacgauccgcgg

SEQ ID NO: 1183803 - RNA, 12 nt, Mycobacterium bovis subsp bovis AF2122/97
cgcuggccagca

SEQ ID NO: 1183804 - RNA, 14 nt, Mycobacterium bovis subsp bovis AF2122/97
cgcuggugcacggc

SEQ ID NO: 1183805 - RNA, 17 nt, Mycobacterium bovis subsp bovis AF2122/97
cgcuggucgaugccuuc

SEQ ID NO: 1183806 - RNA, 15 nt, Mycobacterium bovis subsp bovis AF2122/97
cgcuggguggcgggc

SEQ ID NO: 1183807 - RNA, 17 nt, Mycobacterium bovis subsp bovis AF2122/97
cgcuggucagccgugcc

SEQ ID NO: 1183808 - RNA, 18 nt, Mycobacterium bovis subsp bovis AF2122/97
cgcugguggucagcaccc

SEQ ID NO: 1183809 - RNA, 13 nt, Mycobacterium bovis subsp bovis AF2122/97
cgcugguggcggc

SEQ ID NO: 1183810 - RNA, 21 nt, Mycobacterium bovis subsp bovis AF2122/97
cgcugucuugcuagcgcaucu

SEQ ID NO: 1183811 - RNA, 17 nt, Mycobacterium bovis subsp bovis AF2122/97
cgcugugauagcgccgu

SEQ ID NO: 1183812 - RNA, 18 nt, Mycobacterium bovis subsp bovis AF2122/97
cgcuguaggccagcccgg

SEQ ID NO: 1183813 - RNA, 13 nt, Mycobacterium bovis subsp bovis AF2122/97
cgcuguccagguc

SEQ ID NO: 1183814 - RNA, 13 nt, Mycobacterium bovis subsp bovis AF2122/97
cgcuguuguuguc

SEQ ID NO: 1183815 - RNA, 21 nt, Mycobacterium bovis subsp bovis AF2122/97
cgcuguugccaucgacgccgc

SEQ ID NO: 1183816 - RNA, 22 nt, Mycobacterium bovis subsp bovis AF2122/97
cgcuguucggucuugccggccu

SEQ ID NO: 1183817 - RNA, 13 nt, Mycobacterium bovis subsp bovis AF2122/97
cgcuguuccucga

SEQ ID NO: 1183818 - RNA, 22 nt, Mycobacterium bovis subsp bovis AF2122/97
cgcuuaacagcggguccuucug

SEQ ID NO: 1183819 - RNA, 18 nt, Mycobacterium bovis subsp bovis AF2122/97
cgcuucacagccaccagc

SEQ ID NO: 1183820 - RNA, 15 nt, Mycobacterium bovis subsp bovis AF2122/97
cgcuucacgggccgu

SEQ ID NO: 1183821 - RNA, 21 nt, Mycobacterium bovis subsp bovis AF2122/97
cgcuucaggcgccacugcuuc

SEQ ID NO: 1183822 - RNA, 15 nt, Mycobacterium bovis subsp bovis AF2122/97
cgcuuccguggccca

SEQ ID NO: 1183823 - RNA, 18 nt, Mycobacterium bovis subsp bovis AF2122/97
cgcuucgcaagucaucca

SEQ ID NO: 1183824 - RNA, 21 nt, Mycobacterium bovis subsp bovis AF2122/97
cgcuucggcagcucccgccac

SEQ ID NO: 1183825 - RNA, 18 nt, Mycobacterium bovis subsp bovis AF2122/97
cgcuugaccccuggccgc

SEQ ID NO: 1183826 - RNA, 21 nt, Mycobacterium bovis subsp bovis AF2122/97
cgcuugaccccuggccgccgg

SEQ ID NO: 1183827 - RNA, 19 nt, Mycobacterium bovis subsp bovis AF2122/97
cgcgaccauacccgcgcgc

SEQ ID NO: 1183828 - RNA, 14 nt, Mycobacterium bovis subsp bovis AF2122/97
cgcgaccagcgccg

SEQ ID NO: 1183829 - RNA, 15 nt, Mycobacterium bovis subsp bovis AF2122/97
cgcgaccagcgccgc

SEQ ID NO: 1183830 - RNA, 21 nt, Mycobacterium bovis subsp bovis AF2122/97
cgcgaccagcgccgcacccgc

SEQ ID NO: 1183831 - RNA, 15 nt, Mycobacterium bovis subsp bovis AF2122/97
cgcgacgcggggcuc

SEQ ID NO: 1183832 - RNA, 13 nt, Mycobacterium bovis subsp bovis AF2122/97
cgcgacggcgccc

SEQ ID NO: 1183833 - RNA, 17 nt, Mycobacterium bovis subsp bovis AF2122/97
cgcgacggcggcucccg

SEQ ID NO: 1183834 - RNA, 18 nt, Mycobacterium bovis subsp bovis AF2122/97
cgcgacguacgaguagug

SEQ ID NO: 1183835 - RNA, 16 nt, Mycobacterium bovis subsp bovis AF2122/97
cgcgacguccaccagc

SEQ ID NO: 1183836 - RNA, 19 nt, Mycobacterium bovis subsp bovis AF2122/97
cgcgacguccaccagccgg

SEQ ID NO: 1183837 - RNA, 13 nt, Mycobacterium bovis subsp bovis AF2122/97
cgcgacgggccgc

SEQ ID NO: 1183838 - RNA, 16 nt, Mycobacterium bovis subsp bovis AF2122/97
cgcgacgggccgcgaa

SEQ ID NO: 1183839 - RNA, 13 nt, Mycobacterium bovis subsp bovis AF2122/97
cgcgagcgagcca

SEQ ID NO: 1183840 - RNA, 20 nt, Mycobacterium bovis subsp bovis AF2122/97
cgcgacuaccaucgccgccc

SEQ ID NO: 1183841 - RNA, 12 nt, Mycobacterium bovis subsp bovis AF2122/97
cgcgaccaggaa

SEQ ID NO: 1183842 - RNA, 17 nt, Mycobacterium bovis subsp bovis AF2122/97
cgcgacagacagcaccg

SEQ ID NO: 1183843 - RNA, 23 nt, Mycobacterium bovis subsp bovis AF2122/97
cgcgacacgccggcgggcugucg

SEQ ID NO: 1183844 - RNA, 15 nt, Mycobacterium bovis subsp bovis AF2122/97
cgcgacacgcggccc

SEQ ID NO: 1183845 - RNA, 14 nt, Mycobacterium bovis subsp bovis AF2122/97
cgcgacacggccau

SEQ ID NO: 1183846 - RNA, 14 nt, Mycobacterium bovis subsp bovis AF2122/97
cgcgacagccaccu

SEQ ID NO: 1183847 - RNA, 15 nt, Mycobacterium bovis subsp bovis AF2122/97
cgcgacagccaccuc

SEQ ID NO: 1183848 - RNA, 17 nt, Mycobacterium bovis subsp bovis AF2122/97
cgcgacagccaccucga

SEQ ID NO: 1183849 - RNA, 21 nt, Mycobacterium bovis subsp bovis AF2122/97
cgcgacagacagcaccgccgg

SEQ ID NO: 1183850 - RNA, 15 nt, Mycobacterium bovis subsp bovis AF2122/97
cgcgaaugucgccgc

SEQ ID NO: 1183851 - RNA, 16 nt, Mycobacterium bovis subsp bovis AF2122/97
cgcgacacacgccgcc

SEQ ID NO: 1183852 - RNA, 18 nt, Mycobacterium bovis subsp bovis AF2122/97
cgcgacacacgccgccgg

SEQ ID NO: 1183853 - RNA, 22 nt, Mycobacterium bovis subsp bovis AF2122/97
cgcgacaaaguucgacgagaag

SEQ ID NO: 1183854 - RNA, 14 nt, Mycobacterium bovis subsp bovis AF2122/97
cgcgacauccgcgg

SEQ ID NO: 1183855 - RNA, 13 nt, Mycobacterium bovis subsp bovis AF2122/97
cgcgaccacccgc

SEQ ID NO: 1183856 - RNA, 17 nt, Mycobacterium bovis subsp bovis AF2122/97
cgcgaccaccgccgagc

SEQ ID NO: 1183857 - RNA, 18 nt, Mycobacterium bovis subsp bovis AF2122/97
cgcgaccacgcaccgccc

SEQ ID NO: 1183858 - RNA, 20 nt, Mycobacterium bovis subsp bovis AF2122/97
cgcgaccagaaucgggccga

SEQ ID NO: 1183859 - RNA, 14 nt, Mycobacterium bovis subsp bovis AF2122/97
cgcgaacaucgcca

SEQ ID NO: 1183860 - RNA, 16 nt, Mycobacterium bovis subsp bovis AF2122/97
cgcgaacaucgccagc

SEQ ID NO: 1183861 - RNA, 13 nt, Mycobacterium bovis subsp bovis AF2122/97
cgccuucgccagc

SEQ ID NO: 1183862 - RNA, 17 nt, Mycobacterium bovis subsp bovis AF2122/97
cgccuucacgcuggccu

SEQ ID NO: 1183863 - RNA, 13 nt, Mycobacterium bovis subsp bovis AF2122/97
cgccuuccaggcg

SEQ ID NO: 1183864 - RNA, 20 nt, Mycobacterium bovis subsp bovis AF2122/97
cgcgaacgcgacagccaccu

SEQ ID NO: 1183865 - RNA, 16 nt, Mycobacterium bovis subsp bovis AF2122/97
cgcgaaccggccaucg

SEQ ID NO: 1183866 - RNA, 13 nt, Mycobacterium bovis subsp bovis AF2122/97
cgcgaacccgcga

SEQ ID NO: 1183867 - RNA, 18 nt, Mycobacterium bovis subsp bovis AF2122/97
cgcgaacccgaucgucga

SEQ ID NO: 1183868 - RNA, 17 nt, Mycobacterium bovis subsp bovis AF2122/97
cgcgaacaucgccagcg

SEQ ID NO: 1183869 - RNA, 16 nt, Mycobacterium bovis subsp bovis AF2122/97
cgcgaacuccagcagc

SEQ ID NO: 1183870 - RNA, 14 nt, Mycobacterium bovis subsp bovis AF2122/97
cgcgaacuccagca

SEQ ID NO: 1183871 - RNA, 15 nt, Mycobacterium bovis subsp bovis AF2122/97
cgcgaaugaagcccu

SEQ ID NO: 1183872 - RNA, 19 nt, Mycobacterium bovis subsp bovis AF2122/97
cgccucggacacggcagcc

SEQ ID NO: 1183873 - RNA, 23 nt, Mycobacterium bovis subsp bovis AF2122/97
cgccucgggcaccuggucggccg

SEQ ID NO: 1183874 - RNA, 17 nt, Mycobacterium bovis subsp bovis AF2122/97
cgccucggcggccagcu

SEQ ID NO: 1183875 - RNA, 16 nt, Mycobacterium bovis subsp bovis AF2122/97
cgccucggcggccagc

SEQ ID NO: 1183876 - RNA, 14 nt, Mycobacterium bovis subsp bovis AF2122/97
cgccucggcggcca

SEQ ID NO: 1183877 - RNA, 20 nt, Mycobacterium bovis subsp bovis AF2122/97
cgccucggcaucgccgcggg

SEQ ID NO: 1183878 - RNA, 14 nt, Mycobacterium bovis subsp bovis AF2122/97
cgccucgggcaccu

SEQ ID NO: 1183879 - RNA, 16 nt, Mycobacterium bovis subsp bovis AF2122/97
cgccugaacgacccgc

SEQ ID NO: 1183880 - RNA, 16 nt, Mycobacterium bovis subsp bovis AF2122/97
cgccucugcgaucagu

SEQ ID NO: 1183881 - RNA, 14 nt, Mycobacterium bovis subsp bovis AF2122/97
cgccucuuccuggc

SEQ ID NO: 1183882 - RNA, 13 nt, Mycobacterium bovis subsp bovis AF2122/97
cgccugagcgccg

SEQ ID NO: 1183883 - RNA, 14 nt, Mycobacterium bovis subsp bovis AF2122/97
cgccugagccacca

SEQ ID NO: 1183884 - RNA, 14 nt, Mycobacterium bovis subsp bovis AF2122/97
cgccugagcggccu

SEQ ID NO: 1183885 - RNA, 22 nt, Mycobacterium bovis subsp bovis AF2122/97
cgccugcaccgccgccgcccgu

SEQ ID NO: 1183886 - RNA, 15 nt, Mycobacterium bovis subsp bovis AF2122/97
cgccugcaccgccgc

SEQ ID NO: 1183887 - RNA, 14 nt, Mycobacterium bovis subsp bovis AF2122/97
cgccugcacccggc

SEQ ID NO: 1183888 - RNA, 16 nt, Mycobacterium bovis subsp bovis AF2122/97
cgccugcacccggcga

SEQ ID NO: 1183889 - RNA, 18 nt, Mycobacterium bovis subsp bovis AF2122/97
cgccugaugcggccggcg

SEQ ID NO: 1183890 - RNA, 20 nt, Mycobacterium bovis subsp bovis AF2122/97
cgccugaugcggccggcgcc

SEQ ID NO: 1183891 - RNA, 22 nt, Mycobacterium bovis subsp bovis AF2122/97
cgccugcagguuuccggccugc

SEQ ID NO: 1183892 - RNA, 18 nt, Mycobacterium bovis subsp bovis AF2122/97
cgccugccccacccgcgg

SEQ ID NO: 1183893 - RNA, 16 nt, Mycobacterium bovis subsp bovis AF2122/97
cgccugcccggcccgc

SEQ ID NO: 1183894 - RNA, 13 nt, Mycobacterium bovis subsp bovis AF2122/97
cgccugcccggcc

SEQ ID NO: 1183895 - RNA, 22 nt, Mycobacterium bovis subsp bovis AF2122/97
cgccugcccccgcgcgcacggc

SEQ ID NO: 1183896 - RNA, 18 nt, Mycobacterium bovis subsp bovis AF2122/97
cgccugccucaccgccgc

SEQ ID NO: 1183897 - RNA, 16 nt, Mycobacterium bovis subsp bovis AF2122/97
cgccugcgccgccagc

SEQ ID NO: 1183898 - RNA, 16 nt, Mycobacterium bovis subsp bovis AF2122/97
cgccugcgccgcccgc

SEQ ID NO: 1183899 - RNA, 18 nt, Mycobacterium bovis subsp bovis AF2122/97
cgccuggacgccgccgga

SEQ ID NO: 1183900 - RNA, 18 nt, Mycobacterium bovis subsp bovis AF2122/97
cgccugcgccgcccgcgc

SEQ ID NO: 1183901 - RNA, 16 nt, Mycobacterium bovis subsp bovis AF2122/97
cgccugggcggccagc

SEQ ID NO: 1183902 - RNA, 23 nt, Mycobacterium bovis subsp bovis AF2122/97
cgccugggugagguuggagcgcc

SEQ ID NO: 1183903 - RNA, 15 nt, Mycobacterium bovis subsp bovis AF2122/97
cgccugggcgacgac

SEQ ID NO: 1183904 - RNA, 15 nt, Mycobacterium bovis subsp bovis AF2122/97
cgccuggcggcgccg

SEQ ID NO: 1183905 - RNA, 20 nt, Mycobacterium bovis subsp bovis AF2122/97
cgccgccggaagcgccggcc

SEQ ID NO: 1183906 - RNA, 14 nt, Mycobacterium bovis subsp bovis AF2122/97
cgccggggccgccg

SEQ ID NO: 1183907 - RNA, 17 nt, Mycobacterium bovis subsp bovis AF2122/97
cgccgccggaucgccgg

SEQ ID NO: 1183908 - RNA, 12 nt, Mycobacterium bovis subsp bovis AF2122/97
cgccgccggcaa

SEQ ID NO: 1183909 - RNA, 21 nt, Mycobacterium bovis subsp bovis AF2122/97
cgccgccggcaccgccggcac

SEQ ID NO: 1183910 - RNA, 21 nt, Mycobacterium bovis subsp bovis AF2122/97
cgccgggucagcccggcgcga

SEQ ID NO: 1183911 - RNA, 20 nt, Mycobacterium bovis subsp bovis AF2122/97
cgccgggucagcccggcgcg

SEQ ID NO: 1183912 - RNA, 13 nt, Mycobacterium bovis subsp bovis AF2122/97
cgccgccgcgggc

SEQ ID NO: 1183913 - RNA, 13 nt, Mycobacterium bovis subsp bovis AF2122/97
cgccgccgcgcgu

SEQ ID NO: 1183914 - RNA, 13 nt, Mycobacterium bovis subsp bovis AF2122/97
cgccgccgccggc

SEQ ID NO: 1183915 - RNA, 23 nt, Mycobacterium bovis subsp bovis AF2122/97
cgccgccgcgacgcacugccccg

SEQ ID NO: 1183916 - RNA, 16 nt, Mycobacterium bovis subsp bovis AF2122/97
cgccgccgcgagcgcc

SEQ ID NO: 1183917 - RNA, 16 nt, Mycobacterium bovis subsp bovis AF2122/97
cgccgccgccgccauc

SEQ ID NO: 1183918 - RNA, 18 nt, Mycobacterium bovis subsp bovis AF2122/97
cgccgccgacgccgccgg

SEQ ID NO: 1183919 - RNA, 21 nt, Mycobacterium bovis subsp bovis AF2122/97
cgccgccgacgccgccggcgc

SEQ ID NO: 1183920 - RNA, 19 nt, Mycobacterium bovis subsp bovis AF2122/97
cgccggugccaccggcugg

SEQ ID NO: 1183921 - RNA, 15 nt, Mycobacterium bovis subsp bovis AF2122/97
cgccggugccgcccg

SEQ ID NO: 1183922 - RNA, 15 nt, Mycobacterium bovis subsp bovis AF2122/97
cgccggugccgccgc

SEQ ID NO: 1183923 - RNA, 16 nt, Mycobacterium bovis subsp bovis AF2122/97
cgccggugccgccggg

SEQ ID NO: 1183924 - RNA, 13 nt, Mycobacterium bovis subsp bovis AF2122/97
cgccggugucggg

SEQ ID NO: 1183925 - RNA, 17 nt, Mycobacterium bovis subsp bovis AF2122/97
cgccggugguaccggcg

SEQ ID NO: 1183926 - RNA, 22 nt, Mycobacterium bovis subsp bovis AF2122/97
cgccgguggucagguuggcacg

SEQ ID NO: 1183927 - RNA, 23 nt, Mycobacterium bovis subsp bovis AF2122/97
cgccgguggucagguuggcacgc

SEQ ID NO: 1183928 - RNA, 17 nt, Mycobacterium bovis subsp bovis AF2122/97
cgccgguggcacggccc

SEQ ID NO: 1183929 - RNA, 19 nt, Mycobacterium bovis subsp bovis AF2122/97
cgccgguggcagagccgcc

SEQ ID NO: 1183930 - RNA, 18 nt, Mycobacterium bovis subsp bovis AF2122/97
cgccgguggcgccggggc

SEQ ID NO: 1183931 - RNA, 22 nt, Mycobacterium bovis subsp bovis AF2122/97
cgccgguggcgccggggccgcc

SEQ ID NO: 1183932 - RNA, 17 nt, Mycobacterium bovis subsp bovis AF2122/97
cgccgguuccgccggcc

SEQ ID NO: 1183933 - RNA, 14 nt, Mycobacterium bovis subsp bovis AF2122/97
cgccgucaccgccg

SEQ ID NO: 1183934 - RNA, 20 nt, Mycobacterium bovis subsp bovis AF2122/97
cgccgugacccauucucggc

SEQ ID NO: 1183935 - RNA, 13 nt, Mycobacterium bovis subsp bovis AF2122/97
cgccgugcgccgu

SEQ ID NO: 1183936 - RNA, 20 nt, Mycobacterium bovis subsp bovis AF2122/97
cgccguggcaucgccuccag

SEQ ID NO: 1183937 - RNA, 23 nt, Mycobacterium bovis subsp bovis AF2122/97
cgccguccagcaauaccugagcg

SEQ ID NO: 1183938 - RNA, 17 nt, Mycobacterium bovis subsp bovis AF2122/97
cgccguccagcgccgcg

SEQ ID NO: 1183939 - RNA, 15 nt, Mycobacterium bovis subsp bovis AF2122/97
cgccguccagcaaua

SEQ ID NO: 1183940 - RNA, 17 nt, Mycobacterium bovis subsp bovis AF2122/97
cgccguucgcucccccg

SEQ ID NO: 1183941 - RNA, 15 nt, Mycobacterium bovis subsp bovis AF2122/97
cgccguucugaucug

SEQ ID NO: 1183942 - RNA, 22 nt, Mycobacterium bovis subsp bovis AF2122/97
cgccguugccauugccucccgc

SEQ ID NO: 1183943 - RNA, 22 nt, Mycobacterium bovis subsp bovis AF2122/97
cgccguugccgaucaccacggc

SEQ ID NO: 1183944 - RNA, 19 nt, Mycobacterium bovis subsp bovis AF2122/97
cgccguugccgaucagccc

SEQ ID NO: 1183945 - RNA, 20 nt, Mycobacterium bovis subsp bovis AF2122/97
cgccguugccgauccccagg

SEQ ID NO: 1183946 - RNA, 21 nt, Mycobacterium bovis subsp bovis AF2122/97
cgccguugccgauccccaggc

SEQ ID NO: 1183947 - RNA, 15 nt, Mycobacterium bovis subsp bovis AF2122/97
cgccguugccggcga

SEQ ID NO: 1183948 - RNA, 15 nt, Mycobacterium bovis subsp bovis AF2122/97
cgccguugccgccgu

SEQ ID NO: 1183949 - RNA, 16 nt, Mycobacterium bovis subsp bovis AF2122/97
cgccguugccgccggc

SEQ ID NO: 1183950 - RNA, 21 nt, Mycobacterium bovis subsp bovis AF2122/97
cgccguuggcucgagccgccc

SEQ ID NO: 1183951 - RNA, 15 nt, Mycobacterium bovis subsp bovis AF2122/97
cgccguugggccgcg

SEQ ID NO: 1183952 - RNA, 23 nt, Mycobacterium bovis subsp bovis AF2122/97
cgccguugucgaccuccucgacc

SEQ ID NO: 1183953 - RNA, 13 nt, Mycobacterium bovis subsp bovis AF2122/97
cgccgugcggguu

SEQ ID NO: 1183954 - RNA, 20 nt, Mycobacterium bovis subsp bovis AF2122/97
cgccguggcccgcucccugc

SEQ ID NO: 1183955 - RNA, 15 nt, Mycobacterium bovis subsp bovis AF2122/97
cgccguguuccaggu

SEQ ID NO: 1183956 - RNA, 18 nt, Mycobacterium bovis subsp bovis AF2122/97
cgccguucccacccacgc

SEQ ID NO: 1183957 - RNA, 16 nt, Mycobacterium bovis subsp bovis AF2122/97
cgccguuaccgccgcu

SEQ ID NO: 1183958 - RNA, 15 nt, Mycobacterium bovis subsp bovis AF2122/97
cgccguuaccgccgu

SEQ ID NO: 1183959 - RNA, 15 nt, Mycobacterium bovis subsp bovis AF2122/97
cgccguuguuguaga

SEQ ID NO: 1183960 - RNA, 15 nt, Mycobacterium bovis subsp bovis AF2122/97
cgccguugucggcgg

SEQ ID NO: 1183961 - RNA, 17 nt, Mycobacterium bovis subsp bovis AF2122/97
cgccucaagcucgccgg

SEQ ID NO: 1183962 - RNA, 17 nt, Mycobacterium bovis subsp bovis AF2122/97
cgccucaaugaccaccg

SEQ ID NO: 1183963 - RNA, 19 nt, Mycobacterium bovis subsp bovis AF2122/97
cgccucaaugaccaccggg

SEQ ID NO: 1183964 - RNA, 15 nt, Mycobacterium bovis subsp bovis AF2122/97
cgccuccaggcgcca

SEQ ID NO: 1183965 - RNA, 20 nt, Mycobacterium bovis subsp bovis AF2122/97
cgccuccaggcgccacccga

SEQ ID NO: 1183966 - RNA, 20 nt, Mycobacterium bovis subsp bovis AF2122/97
cgccuccagcagguccgcgg

SEQ ID NO: 1183967 - RNA, 14 nt, Mycobacterium bovis subsp bovis AF2122/97
cgccuccagcacca

SEQ ID NO: 1183968 - RNA, 16 nt, Mycobacterium bovis subsp bovis AF2122/97
cgccuccagcaccacg

SEQ ID NO: 1183969 - RNA, 12 nt, Mycobacterium bovis subsp bovis AF2122/97
cgccuccgccga

SEQ ID NO: 1183970 - RNA, 17 nt, Mycobacterium bovis subsp bovis AF2122/97
cgccuccugccgccgcu

SEQ ID NO: 1183971 - RNA, 14 nt, Mycobacterium bovis subsp bovis AF2122/97
cgccuccgcggcau

SEQ ID NO: 1183972 - RNA, 19 nt, Mycobacterium bovis subsp bovis AF2122/97
cgccuccggcaccuccagc

SEQ ID NO: 1183973 - RNA, 23 nt, Mycobacterium bovis subsp bovis AF2122/97
cgccucgacacccagccgcagcc

SEQ ID NO: 1183974 - RNA, 20 nt, Mycobacterium bovis subsp bovis AF2122/97
cgccucgaauugguaaugca

SEQ ID NO: 1183975 - RNA, 14 nt, Mycobacterium bovis subsp bovis AF2122/97
cgccucgccaucca

SEQ ID NO: 1183976 - RNA, 13 nt, Mycobacterium bovis subsp bovis AF2122/97
cgccucgccggcc

SEQ ID NO: 1183977 - RNA, 17 nt, Mycobacterium bovis subsp bovis AF2122/97
cgccucgccggccacca

SEQ ID NO: 1183978 - RNA, 19 nt, Mycobacterium bovis subsp bovis AF2122/97
cgccucgccggccaccagc

SEQ ID NO: 1183979 - RNA, 23 nt, Mycobacterium bovis subsp bovis AF2122/97
cgccucgccggccacccgcgcga

SEQ ID NO: 1183980 - RNA, 22 nt, Mycobacterium bovis subsp bovis AF2122/97
cgccucgagguauucgcgcagc

SEQ ID NO: 1183981 - RNA, 13 nt, Mycobacterium bovis subsp bovis AF2122/97
cgcgcucgcccag

SEQ ID NO: 1183982 - RNA, 12 nt, Mycobacterium bovis subsp bovis AF2122/97
cgcgcucgccgg

SEQ ID NO: 1183983 - RNA, 13 nt, Mycobacterium bovis subsp bovis AF2122/97
cgcgcucagccgg

SEQ ID NO: 1183984 - RNA, 15 nt, Mycobacterium bovis subsp bovis AF2122/97
cgcgcucaccggggc

SEQ ID NO: 1183985 - RNA, 16 nt, Mycobacterium bovis subsp bovis AF2122/97
cgcgcguggucgcccc

SEQ ID NO: 1183986 - RNA, 19 nt, Mycobacterium bovis subsp bovis AF2122/97
cgcgcguucggcgagcagc

SEQ ID NO: 1183987 - RNA, 21 nt, Mycobacterium bovis subsp bovis AF2122/97
cgcgcguucggcgagcagcgc

SEQ ID NO: 1183988 - RNA, 19 nt, Mycobacterium bovis subsp bovis AF2122/97
cgcgcguugaagucgccgg

SEQ ID NO: 1183989 - RNA, 23 nt, Mycobacterium bovis subsp bovis AF2122/97
cgcgcuaggugcaacaggcgcgu

SEQ ID NO: 1183990 - RNA, 16 nt, Mycobacterium bovis subsp bovis AF2122/97
cgcgcuacgcggccga

SEQ ID NO: 1183991 - RNA, 15 nt, Mycobacterium bovis subsp bovis AF2122/97
cgcgcggcggccgcg

SEQ ID NO: 1183992 - RNA, 19 nt, Mycobacterium bovis subsp bovis AF2122/97
cgcgcgguacugcgcagcg

SEQ ID NO: 1183993 - RNA, 19 nt, Mycobacterium bovis subsp bovis AF2122/97
cgcgcggguuacccgcagc

SEQ ID NO: 1183994 - RNA, 20 nt, Mycobacterium bovis subsp bovis AF2122/97
cgcgcggguuacccgcagcg

SEQ ID NO: 1183995 - RNA, 15 nt, Mycobacterium bovis subsp bovis AF2122/97
cgcgcgguacugcgc

SEQ ID NO: 1183996 - RNA, 22 nt, Mycobacterium bovis subsp bovis AF2122/97
cgcgcgguuuucggcugccgcu

SEQ ID NO: 1183997 - RNA, 15 nt, Mycobacterium bovis subsp bovis AF2122/97
cgcgcguagcggggg

SEQ ID NO: 1183998 - RNA, 14 nt, Mycobacterium bovis subsp bovis AF2122/97
cgcgcguccgucgg

SEQ ID NO: 1183999 - RNA, 13 nt, Mycobacterium bovis subsp bovis AF2122/97
cgcgcgugcagcc

SEQ ID NO: 1184000 - RNA, 15 nt, Mycobacterium bovis subsp bovis AF2122/97
cgcgcugccggccgc

SEQ ID NO: 1184001 - RNA, 18 nt, Mycobacterium bovis subsp bovis AF2122/97
cgcgcugccgacuccucg

SEQ ID NO: 1184002 - RNA, 13 nt, Mycobacterium bovis subsp bovis AF2122/97
cgcgcugcggccc

SEQ ID NO: 1184003 - RNA, 12 nt, Mycobacterium bovis subsp bovis AF2122/97
cgcgcugagcac

SEQ ID NO: 1184004 - RNA, 15 nt, Mycobacterium bovis subsp bovis AF2122/97
cgcgcugaucagccc

SEQ ID NO: 1184005 - RNA, 15 nt, Mycobacterium bovis subsp bovis AF2122/97
cgcgcugagcacgcg

SEQ ID NO: 1184006 - RNA, 19 nt, Mycobacterium bovis subsp bovis AF2122/97
cgcgcugagcacgcggauc

SEQ ID NO: 1184007 - RNA, 15 nt, Mycobacterium bovis subsp bovis AF2122/97
cgcgcucgcgcaagc

SEQ ID NO: 1184008 - RNA, 20 nt, Mycobacterium bovis subsp bovis AF2122/97
cgcggaagccgccuaggacu

SEQ ID NO: 1184009 - RNA, 23 nt, Mycobacterium bovis subsp bovis AF2122/97
cgcggaaguaccguuccacgucg

SEQ ID NO: 1184010 - RNA, 20 nt, Mycobacterium bovis subsp bovis AF2122/97
cgcggaaucgcaucggcggg

SEQ ID NO: 1184011 - RNA, 16 nt, Mycobacterium bovis subsp bovis AF2122/97
cgcggacaccgcggcg

SEQ ID NO: 1184012 - RNA, 15 nt, Mycobacterium bovis subsp bovis AF2122/97
cgcggaaaggcuucc

SEQ ID NO: 1184013 - RNA, 22 nt, Mycobacterium bovis subsp bovis AF2122/97
cgcgcugcuucuucggacagca

SEQ ID NO: 1184014 - RNA, 13 nt, Mycobacterium bovis subsp bovis AF2122/97
cgcgcuggcgccc

SEQ ID NO: 1184015 - RNA, 17 nt, Mycobacterium bovis subsp bovis AF2122/97
cgcgcuggcgccggcca

SEQ ID NO: 1184016 - RNA, 19 nt, Mycobacterium bovis subsp bovis AF2122/97
cgcgcugcggcccacacca

SEQ ID NO: 1184017 - RNA, 23 nt, Mycobacterium bovis subsp bovis AF2122/97
cgcgcugcggcccacaccagcgc

SEQ ID NO: 1184018 - RNA, 16 nt, Mycobacterium bovis subsp bovis AF2122/97
cgcggacacugcgaag

SEQ ID NO: 1184019 - RNA, 12 nt, Mycobacterium bovis subsp bovis AF2122/97
cgcggacagccc

SEQ ID NO: 1184020 - RNA, 14 nt, Mycobacterium bovis subsp bovis AF2122/97
cgcggacagcccgg

SEQ ID NO: 1184021 - RNA, 22 nt, Mycobacterium bovis subsp bovis AF2122/97
cgcggaucaccaucgccgccgc

SEQ ID NO: 1184022 - RNA, 17 nt, Mycobacterium bovis subsp bovis AF2122/97
cgcggaucggcggccgc

SEQ ID NO: 1184023 - RNA, 18 nt, Mycobacterium bovis subsp bovis AF2122/97
cgcggccccgacugccgc

SEQ ID NO: 1184024 - RNA, 16 nt, Mycobacterium bovis subsp bovis AF2122/97
cgcggauuucucgccc

SEQ ID NO: 1184025 - RNA, 18 nt, Mycobacterium bovis subsp bovis AF2122/97
cgcggauugccgcgcgca

SEQ ID NO: 1184026 - RNA, 21 nt, Mycobacterium bovis subsp bovis AF2122/97
cgcggauggguacgacaccgc

SEQ ID NO: 1184027 - RNA, 17 nt, Mycobacterium bovis subsp bovis AF2122/97
cgcggaugagcucggcc

SEQ ID NO: 1184028 - RNA, 22 nt, Mycobacterium bovis subsp bovis AF2122/97
cgcggcccggacgucggcggcc

SEQ ID NO: 1184029 - RNA, 23 nt, Mycobacterium bovis subsp bovis AF2122/97
cgcggcccgcucgaucggcagcc

SEQ ID NO: 1184030 - RNA, 15 nt, Mycobacterium bovis subsp bovis AF2122/97
cgcggccgccagcgg

SEQ ID NO: 1184031 - RNA, 14 nt, Mycobacterium bovis subsp bovis AF2122/97
cgcggcgagagccu

SEQ ID NO: 1184032 - RNA, 18 nt, Mycobacterium bovis subsp bovis AF2122/97
cgcggcgagcaccacccc

SEQ ID NO: 1184033 - RNA, 16 nt, Mycobacterium bovis subsp bovis AF2122/97
cgcggccgcggugacg

SEQ ID NO: 1184034 - RNA, 19 nt, Mycobacterium bovis subsp bovis AF2122/97
cgcggcgaugauggcgcga

SEQ ID NO: 1184035 - RNA, 20 nt, Mycobacterium bovis subsp bovis AF2122/97
cgcggcguucggcuucacug

SEQ ID NO: 1184036 - RNA, 16 nt, Mycobacterium bovis subsp bovis AF2122/97
cgcggcugacaagccu

SEQ ID NO: 1184037 - RNA, 20 nt, Mycobacterium bovis subsp bovis AF2122/97
cgcggcgccgucgucagcgg

SEQ ID NO: 1184038 - RNA, 14 nt, Mycobacterium bovis subsp bovis AF2122/97
cgcggcgccuccgc

SEQ ID NO: 1184039 - RNA, 12 nt, Mycobacterium bovis subsp bovis AF2122/97
cgcggcgcggcc

SEQ ID NO: 1184040 - RNA, 20 nt, Mycobacterium bovis subsp bovis AF2122/97
cgcggcgcagcacggcggcc

SEQ ID NO: 1184041 - RNA, 14 nt, Mycobacterium bovis subsp bovis AF2122/97
cgcggcgccgccau

SEQ ID NO: 1184042 - RNA, 12 nt, Mycobacterium bovis subsp bovis AF2122/97
cgcggcgccgcc

SEQ ID NO: 1184043 - RNA, 17 nt, Mycobacterium bovis subsp bovis AF2122/97
cgcggcgcacaacccgu

SEQ ID NO: 1184044 - RNA, 20 nt, Mycobacterium bovis subsp bovis AF2122/97
cgcggcgcauuccggcgcca

SEQ ID NO: 1184045 - RNA, 18 nt, Mycobacterium bovis subsp bovis AF2122/97
cgcggcgcaggucgcgca

SEQ ID NO: 1184046 - RNA, 19 nt, Mycobacterium bovis subsp bovis AF2122/97
cgcggcgcaggucgcgcag

SEQ ID NO: 1184047 - RNA, 15 nt, Mycobacterium bovis subsp bovis AF2122/97
cgcgccgagcccggg

SEQ ID NO: 1184048 - RNA, 18 nt, Mycobacterium bovis subsp bovis AF2122/97
cgcgccaguggccaccau

SEQ ID NO: 1184049 - RNA, 21 nt, Mycobacterium bovis subsp bovis AF2122/97
cgcgccaguguggugcggcgc

SEQ ID NO: 1184050 - RNA, 19 nt, Mycobacterium bovis subsp bovis AF2122/97
cgcgccaucgccuccagcc

SEQ ID NO: 1184051 - RNA, 14 nt, Mycobacterium bovis subsp bovis AF2122/97
cgcgccaggcgcga

SEQ ID NO: 1184052 - RNA, 12 nt, Mycobacterium bovis subsp bovis AF2122/97
cgcgccggcggc

SEQ ID NO: 1184053 - RNA, 17 nt, Mycobacterium bovis subsp bovis AF2122/97
cgcgccggcggccaccu

SEQ ID NO: 1184054 - RNA, 12 nt, Mycobacterium bovis subsp bovis AF2122/97
cgcgccggcccc

SEQ ID NO: 1184055 - RNA, 17 nt, Mycobacterium bovis subsp bovis AF2122/97
cgcgccgaguugcccgg

SEQ ID NO: 1184056 - RNA, 16 nt, Mycobacterium bovis subsp bovis AF2122/97
cgcgccgagcccgggc

SEQ ID NO: 1184057 - RNA, 22 nt, Mycobacterium bovis subsp bovis AF2122/97
cgcgccuugauggucuccacca

SEQ ID NO: 1184058 - RNA, 15 nt, Mycobacterium bovis subsp bovis AF2122/97
cgcgccuugcuuccg

SEQ ID NO: 1184059 - RNA, 23 nt, Mycobacterium bovis subsp bovis AF2122/97
cgcgccuuggcacccuccgccgg

SEQ ID NO: 1184060 - RNA, 15 nt, Mycobacterium bovis subsp bovis AF2122/97
cgcgccuuugagccc

SEQ ID NO: 1184061 - RNA, 18 nt, Mycobacterium bovis subsp bovis AF2122/97
cgcgcgaagaucggcgcu

SEQ ID NO: 1184062 - RNA, 18 nt, Mycobacterium bovis subsp bovis AF2122/97
cgcgcgaaccccagccga

SEQ ID NO: 1184063 - RNA, 22 nt, Mycobacterium bovis subsp bovis AF2122/97
cgcgcgaauggucagcgucgcu

SEQ ID NO: 1184064 - RNA, 12 nt, Mycobacterium bovis subsp bovis AF2122/97
cgcgccugccuc

SEQ ID NO: 1184065 - RNA, 19 nt, Mycobacterium bovis subsp bovis AF2122/97
cgcgccuucacgcuggccu

SEQ ID NO: 1184066 - RNA, 21 nt, Mycobacterium bovis subsp bovis AF2122/97
cgcgcgagaacacccgugccu

SEQ ID NO: 1184067 - RNA, 16 nt, Mycobacterium bovis subsp bovis AF2122/97
cgcgcgacaacccggc

SEQ ID NO: 1184068 - RNA, 13 nt, Mycobacterium bovis subsp bovis AF2122/97
cgcgcgacgccgu

SEQ ID NO: 1184069 - RNA, 17 nt, Mycobacterium bovis subsp bovis AF2122/97
cgcgcgcaggccgccgc

SEQ ID NO: 1184070 - RNA, 22 nt, Mycobacterium bovis subsp bovis AF2122/97
cgcgcgcaagucgauguacacc

SEQ ID NO: 1184071 - RNA, 16 nt, Mycobacterium bovis subsp bovis AF2122/97
cgcgcggccagcccac

SEQ ID NO: 1184072 - RNA, 15 nt, Mycobacterium bovis subsp bovis AF2122/97
cgcgcggcgcagcac

SEQ ID NO: 1184073 - RNA, 13 nt, Mycobacterium bovis subsp bovis AF2122/97
cgcgcggcgcagc

SEQ ID NO: 1184074 - RNA, 14 nt, Mycobacterium bovis subsp bovis AF2122/97
cgcgcggccagccc

SEQ ID NO: 1184075 - RNA, 21 nt, Mycobacterium bovis subsp bovis AF2122/97
cgcgcggagaccccgcgcgcu

SEQ ID NO: 1184076 - RNA, 20 nt, Mycobacterium bovis subsp bovis AF2122/97
cgcgcgccaucgccuccagc

SEQ ID NO: 1184077 - RNA, 14 nt, Mycobacterium bovis subsp bovis AF2122/97
cgcgcauccgcagc

SEQ ID NO: 1184078 - RNA, 16 nt, Mycobacterium bovis subsp bovis AF2122/97
cgcgcaucaucgccca

SEQ ID NO: 1184079 - RNA, 21 nt, Mycobacterium bovis subsp bovis AF2122/97
cgcgcaguuuggcggcgcgca

SEQ ID NO: 1184080 - RNA, 15 nt, Mycobacterium bovis subsp bovis AF2122/97
cgcgcauauccgcag

SEQ ID NO: 1184081 - RNA, 17 nt, Mycobacterium bovis subsp bovis AF2122/97
cgcgcaucugucgcgcg

SEQ ID NO: 1184082 - RNA, 19 nt, Mycobacterium bovis subsp bovis AF2122/97
cgcgcaucugucgcgcggc

SEQ ID NO: 1184083 - RNA, 21 nt, Mycobacterium bovis subsp bovis AF2122/97
cgcgcaucgcacgggccacca

SEQ ID NO: 1184084 - RNA, 18 nt, Mycobacterium bovis subsp bovis AF2122/97
cgcgcaucgccuccucga

SEQ ID NO: 1184085 - RNA, 12 nt, Mycobacterium bovis subsp bovis AF2122/97
cgcgcagcgccg

SEQ ID NO: 1184086 - RNA, 19 nt, Mycobacterium bovis subsp bovis AF2122/97
cgcgcagccgggccaaccg

SEQ ID NO: 1184087 - RNA, 15 nt, Mycobacterium bovis subsp bovis AF2122/97
cgcgcagcgcggcgg

SEQ ID NO: 1184088 - RNA, 14 nt, Mycobacterium bovis subsp bovis AF2122/97
cgcgcagcuccacc

SEQ ID NO: 1184089 - RNA, 19 nt, Mycobacterium bovis subsp bovis AF2122/97
cgcgcagcugccgcacccc

SEQ ID NO: 1184090 - RNA, 18 nt, Mycobacterium bovis subsp bovis AF2122/97
cgcgccaccggcaccgcc

SEQ ID NO: 1184091 - RNA, 16 nt, Mycobacterium bovis subsp bovis AF2122/97
cgcgccacccagcacc

SEQ ID NO: 1184092 - RNA, 11 nt, Mycobacterium bovis subsp bovis AF2122/97
cgcgccaccga

SEQ ID NO: 1184093 - RNA, 14 nt, Mycobacterium bovis subsp bovis AF2122/97
cgcgccagccucca

SEQ ID NO: 1184094 - RNA, 21 nt, Mycobacterium bovis subsp bovis AF2122/97
cgcgcagcauggugcggcggc

SEQ ID NO: 1184095 - RNA, 14 nt, Mycobacterium bovis subsp bovis AF2122/97
cgcgcagccgccgc

SEQ ID NO: 1184096 - RNA, 18 nt, Mycobacterium bovis subsp bovis AF2122/97
cgcgcagccgccgcgccc

SEQ ID NO: 1184097 - RNA, 18 nt, Mycobacterium bovis subsp bovis AF2122/97
cgcgcagacucgccaccg

SEQ ID NO: 1184098 - RNA, 14 nt, Mycobacterium bovis subsp bovis AF2122/97
cgcgcacccagccc

SEQ ID NO: 1184099 - RNA, 16 nt, Mycobacterium bovis subsp bovis AF2122/97
cgcgcaccaacaccag

SEQ ID NO: 1184100 - RNA, 23 nt, Mycobacterium bovis subsp bovis AF2122/97
cgcgagguugaccaccagcgugc

SEQ ID NO: 1184101 - RNA, 15 nt, Mycobacterium bovis subsp bovis AF2122/97
cgcgagcgcggcgga

SEQ ID NO: 1184102 - RNA, 20 nt, Mycobacterium bovis subsp bovis AF2122/97
cgcgagcuuggccggcaggu

SEQ ID NO: 1184103 - RNA, 13 nt, Mycobacterium bovis subsp bovis AF2122/97
cgcgaggaacgcc

SEQ ID NO: 1184104 - RNA, 16 nt, Mycobacterium bovis subsp bovis AF2122/97
cgcgagugccaguccg

SEQ ID NO: 1184105 - RNA, 17 nt, Mycobacterium bovis subsp bovis AF2122/97
cgcgcaacguagccagc

SEQ ID NO: 1184106 - RNA, 19 nt, Mycobacterium bovis subsp bovis AF2122/97
cgcgcaagcggacccgacc

SEQ ID NO: 1184107 - RNA, 19 nt, Mycobacterium bovis subsp bovis AF2122/97
cgccgcccgugccgcccuc

SEQ ID NO: 1184108 - RNA, 17 nt, Mycobacterium bovis subsp bovis AF2122/97
cgccgccagguccgccg

SEQ ID NO: 1184109 - RNA, 19 nt, Mycobacterium bovis subsp bovis AF2122/97
cgccgcccuugccgccggc

SEQ ID NO: 1184110 - RNA, 22 nt, Mycobacterium bovis subsp bovis AF2122/97
cgccgcccuugccgccggcccc

SEQ ID NO: 1184111 - RNA, 18 nt, Mycobacterium bovis subsp bovis AF2122/97
cgccgcccuggccgccgg

SEQ ID NO: 1184112 - RNA, 19 nt, Mycobacterium bovis subsp bovis AF2122/97
cgccgcccuggccgccggc

SEQ ID NO: 1184113 - RNA, 22 nt, Mycobacterium bovis subsp bovis AF2122/97
cgccgcccuggccgccggcccc

SEQ ID NO: 1184114 - RNA, 23 nt, Mycobacterium bovis subsp bovis AF2122/97
cgccgcccuggccgccggccccg

SEQ ID NO: 1184115 - RNA, 16 nt, Mycobacterium bovis subsp bovis AF2122/97
cgccgcccuccgacgg

SEQ ID NO: 1184116 - RNA, 14 nt, Mycobacterium bovis subsp bovis AF2122/97
cgccgccagcgccg

SEQ ID NO: 1184117 - RNA, 14 nt, Mycobacterium bovis subsp bovis AF2122/97
cgccgccagccugg

SEQ ID NO: 1184118 - RNA, 12 nt, Mycobacterium bovis subsp bovis AF2122/97
cgccgccagcgc

SEQ ID NO: 1184119 - RNA, 13 nt, Mycobacterium bovis subsp bovis AF2122/97
cgccgccagcaga

SEQ ID NO: 1184120 - RNA, 19 nt, Mycobacterium bovis subsp bovis AF2122/97
cgccgccagcgccgccggc

SEQ ID NO: 1184121 - RNA, 12 nt, Mycobacterium bovis subsp bovis AF2122/97
cgccgccagcac

SEQ ID NO: 1184122 - RNA, 16 nt, Mycobacterium bovis subsp bovis AF2122/97
cgccgcaaucagacgg

SEQ ID NO: 1184123 - RNA, 18 nt, Mycobacterium bovis subsp bovis AF2122/97
cgccgauuccaccgccga

SEQ ID NO: 1184124 - RNA, 23 nt, Mycobacterium bovis subsp bovis AF2122/97
cgccgauuuggccgucaucuccg

SEQ ID NO: 1184125 - RNA, 15 nt, Mycobacterium bovis subsp bovis AF2122/97
cgccgaugccggcca

SEQ ID NO: 1184126 - RNA, 13 nt, Mycobacterium bovis subsp bovis AF2122/97
cgccgauguggcc

SEQ ID NO: 1184127 - RNA, 13 nt, Mycobacterium bovis subsp bovis AF2122/97
cgccgaccaccgc

SEQ ID NO: 1184128 - RNA, 13 nt, Mycobacterium bovis subsp bovis AF2122/97
cgccgacccgcgc

SEQ ID NO: 1184129 - RNA, 17 nt, Mycobacterium bovis subsp bovis AF2122/97
cgccgacccgcgcgccg

SEQ ID NO: 1184130 - RNA, 14 nt, Mycobacterium bovis subsp bovis AF2122/97
cgccgacccggggg

SEQ ID NO: 1184131 - RNA, 22 nt, Mycobacterium bovis subsp bovis AF2122/97
cgccgaccaucucaccgggccc

SEQ ID NO: 1184132 - RNA, 21 nt, Mycobacterium bovis subsp bovis AF2122/97
cgccgaccagaacgacgccgc

SEQ ID NO: 1184133 - RNA, 13 nt, Mycobacterium bovis subsp bovis AF2122/97
cgccgaccagcac

SEQ ID NO: 1184134 - RNA, 17 nt, Mycobacterium bovis subsp bovis AF2122/97
cgccgacggccagcagg

SEQ ID NO: 1184135 - RNA, 22 nt, Mycobacterium bovis subsp bovis AF2122/97
cgccgacgccgccggccccgcc

SEQ ID NO: 1184136 - RNA, 16 nt, Mycobacterium bovis subsp bovis AF2122/97
cgccgacgccgguggg

SEQ ID NO: 1184137 - RNA, 17 nt, Mycobacterium bovis subsp bovis AF2122/97
cgccgacgccguugccc

SEQ ID NO: 1184138 - RNA, 19 nt, Mycobacterium bovis subsp bovis AF2122/97
cgccgacuccccgccgggc

SEQ ID NO: 1184139 - RNA, 14 nt, Mycobacterium bovis subsp bovis AF2122/97
cgccgacuccccgc

SEQ ID NO: 1184140 - RNA, 20 nt, Mycobacterium bovis subsp bovis AF2122/97
cgccgacgucgacgccggcc

SEQ ID NO: 1184141 - RNA, 16 nt, Mycobacterium bovis subsp bovis AF2122/97
cgccgaucccggcggu

SEQ ID NO: 1184142 - RNA, 16 nt, Mycobacterium bovis subsp bovis AF2122/97
cgccgaucccgucggg

SEQ ID NO: 1184143 - RNA, 18 nt, Mycobacterium bovis subsp bovis AF2122/97
cgccgaucgcggcggccu

SEQ ID NO: 1184144 - RNA, 19 nt, Mycobacterium bovis subsp bovis AF2122/97
cgccgaucuucgcgcgcuc

SEQ ID NO: 1184145 - RNA, 18 nt, Mycobacterium bovis subsp bovis AF2122/97
cgccgaugaacguggcga

SEQ ID NO: 1184146 - RNA, 18 nt, Mycobacterium bovis subsp bovis AF2122/97
cgccgaugcugccgccgc

SEQ ID NO: 1184147 - RNA, 18 nt, Mycobacterium bovis subsp bovis AF2122/97
cgccgaugaugcggcgca

SEQ ID NO: 1184148 - RNA, 20 nt, Mycobacterium bovis subsp bovis AF2122/97
cgccgaugauggacaccagc

SEQ ID NO: 1184149 - RNA, 21 nt, Mycobacterium bovis subsp bovis AF2122/97
cgccgagaugaugcugccggc

SEQ ID NO: 1184150 - RNA, 23 nt, Mycobacterium bovis subsp bovis AF2122/97
cgccgagaugaugcugccggcac

SEQ ID NO: 1184151 - RNA, 20 nt, Mycobacterium bovis subsp bovis AF2122/97
cgccgagaagacgcaaaagc

SEQ ID NO: 1184152 - RNA, 15 nt, Mycobacterium bovis subsp bovis AF2122/97
cgccgagaccgccgc

SEQ ID NO: 1184153 - RNA, 22 nt, Mycobacterium bovis subsp bovis AF2122/97
cgccgacucggcaccgcggccg

SEQ ID NO: 1184154 - RNA, 21 nt, Mycobacterium bovis subsp bovis AF2122/97
cgccgacuuccgcgucgccgg

SEQ ID NO: 1184155 - RNA, 22 nt, Mycobacterium bovis subsp bovis AF2122/97
cgccgacuuccgcgucgccggc

SEQ ID NO: 1184156 - RNA, 16 nt, Mycobacterium bovis subsp bovis AF2122/97
cgccgagaccgccgcu

SEQ ID NO: 1184157 - RNA, 23 nt, Mycobacterium bovis subsp bovis AF2122/97
cgccgaucaugaccaucugcugu

SEQ ID NO: 1184158 - RNA, 17 nt, Mycobacterium bovis subsp bovis AF2122/97
cgcccgcgguccggcga

SEQ ID NO: 1184159 - RNA, 22 nt, Mycobacterium bovis subsp bovis AF2122/97
cgcccggcccugagcugccgag

SEQ ID NO: 1184160 - RNA, 15 nt, Mycobacterium bovis subsp bovis AF2122/97
cgcccggcccgccac

SEQ ID NO: 1184161 - RNA, 17 nt, Mycobacterium bovis subsp bovis AF2122/97
cgcccggccccgcaagc

SEQ ID NO: 1184162 - RNA, 13 nt, Mycobacterium bovis subsp bovis AF2122/97
cgcccggccccgc

SEQ ID NO: 1184163 - RNA, 18 nt, Mycobacterium bovis subsp bovis AF2122/97
cgcccgcgcugccgacuc

SEQ ID NO: 1184164 - RNA, 15 nt, Mycobacterium bovis subsp bovis AF2122/97
cgcccggcgagcagg

SEQ ID NO: 1184165 - RNA, 17 nt, Mycobacterium bovis subsp bovis AF2122/97
cgcccggcgcaccaucg

SEQ ID NO: 1184166 - RNA, 20 nt, Mycobacterium bovis subsp bovis AF2122/97
cgcccggcgcuagcgccgcg

SEQ ID NO: 1184167 - RNA, 16 nt, Mycobacterium bovis subsp bovis AF2122/97
cgcccgucgcugggag

SEQ ID NO: 1184168 - RNA, 18 nt, Mycobacterium bovis subsp bovis AF2122/97
cgcccgugccgcccgcgc

SEQ ID NO: 1184169 - RNA, 15 nt, Mycobacterium bovis subsp bovis AF2122/97
cgcccgugccgcccu

SEQ ID NO: 1184170 - RNA, 16 nt, Mycobacterium bovis subsp bovis AF2122/97
cgcccgugccgcccuc

SEQ ID NO: 1184171 - RNA, 19 nt, Mycobacterium bovis subsp bovis AF2122/97
cgcccgugcggcucgccgg

SEQ ID NO: 1184172 - RNA, 13 nt, Mycobacterium bovis subsp bovis AF2122/97
cgcccugacaccc

SEQ ID NO: 1184173 - RNA, 15 nt, Mycobacterium bovis subsp bovis AF2122/97
cgcccugccauggga

SEQ ID NO: 1184174 - RNA, 17 nt, Mycobacterium bovis subsp bovis AF2122/97
cgcccuaacccugcccu

SEQ ID NO: 1184175 - RNA, 18 nt, Mycobacterium bovis subsp bovis AF2122/97
cgcccugaagggccgccu

SEQ ID NO: 1184176 - RNA, 19 nt, Mycobacterium bovis subsp bovis AF2122/97
cgcccugaagggccgccuc

SEQ ID NO: 1184177 - RNA, 16 nt, Mycobacterium bovis subsp bovis AF2122/97
cgcccuugccgccagc

SEQ ID NO: 1184178 - RNA, 22 nt, Mycobacterium bovis subsp bovis AF2122/97
cgcccuugccgccagccccagc

SEQ ID NO: 1184179 - RNA, 16 nt, Mycobacterium bovis subsp bovis AF2122/97
cgcccuugccgcccgc

SEQ ID NO: 1184180 - RNA, 17 nt, Mycobacterium bovis subsp bovis AF2122/97
cgcccuugccgcccgcu

SEQ ID NO: 1184181 - RNA, 18 nt, Mycobacterium bovis subsp bovis AF2122/97
cgcccuugccgccggccc

SEQ ID NO: 1184182 - RNA, 21 nt, Mycobacterium bovis subsp bovis AF2122/97
cgcccuugccgccggccccgc

SEQ ID NO: 1184183 - RNA, 15 nt, Mycobacterium bovis subsp bovis AF2122/97
cgcccuugccgccuu

SEQ ID NO: 1184184 - RNA, 15 nt, Mycobacterium bovis subsp bovis AF2122/97
cgcccuugccgccga

SEQ ID NO: 1184185 - RNA, 16 nt, Mycobacterium bovis subsp bovis AF2122/97
cgcccuugccgccggc

SEQ ID NO: 1184186 - RNA, 23 nt, Mycobacterium bovis subsp bovis AF2122/97
cgcccugacacaacaccggcgug

SEQ ID NO: 1184187 - RNA, 12 nt, Mycobacterium bovis subsp bovis AF2122/97
cgcccugcggau

SEQ ID NO: 1184188 - RNA, 22 nt, Mycobacterium bovis subsp bovis AF2122/97
cgccgacaggccggccaccagu

SEQ ID NO: 1184189 - RNA, 14 nt, Mycobacterium bovis subsp bovis AF2122/97
cgccgaacgccacc

SEQ ID NO: 1184190 - RNA, 18 nt, Mycobacterium bovis subsp bovis AF2122/97
cgccgaacaccggcucca

SEQ ID NO: 1184191 - RNA, 17 nt, Mycobacterium bovis subsp bovis AF2122/97
cgccgaaccaguaauac

SEQ ID NO: 1184192 - RNA, 14 nt, Mycobacterium bovis subsp bovis AF2122/97
cgccgaaagccuug

SEQ ID NO: 1184193 - RNA, 22 nt, Mycobacterium bovis subsp bovis AF2122/97
cgccgaaaucaguugcgcucca

SEQ ID NO: 1184194 - RNA, 17 nt, Mycobacterium bovis subsp bovis AF2122/97
cgccgaaacucaccagc

SEQ ID NO: 1184195 - RNA, 19 nt, Mycobacterium bovis subsp bovis AF2122/97
cgccgaaacucaccagcac

SEQ ID NO: 1184196 - RNA, 14 nt, Mycobacterium bovis subsp bovis AF2122/97
cgccgaaaaugccg

SEQ ID NO: 1184197 - RNA, 22 nt, Mycobacterium bovis subsp bovis AF2122/97
cgccgaaaccgggacaaucucg

SEQ ID NO: 1184198 - RNA, 17 nt, Mycobacterium bovis subsp bovis AF2122/97
cgccgaaaaugccgccc

SEQ ID NO: 1184199 - RNA, 18 nt, Mycobacterium bovis subsp bovis AF2122/97
cgccgaaaaugccgccca

SEQ ID NO: 1184200 - RNA, 16 nt, Mycobacterium bovis subsp bovis AF2122/97
cgccgaaacagcaccc

SEQ ID NO: 1184201 - RNA, 22 nt, Mycobacterium bovis subsp bovis AF2122/97
cgccgaaaccacuuccggcgug

SEQ ID NO: 1184202 - RNA, 13 nt, Mycobacterium bovis subsp bovis AF2122/97
cgcccuugugaac

SEQ ID NO: 1184203 - RNA, 18 nt, Mycobacterium bovis subsp bovis AF2122/97
cgccccagccaugcugcu

SEQ ID NO: 1184204 - RNA, 15 nt, Mycobacterium bovis subsp bovis AF2122/97
cgcccauggccacca

SEQ ID NO: 1184205 - RNA, 17 nt, Mycobacterium bovis subsp bovis AF2122/97
cgcccaugaccggccgc

SEQ ID NO: 1184206 - RNA, 18 nt, Mycobacterium bovis subsp bovis AF2122/97
cgcccaugaccggccgcc

SEQ ID NO: 1184207 - RNA, 15 nt, Mycobacterium bovis subsp bovis AF2122/97
cgcccaucucaugca

SEQ ID NO: 1184208 - RNA, 17 nt, Mycobacterium bovis subsp bovis AF2122/97
cgcccaucgcaagcugg

SEQ ID NO: 1184209 - RNA, 18 nt, Mycobacterium bovis subsp bovis AF2122/97
cgcccaucgcgacggccc

SEQ ID NO: 1184210 - RNA, 16 nt, Mycobacterium bovis subsp bovis AF2122/97
cgcccagaucgccgag

SEQ ID NO: 1184211 - RNA, 22 nt, Mycobacterium bovis subsp bovis AF2122/97
cgcccagagugaauccggcaua

SEQ ID NO: 1184212 - RNA, 14 nt, Mycobacterium bovis subsp bovis AF2122/97
cgcccagcgcccgc

SEQ ID NO: 1184213 - RNA, 21 nt, Mycobacterium bovis subsp bovis AF2122/97
cgcccagcgugaacugagggc

SEQ ID NO: 1184214 - RNA, 22 nt, Mycobacterium bovis subsp bovis AF2122/97
cgcccagcgcuagccgggcgcg

SEQ ID NO: 1184215 - RNA, 17 nt, Mycobacterium bovis subsp bovis AF2122/97
cgcccaggaagccgaga

SEQ ID NO: 1184216 - RNA, 14 nt, Mycobacterium bovis subsp bovis AF2122/97
cgcccgcgcggcca

SEQ ID NO: 1184217 - RNA, 20 nt, Mycobacterium bovis subsp bovis AF2122/97
cgcccgcggccgccagcgga

SEQ ID NO: 1184218 - RNA, 22 nt, Mycobacterium bovis subsp bovis AF2122/97
cgcccgcgccuccguugccccc

SEQ ID NO: 1184219 - RNA, 17 nt, Mycobacterium bovis subsp bovis AF2122/97
cgcccgcgagcuguagg

SEQ ID NO: 1184220 - RNA, 16 nt, Mycobacterium bovis subsp bovis AF2122/97
cgcccgcgccaccggc

SEQ ID NO: 1184221 - RNA, 19 nt, Mycobacterium bovis subsp bovis AF2122/97
cgccccugguccacccgug

SEQ ID NO: 1184222 - RNA, 16 nt, Mycobacterium bovis subsp bovis AF2122/97
cgccccugcacagcag

SEQ ID NO: 1184223 - RNA, 22 nt, Mycobacterium bovis subsp bovis AF2122/97
cgccccucacguggacugaccu

SEQ ID NO: 1184224 - RNA, 18 nt, Mycobacterium bovis subsp bovis AF2122/97
cgcccgaagaugccugga

SEQ ID NO: 1184225 - RNA, 17 nt, Mycobacterium bovis subsp bovis AF2122/97
cgcccgaaaaacgaccc

SEQ ID NO: 1184226 - RNA, 20 nt, Mycobacterium bovis subsp bovis AF2122/97
cgcccccgccauugccgccg

SEQ ID NO: 1184227 - RNA, 13 nt, Mycobacterium bovis subsp bovis AF2122/97
cgcccccgugggg

SEQ ID NO: 1184228 - RNA, 13 nt, Mycobacterium bovis subsp bovis AF2122/97
cgccccggcggcg

SEQ ID NO: 1184229 - RNA, 14 nt, Mycobacterium bovis subsp bovis AF2122/97
cgcccccgccggcc

SEQ ID NO: 1184230 - RNA, 15 nt, Mycobacterium bovis subsp bovis AF2122/97
cgccccgggccacca

SEQ ID NO: 1184231 - RNA, 16 nt, Mycobacterium bovis subsp bovis AF2122/97
cgcccccagugcacgc

SEQ ID NO: 1184232 - RNA, 20 nt, Mycobacterium bovis subsp bovis AF2122/97
cgcccccauaacugcggccc

SEQ ID NO: 1184233 - RNA, 12 nt, Mycobacterium bovis subsp bovis AF2122/97
cgcccccgcccg

SEQ ID NO: 1184234 - RNA, 13 nt, Mycobacterium bovis subsp bovis AF2122/97
cgcccccgcccgu

SEQ ID NO: 1184235 - RNA, 19 nt, Mycobacterium bovis subsp bovis AF2122/97
cgcccacggcaccaccaag

SEQ ID NO: 1184236 - RNA, 14 nt, Mycobacterium bovis subsp bovis AF2122/97
cgcccacggggcgu

SEQ ID NO: 1184237 - RNA, 17 nt, Mycobacterium bovis subsp bovis AF2122/97
cgcccagaccgacccgc

SEQ ID NO: 1184238 - RNA, 15 nt, Mycobacterium bovis subsp bovis AF2122/97
cgcccagaccgccga

SEQ ID NO: 1184239 - RNA, 21 nt, Mycobacterium bovis subsp bovis AF2122/97
cgcccagagugaauccggcau

SEQ ID NO: 1184240 - RNA, 16 nt, Mycobacterium bovis subsp bovis AF2122/97
cgcccaagccgccggc

SEQ ID NO: 1184241 - RNA, 16 nt, Mycobacterium bovis subsp bovis AF2122/97
cgcccaagguggcggc

SEQ ID NO: 1184242 - RNA, 22 nt, Mycobacterium bovis subsp bovis AF2122/97
cgcccaauguccaggcgcgcac

SEQ ID NO: 1184243 - RNA, 15 nt, Mycobacterium bovis subsp bovis AF2122/97
cgcccaacaccgcgc

SEQ ID NO: 1184244 - RNA, 17 nt, Mycobacterium bovis subsp bovis AF2122/97
cgcccaacaccgcgccg

SEQ ID NO: 1184245 - RNA, 18 nt, Mycobacterium bovis subsp bovis AF2122/97
cgcccaacaccgcgccga

SEQ ID NO: 1184246 - RNA, 15 nt, Mycobacterium bovis subsp bovis AF2122/97
cgccauucaucggca

SEQ ID NO: 1184247 - RNA, 16 nt, Mycobacterium bovis subsp bovis AF2122/97
cgccauucaucggcau

SEQ ID NO: 1184248 - RNA, 17 nt, Mycobacterium bovis subsp bovis AF2122/97
cgccauugagcucccgc

SEQ ID NO: 1184249 - RNA, 21 nt, Mycobacterium bovis subsp bovis AF2122/97
cgccauugaggaagccguugg

SEQ ID NO: 1184250 - RNA, 14 nt, Mycobacterium bovis subsp bovis AF2122/97
cgccaucagcccgg

SEQ ID NO: 1184251 - RNA, 13 nt, Mycobacterium bovis subsp bovis AF2122/97
cgccaucagcccu

SEQ ID NO: 1184252 - RNA, 12 nt, Mycobacterium bovis subsp bovis AF2122/97
cgccaucagccg

SEQ ID NO: 1184253 - RNA, 17 nt, Mycobacterium bovis subsp bovis AF2122/97
cgccaucagccgcugcg

SEQ ID NO: 1184254 - RNA, 19 nt, Mycobacterium bovis subsp bovis AF2122/97
cgccaucacaucggccucu

SEQ ID NO: 1184255 - RNA, 21 nt, Mycobacterium bovis subsp bovis AF2122/97
cgccaucauggcggcccgguc

SEQ ID NO: 1184256 - RNA, 19 nt, Mycobacterium bovis subsp bovis AF2122/97
cgccaucgccgccaaccac

SEQ ID NO: 1184257 - RNA, 16 nt, Mycobacterium bovis subsp bovis AF2122/97
cgccaggcgcuuggcc

SEQ ID NO: 1184258 - RNA, 23 nt, Mycobacterium bovis subsp bovis AF2122/97
cgccaggcgcgaucgcgcccgcu

SEQ ID NO: 1184259 - RNA, 14 nt, Mycobacterium bovis subsp bovis AF2122/97
cgccagggccaucu

SEQ ID NO: 1184260 - RNA, 23 nt, Mycobacterium bovis subsp bovis AF2122/97
cgccagggaucuagaggcggccc

SEQ ID NO: 1184261 - RNA, 16 nt, Mycobacterium bovis subsp bovis AF2122/97
cgccagggcacguggc

SEQ ID NO: 1184262 - RNA, 21 nt, Mycobacterium bovis subsp bovis AF2122/97
cgccaggucagcuccaucccc

SEQ ID NO: 1184263 - RNA, 21 nt, Mycobacterium bovis subsp bovis AF2122/97
cgccagguacucggugcacag

SEQ ID NO: 1184264 - RNA, 15 nt, Mycobacterium bovis subsp bovis AF2122/97
cgccagguggccgcu

SEQ ID NO: 1184265 - RNA, 17 nt, Mycobacterium bovis subsp bovis AF2122/97
cgccaggugcagcacca

SEQ ID NO: 1184266 - RNA, 14 nt, Mycobacterium bovis subsp bovis AF2122/97
cgccagguugcccg

SEQ ID NO: 1184267 - RNA, 21 nt, Mycobacterium bovis subsp bovis AF2122/97
cgccaguaccacuguuacggc

SEQ ID NO: 1184268 - RNA, 21 nt, Mycobacterium bovis subsp bovis AF2122/97
cgccaguauggccgccaccgc

SEQ ID NO: 1184269 - RNA, 20 nt, Mycobacterium bovis subsp bovis AF2122/97
cgccagucgcaggaucggcg

SEQ ID NO: 1184270 - RNA, 15 nt, Mycobacterium bovis subsp bovis AF2122/97
cgccaguggccacca

SEQ ID NO: 1184271 - RNA, 17 nt, Mycobacterium bovis subsp bovis AF2122/97
cgccaguggccaccauc

SEQ ID NO: 1184272 - RNA, 21 nt, Mycobacterium bovis subsp bovis AF2122/97
cgccagugccucgcggggucu

SEQ ID NO: 1184273 - RNA, 16 nt, Mycobacterium bovis subsp bovis AF2122/97
cgccaguuugggaucc

SEQ ID NO: 1184274 - RNA, 23 nt, Mycobacterium bovis subsp bovis AF2122/97
cgccaguuugggauccuggccga

SEQ ID NO: 1184275 - RNA, 20 nt, Mycobacterium bovis subsp bovis AF2122/97
cgccaguguugcgcugcggc

SEQ ID NO: 1184276 - RNA, 20 nt, Mycobacterium bovis subsp bovis AF2122/97
cgccauaauauugccgccuc

SEQ ID NO: 1184277 - RNA, 13 nt, Mycobacterium bovis subsp bovis AF2122/97
cgccauaccggcu

SEQ ID NO: 1184278 - RNA, 16 nt, Mycobacterium bovis subsp bovis AF2122/97
cgccauaccggccgcc

SEQ ID NO: 1184279 - RNA, 13 nt, Mycobacterium bovis subsp bovis AF2122/97
cgccagcgccgga

SEQ ID NO: 1184280 - RNA, 13 nt, Mycobacterium bovis subsp bovis AF2122/97
cgccagcgccggc

SEQ ID NO: 1184281 - RNA, 14 nt, Mycobacterium bovis subsp bovis AF2122/97
cgccagcgccggcc

SEQ ID NO: 1184282 - RNA, 15 nt, Mycobacterium bovis subsp bovis AF2122/97
cgccagcgccgccga

SEQ ID NO: 1184283 - RNA, 16 nt, Mycobacterium bovis subsp bovis AF2122/97
cgccagcgccgccgga

SEQ ID NO: 1184284 - RNA, 11 nt, Mycobacterium bovis subsp bovis AF2122/97
cgccagcgccg

SEQ ID NO: 1184285 - RNA, 17 nt, Mycobacterium bovis subsp bovis AF2122/97
cgccagcgccagugccu

SEQ ID NO: 1184286 - RNA, 14 nt, Mycobacterium bovis subsp bovis AF2122/97
cgccagccggccgc

SEQ ID NO: 1184287 - RNA, 15 nt, Mycobacterium bovis subsp bovis AF2122/97
cgccagccuccacca

SEQ ID NO: 1184288 - RNA, 19 nt, Mycobacterium bovis subsp bovis AF2122/97
cgccagccguuuuccugau

SEQ ID NO: 1184289 - RNA, 14 nt, Mycobacterium bovis subsp bovis AF2122/97
cgccagccuccacc

SEQ ID NO: 1184290 - RNA, 20 nt, Mycobacterium bovis subsp bovis AF2122/97
cgccagccugugcugccaac

SEQ ID NO: 1184291 - RNA, 17 nt, Mycobacterium bovis subsp bovis AF2122/97
cgccagccuccaccagg

SEQ ID NO: 1184292 - RNA, 19 nt, Mycobacterium bovis subsp bovis AF2122/97
cgccagccuccaccagguc

SEQ ID NO: 1184293 - RNA, 19 nt, Mycobacterium bovis subsp bovis AF2122/97
cgccagcgguggaccaccg

SEQ ID NO: 1184294 - RNA, 12 nt, Mycobacterium bovis subsp bovis AF2122/97
cgccagcggggc

SEQ ID NO: 1184295 - RNA, 17 nt, Mycobacterium bovis subsp bovis AF2122/97
cgccagcggccgcucca

SEQ ID NO: 1184296 - RNA, 23 nt, Mycobacterium bovis subsp bovis AF2122/97
cgccagcggccgcuccaccucgg

SEQ ID NO: 1184297 - RNA, 13 nt, Mycobacterium bovis subsp bovis AF2122/97
cgccagcgcgccg

SEQ ID NO: 1184298 - RNA, 13 nt, Mycobacterium bovis subsp bovis AF2122/97
cgccagcucgccg

SEQ ID NO: 1184299 - RNA, 14 nt, Mycobacterium bovis subsp bovis AF2122/97
cgccagcucgccgg

SEQ ID NO: 1184300 - RNA, 18 nt, Mycobacterium bovis subsp bovis AF2122/97
cgccagcucacggacgcu

SEQ ID NO: 1184301 - RNA, 15 nt, Mycobacterium bovis subsp bovis AF2122/97
cgccagcucgccggc

SEQ ID NO: 1184302 - RNA, 19 nt, Mycobacterium bovis subsp bovis AF2122/97
cgccagcucggcacccgcc

SEQ ID NO: 1184303 - RNA, 20 nt, Mycobacterium bovis subsp bovis AF2122/97
cgccagcugacacccgcagc

SEQ ID NO: 1184304 - RNA, 18 nt, Mycobacterium bovis subsp bovis AF2122/97
cgccaggccgagcccggu

SEQ ID NO: 1184305 - RNA, 15 nt, Mycobacterium bovis subsp bovis AF2122/97
cgccaggccgagccc

SEQ ID NO: 1184306 - RNA, 13 nt, Mycobacterium bovis subsp bovis AF2122/97
cgccaggcccccu

SEQ ID NO: 1184307 - RNA, 19 nt, Mycobacterium bovis subsp bovis AF2122/97
cgccaggcccccucggcgu

SEQ ID NO: 1184308 - RNA, 13 nt, Mycobacterium bovis subsp bovis AF2122/97
cgccaggaucugg

SEQ ID NO: 1184309 - RNA, 17 nt, Mycobacterium bovis subsp bovis AF2122/97
cgccaggagcgcggccc

SEQ ID NO: 1184310 - RNA, 21 nt, Mycobacterium bovis subsp bovis AF2122/97
cgccaggagcgcggcccgccu

SEQ ID NO: 1184311 - RNA, 11 nt, Mycobacterium bovis subsp bovis AF2122/97
cgccaggaacc

SEQ ID NO: 1184312 - RNA, 17 nt, Mycobacterium bovis subsp bovis AF2122/97
cgccagcuuggcaaccu

SEQ ID NO: 1184313 - RNA, 20 nt, Mycobacterium bovis subsp bovis AF2122/97
cgccagccgaccgauggcuc

SEQ ID NO: 1184314 - RNA, 14 nt, Mycobacterium bovis subsp bovis AF2122/97
cgccagccaggcga

SEQ ID NO: 1184315 - RNA, 14 nt, Mycobacterium bovis subsp bovis AF2122/97
cgccagcccagcac

SEQ ID NO: 1184316 - RNA, 22 nt, Mycobacterium bovis subsp bovis AF2122/97
cgccagcaugacaccggccacc

SEQ ID NO: 1184317 - RNA, 14 nt, Mycobacterium bovis subsp bovis AF2122/97
cgccagcaugacac

SEQ ID NO: 1184318 - RNA, 20 nt, Mycobacterium bovis subsp bovis AF2122/97
cgccagcauugaagaagccc

SEQ ID NO: 1184319 - RNA, 21 nt, Mycobacterium bovis subsp bovis AF2122/97
cgccagcauugaagaagcccg

SEQ ID NO: 1184320 - RNA, 18 nt, Mycobacterium bovis subsp bovis AF2122/97
cgccagcagggccagacc

SEQ ID NO: 1184321 - RNA, 21 nt, Mycobacterium bovis subsp bovis AF2122/97
cgccagcaucagcccggcgcu

SEQ ID NO: 1184322 - RNA, 23 nt, Mycobacterium bovis subsp bovis AF2122/97
cgccagcagcugugguaccaacg

SEQ ID NO: 1184323 - RNA, 23 nt, Mycobacterium bovis subsp bovis AF2122/97
cgccagcaccaccggcucccggg

SEQ ID NO: 1184324 - RNA, 14 nt, Mycobacterium bovis subsp bovis AF2122/97
cgccagcaccagcg

SEQ ID NO: 1184325 - RNA, 14 nt, Mycobacterium bovis subsp bovis AF2122/97
cgccagcaccaccg

SEQ ID NO: 1184326 - RNA, 16 nt, Mycobacterium bovis subsp bovis AF2122/97
cgccagaucucgcgcg

SEQ ID NO: 1184327 - RNA, 17 nt, Mycobacterium bovis subsp bovis AF2122/97
cgccagaaagcccaggg

SEQ ID NO: 1184328 - RNA, 13 nt, Mycobacterium bovis subsp bovis AF2122/97
cgccagaacggcg

SEQ ID NO: 1184329 - RNA, 19 nt, Mycobacterium bovis subsp bovis AF2122/97
cgccaccauccccggcaac

SEQ ID NO: 1184330 - RNA, 23 nt, Mycobacterium bovis subsp bovis AF2122/97
cgccaccauccccggcaacaaag

SEQ ID NO: 1184331 - RNA, 22 nt, Mycobacterium bovis subsp bovis AF2122/97
cgccaccagggcggccuccccg

SEQ ID NO: 1184332 - RNA, 13 nt, Mycobacterium bovis subsp bovis AF2122/97
cgccaccaucccc

SEQ ID NO: 1184333 - RNA, 13 nt, Mycobacterium bovis subsp bovis AF2122/97
cgccaccacgccg

SEQ ID NO: 1184334 - RNA, 23 nt, Mycobacterium bovis subsp bovis AF2122/97
cgcauccgguuuggucgccgcgu

SEQ ID NO: 1184335 - RNA, 21 nt, Mycobacterium bovis subsp bovis AF2122/97
cgcaucccgaaguagaagccc

SEQ ID NO: 1184336 - RNA, 13 nt, Mycobacterium bovis subsp bovis AF2122/97
cgcauaaccggcg

SEQ ID NO: 1184337 - RNA, 19 nt, Mycobacterium bovis subsp bovis AF2122/97
cgcauaacgcgaacccgcg

SEQ ID NO: 1184338 - RNA, 18 nt, Mycobacterium bovis subsp bovis AF2122/97
cgccacuagcccugagcg

SEQ ID NO: 1184339 - RNA, 12 nt, Mycobacterium bovis subsp bovis AF2122/97
cgccacugcugg

SEQ ID NO: 1184340 - RNA, 13 nt, Mycobacterium bovis subsp bovis AF2122/97
cgccacuggcgcu

SEQ ID NO: 1184341 - RNA, 20 nt, Mycobacterium bovis subsp bovis AF2122/97
cgccacguacuccaccgcgc

SEQ ID NO: 1184342 - RNA, 17 nt, Mycobacterium bovis subsp bovis AF2122/97
cgccacgguucgggcag

SEQ ID NO: 1184343 - RNA, 15 nt, Mycobacterium bovis subsp bovis AF2122/97
cgccacgguuggucc

SEQ ID NO: 1184344 - RNA, 15 nt, Mycobacterium bovis subsp bovis AF2122/97
cgccacucagcccga

SEQ ID NO: 1184345 - RNA, 18 nt, Mycobacterium bovis subsp bovis AF2122/97
cgccacgggcggccaccg

SEQ ID NO: 1184346 - RNA, 20 nt, Mycobacterium bovis subsp bovis AF2122/97
cgccacggucgccgaccacu

SEQ ID NO: 1184347 - RNA, 20 nt, Mycobacterium bovis subsp bovis AF2122/97
cgccacgacgcccaccguug

SEQ ID NO: 1184348 - RNA, 19 nt, Mycobacterium bovis subsp bovis AF2122/97
cgccacgagcaacgggcga

SEQ ID NO: 1184349 - RNA, 13 nt, Mycobacterium bovis subsp bovis AF2122/97
cgccacgggcggc

SEQ ID NO: 1184350 - RNA, 14 nt, Mycobacterium bovis subsp bovis AF2122/97
cgccaccucgccgg

SEQ ID NO: 1184351 - RNA, 17 nt, Mycobacterium bovis subsp bovis AF2122/97
cgccaccucccacgccg

SEQ ID NO: 1184352 - RNA, 17 nt, Mycobacterium bovis subsp bovis AF2122/97
cgccacccagcaccagg

SEQ ID NO: 1184353 - RNA, 18 nt, Mycobacterium bovis subsp bovis AF2122/97
cgccaccucccagggcuc

SEQ ID NO: 1184354 - RNA, 20 nt, Mycobacterium bovis subsp bovis AF2122/97
cgccaccugacgugcggcgc

SEQ ID NO: 1184355 - RNA, 24 nt, Mycobacterium bovis subsp bovis AF2122/97
cgaucacggcgggaugcagcugcc

SEQ ID NO: 1184356 - RNA, 20 nt, Mycobacterium bovis subsp bovis AF2122/97
cgaucacuagcgccccuggc

SEQ ID NO: 1184357 - RNA, 11 nt, Mycobacterium bovis subsp bovis AF2122/97
cgaucaaugcg

SEQ ID NO: 1184358 - RNA, 22 nt, Mycobacterium bovis subsp bovis AF2122/97
cgaucaccaccggaucgcuccc

SEQ ID NO: 1184359 - RNA, 14 nt, Mycobacterium bovis subsp bovis AF2122/97
cgaucaccccgcca

SEQ ID NO: 1184360 - RNA, 17 nt, Mycobacterium bovis subsp bovis AF2122/97
cgaucacccacauggug

SEQ ID NO: 1184361 - RNA, 14 nt, Mycobacterium bovis subsp bovis AF2122/97
cgaucacccccugg

SEQ ID NO: 1184362 - RNA, 13 nt, Mycobacterium bovis subsp bovis AF2122/97
cgacgucagggua

SEQ ID NO: 1184363 - RNA, 20 nt, Mycobacterium bovis subsp bovis AF2122/97
cgacguaguggaagccgacc

SEQ ID NO: 1184364 - RNA, 21 nt, Mycobacterium bovis subsp bovis AF2122/97
cgacguauaccgcacccuggg

SEQ ID NO: 1184365 - RNA, 18 nt, Mycobacterium bovis subsp bovis AF2122/97
cgacguauuggcgcagca

SEQ ID NO: 1184366 - RNA, 19 nt, Mycobacterium bovis subsp bovis AF2122/97
cgacguauuggcgcagcau

SEQ ID NO: 1184367 - RNA, 16 nt, Mycobacterium bovis subsp bovis AF2122/97
cgacgucaaacgcaaa

SEQ ID NO: 1184368 - RNA, 17 nt, Mycobacterium bovis subsp bovis AF2122/97
cgacgucaucgccgacc

SEQ ID NO: 1184369 - RNA, 22 nt, Mycobacterium bovis subsp bovis AF2122/97
cgacguccaguccaugugccca

SEQ ID NO: 1184370 - RNA, 24 nt, Mycobacterium bovis subsp bovis AF2122/97
cgacguccucgacgaucagcacgu

SEQ ID NO: 1184371 - RNA, 19 nt, Mycobacterium bovis subsp bovis AF2122/97
cgauccccacaaucagccc

SEQ ID NO: 1184372 - RNA, 19 nt, Mycobacterium bovis subsp bovis AF2122/97
cgauccccagcaccacggu

SEQ ID NO: 1184373 - RNA, 18 nt, Mycobacterium bovis subsp bovis AF2122/97
cgaucccaacgcccgggc

SEQ ID NO: 1184374 - RNA, 17 nt, Mycobacterium bovis subsp bovis AF2122/97
cgaucccggcaacaacg

SEQ ID NO: 1184375 - RNA, 14 nt, Mycobacterium bovis subsp bovis AF2122/97
cgaucccggccagc

SEQ ID NO: 1184376 - RNA, 14 nt, Mycobacterium bovis subsp bovis AF2122/97
cgauccgcgcgcau

SEQ ID NO: 1184377 - RNA, 19 nt, Mycobacterium bovis subsp bovis AF2122/97
cgauccgcaacaacgccgc

SEQ ID NO: 1184378 - RNA, 16 nt, Mycobacterium bovis subsp bovis AF2122/97
cgauccgcacagcaac

SEQ ID NO: 1184379 - RNA, 19 nt, Mycobacterium bovis subsp bovis AF2122/97
cgauccgcugcgccgaggc

SEQ ID NO: 1184380 - RNA, 20 nt, Mycobacterium bovis subsp bovis AF2122/97
cgauccgcggcguuccccga

SEQ ID NO: 1184381 - RNA, 18 nt, Mycobacterium bovis subsp bovis AF2122/97
cgauccggaucccaccac

SEQ ID NO: 1184382 - RNA, 20 nt, Mycobacterium bovis subsp bovis AF2122/97
cgauccggaucccaccaccg

SEQ ID NO: 1184383 - RNA, 16 nt, Mycobacterium bovis subsp bovis AF2122/97
cgaucgacugcagccc

SEQ ID NO: 1184384 - RNA, 13 nt, Mycobacterium bovis subsp bovis AF2122/97
cgaucgagcagga

SEQ ID NO: 1184385 - RNA, 16 nt, Mycobacterium bovis subsp bovis AF2122/97
cgaucgccaacgacuc

SEQ ID NO: 1184386 - RNA, 15 nt, Mycobacterium bovis subsp bovis AF2122/97
cgauccugaccagcc

SEQ ID NO: 1184387 - RNA, 15 nt, Mycobacterium bovis subsp bovis AF2122/97
cgauccugcccacca

SEQ ID NO: 1184388 - RNA, 17 nt, Mycobacterium bovis subsp bovis AF2122/97
cgauccugcccaccauc

SEQ ID NO: 1184389 - RNA, 21 nt, Mycobacterium bovis subsp bovis AF2122/97
cgauccugcccaccaucccgc

SEQ ID NO: 1184390 - RNA, 16 nt, Mycobacterium bovis subsp bovis AF2122/97
cgaucgacacccgcuc

SEQ ID NO: 1184391 - RNA, 17 nt, Mycobacterium bovis subsp bovis AF2122/97
cgaucgacucacacacc

SEQ ID NO: 1184392 - RNA, 14 nt, Mycobacterium bovis subsp bovis AF2122/97
cgaucgcgccaggc

SEQ ID NO: 1184393 - RNA, 15 nt, Mycobacterium bovis subsp bovis AF2122/97
cgaucgccggccgcg

SEQ ID NO: 1184394 - RNA, 15 nt, Mycobacterium bovis subsp bovis AF2122/97
cgaucgccaggccga

SEQ ID NO: 1184395 - RNA, 14 nt, Mycobacterium bovis subsp bovis AF2122/97
cgaucgccgcgcug

SEQ ID NO: 1184396 - RNA, 14 nt, Mycobacterium bovis subsp bovis AF2122/97
cgaucgccggccgc

SEQ ID NO: 1184397 - RNA, 14 nt, Mycobacterium bovis subsp bovis AF2122/97
cgaucgcggcccgg

SEQ ID NO: 1184398 - RNA, 22 nt, Mycobacterium bovis subsp bovis AF2122/97
cgaucgcggcgagcaccacccc

SEQ ID NO: 1184399 - RNA, 22 nt, Mycobacterium bovis subsp bovis AF2122/97
cgaucgcggcggccuccaccac

SEQ ID NO: 1184400 - RNA, 21 nt, Mycobacterium bovis subsp bovis AF2122/97
cgaucgcguccgcgcucaacc

SEQ ID NO: 1184401 - RNA, 16 nt, Mycobacterium bovis subsp bovis AF2122/97
cgaucgcguucugcac

SEQ ID NO: 1184402 - RNA, 18 nt, Mycobacterium bovis subsp bovis AF2122/97
cgaucgcguucugcacca

SEQ ID NO: 1184403 - RNA, 12 nt, Mycobacterium bovis subsp bovis AF2122/97
cgaucaggcugc

SEQ ID NO: 1184404 - RNA, 14 nt, Mycobacterium bovis subsp bovis AF2122/97
cgaucaggcugccg

SEQ ID NO: 1184405 - RNA, 19 nt, Mycobacterium bovis subsp bovis AF2122/97
cgaucaguucguggcuggc

SEQ ID NO: 1184406 - RNA, 17 nt, Mycobacterium bovis subsp bovis AF2122/97
cgaucaucaggugcgcc

SEQ ID NO: 1184407 - RNA, 18 nt, Mycobacterium bovis subsp bovis AF2122/97
cgauccacauggugacca

SEQ ID NO: 1184408 - RNA, 20 nt, Mycobacterium bovis subsp bovis AF2122/97
cgauccacggcgaugcagcc

SEQ ID NO: 1184409 - RNA, 22 nt, Mycobacterium bovis subsp bovis AF2122/97
cgauccagcaggccgucgauca

SEQ ID NO: 1184410 - RNA, 23 nt, Mycobacterium bovis subsp bovis AF2122/97
cgauccagcccaacucggccagc

SEQ ID NO: 1184411 - RNA, 18 nt, Mycobacterium bovis subsp bovis AF2122/97
cgaucagcggcagcaccg

SEQ ID NO: 1184412 - RNA, 13 nt, Mycobacterium bovis subsp bovis AF2122/97
cgaucagcugggc

SEQ ID NO: 1184413 - RNA, 21 nt, Mycobacterium bovis subsp bovis AF2122/97
cgaucagcuugggcagcagcg

SEQ ID NO: 1184414 - RNA, 16 nt, Mycobacterium bovis subsp bovis AF2122/97
cgaucagguacgccag

SEQ ID NO: 1184415 - RNA, 15 nt, Mycobacterium bovis subsp bovis AF2122/97
cgaucagguacuccc

SEQ ID NO: 1184416 - RNA, 15 nt, Mycobacterium bovis subsp bovis AF2122/97
cgaucaggccgucgc

SEQ ID NO: 1184417 - RNA, 20 nt, Mycobacterium bovis subsp bovis AF2122/97
cgaucagcgcgcacacggcu

SEQ ID NO: 1184418 - RNA, 12 nt, Mycobacterium bovis subsp bovis AF2122/97
cgaucagcgccg

SEQ ID NO: 1184419 - RNA, 13 nt, Mycobacterium bovis subsp bovis AF2122/97
cgaucagcagccg

SEQ ID NO: 1184420 - RNA, 21 nt, Mycobacterium bovis subsp bovis AF2122/97
cgaucagcaccgacggcgcau

SEQ ID NO: 1184421 - RNA, 17 nt, Mycobacterium bovis subsp bovis AF2122/97
cgaugaggcgcagcgcc

SEQ ID NO: 1184422 - RNA, 13 nt, Mycobacterium bovis subsp bovis AF2122/97
cgaugagcgugcc

SEQ ID NO: 1184423 - RNA, 21 nt, Mycobacterium bovis subsp bovis AF2122/97
cgaugagggugcucgucacca

SEQ ID NO: 1184424 - RNA, 19 nt, Mycobacterium bovis subsp bovis AF2122/97
cgaugagguggccgcgcag

SEQ ID NO: 1184425 - RNA, 13 nt, Mycobacterium bovis subsp bovis AF2122/97
cgaugcacaaccg

SEQ ID NO: 1184426 - RNA, 14 nt, Mycobacterium bovis subsp bovis AF2122/97
cgaugcacaaccgc

SEQ ID NO: 1184427 - RNA, 11 nt, Mycobacterium bovis subsp bovis AF2122/97
cgaugccaaug

SEQ ID NO: 1184428 - RNA, 17 nt, Mycobacterium bovis subsp bovis AF2122/97
cgaugccacccaacagc

SEQ ID NO: 1184429 - RNA, 17 nt, Mycobacterium bovis subsp bovis AF2122/97
cgaugagcaugcccagc

SEQ ID NO: 1184430 - RNA, 18 nt, Mycobacterium bovis subsp bovis AF2122/97
cgaugacgacgccgucgg

SEQ ID NO: 1184431 - RNA, 21 nt, Mycobacterium bovis subsp bovis AF2122/97
cgaugagcgguaccccccagc

SEQ ID NO: 1184432 - RNA, 20 nt, Mycobacterium bovis subsp bovis AF2122/97
cgaugaccuugggaccaccg

SEQ ID NO: 1184433 - RNA, 12 nt, Mycobacterium bovis subsp bovis AF2122/97
cgaugaccgcac

SEQ ID NO: 1184434 - RNA, 16 nt, Mycobacterium bovis subsp bovis AF2122/97
cgaugacaggcuuggc

SEQ ID NO: 1184435 - RNA, 16 nt, Mycobacterium bovis subsp bovis AF2122/97
cgaugaauuucauaaa

SEQ ID NO: 1184436 - RNA, 17 nt, Mycobacterium bovis subsp bovis AF2122/97
cgaucuugguggccuca

SEQ ID NO: 1184437 - RNA, 16 nt, Mycobacterium bovis subsp bovis AF2122/97
cgaucuuggccaccgc

SEQ ID NO: 1184438 - RNA, 17 nt, Mycobacterium bovis subsp bovis AF2122/97
cgaucggcacuuagccc

SEQ ID NO: 1184439 - RNA, 15 nt, Mycobacterium bovis subsp bovis AF2122/97
cgaucgcgccgucgg

SEQ ID NO: 1184440 - RNA, 16 nt, Mycobacterium bovis subsp bovis AF2122/97
cgaucggcgcgccgau

SEQ ID NO: 1184441 - RNA, 18 nt, Mycobacterium bovis subsp bovis AF2122/97
cgaucggugacgcgccgu

SEQ ID NO: 1184442 - RNA, 21 nt, Mycobacterium bovis subsp bovis AF2122/97
cgaucggugccgaagcugccc

SEQ ID NO: 1184443 - RNA, 20 nt, Mycobacterium bovis subsp bovis AF2122/97
cgaucggugcgggcgccgcu

SEQ ID NO: 1184444 - RNA, 17 nt, Mycobacterium bovis subsp bovis AF2122/97
cgaucgggcccagcagc

SEQ ID NO: 1184445 - RNA, 19 nt, Mycobacterium bovis subsp bovis AF2122/97
cgaucguuucagcuagacc

SEQ ID NO: 1184446 - RNA, 20 nt, Mycobacterium bovis subsp bovis AF2122/97
cgaucgugagacgccgucga

SEQ ID NO: 1184447 - RNA, 22 nt, Mycobacterium bovis subsp bovis AF2122/97
cgaucgucgagccgaucgcccg

SEQ ID NO: 1184448 - RNA, 21 nt, Mycobacterium bovis subsp bovis AF2122/97
cgaucggugcgggcgccgcua

SEQ ID NO: 1184449 - RNA, 17 nt, Mycobacterium bovis subsp bovis AF2122/97
cgaucucggcggccgcg

SEQ ID NO: 1184450 - RNA, 19 nt, Mycobacterium bovis subsp bovis AF2122/97
cgaucucguggaucugccu

SEQ ID NO: 1184451 - RNA, 19 nt, Mycobacterium bovis subsp bovis AF2122/97
cgaucuccuccaccagugc

SEQ ID NO: 1184452 - RNA, 21 nt, Mycobacterium bovis subsp bovis AF2122/97
cgaucuggcguagugcucgcc

SEQ ID NO: 1184453 - RNA, 22 nt, Mycobacterium bovis subsp bovis AF2122/97
cgaucugcccggugauccacgc

SEQ ID NO: 1184454 - RNA, 23 nt, Mycobacterium bovis subsp bovis AF2122/97
cgaucugcgcgucaggccagcgc

SEQ ID NO: 1184455 - RNA, 14 nt, Mycobacterium bovis subsp bovis AF2122/97
cgaucugcuaccag

SEQ ID NO: 1184456 - RNA, 13 nt, Mycobacterium bovis subsp bovis AF2122/97
cgaucugcagcgc

SEQ ID NO: 1184457 - RNA, 14 nt, Mycobacterium bovis subsp bovis AF2122/97
cgaucugcagcgcg

SEQ ID NO: 1184458 - RNA, 16 nt, Mycobacterium bovis subsp bovis AF2122/97
cgaucugcccccgccg

SEQ ID NO: 1184459 - RNA, 13 nt, Mycobacterium bovis subsp bovis AF2122/97
cgaucugcccggu

SEQ ID NO: 1184460 - RNA, 15 nt, Mycobacterium bovis subsp bovis AF2122/97
cgaucugcugugucg

SEQ ID NO: 1184461 - RNA, 21 nt, Mycobacterium bovis subsp bovis AF2122/97
cgaucugggcuuucagcaccg

SEQ ID NO: 1184462 - RNA, 18 nt, Mycobacterium bovis subsp bovis AF2122/97
cgaugguguacugcugcu

SEQ ID NO: 1184463 - RNA, 18 nt, Mycobacterium bovis subsp bovis AF2122/97
cgauguacagcgggaucc

SEQ ID NO: 1184464 - RNA, 16 nt, Mycobacterium bovis subsp bovis AF2122/97
cgauguauccgaugcg

SEQ ID NO: 1184465 - RNA, 23 nt, Mycobacterium bovis subsp bovis AF2122/97
cgauguacagcgggaucccgauc

SEQ ID NO: 1184466 - RNA, 14 nt, Mycobacterium bovis subsp bovis AF2122/97
cgauggugccgacc

SEQ ID NO: 1184467 - RNA, 15 nt, Mycobacterium bovis subsp bovis AF2122/97
cgauggcaccacuac

SEQ ID NO: 1184468 - RNA, 19 nt, Mycobacterium bovis subsp bovis AF2122/97
cgauggccaucaucgacgg

SEQ ID NO: 1184469 - RNA, 21 nt, Mycobacterium bovis subsp bovis AF2122/97
cgauggcaugggcuaccgaga

SEQ ID NO: 1184470 - RNA, 12 nt, Mycobacterium bovis subsp bovis AF2122/97
cgaugcccagga

SEQ ID NO: 1184471 - RNA, 22 nt, Mycobacterium bovis subsp bovis AF2122/97
cgaugcagccacauacaggccc

SEQ ID NO: 1184472 - RNA, 16 nt, Mycobacterium bovis subsp bovis AF2122/97
cgaugccagugcaucg

SEQ ID NO: 1184473 - RNA, 20 nt, Mycobacterium bovis subsp bovis AF2122/97
cgaugcccuggcccaucuug

SEQ ID NO: 1184474 - RNA, 17 nt, Mycobacterium bovis subsp bovis AF2122/97
cgaugccgccggcgggc

SEQ ID NO: 1184475 - RNA, 15 nt, Mycobacterium bovis subsp bovis AF2122/97
cgauucggccagcgc

SEQ ID NO: 1184476 - RNA, 17 nt, Mycobacterium bovis subsp bovis AF2122/97
cgauugucgccgcgcuc

SEQ ID NO: 1184477 - RNA, 17 nt, Mycobacterium bovis subsp bovis AF2122/97
cgauuguggccagcgcu

SEQ ID NO: 1184478 - RNA, 21 nt, Mycobacterium bovis subsp bovis AF2122/97
cgaugucagugaucaccaacc

SEQ ID NO: 1184479 - RNA, 15 nt, Mycobacterium bovis subsp bovis AF2122/97
cgauguccccggcgg

SEQ ID NO: 1184480 - RNA, 20 nt, Mycobacterium bovis subsp bovis AF2122/97
cgauuaucgcgcgcaaccgc

SEQ ID NO: 1184481 - RNA, 16 nt, Mycobacterium bovis subsp bovis AF2122/97
cgcaccgagcgagacc

SEQ ID NO: 1184482 - RNA, 17 nt, Mycobacterium bovis subsp bovis AF2122/97
cgcaccgaggccgccga

SEQ ID NO: 1184483 - RNA, 15 nt, Mycobacterium bovis subsp bovis AF2122/97
cgcaccgccacccug

SEQ ID NO: 1184484 - RNA, 16 nt, Mycobacterium bovis subsp bovis AF2122/97
cgcacccguccgccgc

SEQ ID NO: 1184485 - RNA, 22 nt, Mycobacterium bovis subsp bovis AF2122/97
cgcacccguccggccgggcccu

SEQ ID NO: 1184486 - RNA, 17 nt, Mycobacterium bovis subsp bovis AF2122/97
cgcacccguucgugagc

SEQ ID NO: 1184487 - RNA, 22 nt, Mycobacterium bovis subsp bovis AF2122/97
cgcaccgccgcgcgacaggccc

SEQ ID NO: 1184488 - RNA, 19 nt, Mycobacterium bovis subsp bovis AF2122/97
cgcaccggaucggcuaccu

SEQ ID NO: 1184489 - RNA, 13 nt, Mycobacterium bovis subsp bovis AF2122/97
cgcaccgcugacc

SEQ ID NO: 1184490 - RNA, 21 nt, Mycobacterium bovis subsp bovis AF2122/97
cgcaccgcugaccccggcagc

SEQ ID NO: 1184491 - RNA, 15 nt, Mycobacterium bovis subsp bovis AF2122/97
cgcacgguucgggug

SEQ ID NO: 1184492 - RNA, 22 nt, Mycobacterium bovis subsp bovis AF2122/97
cgcaccguggcggaucgcgagc

SEQ ID NO: 1184493 - RNA, 23 nt, Mycobacterium bovis subsp bovis AF2122/97
cgcacggccgggucgaacaggcc

SEQ ID NO: 1184494 - RNA, 19 nt, Mycobacterium bovis subsp bovis AF2122/97
cgcacggcgucggccaccg

SEQ ID NO: 1184495 - RNA, 22 nt, Mycobacterium bovis subsp bovis AF2122/97
cgcacgggaucgaucugcggag

SEQ ID NO: 1184496 - RNA, 14 nt, Mycobacterium bovis subsp bovis AF2122/97
cgcacgggccacca

SEQ ID NO: 1184497 - RNA, 22 nt, Mycobacterium bovis subsp bovis AF2122/97
cgcaccggcuggcccagcgacc

SEQ ID NO: 1184498 - RNA, 19 nt, Mycobacterium bovis subsp bovis AF2122/97
cgcacggaccaucgccagg

SEQ ID NO: 1184499 - RNA, 21 nt, Mycobacterium bovis subsp bovis AF2122/97
cgcacgcugcucgacggucag

SEQ ID NO: 1184500 - RNA, 18 nt, Mycobacterium bovis subsp bovis AF2122/97
cgcacgcuggcgggcacu

SEQ ID NO: 1184501 - RNA, 19 nt, Mycobacterium bovis subsp bovis AF2122/97
cgcacgcucggcggggacc

SEQ ID NO: 1184502 - RNA, 22 nt, Mycobacterium bovis subsp bovis AF2122/97
cgcacugaugucacccgcccga

SEQ ID NO: 1184503 - RNA, 17 nt, Mycobacterium bovis subsp bovis AF2122/97
cgcacugaggcucaggu

SEQ ID NO: 1184504 - RNA, 13 nt, Mycobacterium bovis subsp bovis AF2122/97
cgcacugccccgc
